United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 47

SEQ ID NO: 2105496 - RNA, 16 nt, Human
acgaguaauuuauugu

SEQ ID NO: 2105497 - RNA, 17 nt, Human
acgagucaauccccuca

SEQ ID NO: 2105498 - RNA, 18 nt, Human
acgccaggggaaaaucag

SEQ ID NO: 2105499 - RNA, 14 nt, Human
acgagguaugaggu

SEQ ID NO: 2105500 - RNA, 20 nt, Human
acgaggucaagagaucgaga

SEQ ID NO: 2105501 - RNA, 23 nt, Human
acgccaggggaaaaucagccugc

SEQ ID NO: 2105502 - RNA, 19 nt, Human
uccaggcugcauagaagga

SEQ ID NO: 2105503 - RNA, 23 nt, Human
uccagggaagcuggccgaggguc

SEQ ID NO: 2105504 - RNA, 12 nt, Human
uccacgcugucu

SEQ ID NO: 2105505 - RNA, 15 nt, Human
uccacgcugucucca

SEQ ID NO: 2105506 - RNA, 16 nt, Human
uccacgcugucuccag

SEQ ID NO: 2105507 - RNA, 17 nt, Human
uccacgcugucuccaga

SEQ ID NO: 2105508 - RNA, 18 nt, Human
uccacgcugucuccagac

SEQ ID NO: 2105509 - RNA, 19 nt, Human
uccacgcugucuccagacc

SEQ ID NO: 2105510 - RNA, 20 nt, Human
uccacgcugucuccagaccc

SEQ ID NO: 2105511 - RNA, 21 nt, Human
uccacgcugucuccagacccc

SEQ ID NO: 2105512 - RNA, 22 nt, Human
uccacgcugucuccagaccccc

SEQ ID NO: 2105513 - RNA, 23 nt, Human
uccacgcugucuccagaccccca

SEQ ID NO: 2105514 - RNA, 13 nt, Human
uccacggacucaa

SEQ ID NO: 2105515 - RNA, 21 nt, Human
uccacggacucaaguuucuuc

SEQ ID NO: 2105516 - RNA, 12 nt, Human
acgacaaagcug

SEQ ID NO: 2105517 - RNA, 15 nt, Human
acgacaaagcugcua

SEQ ID NO: 2105518 - RNA, 21 nt, Human
acgacaaagcugcuaaaucuc

SEQ ID NO: 2105519 - RNA, 23 nt, Human
acgacaaagcugcuaaaucuccu

SEQ ID NO: 2105520 - RNA, 20 nt, Human
acgacaacgaugaugcuugu

SEQ ID NO: 2105521 - RNA, 16 nt, Human
acgaagggggcaucug

SEQ ID NO: 2105522 - RNA, 11 nt, Human
acgaagaaaaa

SEQ ID NO: 2105523 - RNA, 12 nt, Human
acgaagaaaaaa

SEQ ID NO: 2105524 - RNA, 17 nt, Human
acgaagggaaaugucuu

SEQ ID NO: 2105525 - RNA, 17 nt, Human
uccagggccacgugcca

SEQ ID NO: 2105526 - RNA, 20 nt, Human
uccagggaugccaucugugg

SEQ ID NO: 2105527 - RNA, 20 nt, Human
acgcgugcacacaccagagc

SEQ ID NO: 2105528 - RNA, 23 nt, Human
acgcgugcacacaccagagccca

SEQ ID NO: 2105529 - RNA, 14 nt, Human
acgcccauguguga

SEQ ID NO: 2105530 - RNA, 16 nt, Human
acgcccaugugugagu

SEQ ID NO: 2105531 - RNA, 21 nt, Human
acggagucccaccuuggcugc

SEQ ID NO: 2105532 - RNA, 13 nt, Human
acggcacccaccc

SEQ ID NO: 2105533 - RNA, 16 nt, Human
acggccaggccagagg

SEQ ID NO: 2105534 - RNA, 21 nt, Human
acggcaggacaacgaggaagc

SEQ ID NO: 2105535 - RNA, 13 nt, Human
acggccaggccag

SEQ ID NO: 2105536 - RNA, 14 nt, Human
acggcacuguggcc

SEQ ID NO: 2105537 - RNA, 15 nt, Human
acggcacuguggccu

SEQ ID NO: 2105538 - RNA, 16 nt, Human
acggcacuguggccuu

SEQ ID NO: 2105539 - RNA, 22 nt, Human
acggcaggacaacgaggaagcc

SEQ ID NO: 2105540 - RNA, 19 nt, Human
acggagucccaccuuggcu

SEQ ID NO: 2105541 - RNA, 18 nt, Human
accuucaauuccugggcc

SEQ ID NO: 2105542 - RNA, 15 nt, Human
accuucagauccuac

SEQ ID NO: 2105543 - RNA, 16 nt, Human
accuucagauccuacc

SEQ ID NO: 2105544 - RNA, 17 nt, Human
accuucagauccuaccc

SEQ ID NO: 2105545 - RNA, 18 nt, Human
accuucagauccuacccc

SEQ ID NO: 2105546 - RNA, 13 nt, Human
accuggggagugg

SEQ ID NO: 2105547 - RNA, 15 nt, Human
accuggggaguggga

SEQ ID NO: 2105548 - RNA, 19 nt, Human
accuggggcagucaccugc

SEQ ID NO: 2105549 - RNA, 24 nt, Human
accuggggagugggacagagucug

SEQ ID NO: 2105550 - RNA, 21 nt, Human
accuggguaacuagggaagau

SEQ ID NO: 2105551 - RNA, 18 nt, Human
accuggggugugggaggc

SEQ ID NO: 2105552 - RNA, 21 nt, Human
accuggggugugggaggcccg

SEQ ID NO: 2105553 - RNA, 17 nt, Human
accuucaauuccugggc

SEQ ID NO: 2105554 - RNA, 13 nt, Human
accuuccugucuu

SEQ ID NO: 2105555 - RNA, 17 nt, Human
accuucccaugcccugg

SEQ ID NO: 2105556 - RNA, 17 nt, Human
accuucccagcucuccc

SEQ ID NO: 2105557 - RNA, 18 nt, Human
accuucccagcucucccu

SEQ ID NO: 2105558 - RNA, 19 nt, Human
accuucccagcucucccuc

SEQ ID NO: 2105559 - RNA, 23 nt, Human
accuucugcccauccugucuguu

SEQ ID NO: 2105560 - RNA, 17 nt, Human
accuugcaacacacaga

SEQ ID NO: 2105561 - RNA, 19 nt, Human
accuugcaacacacagaca

SEQ ID NO: 2105562 - RNA, 16 nt, Human
accuugacagggcaca

SEQ ID NO: 2105563 - RNA, 17 nt, Human
accuugacuugauuagu

SEQ ID NO: 2105564 - RNA, 22 nt, Human
accuugaggucuuuugacaugu

SEQ ID NO: 2105565 - RNA, 15 nt, Human
accuugcaacacaca

SEQ ID NO: 2105566 - RNA, 16 nt, Human
accuugcaacacacag

SEQ ID NO: 2105567 - RNA, 11 nt, Human
accuugagguc

SEQ ID NO: 2105568 - RNA, 21 nt, Human
uccaaugucuuuuuaagcuua

SEQ ID NO: 2105569 - RNA, 16 nt, Human
uccacauagguuuaga

SEQ ID NO: 2105570 - RNA, 13 nt, Human
uccaaauucacaa

SEQ ID NO: 2105571 - RNA, 17 nt, Human
uccaaauguccuccaga

SEQ ID NO: 2105572 - RNA, 19 nt, Human
uccaaauguccuccagaag

SEQ ID NO: 2105573 - RNA, 20 nt, Human
uccaaauguccuccagaagc

SEQ ID NO: 2105574 - RNA, 22 nt, Human
uccaaauguccuccagaagccu

SEQ ID NO: 2105575 - RNA, 15 nt, Human
uccaaggagaaacag

SEQ ID NO: 2105576 - RNA, 16 nt, Human
uccaaggagaaacaga

SEQ ID NO: 2105577 - RNA, 19 nt, Human
uccaaggagaaacagagac

SEQ ID NO: 2105578 - RNA, 20 nt, Human
uccaaggagaaacagagaca

SEQ ID NO: 2105579 - RNA, 22 nt, Human
uccaaggagaaacagagacagg

SEQ ID NO: 2105580 - RNA, 15 nt, Human
uccaaggagcugaga

SEQ ID NO: 2105581 - RNA, 19 nt, Human
uccaaggagcugagaauag

SEQ ID NO: 2105582 - RNA, 21 nt, Human
uccaaggagcugagaauagaa

SEQ ID NO: 2105583 - RNA, 23 nt, Human
uccaaggagcugagaauagaagg

SEQ ID NO: 2105584 - RNA, 23 nt, Human
uccaaggagaaacagagacaggc

SEQ ID NO: 2105585 - RNA, 20 nt, Human
uccacccaggagccccgagg

SEQ ID NO: 2105586 - RNA, 24 nt, Human
uccaccauggcuaaggcaccagcc

SEQ ID NO: 2105587 - RNA, 12 nt, Human
uccaccccacuc

SEQ ID NO: 2105588 - RNA, 20 nt, Human
uccaccccagugcacccacu

SEQ ID NO: 2105589 - RNA, 23 nt, Human
uccaccccagugcacccacucug

SEQ ID NO: 2105590 - RNA, 18 nt, Human
uccacauccggaggagaa

SEQ ID NO: 2105591 - RNA, 17 nt, Human
uccacccaggagccccg

SEQ ID NO: 2105592 - RNA, 13 nt, Human
uccacccaccuca

SEQ ID NO: 2105593 - RNA, 12 nt, Human
uccacccaccuc

SEQ ID NO: 2105594 - RNA, 12 nt, Human
accuggcccugg

SEQ ID NO: 2105595 - RNA, 13 nt, Human
accuggcccuggg

SEQ ID NO: 2105596 - RNA, 15 nt, Human
accuggcccuggggc

SEQ ID NO: 2105597 - RNA, 16 nt, Human
accuggcccuggggcc

SEQ ID NO: 2105598 - RNA, 17 nt, Human
accuggcccuggggccu

SEQ ID NO: 2105599 - RNA, 18 nt, Human
accuggcccuggggccug

SEQ ID NO: 2105600 - RNA, 19 nt, Human
accuggcccuggggccugu

SEQ ID NO: 2105601 - RNA, 21 nt, Human
accuggcccuggggccuguac

SEQ ID NO: 2105602 - RNA, 23 nt, Human
accuggccccaugucucucagaa

SEQ ID NO: 2105603 - RNA, 21 nt, Human
accuggccccaugucucucag

SEQ ID NO: 2105604 - RNA, 14 nt, Human
accugggcaccugg

SEQ ID NO: 2105605 - RNA, 18 nt, Human
accugggcaccuggggag

SEQ ID NO: 2105606 - RNA, 19 nt, Human
accugggcaccuggggagu

SEQ ID NO: 2105607 - RNA, 13 nt, Human
accugggcaccug

SEQ ID NO: 2105608 - RNA, 12 nt, Human
accugcucuccu

SEQ ID NO: 2105609 - RNA, 18 nt, Human
accugcugagggaccagc

SEQ ID NO: 2105610 - RNA, 13 nt, Human
accugcuggcccc

SEQ ID NO: 2105611 - RNA, 19 nt, Human
accugcugagggaccagcc

SEQ ID NO: 2105612 - RNA, 20 nt, Human
accugcugagggaccagcca

SEQ ID NO: 2105613 - RNA, 23 nt, Human
accugcugagggaccagccaaga

SEQ ID NO: 2105614 - RNA, 15 nt, Human
accugaucccacucc

SEQ ID NO: 2105615 - RNA, 13 nt, Human
accugcugaugug

SEQ ID NO: 2105616 - RNA, 14 nt, Human
accugcuggccccu

SEQ ID NO: 2105617 - RNA, 15 nt, Human
accugcuggccccuc

SEQ ID NO: 2105618 - RNA, 16 nt, Human
accugcuggccccuca

SEQ ID NO: 2105619 - RNA, 17 nt, Human
accugcuggccccucac

SEQ ID NO: 2105620 - RNA, 19 nt, Human
accugcuggccccucaccu

SEQ ID NO: 2105621 - RNA, 21 nt, Human
accugcuggccccucaccugg

SEQ ID NO: 2105622 - RNA, 21 nt, Human
accugcgucucauacucaccu

SEQ ID NO: 2105623 - RNA, 17 nt, Human
ucauuuugcuucauagc

SEQ ID NO: 2105624 - RNA, 19 nt, Human
ucauuuuuaguagagacag

SEQ ID NO: 2105625 - RNA, 14 nt, Human
ucauuuuugaauac

SEQ ID NO: 2105626 - RNA, 14 nt, Human
ucauuugucacaca

SEQ ID NO: 2105627 - RNA, 16 nt, Human
accuggaccaaagcug

SEQ ID NO: 2105628 - RNA, 23 nt, Human
ucauuugggguagcuagaggaac

SEQ ID NO: 2105629 - RNA, 11 nt, Human
ucauuuugaag

SEQ ID NO: 2105630 - RNA, 16 nt, Human
ucauuuugaagcuaau

SEQ ID NO: 2105631 - RNA, 17 nt, Human
ucauuuugaagcuaauu

SEQ ID NO: 2105632 - RNA, 18 nt, Human
ucauuuugaagcuaauua

SEQ ID NO: 2105633 - RNA, 15 nt, Human
ucauuuucugcauuu

SEQ ID NO: 2105634 - RNA, 16 nt, Human
ucauuugucacacacu

SEQ ID NO: 2105635 - RNA, 21 nt, Human
accugauguuaaaauuccauc

SEQ ID NO: 2105636 - RNA, 19 nt, Human
accugauguaccugaugcu

SEQ ID NO: 2105637 - RNA, 19 nt, Human
accugcaccuccccccacu

SEQ ID NO: 2105638 - RNA, 17 nt, Human
accugcaccucccccca

SEQ ID NO: 2105639 - RNA, 18 nt, Human
accugcaccuccccccac

SEQ ID NO: 2105640 - RNA, 20 nt, Human
accugcaccuccccccacug

SEQ ID NO: 2105641 - RNA, 14 nt, Human
accugcaccucccc

SEQ ID NO: 2105642 - RNA, 15 nt, Human
accugcaccuccccc

SEQ ID NO: 2105643 - RNA, 16 nt, Human
accugcaccucccccc

SEQ ID NO: 2105644 - RNA, 18 nt, Human
accugaagacucauucuu

SEQ ID NO: 2105645 - RNA, 19 nt, Human
ucauaauaaauaucuguac

SEQ ID NO: 2105646 - RNA, 18 nt, Human
accugaacacuuauugcu

SEQ ID NO: 2105647 - RNA, 20 nt, Human
accugaacacuuauugcuuu

SEQ ID NO: 2105648 - RNA, 17 nt, Human
accugaccaacauggag

SEQ ID NO: 2105649 - RNA, 19 nt, Human
accugaccaacauggagaa

SEQ ID NO: 2105650 - RNA, 21 nt, Human
accugagcccggaugcuucuc

SEQ ID NO: 2105651 - RNA, 23 nt, Human
accugagcccggaugcuucucca

SEQ ID NO: 2105652 - RNA, 16 nt, Human
ucacagccacuuggga

SEQ ID NO: 2105653 - RNA, 15 nt, Human
ucacagagcagaguc

SEQ ID NO: 2105654 - RNA, 12 nt, Human
ucacagaggcuu

SEQ ID NO: 2105655 - RNA, 17 nt, Human
ucacagaggcuucuuca

SEQ ID NO: 2105656 - RNA, 11 nt, Human
ucacagaagaa

SEQ ID NO: 2105657 - RNA, 12 nt, Human
ucacagaagaau

SEQ ID NO: 2105658 - RNA, 14 nt, Human
ucacagacuggaga

SEQ ID NO: 2105659 - RNA, 16 nt, Human
ucacagacuggagaca

SEQ ID NO: 2105660 - RNA, 15 nt, Human
ucacagagacacagg

SEQ ID NO: 2105661 - RNA, 22 nt, Human
ucacagagacacagggcaucca

SEQ ID NO: 2105662 - RNA, 21 nt, Human
ucacagaacccuuggagccaa

SEQ ID NO: 2105663 - RNA, 19 nt, Human
ucacauuaauauuugcuga

SEQ ID NO: 2105664 - RNA, 20 nt, Human
ucacauuaauauuugcugac

SEQ ID NO: 2105665 - RNA, 17 nt, Human
ucaccagccccagugcc

SEQ ID NO: 2105666 - RNA, 15 nt, Human
ucacauuauuugcau

SEQ ID NO: 2105667 - RNA, 16 nt, Human
ucacauuauuugcaug

SEQ ID NO: 2105668 - RNA, 12 nt, Human
ucacaugcugga

SEQ ID NO: 2105669 - RNA, 13 nt, Human
ucacaugcuggac

SEQ ID NO: 2105670 - RNA, 14 nt, Human
ucacaugcuggaca

SEQ ID NO: 2105671 - RNA, 23 nt, Human
ucacaugcuggacaggucuggga

SEQ ID NO: 2105672 - RNA, 13 nt, Human
ucacaucacagga

SEQ ID NO: 2105673 - RNA, 19 nt, Human
ucacagcuucagccaggag

SEQ ID NO: 2105674 - RNA, 17 nt, Human
ucacagcuucagccagg

SEQ ID NO: 2105675 - RNA, 16 nt, Human
ucacagcuucagccag

SEQ ID NO: 2105676 - RNA, 15 nt, Human
ucacagcuucagcca

SEQ ID NO: 2105677 - RNA, 22 nt, Human
ucacagcuuauuuccucauuuu

SEQ ID NO: 2105678 - RNA, 14 nt, Human
accaaauuccuugg

SEQ ID NO: 2105679 - RNA, 13 nt, Human
accaacaagggca

SEQ ID NO: 2105680 - RNA, 16 nt, Human
accaacaagggcagug

SEQ ID NO: 2105681 - RNA, 22 nt, Human
accaacaucccauugcccuggu

SEQ ID NO: 2105682 - RNA, 15 nt, Human
accaacauggagaaa

SEQ ID NO: 2105683 - RNA, 16 nt, Human
accaacauggagaaac

SEQ ID NO: 2105684 - RNA, 23 nt, Human
accaacauggagaaacccugucu

SEQ ID NO: 2105685 - RNA, 24 nt, Human
accaacauggagaaacccugucuc

SEQ ID NO: 2105686 - RNA, 21 nt, Human
accaacaucccauugcccugg

SEQ ID NO: 2105687 - RNA, 16 nt, Human
accaacaguuccuuca

SEQ ID NO: 2105688 - RNA, 12 nt, Human
accaaaugcauc

SEQ ID NO: 2105689 - RNA, 16 nt, Human
accaaaugcaucaauc

SEQ ID NO: 2105690 - RNA, 16 nt, Human
accaaaucagcugcua

SEQ ID NO: 2105691 - RNA, 19 nt, Human
accaaaucagcugcuacua

SEQ ID NO: 2105692 - RNA, 15 nt, Human
accaacccucagagc

SEQ ID NO: 2105693 - RNA, 22 nt, Human
accaacccaucagaaggagaag

SEQ ID NO: 2105694 - RNA, 23 nt, Human
accacacccagcccacuucugcc

SEQ ID NO: 2105695 - RNA, 21 nt, Human
accacacccagcccacuucug

SEQ ID NO: 2105696 - RNA, 20 nt, Human
accacacccagcccacuucu

SEQ ID NO: 2105697 - RNA, 16 nt, Human
accacacccagcccac

SEQ ID NO: 2105698 - RNA, 15 nt, Human
accacacagccuaca

SEQ ID NO: 2105699 - RNA, 15 nt, Human
accacacccagccca

SEQ ID NO: 2105700 - RNA, 17 nt, Human
accacaaugcagugccu

SEQ ID NO: 2105701 - RNA, 17 nt, Human
accacacagaggcugcc

SEQ ID NO: 2105702 - RNA, 17 nt, Human
ucaagcaagauuucaga

SEQ ID NO: 2105703 - RNA, 14 nt, Human
ucaagcaauccucc

SEQ ID NO: 2105704 - RNA, 16 nt, Human
ucaagcaauccuccug

SEQ ID NO: 2105705 - RNA, 18 nt, Human
ucaagcaauccuccugag

SEQ ID NO: 2105706 - RNA, 19 nt, Human
ucaagcaauccuccugagu

SEQ ID NO: 2105707 - RNA, 14 nt, Human
ucaagcaccaggga

SEQ ID NO: 2105708 - RNA, 16 nt, Human
ucaagcagauuggaga

SEQ ID NO: 2105709 - RNA, 18 nt, Human
ucaagauuuugaaugcuu

SEQ ID NO: 2105710 - RNA, 19 nt, Human
ucaagauuuugaaugcuuc

SEQ ID NO: 2105711 - RNA, 13 nt, Human
ucaagauuuugaa

SEQ ID NO: 2105712 - RNA, 16 nt, Human
ucaagauuuugaaugc

SEQ ID NO: 2105713 - RNA, 17 nt, Human
ucaagcagauuggagaa

SEQ ID NO: 2105714 - RNA, 18 nt, Human
ucaaggcgugaggauggg

SEQ ID NO: 2105715 - RNA, 16 nt, Human
ucaaggugcuguuguc

SEQ ID NO: 2105716 - RNA, 21 nt, Human
ucaaggucguuuuuuucauuc

SEQ ID NO: 2105717 - RNA, 22 nt, Human
ucaaggccagcaagguggagug

SEQ ID NO: 2105718 - RNA, 15 nt, Human
ucaaggccugucccu

SEQ ID NO: 2105719 - RNA, 18 nt, Human
ucaaggccugucccuggc

SEQ ID NO: 2105720 - RNA, 12 nt, Human
ucaagaggcuga

SEQ ID NO: 2105721 - RNA, 14 nt, Human
acauuauuugcaug

SEQ ID NO: 2105722 - RNA, 13 nt, Human
acauuauuugcau

SEQ ID NO: 2105723 - RNA, 18 nt, Human
acauuaucgggagcagug

SEQ ID NO: 2105724 - RNA, 14 nt, Human
acauuauauugcaa

SEQ ID NO: 2105725 - RNA, 15 nt, Human
acauuauauugcaau

SEQ ID NO: 2105726 - RNA, 17 nt, Human
acauuauauugcaauga

SEQ ID NO: 2105727 - RNA, 18 nt, Human
acauuauauugcaaugaa

SEQ ID NO: 2105728 - RNA, 19 nt, Human
acauuauauugcaaugaag

SEQ ID NO: 2105729 - RNA, 19 nt, Human
acauuaucgggagcagugu

SEQ ID NO: 2105730 - RNA, 21 nt, Human
acauuaucgggagcagugucu

SEQ ID NO: 2105731 - RNA, 20 nt, Human
acauuaucuaacugugcuca

SEQ ID NO: 2105732 - RNA, 22 nt, Human
acauuaucgggagcagugucuu

SEQ ID NO: 2105733 - RNA, 21 nt, Human
ucaagagggcacugguggccc

SEQ ID NO: 2105734 - RNA, 20 nt, Human
ucaagagggcacugguggcc

SEQ ID NO: 2105735 - RNA, 17 nt, Human
ucaagagggucugagga

SEQ ID NO: 2105736 - RNA, 21 nt, Human
ucaagagguucucgacuggag

SEQ ID NO: 2105737 - RNA, 13 nt, Human
ucaagauaaagga

SEQ ID NO: 2105738 - RNA, 17 nt, Human
ucaagauaaaggacagu

SEQ ID NO: 2105739 - RNA, 19 nt, Human
ucaaguaauccaccugccu

SEQ ID NO: 2105740 - RNA, 16 nt, Human
ucaaguaagaagacau

SEQ ID NO: 2105741 - RNA, 18 nt, Human
ucaaguaagaagacauga

SEQ ID NO: 2105742 - RNA, 22 nt, Human
ucaaguaagaagacaugaacca

SEQ ID NO: 2105743 - RNA, 23 nt, Human
ucaaguaagaagacaugaaccaa

SEQ ID NO: 2105744 - RNA, 15 nt, Human
ucaaguaauugugaa

SEQ ID NO: 2105745 - RNA, 16 nt, Human
ucaaguaauugugaaa

SEQ ID NO: 2105746 - RNA, 16 nt, Human
ucaagugauucuccug

SEQ ID NO: 2105747 - RNA, 17 nt, Human
ucaagugauucuccugc

SEQ ID NO: 2105748 - RNA, 19 nt, Human
ucaauaguaaaagauaaca

SEQ ID NO: 2105749 - RNA, 15 nt, Human
ucaauauuuuccaug

SEQ ID NO: 2105750 - RNA, 16 nt, Human
ucaauauuuuccauga

SEQ ID NO: 2105751 - RNA, 17 nt, Human
ucaauauuuuccaugaa

SEQ ID NO: 2105752 - RNA, 18 nt, Human
ucaauauuuuccaugaaa

SEQ ID NO: 2105753 - RNA, 19 nt, Human
ucaauccagcgguucucaa

SEQ ID NO: 2105754 - RNA, 15 nt, Human
ucaauccccucauuc

SEQ ID NO: 2105755 - RNA, 17 nt, Human
ucaauccccucauucag

SEQ ID NO: 2105756 - RNA, 20 nt, Human
ucaauccccucauucaggaa

SEQ ID NO: 2105757 - RNA, 21 nt, Human
acauuuuucagauauaaaaga

SEQ ID NO: 2105758 - RNA, 18 nt, Human
acauuuuuuuuuuuaauu

SEQ ID NO: 2105759 - RNA, 20 nt, Human
acauuuuuuuuuuuaauuuu

SEQ ID NO: 2105760 - RNA, 21 nt, Human
acauuuuuuuuuuuaauuuug

SEQ ID NO: 2105761 - RNA, 18 nt, Human
acauuuuacuuuuuccug

SEQ ID NO: 2105762 - RNA, 12 nt, Human
acauuuuaacau

SEQ ID NO: 2105763 - RNA, 13 nt, Human
acauuuuaacaug

SEQ ID NO: 2105764 - RNA, 16 nt, Human
acauuuuagacaguaa

SEQ ID NO: 2105765 - RNA, 17 nt, Human
acauuuaaacuugucag

SEQ ID NO: 2105766 - RNA, 11 nt, Human
acauuuaauug

SEQ ID NO: 2105767 - RNA, 15 nt, Human
acauuuaauugagaa

SEQ ID NO: 2105768 - RNA, 19 nt, Human
acauuuuaaugcaccugaa

SEQ ID NO: 2105769 - RNA, 15 nt, Human
acauuuuaaugcacc

SEQ ID NO: 2105770 - RNA, 11 nt, Human
acauuuuaaca

SEQ ID NO: 2105771 - RNA, 22 nt, Human
acauugcggacagccacggcca

SEQ ID NO: 2105772 - RNA, 21 nt, Human
acauugcggacagccacggcc

SEQ ID NO: 2105773 - RNA, 22 nt, Human
ucaauccccucauucaggaaaa

SEQ ID NO: 2105774 - RNA, 14 nt, Human
ucaauccucuaagc

SEQ ID NO: 2105775 - RNA, 19 nt, Human
acauugcuggucuuguaag

SEQ ID NO: 2105776 - RNA, 20 nt, Human
acauugcuggucuuguaaga

SEQ ID NO: 2105777 - RNA, 21 nt, Human
acauugcuggucuuguaagag

SEQ ID NO: 2105778 - RNA, 17 nt, Human
acauugggaaaucuuau

SEQ ID NO: 2105779 - RNA, 14 nt, Human
acauggccagugug

SEQ ID NO: 2105780 - RNA, 15 nt, Human
acauggccaguguga

SEQ ID NO: 2105781 - RNA, 15 nt, Human
acauggaguauaugu

SEQ ID NO: 2105782 - RNA, 19 nt, Human
acauggaguauaugucaag

SEQ ID NO: 2105783 - RNA, 13 nt, Human
acaugagaacaga

SEQ ID NO: 2105784 - RNA, 21 nt, Human
acaugaggacaugauggagcg

SEQ ID NO: 2105785 - RNA, 12 nt, Human
acauggacccgg

SEQ ID NO: 2105786 - RNA, 13 nt, Human
acauggacccgga

SEQ ID NO: 2105787 - RNA, 16 nt, Human
acauggacccggagcu

SEQ ID NO: 2105788 - RNA, 22 nt, Human
acauggacccggagcuaacacu

SEQ ID NO: 2105789 - RNA, 19 nt, Human
acauggacccggagcuaac

SEQ ID NO: 2105790 - RNA, 20 nt, Human
acauggaauaacauguaauu

SEQ ID NO: 2105791 - RNA, 18 nt, Human
acauggaauaacauguaa

SEQ ID NO: 2105792 - RNA, 17 nt, Human
acauuaagccuuccaca

SEQ ID NO: 2105793 - RNA, 16 nt, Human
acauuaagcaucacaa

SEQ ID NO: 2105794 - RNA, 19 nt, Human
acauuaagcaucacaaaug

SEQ ID NO: 2105795 - RNA, 18 nt, Human
acaugguugugaccugag

SEQ ID NO: 2105796 - RNA, 20 nt, Human
acaugguugugaccugagga

SEQ ID NO: 2105797 - RNA, 17 nt, Human
acauguaauaaaaagua

SEQ ID NO: 2105798 - RNA, 19 nt, Human
acauguaauaaaaaguaua

SEQ ID NO: 2105799 - RNA, 14 nt, Human
acauguauaauauu

SEQ ID NO: 2105800 - RNA, 23 nt, Human
acauguaauaaaaaguauauguu

SEQ ID NO: 2105801 - RNA, 20 nt, Human
acauguaauaaaaaguauau

SEQ ID NO: 2105802 - RNA, 19 nt, Human
acauguauaauauuuuuaa

SEQ ID NO: 2105803 - RNA, 20 nt, Human
acauguauaauauuuuuaau

SEQ ID NO: 2105804 - RNA, 18 nt, Human
acaugacgacaaagcugc

SEQ ID NO: 2105805 - RNA, 19 nt, Human
acaugacgacaaagcugcu

SEQ ID NO: 2105806 - RNA, 14 nt, Human
acaugacacugaaa

SEQ ID NO: 2105807 - RNA, 15 nt, Human
acaugacacugaaau

SEQ ID NO: 2105808 - RNA, 17 nt, Human
acaugacacugaaaugc

SEQ ID NO: 2105809 - RNA, 19 nt, Human
acaugacacugaaaugccu

SEQ ID NO: 2105810 - RNA, 23 nt, Human
acaugacacugaaaugccuuacu

SEQ ID NO: 2105811 - RNA, 19 nt, Human
ucaaagguagccaucaugg

SEQ ID NO: 2105812 - RNA, 14 nt, Human
ucaaaguaaaacuu

SEQ ID NO: 2105813 - RNA, 19 nt, Human
ucaaaguaaaacuugcugc

SEQ ID NO: 2105814 - RNA, 10 nt, Human
ucaaagcaag

SEQ ID NO: 2105815 - RNA, 13 nt, Human
ucaaaaggugccu

SEQ ID NO: 2105816 - RNA, 23 nt, Human
ucaaaaggugccugugaggcagg

SEQ ID NO: 2105817 - RNA, 16 nt, Human
ucaaaagcugggcagg

SEQ ID NO: 2105818 - RNA, 20 nt, Human
uauuuguuaaugguuugaau

SEQ ID NO: 2105819 - RNA, 22 nt, Human
uauuuguuaaugguuugaauau

SEQ ID NO: 2105820 - RNA, 17 nt, Human
uauuuguuaaauauuua

SEQ ID NO: 2105821 - RNA, 16 nt, Human
acaucuugcucugcug

SEQ ID NO: 2105822 - RNA, 15 nt, Human
acaucuugcucugcu

SEQ ID NO: 2105823 - RNA, 19 nt, Human
uaugugguuuccacgauga

SEQ ID NO: 2105824 - RNA, 17 nt, Human
acaucuugcucugcuga

SEQ ID NO: 2105825 - RNA, 22 nt, Human
acaucuugcucugcugacagac

SEQ ID NO: 2105826 - RNA, 19 nt, Human
acaucuuggucagauuuga

SEQ ID NO: 2105827 - RNA, 13 nt, Human
acaucuuggcagg

SEQ ID NO: 2105828 - RNA, 14 nt, Human
acaucuuggcaggg

SEQ ID NO: 2105829 - RNA, 20 nt, Human
acaucuuucacacuuccacc

SEQ ID NO: 2105830 - RNA, 12 nt, Human
acaucuuucaca

SEQ ID NO: 2105831 - RNA, 14 nt, Human
acaucuuucacacu

SEQ ID NO: 2105832 - RNA, 15 nt, Human
acaucuuucacacuu

SEQ ID NO: 2105833 - RNA, 13 nt, Human
acaucuuucacau

SEQ ID NO: 2105834 - RNA, 15 nt, Human
acaucuuucacauug

SEQ ID NO: 2105835 - RNA, 17 nt, Human
uauuuuuguagagccag

SEQ ID NO: 2105836 - RNA, 20 nt, Human
uauuuuuguaauuuuaaaua

SEQ ID NO: 2105837 - RNA, 21 nt, Human
uauuuuguuuugugcagagau

SEQ ID NO: 2105838 - RNA, 17 nt, Human
uauuuuuauuuguuugu

SEQ ID NO: 2105839 - RNA, 13 nt, Human
uauuuuuauuugu

SEQ ID NO: 2105840 - RNA, 15 nt, Human
uauuuuucacaguuu

SEQ ID NO: 2105841 - RNA, 18 nt, Human
uauuuuaccacugcugug

SEQ ID NO: 2105842 - RNA, 16 nt, Human
uauuuuacuacugugg

SEQ ID NO: 2105843 - RNA, 15 nt, Human
uauuuuacugucuua

SEQ ID NO: 2105844 - RNA, 16 nt, Human
uauuuuacugucuuaa

SEQ ID NO: 2105845 - RNA, 17 nt, Human
uauuuuacugucuuaau

SEQ ID NO: 2105846 - RNA, 18 nt, Human
uauuuuacuucuagagau

SEQ ID NO: 2105847 - RNA, 18 nt, Human
uauuuuaaauuauaagga

SEQ ID NO: 2105848 - RNA, 20 nt, Human
uauuuuaaauuauaaggacu

SEQ ID NO: 2105849 - RNA, 21 nt, Human
uauuuuaaauuauaaggacug

SEQ ID NO: 2105850 - RNA, 22 nt, Human
uauuuuaaauuauaaggacugc

SEQ ID NO: 2105851 - RNA, 19 nt, Human
uauuuuaauuagguuaacu

SEQ ID NO: 2105852 - RNA, 19 nt, Human
uauuuuaauuuaugaguuu

SEQ ID NO: 2105853 - RNA, 12 nt, Human
uauuuuaagcau

SEQ ID NO: 2105854 - RNA, 13 nt, Human
uauuuuaagcauu

SEQ ID NO: 2105855 - RNA, 14 nt, Human
uauuuuaagcauua

SEQ ID NO: 2105856 - RNA, 19 nt, Human
uauuuuaagcauuacucuu

SEQ ID NO: 2105857 - RNA, 20 nt, Human
uauuuuaagcauuacucuug

SEQ ID NO: 2105858 - RNA, 22 nt, Human
uauuuuaagcauuacucuugua

SEQ ID NO: 2105859 - RNA, 15 nt, Human
ucauaacuagaacug

SEQ ID NO: 2105860 - RNA, 16 nt, Human
ucauaacugugucauu

SEQ ID NO: 2105861 - RNA, 17 nt, Human
ucauaacuuucauuaaa

SEQ ID NO: 2105862 - RNA, 13 nt, Human
ucauaagcacacu

SEQ ID NO: 2105863 - RNA, 13 nt, Human
ucauaacuagaac

SEQ ID NO: 2105864 - RNA, 16 nt, Human
ucauaaacugugugca

SEQ ID NO: 2105865 - RNA, 14 nt, Human
ucauaaacugugug

SEQ ID NO: 2105866 - RNA, 15 nt, Human
ucauaaacugugugc

SEQ ID NO: 2105867 - RNA, 13 nt, Human
ucauaaacugugu

SEQ ID NO: 2105868 - RNA, 23 nt, Human
ucaguuuauccaagguguaacuc

SEQ ID NO: 2105869 - RNA, 22 nt, Human
ucagugcuguggccugggcaag

SEQ ID NO: 2105870 - RNA, 21 nt, Human
ucauaaaauaaaguauauaua

SEQ ID NO: 2105871 - RNA, 19 nt, Human
ucaguuucaauucagugcu

SEQ ID NO: 2105872 - RNA, 19 nt, Human
ucaguuugcuagcagaaau

SEQ ID NO: 2105873 - RNA, 13 nt, Human
ucaguggcagcug

SEQ ID NO: 2105874 - RNA, 12 nt, Human
ucagugcugugg

SEQ ID NO: 2105875 - RNA, 14 nt, Human
ucagugcuguggcc

SEQ ID NO: 2105876 - RNA, 15 nt, Human
ucagugcuguggccu

SEQ ID NO: 2105877 - RNA, 16 nt, Human
ucaguggcagcugcuu

SEQ ID NO: 2105878 - RNA, 17 nt, Human
ucagugcuguggccugg

SEQ ID NO: 2105879 - RNA, 19 nt, Human
ucagugcuguggccugggc

SEQ ID NO: 2105880 - RNA, 15 nt, Human
ucaguggcagcugcu

SEQ ID NO: 2105881 - RNA, 14 nt, Human
ucaguggcagcugc

SEQ ID NO: 2105882 - RNA, 13 nt, Human
ucaguagucagac

SEQ ID NO: 2105883 - RNA, 21 nt, Human
ucaguauuaaaggggggaggg

SEQ ID NO: 2105884 - RNA, 22 nt, Human
ucaguauuaaaggggggagggg

SEQ ID NO: 2105885 - RNA, 18 nt, Human
ucagguucuuagugucac

SEQ ID NO: 2105886 - RNA, 17 nt, Human
accgaaacagcgcuggg

SEQ ID NO: 2105887 - RNA, 15 nt, Human
ucagguuauacuccu

SEQ ID NO: 2105888 - RNA, 12 nt, Human
accgaaacagcg

SEQ ID NO: 2105889 - RNA, 22 nt, Human
ucaggugucccugcacuugcag

SEQ ID NO: 2105890 - RNA, 15 nt, Human
ucaguaacagggccu

SEQ ID NO: 2105891 - RNA, 14 nt, Human
ucagguuuuguaaa

SEQ ID NO: 2105892 - RNA, 13 nt, Human
ucagguuuuguaa

SEQ ID NO: 2105893 - RNA, 22 nt, Human
ucagguugucugaagucacugc

SEQ ID NO: 2105894 - RNA, 17 nt, Human
ucagguuguaguaaaga

SEQ ID NO: 2105895 - RNA, 19 nt, Human
ucagguuguaguaaagaaa

SEQ ID NO: 2105896 - RNA, 20 nt, Human
ucagguuguaguaaagaaau

SEQ ID NO: 2105897 - RNA, 17 nt, Human
ucagguuugccugaggg

SEQ ID NO: 2105898 - RNA, 13 nt, Human
ucagguuuggggu

SEQ ID NO: 2105899 - RNA, 18 nt, Human
ucagguuugccugagggc

SEQ ID NO: 2105900 - RNA, 13 nt, Human
ucaguacccaccu

SEQ ID NO: 2105901 - RNA, 15 nt, Human
ucaguacccaccuga

SEQ ID NO: 2105902 - RNA, 18 nt, Human
ucaguacccaccugagcu

SEQ ID NO: 2105903 - RNA, 22 nt, Human
ucaguacccaccugagcuuugg

SEQ ID NO: 2105904 - RNA, 13 nt, Human
ucaguaauaacuc

SEQ ID NO: 2105905 - RNA, 12 nt, Human
ucaguaauaaaa

SEQ ID NO: 2105906 - RNA, 13 nt, Human
ucaguaauaaaac

SEQ ID NO: 2105907 - RNA, 15 nt, Human
ucaguaauaaaacau

SEQ ID NO: 2105908 - RNA, 19 nt, Human
ucaguaauaaacuguguuu

SEQ ID NO: 2105909 - RNA, 13 nt, Human
ucaguaagccgug

SEQ ID NO: 2105910 - RNA, 21 nt, Human
acccuuggaggcugucuucuc

SEQ ID NO: 2105911 - RNA, 11 nt, Human
acccuuggccu

SEQ ID NO: 2105912 - RNA, 12 nt, Human
acccuuggccug

SEQ ID NO: 2105913 - RNA, 17 nt, Human
acccuuggcucaauccu

SEQ ID NO: 2105914 - RNA, 13 nt, Human
acccuuggccugu

SEQ ID NO: 2105915 - RNA, 17 nt, Human
acccuuggccugucuca

SEQ ID NO: 2105916 - RNA, 18 nt, Human
ucaggugucccugcacuu

SEQ ID NO: 2105917 - RNA, 17 nt, Human
ucaggugucccugcacu

SEQ ID NO: 2105918 - RNA, 15 nt, Human
ucaggugucccugca

SEQ ID NO: 2105919 - RNA, 12 nt, Human
acccccagccug

SEQ ID NO: 2105920 - RNA, 21 nt, Human
acccccacucucauuccccag

SEQ ID NO: 2105921 - RNA, 22 nt, Human
acccccacucucauuccccagg

SEQ ID NO: 2105922 - RNA, 11 nt, Human
acccccagcaa

SEQ ID NO: 2105923 - RNA, 13 nt, Human
acccccagcaacc

SEQ ID NO: 2105924 - RNA, 16 nt, Human
acccccagcaacccuc

SEQ ID NO: 2105925 - RNA, 13 nt, Human
acccccagccugc

SEQ ID NO: 2105926 - RNA, 17 nt, Human
ucaggcaggugggaugg

SEQ ID NO: 2105927 - RNA, 13 nt, Human
ucaggcaggaagg

SEQ ID NO: 2105928 - RNA, 21 nt, Human
ucaggcaggaagggcaggaag

SEQ ID NO: 2105929 - RNA, 18 nt, Human
ucaggcaggugggaugga

SEQ ID NO: 2105930 - RNA, 15 nt, Human
ucaggcauaggccug

SEQ ID NO: 2105931 - RNA, 16 nt, Human
ucaggcauaggccugg

SEQ ID NO: 2105932 - RNA, 17 nt, Human
ucaggcauaggccuggg

SEQ ID NO: 2105933 - RNA, 18 nt, Human
ucaggcauaggccugggu

SEQ ID NO: 2105934 - RNA, 13 nt, Human
ucaggccacuuga

SEQ ID NO: 2105935 - RNA, 17 nt, Human
ucaggccacggcagccu

SEQ ID NO: 2105936 - RNA, 18 nt, Human
ucaggccaaccccaaaga

SEQ ID NO: 2105937 - RNA, 17 nt, Human
ucaggccaccugccccc

SEQ ID NO: 2105938 - RNA, 19 nt, Human
ucaggccaccugcccccuu

SEQ ID NO: 2105939 - RNA, 21 nt, Human
ucaggccaccugcccccuucu

SEQ ID NO: 2105940 - RNA, 14 nt, Human
ucaggccacggcag

SEQ ID NO: 2105941 - RNA, 16 nt, Human
ucaggccacggcagcc

SEQ ID NO: 2105942 - RNA, 19 nt, Human
ucaggguuggccccugccc

SEQ ID NO: 2105943 - RNA, 18 nt, Human
ucaggguuggccccugcc

SEQ ID NO: 2105944 - RNA, 23 nt, Human
ucaggguuggccccugcccggcu

SEQ ID NO: 2105945 - RNA, 23 nt, Human
ucaggggucgucaccaccucucc

SEQ ID NO: 2105946 - RNA, 17 nt, Human
ucagguacagagaagga

SEQ ID NO: 2105947 - RNA, 18 nt, Human
ucagguacagagaaggaa

SEQ ID NO: 2105948 - RNA, 19 nt, Human
ucagguacagagaaggaau

SEQ ID NO: 2105949 - RNA, 13 nt, Human
ucagguagcugcc

SEQ ID NO: 2105950 - RNA, 19 nt, Human
ucagguaguugcaauugaa

SEQ ID NO: 2105951 - RNA, 12 nt, Human
ucaggggugugc

SEQ ID NO: 2105952 - RNA, 19 nt, Human
ucaggggugugcggccuuu

SEQ ID NO: 2105953 - RNA, 23 nt, Human
ucaggggugugcggccuuuggcu

SEQ ID NO: 2105954 - RNA, 17 nt, Human
ucaggguuggccccugc

SEQ ID NO: 2105955 - RNA, 21 nt, Human
acccuccuuucaccacaugug

SEQ ID NO: 2105956 - RNA, 18 nt, Human
acccucccucagccccuc

SEQ ID NO: 2105957 - RNA, 19 nt, Human
acccucccucagccccucu

SEQ ID NO: 2105958 - RNA, 20 nt, Human
acccucccucagccccucuu

SEQ ID NO: 2105959 - RNA, 23 nt, Human
acccucccucagccccucuugcc

SEQ ID NO: 2105960 - RNA, 12 nt, Human
acccucccucag

SEQ ID NO: 2105961 - RNA, 14 nt, Human
acccucccucagcc

SEQ ID NO: 2105962 - RNA, 17 nt, Human
acccucccucagccccu

SEQ ID NO: 2105963 - RNA, 23 nt, Human
acccucccccaggaggucgaccc

SEQ ID NO: 2105964 - RNA, 15 nt, Human
acccggaggggccug

SEQ ID NO: 2105965 - RNA, 22 nt, Human
acccggagcuaacacuggcccc

SEQ ID NO: 2105966 - RNA, 23 nt, Human
acccggagcuaacacuggccccu

SEQ ID NO: 2105967 - RNA, 16 nt, Human
acccgcuuucuugcug

SEQ ID NO: 2105968 - RNA, 21 nt, Human
acccucgaagcgcgccacucg

SEQ ID NO: 2105969 - RNA, 16 nt, Human
acccucgaagcgcgcc

SEQ ID NO: 2105970 - RNA, 20 nt, Human
acccucgaagcgcgccacuc

SEQ ID NO: 2105971 - RNA, 17 nt, Human
acccugauuucuugcuu

SEQ ID NO: 2105972 - RNA, 18 nt, Human
acccugcaaaggacuguu

SEQ ID NO: 2105973 - RNA, 14 nt, Human
acccugccccugcc

SEQ ID NO: 2105974 - RNA, 12 nt, Human
acccugccccug

SEQ ID NO: 2105975 - RNA, 13 nt, Human
acccugccccugc

SEQ ID NO: 2105976 - RNA, 22 nt, Human
acccugcgaaggggcccugguc

SEQ ID NO: 2105977 - RNA, 19 nt, Human
acccugcgaaggggcccug

SEQ ID NO: 2105978 - RNA, 20 nt, Human
acccugcgaaggggcccugg

SEQ ID NO: 2105979 - RNA, 18 nt, Human
acccugcgaaggggcccu

SEQ ID NO: 2105980 - RNA, 17 nt, Human
ucacugcaacuucugcc

SEQ ID NO: 2105981 - RNA, 18 nt, Human
ucacugcaacuucugccu

SEQ ID NO: 2105982 - RNA, 15 nt, Human
ucacugcacagugca

SEQ ID NO: 2105983 - RNA, 18 nt, Human
ucacugcaagcuccgccu

SEQ ID NO: 2105984 - RNA, 14 nt, Human
ucacuguugcccag

SEQ ID NO: 2105985 - RNA, 18 nt, Human
ucacugcaaccuccgccu

SEQ ID NO: 2105986 - RNA, 17 nt, Human
ucacuuaaauguuacca

SEQ ID NO: 2105987 - RNA, 17 nt, Human
ucacuuaccuagauuua

SEQ ID NO: 2105988 - RNA, 15 nt, Human
ucacuguugcccagg

SEQ ID NO: 2105989 - RNA, 20 nt, Human
ucacuguuucucugcuguug

SEQ ID NO: 2105990 - RNA, 15 nt, Human
ucacuucacccugga

SEQ ID NO: 2105991 - RNA, 19 nt, Human
ucacuuaucccaagagaau

SEQ ID NO: 2105992 - RNA, 17 nt, Human
ucacuuccuacaagagc

SEQ ID NO: 2105993 - RNA, 13 nt, Human
ucacuucuaaaug

SEQ ID NO: 2105994 - RNA, 16 nt, Human
ucacuucuaaaugcau

SEQ ID NO: 2105995 - RNA, 17 nt, Human
ucacuucugaccacacu

SEQ ID NO: 2105996 - RNA, 21 nt, Human
ucacuauguugcccaggcagg

SEQ ID NO: 2105997 - RNA, 22 nt, Human
ucaccagccccagugcccacag

SEQ ID NO: 2105998 - RNA, 18 nt, Human
ucacuauuuuuauuuaua

SEQ ID NO: 2105999 - RNA, 17 nt, Human
ucacucaaguucaagga

SEQ ID NO: 2106000 - RNA, 20 nt, Human
ucacucaaguucaaggacca

SEQ ID NO: 2106001 - RNA, 21 nt, Human
ucacucaaguucaaggaccaa

SEQ ID NO: 2106002 - RNA, 14 nt, Human
ucacucaauuguuu

SEQ ID NO: 2106003 - RNA, 20 nt, Human
ucacuauuuuuauuuauauu

SEQ ID NO: 2106004 - RNA, 14 nt, Human
ucacucagauggaa

SEQ ID NO: 2106005 - RNA, 23 nt, Human
ucacugaaacuucaagcaccagg

SEQ ID NO: 2106006 - RNA, 14 nt, Human
ucacuccagccugg

SEQ ID NO: 2106007 - RNA, 16 nt, Human
ucacugaagcuuuuua

SEQ ID NO: 2106008 - RNA, 13 nt, Human
ucacuccaccacc

SEQ ID NO: 2106009 - RNA, 14 nt, Human
ucacuccaccaccc

SEQ ID NO: 2106010 - RNA, 15 nt, Human
ucacuccaccaccca

SEQ ID NO: 2106011 - RNA, 16 nt, Human
ucacuccaccacccaa

SEQ ID NO: 2106012 - RNA, 18 nt, Human
ucacuucugaccacacuu

SEQ ID NO: 2106013 - RNA, 15 nt, Human
accaggguuuaucuu

SEQ ID NO: 2106014 - RNA, 14 nt, Human
accagguugaaaga

SEQ ID NO: 2106015 - RNA, 20 nt, Human
accagguguucuacacucau

SEQ ID NO: 2106016 - RNA, 23 nt, Human
accagguguucuacacucaucuu

SEQ ID NO: 2106017 - RNA, 19 nt, Human
accagguguucuacacuca

SEQ ID NO: 2106018 - RNA, 15 nt, Human
accaguaaaguguaa

SEQ ID NO: 2106019 - RNA, 17 nt, Human
accaguaaaguguaaca

SEQ ID NO: 2106020 - RNA, 18 nt, Human
accaguaaaguguaacau

SEQ ID NO: 2106021 - RNA, 19 nt, Human
accaguaaaguguaacaua

SEQ ID NO: 2106022 - RNA, 16 nt, Human
accauggagacaagaa

SEQ ID NO: 2106023 - RNA, 21 nt, Human
accauggcuaaggcaccagcc

SEQ ID NO: 2106024 - RNA, 15 nt, Human
accauggccagccaa

SEQ ID NO: 2106025 - RNA, 13 nt, Human
accauuuucuggu

SEQ ID NO: 2106026 - RNA, 19 nt, Human
accauguuugagcucagac

SEQ ID NO: 2106027 - RNA, 20 nt, Human
acccacugcuuuuggucugu

SEQ ID NO: 2106028 - RNA, 21 nt, Human
accauuuugggguacccacug

SEQ ID NO: 2106029 - RNA, 12 nt, Human
accauguuugag

SEQ ID NO: 2106030 - RNA, 20 nt, Human
accauguuugagcucagacc

SEQ ID NO: 2106031 - RNA, 13 nt, Human
accccagcggcug

SEQ ID NO: 2106032 - RNA, 14 nt, Human
accccagcucccua

SEQ ID NO: 2106033 - RNA, 17 nt, Human
accccagcucccuagga

SEQ ID NO: 2106034 - RNA, 14 nt, Human
accccagcucugcu

SEQ ID NO: 2106035 - RNA, 23 nt, Human
accccagcucccuaggagaccaa

SEQ ID NO: 2106036 - RNA, 13 nt, Human
accccagguuucu

SEQ ID NO: 2106037 - RNA, 17 nt, Human
acccccaccccacacuu

SEQ ID NO: 2106038 - RNA, 16 nt, Human
acccccaccccacacu

SEQ ID NO: 2106039 - RNA, 13 nt, Human
acccccaccccuu

SEQ ID NO: 2106040 - RNA, 14 nt, Human
acccccaccccuuc

SEQ ID NO: 2106041 - RNA, 15 nt, Human
acccccaccccuucc

SEQ ID NO: 2106042 - RNA, 20 nt, Human
acccccaccccuuccccacu

SEQ ID NO: 2106043 - RNA, 11 nt, Human
acccccacccu

SEQ ID NO: 2106044 - RNA, 12 nt, Human
acccccacccuu

SEQ ID NO: 2106045 - RNA, 13 nt, Human
acccccacucuca

SEQ ID NO: 2106046 - RNA, 17 nt, Human
acccccacucucauucc

SEQ ID NO: 2106047 - RNA, 18 nt, Human
acccccacucucauuccc

SEQ ID NO: 2106048 - RNA, 17 nt, Human
acccagcgagcccuggu

SEQ ID NO: 2106049 - RNA, 16 nt, Human
acccagcgagcccugg

SEQ ID NO: 2106050 - RNA, 13 nt, Human
acccagcgagccc

SEQ ID NO: 2106051 - RNA, 13 nt, Human
ucagcccucagaa

SEQ ID NO: 2106052 - RNA, 15 nt, Human
acccaggagccccga

SEQ ID NO: 2106053 - RNA, 23 nt, Human
acccaggagauggaaguugcagu

SEQ ID NO: 2106054 - RNA, 13 nt, Human
acccaggagcccc

SEQ ID NO: 2106055 - RNA, 20 nt, Human
ucagccccuccucugccacc

SEQ ID NO: 2106056 - RNA, 21 nt, Human
ucagccccuccucugccaccu

SEQ ID NO: 2106057 - RNA, 22 nt, Human
ucagccccuccucugccaccuc

SEQ ID NO: 2106058 - RNA, 23 nt, Human
ucagccccuccucugccaccucc

SEQ ID NO: 2106059 - RNA, 11 nt, Human
ucagccccucu

SEQ ID NO: 2106060 - RNA, 12 nt, Human
ucagccccucuu

SEQ ID NO: 2106061 - RNA, 20 nt, Human
ucagccccucuugcccccca

SEQ ID NO: 2106062 - RNA, 21 nt, Human
ucagccccucuugccccccac

SEQ ID NO: 2106063 - RNA, 22 nt, Human
ucagccccucuugccccccacc

SEQ ID NO: 2106064 - RNA, 23 nt, Human
ucagccccucuugccccccaccc

SEQ ID NO: 2106065 - RNA, 12 nt, Human
ucagcccucaga

SEQ ID NO: 2106066 - RNA, 23 nt, Human
ucagauggaaccgcaggaagcug

SEQ ID NO: 2106067 - RNA, 15 nt, Human
ucagauuccuuuccc

SEQ ID NO: 2106068 - RNA, 19 nt, Human
ucagauuccuuucccuuua

SEQ ID NO: 2106069 - RNA, 21 nt, Human
ucagauggaaccgcaggaagc

SEQ ID NO: 2106070 - RNA, 22 nt, Human
ucagauggaaccgcaggaagcu

SEQ ID NO: 2106071 - RNA, 20 nt, Human
ucagauggaaccgcaggaag

SEQ ID NO: 2106072 - RNA, 13 nt, Human
ucagaugcuucug

SEQ ID NO: 2106073 - RNA, 14 nt, Human
ucagaugcuucugg

SEQ ID NO: 2106074 - RNA, 18 nt, Human
ucagaugcuucugggaga

SEQ ID NO: 2106075 - RNA, 22 nt, Human
ucagaugcccagagggcccagg

SEQ ID NO: 2106076 - RNA, 19 nt, Human
ucagagcaggugcuggcuc

SEQ ID NO: 2106077 - RNA, 16 nt, Human
ucagagauaggccugu

SEQ ID NO: 2106078 - RNA, 21 nt, Human
ucagagccaccccuaaagaga

SEQ ID NO: 2106079 - RNA, 19 nt, Human
ucagagagaauggcuuugg

SEQ ID NO: 2106080 - RNA, 14 nt, Human
ucagagagaguguu

SEQ ID NO: 2106081 - RNA, 17 nt, Human
ucagagaggagucagag

SEQ ID NO: 2106082 - RNA, 20 nt, Human
ucagagaggagucagagaga

SEQ ID NO: 2106083 - RNA, 22 nt, Human
ucagagagcgagcgcuacccac

SEQ ID NO: 2106084 - RNA, 13 nt, Human
ucagagagcuggu

SEQ ID NO: 2106085 - RNA, 14 nt, Human
ucagagagcuggua

SEQ ID NO: 2106086 - RNA, 16 nt, Human
ucagagagcugguagu

SEQ ID NO: 2106087 - RNA, 15 nt, Human
acccagcccacuucu

SEQ ID NO: 2106088 - RNA, 17 nt, Human
acccagcaacuccaacu

SEQ ID NO: 2106089 - RNA, 14 nt, Human
ucagagacucaggg

SEQ ID NO: 2106090 - RNA, 17 nt, Human
ucagagacucagggccc

SEQ ID NO: 2106091 - RNA, 19 nt, Human
ucagagacucagggcccca

SEQ ID NO: 2106092 - RNA, 20 nt, Human
ucagagacucagggccccag

SEQ ID NO: 2106093 - RNA, 23 nt, Human
ucagagacaggaagucuucaggg

SEQ ID NO: 2106094 - RNA, 20 nt, Human
ucagagacaggaagucuuca

SEQ ID NO: 2106095 - RNA, 20 nt, Human
ucagaauucucagaaucuca

SEQ ID NO: 2106096 - RNA, 10 nt, Human
ucagaauucu

SEQ ID NO: 2106097 - RNA, 12 nt, Human
ucagaauucuca

SEQ ID NO: 2106098 - RNA, 13 nt, Human
ucguucucugccu

SEQ ID NO: 2106099 - RNA, 14 nt, Human
ucggggccagaggc

SEQ ID NO: 2106100 - RNA, 15 nt, Human
ucguucuuguuagua

SEQ ID NO: 2106101 - RNA, 15 nt, Human
ucguucuuguucugu

SEQ ID NO: 2106102 - RNA, 17 nt, Human
ucguucuuguucuguuu

SEQ ID NO: 2106103 - RNA, 14 nt, Human
ucguucuuucuagc

SEQ ID NO: 2106104 - RNA, 19 nt, Human
ucguuaguaucuaacaugu

SEQ ID NO: 2106105 - RNA, 15 nt, Human
ucguuauguguguau

SEQ ID NO: 2106106 - RNA, 21 nt, Human
ucguauaacacaauaugaaua

SEQ ID NO: 2106107 - RNA, 16 nt, Human
ucggggcaugcugggg

SEQ ID NO: 2106108 - RNA, 17 nt, Human
ucggggcaugcuggggc

SEQ ID NO: 2106109 - RNA, 18 nt, Human
ucggggcaugcuggggca

SEQ ID NO: 2106110 - RNA, 19 nt, Human
ucggggagaggcugaggac

SEQ ID NO: 2106111 - RNA, 15 nt, Human
ucggggaacuccugg

SEQ ID NO: 2106112 - RNA, 16 nt, Human
ucggggaacuccugga

SEQ ID NO: 2106113 - RNA, 23 nt, Human
ucgggagcagugucuuccauaau

SEQ ID NO: 2106114 - RNA, 13 nt, Human
ucgggagcagugu

SEQ ID NO: 2106115 - RNA, 14 nt, Human
ucgggagcaguguc

SEQ ID NO: 2106116 - RNA, 15 nt, Human
ucgggagcagugucu

SEQ ID NO: 2106117 - RNA, 16 nt, Human
ucgggagcagugucuu

SEQ ID NO: 2106118 - RNA, 19 nt, Human
ucgggagcagugucuucca

SEQ ID NO: 2106119 - RNA, 22 nt, Human
ucgggagcagugucuuccauaa

SEQ ID NO: 2106120 - RNA, 21 nt, Human
acuguuaauaguucagguaac

SEQ ID NO: 2106121 - RNA, 17 nt, Human
acuguuaauaguucagg

SEQ ID NO: 2106122 - RNA, 15 nt, Human
acuguguuccuggca

SEQ ID NO: 2106123 - RNA, 12 nt, Human
acuguguuccug

SEQ ID NO: 2106124 - RNA, 14 nt, Human
acuguccucuuuca

SEQ ID NO: 2106125 - RNA, 18 nt, Human
acuguccucuuucagaaa

SEQ ID NO: 2106126 - RNA, 19 nt, Human
acuguccucuuucagaaaa

SEQ ID NO: 2106127 - RNA, 21 nt, Human
acuguccucuuucagaaaaca

SEQ ID NO: 2106128 - RNA, 22 nt, Human
acuguccucuuucagaaaacag

SEQ ID NO: 2106129 - RNA, 23 nt, Human
acuguccucuuucagaaaacaga

SEQ ID NO: 2106130 - RNA, 21 nt, Human
acuguggccaugguccccaag

SEQ ID NO: 2106131 - RNA, 15 nt, Human
acuguggcacacgcc

SEQ ID NO: 2106132 - RNA, 12 nt, Human
acuguggccuug

SEQ ID NO: 2106133 - RNA, 15 nt, Human
acuguggccuugguc

SEQ ID NO: 2106134 - RNA, 22 nt, Human
acuguggccuuggucuaacuuu

SEQ ID NO: 2106135 - RNA, 12 nt, Human
acuguggcugcu

SEQ ID NO: 2106136 - RNA, 19 nt, Human
acuguggcugcuagcacuu

SEQ ID NO: 2106137 - RNA, 15 nt, Human
ucuacauauucuuua

SEQ ID NO: 2106138 - RNA, 16 nt, Human
ucuacauauucuuuaa

SEQ ID NO: 2106139 - RNA, 13 nt, Human
ucuaccccuggau

SEQ ID NO: 2106140 - RNA, 23 nt, Human
ucuacauuucaccuacuuuguaa

SEQ ID NO: 2106141 - RNA, 21 nt, Human
ucuacccucuuagaaaaacca

SEQ ID NO: 2106142 - RNA, 18 nt, Human
ucuacccucccacccccu

SEQ ID NO: 2106143 - RNA, 15 nt, Human
ucuacccucccaccc

SEQ ID NO: 2106144 - RNA, 16 nt, Human
ucuacccucccacccc

SEQ ID NO: 2106145 - RNA, 18 nt, Human
ucuaaguguuucauaaau

SEQ ID NO: 2106146 - RNA, 21 nt, Human
ucuaagauucauccauuuauu

SEQ ID NO: 2106147 - RNA, 19 nt, Human
ucuaaacuuuaauauguau

SEQ ID NO: 2106148 - RNA, 17 nt, Human
ucuaagccuuuccauaa

SEQ ID NO: 2106149 - RNA, 21 nt, Human
ucgcucuguugcccaggcugg

SEQ ID NO: 2106150 - RNA, 19 nt, Human
ucgcugauauauguguuuu

SEQ ID NO: 2106151 - RNA, 22 nt, Human
ucgcugauauauguguuuuuca

SEQ ID NO: 2106152 - RNA, 23 nt, Human
ucgcugugucagcauagaaguaa

SEQ ID NO: 2106153 - RNA, 11 nt, Human
ucgcuggcccc

SEQ ID NO: 2106154 - RNA, 14 nt, Human
ucgcuggcccccac

SEQ ID NO: 2106155 - RNA, 15 nt, Human
ucgcuggcccccacu

SEQ ID NO: 2106156 - RNA, 17 nt, Human
ucgcuggcccccacugg

SEQ ID NO: 2106157 - RNA, 18 nt, Human
ucgcuggcccccacuggc

SEQ ID NO: 2106158 - RNA, 20 nt, Human
ucgcuggcccccacuggcug

SEQ ID NO: 2106159 - RNA, 21 nt, Human
ucgcuggcccccacuggcugu

SEQ ID NO: 2106160 - RNA, 21 nt, Human
acugggccuguugcccuuucu

SEQ ID NO: 2106161 - RNA, 15 nt, Human
acuggguacuugugg

SEQ ID NO: 2106162 - RNA, 18 nt, Human
acugggguccuggggccu

SEQ ID NO: 2106163 - RNA, 20 nt, Human
acugggguccuggggccucg

SEQ ID NO: 2106164 - RNA, 13 nt, Human
acugggggagggg

SEQ ID NO: 2106165 - RNA, 17 nt, Human
ucgccguugaagaggaa

SEQ ID NO: 2106166 - RNA, 14 nt, Human
ucgcuccugugucu

SEQ ID NO: 2106167 - RNA, 15 nt, Human
ucgccgucugugaau

SEQ ID NO: 2106168 - RNA, 14 nt, Human
ucgccguggcugcg

SEQ ID NO: 2106169 - RNA, 12 nt, Human
acugaagccugc

SEQ ID NO: 2106170 - RNA, 14 nt, Human
acugaagccugcag

SEQ ID NO: 2106171 - RNA, 15 nt, Human
acugaagccugcagg

SEQ ID NO: 2106172 - RNA, 16 nt, Human
acugaagccugcagga

SEQ ID NO: 2106173 - RNA, 19 nt, Human
acugaagccugcaggaguu

SEQ ID NO: 2106174 - RNA, 18 nt, Human
acugaagccagaaauaaa

SEQ ID NO: 2106175 - RNA, 16 nt, Human
acugaaauauacacac

SEQ ID NO: 2106176 - RNA, 15 nt, Human
acugaaauauacaca

SEQ ID NO: 2106177 - RNA, 13 nt, Human
acugaaagguuac

SEQ ID NO: 2106178 - RNA, 14 nt, Human
acugaaaguguuuc

SEQ ID NO: 2106179 - RNA, 17 nt, Human
acugaaaguguuuccuu

SEQ ID NO: 2106180 - RNA, 18 nt, Human
acugaaaugccuuacuuu

SEQ ID NO: 2106181 - RNA, 21 nt, Human
acugaaaugccuuacuuugua

SEQ ID NO: 2106182 - RNA, 22 nt, Human
acugaaaugccuuacuuuguau

SEQ ID NO: 2106183 - RNA, 23 nt, Human
acugaaaugccuuacuuuguaug

SEQ ID NO: 2106184 - RNA, 12 nt, Human
acugaacaaaaa

SEQ ID NO: 2106185 - RNA, 13 nt, Human
acugaacaaaaaa

SEQ ID NO: 2106186 - RNA, 14 nt, Human
acugaacaaaaaaa

SEQ ID NO: 2106187 - RNA, 17 nt, Human
acugaaauauacacaca

SEQ ID NO: 2106188 - RNA, 14 nt, Human
acugaagauagaag

SEQ ID NO: 2106189 - RNA, 16 nt, Human
acugaagauagaagaa

SEQ ID NO: 2106190 - RNA, 17 nt, Human
acugaagauagaagaaa

SEQ ID NO: 2106191 - RNA, 18 nt, Human
acugaagauagaagaaaa

SEQ ID NO: 2106192 - RNA, 19 nt, Human
acugaagauagaagaaaaa

SEQ ID NO: 2106193 - RNA, 21 nt, Human
acugaagauagaagaaaaaag

SEQ ID NO: 2106194 - RNA, 23 nt, Human
acugaagauagaagaaaaaagaa

SEQ ID NO: 2106195 - RNA, 13 nt, Human
acuguaucugugu

SEQ ID NO: 2106196 - RNA, 14 nt, Human
acuguaucugugua

SEQ ID NO: 2106197 - RNA, 15 nt, Human
acuguaucuguguag

SEQ ID NO: 2106198 - RNA, 20 nt, Human
acuguauuacauaaauaaau

SEQ ID NO: 2106199 - RNA, 13 nt, Human
acuguaugcugga

SEQ ID NO: 2106200 - RNA, 20 nt, Human
acuguauuuuuaccuuuuuc

SEQ ID NO: 2106201 - RNA, 16 nt, Human
acugucaaagaaucaa

SEQ ID NO: 2106202 - RNA, 20 nt, Human
acugucaaagaaucaaucca

SEQ ID NO: 2106203 - RNA, 12 nt, Human
acugucaauaaa

SEQ ID NO: 2106204 - RNA, 13 nt, Human
acugucaauaaac

SEQ ID NO: 2106205 - RNA, 14 nt, Human
acugucaauaaaca

SEQ ID NO: 2106206 - RNA, 15 nt, Human
acugucaauaaacag

SEQ ID NO: 2106207 - RNA, 17 nt, Human
acugucaauaaacagcu

SEQ ID NO: 2106208 - RNA, 18 nt, Human
acugucaauaaacagcuu

SEQ ID NO: 2106209 - RNA, 21 nt, Human
acugucaauaaacagcuucau

SEQ ID NO: 2106210 - RNA, 18 nt, Human
acuggguacuuguggaca

SEQ ID NO: 2106211 - RNA, 17 nt, Human
acuggguacuuguggac

SEQ ID NO: 2106212 - RNA, 16 nt, Human
acuguacaaaguagaa

SEQ ID NO: 2106213 - RNA, 22 nt, Human
acuguacaaaguagaagucuua

SEQ ID NO: 2106214 - RNA, 13 nt, Human
acuguacacacuu

SEQ ID NO: 2106215 - RNA, 14 nt, Human
acuguacacacuuu

SEQ ID NO: 2106216 - RNA, 15 nt, Human
acuguacacacuuua

SEQ ID NO: 2106217 - RNA, 17 nt, Human
acuguacacacuuuauu

SEQ ID NO: 2106218 - RNA, 22 nt, Human
acuguacacacuuuauuuacuu

SEQ ID NO: 2106219 - RNA, 23 nt, Human
acuguacacacuuuauuuacuuc

SEQ ID NO: 2106220 - RNA, 17 nt, Human
acuguacuuaauaaauu

SEQ ID NO: 2106221 - RNA, 18 nt, Human
acuguacuuaauaaauuc

SEQ ID NO: 2106222 - RNA, 15 nt, Human
acuguacuccuccca

SEQ ID NO: 2106223 - RNA, 20 nt, Human
acuguacuccucccaggcgc

SEQ ID NO: 2106224 - RNA, 23 nt, Human
acuuguccuuuuguaccauggug

SEQ ID NO: 2106225 - RNA, 18 nt, Human
acuuguauuaaagacaga

SEQ ID NO: 2106226 - RNA, 14 nt, Human
acuuguaugaaaga

SEQ ID NO: 2106227 - RNA, 14 nt, Human
acuuggagccccag

SEQ ID NO: 2106228 - RNA, 14 nt, Human
acuuggagccaagg

SEQ ID NO: 2106229 - RNA, 19 nt, Human
acuuggagccaaggguuca

SEQ ID NO: 2106230 - RNA, 22 nt, Human
acuuggaaaaauccagaaagaa

SEQ ID NO: 2106231 - RNA, 23 nt, Human
acuuggaccagcauccuuaagua

SEQ ID NO: 2106232 - RNA, 11 nt, Human
acuuggagcca

SEQ ID NO: 2106233 - RNA, 14 nt, Human
acuuggaagcuccg

SEQ ID NO: 2106234 - RNA, 21 nt, Human
acuuggaaaaauccagaaaga

SEQ ID NO: 2106235 - RNA, 19 nt, Human
acuugcauugaauauauua

SEQ ID NO: 2106236 - RNA, 11 nt, Human
acuugcauuuc

SEQ ID NO: 2106237 - RNA, 17 nt, Human
acuugauacuuguuuuc

SEQ ID NO: 2106238 - RNA, 17 nt, Human
acuugacagaacacugu

SEQ ID NO: 2106239 - RNA, 20 nt, Human
acuugaauucauagaaaaag

SEQ ID NO: 2106240 - RNA, 18 nt, Human
acuugacagaacacuguc

SEQ ID NO: 2106241 - RNA, 20 nt, Human
acuugacagaacacugucuu

SEQ ID NO: 2106242 - RNA, 19 nt, Human
acuugacccccuugagggu

SEQ ID NO: 2106243 - RNA, 17 nt, Human
acuugacuuuuaaggcu

SEQ ID NO: 2106244 - RNA, 19 nt, Human
acuugagaauuacccuuuu

SEQ ID NO: 2106245 - RNA, 17 nt, Human
acuugagaacuugacaa

SEQ ID NO: 2106246 - RNA, 23 nt, Human
acuugagaacuugacaaguugcg

SEQ ID NO: 2106247 - RNA, 15 nt, Human
acuucugaccacacu

SEQ ID NO: 2106248 - RNA, 13 nt, Human
acuugaaagcauc

SEQ ID NO: 2106249 - RNA, 19 nt, Human
acuucgggaaggugucugg

SEQ ID NO: 2106250 - RNA, 14 nt, Human
acuugaaagcaucc

SEQ ID NO: 2106251 - RNA, 18 nt, Human
acuugaaagcauccaugu

SEQ ID NO: 2106252 - RNA, 20 nt, Human
acuugaaagcauccaugugu

SEQ ID NO: 2106253 - RNA, 18 nt, Human
acuucuccacccugcucu

SEQ ID NO: 2106254 - RNA, 22 nt, Human
acuucuccagacccaccacacc

SEQ ID NO: 2106255 - RNA, 12 nt, Human
acuuccugucca

SEQ ID NO: 2106256 - RNA, 13 nt, Human
acuuccuguccag

SEQ ID NO: 2106257 - RNA, 14 nt, Human
acuuccuguccaga

SEQ ID NO: 2106258 - RNA, 14 nt, Human
acuuccugccuggu

SEQ ID NO: 2106259 - RNA, 16 nt, Human
acuuccugccuggucu

SEQ ID NO: 2106260 - RNA, 17 nt, Human
acuuccugccuggucuc

SEQ ID NO: 2106261 - RNA, 18 nt, Human
acuuccugccuggucucc

SEQ ID NO: 2106262 - RNA, 19 nt, Human
acuuccugccuggucuccu

SEQ ID NO: 2106263 - RNA, 21 nt, Human
acuuccugccuggucuccugc

SEQ ID NO: 2106264 - RNA, 22 nt, Human
acuuccugccuggucuccugcc

SEQ ID NO: 2106265 - RNA, 17 nt, Human
acuucgggaggucgagg

SEQ ID NO: 2106266 - RNA, 20 nt, Human
acuucgggaggucgaggcag

SEQ ID NO: 2106267 - RNA, 18 nt, Human
ucucacuccuaccuggua

SEQ ID NO: 2106268 - RNA, 17 nt, Human
ucucacuccuaccuggu

SEQ ID NO: 2106269 - RNA, 16 nt, Human
ucucacuccuaccugg

SEQ ID NO: 2106270 - RNA, 12 nt, Human
ucucacuccccu

SEQ ID NO: 2106271 - RNA, 13 nt, Human
ucucacuccccuc

SEQ ID NO: 2106272 - RNA, 15 nt, Human
ucucacuccccuccu

SEQ ID NO: 2106273 - RNA, 17 nt, Human
ucucacucccuucuccu

SEQ ID NO: 2106274 - RNA, 18 nt, Human
ucucacucccuucuccuu

SEQ ID NO: 2106275 - RNA, 20 nt, Human
ucucacucccuucuccuuga

SEQ ID NO: 2106276 - RNA, 13 nt, Human
ucucacuccacca

SEQ ID NO: 2106277 - RNA, 14 nt, Human
ucucacuccaccac

SEQ ID NO: 2106278 - RNA, 15 nt, Human
ucucacuccaccacc

SEQ ID NO: 2106279 - RNA, 13 nt, Human
ucucacuccuacc

SEQ ID NO: 2106280 - RNA, 18 nt, Human
ucucacuccaccacccaa

SEQ ID NO: 2106281 - RNA, 17 nt, Human
ucucacuccaccaccca

SEQ ID NO: 2106282 - RNA, 13 nt, Human
ucucaaaaaauaa

SEQ ID NO: 2106283 - RNA, 14 nt, Human
ucuauuuuuguaga

SEQ ID NO: 2106284 - RNA, 23 nt, Human
ucucacagugggagccagggcug

SEQ ID NO: 2106285 - RNA, 22 nt, Human
ucucacagugggagccagggcu

SEQ ID NO: 2106286 - RNA, 21 nt, Human
ucucacagugggagccagggc

SEQ ID NO: 2106287 - RNA, 19 nt, Human
ucucacagugggagccagg

SEQ ID NO: 2106288 - RNA, 12 nt, Human
ucucacaguggg

SEQ ID NO: 2106289 - RNA, 13 nt, Human
ucuauuuaaauuc

SEQ ID NO: 2106290 - RNA, 14 nt, Human
ucuauuuaaauucu

SEQ ID NO: 2106291 - RNA, 15 nt, Human
ucuauuuaaauucuu

SEQ ID NO: 2106292 - RNA, 17 nt, Human
ucuauuuaaauucuuuu

SEQ ID NO: 2106293 - RNA, 16 nt, Human
ucucaaaaaaagaaaa

SEQ ID NO: 2106294 - RNA, 13 nt, Human
ucuauuguaagau

SEQ ID NO: 2106295 - RNA, 19 nt, Human
ucuauuguaagauaaaaaa

SEQ ID NO: 2106296 - RNA, 22 nt, Human
ucuauuggguucauuauuggaa

SEQ ID NO: 2106297 - RNA, 16 nt, Human
ucuauuggguucauua

SEQ ID NO: 2106298 - RNA, 17 nt, Human
ucuauuggguucauuau

SEQ ID NO: 2106299 - RNA, 18 nt, Human
ucuauuggguucauuauu

SEQ ID NO: 2106300 - RNA, 21 nt, Human
ucuauauaguaccuuugcucu

SEQ ID NO: 2106301 - RNA, 13 nt, Human
ucuaguuuuguca

SEQ ID NO: 2106302 - RNA, 18 nt, Human
ucuauaggaacauaugaa

SEQ ID NO: 2106303 - RNA, 20 nt, Human
ucuauaggaacauaugaaaa

SEQ ID NO: 2106304 - RNA, 21 nt, Human
ucuauaggaacauaugaaaau

SEQ ID NO: 2106305 - RNA, 21 nt, Human
ucuaguuccugaugacccagg

SEQ ID NO: 2106306 - RNA, 11 nt, Human
ucuagcuguug

SEQ ID NO: 2106307 - RNA, 19 nt, Human
ucuagcuguugagcuguuu

SEQ ID NO: 2106308 - RNA, 18 nt, Human
ucuagcuguugagcuguu

SEQ ID NO: 2106309 - RNA, 15 nt, Human
ucuagcaaauguuau

SEQ ID NO: 2106310 - RNA, 16 nt, Human
ucuagcaaauguuaug

SEQ ID NO: 2106311 - RNA, 23 nt, Human
ucuagauuacccccucauuguuu

SEQ ID NO: 2106312 - RNA, 16 nt, Human
ucuagcuaauggaaaa

SEQ ID NO: 2106313 - RNA, 20 nt, Human
ucuagcuaauggaaaaugau

SEQ ID NO: 2106314 - RNA, 12 nt, Human
ucuagcaugaag

SEQ ID NO: 2106315 - RNA, 15 nt, Human
acuuccacugaugga

SEQ ID NO: 2106316 - RNA, 11 nt, Human
acuucccagcu

SEQ ID NO: 2106317 - RNA, 19 nt, Human
acuucccauuuuggaaguu

SEQ ID NO: 2106318 - RNA, 22 nt, Human
acuucccaguucaggaguccca

SEQ ID NO: 2106319 - RNA, 23 nt, Human
acuucccaguucaggagucccaa

SEQ ID NO: 2106320 - RNA, 24 nt, Human
acuucccaguucaggagucccaag

SEQ ID NO: 2106321 - RNA, 21 nt, Human
ucuagauuacccccucauugu

SEQ ID NO: 2106322 - RNA, 21 nt, Human
acuucauucuugaaagcugug

SEQ ID NO: 2106323 - RNA, 19 nt, Human
acuucauucuugaaagcug

SEQ ID NO: 2106324 - RNA, 15 nt, Human
acuucauucuugaaa

SEQ ID NO: 2106325 - RNA, 14 nt, Human
acuucauucuugaa

SEQ ID NO: 2106326 - RNA, 20 nt, Human
acuucaucuuccccaagugc

SEQ ID NO: 2106327 - RNA, 19 nt, Human
acuucagggcagggcucug

SEQ ID NO: 2106328 - RNA, 20 nt, Human
acuucagggcagggcucuga

SEQ ID NO: 2106329 - RNA, 21 nt, Human
acuucagggcagggcucugau

SEQ ID NO: 2106330 - RNA, 23 nt, Human
acuucagggcagggcucugauau

SEQ ID NO: 2106331 - RNA, 18 nt, Human
acuucaggcucuucuccu

SEQ ID NO: 2106332 - RNA, 17 nt, Human
acuucaggcucuucucc

SEQ ID NO: 2106333 - RNA, 20 nt, Human
acuucaggcucuucuccuuu

SEQ ID NO: 2106334 - RNA, 17 nt, Human
acuuaucuuacaaagug

SEQ ID NO: 2106335 - RNA, 18 nt, Human
acuuaucuuacaaagugu

SEQ ID NO: 2106336 - RNA, 20 nt, Human
acuuaucuuacaaaguguau

SEQ ID NO: 2106337 - RNA, 22 nt, Human
acuuaucuuacaaaguguauuu

SEQ ID NO: 2106338 - RNA, 17 nt, Human
acuuccauaaucuggac

SEQ ID NO: 2106339 - RNA, 20 nt, Human
acuuccagugcaacacugaa

SEQ ID NO: 2106340 - RNA, 17 nt, Human
acuuccaugaggccaaa

SEQ ID NO: 2106341 - RNA, 12 nt, Human
acuuccauagug

SEQ ID NO: 2106342 - RNA, 18 nt, Human
acuuccaauuuacauacu

SEQ ID NO: 2106343 - RNA, 22 nt, Human
acuuccaagaccugacucaggc

SEQ ID NO: 2106344 - RNA, 17 nt, Human
acuuccacugccauccu

SEQ ID NO: 2106345 - RNA, 14 nt, Human
acuuccaccagccu

SEQ ID NO: 2106346 - RNA, 15 nt, Human
acuuccaccagccug

SEQ ID NO: 2106347 - RNA, 16 nt, Human
acuuccaccagccugc

SEQ ID NO: 2106348 - RNA, 18 nt, Human
acuuccaccagccugcac

SEQ ID NO: 2106349 - RNA, 15 nt, Human
acuuagcaugcacaa

SEQ ID NO: 2106350 - RNA, 16 nt, Human
acuuagcaugcacaaa

SEQ ID NO: 2106351 - RNA, 17 nt, Human
acuuagcaugcacaaag

SEQ ID NO: 2106352 - RNA, 23 nt, Human
acuuagcaugcacaaaguguauu

SEQ ID NO: 2106353 - RNA, 19 nt, Human
acuuauauuuuuaauaaaa

SEQ ID NO: 2106354 - RNA, 16 nt, Human
acuucaggcucuucuc

SEQ ID NO: 2106355 - RNA, 19 nt, Human
acuuauccuaaaacaaaua

SEQ ID NO: 2106356 - RNA, 18 nt, Human
acuuauccuaaaacaaau

SEQ ID NO: 2106357 - RNA, 20 nt, Human
acuuagagguggggagcaga

SEQ ID NO: 2106358 - RNA, 23 nt, Human
acuuugaggguguauauuuucug

SEQ ID NO: 2106359 - RNA, 15 nt, Human
acuuugaagauguca

SEQ ID NO: 2106360 - RNA, 15 nt, Human
acuuugcucuuucuu

SEQ ID NO: 2106361 - RNA, 17 nt, Human
acuuugcucuuucuuga

SEQ ID NO: 2106362 - RNA, 14 nt, Human
acuuuguaugauau

SEQ ID NO: 2106363 - RNA, 15 nt, Human
acuuuguaugauauu

SEQ ID NO: 2106364 - RNA, 16 nt, Human
acuuuguaugauauuc

SEQ ID NO: 2106365 - RNA, 20 nt, Human
acuuuguaugauauuccaua

SEQ ID NO: 2106366 - RNA, 22 nt, Human
acuuuguaugauauuccauagu

SEQ ID NO: 2106367 - RNA, 12 nt, Human
acuuuagaaaua

SEQ ID NO: 2106368 - RNA, 14 nt, Human
acuuuagaaauaaa

SEQ ID NO: 2106369 - RNA, 15 nt, Human
acuuuagaaugagag

SEQ ID NO: 2106370 - RNA, 15 nt, Human
acuuuagaguagcau

SEQ ID NO: 2106371 - RNA, 19 nt, Human
acuuuagaguagcaugaga

SEQ ID NO: 2106372 - RNA, 21 nt, Human
acuuuagaguagcaugagaga

SEQ ID NO: 2106373 - RNA, 20 nt, Human
acuuuagcagaaucaaaaug

SEQ ID NO: 2106374 - RNA, 20 nt, Human
acuuucuuuucgccguggcu

SEQ ID NO: 2106375 - RNA, 21 nt, Human
acuuucuuuucgccguggcug

SEQ ID NO: 2106376 - RNA, 14 nt, Human
acuuguggacacag

SEQ ID NO: 2106377 - RNA, 12 nt, Human
acuugucuuaaa

SEQ ID NO: 2106378 - RNA, 19 nt, Human
acuugucuuaaauaaaaga

SEQ ID NO: 2106379 - RNA, 23 nt, Human
acuugucuuaaauaaaagaaaug

SEQ ID NO: 2106380 - RNA, 16 nt, Human
acuuuaaaaggagcca

SEQ ID NO: 2106381 - RNA, 18 nt, Human
acuuguuuucaaaccagu

SEQ ID NO: 2106382 - RNA, 22 nt, Human
acuugugcugaucgugcuaaau

SEQ ID NO: 2106383 - RNA, 15 nt, Human
acuuguggacacagc

SEQ ID NO: 2106384 - RNA, 15 nt, Human
ucuccuuagaagugg

SEQ ID NO: 2106385 - RNA, 21 nt, Human
ucuccuuagaaguggaaguag

SEQ ID NO: 2106386 - RNA, 14 nt, Human
ucuccuuagucuuc

SEQ ID NO: 2106387 - RNA, 14 nt, Human
ucuccuguccaacc

SEQ ID NO: 2106388 - RNA, 17 nt, Human
ucuccugugcaugggug

SEQ ID NO: 2106389 - RNA, 16 nt, Human
ucuccuguccaaccua

SEQ ID NO: 2106390 - RNA, 23 nt, Human
ucuccugugcaugggugaaggga

SEQ ID NO: 2106391 - RNA, 16 nt, Human
acuuuguguucaccuu

SEQ ID NO: 2106392 - RNA, 15 nt, Human
acuuugucagaggca

SEQ ID NO: 2106393 - RNA, 13 nt, Human
agaaaaaaaacac

SEQ ID NO: 2106394 - RNA, 17 nt, Human
agaaaaaaaauaacaca

SEQ ID NO: 2106395 - RNA, 19 nt, Human
agaaaaaaaauaacacaga

SEQ ID NO: 2106396 - RNA, 20 nt, Human
agaaaaaaaauaacacagag

SEQ ID NO: 2106397 - RNA, 17 nt, Human
agaaaaaaagauuuauu

SEQ ID NO: 2106398 - RNA, 14 nt, Human
acuuugugcuacau

SEQ ID NO: 2106399 - RNA, 13 nt, Human
agaaaaaaaccau

SEQ ID NO: 2106400 - RNA, 21 nt, Human
agaaaaaaaguuugccagaag

SEQ ID NO: 2106401 - RNA, 14 nt, Human
agaaaaaaauaauu

SEQ ID NO: 2106402 - RNA, 22 nt, Human
agaaaaaaauaauuuuaugaac

SEQ ID NO: 2106403 - RNA, 18 nt, Human
acuuuguguucaccuugu

SEQ ID NO: 2106404 - RNA, 17 nt, Human
ucucgcucuguugccca

SEQ ID NO: 2106405 - RNA, 17 nt, Human
ucucggaaggcuggcug

SEQ ID NO: 2106406 - RNA, 13 nt, Human
ucuccuugcccua

SEQ ID NO: 2106407 - RNA, 16 nt, Human
ucuccuugauaacagc

SEQ ID NO: 2106408 - RNA, 17 nt, Human
ucuccuugauaacagcu

SEQ ID NO: 2106409 - RNA, 18 nt, Human
ucuccuugauaacagcua

SEQ ID NO: 2106410 - RNA, 19 nt, Human
ucuccuugcccuagaugag

SEQ ID NO: 2106411 - RNA, 23 nt, Human
ucucgaacauggaacucauuccu

SEQ ID NO: 2106412 - RNA, 14 nt, Human
ucucuccauucccg

SEQ ID NO: 2106413 - RNA, 13 nt, Human
ucucuccagugca

SEQ ID NO: 2106414 - RNA, 19 nt, Human
ucucuccaucagaggacac

SEQ ID NO: 2106415 - RNA, 20 nt, Human
ucucuccaucagaggacacc

SEQ ID NO: 2106416 - RNA, 19 nt, Human
ucucggaguaucugggaac

SEQ ID NO: 2106417 - RNA, 20 nt, Human
agaaaugcugguuuuucagu

SEQ ID NO: 2106418 - RNA, 21 nt, Human
agaaaugcugguuuuucaguu

SEQ ID NO: 2106419 - RNA, 21 nt, Human
agaaaugggaaaugccuaaga

SEQ ID NO: 2106420 - RNA, 23 nt, Human
agaaaugggaaaugccuaagaag

SEQ ID NO: 2106421 - RNA, 18 nt, Human
agaaauagacaguauauu

SEQ ID NO: 2106422 - RNA, 20 nt, Human
agaaauagccugcgcuguuu

SEQ ID NO: 2106423 - RNA, 23 nt, Human
agaaauaccaaaauuauuucaga

SEQ ID NO: 2106424 - RNA, 18 nt, Human
agaaauaccaaaauuauu

SEQ ID NO: 2106425 - RNA, 14 nt, Human
agaaaucuagaaga

SEQ ID NO: 2106426 - RNA, 18 nt, Human
agaaaucucacuuuucuc

SEQ ID NO: 2106427 - RNA, 19 nt, Human
agaaauacaauucuacauu

SEQ ID NO: 2106428 - RNA, 14 nt, Human
agaaagcagaggcu

SEQ ID NO: 2106429 - RNA, 15 nt, Human
agaaagcagaggcug

SEQ ID NO: 2106430 - RNA, 16 nt, Human
agaaagcagaggcugg

SEQ ID NO: 2106431 - RNA, 23 nt, Human
agaaagcagaggcuggccucaga

SEQ ID NO: 2106432 - RNA, 14 nt, Human
agaaagcauaaaau

SEQ ID NO: 2106433 - RNA, 23 nt, Human
agaaagaguuugagaccugaaua

SEQ ID NO: 2106434 - RNA, 19 nt, Human
agaaagauggaugugcuuu

SEQ ID NO: 2106435 - RNA, 20 nt, Human
agaaagacuaucuaaauguu

SEQ ID NO: 2106436 - RNA, 22 nt, Human
agaaagacuaucuaaauguuga

SEQ ID NO: 2106437 - RNA, 18 nt, Human
agaaagacagagcuggga

SEQ ID NO: 2106438 - RNA, 12 nt, Human
agaaagacugag

SEQ ID NO: 2106439 - RNA, 23 nt, Human
agaaagagagagaauucuuucaa

SEQ ID NO: 2106440 - RNA, 11 nt, Human
agaaagagagc

SEQ ID NO: 2106441 - RNA, 14 nt, Human
ucucucccuccccu

SEQ ID NO: 2106442 - RNA, 19 nt, Human
agaaaaaauauuuucccua

SEQ ID NO: 2106443 - RNA, 21 nt, Human
ucucucccuccccugccauuu

SEQ ID NO: 2106444 - RNA, 16 nt, Human
ucucuugguuuccuuc

SEQ ID NO: 2106445 - RNA, 17 nt, Human
ucucuugguuuccuucc

SEQ ID NO: 2106446 - RNA, 18 nt, Human
ucucuugguuuccuuccu

SEQ ID NO: 2106447 - RNA, 17 nt, Human
agaaaaaauauuuuccu

SEQ ID NO: 2106448 - RNA, 23 nt, Human
agaaaaaauauuuuccugccagg

SEQ ID NO: 2106449 - RNA, 20 nt, Human
agaaaacaaaaaaaccucua

SEQ ID NO: 2106450 - RNA, 19 nt, Human
ucucuugguuuccuuccuu

SEQ ID NO: 2106451 - RNA, 13 nt, Human
agaaaaacaauaa

SEQ ID NO: 2106452 - RNA, 16 nt, Human
agaaaaacaauaagag

SEQ ID NO: 2106453 - RNA, 18 nt, Human
agaaaaaugagccuggca

SEQ ID NO: 2106454 - RNA, 14 nt, Human
agaaacacaauauu

SEQ ID NO: 2106455 - RNA, 15 nt, Human
agaaacacacugagg

SEQ ID NO: 2106456 - RNA, 17 nt, Human
agaaacacacugaggca

SEQ ID NO: 2106457 - RNA, 19 nt, Human
agaaacacacugaggcagg

SEQ ID NO: 2106458 - RNA, 20 nt, Human
agaaacacacugaggcaggg

SEQ ID NO: 2106459 - RNA, 15 nt, Human
agaaaagcaccugcc

SEQ ID NO: 2106460 - RNA, 16 nt, Human
agaaaagcaccugccg

SEQ ID NO: 2106461 - RNA, 18 nt, Human
agaaaagcaccugccgac

SEQ ID NO: 2106462 - RNA, 20 nt, Human
agaaaagauacgacuuuauu

SEQ ID NO: 2106463 - RNA, 22 nt, Human
agaaacacacugaggcagggaa

SEQ ID NO: 2106464 - RNA, 14 nt, Human
agaaacaucaguua

SEQ ID NO: 2106465 - RNA, 16 nt, Human
agaaacaucaguuacu

SEQ ID NO: 2106466 - RNA, 21 nt, Human
agaaacaucaguuacucugaa

SEQ ID NO: 2106467 - RNA, 23 nt, Human
agaaacaucaguuacucugaagg

SEQ ID NO: 2106468 - RNA, 14 nt, Human
agaaacuguagucu

SEQ ID NO: 2106469 - RNA, 20 nt, Human
agaaacuguagucucaggac

SEQ ID NO: 2106470 - RNA, 21 nt, Human
agaacugaauuuugucuuuau

SEQ ID NO: 2106471 - RNA, 14 nt, Human
agaacuccuagggu

SEQ ID NO: 2106472 - RNA, 12 nt, Human
agaacugagcuc

SEQ ID NO: 2106473 - RNA, 15 nt, Human
agaacugagcuccuc

SEQ ID NO: 2106474 - RNA, 16 nt, Human
agaacugagcuccucu

SEQ ID NO: 2106475 - RNA, 22 nt, Human
agaacugagcuccucugggcag

SEQ ID NO: 2106476 - RNA, 17 nt, Human
agaacugaugacacuga

SEQ ID NO: 2106477 - RNA, 15 nt, Human
agaacugcauauguu

SEQ ID NO: 2106478 - RNA, 19 nt, Human
agaacugcauauguuucgc

SEQ ID NO: 2106479 - RNA, 20 nt, Human
agaacugcauauguuucgcu

SEQ ID NO: 2106480 - RNA, 21 nt, Human
agaacugcauauguuucgcug

SEQ ID NO: 2106481 - RNA, 11 nt, Human
agaacuccuag

SEQ ID NO: 2106482 - RNA, 14 nt, Human
agaaccuguccuug

SEQ ID NO: 2106483 - RNA, 21 nt, Human
agaaccuguccuugcacacuc

SEQ ID NO: 2106484 - RNA, 22 nt, Human
agaacggacgagauaaugugaa

SEQ ID NO: 2106485 - RNA, 20 nt, Human
agaacuagagguuuuaugau

SEQ ID NO: 2106486 - RNA, 23 nt, Human
agaacuagagguuuuaugauauu

SEQ ID NO: 2106487 - RNA, 19 nt, Human
agaacuacucagggaauga

SEQ ID NO: 2106488 - RNA, 22 nt, Human
agaacuacucagggaaugaagg

SEQ ID NO: 2106489 - RNA, 22 nt, Human
agaacuagugguggcucugaga

SEQ ID NO: 2106490 - RNA, 14 nt, Human
ucugaaguuggaca

SEQ ID NO: 2106491 - RNA, 15 nt, Human
ucugaaguuggacag

SEQ ID NO: 2106492 - RNA, 16 nt, Human
ucugaaguuggacagc

SEQ ID NO: 2106493 - RNA, 16 nt, Human
ucugaaguuucauuua

SEQ ID NO: 2106494 - RNA, 17 nt, Human
ucugaaguuucauuuau

SEQ ID NO: 2106495 - RNA, 18 nt, Human
ucugaaguuucauuuaug

SEQ ID NO: 2106496 - RNA, 17 nt, Human
ucugaauaccucuuuga

SEQ ID NO: 2106497 - RNA, 19 nt, Human
ucugaauaccucuuugaaa

SEQ ID NO: 2106498 - RNA, 13 nt, Human
ucugaauccuaag

SEQ ID NO: 2106499 - RNA, 12 nt, Human
agaaccuguccu

SEQ ID NO: 2106500 - RNA, 13 nt, Human
agaaccuguccuu

SEQ ID NO: 2106501 - RNA, 17 nt, Human
agaaauuagcuguguga

SEQ ID NO: 2106502 - RNA, 15 nt, Human
agaaauuagccgggc

SEQ ID NO: 2106503 - RNA, 15 nt, Human
agaaauuagcugugu

SEQ ID NO: 2106504 - RNA, 14 nt, Human
agaaauuagccggg

SEQ ID NO: 2106505 - RNA, 14 nt, Human
ucugcccauucccc

SEQ ID NO: 2106506 - RNA, 16 nt, Human
ucugcccauuccccag

SEQ ID NO: 2106507 - RNA, 18 nt, Human
ucugcccauuccccagcc

SEQ ID NO: 2106508 - RNA, 19 nt, Human
ucugcccauuccccagccu

SEQ ID NO: 2106509 - RNA, 14 nt, Human
ucugccccagcucu

SEQ ID NO: 2106510 - RNA, 20 nt, Human
ucugccccagcucuggcuuc

SEQ ID NO: 2106511 - RNA, 16 nt, Human
ucugccccagcucugg

SEQ ID NO: 2106512 - RNA, 17 nt, Human
ucugccccagcucuggc

SEQ ID NO: 2106513 - RNA, 13 nt, Human
ucugcccagagcu

SEQ ID NO: 2106514 - RNA, 16 nt, Human
ucugcccagagcuggg

SEQ ID NO: 2106515 - RNA, 18 nt, Human
ucugcccagagcugggug

SEQ ID NO: 2106516 - RNA, 19 nt, Human
ucugcccagagcuggguga

SEQ ID NO: 2106517 - RNA, 15 nt, Human
agaagcaagaaagaa

SEQ ID NO: 2106518 - RNA, 16 nt, Human
agaagcagaggaagga

SEQ ID NO: 2106519 - RNA, 16 nt, Human
agaacugcauggaccu

SEQ ID NO: 2106520 - RNA, 17 nt, Human
agaacugcauggaccua

SEQ ID NO: 2106521 - RNA, 20 nt, Human
agaacugcauggaccuaaca

SEQ ID NO: 2106522 - RNA, 21 nt, Human
agaacuuuugguaagggaaaa

SEQ ID NO: 2106523 - RNA, 18 nt, Human
agaagcccaauauuauaa

SEQ ID NO: 2106524 - RNA, 13 nt, Human
agaagcagugagc

SEQ ID NO: 2106525 - RNA, 14 nt, Human
agaagcagugagcc

SEQ ID NO: 2106526 - RNA, 17 nt, Human
agaagcagugagccgca

SEQ ID NO: 2106527 - RNA, 23 nt, Human
agaagcagugagccgcaucuucu

SEQ ID NO: 2106528 - RNA, 13 nt, Human
agaagcaugaaaa

SEQ ID NO: 2106529 - RNA, 15 nt, Human
agaagcaugaaaaag

SEQ ID NO: 2106530 - RNA, 16 nt, Human
agaagcaugaaaaagc

SEQ ID NO: 2106531 - RNA, 23 nt, Human
agaagcucccugaaguaagcaaa

SEQ ID NO: 2106532 - RNA, 14 nt, Human
agaaggagacagag

SEQ ID NO: 2106533 - RNA, 17 nt, Human
agaaggagacagagcug

SEQ ID NO: 2106534 - RNA, 15 nt, Human
agaagcugagcacca

SEQ ID NO: 2106535 - RNA, 22 nt, Human
agaaggaauucuaggcauccca

SEQ ID NO: 2106536 - RNA, 15 nt, Human
agaaggaauuugagu

SEQ ID NO: 2106537 - RNA, 15 nt, Human
agaaggagaaggaag

SEQ ID NO: 2106538 - RNA, 17 nt, Human
agaagugaccaaggagg

SEQ ID NO: 2106539 - RNA, 18 nt, Human
agaagugaccaaggagga

SEQ ID NO: 2106540 - RNA, 17 nt, Human
agaaggauguacauuuc

SEQ ID NO: 2106541 - RNA, 20 nt, Human
agaaggagacagagcugguu

SEQ ID NO: 2106542 - RNA, 18 nt, Human
agaaggaggagagggaaa

SEQ ID NO: 2106543 - RNA, 19 nt, Human
agaaggaggagagggaaaa

SEQ ID NO: 2106544 - RNA, 22 nt, Human
agaaggaggagagggaaaaugu

SEQ ID NO: 2106545 - RNA, 23 nt, Human
agaaggaggagagggaaaauguu

SEQ ID NO: 2106546 - RNA, 14 nt, Human
agaaggaugaauga

SEQ ID NO: 2106547 - RNA, 21 nt, Human
agaaggaugaaugagguccca

SEQ ID NO: 2106548 - RNA, 16 nt, Human
agaaggauguacauuu

SEQ ID NO: 2106549 - RNA, 17 nt, Human
agaaguggaccaggaca

SEQ ID NO: 2106550 - RNA, 18 nt, Human
agaaguggaccaggacag

SEQ ID NO: 2106551 - RNA, 19 nt, Human
agaaguggaccaggacagg

SEQ ID NO: 2106552 - RNA, 13 nt, Human
agaagugccccug

SEQ ID NO: 2106553 - RNA, 14 nt, Human
agaagugccccugc

SEQ ID NO: 2106554 - RNA, 16 nt, Human
agaagugccccugcug

SEQ ID NO: 2106555 - RNA, 22 nt, Human
agaagugccccugcugccuccc

SEQ ID NO: 2106556 - RNA, 19 nt, Human
agaagugccccugcugccu

SEQ ID NO: 2106557 - RNA, 15 nt, Human
agaaguggaccagga

SEQ ID NO: 2106558 - RNA, 19 nt, Human
agaaguuucuuuaaagacg

SEQ ID NO: 2106559 - RNA, 16 nt, Human
agaaguuuagauuuua

SEQ ID NO: 2106560 - RNA, 15 nt, Human
agaaguuuagauuuu

SEQ ID NO: 2106561 - RNA, 22 nt, Human
agaaguuugagaucagccuggg

SEQ ID NO: 2106562 - RNA, 21 nt, Human
agaauaaugugggaagaaaca

SEQ ID NO: 2106563 - RNA, 22 nt, Human
agaauaaugugggaagaaacaa

SEQ ID NO: 2106564 - RNA, 15 nt, Human
agaauaaugaaugga

SEQ ID NO: 2106565 - RNA, 16 nt, Human
agaauaaucuuugggu

SEQ ID NO: 2106566 - RNA, 15 nt, Human
agaauacaaacauau

SEQ ID NO: 2106567 - RNA, 16 nt, Human
agaauacaaacauauu

SEQ ID NO: 2106568 - RNA, 12 nt, Human
agaauacagaaa

SEQ ID NO: 2106569 - RNA, 18 nt, Human
agaauacagaaagaugga

SEQ ID NO: 2106570 - RNA, 21 nt, Human
agaauacagaaagauggaugu

SEQ ID NO: 2106571 - RNA, 15 nt, Human
agaauaauucuuuga

SEQ ID NO: 2106572 - RNA, 14 nt, Human
agaauauaauuauc

SEQ ID NO: 2106573 - RNA, 15 nt, Human
agaauauaauuaucg

SEQ ID NO: 2106574 - RNA, 23 nt, Human
agaauauaauuaucggaagcagu

SEQ ID NO: 2106575 - RNA, 17 nt, Human
agaauauaauuaucgga

SEQ ID NO: 2106576 - RNA, 14 nt, Human
agaaucaaaacucu

SEQ ID NO: 2106577 - RNA, 21 nt, Human
agaauaaaguucugaguguuu

SEQ ID NO: 2106578 - RNA, 17 nt, Human
agaauaaaguucugagu

SEQ ID NO: 2106579 - RNA, 13 nt, Human
agaauaaucuuug

SEQ ID NO: 2106580 - RNA, 15 nt, Human
agaaguuugucaagu

SEQ ID NO: 2106581 - RNA, 15 nt, Human
ucuggccuuacaccu

SEQ ID NO: 2106582 - RNA, 14 nt, Human
agaagccgggaaca

SEQ ID NO: 2106583 - RNA, 16 nt, Human
agaagccgggaacaga

SEQ ID NO: 2106584 - RNA, 18 nt, Human
agaagccgggaacagaca

SEQ ID NO: 2106585 - RNA, 22 nt, Human
agaagccgggaacagacaacag

SEQ ID NO: 2106586 - RNA, 14 nt, Human
agaagccgugggug

SEQ ID NO: 2106587 - RNA, 17 nt, Human
agaagccugaggcuggg

SEQ ID NO: 2106588 - RNA, 12 nt, Human
agaagccugagg

SEQ ID NO: 2106589 - RNA, 14 nt, Human
agaagccugaggcu

SEQ ID NO: 2106590 - RNA, 16 nt, Human
agaagccucuggcuag

SEQ ID NO: 2106591 - RNA, 23 nt, Human
agaagccucuggcuagaggccag

SEQ ID NO: 2106592 - RNA, 14 nt, Human
agaagccuauugua

SEQ ID NO: 2106593 - RNA, 15 nt, Human
agaagccuauuguaa

SEQ ID NO: 2106594 - RNA, 22 nt, Human
agaagccuauuguaaauacaag

SEQ ID NO: 2106595 - RNA, 23 nt, Human
agaagccuauuguaaauacaagu

SEQ ID NO: 2106596 - RNA, 12 nt, Human
agaagccucugg

SEQ ID NO: 2106597 - RNA, 13 nt, Human
agaagccucuggc

SEQ ID NO: 2106598 - RNA, 14 nt, Human
agaagccucuggcu

SEQ ID NO: 2106599 - RNA, 19 nt, Human
ucuggcagggugggaugga

SEQ ID NO: 2106600 - RNA, 20 nt, Human
ucuggcagggugggauggag

SEQ ID NO: 2106601 - RNA, 14 nt, Human
ucugccugucuccc

SEQ ID NO: 2106602 - RNA, 12 nt, Human
ucugccugucuc

SEQ ID NO: 2106603 - RNA, 18 nt, Human
ucugcccuugccaacgga

SEQ ID NO: 2106604 - RNA, 13 nt, Human
ucugccugucccu

SEQ ID NO: 2106605 - RNA, 17 nt, Human
ucugccugucccucuca

SEQ ID NO: 2106606 - RNA, 18 nt, Human
ucugccugucccucucag

SEQ ID NO: 2106607 - RNA, 21 nt, Human
ucugccugucccucucaggca

SEQ ID NO: 2106608 - RNA, 11 nt, Human
ucugccuguga

SEQ ID NO: 2106609 - RNA, 14 nt, Human
ucugccugugagcc

SEQ ID NO: 2106610 - RNA, 17 nt, Human
ucugccugugagccagu

SEQ ID NO: 2106611 - RNA, 21 nt, Human
ucugcuuugacugagcagacu

SEQ ID NO: 2106612 - RNA, 22 nt, Human
ucugcuuugggguuuaucagaa

SEQ ID NO: 2106613 - RNA, 14 nt, Human
ucuggauuguggga

SEQ ID NO: 2106614 - RNA, 13 nt, Human
ucuggaagagagg

SEQ ID NO: 2106615 - RNA, 20 nt, Human
ucuggaagagaggaaugccu

SEQ ID NO: 2106616 - RNA, 22 nt, Human
ugaaaaaguauccugcuucuga

SEQ ID NO: 2106617 - RNA, 20 nt, Human
ugaaaaaggaggaagagaaa

SEQ ID NO: 2106618 - RNA, 22 nt, Human
ugaaaaaggaggaagagaaaaa

SEQ ID NO: 2106619 - RNA, 18 nt, Human
ugaaaaaucggcuuacca

SEQ ID NO: 2106620 - RNA, 13 nt, Human
ugaaaaauucuca

SEQ ID NO: 2106621 - RNA, 18 nt, Human
ugaaaaauuuaagcauug

SEQ ID NO: 2106622 - RNA, 19 nt, Human
ugaaaaauuuaagcauugu

SEQ ID NO: 2106623 - RNA, 20 nt, Human
ugaaaaauuuaagcauuguu

SEQ ID NO: 2106624 - RNA, 16 nt, Human
ugaaaaucgugacaac

SEQ ID NO: 2106625 - RNA, 12 nt, Human
ugaaaaggaaga

SEQ ID NO: 2106626 - RNA, 19 nt, Human
ugaaaaucgugacaacacu

SEQ ID NO: 2106627 - RNA, 17 nt, Human
ugaaaauguauguguaa

SEQ ID NO: 2106628 - RNA, 19 nt, Human
ugaaaauauuaucuuugua

SEQ ID NO: 2106629 - RNA, 20 nt, Human
ugaaaauauuaucuuuguaa

SEQ ID NO: 2106630 - RNA, 21 nt, Human
ugaaaaugucagaaaccaguu

SEQ ID NO: 2106631 - RNA, 14 nt, Human
ugaaaaugucagaa

SEQ ID NO: 2106632 - RNA, 15 nt, Human
ugaaaaugucagaaa

SEQ ID NO: 2106633 - RNA, 18 nt, Human
ugaaaaugucagaaacca

SEQ ID NO: 2106634 - RNA, 15 nt, Human
ugaaacuagacuuga

SEQ ID NO: 2106635 - RNA, 20 nt, Human
ugaaacuagacuugaggaaa

SEQ ID NO: 2106636 - RNA, 14 nt, Human
ugaaacuaaugaaa

SEQ ID NO: 2106637 - RNA, 16 nt, Human
ugaaacuuacacacaa

SEQ ID NO: 2106638 - RNA, 21 nt, Human
ucuuucugcagaaacagaaag

SEQ ID NO: 2106639 - RNA, 16 nt, Human
ucuuucugaugucaaa

SEQ ID NO: 2106640 - RNA, 23 nt, Human
agagacaggaaaauccucuggcu

SEQ ID NO: 2106641 - RNA, 16 nt, Human
ucuuuggugaacauug

SEQ ID NO: 2106642 - RNA, 20 nt, Human
agagacaggcccaagagaug

SEQ ID NO: 2106643 - RNA, 15 nt, Human
agagacaggcccaag

SEQ ID NO: 2106644 - RNA, 18 nt, Human
agagacaggcccaagaga

SEQ ID NO: 2106645 - RNA, 22 nt, Human
ucuuuggugaacauugcaauag

SEQ ID NO: 2106646 - RNA, 13 nt, Human
ucuuuggugccuu

SEQ ID NO: 2106647 - RNA, 15 nt, Human
ucuuuggugccuuuc

SEQ ID NO: 2106648 - RNA, 17 nt, Human
ucuuuggugccuuuccu

SEQ ID NO: 2106649 - RNA, 18 nt, Human
ucuuuggugccuuuccug

SEQ ID NO: 2106650 - RNA, 20 nt, Human
ucuuuggugccuuuccuguu

SEQ ID NO: 2106651 - RNA, 22 nt, Human
ucuuuggugccuuuccuguuca

SEQ ID NO: 2106652 - RNA, 23 nt, Human
ucuuuggugccuuuccuguucag

SEQ ID NO: 2106653 - RNA, 12 nt, Human
ugaaaaaaauug

SEQ ID NO: 2106654 - RNA, 20 nt, Human
ugaaaaaaauuggcauuaaa

SEQ ID NO: 2106655 - RNA, 21 nt, Human
ugaaaaaagaaauucccugga

SEQ ID NO: 2106656 - RNA, 17 nt, Human
ugaaaaaagcuuuuaug

SEQ ID NO: 2106657 - RNA, 19 nt, Human
ugaaaaaagcuuuuaugag

SEQ ID NO: 2106658 - RNA, 12 nt, Human
ugaaaaacuucc

SEQ ID NO: 2106659 - RNA, 16 nt, Human
ugaaaaaggaggaaga

SEQ ID NO: 2106660 - RNA, 13 nt, Human
ugaaaaagcagac

SEQ ID NO: 2106661 - RNA, 21 nt, Human
ugaaaaagcagcuaccaggug

SEQ ID NO: 2106662 - RNA, 12 nt, Human
ucuuuguuuugu

SEQ ID NO: 2106663 - RNA, 18 nt, Human
ucuuuguuggaaaagaau

SEQ ID NO: 2106664 - RNA, 18 nt, Human
ucuuuguuaagacugcug

SEQ ID NO: 2106665 - RNA, 15 nt, Human
ucuuuguuacaggca

SEQ ID NO: 2106666 - RNA, 14 nt, Human
ucuuuuacauucug

SEQ ID NO: 2106667 - RNA, 18 nt, Human
ucuuuuacucaugaucuu

SEQ ID NO: 2106668 - RNA, 14 nt, Human
ugaaaaaaaaguuu

SEQ ID NO: 2106669 - RNA, 16 nt, Human
ugaaaaaaaaguuuca

SEQ ID NO: 2106670 - RNA, 22 nt, Human
agagaucaaccccuucgcuccu

SEQ ID NO: 2106671 - RNA, 20 nt, Human
agagagaacaacuacuguga

SEQ ID NO: 2106672 - RNA, 20 nt, Human
agagauauguagaaggcaca

SEQ ID NO: 2106673 - RNA, 21 nt, Human
agagagaaagaaguaggcaug

SEQ ID NO: 2106674 - RNA, 23 nt, Human
agagaugggacugggagggccca

SEQ ID NO: 2106675 - RNA, 16 nt, Human
agagaugggacuggga

SEQ ID NO: 2106676 - RNA, 22 nt, Human
agagaugggacugggagggccc

SEQ ID NO: 2106677 - RNA, 18 nt, Human
agagauggaggaggaggc

SEQ ID NO: 2106678 - RNA, 15 nt, Human
agagaucaugagaaa

SEQ ID NO: 2106679 - RNA, 16 nt, Human
agagaucaugagaaau

SEQ ID NO: 2106680 - RNA, 15 nt, Human
agagcaaagggccag

SEQ ID NO: 2106681 - RNA, 16 nt, Human
agagcaaagggccagg

SEQ ID NO: 2106682 - RNA, 19 nt, Human
agagcaaagggccaggaag

SEQ ID NO: 2106683 - RNA, 13 nt, Human
ugaaagacuguac

SEQ ID NO: 2106684 - RNA, 15 nt, Human
ugaaagacuguacaa

SEQ ID NO: 2106685 - RNA, 19 nt, Human
ugaaagaccuucuccaaau

SEQ ID NO: 2106686 - RNA, 12 nt, Human
ugaaagaccuuc

SEQ ID NO: 2106687 - RNA, 17 nt, Human
ugaaagaccuucuccaa

SEQ ID NO: 2106688 - RNA, 13 nt, Human
ugaaagaagaaaa

SEQ ID NO: 2106689 - RNA, 21 nt, Human
ugaaagaaaggggcaggagcu

SEQ ID NO: 2106690 - RNA, 12 nt, Human
ugaaagaaauca

SEQ ID NO: 2106691 - RNA, 14 nt, Human
ugaaagaaaucaug

SEQ ID NO: 2106692 - RNA, 16 nt, Human
ugaaagaaaucauguu

SEQ ID NO: 2106693 - RNA, 17 nt, Human
ugaaagaaaucauguua

SEQ ID NO: 2106694 - RNA, 18 nt, Human
ugaaagaaaucauguuau

SEQ ID NO: 2106695 - RNA, 22 nt, Human
ugaaagaaaucauguuaugaua

SEQ ID NO: 2106696 - RNA, 18 nt, Human
ugaaacuucaagcaccag

SEQ ID NO: 2106697 - RNA, 16 nt, Human
agagacuccagcuggg

SEQ ID NO: 2106698 - RNA, 19 nt, Human
agagacucagggccccagc

SEQ ID NO: 2106699 - RNA, 20 nt, Human
agagacucagggccccagca

SEQ ID NO: 2106700 - RNA, 19 nt, Human
agagcagccuguggcaucu

SEQ ID NO: 2106701 - RNA, 12 nt, Human
agagcagccugu

SEQ ID NO: 2106702 - RNA, 16 nt, Human
agagcagccuguggca

SEQ ID NO: 2106703 - RNA, 17 nt, Human
agagcagccuguggcau

SEQ ID NO: 2106704 - RNA, 14 nt, Human
agagcaagacucug

SEQ ID NO: 2106705 - RNA, 23 nt, Human
agagcaguuugguuucuagcaug

SEQ ID NO: 2106706 - RNA, 21 nt, Human
agagcaguuugguuucuagca

SEQ ID NO: 2106707 - RNA, 13 nt, Human
agagccagcuccc

SEQ ID NO: 2106708 - RNA, 22 nt, Human
agagccagcccucccuguccuc

SEQ ID NO: 2106709 - RNA, 12 nt, Human
agagccagcccu

SEQ ID NO: 2106710 - RNA, 13 nt, Human
agagccagcccuc

SEQ ID NO: 2106711 - RNA, 14 nt, Human
agagccagcccucc

SEQ ID NO: 2106712 - RNA, 16 nt, Human
agagccagcccucccu

SEQ ID NO: 2106713 - RNA, 17 nt, Human
agagccagcccucccug

SEQ ID NO: 2106714 - RNA, 20 nt, Human
agagccagcccucccugucc

SEQ ID NO: 2106715 - RNA, 21 nt, Human
agagccagcccucccuguccu

SEQ ID NO: 2106716 - RNA, 13 nt, Human
agagcuauacagu

SEQ ID NO: 2106717 - RNA, 19 nt, Human
agagcuauacaguuuuccu

SEQ ID NO: 2106718 - RNA, 16 nt, Human
agagcuagcgcugccg

SEQ ID NO: 2106719 - RNA, 21 nt, Human
agagcuagcgcugccgcaccc

SEQ ID NO: 2106720 - RNA, 13 nt, Human
agagcuagcgcug

SEQ ID NO: 2106721 - RNA, 14 nt, Human
agagcuagcgcugc

SEQ ID NO: 2106722 - RNA, 23 nt, Human
agagcuccuccuugucuuggcag

SEQ ID NO: 2106723 - RNA, 14 nt, Human
agagcucuggagcc

SEQ ID NO: 2106724 - RNA, 18 nt, Human
agagcucuggagccaccu

SEQ ID NO: 2106725 - RNA, 19 nt, Human
agagcucuggagccaccug

SEQ ID NO: 2106726 - RNA, 20 nt, Human
agagcucuggagccaccugu

SEQ ID NO: 2106727 - RNA, 22 nt, Human
agagcucuggagccaccugucc

SEQ ID NO: 2106728 - RNA, 11 nt, Human
agagcugaggc

SEQ ID NO: 2106729 - RNA, 15 nt, Human
agagcugagugagcu

SEQ ID NO: 2106730 - RNA, 20 nt, Human
agagcuagcagcagggaggg

SEQ ID NO: 2106731 - RNA, 16 nt, Human
ucuuuaugauuuuuaa

SEQ ID NO: 2106732 - RNA, 12 nt, Human
ucuuuauaugaa

SEQ ID NO: 2106733 - RNA, 15 nt, Human
ucuuuauaugaacau

SEQ ID NO: 2106734 - RNA, 16 nt, Human
ucuuuauaugaacaua

SEQ ID NO: 2106735 - RNA, 17 nt, Human
ucuuuauuaaauguaga

SEQ ID NO: 2106736 - RNA, 21 nt, Human
ucuuuauuaaauguagaaagu

SEQ ID NO: 2106737 - RNA, 18 nt, Human
ucuuucuaaugugugaau

SEQ ID NO: 2106738 - RNA, 21 nt, Human
ucuuucuaacuccagugaagu

SEQ ID NO: 2106739 - RNA, 18 nt, Human
ucuuuccuguuguuguua

SEQ ID NO: 2106740 - RNA, 12 nt, Human
ucuuuccuuccu

SEQ ID NO: 2106741 - RNA, 14 nt, Human
ucuuuccuuccucu

SEQ ID NO: 2106742 - RNA, 16 nt, Human
ucuuuccuuccucuca

SEQ ID NO: 2106743 - RNA, 14 nt, Human
ucuuuaaucuucag

SEQ ID NO: 2106744 - RNA, 15 nt, Human
ucuuuaaucuucagu

SEQ ID NO: 2106745 - RNA, 21 nt, Human
ucuuuaaccagucugaaguuu

SEQ ID NO: 2106746 - RNA, 14 nt, Human
ucuuuaacucagga

SEQ ID NO: 2106747 - RNA, 16 nt, Human
ucuuuaacucaggacu

SEQ ID NO: 2106748 - RNA, 20 nt, Human
ucuuuaacucaggacuccag

SEQ ID NO: 2106749 - RNA, 21 nt, Human
ucuuuaacucaggacuccagc

SEQ ID NO: 2106750 - RNA, 23 nt, Human
ucuuuaacucaggacuccagccc

SEQ ID NO: 2106751 - RNA, 22 nt, Human
ucuugcaauggcagccuuggca

SEQ ID NO: 2106752 - RNA, 18 nt, Human
ucuugcaauggcagccuu

SEQ ID NO: 2106753 - RNA, 19 nt, Human
ucuugcaauggcagccuug

SEQ ID NO: 2106754 - RNA, 13 nt, Human
ucuugacuauugg

SEQ ID NO: 2106755 - RNA, 19 nt, Human
ucuugauuuguuuuagaau

SEQ ID NO: 2106756 - RNA, 19 nt, Human
ucuuggcuuacugcagccu

SEQ ID NO: 2106757 - RNA, 16 nt, Human
ucuuggcuggcuuccu

SEQ ID NO: 2106758 - RNA, 12 nt, Human
ucuuggcuuugu

SEQ ID NO: 2106759 - RNA, 13 nt, Human
ucuuggcuuuguu

SEQ ID NO: 2106760 - RNA, 18 nt, Human
ucuuggcuuuguuuuguu

SEQ ID NO: 2106761 - RNA, 16 nt, Human
ucuuggguaggcggga

SEQ ID NO: 2106762 - RNA, 14 nt, Human
ucuugguaagaagc

SEQ ID NO: 2106763 - RNA, 17 nt, Human
ucuuggucagauuugaa

SEQ ID NO: 2106764 - RNA, 11 nt, Human
ucuugggcccu

SEQ ID NO: 2106765 - RNA, 13 nt, Human
ucuugggcccucc

SEQ ID NO: 2106766 - RNA, 12 nt, Human
agaccccuggcu

SEQ ID NO: 2106767 - RNA, 13 nt, Human
agaccccuggcug

SEQ ID NO: 2106768 - RNA, 16 nt, Human
agaccuucuccaaaug

SEQ ID NO: 2106769 - RNA, 18 nt, Human
agaccuucuccaaaugag

SEQ ID NO: 2106770 - RNA, 19 nt, Human
agaccuucuccaaaugaga

SEQ ID NO: 2106771 - RNA, 16 nt, Human
ucuugagaugucuucu

SEQ ID NO: 2106772 - RNA, 13 nt, Human
ucuugagccuggg

SEQ ID NO: 2106773 - RNA, 16 nt, Human
ucuugagccugggagg

SEQ ID NO: 2106774 - RNA, 21 nt, Human
agacucagggccccagcacua

SEQ ID NO: 2106775 - RNA, 18 nt, Human
agacucagggccccagca

SEQ ID NO: 2106776 - RNA, 20 nt, Human
agacucagggccccagcacu

SEQ ID NO: 2106777 - RNA, 12 nt, Human
agacucagggcc

SEQ ID NO: 2106778 - RNA, 16 nt, Human
agacucagggccccag

SEQ ID NO: 2106779 - RNA, 17 nt, Human
agacucagggccccagc

SEQ ID NO: 2106780 - RNA, 17 nt, Human
agacucaccucugccuc

SEQ ID NO: 2106781 - RNA, 18 nt, Human
agacucaccucugccuca

SEQ ID NO: 2106782 - RNA, 15 nt, Human
agacucagacuccau

SEQ ID NO: 2106783 - RNA, 19 nt, Human
agacucaccucugccucaa

SEQ ID NO: 2106784 - RNA, 15 nt, Human
ucuugaggccaggag

SEQ ID NO: 2106785 - RNA, 16 nt, Human
ucuugaggccaggagu

SEQ ID NO: 2106786 - RNA, 14 nt, Human
ucuugagggagcuu

SEQ ID NO: 2106787 - RNA, 19 nt, Human
ucuucugcuucagccuccc

SEQ ID NO: 2106788 - RNA, 12 nt, Human
ucuucugcuuca

SEQ ID NO: 2106789 - RNA, 22 nt, Human
ucuucugcuccacccuuggccu

SEQ ID NO: 2106790 - RNA, 23 nt, Human
ucuucugcuccacccuuggccug

SEQ ID NO: 2106791 - RNA, 14 nt, Human
ucuucugcuccacc

SEQ ID NO: 2106792 - RNA, 15 nt, Human
ucuucugcuccaccc

SEQ ID NO: 2106793 - RNA, 16 nt, Human
ucuucugcuccacccu

SEQ ID NO: 2106794 - RNA, 17 nt, Human
ucuucugcuccacccuu

SEQ ID NO: 2106795 - RNA, 19 nt, Human
ucuucugcuccacccuugg

SEQ ID NO: 2106796 - RNA, 20 nt, Human
ucuucugcuccacccuuggc

SEQ ID NO: 2106797 - RNA, 19 nt, Human
ucuucuguauacuguggag

SEQ ID NO: 2106798 - RNA, 14 nt, Human
ucuucugucaucua

SEQ ID NO: 2106799 - RNA, 17 nt, Human
ucuucugucaucuaccu

SEQ ID NO: 2106800 - RNA, 15 nt, Human
ucuucuguacgucug

SEQ ID NO: 2106801 - RNA, 13 nt, Human
ucuucuuaacuua

SEQ ID NO: 2106802 - RNA, 17 nt, Human
agacaucaagcacagaa

SEQ ID NO: 2106803 - RNA, 20 nt, Human
agacaucaagcacagaagga

SEQ ID NO: 2106804 - RNA, 18 nt, Human
agacauaaccacugcuuc

SEQ ID NO: 2106805 - RNA, 14 nt, Human
agaccccucuggcc

SEQ ID NO: 2106806 - RNA, 19 nt, Human
agacccccggaacaagccu

SEQ ID NO: 2106807 - RNA, 17 nt, Human
agaccccucuggccagg

SEQ ID NO: 2106808 - RNA, 19 nt, Human
agaccccucuggccaggau

SEQ ID NO: 2106809 - RNA, 21 nt, Human
agaccccucuggccaggaugg

SEQ ID NO: 2106810 - RNA, 22 nt, Human
agaccccucuggccaggaugga

SEQ ID NO: 2106811 - RNA, 16 nt, Human
agacauugucaauaaa

SEQ ID NO: 2106812 - RNA, 13 nt, Human
agacauugucaau

SEQ ID NO: 2106813 - RNA, 19 nt, Human
agacauucugccaggcccc

SEQ ID NO: 2106814 - RNA, 14 nt, Human
agacauucugccag

SEQ ID NO: 2106815 - RNA, 15 nt, Human
agacauucugccagg

SEQ ID NO: 2106816 - RNA, 16 nt, Human
agacauuccaaaacga

SEQ ID NO: 2106817 - RNA, 17 nt, Human
agacauuccaaaacgaa

SEQ ID NO: 2106818 - RNA, 18 nt, Human
agacauuccaaaacgaag

SEQ ID NO: 2106819 - RNA, 14 nt, Human
agacauuaaauaau

SEQ ID NO: 2106820 - RNA, 13 nt, Human
ucuucaagggcug

SEQ ID NO: 2106821 - RNA, 17 nt, Human
ucuucaagggcugcuuc

SEQ ID NO: 2106822 - RNA, 18 nt, Human
ucuucaagggcugcuuca

SEQ ID NO: 2106823 - RNA, 18 nt, Human
ucuucaauuuguauaaaa

SEQ ID NO: 2106824 - RNA, 20 nt, Human
ucuucaauuuguauaaaaug

SEQ ID NO: 2106825 - RNA, 19 nt, Human
ucuucaacugaccagccuc

SEQ ID NO: 2106826 - RNA, 16 nt, Human
ucuucaacugaccagc

SEQ ID NO: 2106827 - RNA, 17 nt, Human
agaaucagaucauuuca

SEQ ID NO: 2106828 - RNA, 21 nt, Human
ucuucucuggcgacaguuuuc

SEQ ID NO: 2106829 - RNA, 14 nt, Human
ucuuccucugcuga

SEQ ID NO: 2106830 - RNA, 12 nt, Human
ucuuccucugcu

SEQ ID NO: 2106831 - RNA, 11 nt, Human
ucuuccucugc

SEQ ID NO: 2106832 - RNA, 15 nt, Human
ucuuccucccucccu

SEQ ID NO: 2106833 - RNA, 18 nt, Human
ucuucccgaaccccaagg

SEQ ID NO: 2106834 - RNA, 19 nt, Human
ucuucccgaaccccaagga

SEQ ID NO: 2106835 - RNA, 14 nt, Human
ucuuccucccuccc

SEQ ID NO: 2106836 - RNA, 19 nt, Human
ucuucccuacaguugaaaa

SEQ ID NO: 2106837 - RNA, 22 nt, Human
ucuucccuacaguugaaaaaca

SEQ ID NO: 2106838 - RNA, 14 nt, Human
ucuucccccucucc

SEQ ID NO: 2106839 - RNA, 16 nt, Human
ucuucccccucuccca

SEQ ID NO: 2106840 - RNA, 17 nt, Human
ucuucccccucucccag

SEQ ID NO: 2106841 - RNA, 18 nt, Human
ucuucccccucucccagu

SEQ ID NO: 2106842 - RNA, 21 nt, Human
ucuucccccucucccaguugu

SEQ ID NO: 2106843 - RNA, 24 nt, Human
ucuuccccucuaaugcucacgcuc

SEQ ID NO: 2106844 - RNA, 17 nt, Human
ucuucccgaaccccaag

SEQ ID NO: 2106845 - RNA, 16 nt, Human
ucuucccaucacugga

SEQ ID NO: 2106846 - RNA, 17 nt, Human
ucuucccaucacuggag

SEQ ID NO: 2106847 - RNA, 20 nt, Human
ucuuccccagaaaggagacu

SEQ ID NO: 2106848 - RNA, 20 nt, Human
ucuuccccaacgaaaagcac

SEQ ID NO: 2106849 - RNA, 14 nt, Human
ucuuccccacuccc

SEQ ID NO: 2106850 - RNA, 19 nt, Human
ucuuccccacuccccaccu

SEQ ID NO: 2106851 - RNA, 22 nt, Human
ugacacagucuuggcucacugc

SEQ ID NO: 2106852 - RNA, 23 nt, Human
ugacacagucuuggcucacugca

SEQ ID NO: 2106853 - RNA, 19 nt, Human
ugacacacagcucuguccu

SEQ ID NO: 2106854 - RNA, 18 nt, Human
ugacacacagcucugucc

SEQ ID NO: 2106855 - RNA, 16 nt, Human
ugacacacagcucugu

SEQ ID NO: 2106856 - RNA, 19 nt, Human
ugacaaagaaacccaagug

SEQ ID NO: 2106857 - RNA, 23 nt, Human
ugacaccagccuuucucccaggc

SEQ ID NO: 2106858 - RNA, 16 nt, Human
ugacacggccaugacc

SEQ ID NO: 2106859 - RNA, 17 nt, Human
ugacacguccaccccag

SEQ ID NO: 2106860 - RNA, 12 nt, Human
ugacaccagccu

SEQ ID NO: 2106861 - RNA, 13 nt, Human
ugacaccagccuu

SEQ ID NO: 2106862 - RNA, 15 nt, Human
ugacaccagccuuuc

SEQ ID NO: 2106863 - RNA, 16 nt, Human
ugacaccagccuuucu

SEQ ID NO: 2106864 - RNA, 22 nt, Human
ugacaccagccuuucucccagg

SEQ ID NO: 2106865 - RNA, 15 nt, Human
ugacaaagaaaccca

SEQ ID NO: 2106866 - RNA, 17 nt, Human
ugacaaagaaacccaag

SEQ ID NO: 2106867 - RNA, 13 nt, Human
ugacaaaauuuug

SEQ ID NO: 2106868 - RNA, 14 nt, Human
ugacaaaauuuugc

SEQ ID NO: 2106869 - RNA, 15 nt, Human
ugaauuuuucucuaa

SEQ ID NO: 2106870 - RNA, 13 nt, Human
ugaauuuuucucu

SEQ ID NO: 2106871 - RNA, 18 nt, Human
ugaauuuuguuuggacuu

SEQ ID NO: 2106872 - RNA, 19 nt, Human
ugaauuugaaugaaaaauu

SEQ ID NO: 2106873 - RNA, 21 nt, Human
ugaauuuggccugcacuaauu

SEQ ID NO: 2106874 - RNA, 14 nt, Human
agaucaaauuucac

SEQ ID NO: 2106875 - RNA, 23 nt, Human
agaucaaauuucacgucgucuuc

SEQ ID NO: 2106876 - RNA, 13 nt, Human
ugaauuugaauga

SEQ ID NO: 2106877 - RNA, 15 nt, Human
ugaauuugaaugaaa

SEQ ID NO: 2106878 - RNA, 16 nt, Human
ugaauuugaaugaaaa

SEQ ID NO: 2106879 - RNA, 17 nt, Human
ugaauuugaaugaaaaa

SEQ ID NO: 2106880 - RNA, 18 nt, Human
ugaauuugaaugaaaaau

SEQ ID NO: 2106881 - RNA, 14 nt, Human
ugaauuuggagacu

SEQ ID NO: 2106882 - RNA, 15 nt, Human
ugaauuuggagacuc

SEQ ID NO: 2106883 - RNA, 17 nt, Human
ugaauuuggagacucug

SEQ ID NO: 2106884 - RNA, 20 nt, Human
ugaauuuggagacucugugg

SEQ ID NO: 2106885 - RNA, 20 nt, Human
ugaauuuggccugcacuaau

SEQ ID NO: 2106886 - RNA, 22 nt, Human
agauaagcaagagagauguuuu

SEQ ID NO: 2106887 - RNA, 15 nt, Human
agauaauaugagaau

SEQ ID NO: 2106888 - RNA, 13 nt, Human
agauaagcaagag

SEQ ID NO: 2106889 - RNA, 16 nt, Human
agauaagcaagagaga

SEQ ID NO: 2106890 - RNA, 17 nt, Human
agauaagcaagagagau

SEQ ID NO: 2106891 - RNA, 20 nt, Human
agauaagcaagagagauguu

SEQ ID NO: 2106892 - RNA, 22 nt, Human
agauaagaaugcugguuuuccu

SEQ ID NO: 2106893 - RNA, 14 nt, Human
agauaacucuuugg

SEQ ID NO: 2106894 - RNA, 15 nt, Human
agauaacucuuugga

SEQ ID NO: 2106895 - RNA, 16 nt, Human
agauaacucuuuggau

SEQ ID NO: 2106896 - RNA, 22 nt, Human
agauaacucuuuggauagcaug

SEQ ID NO: 2106897 - RNA, 20 nt, Human
agaguuugagaccugaauag

SEQ ID NO: 2106898 - RNA, 14 nt, Human
agauaaucagccuc

SEQ ID NO: 2106899 - RNA, 17 nt, Human
agauaauaugagaauca

SEQ ID NO: 2106900 - RNA, 20 nt, Human
agauacaggaaaagcugcug

SEQ ID NO: 2106901 - RNA, 18 nt, Human
agauaauauuaaggaaga

SEQ ID NO: 2106902 - RNA, 22 nt, Human
agauaauauuaaggaagacaau

SEQ ID NO: 2106903 - RNA, 23 nt, Human
agauauuuauuguuuauuuauca

SEQ ID NO: 2106904 - RNA, 17 nt, Human
agauauuuauauuuuua

SEQ ID NO: 2106905 - RNA, 20 nt, Human
agauauuuauauuuuuauuu

SEQ ID NO: 2106906 - RNA, 23 nt, Human
agauauuuauauuuuuauuuuau

SEQ ID NO: 2106907 - RNA, 18 nt, Human
agaucaaaagguuaauaa

SEQ ID NO: 2106908 - RNA, 14 nt, Human
ugaagucacugcac

SEQ ID NO: 2106909 - RNA, 22 nt, Human
ugaagcucuggugacaccagcc

SEQ ID NO: 2106910 - RNA, 16 nt, Human
ugaaggucuugauuug

SEQ ID NO: 2106911 - RNA, 14 nt, Human
ugaagucacacagu

SEQ ID NO: 2106912 - RNA, 21 nt, Human
ugaagguaaaauugaaaggca

SEQ ID NO: 2106913 - RNA, 16 nt, Human
ugaauaaagacaccua

SEQ ID NO: 2106914 - RNA, 21 nt, Human
ugaagucacugcacagugcau

SEQ ID NO: 2106915 - RNA, 16 nt, Human
ugaagucacugcacag

SEQ ID NO: 2106916 - RNA, 15 nt, Human
ugaagucacugcaca

SEQ ID NO: 2106917 - RNA, 16 nt, Human
ugaauaaauaaaugua

SEQ ID NO: 2106918 - RNA, 19 nt, Human
ugaagucacccggccccca

SEQ ID NO: 2106919 - RNA, 17 nt, Human
ugaauaaaguugaagcu

SEQ ID NO: 2106920 - RNA, 18 nt, Human
ugaauaaagccugcuuuu

SEQ ID NO: 2106921 - RNA, 18 nt, Human
ugaagucacaucacagga

SEQ ID NO: 2106922 - RNA, 20 nt, Human
ugaauaaagccugcuuuuua

SEQ ID NO: 2106923 - RNA, 18 nt, Human
ugaauauguacauaggca

SEQ ID NO: 2106924 - RNA, 21 nt, Human
ugaauauggacucaguuuucu

SEQ ID NO: 2106925 - RNA, 19 nt, Human
ugaauaugauuaguaaaga

SEQ ID NO: 2106926 - RNA, 20 nt, Human
ugaauagcucccagauuuca

SEQ ID NO: 2106927 - RNA, 20 nt, Human
ugaauaugaacggugagcau

SEQ ID NO: 2106928 - RNA, 16 nt, Human
ugaauguauugaacuu

SEQ ID NO: 2106929 - RNA, 15 nt, Human
ugaauguaucaggaa

SEQ ID NO: 2106930 - RNA, 16 nt, Human
ugaauguaucaggaaa

SEQ ID NO: 2106931 - RNA, 14 nt, Human
ugaauguaauuugu

SEQ ID NO: 2106932 - RNA, 15 nt, Human
ugaauguaauuugug

SEQ ID NO: 2106933 - RNA, 18 nt, Human
ugaauguaauuuguguaa

SEQ ID NO: 2106934 - RNA, 20 nt, Human
ugaauguaauuuguguaaua

SEQ ID NO: 2106935 - RNA, 13 nt, Human
agaguauaugcac

SEQ ID NO: 2106936 - RNA, 22 nt, Human
agaguagccgagagccugcucc

SEQ ID NO: 2106937 - RNA, 23 nt, Human
agaguagccgagagccugcuccc

SEQ ID NO: 2106938 - RNA, 13 nt, Human
agaguagccgaga

SEQ ID NO: 2106939 - RNA, 17 nt, Human
agaguagccgagagccu

SEQ ID NO: 2106940 - RNA, 18 nt, Human
agaguagccgagagccug

SEQ ID NO: 2106941 - RNA, 19 nt, Human
agaguagccgagagccugc

SEQ ID NO: 2106942 - RNA, 16 nt, Human
agagguggggagcaga

SEQ ID NO: 2106943 - RNA, 15 nt, Human
ugaagcuaagauuua

SEQ ID NO: 2106944 - RNA, 19 nt, Human
ugaagcuauuuaucuguag

SEQ ID NO: 2106945 - RNA, 13 nt, Human
ugaagcuaauuau

SEQ ID NO: 2106946 - RNA, 14 nt, Human
ugaagcuaauuauu

SEQ ID NO: 2106947 - RNA, 18 nt, Human
ugaagcuaauuauuuuaa

SEQ ID NO: 2106948 - RNA, 19 nt, Human
ugaagcuaauuauuuuaau

SEQ ID NO: 2106949 - RNA, 20 nt, Human
ugaagcuaauuauuuuaauu

SEQ ID NO: 2106950 - RNA, 22 nt, Human
ugaagcuaauuauuuuaauuag

SEQ ID NO: 2106951 - RNA, 23 nt, Human
ugaagcuaauuauuuuaauuagg

SEQ ID NO: 2106952 - RNA, 19 nt, Human
ugaagccacagcccaggcc

SEQ ID NO: 2106953 - RNA, 20 nt, Human
ugaagccacagcccaggccu

SEQ ID NO: 2106954 - RNA, 22 nt, Human
ugaagccacagcccaggccucc

SEQ ID NO: 2106955 - RNA, 16 nt, Human
ugaagccacugaagcu

SEQ ID NO: 2106956 - RNA, 14 nt, Human
agaggcuucuucag

SEQ ID NO: 2106957 - RNA, 21 nt, Human
agaggcuucuucagaucagug

SEQ ID NO: 2106958 - RNA, 16 nt, Human
agagggagaagcauga

SEQ ID NO: 2106959 - RNA, 19 nt, Human
agagggagaagcaugaaaa

SEQ ID NO: 2106960 - RNA, 19 nt, Human
agagggagaagggauggag

SEQ ID NO: 2106961 - RNA, 22 nt, Human
agaggcuguucccaccaggcug

SEQ ID NO: 2106962 - RNA, 17 nt, Human
agaggcuggaggcaggg

SEQ ID NO: 2106963 - RNA, 19 nt, Human
agaggcuggaggcagggcc

SEQ ID NO: 2106964 - RNA, 20 nt, Human
agaggcuggaggcagggccu

SEQ ID NO: 2106965 - RNA, 22 nt, Human
agaggcuggaggcagggccuug

SEQ ID NO: 2106966 - RNA, 15 nt, Human
ugaaaguauaacuga

SEQ ID NO: 2106967 - RNA, 15 nt, Human
ugaaagucagaugcc

SEQ ID NO: 2106968 - RNA, 18 nt, Human
ugaaagucagaugcccag

SEQ ID NO: 2106969 - RNA, 15 nt, Human
ugaaagguuuacauu

SEQ ID NO: 2106970 - RNA, 17 nt, Human
ugaaagucaugaacaca

SEQ ID NO: 2106971 - RNA, 18 nt, Human
ugaaagucaugaacacau

SEQ ID NO: 2106972 - RNA, 19 nt, Human
ugaaagucaugaacacauc

SEQ ID NO: 2106973 - RNA, 14 nt, Human
agcaagauuucaga

SEQ ID NO: 2106974 - RNA, 19 nt, Human
ugagaacuacucagggaau

SEQ ID NO: 2106975 - RNA, 17 nt, Human
ugagaacugcauauguu

SEQ ID NO: 2106976 - RNA, 20 nt, Human
ugagaacugcauauguuucg

SEQ ID NO: 2106977 - RNA, 20 nt, Human
ugagaagcagaggaaggaga

SEQ ID NO: 2106978 - RNA, 13 nt, Human
ugagaagaauauu

SEQ ID NO: 2106979 - RNA, 14 nt, Human
ugagaagaauauug

SEQ ID NO: 2106980 - RNA, 21 nt, Human
ugagaagaauauuguuccuaa

SEQ ID NO: 2106981 - RNA, 22 nt, Human
ugagaagaauauuguuccuaag

SEQ ID NO: 2106982 - RNA, 16 nt, Human
ugagaagguccuuaau

SEQ ID NO: 2106983 - RNA, 22 nt, Human
ugagaagucaaacauuucaaag

SEQ ID NO: 2106984 - RNA, 15 nt, Human
ugagaacuugacaag

SEQ ID NO: 2106985 - RNA, 23 nt, Human
ugagaaggggaggaccucugggc

SEQ ID NO: 2106986 - RNA, 15 nt, Human
ugagaauagaaggaa

SEQ ID NO: 2106987 - RNA, 16 nt, Human
ugagaauagaaggaaa

SEQ ID NO: 2106988 - RNA, 17 nt, Human
ugagaauagaaggaaac

SEQ ID NO: 2106989 - RNA, 18 nt, Human
ugagaauagaaggaaacu

SEQ ID NO: 2106990 - RNA, 22 nt, Human
ugagaauagaaggaaacuagcu

SEQ ID NO: 2106991 - RNA, 23 nt, Human
ugagaauagaaggaaacuagcuu

SEQ ID NO: 2106992 - RNA, 16 nt, Human
ugagaaucaaaacucu

SEQ ID NO: 2106993 - RNA, 17 nt, Human
ugagaaucagaucauuu

SEQ ID NO: 2106994 - RNA, 12 nt, Human
agcaagacucug

SEQ ID NO: 2106995 - RNA, 15 nt, Human
agcaagagagauguu

SEQ ID NO: 2106996 - RNA, 12 nt, Human
agcaagagagau

SEQ ID NO: 2106997 - RNA, 21 nt, Human
agcaagauccugucuuuaagg

SEQ ID NO: 2106998 - RNA, 12 nt, Human
agcaagaaagaa

SEQ ID NO: 2106999 - RNA, 15 nt, Human
agcaagaaagaaacc

SEQ ID NO: 2107000 - RNA, 20 nt, Human
agcaacuugucuuuuucugg

SEQ ID NO: 2107001 - RNA, 21 nt, Human
agcaacuugucuuuuucugga

SEQ ID NO: 2107002 - RNA, 23 nt, Human
agcaacuugucuuuuucuggacu

SEQ ID NO: 2107003 - RNA, 15 nt, Human
agcaacuugucuuuu

SEQ ID NO: 2107004 - RNA, 19 nt, Human
agcaaaaacgaaagcuggg

SEQ ID NO: 2107005 - RNA, 16 nt, Human
agauuuuuaacgaaug

SEQ ID NO: 2107006 - RNA, 14 nt, Human
agauuuugaaugcu

SEQ ID NO: 2107007 - RNA, 21 nt, Human
agauuuugaaauuuuuauuaa

SEQ ID NO: 2107008 - RNA, 12 nt, Human
agauuuugaaaa

SEQ ID NO: 2107009 - RNA, 13 nt, Human
agauuuugaaaac

SEQ ID NO: 2107010 - RNA, 17 nt, Human
agauuuugaaaacuaca

SEQ ID NO: 2107011 - RNA, 21 nt, Human
agauuuugaaaacuacauuuu

SEQ ID NO: 2107012 - RNA, 23 nt, Human
agauuuugaaaacuacauuuuaa

SEQ ID NO: 2107013 - RNA, 19 nt, Human
agauuucuugaguuuuguu

SEQ ID NO: 2107014 - RNA, 19 nt, Human
agauuucugauuuuaugua

SEQ ID NO: 2107015 - RNA, 22 nt, Human
agauuucugauuuuauguaaaa

SEQ ID NO: 2107016 - RNA, 17 nt, Human
agauuugaacucuucaa

SEQ ID NO: 2107017 - RNA, 18 nt, Human
agauuccagagaguggcu

SEQ ID NO: 2107018 - RNA, 12 nt, Human
agauucauuuuu

SEQ ID NO: 2107019 - RNA, 15 nt, Human
agauucauccauuua

SEQ ID NO: 2107020 - RNA, 22 nt, Human
agauucauauuuacuucuuaua

SEQ ID NO: 2107021 - RNA, 14 nt, Human
agauugcuucugua

SEQ ID NO: 2107022 - RNA, 15 nt, Human
agauugcuucuguag

SEQ ID NO: 2107023 - RNA, 17 nt, Human
agauugcuucuguagua

SEQ ID NO: 2107024 - RNA, 23 nt, Human
agauuggagaaacccuugaaaag

SEQ ID NO: 2107025 - RNA, 15 nt, Human
agauugcuuaaaaua

SEQ ID NO: 2107026 - RNA, 16 nt, Human
agauugcuuaaaauag

SEQ ID NO: 2107027 - RNA, 16 nt, Human
agauucgcuuuccaug

SEQ ID NO: 2107028 - RNA, 14 nt, Human
agauugcugcuucu

SEQ ID NO: 2107029 - RNA, 15 nt, Human
agauugcugcuucug

SEQ ID NO: 2107030 - RNA, 14 nt, Human
agauuccuuucccu

SEQ ID NO: 2107031 - RNA, 16 nt, Human
agauuccuuucccuuu

SEQ ID NO: 2107032 - RNA, 20 nt, Human
agauuccuuucccuuuagca

SEQ ID NO: 2107033 - RNA, 14 nt, Human
agauuccuuuucuu

SEQ ID NO: 2107034 - RNA, 17 nt, Human
agauuccuuuucuuguu

SEQ ID NO: 2107035 - RNA, 17 nt, Human
agauucauuuuucuuuc

SEQ ID NO: 2107036 - RNA, 17 nt, Human
ugacuagaggcagggag

SEQ ID NO: 2107037 - RNA, 21 nt, Human
ugacuagaggcagggagggga

SEQ ID NO: 2107038 - RNA, 17 nt, Human
ugacuagggauucaggc

SEQ ID NO: 2107039 - RNA, 18 nt, Human
ugacuagggauucaggcu

SEQ ID NO: 2107040 - RNA, 19 nt, Human
ugacuagggauucaggcug

SEQ ID NO: 2107041 - RNA, 16 nt, Human
ugacuagaaagugaau

SEQ ID NO: 2107042 - RNA, 21 nt, Human
ugacuagaagggccaguccug

SEQ ID NO: 2107043 - RNA, 19 nt, Human
ugacuagacguucauuugu

SEQ ID NO: 2107044 - RNA, 17 nt, Human
ugaccuucuaggaagcu

SEQ ID NO: 2107045 - RNA, 13 nt, Human
ugaccuucuggga

SEQ ID NO: 2107046 - RNA, 14 nt, Human
ugaccuucugggaa

SEQ ID NO: 2107047 - RNA, 17 nt, Human
ugaccuugaacuccugg

SEQ ID NO: 2107048 - RNA, 18 nt, Human
ugaccuugaacuccuggg

SEQ ID NO: 2107049 - RNA, 19 nt, Human
ugaccuugaacuccugggc

SEQ ID NO: 2107050 - RNA, 20 nt, Human
ugaccuugaacuccugggcu

SEQ ID NO: 2107051 - RNA, 20 nt, Human
ugacucaagugucucagucc

SEQ ID NO: 2107052 - RNA, 23 nt, Human
ugacucaacauguuacugaccag

SEQ ID NO: 2107053 - RNA, 13 nt, Human
ugacuagugcuga

SEQ ID NO: 2107054 - RNA, 14 nt, Human
ugacucaacauguu

SEQ ID NO: 2107055 - RNA, 15 nt, Human
ugacucaacauguua

SEQ ID NO: 2107056 - RNA, 22 nt, Human
ugacucaacauguuacugacca

SEQ ID NO: 2107057 - RNA, 20 nt, Human
ugacuagggauucaggcugc

SEQ ID NO: 2107058 - RNA, 21 nt, Human
ugacuagggauucaggcugcu

SEQ ID NO: 2107059 - RNA, 23 nt, Human
ugacuagggauucaggcugcuug

SEQ ID NO: 2107060 - RNA, 22 nt, Human
ugacuccuuagagacaucaaaa

SEQ ID NO: 2107061 - RNA, 18 nt, Human
ugacucgagucacacuca

SEQ ID NO: 2107062 - RNA, 17 nt, Human
ugacucccaaagagcug

SEQ ID NO: 2107063 - RNA, 18 nt, Human
ugacucccaaagagcugc

SEQ ID NO: 2107064 - RNA, 20 nt, Human
ugacucccaaagagcugccu

SEQ ID NO: 2107065 - RNA, 22 nt, Human
ugacucccaaagagcugccuaa

SEQ ID NO: 2107066 - RNA, 14 nt, Human
ugacucacccaagc

SEQ ID NO: 2107067 - RNA, 15 nt, Human
ugacucacccaagca

SEQ ID NO: 2107068 - RNA, 11 nt, Human
ugacucaccca

SEQ ID NO: 2107069 - RNA, 12 nt, Human
ugacucacccaa

SEQ ID NO: 2107070 - RNA, 13 nt, Human
ugacucacccaag

SEQ ID NO: 2107071 - RNA, 18 nt, Human
ugaccugugaccagcacu

SEQ ID NO: 2107072 - RNA, 22 nt, Human
ugaccugugaccagcacugucu

SEQ ID NO: 2107073 - RNA, 13 nt, Human
ugaccugugacca

SEQ ID NO: 2107074 - RNA, 15 nt, Human
ugaccugugaccagc

SEQ ID NO: 2107075 - RNA, 19 nt, Human
ugaccuguggggauuucuc

SEQ ID NO: 2107076 - RNA, 21 nt, Human
ugaccuguggggauuucuccc

SEQ ID NO: 2107077 - RNA, 22 nt, Human
ugaccuguggggauuucuccca

SEQ ID NO: 2107078 - RNA, 23 nt, Human
ugaccuguggggauuucucccag

SEQ ID NO: 2107079 - RNA, 14 nt, Human
ugaccugugucacu

SEQ ID NO: 2107080 - RNA, 15 nt, Human
ugaccugugucacua

SEQ ID NO: 2107081 - RNA, 19 nt, Human
ugacccucaauucauauuu

SEQ ID NO: 2107082 - RNA, 18 nt, Human
ugacccuagcucuuuccu

SEQ ID NO: 2107083 - RNA, 11 nt, Human
ugaccugcagg

SEQ ID NO: 2107084 - RNA, 20 nt, Human
ugaccugcaggccaagagca

SEQ ID NO: 2107085 - RNA, 16 nt, Human
agauuaaacugaguga

SEQ ID NO: 2107086 - RNA, 24 nt, Human
agauguuugucagauaugauaugu

SEQ ID NO: 2107087 - RNA, 14 nt, Human
agauguuucacgaa

SEQ ID NO: 2107088 - RNA, 15 nt, Human
agauguuugucagau

SEQ ID NO: 2107089 - RNA, 17 nt, Human
agauguuugucagauau

SEQ ID NO: 2107090 - RNA, 19 nt, Human
agauguuugucagauauga

SEQ ID NO: 2107091 - RNA, 23 nt, Human
agauggaaguugcagugagcuga

SEQ ID NO: 2107092 - RNA, 22 nt, Human
agauggaaguugcagugagcug

SEQ ID NO: 2107093 - RNA, 20 nt, Human
agauggaaccgcaggaagcu

SEQ ID NO: 2107094 - RNA, 21 nt, Human
agauggaaccgcaggaagcug

SEQ ID NO: 2107095 - RNA, 13 nt, Human
agauggagucccu

SEQ ID NO: 2107096 - RNA, 16 nt, Human
agauggaggaggaggc

SEQ ID NO: 2107097 - RNA, 16 nt, Human
agaugccgcauuugga

SEQ ID NO: 2107098 - RNA, 21 nt, Human
agaugcccagagggcccaggc

SEQ ID NO: 2107099 - RNA, 22 nt, Human
agaugcccagagggcccaggca

SEQ ID NO: 2107100 - RNA, 12 nt, Human
agaugccccaga

SEQ ID NO: 2107101 - RNA, 17 nt, Human
agaugccccagagcugu

SEQ ID NO: 2107102 - RNA, 14 nt, Human
agaugcccugcuag

SEQ ID NO: 2107103 - RNA, 12 nt, Human
agaugccuccac

SEQ ID NO: 2107104 - RNA, 13 nt, Human
agaugccuccacc

SEQ ID NO: 2107105 - RNA, 21 nt, Human
agaugccuccaccccccagaa

SEQ ID NO: 2107106 - RNA, 22 nt, Human
agaugccuccaccccccagaac

SEQ ID NO: 2107107 - RNA, 14 nt, Human
agaugccuccaccg

SEQ ID NO: 2107108 - RNA, 15 nt, Human
agaugccuccaccgc

SEQ ID NO: 2107109 - RNA, 16 nt, Human
agaugccuccaccgcu

SEQ ID NO: 2107110 - RNA, 17 nt, Human
agaugccuccaccgcug

SEQ ID NO: 2107111 - RNA, 21 nt, Human
agaugccuccaccgcugccua

SEQ ID NO: 2107112 - RNA, 20 nt, Human
agaugcugacuguacuccuc

SEQ ID NO: 2107113 - RNA, 18 nt, Human
agaugcugaaacaggaga

SEQ ID NO: 2107114 - RNA, 13 nt, Human
agaugcucuuuua

SEQ ID NO: 2107115 - RNA, 23 nt, Human
agaugcugacuguacuccuccca

SEQ ID NO: 2107116 - RNA, 21 nt, Human
agaugcugaaacaggagagaa

SEQ ID NO: 2107117 - RNA, 22 nt, Human
agaugcugaaacaggagagaaa

SEQ ID NO: 2107118 - RNA, 22 nt, Human
agauggaacccuuuuggccccc

SEQ ID NO: 2107119 - RNA, 17 nt, Human
agauggaaccgcaggaa

SEQ ID NO: 2107120 - RNA, 18 nt, Human
agauggaaccgcaggaag

SEQ ID NO: 2107121 - RNA, 23 nt, Human
ugacacuucagagagcugguagu

SEQ ID NO: 2107122 - RNA, 24 nt, Human
ugacacuucagagagcugguaguu

SEQ ID NO: 2107123 - RNA, 17 nt, Human
ugacacuucagagagcu

SEQ ID NO: 2107124 - RNA, 18 nt, Human
ugacacuucagagagcug

SEQ ID NO: 2107125 - RNA, 19 nt, Human
ugacacuucagagagcugg

SEQ ID NO: 2107126 - RNA, 20 nt, Human
ugacacuucagagagcuggu

SEQ ID NO: 2107127 - RNA, 13 nt, Human
ugacacugaaaug

SEQ ID NO: 2107128 - RNA, 14 nt, Human
ugacacugaaaugc

SEQ ID NO: 2107129 - RNA, 16 nt, Human
ugacacugaaaugccu

SEQ ID NO: 2107130 - RNA, 17 nt, Human
ugacacugaaaugccuu

SEQ ID NO: 2107131 - RNA, 18 nt, Human
ugacacugaaaugccuua

SEQ ID NO: 2107132 - RNA, 22 nt, Human
ugacacugaaaugccuuacuuu

SEQ ID NO: 2107133 - RNA, 16 nt, Human
ugacacuucagagagc

SEQ ID NO: 2107134 - RNA, 16 nt, Human
agaugccaucuguguc

SEQ ID NO: 2107135 - RNA, 19 nt, Human
ugauauguugguagauucu

SEQ ID NO: 2107136 - RNA, 15 nt, Human
ugauauguaaacaua

SEQ ID NO: 2107137 - RNA, 21 nt, Human
ugauacuuuugacaacaaauu

SEQ ID NO: 2107138 - RNA, 15 nt, Human
ugauacuuuuaagag

SEQ ID NO: 2107139 - RNA, 15 nt, Human
ugauacuuuugacaa

SEQ ID NO: 2107140 - RNA, 14 nt, Human
ugauacuuguuuuc

SEQ ID NO: 2107141 - RNA, 22 nt, Human
ugauacuuguuuucaaaccagu

SEQ ID NO: 2107142 - RNA, 23 nt, Human
ugauauuuucaacgcagcccugc

SEQ ID NO: 2107143 - RNA, 22 nt, Human
ugauauuuucaacgcagcccug

SEQ ID NO: 2107144 - RNA, 21 nt, Human
ugauauuuucaacgcagcccu

SEQ ID NO: 2107145 - RNA, 19 nt, Human
ugauauuuucaacgcagcc

SEQ ID NO: 2107146 - RNA, 17 nt, Human
ugauauugcauaugcau

SEQ ID NO: 2107147 - RNA, 21 nt, Human
ugauauuccccccacuuaaga

SEQ ID NO: 2107148 - RNA, 21 nt, Human
ugauauguaaacauaauucuu

SEQ ID NO: 2107149 - RNA, 15 nt, Human
ugauauuccauagua

SEQ ID NO: 2107150 - RNA, 16 nt, Human
ugauauuccauaguau

SEQ ID NO: 2107151 - RNA, 19 nt, Human
ugauauuccauaguauauu

SEQ ID NO: 2107152 - RNA, 16 nt, Human
ugauauuccaugaaug

SEQ ID NO: 2107153 - RNA, 18 nt, Human
ugauauuccaugaaugua

SEQ ID NO: 2107154 - RNA, 19 nt, Human
ugauauuccaugaauguau

SEQ ID NO: 2107155 - RNA, 20 nt, Human
ugauauuccaugaauguauc

SEQ ID NO: 2107156 - RNA, 22 nt, Human
ugauauuccaugaauguaucag

SEQ ID NO: 2107157 - RNA, 15 nt, Human
agcaucacaaaugau

SEQ ID NO: 2107158 - RNA, 21 nt, Human
ugaucacggcucacugcagcc

SEQ ID NO: 2107159 - RNA, 20 nt, Human
ugaucacggcucacugcagc

SEQ ID NO: 2107160 - RNA, 18 nt, Human
ugaucaauaaaaugugau

SEQ ID NO: 2107161 - RNA, 13 nt, Human
agcaucaaacucu

SEQ ID NO: 2107162 - RNA, 14 nt, Human
agcaucaaacucuu

SEQ ID NO: 2107163 - RNA, 19 nt, Human
ugaucacggcucacugcag

SEQ ID NO: 2107164 - RNA, 13 nt, Human
ugaucaauaaaau

SEQ ID NO: 2107165 - RNA, 15 nt, Human
ugaucaauaaaaugu

SEQ ID NO: 2107166 - RNA, 16 nt, Human
ugaucaauaaaaugug

SEQ ID NO: 2107167 - RNA, 19 nt, Human
ugaucaauaaaaugugauu

SEQ ID NO: 2107168 - RNA, 15 nt, Human
ugauauuuuuuuaag

SEQ ID NO: 2107169 - RNA, 16 nt, Human
ugauauuuuuuuaagu

SEQ ID NO: 2107170 - RNA, 20 nt, Human
ugauauuuuuuuaagucuuu

SEQ ID NO: 2107171 - RNA, 18 nt, Human
agcauggcucaaagugca

SEQ ID NO: 2107172 - RNA, 15 nt, Human
agcauguaggagaau

SEQ ID NO: 2107173 - RNA, 16 nt, Human
agcaugucacuaaagc

SEQ ID NO: 2107174 - RNA, 11 nt, Human
agcauugcuuu

SEQ ID NO: 2107175 - RNA, 12 nt, Human
agcauugcuuuc

SEQ ID NO: 2107176 - RNA, 13 nt, Human
agcauugcuuucu

SEQ ID NO: 2107177 - RNA, 14 nt, Human
agcauugcuuucug

SEQ ID NO: 2107178 - RNA, 15 nt, Human
agcauugcuuucuga

SEQ ID NO: 2107179 - RNA, 16 nt, Human
agcauugcuuucugaa

SEQ ID NO: 2107180 - RNA, 17 nt, Human
agcauugcuuucugaaa

SEQ ID NO: 2107181 - RNA, 15 nt, Human
agcauuguuugcuua

SEQ ID NO: 2107182 - RNA, 17 nt, Human
agcauuguuugcuuauu

SEQ ID NO: 2107183 - RNA, 20 nt, Human
agcauuguggcugucagcag

SEQ ID NO: 2107184 - RNA, 21 nt, Human
agcauuguggcugucagcagg

SEQ ID NO: 2107185 - RNA, 17 nt, Human
agcauguggcauguuca

SEQ ID NO: 2107186 - RNA, 19 nt, Human
agcauguguauuuccagug

SEQ ID NO: 2107187 - RNA, 12 nt, Human
agcauguuacug

SEQ ID NO: 2107188 - RNA, 16 nt, Human
agcauguugagccagg

SEQ ID NO: 2107189 - RNA, 18 nt, Human
agcauguggcauguucau

SEQ ID NO: 2107190 - RNA, 16 nt, Human
agcauguguugaaaaa

SEQ ID NO: 2107191 - RNA, 22 nt, Human
agcauguguuugguucuggggc

SEQ ID NO: 2107192 - RNA, 19 nt, Human
agcauguugagccaggccu

SEQ ID NO: 2107193 - RNA, 20 nt, Human
agcauguugagccaggccug

SEQ ID NO: 2107194 - RNA, 21 nt, Human
agcauguugagccaggccugg

SEQ ID NO: 2107195 - RNA, 14 nt, Human
agcauuaacuaauc

SEQ ID NO: 2107196 - RNA, 18 nt, Human
agcauuaacuaaucuauu

SEQ ID NO: 2107197 - RNA, 13 nt, Human
ugaguagcuggau

SEQ ID NO: 2107198 - RNA, 20 nt, Human
ugaguagagagcaagggaag

SEQ ID NO: 2107199 - RNA, 13 nt, Human
ugaguaagagcug

SEQ ID NO: 2107200 - RNA, 12 nt, Human
agcauaugagga

SEQ ID NO: 2107201 - RNA, 16 nt, Human
agcauaugaggaugca

SEQ ID NO: 2107202 - RNA, 23 nt, Human
agcauaugaggaugcagagucag

SEQ ID NO: 2107203 - RNA, 20 nt, Human
ugaguaaaaaguuucuaaag

SEQ ID NO: 2107204 - RNA, 13 nt, Human
agcauaaaugcaa

SEQ ID NO: 2107205 - RNA, 14 nt, Human
agcauaaaugcaaa

SEQ ID NO: 2107206 - RNA, 12 nt, Human
ugagaauuaccc

SEQ ID NO: 2107207 - RNA, 16 nt, Human
ugagaauucagcugcc

SEQ ID NO: 2107208 - RNA, 17 nt, Human
ugagaauucagcugccc

SEQ ID NO: 2107209 - RNA, 18 nt, Human
ugagaauucagcugcccc

SEQ ID NO: 2107210 - RNA, 22 nt, Human
ugagaauucagcugcccccgcu

SEQ ID NO: 2107211 - RNA, 23 nt, Human
ugagaauucagcugcccccgcuc

SEQ ID NO: 2107212 - RNA, 20 nt, Human
ugagaaucagaucauuucaa

SEQ ID NO: 2107213 - RNA, 18 nt, Human
ugagacaaauggaggccu

SEQ ID NO: 2107214 - RNA, 12 nt, Human
ugagacaaaaau

SEQ ID NO: 2107215 - RNA, 14 nt, Human
ugagacaaaaauua

SEQ ID NO: 2107216 - RNA, 15 nt, Human
ugagacaaaaauuau

SEQ ID NO: 2107217 - RNA, 16 nt, Human
ugagacaaaaauuauc

SEQ ID NO: 2107218 - RNA, 18 nt, Human
ugagacaaaaauuaucua

SEQ ID NO: 2107219 - RNA, 13 nt, Human
ugagaauuuuaaa

SEQ ID NO: 2107220 - RNA, 15 nt, Human
ugagaauuuuaaauu

SEQ ID NO: 2107221 - RNA, 23 nt, Human
ugagaauuuuaaauuauaacuua

SEQ ID NO: 2107222 - RNA, 16 nt, Human
ugauaaggaucagaac

SEQ ID NO: 2107223 - RNA, 20 nt, Human
ugauaaggaucagaacagca

SEQ ID NO: 2107224 - RNA, 18 nt, Human
ugauaaugaugaugacga

SEQ ID NO: 2107225 - RNA, 21 nt, Human
ugauaauguugugguuuguug

SEQ ID NO: 2107226 - RNA, 17 nt, Human
ugaguucauacccuguu

SEQ ID NO: 2107227 - RNA, 16 nt, Human
ugaguucagguagcug

SEQ ID NO: 2107228 - RNA, 23 nt, Human
ugauacacuaugaagauguuuca

SEQ ID NO: 2107229 - RNA, 23 nt, Human
ugagugggggaucacagccucug

SEQ ID NO: 2107230 - RNA, 21 nt, Human
ugagugggugaauaauacagu

SEQ ID NO: 2107231 - RNA, 20 nt, Human
ugaguucaagggcuguaggu

SEQ ID NO: 2107232 - RNA, 15 nt, Human
ugaguucagguagcu

SEQ ID NO: 2107233 - RNA, 17 nt, Human
ugaguguaacaagaaag

SEQ ID NO: 2107234 - RNA, 19 nt, Human
ugaguguaacaagaaagga

SEQ ID NO: 2107235 - RNA, 14 nt, Human
ugaguguaagugug

SEQ ID NO: 2107236 - RNA, 15 nt, Human
ugaguguaaguguga

SEQ ID NO: 2107237 - RNA, 11 nt, Human
ugaguguacca

SEQ ID NO: 2107238 - RNA, 17 nt, Human
ugagucaccaagcccag

SEQ ID NO: 2107239 - RNA, 16 nt, Human
ugagucaccaagccca

SEQ ID NO: 2107240 - RNA, 17 nt, Human
ugaguauguggaaggca

SEQ ID NO: 2107241 - RNA, 15 nt, Human
ugaguaucuccucgc

SEQ ID NO: 2107242 - RNA, 21 nt, Human
ugaguaucuccucgcaagcug

SEQ ID NO: 2107243 - RNA, 14 nt, Human
ugagucaccaagcc

SEQ ID NO: 2107244 - RNA, 15 nt, Human
agccacggccaggcc

SEQ ID NO: 2107245 - RNA, 21 nt, Human
ugauccaugaguuugcccugg

SEQ ID NO: 2107246 - RNA, 15 nt, Human
ugaucgugcuaaauu

SEQ ID NO: 2107247 - RNA, 17 nt, Human
ugaugaagggaggaggu

SEQ ID NO: 2107248 - RNA, 16 nt, Human
ugaugagcuccucuuc

SEQ ID NO: 2107249 - RNA, 12 nt, Human
ugaugaaucuug

SEQ ID NO: 2107250 - RNA, 13 nt, Human
ugaugaaucuugc

SEQ ID NO: 2107251 - RNA, 14 nt, Human
agccacggccaggc

SEQ ID NO: 2107252 - RNA, 18 nt, Human
agccaccucucuuuuuca

SEQ ID NO: 2107253 - RNA, 13 nt, Human
agccaccuguccc

SEQ ID NO: 2107254 - RNA, 14 nt, Human
agccaccuguccca

SEQ ID NO: 2107255 - RNA, 15 nt, Human
agccaccugucccac

SEQ ID NO: 2107256 - RNA, 16 nt, Human
agccaccugucccacc

SEQ ID NO: 2107257 - RNA, 18 nt, Human
agccaccugucccaccuc

SEQ ID NO: 2107258 - RNA, 19 nt, Human
agccaccugucccaccuca

SEQ ID NO: 2107259 - RNA, 14 nt, Human
agccaccucucuuu

SEQ ID NO: 2107260 - RNA, 21 nt, Human
agccacaugggaaacuuccaa

SEQ ID NO: 2107261 - RNA, 14 nt, Human
agccacccucccag

SEQ ID NO: 2107262 - RNA, 17 nt, Human
agccacccucccagcuc

SEQ ID NO: 2107263 - RNA, 18 nt, Human
agccacccucccagcucu

SEQ ID NO: 2107264 - RNA, 19 nt, Human
agccacccucccagcucug

SEQ ID NO: 2107265 - RNA, 20 nt, Human
agccacccucccagcucuga

SEQ ID NO: 2107266 - RNA, 16 nt, Human
agccacugaagcuggg

SEQ ID NO: 2107267 - RNA, 13 nt, Human
agccacucuguuc

SEQ ID NO: 2107268 - RNA, 15 nt, Human
agccacucuguuccu

SEQ ID NO: 2107269 - RNA, 12 nt, Human
agccacugaagc

SEQ ID NO: 2107270 - RNA, 13 nt, Human
agccacugaagcu

SEQ ID NO: 2107271 - RNA, 21 nt, Human
ugauuaauucaccuuccagug

SEQ ID NO: 2107272 - RNA, 13 nt, Human
ugauuacacaguu

SEQ ID NO: 2107273 - RNA, 14 nt, Human
ugauuacacaguug

SEQ ID NO: 2107274 - RNA, 22 nt, Human
agccacugcaccgggccacaga

SEQ ID NO: 2107275 - RNA, 21 nt, Human
agccacugcaccgggccacag

SEQ ID NO: 2107276 - RNA, 13 nt, Human
agccacugcaccg

SEQ ID NO: 2107277 - RNA, 23 nt, Human
agccacuuaccuucaauaaagua

SEQ ID NO: 2107278 - RNA, 19 nt, Human
agccagaaauaaaguuggu

SEQ ID NO: 2107279 - RNA, 16 nt, Human
agccagaaccccgagc

SEQ ID NO: 2107280 - RNA, 20 nt, Human
agccagaaccccgagcccua

SEQ ID NO: 2107281 - RNA, 23 nt, Human
agccagaaauaaaguuggugaca

SEQ ID NO: 2107282 - RNA, 13 nt, Human
agccacuuaccuu

SEQ ID NO: 2107283 - RNA, 15 nt, Human
agccacuuaccuuca

SEQ ID NO: 2107284 - RNA, 16 nt, Human
agccacuuaccuucaa

SEQ ID NO: 2107285 - RNA, 17 nt, Human
agccacuuaccuucaau

SEQ ID NO: 2107286 - RNA, 18 nt, Human
agccacuuaccuucaaua

SEQ ID NO: 2107287 - RNA, 21 nt, Human
agccacuuaccuucaauaaag

SEQ ID NO: 2107288 - RNA, 22 nt, Human
agccacuuaccuucaauaaagu

SEQ ID NO: 2107289 - RNA, 16 nt, Human
ugauguuuguggccuc

SEQ ID NO: 2107290 - RNA, 13 nt, Human
ugauguuuguccu

SEQ ID NO: 2107291 - RNA, 11 nt, Human
ugauguuugug

SEQ ID NO: 2107292 - RNA, 17 nt, Human
ugauguuuguggccuca

SEQ ID NO: 2107293 - RNA, 18 nt, Human
ugauguuuguggccucag

SEQ ID NO: 2107294 - RNA, 19 nt, Human
ugauguuuguggccucaga

SEQ ID NO: 2107295 - RNA, 20 nt, Human
ugauguuuguggccucagaa

SEQ ID NO: 2107296 - RNA, 14 nt, Human
ugaugauaaugaug

SEQ ID NO: 2107297 - RNA, 21 nt, Human
ugaugaucagcuguuugucau

SEQ ID NO: 2107298 - RNA, 18 nt, Human
ugauguuuuccuauaaua

SEQ ID NO: 2107299 - RNA, 14 nt, Human
ugaugauccuaggc

SEQ ID NO: 2107300 - RNA, 17 nt, Human
ugaugaguguaacaaga

SEQ ID NO: 2107301 - RNA, 18 nt, Human
ugaugaguguaacaagaa

SEQ ID NO: 2107302 - RNA, 19 nt, Human
ugaugaguguaacaagaaa

SEQ ID NO: 2107303 - RNA, 21 nt, Human
ugaugaguguaacaagaaagg

SEQ ID NO: 2107304 - RNA, 22 nt, Human
ugaugaguguaacaagaaagga

SEQ ID NO: 2107305 - RNA, 20 nt, Human
ugaugauccuaggcauuugc

SEQ ID NO: 2107306 - RNA, 12 nt, Human
agccagaagcug

SEQ ID NO: 2107307 - RNA, 14 nt, Human
agccagaagcugag

SEQ ID NO: 2107308 - RNA, 20 nt, Human
agccagaagcugagcaccag

SEQ ID NO: 2107309 - RNA, 15 nt, Human
agccagaagcugagc

SEQ ID NO: 2107310 - RNA, 21 nt, Human
agccagacagcaacggggagg

SEQ ID NO: 2107311 - RNA, 20 nt, Human
agccagcugccgaccagagc

SEQ ID NO: 2107312 - RNA, 16 nt, Human
agccagcugccgacca

SEQ ID NO: 2107313 - RNA, 19 nt, Human
agccagcugcagcugggcu

SEQ ID NO: 2107314 - RNA, 20 nt, Human
agccagcugcagcugggcug

SEQ ID NO: 2107315 - RNA, 18 nt, Human
agccaggagcugggcaga

SEQ ID NO: 2107316 - RNA, 14 nt, Human
agccaggagcuggg

SEQ ID NO: 2107317 - RNA, 12 nt, Human
agccagucuuaa

SEQ ID NO: 2107318 - RNA, 15 nt, Human
agccagucuuaacau

SEQ ID NO: 2107319 - RNA, 17 nt, Human
agccagugaccugagga

SEQ ID NO: 2107320 - RNA, 18 nt, Human
agccagugaccugaggaa

SEQ ID NO: 2107321 - RNA, 19 nt, Human
agccagugaccugaggaag

SEQ ID NO: 2107322 - RNA, 21 nt, Human
agccagugaccugaggaagcg

SEQ ID NO: 2107323 - RNA, 22 nt, Human
agccaggccugggucugugucu

SEQ ID NO: 2107324 - RNA, 15 nt, Human
agccaggcucaggcc

SEQ ID NO: 2107325 - RNA, 12 nt, Human
agccagggucuc

SEQ ID NO: 2107326 - RNA, 12 nt, Human
agccaggccugg

SEQ ID NO: 2107327 - RNA, 22 nt, Human
agcccacuucugccauauucug

SEQ ID NO: 2107328 - RNA, 12 nt, Human
agcccagacaaa

SEQ ID NO: 2107329 - RNA, 14 nt, Human
agccauguuuaaga

SEQ ID NO: 2107330 - RNA, 15 nt, Human
agccauguuuaagau

SEQ ID NO: 2107331 - RNA, 16 nt, Human
agccauguuuaagauu

SEQ ID NO: 2107332 - RNA, 17 nt, Human
agccauguuuaagauuu

SEQ ID NO: 2107333 - RNA, 18 nt, Human
agccauguuuaagauuua

SEQ ID NO: 2107334 - RNA, 19 nt, Human
agccauguuuaagauuuaa

SEQ ID NO: 2107335 - RNA, 20 nt, Human
agccauguuuaagauuuaau

SEQ ID NO: 2107336 - RNA, 22 nt, Human
agccauguuuaagauuuaauuu

SEQ ID NO: 2107337 - RNA, 14 nt, Human
agcccagcccagcu

SEQ ID NO: 2107338 - RNA, 15 nt, Human
agcccagcccagcug

SEQ ID NO: 2107339 - RNA, 23 nt, Human
agcccagccauuaccauggagac

SEQ ID NO: 2107340 - RNA, 16 nt, Human
agcccagcccagcugc

SEQ ID NO: 2107341 - RNA, 17 nt, Human
agcccagcccagcugcu

SEQ ID NO: 2107342 - RNA, 18 nt, Human
agcccagcccagcugcuc

SEQ ID NO: 2107343 - RNA, 16 nt, Human
agcccagcccagcugg

SEQ ID NO: 2107344 - RNA, 13 nt, Human
agcccagcuccag

SEQ ID NO: 2107345 - RNA, 14 nt, Human
agcccagcuccagg

SEQ ID NO: 2107346 - RNA, 15 nt, Human
agcccagcuccaggg

SEQ ID NO: 2107347 - RNA, 16 nt, Human
agcccagcuccagggc

SEQ ID NO: 2107348 - RNA, 17 nt, Human
agcccagcuccagggcc

SEQ ID NO: 2107349 - RNA, 18 nt, Human
agcccagcuccagggcca

SEQ ID NO: 2107350 - RNA, 12 nt, Human
agcccagcugcu

SEQ ID NO: 2107351 - RNA, 14 nt, Human
agcccagcugcucu

SEQ ID NO: 2107352 - RNA, 15 nt, Human
agcccagcugcucug

SEQ ID NO: 2107353 - RNA, 16 nt, Human
agcccagcugcucugc

SEQ ID NO: 2107354 - RNA, 18 nt, Human
agcccagcugcucugccc

SEQ ID NO: 2107355 - RNA, 19 nt, Human
agcccagcugcucugccca

SEQ ID NO: 2107356 - RNA, 20 nt, Human
agcccagcugcucugcccag

SEQ ID NO: 2107357 - RNA, 21 nt, Human
agcccagcugcucugcccaga

SEQ ID NO: 2107358 - RNA, 22 nt, Human
agcccagcugcucugcccagag

SEQ ID NO: 2107359 - RNA, 23 nt, Human
agcccagcugcucugcccagagc

SEQ ID NO: 2107360 - RNA, 15 nt, Human
agcccagcccuguuc

SEQ ID NO: 2107361 - RNA, 16 nt, Human
agcccagcccuguucu

SEQ ID NO: 2107362 - RNA, 17 nt, Human
agcccagcccuguucug

SEQ ID NO: 2107363 - RNA, 13 nt, Human
ugauucagcucug

SEQ ID NO: 2107364 - RNA, 14 nt, Human
ugauucagcucugc

SEQ ID NO: 2107365 - RNA, 24 nt, Human
agcccaggaauuugaagcugcagu

SEQ ID NO: 2107366 - RNA, 18 nt, Human
ugauucccaagcucugcu

SEQ ID NO: 2107367 - RNA, 16 nt, Human
ugauucccaagcucug

SEQ ID NO: 2107368 - RNA, 15 nt, Human
ugauucccaagcucu

SEQ ID NO: 2107369 - RNA, 17 nt, Human
ugauucauaauaaauau

SEQ ID NO: 2107370 - RNA, 21 nt, Human
ugauucccaagcucugcuccu

SEQ ID NO: 2107371 - RNA, 19 nt, Human
ugauucccaagcucugcuc

SEQ ID NO: 2107372 - RNA, 13 nt, Human
ugauuccaucucc

SEQ ID NO: 2107373 - RNA, 16 nt, Human
ugauuccaucuccuug

SEQ ID NO: 2107374 - RNA, 12 nt, Human
agcuagaaauga

SEQ ID NO: 2107375 - RNA, 13 nt, Human
agcuacuuuguuu

SEQ ID NO: 2107376 - RNA, 15 nt, Human
agcuagaagugggcc

SEQ ID NO: 2107377 - RNA, 19 nt, Human
agcuagaagugggccagga

SEQ ID NO: 2107378 - RNA, 21 nt, Human
agcuagaagugggccaggaca

SEQ ID NO: 2107379 - RNA, 22 nt, Human
agcuagaagugggccaggacag

SEQ ID NO: 2107380 - RNA, 24 nt, Human
agcuagaagugggccaggacaggc

SEQ ID NO: 2107381 - RNA, 11 nt, Human
agcuagaaaug

SEQ ID NO: 2107382 - RNA, 16 nt, Human
agcuacuugggaggcu

SEQ ID NO: 2107383 - RNA, 13 nt, Human
agcuacuaaugau

SEQ ID NO: 2107384 - RNA, 16 nt, Human
agcuacuaaugauguu

SEQ ID NO: 2107385 - RNA, 18 nt, Human
agcuacuaaugauguuuu

SEQ ID NO: 2107386 - RNA, 17 nt, Human
agcuacuugggaggcug

SEQ ID NO: 2107387 - RNA, 20 nt, Human
agcuagcgcugccgcacccc

SEQ ID NO: 2107388 - RNA, 21 nt, Human
agcuagcgcugccgcacccca

SEQ ID NO: 2107389 - RNA, 19 nt, Human
agcuagcaaaagaaguaac

SEQ ID NO: 2107390 - RNA, 20 nt, Human
agcuagcaaaagaaguaaca

SEQ ID NO: 2107391 - RNA, 23 nt, Human
agcuagcaaaagaaguaacaaga

SEQ ID NO: 2107392 - RNA, 14 nt, Human
agcuagcgcugccg

SEQ ID NO: 2107393 - RNA, 16 nt, Human
agcuagcgcugccgca

SEQ ID NO: 2107394 - RNA, 18 nt, Human
agcuagcgcugccgcacc

SEQ ID NO: 2107395 - RNA, 20 nt, Human
agcuagaggaaccaaccccc

SEQ ID NO: 2107396 - RNA, 14 nt, Human
agcuagagcuucaa

SEQ ID NO: 2107397 - RNA, 15 nt, Human
agcuagagcuucaag

SEQ ID NO: 2107398 - RNA, 12 nt, Human
agcuagaggaac

SEQ ID NO: 2107399 - RNA, 16 nt, Human
agcuaccucaaacuuc

SEQ ID NO: 2107400 - RNA, 23 nt, Human
agcguagcuaagugaaaagguca

SEQ ID NO: 2107401 - RNA, 22 nt, Human
agcgugagccacugcaccgggc

SEQ ID NO: 2107402 - RNA, 15 nt, Human
agcgugcauaaguua

SEQ ID NO: 2107403 - RNA, 19 nt, Human
agcgugagccacugcaccg

SEQ ID NO: 2107404 - RNA, 19 nt, Human
agcgguuuggggagcagag

SEQ ID NO: 2107405 - RNA, 14 nt, Human
agcguagccucucc

SEQ ID NO: 2107406 - RNA, 18 nt, Human
agcguacucaucaucaac

SEQ ID NO: 2107407 - RNA, 22 nt, Human
agcgguuuggggagcagagaca

SEQ ID NO: 2107408 - RNA, 23 nt, Human
ugccacuuugguacauggccagu

SEQ ID NO: 2107409 - RNA, 23 nt, Human
ugccacacuucaggcucuucucc

SEQ ID NO: 2107410 - RNA, 22 nt, Human
ugccacacuucaggcucuucuc

SEQ ID NO: 2107411 - RNA, 12 nt, Human
ugccagacaugu

SEQ ID NO: 2107412 - RNA, 13 nt, Human
ugccagacaugug

SEQ ID NO: 2107413 - RNA, 14 nt, Human
ugccagaacaguuu

SEQ ID NO: 2107414 - RNA, 18 nt, Human
ugccagaacaguuuguac

SEQ ID NO: 2107415 - RNA, 19 nt, Human
ugccagaacaguuuguaca

SEQ ID NO: 2107416 - RNA, 20 nt, Human
ugccagaacaguuuguacag

SEQ ID NO: 2107417 - RNA, 21 nt, Human
ugccagacggcacccacccag

SEQ ID NO: 2107418 - RNA, 13 nt, Human
agcggggggaggg

SEQ ID NO: 2107419 - RNA, 14 nt, Human
agcggggggagggu

SEQ ID NO: 2107420 - RNA, 14 nt, Human
agcgguuuggggag

SEQ ID NO: 2107421 - RNA, 16 nt, Human
ugcccacaggaucagu

SEQ ID NO: 2107422 - RNA, 19 nt, Human
ugcccacaggaucagucug

SEQ ID NO: 2107423 - RNA, 20 nt, Human
ugcccacaggaucagucuga

SEQ ID NO: 2107424 - RNA, 23 nt, Human
ugcccaagaauagaugcugacug

SEQ ID NO: 2107425 - RNA, 22 nt, Human
ugcccaagaauagaugcugacu

SEQ ID NO: 2107426 - RNA, 21 nt, Human
ugcccaagaauagaugcugac

SEQ ID NO: 2107427 - RNA, 19 nt, Human
agcucaguuuauccaaggu

SEQ ID NO: 2107428 - RNA, 19 nt, Human
agcucauguagcaaucaga

SEQ ID NO: 2107429 - RNA, 21 nt, Human
agcucauuauaaugucauuaa

SEQ ID NO: 2107430 - RNA, 21 nt, Human
agcucaggugucccugcacuu

SEQ ID NO: 2107431 - RNA, 20 nt, Human
agcucaggugucccugcacu

SEQ ID NO: 2107432 - RNA, 22 nt, Human
agcucaggugucccugcacuug

SEQ ID NO: 2107433 - RNA, 18 nt, Human
agcucagucuucccuagg

SEQ ID NO: 2107434 - RNA, 21 nt, Human
agcucagucuucccuagggcu

SEQ ID NO: 2107435 - RNA, 22 nt, Human
agcucagucuucccuagggcug

SEQ ID NO: 2107436 - RNA, 23 nt, Human
agcucagucuucccuagggcugg

SEQ ID NO: 2107437 - RNA, 13 nt, Human
agcucagucccau

SEQ ID NO: 2107438 - RNA, 21 nt, Human
agcucagucccaucagagagc

SEQ ID NO: 2107439 - RNA, 18 nt, Human
agcucaggugucccugca

SEQ ID NO: 2107440 - RNA, 20 nt, Human
agcucagcuuuuugucuuuu

SEQ ID NO: 2107441 - RNA, 22 nt, Human
agcucagcuuuuugucuuuucu

SEQ ID NO: 2107442 - RNA, 15 nt, Human
agcuaggccuggcca

SEQ ID NO: 2107443 - RNA, 14 nt, Human
agcuaggccuggcc

SEQ ID NO: 2107444 - RNA, 16 nt, Human
agcuaggccuggccag

SEQ ID NO: 2107445 - RNA, 12 nt, Human
agcuaggccugg

SEQ ID NO: 2107446 - RNA, 22 nt, Human
agccuugguguccaccuggccc

SEQ ID NO: 2107447 - RNA, 19 nt, Human
agccuugguguccaccugg

SEQ ID NO: 2107448 - RNA, 21 nt, Human
agccuugguguccaccuggcc

SEQ ID NO: 2107449 - RNA, 16 nt, Human
agccuuccacacucac

SEQ ID NO: 2107450 - RNA, 16 nt, Human
agccuugguguccacc

SEQ ID NO: 2107451 - RNA, 17 nt, Human
agccuugguguccaccu

SEQ ID NO: 2107452 - RNA, 18 nt, Human
agccuugguguccaccug

SEQ ID NO: 2107453 - RNA, 18 nt, Human
agcggagacggaguccca

SEQ ID NO: 2107454 - RNA, 15 nt, Human
agcgccugccccucc

SEQ ID NO: 2107455 - RNA, 18 nt, Human
agcgccugccccucccag

SEQ ID NO: 2107456 - RNA, 23 nt, Human
agcgccuaguggggucucccucu

SEQ ID NO: 2107457 - RNA, 12 nt, Human
agcgccugcccc

SEQ ID NO: 2107458 - RNA, 19 nt, Human
agcgccugccccucccaga

SEQ ID NO: 2107459 - RNA, 20 nt, Human
agccuugguucaucaguguu

SEQ ID NO: 2107460 - RNA, 13 nt, Human
ugcauugaauaua

SEQ ID NO: 2107461 - RNA, 14 nt, Human
ugcauugaauauau

SEQ ID NO: 2107462 - RNA, 16 nt, Human
ugcauugaauauauua

SEQ ID NO: 2107463 - RNA, 23 nt, Human
agcggagguugcagggagccgag

SEQ ID NO: 2107464 - RNA, 15 nt, Human
ugcauugaauauauu

SEQ ID NO: 2107465 - RNA, 15 nt, Human
ugcauugagaacugc

SEQ ID NO: 2107466 - RNA, 17 nt, Human
ugcauugagaacugcau

SEQ ID NO: 2107467 - RNA, 23 nt, Human
ugcauugccugcggucaaggcca

SEQ ID NO: 2107468 - RNA, 16 nt, Human
ugccacacuucaggcu

SEQ ID NO: 2107469 - RNA, 15 nt, Human
ugccacacuucaggc

SEQ ID NO: 2107470 - RNA, 14 nt, Human
ugccacacuucagg

SEQ ID NO: 2107471 - RNA, 13 nt, Human
ugccacacuucag

SEQ ID NO: 2107472 - RNA, 14 nt, Human
agccuggugcugcu

SEQ ID NO: 2107473 - RNA, 15 nt, Human
agccuggugcugcug

SEQ ID NO: 2107474 - RNA, 16 nt, Human
agccuggugcugcugc

SEQ ID NO: 2107475 - RNA, 21 nt, Human
agccugugccucugggacugg

SEQ ID NO: 2107476 - RNA, 11 nt, Human
agccugguggg

SEQ ID NO: 2107477 - RNA, 14 nt, Human
agccuggugggccu

SEQ ID NO: 2107478 - RNA, 16 nt, Human
agccuggugggccucc

SEQ ID NO: 2107479 - RNA, 18 nt, Human
agccuggugggccuccuc

SEQ ID NO: 2107480 - RNA, 21 nt, Human
agccuggugggccuccucugu

SEQ ID NO: 2107481 - RNA, 22 nt, Human
agccuggugggccuccucuguc

SEQ ID NO: 2107482 - RNA, 11 nt, Human
agccuguggca

SEQ ID NO: 2107483 - RNA, 22 nt, Human
agccuguggcaguaaagagaaa

SEQ ID NO: 2107484 - RNA, 23 nt, Human
agccuguggcaguaaagagaaac

SEQ ID NO: 2107485 - RNA, 24 nt, Human
agccuguggcaguaaagagaaacu

SEQ ID NO: 2107486 - RNA, 14 nt, Human
agccuguggcaucu

SEQ ID NO: 2107487 - RNA, 22 nt, Human
agccuguggcaucuuugccuug

SEQ ID NO: 2107488 - RNA, 17 nt, Human
agccuguggcggugccu

SEQ ID NO: 2107489 - RNA, 21 nt, Human
agccuguggcaucuuugccuu

SEQ ID NO: 2107490 - RNA, 22 nt, Human
agccuguggcggugccugggug

SEQ ID NO: 2107491 - RNA, 18 nt, Human
agccuguggcggugccug

SEQ ID NO: 2107492 - RNA, 19 nt, Human
agccuguggcggugccugg

SEQ ID NO: 2107493 - RNA, 20 nt, Human
agccuguggcggugccuggg

SEQ ID NO: 2107494 - RNA, 23 nt, Human
agccuucagucuugaauuucuaa

SEQ ID NO: 2107495 - RNA, 18 nt, Human
ugcauaccaaccugggca

SEQ ID NO: 2107496 - RNA, 14 nt, Human
ugcauaccaaccug

SEQ ID NO: 2107497 - RNA, 12 nt, Human
ugcauaccaacc

SEQ ID NO: 2107498 - RNA, 16 nt, Human
ugcauacauacacaua

SEQ ID NO: 2107499 - RNA, 15 nt, Human
agccugcuccagcug

SEQ ID NO: 2107500 - RNA, 16 nt, Human
agccugcuccagcugu

SEQ ID NO: 2107501 - RNA, 17 nt, Human
agccugcuccagcuguu

SEQ ID NO: 2107502 - RNA, 22 nt, Human
agccugggugacagagcaagug

SEQ ID NO: 2107503 - RNA, 23 nt, Human
agccugcucccccacccccuccc

SEQ ID NO: 2107504 - RNA, 19 nt, Human
agccugcucccccaccccc

SEQ ID NO: 2107505 - RNA, 21 nt, Human
agccugcucccccacccccuc

SEQ ID NO: 2107506 - RNA, 11 nt, Human
agccugcuccc

SEQ ID NO: 2107507 - RNA, 14 nt, Human
agccugcuccccca

SEQ ID NO: 2107508 - RNA, 15 nt, Human
agccugcucccccac

SEQ ID NO: 2107509 - RNA, 17 nt, Human
agccugcucccccaccc

SEQ ID NO: 2107510 - RNA, 19 nt, Human
agccugcuccagcuguuca

SEQ ID NO: 2107511 - RNA, 22 nt, Human
agccugcuccagcuguucagcu

SEQ ID NO: 2107512 - RNA, 19 nt, Human
ugauucuccugccucagcc

SEQ ID NO: 2107513 - RNA, 15 nt, Human
ugauucuccugccuc

SEQ ID NO: 2107514 - RNA, 21 nt, Human
ugauucgcccaaagccagaca

SEQ ID NO: 2107515 - RNA, 22 nt, Human
ugauucgcccaaagccagacag

SEQ ID NO: 2107516 - RNA, 15 nt, Human
ugauucgagcuauau

SEQ ID NO: 2107517 - RNA, 16 nt, Human
ugauucgagcuauauu

SEQ ID NO: 2107518 - RNA, 23 nt, Human
ugauucgagcuauauuuaaguau

SEQ ID NO: 2107519 - RNA, 16 nt, Human
ugauucgcccaaagcc

SEQ ID NO: 2107520 - RNA, 20 nt, Human
ugauucuccugccucagccu

SEQ ID NO: 2107521 - RNA, 17 nt, Human
agcccaggguuccccca

SEQ ID NO: 2107522 - RNA, 23 nt, Human
agcccaggguucccccagcccug

SEQ ID NO: 2107523 - RNA, 18 nt, Human
agcccaggguucccccag

SEQ ID NO: 2107524 - RNA, 19 nt, Human
agcccaggguucccccagc

SEQ ID NO: 2107525 - RNA, 21 nt, Human
agcccaggguucccccagccc

SEQ ID NO: 2107526 - RNA, 22 nt, Human
agcccaggguucccccagcccu

SEQ ID NO: 2107527 - RNA, 13 nt, Human
agcccaucaauua

SEQ ID NO: 2107528 - RNA, 17 nt, Human
agcccaucuugccucca

SEQ ID NO: 2107529 - RNA, 19 nt, Human
agcccaucuugccuccaug

SEQ ID NO: 2107530 - RNA, 11 nt, Human
agcccaugccc

SEQ ID NO: 2107531 - RNA, 22 nt, Human
agcccaugcccaccugcccauc

SEQ ID NO: 2107532 - RNA, 16 nt, Human
agcccaugcccaccug

SEQ ID NO: 2107533 - RNA, 20 nt, Human
agcccaugcccaccugccca

SEQ ID NO: 2107534 - RNA, 20 nt, Human
agccccgcaaaacccacuga

SEQ ID NO: 2107535 - RNA, 13 nt, Human
agccccucccacc

SEQ ID NO: 2107536 - RNA, 14 nt, Human
agccccucccacca

SEQ ID NO: 2107537 - RNA, 18 nt, Human
agccccucccaccacagc

SEQ ID NO: 2107538 - RNA, 18 nt, Human
agccccugccccucaugc

SEQ ID NO: 2107539 - RNA, 19 nt, Human
agccccugccccucaugcc

SEQ ID NO: 2107540 - RNA, 16 nt, Human
agccccucccaccaca

SEQ ID NO: 2107541 - RNA, 17 nt, Human
agccccucccaccacag

SEQ ID NO: 2107542 - RNA, 16 nt, Human
agccccgaggccuucu

SEQ ID NO: 2107543 - RNA, 22 nt, Human
agccccgaggccuucucugaag

SEQ ID NO: 2107544 - RNA, 17 nt, Human
agccccgaggccuucuc

SEQ ID NO: 2107545 - RNA, 18 nt, Human
ugcacacucacuggcauc

SEQ ID NO: 2107546 - RNA, 18 nt, Human
ugcacacuccccugcacu

SEQ ID NO: 2107547 - RNA, 21 nt, Human
ugcacacuagccucuccagga

SEQ ID NO: 2107548 - RNA, 21 nt, Human
ugcacacuccccugcacugga

SEQ ID NO: 2107549 - RNA, 19 nt, Human
ugcacacuagccucuccag

SEQ ID NO: 2107550 - RNA, 23 nt, Human
ugcaccauugcgcucuagccugg

SEQ ID NO: 2107551 - RNA, 17 nt, Human
ugcacccacccaggagu

SEQ ID NO: 2107552 - RNA, 18 nt, Human
ugcacccacccaggagug

SEQ ID NO: 2107553 - RNA, 21 nt, Human
ugcacccacucugcuuugacu

SEQ ID NO: 2107554 - RNA, 14 nt, Human
ugcacacagugcuu

SEQ ID NO: 2107555 - RNA, 19 nt, Human
ugcacacauuaggcauuga

SEQ ID NO: 2107556 - RNA, 15 nt, Human
ugcacgugugugcac

SEQ ID NO: 2107557 - RNA, 14 nt, Human
ugcacgugugugca

SEQ ID NO: 2107558 - RNA, 16 nt, Human
ugcacccuccgccuuc

SEQ ID NO: 2107559 - RNA, 16 nt, Human
ugcacguggcuucuga

SEQ ID NO: 2107560 - RNA, 18 nt, Human
ugcacguggcuucugaug

SEQ ID NO: 2107561 - RNA, 12 nt, Human
ugcacgugugca

SEQ ID NO: 2107562 - RNA, 14 nt, Human
ugcacccuccgccu

SEQ ID NO: 2107563 - RNA, 16 nt, Human
ugcacccucaggcagg

SEQ ID NO: 2107564 - RNA, 17 nt, Human
ugcacccucaggcaggu

SEQ ID NO: 2107565 - RNA, 23 nt, Human
agcccugguggcagugggagcug

SEQ ID NO: 2107566 - RNA, 22 nt, Human
agcccugguggcagugggagcu

SEQ ID NO: 2107567 - RNA, 15 nt, Human
ugcacaagcugcacc

SEQ ID NO: 2107568 - RNA, 14 nt, Human
agcccugucagugc

SEQ ID NO: 2107569 - RNA, 16 nt, Human
agcccugucagugcag

SEQ ID NO: 2107570 - RNA, 22 nt, Human
ugcacacaccagagcccaccuu

SEQ ID NO: 2107571 - RNA, 18 nt, Human
ugcacaagcugcacccuc

SEQ ID NO: 2107572 - RNA, 21 nt, Human
ugcacaagcugcacccucagg

SEQ ID NO: 2107573 - RNA, 23 nt, Human
agccccuugcucuccccugcccu

SEQ ID NO: 2107574 - RNA, 23 nt, Human
agcccugcuuugggcugcccugg

SEQ ID NO: 2107575 - RNA, 22 nt, Human
agcccugcuuugggcugcccug

SEQ ID NO: 2107576 - RNA, 21 nt, Human
agcccugguggcagugggagc

SEQ ID NO: 2107577 - RNA, 21 nt, Human
agcccugcuuugggcugcccu

SEQ ID NO: 2107578 - RNA, 17 nt, Human
agccccuugagaaaccu

SEQ ID NO: 2107579 - RNA, 20 nt, Human
agccccuugcucuccccugc

SEQ ID NO: 2107580 - RNA, 12 nt, Human
agccucaucucu

SEQ ID NO: 2107581 - RNA, 19 nt, Human
agccucauccgaggcaggg

SEQ ID NO: 2107582 - RNA, 23 nt, Human
agccucagcauccuggcacccgg

SEQ ID NO: 2107583 - RNA, 22 nt, Human
agccucagcauccuggcacccg

SEQ ID NO: 2107584 - RNA, 16 nt, Human
agccucccaaagugcu

SEQ ID NO: 2107585 - RNA, 20 nt, Human
agccuccauuuaguucuuug

SEQ ID NO: 2107586 - RNA, 21 nt, Human
agccuccauuuaguucuuugu

SEQ ID NO: 2107587 - RNA, 20 nt, Human
agccucauccgaggcagggu

SEQ ID NO: 2107588 - RNA, 15 nt, Human
agccuccauuuaguu

SEQ ID NO: 2107589 - RNA, 17 nt, Human
agccuccauuuaguucu

SEQ ID NO: 2107590 - RNA, 20 nt, Human
agccuccaugcugccuccag

SEQ ID NO: 2107591 - RNA, 18 nt, Human
agccuccaugcugccucc

SEQ ID NO: 2107592 - RNA, 15 nt, Human
agccuagacccuccu

SEQ ID NO: 2107593 - RNA, 18 nt, Human
agccuagacccuccuccu

SEQ ID NO: 2107594 - RNA, 19 nt, Human
agccuacuagggaccuggg

SEQ ID NO: 2107595 - RNA, 21 nt, Human
agccuacuagggaccugggga

SEQ ID NO: 2107596 - RNA, 22 nt, Human
agccuacuagggaccuggggaa

SEQ ID NO: 2107597 - RNA, 17 nt, Human
agccuagaagagcuucu

SEQ ID NO: 2107598 - RNA, 19 nt, Human
agccuagaagagcuucuga

SEQ ID NO: 2107599 - RNA, 17 nt, Human
agccuagccgaccucag

SEQ ID NO: 2107600 - RNA, 18 nt, Human
agccuagccgaccucagc

SEQ ID NO: 2107601 - RNA, 19 nt, Human
agccuagccgaccucagcc

SEQ ID NO: 2107602 - RNA, 20 nt, Human
agccuagccgaccucagccu

SEQ ID NO: 2107603 - RNA, 21 nt, Human
agccuagccgaccucagccuu

SEQ ID NO: 2107604 - RNA, 16 nt, Human
agccucagcauccugg

SEQ ID NO: 2107605 - RNA, 21 nt, Human
agccucagcauccuggcaccc

SEQ ID NO: 2107606 - RNA, 20 nt, Human
agccucagcauccuggcacc

SEQ ID NO: 2107607 - RNA, 19 nt, Human
agccucagcauccuggcac

SEQ ID NO: 2107608 - RNA, 17 nt, Human
agccucagcauccuggc

SEQ ID NO: 2107609 - RNA, 16 nt, Human
agccgaccucagccuu

SEQ ID NO: 2107610 - RNA, 14 nt, Human
agccgaccucagcc

SEQ ID NO: 2107611 - RNA, 15 nt, Human
agccgaccucagccu

SEQ ID NO: 2107612 - RNA, 13 nt, Human
agccgagagccug

SEQ ID NO: 2107613 - RNA, 14 nt, Human
agccgagagccugc

SEQ ID NO: 2107614 - RNA, 12 nt, Human
agccgaccucag

SEQ ID NO: 2107615 - RNA, 13 nt, Human
agccgaccucagc

SEQ ID NO: 2107616 - RNA, 13 nt, Human
agccguggcuucc

SEQ ID NO: 2107617 - RNA, 15 nt, Human
agccgagagccugcu

SEQ ID NO: 2107618 - RNA, 16 nt, Human
agccgagagccugcuc

SEQ ID NO: 2107619 - RNA, 17 nt, Human
agccgagagccugcucc

SEQ ID NO: 2107620 - RNA, 18 nt, Human
agccgagagccugcuccc

SEQ ID NO: 2107621 - RNA, 21 nt, Human
agccguggcuucccgcucagc

SEQ ID NO: 2107622 - RNA, 14 nt, Human
agccguggcuuccc

SEQ ID NO: 2107623 - RNA, 23 nt, Human
agccguggcuucccgcucagccc

SEQ ID NO: 2107624 - RNA, 22 nt, Human
agccguggcuucccgcucagcc

SEQ ID NO: 2107625 - RNA, 21 nt, Human
agccgagagccugcuccccca

SEQ ID NO: 2107626 - RNA, 23 nt, Human
ugcacuauagccuaggugacaga

SEQ ID NO: 2107627 - RNA, 15 nt, Human
ugcaccauugcugcu

SEQ ID NO: 2107628 - RNA, 20 nt, Human
agccugaaauagugguucuu

SEQ ID NO: 2107629 - RNA, 22 nt, Human
agccugaaauagugguucuugg

SEQ ID NO: 2107630 - RNA, 23 nt, Human
ugcagcccaugcccaccugccca

SEQ ID NO: 2107631 - RNA, 14 nt, Human
ugcagcccaugccc

SEQ ID NO: 2107632 - RNA, 18 nt, Human
ugcagcccaugcccaccu

SEQ ID NO: 2107633 - RNA, 19 nt, Human
ugcagcccaugcccaccug

SEQ ID NO: 2107634 - RNA, 21 nt, Human
ugcagcccaugcccaccugcc

SEQ ID NO: 2107635 - RNA, 19 nt, Human
ugcagcccguguggccccu

SEQ ID NO: 2107636 - RNA, 21 nt, Human
ugcagcccguguggccccuuc

SEQ ID NO: 2107637 - RNA, 23 nt, Human
ugcagcccguguggccccuucac

SEQ ID NO: 2107638 - RNA, 21 nt, Human
ugcagccccgcgccuccuucc

SEQ ID NO: 2107639 - RNA, 23 nt, Human
ugcagccuuugccuccccggcuc

SEQ ID NO: 2107640 - RNA, 19 nt, Human
ugcagcgaaccaauauuug

SEQ ID NO: 2107641 - RNA, 14 nt, Human
ugcagccuggaggc

SEQ ID NO: 2107642 - RNA, 15 nt, Human
ugcagccuggaggcc

SEQ ID NO: 2107643 - RNA, 19 nt, Human
ugcagccucgaacuccugg

SEQ ID NO: 2107644 - RNA, 20 nt, Human
ugcagccucgaacuccuggg

SEQ ID NO: 2107645 - RNA, 21 nt, Human
ugcagccucgaacuccugggc

SEQ ID NO: 2107646 - RNA, 22 nt, Human
ugcagccucgaacuccugggcu

SEQ ID NO: 2107647 - RNA, 23 nt, Human
ugcagccucgaacuccugggcuc

SEQ ID NO: 2107648 - RNA, 15 nt, Human
ugcauaacugacaaa

SEQ ID NO: 2107649 - RNA, 22 nt, Human
ugcauaacugacaaaucaaguu

SEQ ID NO: 2107650 - RNA, 23 nt, Human
ugcauaacugacaaaucaaguuu

SEQ ID NO: 2107651 - RNA, 14 nt, Human
ugcauaaguuaacu

SEQ ID NO: 2107652 - RNA, 17 nt, Human
ugcauaaguuaacuucc

SEQ ID NO: 2107653 - RNA, 14 nt, Human
ugcagucugcuucu

SEQ ID NO: 2107654 - RNA, 15 nt, Human
ugcagucugcuucug

SEQ ID NO: 2107655 - RNA, 19 nt, Human
ugcagucugcuucugcacc

SEQ ID NO: 2107656 - RNA, 18 nt, Human
ugcaguacuuuaccuccu

SEQ ID NO: 2107657 - RNA, 16 nt, Human
ugcaguagagucaucu

SEQ ID NO: 2107658 - RNA, 19 nt, Human
ugcaguagagucaucucca

SEQ ID NO: 2107659 - RNA, 22 nt, Human
ugcaguagagucaucuccauca

SEQ ID NO: 2107660 - RNA, 13 nt, Human
uggauuggauuug

SEQ ID NO: 2107661 - RNA, 17 nt, Human
uggauugguguaaaagg

SEQ ID NO: 2107662 - RNA, 17 nt, Human
uggauuaauuaaaugca

SEQ ID NO: 2107663 - RNA, 17 nt, Human
uggauuagccuggagca

SEQ ID NO: 2107664 - RNA, 13 nt, Human
uggauggcuucua

SEQ ID NO: 2107665 - RNA, 21 nt, Human
uggagguugcagugagccaag

SEQ ID NO: 2107666 - RNA, 20 nt, Human
uggagguugcagugagcuga

SEQ ID NO: 2107667 - RNA, 18 nt, Human
uggaguagaccccuggcu

SEQ ID NO: 2107668 - RNA, 20 nt, Human
uggaguagaccccuggcugg

SEQ ID NO: 2107669 - RNA, 14 nt, Human
uggaguauauguca

SEQ ID NO: 2107670 - RNA, 24 nt, Human
uggagguuaaggcugaggaaaggc

SEQ ID NO: 2107671 - RNA, 20 nt, Human
uggagguuaaggcugaggaa

SEQ ID NO: 2107672 - RNA, 21 nt, Human
uggagguuaaggcugaggaaa

SEQ ID NO: 2107673 - RNA, 22 nt, Human
uggagguuaaggcugaggaaag

SEQ ID NO: 2107674 - RNA, 14 nt, Human
uggagguugcagug

SEQ ID NO: 2107675 - RNA, 17 nt, Human
aggcagccccauucugc

SEQ ID NO: 2107676 - RNA, 16 nt, Human
aggcagccccauucug

SEQ ID NO: 2107677 - RNA, 21 nt, Human
aggcaccuauaaaacagguca

SEQ ID NO: 2107678 - RNA, 14 nt, Human
aggccaagaggcug

SEQ ID NO: 2107679 - RNA, 14 nt, Human
aggccaagagcaga

SEQ ID NO: 2107680 - RNA, 17 nt, Human
aggccaagagcagaggc

SEQ ID NO: 2107681 - RNA, 18 nt, Human
aggccaagagcagaggca

SEQ ID NO: 2107682 - RNA, 20 nt, Human
aggccaagagcagaggcagc

SEQ ID NO: 2107683 - RNA, 16 nt, Human
aggccaaggugggagg

SEQ ID NO: 2107684 - RNA, 20 nt, Human
uggagggugggagagcccag

SEQ ID NO: 2107685 - RNA, 14 nt, Human
uggagguacacucu

SEQ ID NO: 2107686 - RNA, 19 nt, Human
uggaggggugguccugacu

SEQ ID NO: 2107687 - RNA, 20 nt, Human
uggaggggugguccugacuc

SEQ ID NO: 2107688 - RNA, 14 nt, Human
uggcaauucuuuga

SEQ ID NO: 2107689 - RNA, 18 nt, Human
uggcacagggcaguggga

SEQ ID NO: 2107690 - RNA, 23 nt, Human
uggcaauucuuugaccucaaccu

SEQ ID NO: 2107691 - RNA, 14 nt, Human
aggccagagggagu

SEQ ID NO: 2107692 - RNA, 17 nt, Human
uggcagccuuggcaaac

SEQ ID NO: 2107693 - RNA, 20 nt, Human
aggccagagggagugacaga

SEQ ID NO: 2107694 - RNA, 16 nt, Human
aggccagaguggccug

SEQ ID NO: 2107695 - RNA, 17 nt, Human
aggccagaguggccugg

SEQ ID NO: 2107696 - RNA, 13 nt, Human
aggccagccagug

SEQ ID NO: 2107697 - RNA, 22 nt, Human
aggccagccagugaccugagga

SEQ ID NO: 2107698 - RNA, 15 nt, Human
aggccagcaaggugg

SEQ ID NO: 2107699 - RNA, 17 nt, Human
aggccagcaagguggag

SEQ ID NO: 2107700 - RNA, 18 nt, Human
aggccagcaagguggagu

SEQ ID NO: 2107701 - RNA, 20 nt, Human
aggccagcaagguggagugg

SEQ ID NO: 2107702 - RNA, 22 nt, Human
aggccagcaagguggaguggau

SEQ ID NO: 2107703 - RNA, 24 nt, Human
aggccagcaagguggaguggaugc

SEQ ID NO: 2107704 - RNA, 19 nt, Human
aggccagaguggccuggcc

SEQ ID NO: 2107705 - RNA, 20 nt, Human
aggccagaguggccuggcca

SEQ ID NO: 2107706 - RNA, 21 nt, Human
aggccagaguggccuggccag

SEQ ID NO: 2107707 - RNA, 22 nt, Human
aggccagaguggccuggccagg

SEQ ID NO: 2107708 - RNA, 21 nt, Human
aggccagccccacccaggagg

SEQ ID NO: 2107709 - RNA, 17 nt, Human
aggccagccccacccag

SEQ ID NO: 2107710 - RNA, 18 nt, Human
aggccagccccacccagg

SEQ ID NO: 2107711 - RNA, 13 nt, Human
aggccagccccac

SEQ ID NO: 2107712 - RNA, 14 nt, Human
aggccagccccacc

SEQ ID NO: 2107713 - RNA, 15 nt, Human
aggccagccccaccc

SEQ ID NO: 2107714 - RNA, 16 nt, Human
aggccagccccaccca

SEQ ID NO: 2107715 - RNA, 21 nt, Human
aggccccaagggguuucuguu

SEQ ID NO: 2107716 - RNA, 21 nt, Human
aggccccaaaaccacagcccu

SEQ ID NO: 2107717 - RNA, 23 nt, Human
aggccccaaaaccacagcccugu

SEQ ID NO: 2107718 - RNA, 13 nt, Human
aggccccacuggg

SEQ ID NO: 2107719 - RNA, 15 nt, Human
aggccccacugggga

SEQ ID NO: 2107720 - RNA, 17 nt, Human
aggccccacuggggaaa

SEQ ID NO: 2107721 - RNA, 13 nt, Human
aggccccagagac

SEQ ID NO: 2107722 - RNA, 14 nt, Human
aggccccagagacu

SEQ ID NO: 2107723 - RNA, 20 nt, Human
aggccccagagacucagagg

SEQ ID NO: 2107724 - RNA, 22 nt, Human
aggccccagagacucagaggga

SEQ ID NO: 2107725 - RNA, 12 nt, Human
aggccccaggaa

SEQ ID NO: 2107726 - RNA, 18 nt, Human
aggcccaugguugagaaa

SEQ ID NO: 2107727 - RNA, 18 nt, Human
aggccccaaaaccacagc

SEQ ID NO: 2107728 - RNA, 22 nt, Human
uggcauacgccuguaguccuag

SEQ ID NO: 2107729 - RNA, 14 nt, Human
aggccccaggaagc

SEQ ID NO: 2107730 - RNA, 21 nt, Human
uggcaucuuugccuugggcug

SEQ ID NO: 2107731 - RNA, 23 nt, Human
uggcaucuuugccuugggcugcu

SEQ ID NO: 2107732 - RNA, 15 nt, Human
uggcauuucccuacu

SEQ ID NO: 2107733 - RNA, 15 nt, Human
uggcaucugacacaa

SEQ ID NO: 2107734 - RNA, 18 nt, Human
uggcaucugacacaaaaa

SEQ ID NO: 2107735 - RNA, 16 nt, Human
uggcaucuuugccuug

SEQ ID NO: 2107736 - RNA, 20 nt, Human
uggcaucuuugccuugggcu

SEQ ID NO: 2107737 - RNA, 12 nt, Human
aggccccugcca

SEQ ID NO: 2107738 - RNA, 22 nt, Human
aggccccgcuuguccagcgccu

SEQ ID NO: 2107739 - RNA, 20 nt, Human
aggccccgcuuguccagcgc

SEQ ID NO: 2107740 - RNA, 21 nt, Human
aggccccgcuuguccagcgcc

SEQ ID NO: 2107741 - RNA, 13 nt, Human
aggccccaggaag

SEQ ID NO: 2107742 - RNA, 15 nt, Human
aggccccgcuugucc

SEQ ID NO: 2107743 - RNA, 17 nt, Human
aggccccgcuuguccag

SEQ ID NO: 2107744 - RNA, 18 nt, Human
aggccccgcuuguccagc

SEQ ID NO: 2107745 - RNA, 19 nt, Human
uggccagguggccacucca

SEQ ID NO: 2107746 - RNA, 17 nt, Human
uggccagguggccacuc

SEQ ID NO: 2107747 - RNA, 16 nt, Human
uggccagguggccacu

SEQ ID NO: 2107748 - RNA, 23 nt, Human
uggccagugugacaaggauugcu

SEQ ID NO: 2107749 - RNA, 16 nt, Human
uggccagugugauccc

SEQ ID NO: 2107750 - RNA, 16 nt, Human
uggccaguuaucccuu

SEQ ID NO: 2107751 - RNA, 16 nt, Human
uggccaguuggaacca

SEQ ID NO: 2107752 - RNA, 11 nt, Human
uggccaucucu

SEQ ID NO: 2107753 - RNA, 23 nt, Human
uggccaaagccaaagcuaggccu

SEQ ID NO: 2107754 - RNA, 21 nt, Human
uggccaaagccaaagcuaggc

SEQ ID NO: 2107755 - RNA, 21 nt, Human
uggcauuugugaucaugagau

SEQ ID NO: 2107756 - RNA, 14 nt, Human
uggccaaaaagaau

SEQ ID NO: 2107757 - RNA, 22 nt, Human
uggccaaaaagaaucugcauuu

SEQ ID NO: 2107758 - RNA, 15 nt, Human
uggccagguggccac

SEQ ID NO: 2107759 - RNA, 11 nt, Human
uggccaggugg

SEQ ID NO: 2107760 - RNA, 14 nt, Human
uggccaaaguguua

SEQ ID NO: 2107761 - RNA, 18 nt, Human
uggccuuccccagccucu

SEQ ID NO: 2107762 - RNA, 18 nt, Human
uggccuguuucaacacag

SEQ ID NO: 2107763 - RNA, 18 nt, Human
uggccuuccauuuauaug

SEQ ID NO: 2107764 - RNA, 16 nt, Human
uggccuuccccagccu

SEQ ID NO: 2107765 - RNA, 17 nt, Human
uggccuuccccagccuc

SEQ ID NO: 2107766 - RNA, 17 nt, Human
uggccugggagagcugg

SEQ ID NO: 2107767 - RNA, 12 nt, Human
aggccuggggac

SEQ ID NO: 2107768 - RNA, 12 nt, Human
uggccuggcucc

SEQ ID NO: 2107769 - RNA, 14 nt, Human
uggccuggcuccgc

SEQ ID NO: 2107770 - RNA, 18 nt, Human
uggccuggcuccgcugug

SEQ ID NO: 2107771 - RNA, 13 nt, Human
uggccugggagag

SEQ ID NO: 2107772 - RNA, 16 nt, Human
uggccuaaaaaugcaa

SEQ ID NO: 2107773 - RNA, 16 nt, Human
uggcccugccuucuuc

SEQ ID NO: 2107774 - RNA, 11 nt, Human
uggcccugccu

SEQ ID NO: 2107775 - RNA, 12 nt, Human
uggcccugccuu

SEQ ID NO: 2107776 - RNA, 13 nt, Human
uggcccuggccug

SEQ ID NO: 2107777 - RNA, 14 nt, Human
uggcccuggccugc

SEQ ID NO: 2107778 - RNA, 15 nt, Human
uggcccuggccugcu

SEQ ID NO: 2107779 - RNA, 16 nt, Human
uggcccuggccugcug

SEQ ID NO: 2107780 - RNA, 17 nt, Human
uggcccuggccugcugg

SEQ ID NO: 2107781 - RNA, 18 nt, Human
uggcccuggccugcuggg

SEQ ID NO: 2107782 - RNA, 23 nt, Human
uggccgggcgcgguggcucacgc

SEQ ID NO: 2107783 - RNA, 12 nt, Human
uggcccuggggc

SEQ ID NO: 2107784 - RNA, 13 nt, Human
uggcccuggggcc

SEQ ID NO: 2107785 - RNA, 15 nt, Human
uggcccuggggccug

SEQ ID NO: 2107786 - RNA, 16 nt, Human
uggcccuggggccugu

SEQ ID NO: 2107787 - RNA, 20 nt, Human
uggccaugguccccaagacc

SEQ ID NO: 2107788 - RNA, 13 nt, Human
uggcccacgcacu

SEQ ID NO: 2107789 - RNA, 22 nt, Human
uggccaugccacccuguuuuca

SEQ ID NO: 2107790 - RNA, 18 nt, Human
aggagcugggauccuaag

SEQ ID NO: 2107791 - RNA, 20 nt, Human
aggagcugggcagaaggcca

SEQ ID NO: 2107792 - RNA, 21 nt, Human
aggagcugcuggcuugcagug

SEQ ID NO: 2107793 - RNA, 16 nt, Human
aggagcugggaggaaa

SEQ ID NO: 2107794 - RNA, 17 nt, Human
aggagcugggaggaaaa

SEQ ID NO: 2107795 - RNA, 19 nt, Human
aggagcugggggcagccug

SEQ ID NO: 2107796 - RNA, 17 nt, Human
aggagcuuaccucccac

SEQ ID NO: 2107797 - RNA, 18 nt, Human
aggagcuuaccucccacc

SEQ ID NO: 2107798 - RNA, 20 nt, Human
aggagcuuaccucccaccuu

SEQ ID NO: 2107799 - RNA, 13 nt, Human
aggagcugagaau

SEQ ID NO: 2107800 - RNA, 14 nt, Human
aggagcugagaaua

SEQ ID NO: 2107801 - RNA, 15 nt, Human
aggagcugagaauag

SEQ ID NO: 2107802 - RNA, 16 nt, Human
aggagcugagaauaga

SEQ ID NO: 2107803 - RNA, 17 nt, Human
aggagcugagaauagaa

SEQ ID NO: 2107804 - RNA, 18 nt, Human
aggagcugagaauagaag

SEQ ID NO: 2107805 - RNA, 22 nt, Human
aggagcugagaauagaaggaaa

SEQ ID NO: 2107806 - RNA, 23 nt, Human
aggagcugagaauagaaggaaac

SEQ ID NO: 2107807 - RNA, 17 nt, Human
aggagcucuucaggccu

SEQ ID NO: 2107808 - RNA, 19 nt, Human
aggagcucuucaggccucc

SEQ ID NO: 2107809 - RNA, 21 nt, Human
aggagcucuucaggccucccu

SEQ ID NO: 2107810 - RNA, 13 nt, Human
aggauacucuguc

SEQ ID NO: 2107811 - RNA, 16 nt, Human
aggauacucugucaga

SEQ ID NO: 2107812 - RNA, 16 nt, Human
aggauagauaacucuu

SEQ ID NO: 2107813 - RNA, 20 nt, Human
aggauagauaacucuuugga

SEQ ID NO: 2107814 - RNA, 17 nt, Human
uggaagggaagaaaagg

SEQ ID NO: 2107815 - RNA, 15 nt, Human
uggaagggacuagga

SEQ ID NO: 2107816 - RNA, 11 nt, Human
uggaagcacag

SEQ ID NO: 2107817 - RNA, 22 nt, Human
uggaagcacagaaaacuagaau

SEQ ID NO: 2107818 - RNA, 11 nt, Human
uggaaggaaag

SEQ ID NO: 2107819 - RNA, 14 nt, Human
uggaaggaaagaug

SEQ ID NO: 2107820 - RNA, 15 nt, Human
uggaaggaaagaugc

SEQ ID NO: 2107821 - RNA, 15 nt, Human
uggaaggguuugugg

SEQ ID NO: 2107822 - RNA, 17 nt, Human
uggaaggguuuguggcu

SEQ ID NO: 2107823 - RNA, 21 nt, Human
uggaagguuuguauauuguca

SEQ ID NO: 2107824 - RNA, 22 nt, Human
uggaagauuugcccauuuacac

SEQ ID NO: 2107825 - RNA, 23 nt, Human
uggaagauuugcccauuuacacu

SEQ ID NO: 2107826 - RNA, 14 nt, Human
uggaagauuuuaaa

SEQ ID NO: 2107827 - RNA, 16 nt, Human
uggaagauuuuaaauu

SEQ ID NO: 2107828 - RNA, 16 nt, Human
uggaagcacagcuuca

SEQ ID NO: 2107829 - RNA, 21 nt, Human
ugcuugaggcaacucaucuua

SEQ ID NO: 2107830 - RNA, 20 nt, Human
aggacauaaauuagaggucu

SEQ ID NO: 2107831 - RNA, 15 nt, Human
ugcuugaugguuuau

SEQ ID NO: 2107832 - RNA, 18 nt, Human
ugcuugaugguuuauguu

SEQ ID NO: 2107833 - RNA, 15 nt, Human
aggacagugcuucag

SEQ ID NO: 2107834 - RNA, 16 nt, Human
aggacagugcuucagc

SEQ ID NO: 2107835 - RNA, 17 nt, Human
aggacagugcuucagcc

SEQ ID NO: 2107836 - RNA, 18 nt, Human
aggacagugcuucagccu

SEQ ID NO: 2107837 - RNA, 19 nt, Human
aggacagugcuucagccug

SEQ ID NO: 2107838 - RNA, 20 nt, Human
aggacagugcuucagccuga

SEQ ID NO: 2107839 - RNA, 21 nt, Human
aggacagugcuucagccugag

SEQ ID NO: 2107840 - RNA, 22 nt, Human
aggacagugcuucagccugagg

SEQ ID NO: 2107841 - RNA, 18 nt, Human
ugcuuguaacaagaaaac

SEQ ID NO: 2107842 - RNA, 19 nt, Human
ugcuuguaacaagaaaaca

SEQ ID NO: 2107843 - RNA, 20 nt, Human
ugcuuguaacaagaaaacau

SEQ ID NO: 2107844 - RNA, 21 nt, Human
ugcuuguaacaagaaaacaua

SEQ ID NO: 2107845 - RNA, 23 nt, Human
ugcuuguaacaagaaaacauaag

SEQ ID NO: 2107846 - RNA, 21 nt, Human
ugcuuggaauaucugcuguau

SEQ ID NO: 2107847 - RNA, 19 nt, Human
ugcuuggaccucgugcuuu

SEQ ID NO: 2107848 - RNA, 20 nt, Human
ugcuuggaccucgugcuuua

SEQ ID NO: 2107849 - RNA, 21 nt, Human
ugcuuggaccucgugcuuuaa

SEQ ID NO: 2107850 - RNA, 17 nt, Human
ugcuuuuggucugugug

SEQ ID NO: 2107851 - RNA, 14 nt, Human
ugcuuuuggucugu

SEQ ID NO: 2107852 - RNA, 13 nt, Human
uggaaaggcucag

SEQ ID NO: 2107853 - RNA, 17 nt, Human
uggaaaggcucagucuc

SEQ ID NO: 2107854 - RNA, 20 nt, Human
uggaaaggcucagucucagg

SEQ ID NO: 2107855 - RNA, 21 nt, Human
uggaaaggcucagucucagga

SEQ ID NO: 2107856 - RNA, 23 nt, Human
uggaaaggcucagucucaggagc

SEQ ID NO: 2107857 - RNA, 23 nt, Human
uggaaagggugcugcuucccucu

SEQ ID NO: 2107858 - RNA, 17 nt, Human
ugcuugucccugcccag

SEQ ID NO: 2107859 - RNA, 15 nt, Human
aggcaccgagaaugu

SEQ ID NO: 2107860 - RNA, 16 nt, Human
aggcaccgagaauguu

SEQ ID NO: 2107861 - RNA, 18 nt, Human
aggcaccgagaauguugu

SEQ ID NO: 2107862 - RNA, 12 nt, Human
aggcacccaucc

SEQ ID NO: 2107863 - RNA, 21 nt, Human
aggcacccauccuagagaaaa

SEQ ID NO: 2107864 - RNA, 22 nt, Human
aggcacccauccuagagaaaac

SEQ ID NO: 2107865 - RNA, 17 nt, Human
aggcaccgcugaugggg

SEQ ID NO: 2107866 - RNA, 14 nt, Human
aggcaaucacauag

SEQ ID NO: 2107867 - RNA, 22 nt, Human
aggcacccaccaucaugucugg

SEQ ID NO: 2107868 - RNA, 21 nt, Human
aggcacccaccaucaugucug

SEQ ID NO: 2107869 - RNA, 20 nt, Human
aggcacccaccaucaugucu

SEQ ID NO: 2107870 - RNA, 14 nt, Human
aggcaaugcuggcu

SEQ ID NO: 2107871 - RNA, 21 nt, Human
uggagcgcaccugcccccugg

SEQ ID NO: 2107872 - RNA, 22 nt, Human
uggagcgcaccugcccccuggu

SEQ ID NO: 2107873 - RNA, 12 nt, Human
uggagcuccugg

SEQ ID NO: 2107874 - RNA, 13 nt, Human
uggagcuccuggg

SEQ ID NO: 2107875 - RNA, 14 nt, Human
uggagcuccuggga

SEQ ID NO: 2107876 - RNA, 17 nt, Human
uggagcuccugggaagg

SEQ ID NO: 2107877 - RNA, 18 nt, Human
uggagcuccugggaaggc

SEQ ID NO: 2107878 - RNA, 20 nt, Human
uggagcuccugggaaggcua

SEQ ID NO: 2107879 - RNA, 15 nt, Human
uggagcccuuggguu

SEQ ID NO: 2107880 - RNA, 22 nt, Human
uggagcccgcacccccacccuu

SEQ ID NO: 2107881 - RNA, 19 nt, Human
uggagcccgcacccccacc

SEQ ID NO: 2107882 - RNA, 14 nt, Human
uggagcgcaccugc

SEQ ID NO: 2107883 - RNA, 16 nt, Human
uggagcgcaccugccc

SEQ ID NO: 2107884 - RNA, 14 nt, Human
aggcaauaaaaauc

SEQ ID NO: 2107885 - RNA, 22 nt, Human
aggcaaugauuguuaauuuaca

SEQ ID NO: 2107886 - RNA, 17 nt, Human
aggcaauaaaaaucaua

SEQ ID NO: 2107887 - RNA, 18 nt, Human
aggcaaggggugccuggg

SEQ ID NO: 2107888 - RNA, 19 nt, Human
aggcaaggggugccuggga

SEQ ID NO: 2107889 - RNA, 13 nt, Human
uggagaagcggcu

SEQ ID NO: 2107890 - RNA, 22 nt, Human
uggagaagcggcuggcagccca

SEQ ID NO: 2107891 - RNA, 17 nt, Human
uggagaacuccuagggu

SEQ ID NO: 2107892 - RNA, 15 nt, Human
uggagcccagggagc

SEQ ID NO: 2107893 - RNA, 20 nt, Human
uggagcccagggagcggaaa

SEQ ID NO: 2107894 - RNA, 16 nt, Human
uggagccccacugccc

SEQ ID NO: 2107895 - RNA, 18 nt, Human
uggagccccacugcccuu

SEQ ID NO: 2107896 - RNA, 22 nt, Human
uggagccccacugcccuucuca

SEQ ID NO: 2107897 - RNA, 14 nt, Human
uggagccccaucag

SEQ ID NO: 2107898 - RNA, 17 nt, Human
uggagcccgaggcacca

SEQ ID NO: 2107899 - RNA, 18 nt, Human
uggagcccgaggcaccag

SEQ ID NO: 2107900 - RNA, 19 nt, Human
uggagcccgaggcaccagu

SEQ ID NO: 2107901 - RNA, 16 nt, Human
uggagcccgcaccccc

SEQ ID NO: 2107902 - RNA, 17 nt, Human
uggagcccgcaccccca

SEQ ID NO: 2107903 - RNA, 18 nt, Human
uggagcccgcacccccac

SEQ ID NO: 2107904 - RNA, 20 nt, Human
uggacuuuccacccccuccc

SEQ ID NO: 2107905 - RNA, 15 nt, Human
uggaauucuguucau

SEQ ID NO: 2107906 - RNA, 14 nt, Human
uggagaacuagaga

SEQ ID NO: 2107907 - RNA, 15 nt, Human
uggagaacuccuagg

SEQ ID NO: 2107908 - RNA, 17 nt, Human
uggacuugagcuuggca

SEQ ID NO: 2107909 - RNA, 16 nt, Human
uggacuuuccaccccc

SEQ ID NO: 2107910 - RNA, 18 nt, Human
uggacuuuccacccccuc

SEQ ID NO: 2107911 - RNA, 19 nt, Human
uggacuuuccacccccucc

SEQ ID NO: 2107912 - RNA, 23 nt, Human
uggacacagcucuucuccaggcu

SEQ ID NO: 2107913 - RNA, 18 nt, Human
uggacaccaggagucccu

SEQ ID NO: 2107914 - RNA, 14 nt, Human
uggacacacacagc

SEQ ID NO: 2107915 - RNA, 15 nt, Human
uggacacacacagcu

SEQ ID NO: 2107916 - RNA, 23 nt, Human
uggacccuguggaugauaaaaca

SEQ ID NO: 2107917 - RNA, 20 nt, Human
uggaccuugaacuggguacu

SEQ ID NO: 2107918 - RNA, 19 nt, Human
aggaucucuugagccuggg

SEQ ID NO: 2107919 - RNA, 17 nt, Human
aggaucucuugagccug

SEQ ID NO: 2107920 - RNA, 18 nt, Human
aggaucucuugagccugg

SEQ ID NO: 2107921 - RNA, 14 nt, Human
uggacacagcucuu

SEQ ID NO: 2107922 - RNA, 13 nt, Human
uggacacagcucu

SEQ ID NO: 2107923 - RNA, 22 nt, Human
uggacacagcucuucuccaggc

SEQ ID NO: 2107924 - RNA, 21 nt, Human
uggacacagcucuucuccagg

SEQ ID NO: 2107925 - RNA, 17 nt, Human
uggacacacaaggugca

SEQ ID NO: 2107926 - RNA, 16 nt, Human
uggacaaucaugaaau

SEQ ID NO: 2107927 - RNA, 13 nt, Human
ugcuucaaaaaca

SEQ ID NO: 2107928 - RNA, 21 nt, Human
ugcuucaaaaacauucuuaca

SEQ ID NO: 2107929 - RNA, 23 nt, Human
ugcuuauuguuccaagacauugu

SEQ ID NO: 2107930 - RNA, 17 nt, Human
ugcuuauuguuccaaga

SEQ ID NO: 2107931 - RNA, 21 nt, Human
ugcuuauuguuccaagacauu

SEQ ID NO: 2107932 - RNA, 14 nt, Human
ugcuuauuguucca

SEQ ID NO: 2107933 - RNA, 15 nt, Human
ugcuuauuguuccaa

SEQ ID NO: 2107934 - RNA, 16 nt, Human
ugcuuauuguuccaag

SEQ ID NO: 2107935 - RNA, 16 nt, Human
ugcuuacucauuaaaa

SEQ ID NO: 2107936 - RNA, 16 nt, Human
ugcuguggccugggca

SEQ ID NO: 2107937 - RNA, 12 nt, Human
ugcuguggccug

SEQ ID NO: 2107938 - RNA, 14 nt, Human
ugcuguggccuggg

SEQ ID NO: 2107939 - RNA, 15 nt, Human
ugcuguggccugggc

SEQ ID NO: 2107940 - RNA, 18 nt, Human
aggacaccuguacuggag

SEQ ID NO: 2107941 - RNA, 19 nt, Human
aggacaccuguacuggaga

SEQ ID NO: 2107942 - RNA, 20 nt, Human
aggacaccuguacuggagag

SEQ ID NO: 2107943 - RNA, 22 nt, Human
aggacaccuguacuggagagca

SEQ ID NO: 2107944 - RNA, 18 nt, Human
aggacacuaaccacgcug

SEQ ID NO: 2107945 - RNA, 16 nt, Human
ugcuucaugaaaaucc

SEQ ID NO: 2107946 - RNA, 17 nt, Human
ugcuucaugaaaauccu

SEQ ID NO: 2107947 - RNA, 18 nt, Human
ugcuucaugaaaauccua

SEQ ID NO: 2107948 - RNA, 20 nt, Human
ugcuucaugaaaauccuacc

SEQ ID NO: 2107949 - RNA, 21 nt, Human
ugcuucaugaaaauccuacca

SEQ ID NO: 2107950 - RNA, 14 nt, Human
ugcuucaacugucu

SEQ ID NO: 2107951 - RNA, 15 nt, Human
ugcuuauuuuaaaau

SEQ ID NO: 2107952 - RNA, 17 nt, Human
ugcuuauuuuaaaauuu

SEQ ID NO: 2107953 - RNA, 21 nt, Human
ugcuucaaacucaaacacaga

SEQ ID NO: 2107954 - RNA, 24 nt, Human
aggaaugccuccucccugggcaga

SEQ ID NO: 2107955 - RNA, 13 nt, Human
aggaaugcuaaca

SEQ ID NO: 2107956 - RNA, 20 nt, Human
aggaaugcuaacaguucacu

SEQ ID NO: 2107957 - RNA, 22 nt, Human
aggaaugcuaacaguucacuug

SEQ ID NO: 2107958 - RNA, 12 nt, Human
aggaaugcuccc

SEQ ID NO: 2107959 - RNA, 16 nt, Human
aggaaugccuguguga

SEQ ID NO: 2107960 - RNA, 13 nt, Human
aggaaugcucccc

SEQ ID NO: 2107961 - RNA, 14 nt, Human
aggaaugcuccccc

SEQ ID NO: 2107962 - RNA, 15 nt, Human
aggaaugcuccccca

SEQ ID NO: 2107963 - RNA, 19 nt, Human
aggaaggagacucaccucu

SEQ ID NO: 2107964 - RNA, 20 nt, Human
aggaagcucagacugguuga

SEQ ID NO: 2107965 - RNA, 21 nt, Human
aggaaggagacucaccucugc

SEQ ID NO: 2107966 - RNA, 22 nt, Human
aggaaugcucccccauccuccc

SEQ ID NO: 2107967 - RNA, 20 nt, Human
aggaaugcucccccauccuc

SEQ ID NO: 2107968 - RNA, 16 nt, Human
aggaaugcuuggaaua

SEQ ID NO: 2107969 - RNA, 20 nt, Human
aggaaugcuuggaauaucug

SEQ ID NO: 2107970 - RNA, 24 nt, Human
aggaaugcuuggaauaucugcugu

SEQ ID NO: 2107971 - RNA, 18 nt, Human
aggaauggaggcucuaau

SEQ ID NO: 2107972 - RNA, 20 nt, Human
aggaauggaggcucuaauug

SEQ ID NO: 2107973 - RNA, 21 nt, Human
aggaauggaggcucuaauuga

SEQ ID NO: 2107974 - RNA, 20 nt, Human
ugcuggccccucaccugggc

SEQ ID NO: 2107975 - RNA, 22 nt, Human
ugcuggccccucaccugggcac

SEQ ID NO: 2107976 - RNA, 24 nt, Human
ugcuggccccucaccugggcaccu

SEQ ID NO: 2107977 - RNA, 18 nt, Human
ugcuggcacauuucccca

SEQ ID NO: 2107978 - RNA, 20 nt, Human
ugcuggcacauuuccccaga

SEQ ID NO: 2107979 - RNA, 19 nt, Human
ugcuggaucucccagggcu

SEQ ID NO: 2107980 - RNA, 20 nt, Human
ugcuggaucucccagggcua

SEQ ID NO: 2107981 - RNA, 15 nt, Human
ugcuggauaaaauga

SEQ ID NO: 2107982 - RNA, 17 nt, Human
ugcuggauaaaaugagg

SEQ ID NO: 2107983 - RNA, 16 nt, Human
ugcuggauauuuucaa

SEQ ID NO: 2107984 - RNA, 17 nt, Human
ugcuggauauuuucaaa

SEQ ID NO: 2107985 - RNA, 22 nt, Human
ugcuggauauuuucaaauugua

SEQ ID NO: 2107986 - RNA, 17 nt, Human
ugcugggauuacaggug

SEQ ID NO: 2107987 - RNA, 21 nt, Human
ugcugggauuacaagcgugag

SEQ ID NO: 2107988 - RNA, 16 nt, Human
ugcuggccgggcacag

SEQ ID NO: 2107989 - RNA, 17 nt, Human
ugcuggccgggcacagc

SEQ ID NO: 2107990 - RNA, 18 nt, Human
ugcuggccgggcacagcu

SEQ ID NO: 2107991 - RNA, 19 nt, Human
ugcuggccgggcacagcug

SEQ ID NO: 2107992 - RNA, 13 nt, Human
ugcuggcugccuu

SEQ ID NO: 2107993 - RNA, 15 nt, Human
ugcuggcucccaggg

SEQ ID NO: 2107994 - RNA, 16 nt, Human
ugcuggcucccagggc

SEQ ID NO: 2107995 - RNA, 18 nt, Human
ugcuggcucccagggcca

SEQ ID NO: 2107996 - RNA, 13 nt, Human
ugcuggcugccca

SEQ ID NO: 2107997 - RNA, 14 nt, Human
ugcuggcugcccag

SEQ ID NO: 2107998 - RNA, 21 nt, Human
ugcuggcugcccagaccccuc

SEQ ID NO: 2107999 - RNA, 21 nt, Human
ugcuggcuguuggcugggggc

SEQ ID NO: 2108000 - RNA, 19 nt, Human
ugcuggcuguuggcugggg

SEQ ID NO: 2108001 - RNA, 19 nt, Human
ugcugggauuacaagcgug

SEQ ID NO: 2108002 - RNA, 19 nt, Human
ugcugacuguacuccuccc

SEQ ID NO: 2108003 - RNA, 16 nt, Human
ugcugacuguacuccu

SEQ ID NO: 2108004 - RNA, 14 nt, Human
ugcugacuguacuc

SEQ ID NO: 2108005 - RNA, 16 nt, Human
ugcucuggacaggcau

SEQ ID NO: 2108006 - RNA, 15 nt, Human
ugcucuggacaggca

SEQ ID NO: 2108007 - RNA, 14 nt, Human
ugcucuggacaggc

SEQ ID NO: 2108008 - RNA, 11 nt, Human
ugcuccuccag

SEQ ID NO: 2108009 - RNA, 12 nt, Human
ugcuccuccagg

SEQ ID NO: 2108010 - RNA, 13 nt, Human
ugcuccuccaggg

SEQ ID NO: 2108011 - RNA, 16 nt, Human
ugcuccuccagggcca

SEQ ID NO: 2108012 - RNA, 21 nt, Human
ugcuccuccagggccacgugc

SEQ ID NO: 2108013 - RNA, 22 nt, Human
ugcuccuccagggccacgugcc

SEQ ID NO: 2108014 - RNA, 13 nt, Human
ugcuccgugcuug

SEQ ID NO: 2108015 - RNA, 22 nt, Human
ugcucccccauccuccccuucc

SEQ ID NO: 2108016 - RNA, 23 nt, Human
ugcucccccauccuccccuuccc

SEQ ID NO: 2108017 - RNA, 14 nt, Human
ugcuccccucccuc

SEQ ID NO: 2108018 - RNA, 16 nt, Human
ugcuccccucccuccu

SEQ ID NO: 2108019 - RNA, 17 nt, Human
ugcuccccucccuccuc

SEQ ID NO: 2108020 - RNA, 16 nt, Human
ugcucccuaccaccuc

SEQ ID NO: 2108021 - RNA, 20 nt, Human
ugcucccuaccaccucccca

SEQ ID NO: 2108022 - RNA, 13 nt, Human
ugcucccuccccu

SEQ ID NO: 2108023 - RNA, 14 nt, Human
ugcucccuccccug

SEQ ID NO: 2108024 - RNA, 15 nt, Human
ugcucccuccccugc

SEQ ID NO: 2108025 - RNA, 17 nt, Human
ugcucccuccccugccc

SEQ ID NO: 2108026 - RNA, 18 nt, Human
ugcucccuccccugcccu

SEQ ID NO: 2108027 - RNA, 22 nt, Human
ugcucaugguccccauggcaug

SEQ ID NO: 2108028 - RNA, 14 nt, Human
ugcucauuucaugg

SEQ ID NO: 2108029 - RNA, 14 nt, Human
ugcuccaccacauc

SEQ ID NO: 2108030 - RNA, 18 nt, Human
ugcucccccauccucccc

SEQ ID NO: 2108031 - RNA, 19 nt, Human
ugcucccccauccuccccu

SEQ ID NO: 2108032 - RNA, 20 nt, Human
ugcucccccauccuccccuu

SEQ ID NO: 2108033 - RNA, 21 nt, Human
ugcucccccauccuccccuuc

SEQ ID NO: 2108034 - RNA, 22 nt, Human
ugcuauggggagaaaagacaug

SEQ ID NO: 2108035 - RNA, 17 nt, Human
agcuuucaaagaaggaa

SEQ ID NO: 2108036 - RNA, 16 nt, Human
ugcuauugacaaguca

SEQ ID NO: 2108037 - RNA, 16 nt, Human
agcuuuauguaauaau

SEQ ID NO: 2108038 - RNA, 22 nt, Human
agcuuguuuuguuucauccugu

SEQ ID NO: 2108039 - RNA, 19 nt, Human
agcuuuauuuuuuaaguau

SEQ ID NO: 2108040 - RNA, 22 nt, Human
agcuuuauuuuuuaaguauuua

SEQ ID NO: 2108041 - RNA, 14 nt, Human
agcuuuauguaaua

SEQ ID NO: 2108042 - RNA, 22 nt, Human
agcuuuauguaauaaugugaau

SEQ ID NO: 2108043 - RNA, 21 nt, Human
agcuugggggaugacuagagg

SEQ ID NO: 2108044 - RNA, 13 nt, Human
agcuuuacccuca

SEQ ID NO: 2108045 - RNA, 17 nt, Human
agcuuuacccucaggca

SEQ ID NO: 2108046 - RNA, 20 nt, Human
agcuuuacccucaggcauag

SEQ ID NO: 2108047 - RNA, 18 nt, Human
agcuuuacccucaggcau

SEQ ID NO: 2108048 - RNA, 15 nt, Human
agcuuuacuguuugu

SEQ ID NO: 2108049 - RNA, 20 nt, Human
aggaagccgugcccugcccc

SEQ ID NO: 2108050 - RNA, 21 nt, Human
aggaagccgugcccugccccc

SEQ ID NO: 2108051 - RNA, 14 nt, Human
aggaagcucagacu

SEQ ID NO: 2108052 - RNA, 16 nt, Human
aggaagcucagacugg

SEQ ID NO: 2108053 - RNA, 17 nt, Human
aggaagcucagacuggu

SEQ ID NO: 2108054 - RNA, 12 nt, Human
aggaaggaaaga

SEQ ID NO: 2108055 - RNA, 22 nt, Human
ugcugacuguacuccucccagg

SEQ ID NO: 2108056 - RNA, 21 nt, Human
ugcugacuguacuccucccag

SEQ ID NO: 2108057 - RNA, 16 nt, Human
ugcugacuguuuucuc

SEQ ID NO: 2108058 - RNA, 24 nt, Human
aggaaaggccagcuggcagcagag

SEQ ID NO: 2108059 - RNA, 19 nt, Human
aggaaauaaaaccuuucaa

SEQ ID NO: 2108060 - RNA, 20 nt, Human
aggaaauaaaaccuuucaaa

SEQ ID NO: 2108061 - RNA, 21 nt, Human
aggaaauaaaaccuuucaaau

SEQ ID NO: 2108062 - RNA, 22 nt, Human
aggaaauaaaaccuuucaaauu

SEQ ID NO: 2108063 - RNA, 20 nt, Human
aggaaauauauaugugugug

SEQ ID NO: 2108064 - RNA, 22 nt, Human
ugcggacagccacggccaggcc

SEQ ID NO: 2108065 - RNA, 23 nt, Human
ugcggacagccacggccaggcca

SEQ ID NO: 2108066 - RNA, 14 nt, Human
ugcggacgggcugu

SEQ ID NO: 2108067 - RNA, 18 nt, Human
ugcggccgcauucccuga

SEQ ID NO: 2108068 - RNA, 10 nt, Human
ugccuuuccu

SEQ ID NO: 2108069 - RNA, 12 nt, Human
ugccuuuccugu

SEQ ID NO: 2108070 - RNA, 13 nt, Human
ugccuuuccuguu

SEQ ID NO: 2108071 - RNA, 14 nt, Human
ugccuuuccuguuc

SEQ ID NO: 2108072 - RNA, 16 nt, Human
ugccuuuccuguucag

SEQ ID NO: 2108073 - RNA, 19 nt, Human
ugccuuuccuguucagcau

SEQ ID NO: 2108074 - RNA, 20 nt, Human
ugccuuuccuguucagcauu

SEQ ID NO: 2108075 - RNA, 11 nt, Human
ugccuuuguaa

SEQ ID NO: 2108076 - RNA, 12 nt, Human
ugccuuuguaag

SEQ ID NO: 2108077 - RNA, 13 nt, Human
ugccuuuguaagu

SEQ ID NO: 2108078 - RNA, 15 nt, Human
ugccuuuguaaguua

SEQ ID NO: 2108079 - RNA, 16 nt, Human
ugccuuuguaaguuau

SEQ ID NO: 2108080 - RNA, 15 nt, Human
ugccuuuguuuugau

SEQ ID NO: 2108081 - RNA, 18 nt, Human
ugccuuugaguuuccuca

SEQ ID NO: 2108082 - RNA, 19 nt, Human
ugccuuugaguuuccucag

SEQ ID NO: 2108083 - RNA, 21 nt, Human
ugccuuugaguuuccucaggc

SEQ ID NO: 2108084 - RNA, 22 nt, Human
ugccuuugaguuuccucaggcu

SEQ ID NO: 2108085 - RNA, 14 nt, Human
ugccuuugcagaaa

SEQ ID NO: 2108086 - RNA, 15 nt, Human
ugccuuugcagaaac

SEQ ID NO: 2108087 - RNA, 17 nt, Human
ugccuuugcagaaacag

SEQ ID NO: 2108088 - RNA, 18 nt, Human
ugccuuugcagaaacaga

SEQ ID NO: 2108089 - RNA, 18 nt, Human
ugcgguccacccaggagc

SEQ ID NO: 2108090 - RNA, 17 nt, Human
ugcgggcugggcagcug

SEQ ID NO: 2108091 - RNA, 21 nt, Human
ugcgggaccgguacagaaagg

SEQ ID NO: 2108092 - RNA, 17 nt, Human
ugcgggcuuuuccccgg

SEQ ID NO: 2108093 - RNA, 17 nt, Human
ugcgguccacccaggag

SEQ ID NO: 2108094 - RNA, 19 nt, Human
ugcggccgcauucccugag

SEQ ID NO: 2108095 - RNA, 17 nt, Human
ugcggccuuuggcuuca

SEQ ID NO: 2108096 - RNA, 19 nt, Human
ugcggccuuuggcuucacg

SEQ ID NO: 2108097 - RNA, 16 nt, Human
ugcgggcacaauaaau

SEQ ID NO: 2108098 - RNA, 17 nt, Human
ugcgggcacaauaaauc

SEQ ID NO: 2108099 - RNA, 13 nt, Human
ugcgggcugggca

SEQ ID NO: 2108100 - RNA, 14 nt, Human
ugcgggcugggcag

SEQ ID NO: 2108101 - RNA, 15 nt, Human
ugcgggcugggcagc

SEQ ID NO: 2108102 - RNA, 16 nt, Human
ugcgggcugggcagcu

SEQ ID NO: 2108103 - RNA, 17 nt, Human
ugcgggaugguccuggg

SEQ ID NO: 2108104 - RNA, 18 nt, Human
ugcgggaugguccugggg

SEQ ID NO: 2108105 - RNA, 19 nt, Human
ugcgggaugguccuggggc

SEQ ID NO: 2108106 - RNA, 14 nt, Human
agcuguugagcugu

SEQ ID NO: 2108107 - RNA, 13 nt, Human
agcuguugagcug

SEQ ID NO: 2108108 - RNA, 17 nt, Human
agcuguugagcuguuuu

SEQ ID NO: 2108109 - RNA, 16 nt, Human
agcuguugagcuguuu

SEQ ID NO: 2108110 - RNA, 15 nt, Human
agcuguugagcuguu

SEQ ID NO: 2108111 - RNA, 22 nt, Human
agcuugaagaucguuaguaucu

SEQ ID NO: 2108112 - RNA, 22 nt, Human
agcuugaaaguuuucagaaccu

SEQ ID NO: 2108113 - RNA, 16 nt, Human
agcuugaaaguuuuca

SEQ ID NO: 2108114 - RNA, 17 nt, Human
agcuugaaaguuuucag

SEQ ID NO: 2108115 - RNA, 17 nt, Human
agcuuaccucccaccuu

SEQ ID NO: 2108116 - RNA, 14 nt, Human
agcuuacaugagaa

SEQ ID NO: 2108117 - RNA, 16 nt, Human
agcuuacaugagaaca

SEQ ID NO: 2108118 - RNA, 14 nt, Human
agcuuagaccucag

SEQ ID NO: 2108119 - RNA, 15 nt, Human
agcuuagaccucagc

SEQ ID NO: 2108120 - RNA, 20 nt, Human
agcuuagaccucagccugug

SEQ ID NO: 2108121 - RNA, 16 nt, Human
agcuuagaccucagcc

SEQ ID NO: 2108122 - RNA, 17 nt, Human
agcuuagaccucagccu

SEQ ID NO: 2108123 - RNA, 18 nt, Human
agcuuagaccucagccug

SEQ ID NO: 2108124 - RNA, 19 nt, Human
agcuuagaccucagccugu

SEQ ID NO: 2108125 - RNA, 18 nt, Human
agcuuguaaauagcucag

SEQ ID NO: 2108126 - RNA, 18 nt, Human
agcuuggguuuuuguuac

SEQ ID NO: 2108127 - RNA, 18 nt, Human
agcuugggaggcuucccc

SEQ ID NO: 2108128 - RNA, 18 nt, Human
agcuugaggguugggcug

SEQ ID NO: 2108129 - RNA, 14 nt, Human
agcuugaggguugg

SEQ ID NO: 2108130 - RNA, 19 nt, Human
agcuugaaggaucuguuuu

SEQ ID NO: 2108131 - RNA, 20 nt, Human
agcugccuguucagcuccag

SEQ ID NO: 2108132 - RNA, 13 nt, Human
agcugccucacuu

SEQ ID NO: 2108133 - RNA, 13 nt, Human
agcugccuaagag

SEQ ID NO: 2108134 - RNA, 14 nt, Human
agcugccuaagagg

SEQ ID NO: 2108135 - RNA, 13 nt, Human
agcugccgaccag

SEQ ID NO: 2108136 - RNA, 17 nt, Human
agcugccgaccagagcc

SEQ ID NO: 2108137 - RNA, 18 nt, Human
agcugccgaccagagccc

SEQ ID NO: 2108138 - RNA, 14 nt, Human
ugccuggagcccca

SEQ ID NO: 2108139 - RNA, 20 nt, Human
ugccuggagccccacugccc

SEQ ID NO: 2108140 - RNA, 11 nt, Human
ugccuggagcu

SEQ ID NO: 2108141 - RNA, 16 nt, Human
ugccuggagcuccugg

SEQ ID NO: 2108142 - RNA, 17 nt, Human
ugccuggagcuccuggg

SEQ ID NO: 2108143 - RNA, 18 nt, Human
ugccuggagcuccuggga

SEQ ID NO: 2108144 - RNA, 22 nt, Human
agcugccuguucagcuccagcu

SEQ ID NO: 2108145 - RNA, 21 nt, Human
agcugccuguucagcuccagc

SEQ ID NO: 2108146 - RNA, 19 nt, Human
agcugccuguucagcucca

SEQ ID NO: 2108147 - RNA, 21 nt, Human
agcugcuuuugucuaugggac

SEQ ID NO: 2108148 - RNA, 22 nt, Human
agcuggaucuccauucucucag

SEQ ID NO: 2108149 - RNA, 15 nt, Human
ugccucugccucuga

SEQ ID NO: 2108150 - RNA, 13 nt, Human
ugccugcccaggc

SEQ ID NO: 2108151 - RNA, 14 nt, Human
ugccucugccucug

SEQ ID NO: 2108152 - RNA, 13 nt, Human
ugccucugccucu

SEQ ID NO: 2108153 - RNA, 14 nt, Human
ugcccaggcagguc

SEQ ID NO: 2108154 - RNA, 13 nt, Human
ugcccaggcaggu

SEQ ID NO: 2108155 - RNA, 12 nt, Human
ugcccaggcagg

SEQ ID NO: 2108156 - RNA, 22 nt, Human
ugcccaggagagccagcccucc

SEQ ID NO: 2108157 - RNA, 23 nt, Human
ugcccaggagagccagcccuccc

SEQ ID NO: 2108158 - RNA, 16 nt, Human
ugccugcccaggcccc

SEQ ID NO: 2108159 - RNA, 24 nt, Human
ugccugcccaggccccugccaccc

SEQ ID NO: 2108160 - RNA, 15 nt, Human
ugccugcccaggccc

SEQ ID NO: 2108161 - RNA, 14 nt, Human
ugccugcccaggcc

SEQ ID NO: 2108162 - RNA, 20 nt, Human
ugccugccccaaacaaauau

SEQ ID NO: 2108163 - RNA, 18 nt, Human
ugccugccccaaacaaau

SEQ ID NO: 2108164 - RNA, 20 nt, Human
ugccuguucagcuccagcuc

SEQ ID NO: 2108165 - RNA, 18 nt, Human
ugccuguucagcuccagc

SEQ ID NO: 2108166 - RNA, 13 nt, Human
agcuguucagcug

SEQ ID NO: 2108167 - RNA, 14 nt, Human
agcuguucagcugg

SEQ ID NO: 2108168 - RNA, 15 nt, Human
ugccuuaaaacuuua

SEQ ID NO: 2108169 - RNA, 21 nt, Human
ugccuguucagcuccagcuca

SEQ ID NO: 2108170 - RNA, 14 nt, Human
agcugucccuguca

SEQ ID NO: 2108171 - RNA, 15 nt, Human
agcugucccugucac

SEQ ID NO: 2108172 - RNA, 18 nt, Human
agcugucccugucaccaa

SEQ ID NO: 2108173 - RNA, 22 nt, Human
agcugucccugucaccaagcuc

SEQ ID NO: 2108174 - RNA, 21 nt, Human
agcuggccgaggguccuggcu

SEQ ID NO: 2108175 - RNA, 16 nt, Human
agcuggcagcagagug

SEQ ID NO: 2108176 - RNA, 20 nt, Human
agcuggccgaggguccuggc

SEQ ID NO: 2108177 - RNA, 20 nt, Human
agcugugcucuggacaggca

SEQ ID NO: 2108178 - RNA, 19 nt, Human
agcugugcucuggacaggc

SEQ ID NO: 2108179 - RNA, 19 nt, Human
agcugucucaaaccuccaa

SEQ ID NO: 2108180 - RNA, 20 nt, Human
agcugucccugucaccaagc

SEQ ID NO: 2108181 - RNA, 23 nt, Human
agcugugcucuggacaggcaugu

SEQ ID NO: 2108182 - RNA, 21 nt, Human
agcugugcucuggacaggcau

SEQ ID NO: 2108183 - RNA, 18 nt, Human
uggucucaaacuccugac

SEQ ID NO: 2108184 - RNA, 23 nt, Human
uggucucaaacucuugaccucag

SEQ ID NO: 2108185 - RNA, 17 nt, Human
uggucucaaacucuuga

SEQ ID NO: 2108186 - RNA, 13 nt, Human
uggucccacucag

SEQ ID NO: 2108187 - RNA, 21 nt, Human
uggucagguuauacuccuccu

SEQ ID NO: 2108188 - RNA, 22 nt, Human
uggucaguuugguuguguaaga

SEQ ID NO: 2108189 - RNA, 16 nt, Human
uggucucaaacucuug

SEQ ID NO: 2108190 - RNA, 18 nt, Human
ugguaggaauagcauguc

SEQ ID NO: 2108191 - RNA, 18 nt, Human
uggucaccaaaucagcug

SEQ ID NO: 2108192 - RNA, 22 nt, Human
uggucagauuugaacucuucaa

SEQ ID NO: 2108193 - RNA, 20 nt, Human
uggucaccaaaucagcugcu

SEQ ID NO: 2108194 - RNA, 22 nt, Human
aggguguccggucccuguccca

SEQ ID NO: 2108195 - RNA, 21 nt, Human
aggguggugaccucugccuga

SEQ ID NO: 2108196 - RNA, 13 nt, Human
aggguuauaauaa

SEQ ID NO: 2108197 - RNA, 13 nt, Human
aggguuagggagg

SEQ ID NO: 2108198 - RNA, 15 nt, Human
aggguuagggagggg

SEQ ID NO: 2108199 - RNA, 16 nt, Human
aggguuagggaggggu

SEQ ID NO: 2108200 - RNA, 18 nt, Human
aggguuacuaugcacaau

SEQ ID NO: 2108201 - RNA, 15 nt, Human
aggguuauauuuuac

SEQ ID NO: 2108202 - RNA, 14 nt, Human
uggucuuucuggag

SEQ ID NO: 2108203 - RNA, 15 nt, Human
uggucuuucuggaga

SEQ ID NO: 2108204 - RNA, 17 nt, Human
uggucuuucuggagagg

SEQ ID NO: 2108205 - RNA, 13 nt, Human
uggucuuguaaga

SEQ ID NO: 2108206 - RNA, 14 nt, Human
uggucuuguaagag

SEQ ID NO: 2108207 - RNA, 21 nt, Human
uggucuuguaagagcuauaca

SEQ ID NO: 2108208 - RNA, 23 nt, Human
uggucuuguaagagcuauacagu

SEQ ID NO: 2108209 - RNA, 17 nt, Human
uggucuugagaugucuu

SEQ ID NO: 2108210 - RNA, 18 nt, Human
uggucugaauguucugac

SEQ ID NO: 2108211 - RNA, 19 nt, Human
uggucugaauguucugaca

SEQ ID NO: 2108212 - RNA, 21 nt, Human
uggucugaauguucugacauu

SEQ ID NO: 2108213 - RNA, 22 nt, Human
uggucugaauguucugacauua

SEQ ID NO: 2108214 - RNA, 17 nt, Human
uggucugacccacugcu

SEQ ID NO: 2108215 - RNA, 16 nt, Human
uggucugacccacugc

SEQ ID NO: 2108216 - RNA, 14 nt, Human
uggucugaauguuc

SEQ ID NO: 2108217 - RNA, 15 nt, Human
uggucugaauguucu

SEQ ID NO: 2108218 - RNA, 16 nt, Human
uggucugaauguucug

SEQ ID NO: 2108219 - RNA, 17 nt, Human
uggucugaauguucuga

SEQ ID NO: 2108220 - RNA, 20 nt, Human
uggucuccucuuuguuuugu

SEQ ID NO: 2108221 - RNA, 14 nt, Human
uggucuccugcccc

SEQ ID NO: 2108222 - RNA, 17 nt, Human
uggucuccugcccccac

SEQ ID NO: 2108223 - RNA, 18 nt, Human
uggucuccugcccccaca

SEQ ID NO: 2108224 - RNA, 15 nt, Human
aggguugggcccaga

SEQ ID NO: 2108225 - RNA, 17 nt, Human
aggguuggccccugccc

SEQ ID NO: 2108226 - RNA, 23 nt, Human
aggguuggccccugcccggcugc

SEQ ID NO: 2108227 - RNA, 18 nt, Human
aggguuggccccugcccg

SEQ ID NO: 2108228 - RNA, 11 nt, Human
agguacuuuug

SEQ ID NO: 2108229 - RNA, 16 nt, Human
agguacuuuuggaauc

SEQ ID NO: 2108230 - RNA, 17 nt, Human
agguacuuuuggaaucu

SEQ ID NO: 2108231 - RNA, 17 nt, Human
agguagaaauaucugaa

SEQ ID NO: 2108232 - RNA, 19 nt, Human
agguagaaauaucugaaaa

SEQ ID NO: 2108233 - RNA, 20 nt, Human
agguagguggaucaccugag

SEQ ID NO: 2108234 - RNA, 23 nt, Human
agguagaaauaucugaaaaugua

SEQ ID NO: 2108235 - RNA, 11 nt, Human
agguauaauuu

SEQ ID NO: 2108236 - RNA, 15 nt, Human
agguauaauuuuaug

SEQ ID NO: 2108237 - RNA, 21 nt, Human
agguaugcaaucaaaucugcu

SEQ ID NO: 2108238 - RNA, 23 nt, Human
aggucaucuccuuucauccccac

SEQ ID NO: 2108239 - RNA, 12 nt, Human
aggucagagccu

SEQ ID NO: 2108240 - RNA, 12 nt, Human
aggucccaaggc

SEQ ID NO: 2108241 - RNA, 16 nt, Human
aggucccaaggcaagg

SEQ ID NO: 2108242 - RNA, 11 nt, Human
aggucccaggc

SEQ ID NO: 2108243 - RNA, 12 nt, Human
aggucccaggca

SEQ ID NO: 2108244 - RNA, 13 nt, Human
aggucccaggcag

SEQ ID NO: 2108245 - RNA, 14 nt, Human
aggucacuccuggg

SEQ ID NO: 2108246 - RNA, 15 nt, Human
aggucacuccugggg

SEQ ID NO: 2108247 - RNA, 18 nt, Human
aggucacuccuggggccu

SEQ ID NO: 2108248 - RNA, 19 nt, Human
aggucacuccuggggccuc

SEQ ID NO: 2108249 - RNA, 22 nt, Human
agguauuccuuuuguguacagu

SEQ ID NO: 2108250 - RNA, 20 nt, Human
agguauggaaggguuugugg

SEQ ID NO: 2108251 - RNA, 22 nt, Human
agguauggaaggguuuguggcu

SEQ ID NO: 2108252 - RNA, 22 nt, Human
aggucaaguaagaagacaugaa

SEQ ID NO: 2108253 - RNA, 17 nt, Human
agguauucgugcagcau

SEQ ID NO: 2108254 - RNA, 18 nt, Human
aggucaauacaguacagg

SEQ ID NO: 2108255 - RNA, 23 nt, Human
aggucaauacaguacaggcagca

SEQ ID NO: 2108256 - RNA, 21 nt, Human
aggucaauacaguacaggcag

SEQ ID NO: 2108257 - RNA, 22 nt, Human
aggucaauacaguacaggcagc

SEQ ID NO: 2108258 - RNA, 17 nt, Human
ugguacucauuaaaaaa

SEQ ID NO: 2108259 - RNA, 20 nt, Human
ugguacuacuagaugucuuu

SEQ ID NO: 2108260 - RNA, 18 nt, Human
ugguacggagauguuuca

SEQ ID NO: 2108261 - RNA, 16 nt, Human
ugguacuaacuuuccu

SEQ ID NO: 2108262 - RNA, 20 nt, Human
ugguagcuuuucccuucuuu

SEQ ID NO: 2108263 - RNA, 17 nt, Human
ugguacuugcugcuauu

SEQ ID NO: 2108264 - RNA, 18 nt, Human
ugguacuugcugcuauuu

SEQ ID NO: 2108265 - RNA, 19 nt, Human
ugguacuugcugcuauuuu

SEQ ID NO: 2108266 - RNA, 20 nt, Human
uggucacaggacucugccuc

SEQ ID NO: 2108267 - RNA, 23 nt, Human
uggucacaggacucugccuccuc

SEQ ID NO: 2108268 - RNA, 22 nt, Human
uggucacaggacucugccuccu

SEQ ID NO: 2108269 - RNA, 17 nt, Human
ugguagcuuuucccuuc

SEQ ID NO: 2108270 - RNA, 17 nt, Human
ugguaggaauagcaugu

SEQ ID NO: 2108271 - RNA, 21 nt, Human
ugguagcuuuucccuucuuuu

SEQ ID NO: 2108272 - RNA, 13 nt, Human
ugguaagcuucca

SEQ ID NO: 2108273 - RNA, 19 nt, Human
ugguaagcuuccaggaaaa

SEQ ID NO: 2108274 - RNA, 20 nt, Human
ugguaagcuuccaggaaaaa

SEQ ID NO: 2108275 - RNA, 13 nt, Human
ugguaagggaaaa

SEQ ID NO: 2108276 - RNA, 16 nt, Human
ugguaagggccaaguc

SEQ ID NO: 2108277 - RNA, 13 nt, Human
uggguggggcugc

SEQ ID NO: 2108278 - RNA, 14 nt, Human
ugggugcuggcugc

SEQ ID NO: 2108279 - RNA, 18 nt, Human
ugggugcuggcugcccag

SEQ ID NO: 2108280 - RNA, 14 nt, Human
uggguggggaggga

SEQ ID NO: 2108281 - RNA, 21 nt, Human
uggguggggcugcuccuccag

SEQ ID NO: 2108282 - RNA, 21 nt, Human
agggucucacucugucgccca

SEQ ID NO: 2108283 - RNA, 22 nt, Human
agggucucacucugucgcccag

SEQ ID NO: 2108284 - RNA, 14 nt, Human
aggguggcagguga

SEQ ID NO: 2108285 - RNA, 15 nt, Human
aggguggcaucccag

SEQ ID NO: 2108286 - RNA, 21 nt, Human
aggguggcaucccaguggccu

SEQ ID NO: 2108287 - RNA, 21 nt, Human
aggguggcuggguccagggga

SEQ ID NO: 2108288 - RNA, 18 nt, Human
aggguggcccuugcaguu

SEQ ID NO: 2108289 - RNA, 11 nt, Human
aggguggcccu

SEQ ID NO: 2108290 - RNA, 14 nt, Human
aggguggcccuugc

SEQ ID NO: 2108291 - RNA, 16 nt, Human
agggugggagagccca

SEQ ID NO: 2108292 - RNA, 17 nt, Human
agggugggagagcccag

SEQ ID NO: 2108293 - RNA, 18 nt, Human
agggugggagagcccagc

SEQ ID NO: 2108294 - RNA, 19 nt, Human
agggugggagagcccagcc

SEQ ID NO: 2108295 - RNA, 23 nt, Human
ugggucuaagggguugguugagg

SEQ ID NO: 2108296 - RNA, 20 nt, Human
ugggucucgcuuuguugccc

SEQ ID NO: 2108297 - RNA, 22 nt, Human
ugggucucgcuuuguugcccag

SEQ ID NO: 2108298 - RNA, 14 nt, Human
ugggucugugucuc

SEQ ID NO: 2108299 - RNA, 19 nt, Human
ugggucugugucucuuuuc

SEQ ID NO: 2108300 - RNA, 20 nt, Human
ugggucugugucucuuuucu

SEQ ID NO: 2108301 - RNA, 22 nt, Human
uggguggcaccagcagccugga

SEQ ID NO: 2108302 - RNA, 13 nt, Human
ugggugcucccua

SEQ ID NO: 2108303 - RNA, 23 nt, Human
agggucucacuauguugcccagg

SEQ ID NO: 2108304 - RNA, 22 nt, Human
agggucucacuauguugcccag

SEQ ID NO: 2108305 - RNA, 21 nt, Human
agggucucacuauguugccca

SEQ ID NO: 2108306 - RNA, 18 nt, Human
aggggugguccugacuca

SEQ ID NO: 2108307 - RNA, 13 nt, Human
aggggugguccug

SEQ ID NO: 2108308 - RNA, 15 nt, Human
aggggugguccugac

SEQ ID NO: 2108309 - RNA, 20 nt, Human
agggguggguuccucuuccc

SEQ ID NO: 2108310 - RNA, 21 nt, Human
agggguggguuccucuucccc

SEQ ID NO: 2108311 - RNA, 22 nt, Human
aggggacucagcccugagguga

SEQ ID NO: 2108312 - RNA, 14 nt, Human
aggggacucagccc

SEQ ID NO: 2108313 - RNA, 17 nt, Human
aggggacucagcccuga

SEQ ID NO: 2108314 - RNA, 19 nt, Human
aggggacuauuuaugaagg

SEQ ID NO: 2108315 - RNA, 23 nt, Human
aggggccuggcagccgugccuuc

SEQ ID NO: 2108316 - RNA, 18 nt, Human
aggggccuggcagccgug

SEQ ID NO: 2108317 - RNA, 17 nt, Human
aggggagagggucugga

SEQ ID NO: 2108318 - RNA, 10 nt, Human
aggggagagg

SEQ ID NO: 2108319 - RNA, 15 nt, Human
aggggccuggcagcc

SEQ ID NO: 2108320 - RNA, 23 nt, Human
aggggagcaaaaucgaugcagug

SEQ ID NO: 2108321 - RNA, 14 nt, Human
aggggcguguggcu

SEQ ID NO: 2108322 - RNA, 17 nt, Human
aggggcguguggcucac

SEQ ID NO: 2108323 - RNA, 14 nt, Human
aggggcggcaggag

SEQ ID NO: 2108324 - RNA, 17 nt, Human
aggggcggcaggaggga

SEQ ID NO: 2108325 - RNA, 18 nt, Human
aggggcggcaggagggag

SEQ ID NO: 2108326 - RNA, 20 nt, Human
aggggcggcaggagggaggu

SEQ ID NO: 2108327 - RNA, 20 nt, Human
agggggaggggguuacaaac

SEQ ID NO: 2108328 - RNA, 22 nt, Human
agggggaggggguuacaaacug

SEQ ID NO: 2108329 - RNA, 15 nt, Human
ugggcugcuccucau

SEQ ID NO: 2108330 - RNA, 16 nt, Human
ugggcugcuccucaug

SEQ ID NO: 2108331 - RNA, 14 nt, Human
uggggaagacugug

SEQ ID NO: 2108332 - RNA, 24 nt, Human
uggggaagacuguggcugcuagca

SEQ ID NO: 2108333 - RNA, 16 nt, Human
uggggaagacuguggc

SEQ ID NO: 2108334 - RNA, 17 nt, Human
uggggaagacuguggcu

SEQ ID NO: 2108335 - RNA, 13 nt, Human
uggggaaggaggc

SEQ ID NO: 2108336 - RNA, 18 nt, Human
uggggaagcuucuuaaau

SEQ ID NO: 2108337 - RNA, 17 nt, Human
uggggacagagcagaac

SEQ ID NO: 2108338 - RNA, 23 nt, Human
agggcuucugccauuucugagau

SEQ ID NO: 2108339 - RNA, 15 nt, Human
agggccuccagcccu

SEQ ID NO: 2108340 - RNA, 20 nt, Human
agggccuccauuccuggagc

SEQ ID NO: 2108341 - RNA, 21 nt, Human
ugggcugcccuggugcugcca

SEQ ID NO: 2108342 - RNA, 16 nt, Human
ugggcugcccuggugc

SEQ ID NO: 2108343 - RNA, 17 nt, Human
ugggcugcuacccagaa

SEQ ID NO: 2108344 - RNA, 20 nt, Human
ugggcugcccuggugcugcc

SEQ ID NO: 2108345 - RNA, 19 nt, Human
ugggcugcccuggugcugc

SEQ ID NO: 2108346 - RNA, 17 nt, Human
ugggcugcccuggugcu

SEQ ID NO: 2108347 - RNA, 17 nt, Human
ugggcugagcccuggca

SEQ ID NO: 2108348 - RNA, 18 nt, Human
ugggcugagcccuggcag

SEQ ID NO: 2108349 - RNA, 15 nt, Human
ugggcugagcccugg

SEQ ID NO: 2108350 - RNA, 16 nt, Human
ugggcugagcccuggc

SEQ ID NO: 2108351 - RNA, 14 nt, Human
ugggcugagacugg

SEQ ID NO: 2108352 - RNA, 15 nt, Human
ugggcugagacugga

SEQ ID NO: 2108353 - RNA, 23 nt, Human
ugggcugagacuggauacugccc

SEQ ID NO: 2108354 - RNA, 12 nt, Human
ugggcugagccc

SEQ ID NO: 2108355 - RNA, 14 nt, Human
ugggguacccacug

SEQ ID NO: 2108356 - RNA, 13 nt, Human
uggggcuucuugg

SEQ ID NO: 2108357 - RNA, 17 nt, Human
uggggcucugugcaggg

SEQ ID NO: 2108358 - RNA, 11 nt, Human
uggggcugaac

SEQ ID NO: 2108359 - RNA, 17 nt, Human
uggggcugaucucaggg

SEQ ID NO: 2108360 - RNA, 18 nt, Human
uggggcugaucucaggga

SEQ ID NO: 2108361 - RNA, 19 nt, Human
uggggcugaucucagggaa

SEQ ID NO: 2108362 - RNA, 20 nt, Human
uggggcugaucucagggaag

SEQ ID NO: 2108363 - RNA, 21 nt, Human
uggggcugaucucagggaagc

SEQ ID NO: 2108364 - RNA, 22 nt, Human
uggggcugaucucagggaagcc

SEQ ID NO: 2108365 - RNA, 11 nt, Human
uggggcugggg

SEQ ID NO: 2108366 - RNA, 20 nt, Human
ugggguacccacugcucugg

SEQ ID NO: 2108367 - RNA, 15 nt, Human
uggggguuggcuggg

SEQ ID NO: 2108368 - RNA, 16 nt, Human
uggggguuggcugggu

SEQ ID NO: 2108369 - RNA, 14 nt, Human
ugggggaagcccug

SEQ ID NO: 2108370 - RNA, 18 nt, Human
ugggguagcuagaggaac

SEQ ID NO: 2108371 - RNA, 20 nt, Human
ugggguagcuagaggaacca

SEQ ID NO: 2108372 - RNA, 16 nt, Human
ugggguacccacugcu

SEQ ID NO: 2108373 - RNA, 15 nt, Human
ugggguacccacugc

SEQ ID NO: 2108374 - RNA, 13 nt, Human
ugggguagggcug

SEQ ID NO: 2108375 - RNA, 16 nt, Human
ugggguagggcugacu

SEQ ID NO: 2108376 - RNA, 18 nt, Human
uggggcggugagagggga

SEQ ID NO: 2108377 - RNA, 13 nt, Human
uggggcucuggga

SEQ ID NO: 2108378 - RNA, 15 nt, Human
uggggcucugugcag

SEQ ID NO: 2108379 - RNA, 12 nt, Human
uggggccuuggu

SEQ ID NO: 2108380 - RNA, 18 nt, Human
uggggccuagauccacac

SEQ ID NO: 2108381 - RNA, 17 nt, Human
uggggagacaccucaga

SEQ ID NO: 2108382 - RNA, 18 nt, Human
uggggagacaccucagag

SEQ ID NO: 2108383 - RNA, 20 nt, Human
uggggagacaccucagagcc

SEQ ID NO: 2108384 - RNA, 21 nt, Human
uggggacguccugccaccugg

SEQ ID NO: 2108385 - RNA, 12 nt, Human
uggggagaaagu

SEQ ID NO: 2108386 - RNA, 20 nt, Human
uggggacguccugccaccug

SEQ ID NO: 2108387 - RNA, 16 nt, Human
uggggagugggacaga

SEQ ID NO: 2108388 - RNA, 19 nt, Human
uggggagugggacagaguc

SEQ ID NO: 2108389 - RNA, 19 nt, Human
uggggaguaggacauacca

SEQ ID NO: 2108390 - RNA, 13 nt, Human
uggggagugggac

SEQ ID NO: 2108391 - RNA, 12 nt, Human
ugggcccagaag

SEQ ID NO: 2108392 - RNA, 23 nt, Human
ugggcccaagacagaugccccag

SEQ ID NO: 2108393 - RNA, 22 nt, Human
ugggcccaagacagaugcccca

SEQ ID NO: 2108394 - RNA, 17 nt, Human
ugggcccagaggcacag

SEQ ID NO: 2108395 - RNA, 18 nt, Human
ugggcccagaggcacagc

SEQ ID NO: 2108396 - RNA, 19 nt, Human
ugggcccagaggcacagcc

SEQ ID NO: 2108397 - RNA, 13 nt, Human
ugggcccagaucu

SEQ ID NO: 2108398 - RNA, 14 nt, Human
ugggcccagaucug

SEQ ID NO: 2108399 - RNA, 15 nt, Human
agggagggcuucugc

SEQ ID NO: 2108400 - RNA, 12 nt, Human
agggaggggacu

SEQ ID NO: 2108401 - RNA, 17 nt, Human
ugggccccaccaccuag

SEQ ID NO: 2108402 - RNA, 18 nt, Human
ugggccccaccaccuagg

SEQ ID NO: 2108403 - RNA, 23 nt, Human
ugggccccaccaccuaggccacu

SEQ ID NO: 2108404 - RNA, 19 nt, Human
agggagugacagaggcagc

SEQ ID NO: 2108405 - RNA, 18 nt, Human
agggagugacagaggcag

SEQ ID NO: 2108406 - RNA, 17 nt, Human
agggagugacagaggca

SEQ ID NO: 2108407 - RNA, 17 nt, Human
agggaggugaccccagg

SEQ ID NO: 2108408 - RNA, 20 nt, Human
agggcaggcccaaauuauca

SEQ ID NO: 2108409 - RNA, 13 nt, Human
agggcagggcauc

SEQ ID NO: 2108410 - RNA, 15 nt, Human
agggcagccugccug

SEQ ID NO: 2108411 - RNA, 16 nt, Human
agggcagccugccugg

SEQ ID NO: 2108412 - RNA, 17 nt, Human
agggcagccugccugga

SEQ ID NO: 2108413 - RNA, 18 nt, Human
agggcagccugccuggag

SEQ ID NO: 2108414 - RNA, 14 nt, Human
agggcagcagaucu

SEQ ID NO: 2108415 - RNA, 16 nt, Human
agggccagaucuguua

SEQ ID NO: 2108416 - RNA, 15 nt, Human
agggcagggcucuga

SEQ ID NO: 2108417 - RNA, 16 nt, Human
agggcagggcucugau

SEQ ID NO: 2108418 - RNA, 17 nt, Human
agggcagggcaucuccu

SEQ ID NO: 2108419 - RNA, 18 nt, Human
agggcccagagagggugg

SEQ ID NO: 2108420 - RNA, 17 nt, Human
agggccaguccugccug

SEQ ID NO: 2108421 - RNA, 18 nt, Human
agggccaguccugccugg

SEQ ID NO: 2108422 - RNA, 23 nt, Human
agggcccagagaggguggugacc

SEQ ID NO: 2108423 - RNA, 12 nt, Human
agggccagggcc

SEQ ID NO: 2108424 - RNA, 14 nt, Human
agggccagggcccu

SEQ ID NO: 2108425 - RNA, 15 nt, Human
agggccagggcccug

SEQ ID NO: 2108426 - RNA, 19 nt, Human
agggccagggcccugcaga

SEQ ID NO: 2108427 - RNA, 22 nt, Human
agggccagggcccugcagaggg

SEQ ID NO: 2108428 - RNA, 13 nt, Human
agggccaguccug

SEQ ID NO: 2108429 - RNA, 16 nt, Human
agggccaguccugccu

SEQ ID NO: 2108430 - RNA, 16 nt, Human
ugggcaacccccagcc

SEQ ID NO: 2108431 - RNA, 10 nt, Human
ugggauugcu

SEQ ID NO: 2108432 - RNA, 20 nt, Human
ugggagguggagguugcagu

SEQ ID NO: 2108433 - RNA, 13 nt, Human
ugggaggucgagg

SEQ ID NO: 2108434 - RNA, 18 nt, Human
ugggaggucaaggcugca

SEQ ID NO: 2108435 - RNA, 19 nt, Human
ugggaggucaaggcugcag

SEQ ID NO: 2108436 - RNA, 20 nt, Human
ugggaggucaaggcugcagu

SEQ ID NO: 2108437 - RNA, 23 nt, Human
ugggaggucaaggcugcagugag

SEQ ID NO: 2108438 - RNA, 17 nt, Human
ugggaggucaaggcugc

SEQ ID NO: 2108439 - RNA, 20 nt, Human
ugggcaacccccagccugcu

SEQ ID NO: 2108440 - RNA, 17 nt, Human
ugggcaacccccagccu

SEQ ID NO: 2108441 - RNA, 17 nt, Human
ugggcaccuauaauacc

SEQ ID NO: 2108442 - RNA, 22 nt, Human
ugggcaccaagagccaauggag

SEQ ID NO: 2108443 - RNA, 13 nt, Human
ugggccagccccu

SEQ ID NO: 2108444 - RNA, 14 nt, Human
ugggccagccccuc

SEQ ID NO: 2108445 - RNA, 15 nt, Human
ugggccagccccucc

SEQ ID NO: 2108446 - RNA, 16 nt, Human
ugggccagccccuccc

SEQ ID NO: 2108447 - RNA, 18 nt, Human
ugggccagccccucccac

SEQ ID NO: 2108448 - RNA, 20 nt, Human
ugggccagccccucccacca

SEQ ID NO: 2108449 - RNA, 14 nt, Human
ugggccaggacagg

SEQ ID NO: 2108450 - RNA, 22 nt, Human
ugggccagccccucccaccaca

SEQ ID NO: 2108451 - RNA, 23 nt, Human
ugggccagccccucccaccacag

SEQ ID NO: 2108452 - RNA, 17 nt, Human
ugggccaggacaggccc

SEQ ID NO: 2108453 - RNA, 18 nt, Human
ugggccaggacaggcccg

SEQ ID NO: 2108454 - RNA, 14 nt, Human
aguaauccaccugc

SEQ ID NO: 2108455 - RNA, 19 nt, Human
aguaaguaccacucaggcc

SEQ ID NO: 2108456 - RNA, 14 nt, Human
aguaauuucuucuc

SEQ ID NO: 2108457 - RNA, 20 nt, Human
aguagaaagacagagcuggg

SEQ ID NO: 2108458 - RNA, 21 nt, Human
aguagaaagacagagcuggga

SEQ ID NO: 2108459 - RNA, 12 nt, Human
aguagagacagg

SEQ ID NO: 2108460 - RNA, 18 nt, Human
aguagaaauaauaugcau

SEQ ID NO: 2108461 - RNA, 19 nt, Human
aguagaaauaauaugcauu

SEQ ID NO: 2108462 - RNA, 14 nt, Human
aguagaaauuuuac

SEQ ID NO: 2108463 - RNA, 17 nt, Human
aguagaaauuuuacaau

SEQ ID NO: 2108464 - RNA, 14 nt, Human
aguagagucaucuc

SEQ ID NO: 2108465 - RNA, 16 nt, Human
aguagagucaucucca

SEQ ID NO: 2108466 - RNA, 23 nt, Human
aguagagucaucuccaucagcug

SEQ ID NO: 2108467 - RNA, 17 nt, Human
aguagaagucuuagaug

SEQ ID NO: 2108468 - RNA, 19 nt, Human
aguagagauggggaaagaa

SEQ ID NO: 2108469 - RNA, 20 nt, Human
aguagagauggggaaagaau

SEQ ID NO: 2108470 - RNA, 18 nt, Human
uguaggaagguuaauguu

SEQ ID NO: 2108471 - RNA, 17 nt, Human
aguagagucaucuccau

SEQ ID NO: 2108472 - RNA, 20 nt, Human
uguaggaagguuaauguuca

SEQ ID NO: 2108473 - RNA, 11 nt, Human
uguaggagaau

SEQ ID NO: 2108474 - RNA, 20 nt, Human
uguaggagagguugucugug

SEQ ID NO: 2108475 - RNA, 17 nt, Human
uguagguaugaauaagu

SEQ ID NO: 2108476 - RNA, 13 nt, Human
uguagagugggag

SEQ ID NO: 2108477 - RNA, 14 nt, Human
uguagagugggagc

SEQ ID NO: 2108478 - RNA, 16 nt, Human
uguacuuuuaaggcag

SEQ ID NO: 2108479 - RNA, 15 nt, Human
uguacuuuuuccaga

SEQ ID NO: 2108480 - RNA, 21 nt, Human
uguaccaugaaacaaagcugc

SEQ ID NO: 2108481 - RNA, 19 nt, Human
aguaaaaauacaaaaauua

SEQ ID NO: 2108482 - RNA, 14 nt, Human
aguaagcugcuuuu

SEQ ID NO: 2108483 - RNA, 17 nt, Human
aguaaguaccacucagg

SEQ ID NO: 2108484 - RNA, 12 nt, Human
aguaaaaauaaa

SEQ ID NO: 2108485 - RNA, 15 nt, Human
aguaaaaauaaaauu

SEQ ID NO: 2108486 - RNA, 13 nt, Human
aguaaaaauacaa

SEQ ID NO: 2108487 - RNA, 12 nt, Human
aguaaaaauaca

SEQ ID NO: 2108488 - RNA, 20 nt, Human
aguaagccgugauuuucauu

SEQ ID NO: 2108489 - RNA, 13 nt, Human
agguuuuguaaag

SEQ ID NO: 2108490 - RNA, 13 nt, Human
agguuuuguacaa

SEQ ID NO: 2108491 - RNA, 15 nt, Human
agguuuuguaaagau

SEQ ID NO: 2108492 - RNA, 19 nt, Human
uguaagaucguucucugcc

SEQ ID NO: 2108493 - RNA, 20 nt, Human
uguaagaucguucucugccu

SEQ ID NO: 2108494 - RNA, 17 nt, Human
uguaagagcuauacagu

SEQ ID NO: 2108495 - RNA, 21 nt, Human
uguaagagcuuuacaaaaaga

SEQ ID NO: 2108496 - RNA, 13 nt, Human
uguaagauaaaaa

SEQ ID NO: 2108497 - RNA, 14 nt, Human
uguaagauuuugaa

SEQ ID NO: 2108498 - RNA, 15 nt, Human
uguaagauuuugaaa

SEQ ID NO: 2108499 - RNA, 16 nt, Human
uguaagauuuugaaaa

SEQ ID NO: 2108500 - RNA, 17 nt, Human
uguaagauuuugaaaac

SEQ ID NO: 2108501 - RNA, 16 nt, Human
uguaaguuauuucuug

SEQ ID NO: 2108502 - RNA, 22 nt, Human
uguaaguuauuucuuguuuguu

SEQ ID NO: 2108503 - RNA, 12 nt, Human
uguaagugugag

SEQ ID NO: 2108504 - RNA, 14 nt, Human
uguaagugugagua

SEQ ID NO: 2108505 - RNA, 17 nt, Human
uguaagugugaguaaga

SEQ ID NO: 2108506 - RNA, 21 nt, Human
uguaagugugaguaagagcug

SEQ ID NO: 2108507 - RNA, 18 nt, Human
uguaagugagagagacaa

SEQ ID NO: 2108508 - RNA, 17 nt, Human
uguaaguaaacugcccu

SEQ ID NO: 2108509 - RNA, 18 nt, Human
uguaaguaaacugcccug

SEQ ID NO: 2108510 - RNA, 16 nt, Human
uguaaguaaaugucug

SEQ ID NO: 2108511 - RNA, 17 nt, Human
uguaaguaaaugucugu

SEQ ID NO: 2108512 - RNA, 21 nt, Human
uguaaguaaaugucuguggcc

SEQ ID NO: 2108513 - RNA, 14 nt, Human
uguaaguaauuauc

SEQ ID NO: 2108514 - RNA, 23 nt, Human
uguaauuaaguacuauguaucaa

SEQ ID NO: 2108515 - RNA, 17 nt, Human
aggugguuauggagagg

SEQ ID NO: 2108516 - RNA, 17 nt, Human
agguugaggggcuccug

SEQ ID NO: 2108517 - RNA, 20 nt, Human
agguugaggggcuccuggaa

SEQ ID NO: 2108518 - RNA, 16 nt, Human
agguugggguguacua

SEQ ID NO: 2108519 - RNA, 19 nt, Human
agguugggagccaaaugug

SEQ ID NO: 2108520 - RNA, 18 nt, Human
agguugcagggagccgag

SEQ ID NO: 2108521 - RNA, 12 nt, Human
agguugcaggga

SEQ ID NO: 2108522 - RNA, 17 nt, Human
agguuguaaauguguuu

SEQ ID NO: 2108523 - RNA, 19 nt, Human
agguugggguguacuaguu

SEQ ID NO: 2108524 - RNA, 17 nt, Human
agguuguaguaaagaaa

SEQ ID NO: 2108525 - RNA, 14 nt, Human
agguuggugggggc

SEQ ID NO: 2108526 - RNA, 17 nt, Human
uguaagagaauguugaa

SEQ ID NO: 2108527 - RNA, 15 nt, Human
uguaagaaucauugu

SEQ ID NO: 2108528 - RNA, 17 nt, Human
uguaagaagagacuggg

SEQ ID NO: 2108529 - RNA, 21 nt, Human
uguaagaagagacugggaaga

SEQ ID NO: 2108530 - RNA, 19 nt, Human
uguaagaagagacugggaa

SEQ ID NO: 2108531 - RNA, 11 nt, Human
aggugcagugg

SEQ ID NO: 2108532 - RNA, 16 nt, Human
aggugcaguggcucac

SEQ ID NO: 2108533 - RNA, 14 nt, Human
agguggccacucca

SEQ ID NO: 2108534 - RNA, 17 nt, Human
agguggccacuccagac

SEQ ID NO: 2108535 - RNA, 23 nt, Human
aggugcacagacgucccuccacg

SEQ ID NO: 2108536 - RNA, 19 nt, Human
aggugcagagugcccagaa

SEQ ID NO: 2108537 - RNA, 20 nt, Human
aggugcagagugcccagaac

SEQ ID NO: 2108538 - RNA, 17 nt, Human
aggugcagagugcccag

SEQ ID NO: 2108539 - RNA, 18 nt, Human
aggugcagagugcccaga

SEQ ID NO: 2108540 - RNA, 22 nt, Human
aggugcacagacgucccuccac

SEQ ID NO: 2108541 - RNA, 19 nt, Human
aggugggcacuggauuagu

SEQ ID NO: 2108542 - RNA, 21 nt, Human
agguggcugacccagucccug

SEQ ID NO: 2108543 - RNA, 22 nt, Human
agguggcugacccagucccugg

SEQ ID NO: 2108544 - RNA, 23 nt, Human
agguggcucuggaaugacaugug

SEQ ID NO: 2108545 - RNA, 19 nt, Human
agguggcugacccaguccc

SEQ ID NO: 2108546 - RNA, 20 nt, Human
agguggcugacccagucccu

SEQ ID NO: 2108547 - RNA, 14 nt, Human
aggugggccagccc

SEQ ID NO: 2108548 - RNA, 15 nt, Human
aggugggccagcccc

SEQ ID NO: 2108549 - RNA, 16 nt, Human
aggugggccagccccu

SEQ ID NO: 2108550 - RNA, 17 nt, Human
aggugggccagccccuc

SEQ ID NO: 2108551 - RNA, 18 nt, Human
aggugggccagccccucc

SEQ ID NO: 2108552 - RNA, 19 nt, Human
aggugggccagccccuccc

SEQ ID NO: 2108553 - RNA, 21 nt, Human
aggugggccagccccucccac

SEQ ID NO: 2108554 - RNA, 22 nt, Human
aggugggccagccccucccacc

SEQ ID NO: 2108555 - RNA, 19 nt, Human
agguggucugaauguucug

SEQ ID NO: 2108556 - RNA, 20 nt, Human
agguggucugaauguucuga

SEQ ID NO: 2108557 - RNA, 21 nt, Human
agguggucugaauguucugac

SEQ ID NO: 2108558 - RNA, 22 nt, Human
agguggucugaauguucugaca

SEQ ID NO: 2108559 - RNA, 23 nt, Human
agguggucugaauguucugacau

SEQ ID NO: 2108560 - RNA, 23 nt, Human
aggucuugaacuccuggccucaa

SEQ ID NO: 2108561 - RNA, 14 nt, Human
aggucccaggcaga

SEQ ID NO: 2108562 - RNA, 20 nt, Human
aggucuugauuuguuuuaga

SEQ ID NO: 2108563 - RNA, 14 nt, Human
aggucuuuugacau

SEQ ID NO: 2108564 - RNA, 15 nt, Human
aggucuuuugacaug

SEQ ID NO: 2108565 - RNA, 16 nt, Human
aggucuuuugacaugu

SEQ ID NO: 2108566 - RNA, 18 nt, Human
aggucuuuugacaugugg

SEQ ID NO: 2108567 - RNA, 20 nt, Human
uguaaauccuuuuucuuuau

SEQ ID NO: 2108568 - RNA, 22 nt, Human
uguaaauccuuuuucuuuauaa

SEQ ID NO: 2108569 - RNA, 19 nt, Human
aggucuuuugacaugugga

SEQ ID NO: 2108570 - RNA, 12 nt, Human
uguaaauccuuu

SEQ ID NO: 2108571 - RNA, 19 nt, Human
uguaaauccuuuuucuuua

SEQ ID NO: 2108572 - RNA, 16 nt, Human
agucuaggagcuggga

SEQ ID NO: 2108573 - RNA, 17 nt, Human
agucucacuguugccca

SEQ ID NO: 2108574 - RNA, 16 nt, Human
agucucacuguugccc

SEQ ID NO: 2108575 - RNA, 23 nt, Human
agucccuuccccucccuggcucc

SEQ ID NO: 2108576 - RNA, 23 nt, Human
aguccgaaagggacuuggaagcu

SEQ ID NO: 2108577 - RNA, 14 nt, Human
agucccuuccaggc

SEQ ID NO: 2108578 - RNA, 13 nt, Human
agucccuuccccu

SEQ ID NO: 2108579 - RNA, 14 nt, Human
agucccuuccccuc

SEQ ID NO: 2108580 - RNA, 15 nt, Human
agucccuuccccucc

SEQ ID NO: 2108581 - RNA, 17 nt, Human
agucccuuccccucccu

SEQ ID NO: 2108582 - RNA, 19 nt, Human
agucccuuccccucccugg

SEQ ID NO: 2108583 - RNA, 20 nt, Human
agucccuuccccucccuggc

SEQ ID NO: 2108584 - RNA, 21 nt, Human
agucccuuccccucccuggcu

SEQ ID NO: 2108585 - RNA, 22 nt, Human
agucccuuccccucccuggcuc

SEQ ID NO: 2108586 - RNA, 14 nt, Human
agucccugggggaa

SEQ ID NO: 2108587 - RNA, 17 nt, Human
agucccugggggaagcc

SEQ ID NO: 2108588 - RNA, 20 nt, Human
agucccugggggaagcccug

SEQ ID NO: 2108589 - RNA, 21 nt, Human
agucccugggggaagcccugg

SEQ ID NO: 2108590 - RNA, 21 nt, Human
agucccugugaagacugggug

SEQ ID NO: 2108591 - RNA, 22 nt, Human
agucccugggggaagcccugga

SEQ ID NO: 2108592 - RNA, 21 nt, Human
agucccugacucucugugacc

SEQ ID NO: 2108593 - RNA, 12 nt, Human
aguccaggcccc

SEQ ID NO: 2108594 - RNA, 22 nt, Human
agucaggccuuaauuuucagua

SEQ ID NO: 2108595 - RNA, 19 nt, Human
agucagggaccccugcccu

SEQ ID NO: 2108596 - RNA, 16 nt, Human
agucagggaccccugc

SEQ ID NO: 2108597 - RNA, 13 nt, Human
aguccaggcccca

SEQ ID NO: 2108598 - RNA, 18 nt, Human
aguccaggccccaaaacc

SEQ ID NO: 2108599 - RNA, 19 nt, Human
agucccugacucucuguga

SEQ ID NO: 2108600 - RNA, 23 nt, Human
aguccaggccccaaaaccacagc

SEQ ID NO: 2108601 - RNA, 15 nt, Human
agucccgucaggacg

SEQ ID NO: 2108602 - RNA, 15 nt, Human
agucagacugcuggg

SEQ ID NO: 2108603 - RNA, 13 nt, Human
ugucuaaaaacac

SEQ ID NO: 2108604 - RNA, 14 nt, Human
agucagagagaauc

SEQ ID NO: 2108605 - RNA, 23 nt, Human
agucagacuggauaguccgucuc

SEQ ID NO: 2108606 - RNA, 17 nt, Human
agucagagagaguguuu

SEQ ID NO: 2108607 - RNA, 15 nt, Human
ugucgcccagucugg

SEQ ID NO: 2108608 - RNA, 14 nt, Human
ugucgcccagucug

SEQ ID NO: 2108609 - RNA, 22 nt, Human
ugucgauuaaaaucacucucag

SEQ ID NO: 2108610 - RNA, 17 nt, Human
ugucgcccagugcccug

SEQ ID NO: 2108611 - RNA, 23 nt, Human
ugucgguuuuuuuuaaauaaaag

SEQ ID NO: 2108612 - RNA, 23 nt, Human
ugucguagccaaggugggcugag

SEQ ID NO: 2108613 - RNA, 21 nt, Human
ugucguggguguguguagcca

SEQ ID NO: 2108614 - RNA, 19 nt, Human
ugucgauauuuccaucauu

SEQ ID NO: 2108615 - RNA, 17 nt, Human
uguccuuuuuguuauua

SEQ ID NO: 2108616 - RNA, 16 nt, Human
uguccuuuuuguuauu

SEQ ID NO: 2108617 - RNA, 16 nt, Human
uguccuacccacccuc

SEQ ID NO: 2108618 - RNA, 18 nt, Human
uguccuuucccuccacuc

SEQ ID NO: 2108619 - RNA, 13 nt, Human
uguccgagcuuug

SEQ ID NO: 2108620 - RNA, 14 nt, Human
uguccgagcuuuga

SEQ ID NO: 2108621 - RNA, 13 nt, Human
uguccgagaacua

SEQ ID NO: 2108622 - RNA, 22 nt, Human
uguccgagaacuaaagccaagg

SEQ ID NO: 2108623 - RNA, 12 nt, Human
uguccgcccucu

SEQ ID NO: 2108624 - RNA, 13 nt, Human
uguccgcccucuu

SEQ ID NO: 2108625 - RNA, 15 nt, Human
uguccgcccucuucc

SEQ ID NO: 2108626 - RNA, 17 nt, Human
uguccgcccucuucccc

SEQ ID NO: 2108627 - RNA, 15 nt, Human
ugucauuuuugcagu

SEQ ID NO: 2108628 - RNA, 12 nt, Human
ugucauuuugaa

SEQ ID NO: 2108629 - RNA, 15 nt, Human
ugucauuuugaagcu

SEQ ID NO: 2108630 - RNA, 17 nt, Human
ugucauuuugaagcuaa

SEQ ID NO: 2108631 - RNA, 18 nt, Human
ugucauuuugaagcuaau

SEQ ID NO: 2108632 - RNA, 19 nt, Human
ugucauuuugaagcuaauu

SEQ ID NO: 2108633 - RNA, 22 nt, Human
ugucauuuugaagcuaauuauu

SEQ ID NO: 2108634 - RNA, 18 nt, Human
ugucauuuuugcaguaga

SEQ ID NO: 2108635 - RNA, 19 nt, Human
ugucaagagggucugagga

SEQ ID NO: 2108636 - RNA, 15 nt, Human
ugucaagccauaauu

SEQ ID NO: 2108637 - RNA, 12 nt, Human
ugucaauaaaca

SEQ ID NO: 2108638 - RNA, 14 nt, Human
ugucaagaaagagc

SEQ ID NO: 2108639 - RNA, 23 nt, Human
uguauucacgugcagcagcaaca

SEQ ID NO: 2108640 - RNA, 17 nt, Human
uguauucagugaggguc

SEQ ID NO: 2108641 - RNA, 16 nt, Human
uguauuauucugcagc

SEQ ID NO: 2108642 - RNA, 19 nt, Human
uguaguaaacuauuuaucu

SEQ ID NO: 2108643 - RNA, 13 nt, Human
uguaguaaagaaa

SEQ ID NO: 2108644 - RNA, 15 nt, Human
uguaguaaagaaauu

SEQ ID NO: 2108645 - RNA, 16 nt, Human
ugucaauaaacagcuu

SEQ ID NO: 2108646 - RNA, 21 nt, Human
ugucaauaaacagcuucaugc

SEQ ID NO: 2108647 - RNA, 23 nt, Human
ugucaauaaacagcuucaugccu

SEQ ID NO: 2108648 - RNA, 14 nt, Human
aguagucauuucau

SEQ ID NO: 2108649 - RNA, 12 nt, Human
aguagucauuuc

SEQ ID NO: 2108650 - RNA, 13 nt, Human
aguagucauuuca

SEQ ID NO: 2108651 - RNA, 15 nt, Human
aguagugagaagaau

SEQ ID NO: 2108652 - RNA, 17 nt, Human
aguagugagaagaauau

SEQ ID NO: 2108653 - RNA, 18 nt, Human
aguagugagaagaauauu

SEQ ID NO: 2108654 - RNA, 20 nt, Human
aguagugagaagaauauugu

SEQ ID NO: 2108655 - RNA, 21 nt, Human
aguagugagaagaauauuguu

SEQ ID NO: 2108656 - RNA, 16 nt, Human
ugucagguggggcagc

SEQ ID NO: 2108657 - RNA, 18 nt, Human
ugucaggaacagaaggau

SEQ ID NO: 2108658 - RNA, 20 nt, Human
ugucaggaacagaaggauga

SEQ ID NO: 2108659 - RNA, 21 nt, Human
agucacugccucucccuggcc

SEQ ID NO: 2108660 - RNA, 16 nt, Human
ugucaggaacagaagg

SEQ ID NO: 2108661 - RNA, 17 nt, Human
ugucaggaacagaagga

SEQ ID NO: 2108662 - RNA, 19 nt, Human
ugucagcugaaccugggua

SEQ ID NO: 2108663 - RNA, 14 nt, Human
agucacugccucuc

SEQ ID NO: 2108664 - RNA, 17 nt, Human
agucacugccucucccu

SEQ ID NO: 2108665 - RNA, 20 nt, Human
agucacugccucucccuggc

SEQ ID NO: 2108666 - RNA, 13 nt, Human
agucacugcacag

SEQ ID NO: 2108667 - RNA, 16 nt, Human
ugucagcugaaccugg

SEQ ID NO: 2108668 - RNA, 14 nt, Human
agucaccaagccca

SEQ ID NO: 2108669 - RNA, 13 nt, Human
agucaccaagccc

SEQ ID NO: 2108670 - RNA, 17 nt, Human
aguauuucagaugcuuu

SEQ ID NO: 2108671 - RNA, 19 nt, Human
aguauuucagaugcuuuag

SEQ ID NO: 2108672 - RNA, 16 nt, Human
aguauuugcauauucu

SEQ ID NO: 2108673 - RNA, 17 nt, Human
agugcugggauuacagg

SEQ ID NO: 2108674 - RNA, 19 nt, Human
agugcugggauuacaggug

SEQ ID NO: 2108675 - RNA, 16 nt, Human
agugcuuaaaaaucau

SEQ ID NO: 2108676 - RNA, 17 nt, Human
agugcuuaaaaaucauu

SEQ ID NO: 2108677 - RNA, 19 nt, Human
agugcuuaaaaaucauuga

SEQ ID NO: 2108678 - RNA, 14 nt, Human
agugcuucagccug

SEQ ID NO: 2108679 - RNA, 20 nt, Human
agugcugggauuacaagcgu

SEQ ID NO: 2108680 - RNA, 17 nt, Human
agugccugggaauguau

SEQ ID NO: 2108681 - RNA, 18 nt, Human
agugccugggaauguauu

SEQ ID NO: 2108682 - RNA, 22 nt, Human
agugccugggaauguauuauuc

SEQ ID NO: 2108683 - RNA, 22 nt, Human
agugcccuggggcugaucucag

SEQ ID NO: 2108684 - RNA, 23 nt, Human
agugcccuggggcugaucucagg

SEQ ID NO: 2108685 - RNA, 12 nt, Human
agugccugcuga

SEQ ID NO: 2108686 - RNA, 13 nt, Human
agugccugggaau

SEQ ID NO: 2108687 - RNA, 16 nt, Human
agugcuuccaaggaug

SEQ ID NO: 2108688 - RNA, 15 nt, Human
agugcuucagccuga

SEQ ID NO: 2108689 - RNA, 16 nt, Human
agugcuucagccugag

SEQ ID NO: 2108690 - RNA, 17 nt, Human
agugcuucagccugagg

SEQ ID NO: 2108691 - RNA, 18 nt, Human
agugcuucagccugaggc

SEQ ID NO: 2108692 - RNA, 14 nt, Human
agugcuucuuacua

SEQ ID NO: 2108693 - RNA, 21 nt, Human
agugcuucuuacuauuaagca

SEQ ID NO: 2108694 - RNA, 19 nt, Human
agugcuugaguuuggggaa

SEQ ID NO: 2108695 - RNA, 19 nt, Human
agugcuucagccugaggcu

SEQ ID NO: 2108696 - RNA, 20 nt, Human
agugcuucagccugaggcug

SEQ ID NO: 2108697 - RNA, 14 nt, Human
agugcuucucuaca

SEQ ID NO: 2108698 - RNA, 21 nt, Human
agugcuucuuaaagaguucuu

SEQ ID NO: 2108699 - RNA, 19 nt, Human
ugugucagcauagaaguaa

SEQ ID NO: 2108700 - RNA, 12 nt, Human
ugugguuucauu

SEQ ID NO: 2108701 - RNA, 20 nt, Human
ugugguuaaugccauggaca

SEQ ID NO: 2108702 - RNA, 15 nt, Human
ugugguuaaugccau

SEQ ID NO: 2108703 - RNA, 19 nt, Human
ugugguugacuuaugggcc

SEQ ID NO: 2108704 - RNA, 18 nt, Human
ugugguuauuuuuauaca

SEQ ID NO: 2108705 - RNA, 19 nt, Human
ugugguuauuuuuauacag

SEQ ID NO: 2108706 - RNA, 20 nt, Human
ugugguuauuuuuauacagu

SEQ ID NO: 2108707 - RNA, 21 nt, Human
ugugguuauuuuuauacagua

SEQ ID NO: 2108708 - RNA, 15 nt, Human
ugugguuuaguguaa

SEQ ID NO: 2108709 - RNA, 21 nt, Human
ugugguuuaguguaaaaauga

SEQ ID NO: 2108710 - RNA, 19 nt, Human
uguggugagguugggcagc

SEQ ID NO: 2108711 - RNA, 14 nt, Human
ugugguuaaugcca

SEQ ID NO: 2108712 - RNA, 19 nt, Human
ugugucuaggcaggaccug

SEQ ID NO: 2108713 - RNA, 20 nt, Human
ugugucuaggcaggaccugu

SEQ ID NO: 2108714 - RNA, 12 nt, Human
ugugugugugca

SEQ ID NO: 2108715 - RNA, 13 nt, Human
ugugucuccugca

SEQ ID NO: 2108716 - RNA, 19 nt, Human
ugugucuccugcaugcaga

SEQ ID NO: 2108717 - RNA, 11 nt, Human
ugugugugugu

SEQ ID NO: 2108718 - RNA, 19 nt, Human
ugugucagguggggcagcu

SEQ ID NO: 2108719 - RNA, 17 nt, Human
ugugucagguggggcag

SEQ ID NO: 2108720 - RNA, 13 nt, Human
uguguuauuuaaa

SEQ ID NO: 2108721 - RNA, 14 nt, Human
uguguuauuuaaau

SEQ ID NO: 2108722 - RNA, 16 nt, Human
uguguuauuuaaauga

SEQ ID NO: 2108723 - RNA, 14 nt, Human
uguguuaugaagca

SEQ ID NO: 2108724 - RNA, 12 nt, Human
ugugugugugug

SEQ ID NO: 2108725 - RNA, 15 nt, Human
uguguguguguauga

SEQ ID NO: 2108726 - RNA, 21 nt, Human
uguuaacauggacaugaucuu

SEQ ID NO: 2108727 - RNA, 15 nt, Human
uguuaaccucagugu

SEQ ID NO: 2108728 - RNA, 16 nt, Human
uguuaaccagaauaaa

SEQ ID NO: 2108729 - RNA, 19 nt, Human
uguuaaccucagugucauu

SEQ ID NO: 2108730 - RNA, 17 nt, Human
uguuaaccucaguguca

SEQ ID NO: 2108731 - RNA, 12 nt, Human
uguguuggcugu

SEQ ID NO: 2108732 - RNA, 18 nt, Human
uguguugccaugugugcu

SEQ ID NO: 2108733 - RNA, 19 nt, Human
uguuaaugauagcuacugu

SEQ ID NO: 2108734 - RNA, 14 nt, Human
uguuaauccuagcu

SEQ ID NO: 2108735 - RNA, 20 nt, Human
uguuaauccuagcugugugc

SEQ ID NO: 2108736 - RNA, 17 nt, Human
uguuaaugguuugaaua

SEQ ID NO: 2108737 - RNA, 23 nt, Human
uguuaaucuuaggggagagcuuu

SEQ ID NO: 2108738 - RNA, 14 nt, Human
uguuaaugaaaaug

SEQ ID NO: 2108739 - RNA, 17 nt, Human
uguuaaugaaaauguca

SEQ ID NO: 2108740 - RNA, 19 nt, Human
uguuaaugaaaaugucaga

SEQ ID NO: 2108741 - RNA, 11 nt, Human
aguggaaaaau

SEQ ID NO: 2108742 - RNA, 20 nt, Human
uguuaauggugcaaauccua

SEQ ID NO: 2108743 - RNA, 13 nt, Human
agugcuuuguaau

SEQ ID NO: 2108744 - RNA, 18 nt, Human
aguggaaaaauagccugc

SEQ ID NO: 2108745 - RNA, 19 nt, Human
aguggaaaaauagccugcc

SEQ ID NO: 2108746 - RNA, 18 nt, Human
agugcaaugacacagucu

SEQ ID NO: 2108747 - RNA, 22 nt, Human
agugcaaugguauaaauuucaa

SEQ ID NO: 2108748 - RNA, 16 nt, Human
agugcaaugacacagu

SEQ ID NO: 2108749 - RNA, 21 nt, Human
agugauuucuggggccccacc

SEQ ID NO: 2108750 - RNA, 16 nt, Human
agugauuuuuauccaa

SEQ ID NO: 2108751 - RNA, 22 nt, Human
agugauuuuuauccaaucuugu

SEQ ID NO: 2108752 - RNA, 21 nt, Human
agugaguguggcuccccucua

SEQ ID NO: 2108753 - RNA, 22 nt, Human
agugauucuccugccucagccu

SEQ ID NO: 2108754 - RNA, 24 nt, Human
agugauucuccugccucagccucc

SEQ ID NO: 2108755 - RNA, 16 nt, Human
agugagucucuucaga

SEQ ID NO: 2108756 - RNA, 16 nt, Human
agugaguguggcuccc

SEQ ID NO: 2108757 - RNA, 18 nt, Human
agugaguguggcuccccu

SEQ ID NO: 2108758 - RNA, 19 nt, Human
agugaguguggcuccccuc

SEQ ID NO: 2108759 - RNA, 16 nt, Human
agugagucgaggacag

SEQ ID NO: 2108760 - RNA, 17 nt, Human
uguggcccuggccugcu

SEQ ID NO: 2108761 - RNA, 14 nt, Human
uguggcccuggccu

SEQ ID NO: 2108762 - RNA, 20 nt, Human
uguggcccuggccugcuggg

SEQ ID NO: 2108763 - RNA, 22 nt, Human
uguggccaugguccccaagacc

SEQ ID NO: 2108764 - RNA, 12 nt, Human
uguggccccuuc

SEQ ID NO: 2108765 - RNA, 13 nt, Human
uguggccccuuca

SEQ ID NO: 2108766 - RNA, 12 nt, Human
uguggcccuggc

SEQ ID NO: 2108767 - RNA, 14 nt, Human
agugcccacaggau

SEQ ID NO: 2108768 - RNA, 16 nt, Human
agugcccaccaacauc

SEQ ID NO: 2108769 - RNA, 17 nt, Human
agugcccaacuguuaua

SEQ ID NO: 2108770 - RNA, 20 nt, Human
agugcccaccaacaucccau

SEQ ID NO: 2108771 - RNA, 19 nt, Human
agugcccaccaacauccca

SEQ ID NO: 2108772 - RNA, 23 nt, Human
agugcccagaacuggacucagga

SEQ ID NO: 2108773 - RNA, 13 nt, Human
agugccccaccug

SEQ ID NO: 2108774 - RNA, 14 nt, Human
agugccccaccugc

SEQ ID NO: 2108775 - RNA, 15 nt, Human
agugccccaccugcc

SEQ ID NO: 2108776 - RNA, 16 nt, Human
agugccccaccugcca

SEQ ID NO: 2108777 - RNA, 17 nt, Human
agugccccaccugccac

SEQ ID NO: 2108778 - RNA, 23 nt, Human
agugccccaccugccacuaggcu

SEQ ID NO: 2108779 - RNA, 14 nt, Human
agugccaagcacag

SEQ ID NO: 2108780 - RNA, 20 nt, Human
agugccacugcccgagcugg

SEQ ID NO: 2108781 - RNA, 19 nt, Human
agugccaagcacagugccu

SEQ ID NO: 2108782 - RNA, 21 nt, Human
agugccacugcccgagcuggu

SEQ ID NO: 2108783 - RNA, 22 nt, Human
agugccacugcccgagcuggug

SEQ ID NO: 2108784 - RNA, 17 nt, Human
agugcaucucagcccac

SEQ ID NO: 2108785 - RNA, 16 nt, Human
agugcaucucagccca

SEQ ID NO: 2108786 - RNA, 15 nt, Human
agugcaugcucucug

SEQ ID NO: 2108787 - RNA, 16 nt, Human
agugcaugcucucugc

SEQ ID NO: 2108788 - RNA, 17 nt, Human
agugcaugcucucugca

SEQ ID NO: 2108789 - RNA, 20 nt, Human
agugcaugcucucugcagcc

SEQ ID NO: 2108790 - RNA, 22 nt, Human
agugcaugcucucugcagccag

SEQ ID NO: 2108791 - RNA, 14 nt, Human
agugcaucucagcc

SEQ ID NO: 2108792 - RNA, 15 nt, Human
agugcaucucagccc

SEQ ID NO: 2108793 - RNA, 11 nt, Human
agugcaggcug

SEQ ID NO: 2108794 - RNA, 13 nt, Human
agugcaggcuggc

SEQ ID NO: 2108795 - RNA, 15 nt, Human
agugcaggcuggcac

SEQ ID NO: 2108796 - RNA, 18 nt, Human
agugcagcugauuuuaac

SEQ ID NO: 2108797 - RNA, 20 nt, Human
agugcagcugauuuuaacaa

SEQ ID NO: 2108798 - RNA, 14 nt, Human
agugcagcugauuu

SEQ ID NO: 2108799 - RNA, 15 nt, Human
agugcagcugauuuu

SEQ ID NO: 2108800 - RNA, 16 nt, Human
agugcagcugauuuua

SEQ ID NO: 2108801 - RNA, 17 nt, Human
agugcagcugauuuuaa

SEQ ID NO: 2108802 - RNA, 17 nt, Human
agugcacccacucugcu

SEQ ID NO: 2108803 - RNA, 23 nt, Human
agugcagcccguguggccccuuc

SEQ ID NO: 2108804 - RNA, 24 nt, Human
agugcagcccguguggccccuuca

SEQ ID NO: 2108805 - RNA, 13 nt, Human
agugcacccacuc

SEQ ID NO: 2108806 - RNA, 15 nt, Human
ugugcucuggacagg

SEQ ID NO: 2108807 - RNA, 23 nt, Human
ugugcucugaucauccacugugc

SEQ ID NO: 2108808 - RNA, 12 nt, Human
ugugcucugauc

SEQ ID NO: 2108809 - RNA, 22 nt, Human
ugugcucugaucauccacugug

SEQ ID NO: 2108810 - RNA, 13 nt, Human
ugugccucugccu

SEQ ID NO: 2108811 - RNA, 12 nt, Human
ugugccucugcc

SEQ ID NO: 2108812 - RNA, 19 nt, Human
agucucacuguugcccagg

SEQ ID NO: 2108813 - RNA, 18 nt, Human
agucucacuguugcccag

SEQ ID NO: 2108814 - RNA, 20 nt, Human
agucucacuguugcccaggc

SEQ ID NO: 2108815 - RNA, 14 nt, Human
agucucacuccccu

SEQ ID NO: 2108816 - RNA, 16 nt, Human
agucucacuccccucc

SEQ ID NO: 2108817 - RNA, 21 nt, Human
agucucacuccccuccuuucc

SEQ ID NO: 2108818 - RNA, 21 nt, Human
agucucacuguugcccaggcu

SEQ ID NO: 2108819 - RNA, 19 nt, Human
ugugcucuggacaggcaug

SEQ ID NO: 2108820 - RNA, 18 nt, Human
ugugcucuggacaggcau

SEQ ID NO: 2108821 - RNA, 16 nt, Human
ugugcucuggacaggc

SEQ ID NO: 2108822 - RNA, 19 nt, Human
uguggagagugcaacagua

SEQ ID NO: 2108823 - RNA, 20 nt, Human
uguggagcacaaaagccucu

SEQ ID NO: 2108824 - RNA, 16 nt, Human
uguggagcccgcaccc

SEQ ID NO: 2108825 - RNA, 18 nt, Human
uguggagcccgcaccccc

SEQ ID NO: 2108826 - RNA, 19 nt, Human
uguggagcccgcaccccca

SEQ ID NO: 2108827 - RNA, 22 nt, Human
uguggcaaagccuucauugccu

SEQ ID NO: 2108828 - RNA, 14 nt, Human
uguggcacauuuuu

SEQ ID NO: 2108829 - RNA, 15 nt, Human
uguugcccaggcugg

SEQ ID NO: 2108830 - RNA, 14 nt, Human
uguugcccaggcug

SEQ ID NO: 2108831 - RNA, 21 nt, Human
uguugcccaggcuggagugca

SEQ ID NO: 2108832 - RNA, 13 nt, Human
uguugcccaggcu

SEQ ID NO: 2108833 - RNA, 19 nt, Human
uguucuugccacugcacuc

SEQ ID NO: 2108834 - RNA, 22 nt, Human
aguguuauuuucuuugaaauug

SEQ ID NO: 2108835 - RNA, 12 nt, Human
aguguguucuga

SEQ ID NO: 2108836 - RNA, 13 nt, Human
aguguguucugau

SEQ ID NO: 2108837 - RNA, 17 nt, Human
aguguguucugauuaga

SEQ ID NO: 2108838 - RNA, 20 nt, Human
aguguguucugauuagaaau

SEQ ID NO: 2108839 - RNA, 21 nt, Human
aguguguucugauuagaaaug

SEQ ID NO: 2108840 - RNA, 19 nt, Human
aguguguuuccuucagugc

SEQ ID NO: 2108841 - RNA, 20 nt, Human
aguguguuuccuucagugca

SEQ ID NO: 2108842 - RNA, 21 nt, Human
aguguuaaaaaauuuuugaaa

SEQ ID NO: 2108843 - RNA, 15 nt, Human
aguuacucugaaggg

SEQ ID NO: 2108844 - RNA, 16 nt, Human
aguuacucugaagggc

SEQ ID NO: 2108845 - RNA, 17 nt, Human
aguuacuguuauagagg

SEQ ID NO: 2108846 - RNA, 14 nt, Human
aguuacuuccuauc

SEQ ID NO: 2108847 - RNA, 15 nt, Human
aguuacuuccuauca

SEQ ID NO: 2108848 - RNA, 19 nt, Human
aguuacuuugucagaggca

SEQ ID NO: 2108849 - RNA, 16 nt, Human
aguggaaccagcccag

SEQ ID NO: 2108850 - RNA, 15 nt, Human
aguggaaauguucua

SEQ ID NO: 2108851 - RNA, 22 nt, Human
aguggaaagacagcuucucauc

SEQ ID NO: 2108852 - RNA, 22 nt, Human
aguggacuuuccacccccuccc

SEQ ID NO: 2108853 - RNA, 17 nt, Human
aguggacuuuccacccc

SEQ ID NO: 2108854 - RNA, 18 nt, Human
aguggacuuuccaccccc

SEQ ID NO: 2108855 - RNA, 19 nt, Human
aguggacuuuccacccccu

SEQ ID NO: 2108856 - RNA, 20 nt, Human
aguggacuuuccacccccuc

SEQ ID NO: 2108857 - RNA, 16 nt, Human
aguggaagaagaaaac

SEQ ID NO: 2108858 - RNA, 12 nt, Human
aguggaaggaaa

SEQ ID NO: 2108859 - RNA, 13 nt, Human
aguggaaggaaag

SEQ ID NO: 2108860 - RNA, 15 nt, Human
aguggaaggaaagau

SEQ ID NO: 2108861 - RNA, 15 nt, Human
aguggacuuuccacc

SEQ ID NO: 2108862 - RNA, 23 nt, Human
aguggagguuaaggcugaggaaa

SEQ ID NO: 2108863 - RNA, 22 nt, Human
aguggagguuaaggcugaggaa

SEQ ID NO: 2108864 - RNA, 14 nt, Human
aguggaggugcugc

SEQ ID NO: 2108865 - RNA, 12 nt, Human
aguggagaggga

SEQ ID NO: 2108866 - RNA, 15 nt, Human
aguggauagaugccc

SEQ ID NO: 2108867 - RNA, 21 nt, Human
aguggauagaugcccugcuag

SEQ ID NO: 2108868 - RNA, 21 nt, Human
agugugguagggacuuaaaaa

SEQ ID NO: 2108869 - RNA, 13 nt, Human
uguuauugaaaaa

SEQ ID NO: 2108870 - RNA, 14 nt, Human
uguuauugaaaaaa

SEQ ID NO: 2108871 - RNA, 16 nt, Human
uguuauugaaaaaaau

SEQ ID NO: 2108872 - RNA, 23 nt, Human
uguuauugaaaaaaauuggcauu

SEQ ID NO: 2108873 - RNA, 12 nt, Human
uguuauuauaua

SEQ ID NO: 2108874 - RNA, 14 nt, Human
uguuauuacauccu

SEQ ID NO: 2108875 - RNA, 17 nt, Human
uguuauuacauccuugu

SEQ ID NO: 2108876 - RNA, 20 nt, Human
uguuauuacauccuuguggc

SEQ ID NO: 2108877 - RNA, 22 nt, Human
uguuauuucuauuuuuguagaa

SEQ ID NO: 2108878 - RNA, 21 nt, Human
uguuauuucuauuuuuguaga

SEQ ID NO: 2108879 - RNA, 15 nt, Human
uguuauuuaaaugag

SEQ ID NO: 2108880 - RNA, 22 nt, Human
uguuccccuuugcuucauucaa

SEQ ID NO: 2108881 - RNA, 18 nt, Human
uguucccucucccuguug

SEQ ID NO: 2108882 - RNA, 18 nt, Human
uguucuuaguuugcaguu

SEQ ID NO: 2108883 - RNA, 18 nt, Human
uguucuacucauauauau

SEQ ID NO: 2108884 - RNA, 20 nt, Human
uguuguuaaugaaaauguca

SEQ ID NO: 2108885 - RNA, 21 nt, Human
uguuguuaaugaaaaugucag

SEQ ID NO: 2108886 - RNA, 17 nt, Human
uguuguuaaugaaaaug

SEQ ID NO: 2108887 - RNA, 18 nt, Human
uguuguuaaugaaaaugu

SEQ ID NO: 2108888 - RNA, 21 nt, Human
uguuguguacguggagaggga

SEQ ID NO: 2108889 - RNA, 16 nt, Human
uguugugguuuguugc

SEQ ID NO: 2108890 - RNA, 15 nt, Human
uguugguauuuaucu

SEQ ID NO: 2108891 - RNA, 18 nt, Human
uguugguauuuaucuauu

SEQ ID NO: 2108892 - RNA, 14 nt, Human
aguucacuugcagu

SEQ ID NO: 2108893 - RNA, 18 nt, Human
uguugugaagauguuugc

SEQ ID NO: 2108894 - RNA, 14 nt, Human
uguuuauuuuuaua

SEQ ID NO: 2108895 - RNA, 15 nt, Human
uguuuauuuuuauau

SEQ ID NO: 2108896 - RNA, 22 nt, Human
uguuuauuuuuauauagcuuga

SEQ ID NO: 2108897 - RNA, 23 nt, Human
uguuuauuuuuauauagcuugaa

SEQ ID NO: 2108898 - RNA, 24 nt, Human
uguuuauggccucagcugccucac

SEQ ID NO: 2108899 - RNA, 14 nt, Human
uguuuaugagccag

SEQ ID NO: 2108900 - RNA, 16 nt, Human
uguuuaugagccagac

SEQ ID NO: 2108901 - RNA, 21 nt, Human
uguuuaugagccagacaaaug

SEQ ID NO: 2108902 - RNA, 21 nt, Human
uguuuaugcaaggaaggaaag

SEQ ID NO: 2108903 - RNA, 13 nt, Human
uguuuauggccuc

SEQ ID NO: 2108904 - RNA, 14 nt, Human
uguuuauggccuca

SEQ ID NO: 2108905 - RNA, 15 nt, Human
uguuuauggccucag

SEQ ID NO: 2108906 - RNA, 23 nt, Human
uguuuauggccucagcugccuca

SEQ ID NO: 2108907 - RNA, 13 nt, Human
aguucaaggacca

SEQ ID NO: 2108908 - RNA, 15 nt, Human
aguucaaggaccaac

SEQ ID NO: 2108909 - RNA, 16 nt, Human
aguucaauucucauuu

SEQ ID NO: 2108910 - RNA, 17 nt, Human
aguuauauaaagagaaa

SEQ ID NO: 2108911 - RNA, 19 nt, Human
aguuauauaaagagaaaau

SEQ ID NO: 2108912 - RNA, 20 nt, Human
aguuauauaaagagaaaauu

SEQ ID NO: 2108913 - RNA, 21 nt, Human
aguuauauaaagagaaaauug

SEQ ID NO: 2108914 - RNA, 22 nt, Human
aguuauauaaagagaaaauuga

SEQ ID NO: 2108915 - RNA, 16 nt, Human
aguucaagaccagccu

SEQ ID NO: 2108916 - RNA, 18 nt, Human
aguucaagaccagccugg

SEQ ID NO: 2108917 - RNA, 19 nt, Human
aguucaagaccagccuggc

SEQ ID NO: 2108918 - RNA, 15 nt, Human
aguucccauguuaaa

SEQ ID NO: 2108919 - RNA, 15 nt, Human
aguucccuacuuccu

SEQ ID NO: 2108920 - RNA, 23 nt, Human
aguuccucauuagcauuuugcua

SEQ ID NO: 2108921 - RNA, 17 nt, Human
aguucaccuauuucaaa

SEQ ID NO: 2108922 - RNA, 22 nt, Human
aguucaccuauuucaaaaauuu

SEQ ID NO: 2108923 - RNA, 16 nt, Human
aguucacuauaaaugg

SEQ ID NO: 2108924 - RNA, 21 nt, Human
aguucacuauaaaugguguuu

SEQ ID NO: 2108925 - RNA, 15 nt, Human
aguucuauuuaagug

SEQ ID NO: 2108926 - RNA, 14 nt, Human
aguucuauuucuau

SEQ ID NO: 2108927 - RNA, 22 nt, Human
aguucuauuucuaucccaaacu

SEQ ID NO: 2108928 - RNA, 12 nt, Human
aguuccucgccc

SEQ ID NO: 2108929 - RNA, 13 nt, Human
aguuccucgcccu

SEQ ID NO: 2108930 - RNA, 14 nt, Human
aguuccucgcccug

SEQ ID NO: 2108931 - RNA, 15 nt, Human
aguuccucgcccugg

SEQ ID NO: 2108932 - RNA, 18 nt, Human
aguuccucuagugcccuc

SEQ ID NO: 2108933 - RNA, 16 nt, Human
aguuccucgcccuggg

SEQ ID NO: 2108934 - RNA, 17 nt, Human
aguuccucgcccugggu

SEQ ID NO: 2108935 - RNA, 18 nt, Human
aguuccugaugacccagg

SEQ ID NO: 2108936 - RNA, 19 nt, Human
aguuccugaugacccaggc

SEQ ID NO: 2108937 - RNA, 15 nt, Human
aguuuuuauugcuug

SEQ ID NO: 2108938 - RNA, 17 nt, Human
aguuuuuauggggcuga

SEQ ID NO: 2108939 - RNA, 18 nt, Human
aguuuuuauuccuuguga

SEQ ID NO: 2108940 - RNA, 16 nt, Human
auaaaagcagcaucug

SEQ ID NO: 2108941 - RNA, 20 nt, Human
auaaaagcagcaucugcuaa

SEQ ID NO: 2108942 - RNA, 15 nt, Human
auaaaagcauaaaug

SEQ ID NO: 2108943 - RNA, 18 nt, Human
auaaaagcauaaaugcaa

SEQ ID NO: 2108944 - RNA, 20 nt, Human
auaaaagcauaaaugcaaac

SEQ ID NO: 2108945 - RNA, 14 nt, Human
uuaaaaaaaacuca

SEQ ID NO: 2108946 - RNA, 17 nt, Human
uuaagaaaauacaauaa

SEQ ID NO: 2108947 - RNA, 18 nt, Human
uuaagaaaauacaauaaa

SEQ ID NO: 2108948 - RNA, 19 nt, Human
uuaagaaaauacaauaaac

SEQ ID NO: 2108949 - RNA, 18 nt, Human
auaaaauaucauucagca

SEQ ID NO: 2108950 - RNA, 19 nt, Human
auaaaauaucauucagcaa

SEQ ID NO: 2108951 - RNA, 13 nt, Human
auaaaauaucauu

SEQ ID NO: 2108952 - RNA, 15 nt, Human
auaaaauaucauuca

SEQ ID NO: 2108953 - RNA, 16 nt, Human
auaaaauaucauucag

SEQ ID NO: 2108954 - RNA, 17 nt, Human
auaaaauaucauucagc

SEQ ID NO: 2108955 - RNA, 15 nt, Human
auaaaauauaauugu

SEQ ID NO: 2108956 - RNA, 12 nt, Human
aguuuuguaaau

SEQ ID NO: 2108957 - RNA, 15 nt, Human
aguuuuguaaauuuc

SEQ ID NO: 2108958 - RNA, 17 nt, Human
aguuuuuaccuaccaca

SEQ ID NO: 2108959 - RNA, 21 nt, Human
aguuuuuaccuaccacagugu

SEQ ID NO: 2108960 - RNA, 22 nt, Human
aguuuuuaccuaccacaguguc

SEQ ID NO: 2108961 - RNA, 23 nt, Human
aguuuuuaccuaccacagugucu

SEQ ID NO: 2108962 - RNA, 16 nt, Human
aguuuuuacuuucugu

SEQ ID NO: 2108963 - RNA, 19 nt, Human
aguuuugccagaacaguuu

SEQ ID NO: 2108964 - RNA, 16 nt, Human
aguuuugcauuuaugg

SEQ ID NO: 2108965 - RNA, 13 nt, Human
aguuuccucaggc

SEQ ID NO: 2108966 - RNA, 17 nt, Human
aguuuccccaccaguga

SEQ ID NO: 2108967 - RNA, 23 nt, Human
aguuuccccaccagugaaugaaa

SEQ ID NO: 2108968 - RNA, 22 nt, Human
aguuuccccaccagugaaugaa

SEQ ID NO: 2108969 - RNA, 22 nt, Human
aguuuccguuuccagguguuua

SEQ ID NO: 2108970 - RNA, 23 nt, Human
aguuuccguuuccagguguuuau

SEQ ID NO: 2108971 - RNA, 15 nt, Human
aguuuccuaaaaguu

SEQ ID NO: 2108972 - RNA, 17 nt, Human
aguuuccuaaaaguuca

SEQ ID NO: 2108973 - RNA, 13 nt, Human
aguuucauuuaug

SEQ ID NO: 2108974 - RNA, 21 nt, Human
aguuucauuuaugauacaaaa

SEQ ID NO: 2108975 - RNA, 15 nt, Human
aguuuccaagcaaau

SEQ ID NO: 2108976 - RNA, 17 nt, Human
aguuuccaagcaaaugu

SEQ ID NO: 2108977 - RNA, 18 nt, Human
aguuuccaagcaaauguu

SEQ ID NO: 2108978 - RNA, 19 nt, Human
aguuuccaagcaaauguua

SEQ ID NO: 2108979 - RNA, 20 nt, Human
aguuuccaagcaaauguuac

SEQ ID NO: 2108980 - RNA, 22 nt, Human
aguuuccaagcaaauguuacau

SEQ ID NO: 2108981 - RNA, 17 nt, Human
aguuuccucaggcugcu

SEQ ID NO: 2108982 - RNA, 21 nt, Human
uuaauugacuuauuuauauaa

SEQ ID NO: 2108983 - RNA, 14 nt, Human
uuaauugaaggaaa

SEQ ID NO: 2108984 - RNA, 15 nt, Human
uuaauugaaggaaag

SEQ ID NO: 2108985 - RNA, 19 nt, Human
uuaaugaaagacuguacaa

SEQ ID NO: 2108986 - RNA, 14 nt, Human
uuaaugaaaauguc

SEQ ID NO: 2108987 - RNA, 15 nt, Human
uuaaugaaaauguca

SEQ ID NO: 2108988 - RNA, 16 nt, Human
uuaaugaaaaugucag

SEQ ID NO: 2108989 - RNA, 18 nt, Human
uuaaugaaagacuguaca

SEQ ID NO: 2108990 - RNA, 22 nt, Human
uuaaucugguuuauuuuuguuc

SEQ ID NO: 2108991 - RNA, 12 nt, Human
uuaauauuugcu

SEQ ID NO: 2108992 - RNA, 19 nt, Human
uuaauauuugcugacagcu

SEQ ID NO: 2108993 - RNA, 20 nt, Human
uuaauauuugcugacagcug

SEQ ID NO: 2108994 - RNA, 16 nt, Human
uuaagaacacaaagcg

SEQ ID NO: 2108995 - RNA, 20 nt, Human
auaaaauaucauucagcaac

SEQ ID NO: 2108996 - RNA, 12 nt, Human
uuaagaaacacu

SEQ ID NO: 2108997 - RNA, 14 nt, Human
uuaagaaacacuga

SEQ ID NO: 2108998 - RNA, 22 nt, Human
uuaagaaagacuaucuaaaugu

SEQ ID NO: 2108999 - RNA, 21 nt, Human
uuaagggauggaaaaggaaga

SEQ ID NO: 2109000 - RNA, 16 nt, Human
uuaaggucucucuuug

SEQ ID NO: 2109001 - RNA, 17 nt, Human
uuaaggucucucuuugg

SEQ ID NO: 2109002 - RNA, 19 nt, Human
uuaagucuaaauauuuccu

SEQ ID NO: 2109003 - RNA, 17 nt, Human
uuaaguauuuauauauu

SEQ ID NO: 2109004 - RNA, 19 nt, Human
uuaaguauuuauauauuua

SEQ ID NO: 2109005 - RNA, 15 nt, Human
uuaaguauucaagaa

SEQ ID NO: 2109006 - RNA, 11 nt, Human
uuaaguauuua

SEQ ID NO: 2109007 - RNA, 16 nt, Human
uuaaguauuuauauau

SEQ ID NO: 2109008 - RNA, 18 nt, Human
aguuuaauugacuuauuu

SEQ ID NO: 2109009 - RNA, 14 nt, Human
aguuuaauugacuu

SEQ ID NO: 2109010 - RNA, 15 nt, Human
aguuuaauugacuua

SEQ ID NO: 2109011 - RNA, 13 nt, Human
uuaaaaaaaaucc

SEQ ID NO: 2109012 - RNA, 19 nt, Human
uuaaaaaaaauccuucuaa

SEQ ID NO: 2109013 - RNA, 20 nt, Human
uuaaaaaaaauccuucuaau

SEQ ID NO: 2109014 - RNA, 12 nt, Human
uuaaaaaaaaua

SEQ ID NO: 2109015 - RNA, 13 nt, Human
uuaaaaaaaauaa

SEQ ID NO: 2109016 - RNA, 14 nt, Human
uuaaaaaaaauaau

SEQ ID NO: 2109017 - RNA, 17 nt, Human
uuaaaaaaaauaauaaa

SEQ ID NO: 2109018 - RNA, 18 nt, Human
uuaaaaaaaauaauaaau

SEQ ID NO: 2109019 - RNA, 19 nt, Human
uuaaaaaaaauaauaaauu

SEQ ID NO: 2109020 - RNA, 14 nt, Human
uuaaaaaaaugaca

SEQ ID NO: 2109021 - RNA, 12 nt, Human
aguuuaaagcaa

SEQ ID NO: 2109022 - RNA, 13 nt, Human
aguuuaaaaugua

SEQ ID NO: 2109023 - RNA, 14 nt, Human
aguuuaaaauguau

SEQ ID NO: 2109024 - RNA, 15 nt, Human
aguuuaaaauguaua

SEQ ID NO: 2109025 - RNA, 17 nt, Human
aguugguaagcuuccag

SEQ ID NO: 2109026 - RNA, 22 nt, Human
aguugguaagcuuccaggaaaa

SEQ ID NO: 2109027 - RNA, 20 nt, Human
aguuggacagcaaaaccauu

SEQ ID NO: 2109028 - RNA, 14 nt, Human
aguugcugucauaa

SEQ ID NO: 2109029 - RNA, 19 nt, Human
aguuggagugaguguggcu

SEQ ID NO: 2109030 - RNA, 13 nt, Human
aguuggacugggu

SEQ ID NO: 2109031 - RNA, 17 nt, Human
aguuggacuggguugcg

SEQ ID NO: 2109032 - RNA, 13 nt, Human
aguugggcuuccu

SEQ ID NO: 2109033 - RNA, 19 nt, Human
aguugggcuuccucauagu

SEQ ID NO: 2109034 - RNA, 16 nt, Human
uguuucaaaauaaaaa

SEQ ID NO: 2109035 - RNA, 22 nt, Human
uuaaacaaauguaugauuacau

SEQ ID NO: 2109036 - RNA, 16 nt, Human
uuaaacaauuuauuuu

SEQ ID NO: 2109037 - RNA, 18 nt, Human
uuaaacaauuuauuuuau

SEQ ID NO: 2109038 - RNA, 13 nt, Human
uuaaaguauauau

SEQ ID NO: 2109039 - RNA, 16 nt, Human
uuaaaguauauauuua

SEQ ID NO: 2109040 - RNA, 13 nt, Human
uuaaacauugaag

SEQ ID NO: 2109041 - RNA, 15 nt, Human
uuaaacauugaagua

SEQ ID NO: 2109042 - RNA, 18 nt, Human
uuaaaguguauuauaaca

SEQ ID NO: 2109043 - RNA, 19 nt, Human
uuaaaguguauuauaacag

SEQ ID NO: 2109044 - RNA, 20 nt, Human
uuaaaguguauuauaacagu

SEQ ID NO: 2109045 - RNA, 18 nt, Human
uuaaagucagguccaauu

SEQ ID NO: 2109046 - RNA, 19 nt, Human
uuaaauagaguauaugcac

SEQ ID NO: 2109047 - RNA, 18 nt, Human
uuaacaauaacuacugug

SEQ ID NO: 2109048 - RNA, 19 nt, Human
uuaacaauaacuacugugu

SEQ ID NO: 2109049 - RNA, 20 nt, Human
uuaacaauaacuacuguguu

SEQ ID NO: 2109050 - RNA, 21 nt, Human
uuaacaauaacuacuguguuc

SEQ ID NO: 2109051 - RNA, 23 nt, Human
uuaacaauaacuacuguguuccu

SEQ ID NO: 2109052 - RNA, 18 nt, Human
uuaacaaugcgaauggua

SEQ ID NO: 2109053 - RNA, 21 nt, Human
uuaacaaugucuuguaagcaa

SEQ ID NO: 2109054 - RNA, 14 nt, Human
uuaacagagacaga

SEQ ID NO: 2109055 - RNA, 16 nt, Human
uuaacaauuccaaagg

SEQ ID NO: 2109056 - RNA, 14 nt, Human
uuaacacacauaaa

SEQ ID NO: 2109057 - RNA, 16 nt, Human
uuaacacacauaaagg

SEQ ID NO: 2109058 - RNA, 18 nt, Human
uuaacacacauaaaggau

SEQ ID NO: 2109059 - RNA, 18 nt, Human
auaaucucuccauucccg

SEQ ID NO: 2109060 - RNA, 22 nt, Human
auaaucggcccacagcucccac

SEQ ID NO: 2109061 - RNA, 20 nt, Human
auaaucuggacuccucuguc

SEQ ID NO: 2109062 - RNA, 19 nt, Human
auaaucuggacuccucugu

SEQ ID NO: 2109063 - RNA, 18 nt, Human
auaaucuggacuccucug

SEQ ID NO: 2109064 - RNA, 13 nt, Human
uuagaaaugcaaa

SEQ ID NO: 2109065 - RNA, 15 nt, Human
auaaugaaugaaaca

SEQ ID NO: 2109066 - RNA, 14 nt, Human
auaauucuuugauu

SEQ ID NO: 2109067 - RNA, 16 nt, Human
auaauucuuugauuau

SEQ ID NO: 2109068 - RNA, 22 nt, Human
auaauugacaggauuauuggaa

SEQ ID NO: 2109069 - RNA, 14 nt, Human
auaauucuuguaua

SEQ ID NO: 2109070 - RNA, 19 nt, Human
auaauucuuguauauuaug

SEQ ID NO: 2109071 - RNA, 12 nt, Human
auaauaaaguau

SEQ ID NO: 2109072 - RNA, 13 nt, Human
auaauaaaguauu

SEQ ID NO: 2109073 - RNA, 22 nt, Human
auaauaaaguauuccaccuuaa

SEQ ID NO: 2109074 - RNA, 23 nt, Human
auaauaaaguauuccaccuuaaa

SEQ ID NO: 2109075 - RNA, 20 nt, Human
auaagagagaacaacuacug

SEQ ID NO: 2109076 - RNA, 19 nt, Human
auaagagagccuugguuca

SEQ ID NO: 2109077 - RNA, 14 nt, Human
auaauaaacugucc

SEQ ID NO: 2109078 - RNA, 12 nt, Human
auaauaaacuuu

SEQ ID NO: 2109079 - RNA, 19 nt, Human
auaauaaacuuuuuugaaa

SEQ ID NO: 2109080 - RNA, 16 nt, Human
auaagaaugcugguuu

SEQ ID NO: 2109081 - RNA, 19 nt, Human
auaagaaugcugguuuucc

SEQ ID NO: 2109082 - RNA, 22 nt, Human
auaagaaugcugguuuuccuaa

SEQ ID NO: 2109083 - RNA, 21 nt, Human
auaagaaugcugguuuuccua

SEQ ID NO: 2109084 - RNA, 23 nt, Human
uuagacagucaaggaguggcuua

SEQ ID NO: 2109085 - RNA, 12 nt, Human
auaauagaagaa

SEQ ID NO: 2109086 - RNA, 13 nt, Human
auaauagaagaac

SEQ ID NO: 2109087 - RNA, 14 nt, Human
uuagcggagacgga

SEQ ID NO: 2109088 - RNA, 20 nt, Human
uuagccuguggcaguaaaga

SEQ ID NO: 2109089 - RNA, 22 nt, Human
uuagccuguggcaguaaagaga

SEQ ID NO: 2109090 - RNA, 21 nt, Human
uuagcaugacaagccccaggc

SEQ ID NO: 2109091 - RNA, 22 nt, Human
uuagcaugacaagccccaggca

SEQ ID NO: 2109092 - RNA, 24 nt, Human
uuagcaugacaagccccaggcagg

SEQ ID NO: 2109093 - RNA, 18 nt, Human
uuagccaagugugguaga

SEQ ID NO: 2109094 - RNA, 19 nt, Human
uuagccagguaaugugaau

SEQ ID NO: 2109095 - RNA, 15 nt, Human
uuagcaugcacaaag

SEQ ID NO: 2109096 - RNA, 17 nt, Human
uuagcauguguugaaaa

SEQ ID NO: 2109097 - RNA, 22 nt, Human
uuagcauuuaguccaaugucuu

SEQ ID NO: 2109098 - RNA, 13 nt, Human
uuagccacaaaau

SEQ ID NO: 2109099 - RNA, 14 nt, Human
auaauuguuuuuua

SEQ ID NO: 2109100 - RNA, 18 nt, Human
auaauuguuuuuuaucuu

SEQ ID NO: 2109101 - RNA, 19 nt, Human
auaauuguuuuuuaucuuu

SEQ ID NO: 2109102 - RNA, 21 nt, Human
auaauuguuuuuuaucuuuuc

SEQ ID NO: 2109103 - RNA, 23 nt, Human
auaauuguuuuuuaucuuuucua

SEQ ID NO: 2109104 - RNA, 15 nt, Human
auaauuuaaugcaug

SEQ ID NO: 2109105 - RNA, 20 nt, Human
uuagcaaagaguuaauauau

SEQ ID NO: 2109106 - RNA, 13 nt, Human
uuagcaaagaguu

SEQ ID NO: 2109107 - RNA, 19 nt, Human
uuagcaaagaguuaauaua

SEQ ID NO: 2109108 - RNA, 17 nt, Human
uuagcacaaaaaaaauu

SEQ ID NO: 2109109 - RNA, 18 nt, Human
uuagcaaauucuguuuuu

SEQ ID NO: 2109110 - RNA, 13 nt, Human
uuagggaagagaa

SEQ ID NO: 2109111 - RNA, 14 nt, Human
uuagggaagagaaa

SEQ ID NO: 2109112 - RNA, 16 nt, Human
uuagggaagagaaaca

SEQ ID NO: 2109113 - RNA, 17 nt, Human
uuagggaagagaaacag

SEQ ID NO: 2109114 - RNA, 18 nt, Human
uuagggaagagaaacagg

SEQ ID NO: 2109115 - RNA, 14 nt, Human
uuaguuucuuuggg

SEQ ID NO: 2109116 - RNA, 22 nt, Human
uuaguuugcaguuacacuaaaa

SEQ ID NO: 2109117 - RNA, 22 nt, Human
uuaguuuguaugccaagugaga

SEQ ID NO: 2109118 - RNA, 15 nt, Human
uuaguaaagaaauga

SEQ ID NO: 2109119 - RNA, 14 nt, Human
uuaguaaagaaaug

SEQ ID NO: 2109120 - RNA, 16 nt, Human
uuagguuuuguacaau

SEQ ID NO: 2109121 - RNA, 19 nt, Human
uuagguuuuuuuguauagu

SEQ ID NO: 2109122 - RNA, 14 nt, Human
uuagguuuaacaua

SEQ ID NO: 2109123 - RNA, 14 nt, Human
uuagguuuuguaca

SEQ ID NO: 2109124 - RNA, 22 nt, Human
uuagguuuuguacaauugaacu

SEQ ID NO: 2109125 - RNA, 14 nt, Human
auaaauagcuauau

SEQ ID NO: 2109126 - RNA, 15 nt, Human
auaaauagcuauauc

SEQ ID NO: 2109127 - RNA, 21 nt, Human
auaaauagcuauauccaugua

SEQ ID NO: 2109128 - RNA, 20 nt, Human
auaaauauuuauguagaugu

SEQ ID NO: 2109129 - RNA, 14 nt, Human
auaaauauuuaugu

SEQ ID NO: 2109130 - RNA, 14 nt, Human
auaaaucaauguca

SEQ ID NO: 2109131 - RNA, 16 nt, Human
auaaagguugacaaua

SEQ ID NO: 2109132 - RNA, 21 nt, Human
auaaagguugacaauaaaugu

SEQ ID NO: 2109133 - RNA, 22 nt, Human
auaaagguugacaauaaaugug

SEQ ID NO: 2109134 - RNA, 20 nt, Human
uuaauugugaauugauaaua

SEQ ID NO: 2109135 - RNA, 22 nt, Human
uuaauugugaauugauaauaaa

SEQ ID NO: 2109136 - RNA, 12 nt, Human
uuaauuguaaac

SEQ ID NO: 2109137 - RNA, 14 nt, Human
uuaauuguaaacug

SEQ ID NO: 2109138 - RNA, 15 nt, Human
uuaauuguaaacugu

SEQ ID NO: 2109139 - RNA, 18 nt, Human
uuaauuguaaacuguacu

SEQ ID NO: 2109140 - RNA, 16 nt, Human
auaaagguuauuuucu

SEQ ID NO: 2109141 - RNA, 19 nt, Human
auaaagguuauuuucuccu

SEQ ID NO: 2109142 - RNA, 20 nt, Human
auaaagguuauuuucuccug

SEQ ID NO: 2109143 - RNA, 20 nt, Human
auaaaggugguaugugugug

SEQ ID NO: 2109144 - RNA, 21 nt, Human
auaaaggugguaugugugugu

SEQ ID NO: 2109145 - RNA, 19 nt, Human
auaaaggugguaugugugu

SEQ ID NO: 2109146 - RNA, 14 nt, Human
auaacgaaguuggg

SEQ ID NO: 2109147 - RNA, 17 nt, Human
auaacgaaguugggcaa

SEQ ID NO: 2109148 - RNA, 12 nt, Human
auaacuuaaaaa

SEQ ID NO: 2109149 - RNA, 16 nt, Human
auaacuuaaaaaaaug

SEQ ID NO: 2109150 - RNA, 19 nt, Human
auaacuuaaaaaaaugaca

SEQ ID NO: 2109151 - RNA, 15 nt, Human
auaaaucaaugucac

SEQ ID NO: 2109152 - RNA, 11 nt, Human
auaaauuauuu

SEQ ID NO: 2109153 - RNA, 22 nt, Human
auaaauucagauauauuuuuca

SEQ ID NO: 2109154 - RNA, 12 nt, Human
auaaauucagau

SEQ ID NO: 2109155 - RNA, 13 nt, Human
auaaauucagaua

SEQ ID NO: 2109156 - RNA, 16 nt, Human
auaaauucagauauau

SEQ ID NO: 2109157 - RNA, 15 nt, Human
auaaauuccacugga

SEQ ID NO: 2109158 - RNA, 20 nt, Human
auaaccccagcucccuagga

SEQ ID NO: 2109159 - RNA, 16 nt, Human
auaaccccauucuuug

SEQ ID NO: 2109160 - RNA, 18 nt, Human
auaaccccauucuuugcu

SEQ ID NO: 2109161 - RNA, 15 nt, Human
uuacaggcaccgaga

SEQ ID NO: 2109162 - RNA, 17 nt, Human
uuacaggcaccgagaau

SEQ ID NO: 2109163 - RNA, 12 nt, Human
auaacuuaaaau

SEQ ID NO: 2109164 - RNA, 16 nt, Human
auaacuuaaaauauuu

SEQ ID NO: 2109165 - RNA, 18 nt, Human
uuacaggcaccgagaaug

SEQ ID NO: 2109166 - RNA, 24 nt, Human
uuacaggcaccgagaauguuguau

SEQ ID NO: 2109167 - RNA, 14 nt, Human
uuaccccucuacca

SEQ ID NO: 2109168 - RNA, 14 nt, Human
uuaccccuuagccu

SEQ ID NO: 2109169 - RNA, 16 nt, Human
uuacccagaaugucag

SEQ ID NO: 2109170 - RNA, 14 nt, Human
uuaccuucaauaaa

SEQ ID NO: 2109171 - RNA, 15 nt, Human
uuaccuucaauaaag

SEQ ID NO: 2109172 - RNA, 16 nt, Human
uuaccuucaauaaagu

SEQ ID NO: 2109173 - RNA, 17 nt, Human
uuaccuucaauaaagua

SEQ ID NO: 2109174 - RNA, 18 nt, Human
uuaccuucaauaaaguau

SEQ ID NO: 2109175 - RNA, 19 nt, Human
uuaccuucaauaaaguauc

SEQ ID NO: 2109176 - RNA, 19 nt, Human
uuaccuccugcccaggaga

SEQ ID NO: 2109177 - RNA, 12 nt, Human
uuaccuccugcc

SEQ ID NO: 2109178 - RNA, 13 nt, Human
uuaccuccugccc

SEQ ID NO: 2109179 - RNA, 14 nt, Human
uuaccuccugccca

SEQ ID NO: 2109180 - RNA, 15 nt, Human
uuaccuccugcccag

SEQ ID NO: 2109181 - RNA, 20 nt, Human
uuaccuaguagucauuucau

SEQ ID NO: 2109182 - RNA, 22 nt, Human
uuacccucaggcauaggccugg

SEQ ID NO: 2109183 - RNA, 16 nt, Human
uuaccccuuagccucc

SEQ ID NO: 2109184 - RNA, 16 nt, Human
uuaccuaccacagugu

SEQ ID NO: 2109185 - RNA, 17 nt, Human
uuaccuaccacaguguc

SEQ ID NO: 2109186 - RNA, 18 nt, Human
uuaccuaccacagugucu

SEQ ID NO: 2109187 - RNA, 21 nt, Human
uuaccuaccacagugucugua

SEQ ID NO: 2109188 - RNA, 17 nt, Human
uuagaaauugcauuucc

SEQ ID NO: 2109189 - RNA, 12 nt, Human
uuagaacacuau

SEQ ID NO: 2109190 - RNA, 13 nt, Human
uuagaacacuauu

SEQ ID NO: 2109191 - RNA, 14 nt, Human
uuagaacacuauuu

SEQ ID NO: 2109192 - RNA, 17 nt, Human
uuagaacacuauuuuca

SEQ ID NO: 2109193 - RNA, 19 nt, Human
uuagaacacuauuuucaga

SEQ ID NO: 2109194 - RNA, 20 nt, Human
uuagaacacuauuuucagaa

SEQ ID NO: 2109195 - RNA, 21 nt, Human
uuagaacacuauuuucagaau

SEQ ID NO: 2109196 - RNA, 18 nt, Human
uuagaaaugaccaauauu

SEQ ID NO: 2109197 - RNA, 17 nt, Human
uuagaaaugaccaauau

SEQ ID NO: 2109198 - RNA, 20 nt, Human
uuagacagagucucacuguu

SEQ ID NO: 2109199 - RNA, 13 nt, Human
uuagacagagucu

SEQ ID NO: 2109200 - RNA, 15 nt, Human
uuagaacagaaaaca

SEQ ID NO: 2109201 - RNA, 16 nt, Human
uuagaacagaaaacaa

SEQ ID NO: 2109202 - RNA, 17 nt, Human
uuagaacagaaaacaac

SEQ ID NO: 2109203 - RNA, 22 nt, Human
uuagaacagaaaacaacaaaaa

SEQ ID NO: 2109204 - RNA, 16 nt, Human
uuacucuccaaccugg

SEQ ID NO: 2109205 - RNA, 22 nt, Human
uuacucugaagggcaucaugca

SEQ ID NO: 2109206 - RNA, 19 nt, Human
uuacucuccaaccuggaca

SEQ ID NO: 2109207 - RNA, 13 nt, Human
uuacucugaaggg

SEQ ID NO: 2109208 - RNA, 14 nt, Human
uuacucuuguaaga

SEQ ID NO: 2109209 - RNA, 16 nt, Human
uuacucuuguaagauu

SEQ ID NO: 2109210 - RNA, 17 nt, Human
uuacucuuguaagauuu

SEQ ID NO: 2109211 - RNA, 18 nt, Human
uuacucuuguaagauuuu

SEQ ID NO: 2109212 - RNA, 21 nt, Human
uuacucuuguaagauuuugaa

SEQ ID NO: 2109213 - RNA, 22 nt, Human
uuacucuuguaagauuuugaaa

SEQ ID NO: 2109214 - RNA, 23 nt, Human
uuacucuuguaagauuuugaaaa

SEQ ID NO: 2109215 - RNA, 18 nt, Human
uuacugaagguaaaauug

SEQ ID NO: 2109216 - RNA, 19 nt, Human
uuacugaagguaaaauuga

SEQ ID NO: 2109217 - RNA, 20 nt, Human
uuacugaagguaaaauugaa

SEQ ID NO: 2109218 - RNA, 19 nt, Human
uuagaaacuuaucuuacaa

SEQ ID NO: 2109219 - RNA, 22 nt, Human
uuagaaagaagcccaauauuau

SEQ ID NO: 2109220 - RNA, 15 nt, Human
uuugcuucaaaaaca

SEQ ID NO: 2109221 - RNA, 15 nt, Human
uuugcuuauuguucc

SEQ ID NO: 2109222 - RNA, 16 nt, Human
uuugcuuauuguucca

SEQ ID NO: 2109223 - RNA, 17 nt, Human
uuugcuuauuguuccaa

SEQ ID NO: 2109224 - RNA, 19 nt, Human
uuugcuuauuguuccaaga

SEQ ID NO: 2109225 - RNA, 12 nt, Human
uuuggcccccga

SEQ ID NO: 2109226 - RNA, 20 nt, Human
uuuggcccccgagcuggggg

SEQ ID NO: 2109227 - RNA, 21 nt, Human
uuuggcccccgagcugggggc

SEQ ID NO: 2109228 - RNA, 13 nt, Human
uuugcuguagaag

SEQ ID NO: 2109229 - RNA, 21 nt, Human
uuugcuguagaagauggcacu

SEQ ID NO: 2109230 - RNA, 18 nt, Human
uuugcucagcuucuccaa

SEQ ID NO: 2109231 - RNA, 22 nt, Human
uuugggaggccaaggugggagg

SEQ ID NO: 2109232 - RNA, 17 nt, Human
uuugggaggcugaggcg

SEQ ID NO: 2109233 - RNA, 20 nt, Human
uuuggggagcagagacacua

SEQ ID NO: 2109234 - RNA, 17 nt, Human
uuuggccugcacuaauu

SEQ ID NO: 2109235 - RNA, 16 nt, Human
uuuggcuaguccuugu

SEQ ID NO: 2109236 - RNA, 14 nt, Human
uuuggcgggccaag

SEQ ID NO: 2109237 - RNA, 17 nt, Human
uuuggcgggccaaggac

SEQ ID NO: 2109238 - RNA, 19 nt, Human
uuuggcgggccaaggacug

SEQ ID NO: 2109239 - RNA, 22 nt, Human
uuugccauguuggccaggcugg

SEQ ID NO: 2109240 - RNA, 16 nt, Human
uuugcccaaccucagc

SEQ ID NO: 2109241 - RNA, 17 nt, Human
uuugcccaaccucagca

SEQ ID NO: 2109242 - RNA, 15 nt, Human
uuugcccauuuacac

SEQ ID NO: 2109243 - RNA, 18 nt, Human
uuugcccauuuacacuuu

SEQ ID NO: 2109244 - RNA, 19 nt, Human
uuugcccauuuacacuuuu

SEQ ID NO: 2109245 - RNA, 19 nt, Human
uuugcccugguuucacugg

SEQ ID NO: 2109246 - RNA, 13 nt, Human
uuugcuauugaca

SEQ ID NO: 2109247 - RNA, 20 nt, Human
uuugcuauugacaagucauu

SEQ ID NO: 2109248 - RNA, 23 nt, Human
uuugcuauugacaagucauuuua

SEQ ID NO: 2109249 - RNA, 16 nt, Human
uuugcucaccuggggu

SEQ ID NO: 2109250 - RNA, 17 nt, Human
uuugcucagaacacauu

SEQ ID NO: 2109251 - RNA, 19 nt, Human
uuugcucagaacacauucu

SEQ ID NO: 2109252 - RNA, 22 nt, Human
uuugggggaaaauuuagaaaua

SEQ ID NO: 2109253 - RNA, 15 nt, Human
auguaucaaugagua

SEQ ID NO: 2109254 - RNA, 17 nt, Human
auguauaaagaacaagg

SEQ ID NO: 2109255 - RNA, 15 nt, Human
auguauccaguacau

SEQ ID NO: 2109256 - RNA, 17 nt, Human
auguauccaguacauuu

SEQ ID NO: 2109257 - RNA, 20 nt, Human
auguauccaugggggcaggg

SEQ ID NO: 2109258 - RNA, 21 nt, Human
auguaucaggaaauauauaug

SEQ ID NO: 2109259 - RNA, 13 nt, Human
auguaucaggaaa

SEQ ID NO: 2109260 - RNA, 15 nt, Human
auguaucugagcagg

SEQ ID NO: 2109261 - RNA, 18 nt, Human
auguauggaauacagugu

SEQ ID NO: 2109262 - RNA, 20 nt, Human
auguauggaauacaguguua

SEQ ID NO: 2109263 - RNA, 21 nt, Human
auguauggaauacaguguuau

SEQ ID NO: 2109264 - RNA, 12 nt, Human
auguauguaaaa

SEQ ID NO: 2109265 - RNA, 13 nt, Human
auguauguaaaaa

SEQ ID NO: 2109266 - RNA, 14 nt, Human
auguauguaaaaau

SEQ ID NO: 2109267 - RNA, 15 nt, Human
auguauguaaaaaug

SEQ ID NO: 2109268 - RNA, 12 nt, Human
auguauguguaa

SEQ ID NO: 2109269 - RNA, 15 nt, Human
augucaggaacagaa

SEQ ID NO: 2109270 - RNA, 17 nt, Human
augucaggaacagaagg

SEQ ID NO: 2109271 - RNA, 19 nt, Human
augucaggaacagaaggau

SEQ ID NO: 2109272 - RNA, 20 nt, Human
augucaggaacagaaggaug

SEQ ID NO: 2109273 - RNA, 19 nt, Human
auguccauaucuaaccagu

SEQ ID NO: 2109274 - RNA, 17 nt, Human
augucccauuuucagac

SEQ ID NO: 2109275 - RNA, 21 nt, Human
augucccuacaccccuccccu

SEQ ID NO: 2109276 - RNA, 24 nt, Human
augucccuaccgagucucuucucc

SEQ ID NO: 2109277 - RNA, 20 nt, Human
augucccaacuuguaaaaau

SEQ ID NO: 2109278 - RNA, 14 nt, Human
augucccuugcugu

SEQ ID NO: 2109279 - RNA, 20 nt, Human
augucucaauaguaaaagau

SEQ ID NO: 2109280 - RNA, 16 nt, Human
auguccacagaugccu

SEQ ID NO: 2109281 - RNA, 20 nt, Human
auguccacagaugccuccac

SEQ ID NO: 2109282 - RNA, 21 nt, Human
uuuuaacaauaacuacugugu

SEQ ID NO: 2109283 - RNA, 22 nt, Human
uuuuaacaauaacuacuguguu

SEQ ID NO: 2109284 - RNA, 18 nt, Human
uuuuaacacacauaaagg

SEQ ID NO: 2109285 - RNA, 19 nt, Human
uuuuaacacacauaaagga

SEQ ID NO: 2109286 - RNA, 22 nt, Human
uuuuaaaacacuuccauaaucu

SEQ ID NO: 2109287 - RNA, 16 nt, Human
uuuuaaaacacuucca

SEQ ID NO: 2109288 - RNA, 22 nt, Human
uuuuaaaacaagaaaguuuccc

SEQ ID NO: 2109289 - RNA, 15 nt, Human
uuuuaaaaaucauaa

SEQ ID NO: 2109290 - RNA, 22 nt, Human
uuuuaaaaaucauaaacugugu

SEQ ID NO: 2109291 - RNA, 23 nt, Human
uuuuaaaaaucauaaacugugug

SEQ ID NO: 2109292 - RNA, 14 nt, Human
uuuuaaaaagcaaa

SEQ ID NO: 2109293 - RNA, 13 nt, Human
uuuguuugugcau

SEQ ID NO: 2109294 - RNA, 15 nt, Human
uuuuaagaggcaggg

SEQ ID NO: 2109295 - RNA, 16 nt, Human
uuuuaagaggcagggu

SEQ ID NO: 2109296 - RNA, 22 nt, Human
uuuuaagauaaauuauaaguua

SEQ ID NO: 2109297 - RNA, 13 nt, Human
uuuuaacauggaa

SEQ ID NO: 2109298 - RNA, 12 nt, Human
uuuuaacucacc

SEQ ID NO: 2109299 - RNA, 12 nt, Human
uuuuaacuagaa

SEQ ID NO: 2109300 - RNA, 16 nt, Human
uuuuaacuagaauuua

SEQ ID NO: 2109301 - RNA, 13 nt, Human
uuuuaacucaaua

SEQ ID NO: 2109302 - RNA, 23 nt, Human
uuuuaagcccaucaauuauagaa

SEQ ID NO: 2109303 - RNA, 15 nt, Human
uuuuaagcaaaauau

SEQ ID NO: 2109304 - RNA, 12 nt, Human
uuuuaagcauua

SEQ ID NO: 2109305 - RNA, 16 nt, Human
uuuuaagcauuacucu

SEQ ID NO: 2109306 - RNA, 19 nt, Human
uuuuaagcauuacucuugu

SEQ ID NO: 2109307 - RNA, 22 nt, Human
uuuuaagcauuacucuuguaag

SEQ ID NO: 2109308 - RNA, 23 nt, Human
uuuuaagcauuacucuuguaaga

SEQ ID NO: 2109309 - RNA, 18 nt, Human
uuuuaagauuccuuuucu

SEQ ID NO: 2109310 - RNA, 21 nt, Human
uuuuaagauuccuuuucuugu

SEQ ID NO: 2109311 - RNA, 22 nt, Human
uuuuaagauuccuuuucuuguu

SEQ ID NO: 2109312 - RNA, 20 nt, Human
uuuuaaggguuuguggaaaa

SEQ ID NO: 2109313 - RNA, 12 nt, Human
uuuuaagcuguu

SEQ ID NO: 2109314 - RNA, 23 nt, Human
uuuuaaggguuuguggaaaauga

SEQ ID NO: 2109315 - RNA, 14 nt, Human
uuuuaaggcuucaa

SEQ ID NO: 2109316 - RNA, 17 nt, Human
uuuuaaguauuuauaua

SEQ ID NO: 2109317 - RNA, 18 nt, Human
uuuuaaguauuuauauau

SEQ ID NO: 2109318 - RNA, 17 nt, Human
uuuguaccaugguguga

SEQ ID NO: 2109319 - RNA, 13 nt, Human
uuuguagagccag

SEQ ID NO: 2109320 - RNA, 19 nt, Human
uuuguacauauguaaaaua

SEQ ID NO: 2109321 - RNA, 14 nt, Human
uuuguaccauggug

SEQ ID NO: 2109322 - RNA, 20 nt, Human
augucugcugaauaauaaac

SEQ ID NO: 2109323 - RNA, 22 nt, Human
augucuggagaauaauucuuug

SEQ ID NO: 2109324 - RNA, 18 nt, Human
augucuguagcuccucaa

SEQ ID NO: 2109325 - RNA, 19 nt, Human
augucuguagcuccucaac

SEQ ID NO: 2109326 - RNA, 16 nt, Human
augucuguagcuccuc

SEQ ID NO: 2109327 - RNA, 16 nt, Human
augucuguggccuugu

SEQ ID NO: 2109328 - RNA, 21 nt, Human
augucuguggccuuguucucu

SEQ ID NO: 2109329 - RNA, 22 nt, Human
uuugucgauauuuccaucauua

SEQ ID NO: 2109330 - RNA, 17 nt, Human
uuugucuacguuuaguu

SEQ ID NO: 2109331 - RNA, 21 nt, Human
uuugucuacguuuaguuuccg

SEQ ID NO: 2109332 - RNA, 17 nt, Human
uuugucugucuucauag

SEQ ID NO: 2109333 - RNA, 22 nt, Human
uuuguccuuggggacaucucau

SEQ ID NO: 2109334 - RNA, 16 nt, Human
uuuguuucuuccaaag

SEQ ID NO: 2109335 - RNA, 12 nt, Human
uuugugagagcg

SEQ ID NO: 2109336 - RNA, 16 nt, Human
auguuggccaggcugg

SEQ ID NO: 2109337 - RNA, 14 nt, Human
auguuggccaggcu

SEQ ID NO: 2109338 - RNA, 13 nt, Human
auguuggccaggc

SEQ ID NO: 2109339 - RNA, 12 nt, Human
auguugaauauu

SEQ ID NO: 2109340 - RNA, 22 nt, Human
auguugaaugcccacaggcaaa

SEQ ID NO: 2109341 - RNA, 18 nt, Human
auguugagccaggccugg

SEQ ID NO: 2109342 - RNA, 14 nt, Human
auguugagggaaca

SEQ ID NO: 2109343 - RNA, 20 nt, Human
auguugagggaacagacagg

SEQ ID NO: 2109344 - RNA, 20 nt, Human
uuuuagcaguucugcaaaua

SEQ ID NO: 2109345 - RNA, 11 nt, Human
uuuuagcaugu

SEQ ID NO: 2109346 - RNA, 21 nt, Human
uuuuagcaauuuauacaauau

SEQ ID NO: 2109347 - RNA, 22 nt, Human
uuuuagcauguguuugguucug

SEQ ID NO: 2109348 - RNA, 19 nt, Human
uuuuagccuaguucaucca

SEQ ID NO: 2109349 - RNA, 19 nt, Human
uuuuagaugguuacacugu

SEQ ID NO: 2109350 - RNA, 13 nt, Human
uuuuaguuuuagu

SEQ ID NO: 2109351 - RNA, 21 nt, Human
uuuuaaguuacacauuuuuca

SEQ ID NO: 2109352 - RNA, 22 nt, Human
uuuuaaguuacacauuuuucag

SEQ ID NO: 2109353 - RNA, 17 nt, Human
uuuuaaggaagaaaaau

SEQ ID NO: 2109354 - RNA, 14 nt, Human
auguuauagugaau

SEQ ID NO: 2109355 - RNA, 15 nt, Human
auguuauagugaauu

SEQ ID NO: 2109356 - RNA, 17 nt, Human
uuuuaagugcuuuguaa

SEQ ID NO: 2109357 - RNA, 19 nt, Human
uuuuaagugcuuuguaaug

SEQ ID NO: 2109358 - RNA, 19 nt, Human
uuuuaaguauuuauauauu

SEQ ID NO: 2109359 - RNA, 21 nt, Human
auguucaucauccuaagcuau

SEQ ID NO: 2109360 - RNA, 14 nt, Human
auguucauuguaau

SEQ ID NO: 2109361 - RNA, 21 nt, Human
auguucauuguaauguuacug

SEQ ID NO: 2109362 - RNA, 22 nt, Human
auguucauuguaauguuacuga

SEQ ID NO: 2109363 - RNA, 23 nt, Human
auguucauuguaauguuacugau

SEQ ID NO: 2109364 - RNA, 22 nt, Human
uuuucagauauaaaagacugac

SEQ ID NO: 2109365 - RNA, 19 nt, Human
uuuucagauauaaaagacu

SEQ ID NO: 2109366 - RNA, 21 nt, Human
uuuucagauauaaaagacuga

SEQ ID NO: 2109367 - RNA, 17 nt, Human
uuuucagauauaaaaga

SEQ ID NO: 2109368 - RNA, 14 nt, Human
uuuuauucaaggua

SEQ ID NO: 2109369 - RNA, 23 nt, Human
uuuuauucaagguaaaauucuaa

SEQ ID NO: 2109370 - RNA, 19 nt, Human
uuuuccagguuuaagcugu

SEQ ID NO: 2109371 - RNA, 11 nt, Human
uuuuccaugaa

SEQ ID NO: 2109372 - RNA, 14 nt, Human
uuuuccaugaaaac

SEQ ID NO: 2109373 - RNA, 16 nt, Human
uuuuccaugaaaacgu

SEQ ID NO: 2109374 - RNA, 18 nt, Human
uuuuccaugaaaaugcaa

SEQ ID NO: 2109375 - RNA, 19 nt, Human
uuuuccaugaaaaugcaac

SEQ ID NO: 2109376 - RNA, 14 nt, Human
uuuucaugugugau

SEQ ID NO: 2109377 - RNA, 20 nt, Human
uuuucauuccaugugcccag

SEQ ID NO: 2109378 - RNA, 21 nt, Human
uuuucauuccaugugcccagu

SEQ ID NO: 2109379 - RNA, 19 nt, Human
uuuuauaaaaaaaaugaaa

SEQ ID NO: 2109380 - RNA, 20 nt, Human
uuuuauaaaaaaaaugaaau

SEQ ID NO: 2109381 - RNA, 21 nt, Human
uuuuauaaaaaaaaugaaaug

SEQ ID NO: 2109382 - RNA, 20 nt, Human
uuuuauaaaauuaaagaaaa

SEQ ID NO: 2109383 - RNA, 21 nt, Human
uuuuauaaaauuaaagaaaau

SEQ ID NO: 2109384 - RNA, 22 nt, Human
uuuuauaaaauuaaagaaaaua

SEQ ID NO: 2109385 - RNA, 20 nt, Human
uuuuauaacuaguccuuuac

SEQ ID NO: 2109386 - RNA, 12 nt, Human
uuuuauaaauua

SEQ ID NO: 2109387 - RNA, 13 nt, Human
uuuuauaaauuaa

SEQ ID NO: 2109388 - RNA, 15 nt, Human
uuuuauaaauuaaau

SEQ ID NO: 2109389 - RNA, 16 nt, Human
uuuuauaaauuaaaua

SEQ ID NO: 2109390 - RNA, 19 nt, Human
uuuuaugccuuuuauuucu

SEQ ID NO: 2109391 - RNA, 12 nt, Human
uuuuauuaugcu

SEQ ID NO: 2109392 - RNA, 21 nt, Human
uuuuauuaugcuguauuuucu

SEQ ID NO: 2109393 - RNA, 18 nt, Human
uuuuaugugagagaaagu

SEQ ID NO: 2109394 - RNA, 22 nt, Human
auguuuacagguggacacacaa

SEQ ID NO: 2109395 - RNA, 13 nt, Human
auguuuauuuaua

SEQ ID NO: 2109396 - RNA, 14 nt, Human
auguugugaagaug

SEQ ID NO: 2109397 - RNA, 16 nt, Human
auguugugguuuguug

SEQ ID NO: 2109398 - RNA, 16 nt, Human
auguuguguucuaaua

SEQ ID NO: 2109399 - RNA, 16 nt, Human
uuuuccaucauaauuc

SEQ ID NO: 2109400 - RNA, 17 nt, Human
auuaaaaaauuuccagu

SEQ ID NO: 2109401 - RNA, 12 nt, Human
auuaaaaaauuu

SEQ ID NO: 2109402 - RNA, 19 nt, Human
auuaaaauaaauaaaugca

SEQ ID NO: 2109403 - RNA, 18 nt, Human
auguuuuucuucucccuc

SEQ ID NO: 2109404 - RNA, 17 nt, Human
auguuuuuguguauuug

SEQ ID NO: 2109405 - RNA, 17 nt, Human
auguuuuucuucucccu

SEQ ID NO: 2109406 - RNA, 18 nt, Human
auguuuucuuugcuuuaa

SEQ ID NO: 2109407 - RNA, 22 nt, Human
auuaacauugggaaaucuuaua

SEQ ID NO: 2109408 - RNA, 18 nt, Human
auuaaccagaaauccagu

SEQ ID NO: 2109409 - RNA, 15 nt, Human
auuaaccauagaugu

SEQ ID NO: 2109410 - RNA, 18 nt, Human
auuaaccacuucagcuga

SEQ ID NO: 2109411 - RNA, 20 nt, Human
auuaaccacuucagcugacu

SEQ ID NO: 2109412 - RNA, 17 nt, Human
auuaaccacuucagcug

SEQ ID NO: 2109413 - RNA, 19 nt, Human
auuaacauugggaaaucuu

SEQ ID NO: 2109414 - RNA, 21 nt, Human
auuaacauugggaaaucuuau

SEQ ID NO: 2109415 - RNA, 17 nt, Human
auuaaagcuaaaguauc

SEQ ID NO: 2109416 - RNA, 18 nt, Human
auuaaagcuaaaguaucu

SEQ ID NO: 2109417 - RNA, 16 nt, Human
auuaaccuggugcugg

SEQ ID NO: 2109418 - RNA, 17 nt, Human
auuaacuaaucuauugg

SEQ ID NO: 2109419 - RNA, 14 nt, Human
auuaaccuggugcu

SEQ ID NO: 2109420 - RNA, 17 nt, Human
auuaaccuggugcugga

SEQ ID NO: 2109421 - RNA, 15 nt, Human
auuaacuuagcaugu

SEQ ID NO: 2109422 - RNA, 13 nt, Human
auuaagaaagacu

SEQ ID NO: 2109423 - RNA, 14 nt, Human
auuaagaaagacua

SEQ ID NO: 2109424 - RNA, 23 nt, Human
auuccaugaauguaucaggaaau

SEQ ID NO: 2109425 - RNA, 17 nt, Human
auuccaugaauguauca

SEQ ID NO: 2109426 - RNA, 18 nt, Human
auuccaugaauguaucag

SEQ ID NO: 2109427 - RNA, 15 nt, Human
auuccaugaauguau

SEQ ID NO: 2109428 - RNA, 16 nt, Human
auuccaugaauguauc

SEQ ID NO: 2109429 - RNA, 12 nt, Human
auuccacuggac

SEQ ID NO: 2109430 - RNA, 16 nt, Human
auuccagaaaggauau

SEQ ID NO: 2109431 - RNA, 15 nt, Human
auuccaugugcccag

SEQ ID NO: 2109432 - RNA, 14 nt, Human
auuccaugugccca

SEQ ID NO: 2109433 - RNA, 16 nt, Human
auuccaugugcccagu

SEQ ID NO: 2109434 - RNA, 11 nt, Human
auucauaauaa

SEQ ID NO: 2109435 - RNA, 14 nt, Human
auuccaccuuaaau

SEQ ID NO: 2109436 - RNA, 16 nt, Human
auuccaccuuaaauua

SEQ ID NO: 2109437 - RNA, 17 nt, Human
auuccaccuuaaauuaa

SEQ ID NO: 2109438 - RNA, 18 nt, Human
auuccaccuuaaauuaaa

SEQ ID NO: 2109439 - RNA, 19 nt, Human
auuccaccuuaaauuaaac

SEQ ID NO: 2109440 - RNA, 20 nt, Human
auuccaccuuaaauuaaaca

SEQ ID NO: 2109441 - RNA, 22 nt, Human
auuccaccuuaaauuaaacaau

SEQ ID NO: 2109442 - RNA, 23 nt, Human
auuccaccuuaaauuaaacaauu

SEQ ID NO: 2109443 - RNA, 19 nt, Human
auucccuguacaauauuua

SEQ ID NO: 2109444 - RNA, 21 nt, Human
auucccuguacaauauuuaaa

SEQ ID NO: 2109445 - RNA, 21 nt, Human
auuccgacaaccgaugcucca

SEQ ID NO: 2109446 - RNA, 22 nt, Human
auuccccacccugaaagcccug

SEQ ID NO: 2109447 - RNA, 20 nt, Human
auuccccagauugcaacagg

SEQ ID NO: 2109448 - RNA, 15 nt, Human
auuccauugugugag

SEQ ID NO: 2109449 - RNA, 16 nt, Human
auuccauugugugagu

SEQ ID NO: 2109450 - RNA, 14 nt, Human
auuccccagccucu

SEQ ID NO: 2109451 - RNA, 20 nt, Human
auuccccagccucucuuccu

SEQ ID NO: 2109452 - RNA, 21 nt, Human
auuccccagccucucuuccua

SEQ ID NO: 2109453 - RNA, 16 nt, Human
auucaaaaguugaaau

SEQ ID NO: 2109454 - RNA, 14 nt, Human
auucagcucugcaa

SEQ ID NO: 2109455 - RNA, 18 nt, Human
auucagcucugcaagaau

SEQ ID NO: 2109456 - RNA, 21 nt, Human
auuauucaguuaagaaaaaaa

SEQ ID NO: 2109457 - RNA, 17 nt, Human
auuauucccuguacaau

SEQ ID NO: 2109458 - RNA, 21 nt, Human
auuauucccuguacaauauuu

SEQ ID NO: 2109459 - RNA, 22 nt, Human
auuauucccuguacaauauuua

SEQ ID NO: 2109460 - RNA, 13 nt, Human
auuauucugcagc

SEQ ID NO: 2109461 - RNA, 15 nt, Human
auuauuuauuaaauu

SEQ ID NO: 2109462 - RNA, 14 nt, Human
auuauuuuaaauua

SEQ ID NO: 2109463 - RNA, 16 nt, Human
auuauuuuaaauuaua

SEQ ID NO: 2109464 - RNA, 17 nt, Human
auuauuuuaaauuauaa

SEQ ID NO: 2109465 - RNA, 18 nt, Human
auuauuuuaaauuauaag

SEQ ID NO: 2109466 - RNA, 20 nt, Human
auuauuuuaaauuauaagga

SEQ ID NO: 2109467 - RNA, 22 nt, Human
auuauuuuaaauuauaaggacu

SEQ ID NO: 2109468 - RNA, 23 nt, Human
auuauuuuaaauuauaaggacug

SEQ ID NO: 2109469 - RNA, 15 nt, Human
auuauuuuaauuagg

SEQ ID NO: 2109470 - RNA, 18 nt, Human
auuauuuuaauuagguua

SEQ ID NO: 2109471 - RNA, 12 nt, Human
auuaucuuaaaa

SEQ ID NO: 2109472 - RNA, 18 nt, Human
auuaucuuuguaauuauu

SEQ ID NO: 2109473 - RNA, 15 nt, Human
auuaucuauuuguau

SEQ ID NO: 2109474 - RNA, 18 nt, Human
auuaucuuggaaagaaac

SEQ ID NO: 2109475 - RNA, 20 nt, Human
auuaucgggagcagugucuu

SEQ ID NO: 2109476 - RNA, 21 nt, Human
auuaucgggagcagugucuuc

SEQ ID NO: 2109477 - RNA, 22 nt, Human
auuaucgggaacaguguuuccc

SEQ ID NO: 2109478 - RNA, 16 nt, Human
auuaucgggagcagug

SEQ ID NO: 2109479 - RNA, 17 nt, Human
auuaucgggagcagugu

SEQ ID NO: 2109480 - RNA, 19 nt, Human
auuaucgggagcagugucu

SEQ ID NO: 2109481 - RNA, 17 nt, Human
auuaucggaagcagugc

SEQ ID NO: 2109482 - RNA, 19 nt, Human
auuaucggaagcagugccu

SEQ ID NO: 2109483 - RNA, 21 nt, Human
auuaucggaagcagugccuuc

SEQ ID NO: 2109484 - RNA, 16 nt, Human
auuaucgggaacagug

SEQ ID NO: 2109485 - RNA, 17 nt, Human
auuaucgggaacagugu

SEQ ID NO: 2109486 - RNA, 18 nt, Human
auuaucgggaacaguguu

SEQ ID NO: 2109487 - RNA, 19 nt, Human
auuaucgggaacaguguuu

SEQ ID NO: 2109488 - RNA, 20 nt, Human
auuaucgggaacaguguuuc

SEQ ID NO: 2109489 - RNA, 23 nt, Human
auuaucaagcuaauaaaauauca

SEQ ID NO: 2109490 - RNA, 15 nt, Human
auuaucaagcuaaua

SEQ ID NO: 2109491 - RNA, 16 nt, Human
auuaucaagcuaauaa

SEQ ID NO: 2109492 - RNA, 17 nt, Human
auuaucaagcuaauaaa

SEQ ID NO: 2109493 - RNA, 22 nt, Human
auuaucaagcuaauaaaauauc

SEQ ID NO: 2109494 - RNA, 18 nt, Human
auuaucgccuuuugacag

SEQ ID NO: 2109495 - RNA, 16 nt, Human
auuaucggaagcagug

SEQ ID NO: 2109496 - RNA, 19 nt, Human
auuaucaauuaccacacca

SEQ ID NO: 2109497 - RNA, 15 nt, Human
auuaucaugcaaaug

SEQ ID NO: 2109498 - RNA, 17 nt, Human
auuaucaugcaaaugcu

SEQ ID NO: 2109499 - RNA, 20 nt, Human
auuauaacuuaaaauauuuu

SEQ ID NO: 2109500 - RNA, 10 nt, Human
auuauaagga

SEQ ID NO: 2109501 - RNA, 12 nt, Human
auuauaaggacu

SEQ ID NO: 2109502 - RNA, 13 nt, Human
auuauaaggacug

SEQ ID NO: 2109503 - RNA, 14 nt, Human
auuauaaggacugc

SEQ ID NO: 2109504 - RNA, 15 nt, Human
auuauaaggacugca

SEQ ID NO: 2109505 - RNA, 16 nt, Human
auuauaaggacugcau

SEQ ID NO: 2109506 - RNA, 17 nt, Human
auuauaaggacugcaug

SEQ ID NO: 2109507 - RNA, 18 nt, Human
auuauaaggacugcaugg

SEQ ID NO: 2109508 - RNA, 21 nt, Human
auuagagcagaugaccccucc

SEQ ID NO: 2109509 - RNA, 14 nt, Human
auuagaaguguuaa

SEQ ID NO: 2109510 - RNA, 18 nt, Human
auuagaaguguuaacuua

SEQ ID NO: 2109511 - RNA, 20 nt, Human
auuagaaguguuaacuuagc

SEQ ID NO: 2109512 - RNA, 15 nt, Human
auuagaaauuagcug

SEQ ID NO: 2109513 - RNA, 20 nt, Human
auuagaaauuagcuguguga

SEQ ID NO: 2109514 - RNA, 23 nt, Human
auuagaaauuagcugugugaaau

SEQ ID NO: 2109515 - RNA, 17 nt, Human
auuagaaauuggcugga

SEQ ID NO: 2109516 - RNA, 15 nt, Human
auuagaaauaaagca

SEQ ID NO: 2109517 - RNA, 16 nt, Human
auuagaaauagacagu

SEQ ID NO: 2109518 - RNA, 22 nt, Human
auuagaaauagacaguauauuu

SEQ ID NO: 2109519 - RNA, 11 nt, Human
auuagaaauga

SEQ ID NO: 2109520 - RNA, 15 nt, Human
auuauaauuuaaugc

SEQ ID NO: 2109521 - RNA, 13 nt, Human
auuauaaugaauu

SEQ ID NO: 2109522 - RNA, 16 nt, Human
auuauaggccaaacug

SEQ ID NO: 2109523 - RNA, 22 nt, Human
uuuuuguuccacaaguuaaaua

SEQ ID NO: 2109524 - RNA, 15 nt, Human
auuaagauggauucu

SEQ ID NO: 2109525 - RNA, 20 nt, Human
auuaagauggauucucagau

SEQ ID NO: 2109526 - RNA, 23 nt, Human
auuaagauggauucucagauauu

SEQ ID NO: 2109527 - RNA, 12 nt, Human
auuaagaauguu

SEQ ID NO: 2109528 - RNA, 18 nt, Human
auuaagaauguucucaau

SEQ ID NO: 2109529 - RNA, 15 nt, Human
auuaaguaaacuaau

SEQ ID NO: 2109530 - RNA, 18 nt, Human
auuaaguaaacuaaugag

SEQ ID NO: 2109531 - RNA, 16 nt, Human
uuuuuguuuguuuugu

SEQ ID NO: 2109532 - RNA, 17 nt, Human
uuuuuguuguguucugu

SEQ ID NO: 2109533 - RNA, 24 nt, Human
auuaagauggauucucagauauuu

SEQ ID NO: 2109534 - RNA, 20 nt, Human
auuaauauggggaugcagca

SEQ ID NO: 2109535 - RNA, 16 nt, Human
auuaauauucauugua

SEQ ID NO: 2109536 - RNA, 16 nt, Human
auuaaugacagagcca

SEQ ID NO: 2109537 - RNA, 12 nt, Human
auuaccacugaa

SEQ ID NO: 2109538 - RNA, 14 nt, Human
auuaccacugaaga

SEQ ID NO: 2109539 - RNA, 18 nt, Human
auuaccacugaagauaga

SEQ ID NO: 2109540 - RNA, 19 nt, Human
auuaccacugaagauagaa

SEQ ID NO: 2109541 - RNA, 22 nt, Human
auuaccacugaagauagaagaa

SEQ ID NO: 2109542 - RNA, 20 nt, Human
auuaccagacgguucaccag

SEQ ID NO: 2109543 - RNA, 23 nt, Human
auuaccagacgguucaccagccu

SEQ ID NO: 2109544 - RNA, 21 nt, Human
auuaccuaguagucauuucau

SEQ ID NO: 2109545 - RNA, 13 nt, Human
auuaccucugaua

SEQ ID NO: 2109546 - RNA, 12 nt, Human
auuacucuugua

SEQ ID NO: 2109547 - RNA, 13 nt, Human
auuacucuuguaa

SEQ ID NO: 2109548 - RNA, 15 nt, Human
auuacucuuguaaga

SEQ ID NO: 2109549 - RNA, 16 nt, Human
auuacucuuguaagau

SEQ ID NO: 2109550 - RNA, 17 nt, Human
auuacucuuguaagauu

SEQ ID NO: 2109551 - RNA, 18 nt, Human
auuacucuuguaagauuu

SEQ ID NO: 2109552 - RNA, 19 nt, Human
auuacucuuguaagauuuu

SEQ ID NO: 2109553 - RNA, 21 nt, Human
auuacucuuguaagauuuuga

SEQ ID NO: 2109554 - RNA, 22 nt, Human
auuacucuuguaagauuuugaa

SEQ ID NO: 2109555 - RNA, 15 nt, Human
auuacucugaaauug

SEQ ID NO: 2109556 - RNA, 19 nt, Human
auuuacccuucuuuucuga

SEQ ID NO: 2109557 - RNA, 19 nt, Human
auuuacccagaaugucaga

SEQ ID NO: 2109558 - RNA, 23 nt, Human
auuuaauuuuuuugagacagagu

SEQ ID NO: 2109559 - RNA, 19 nt, Human
auuuaauuuuuuugagaca

SEQ ID NO: 2109560 - RNA, 20 nt, Human
auuuaacuuaacauucugua

SEQ ID NO: 2109561 - RNA, 13 nt, Human
auuuaacuggcuu

SEQ ID NO: 2109562 - RNA, 21 nt, Human
auuuaacuuaacauucuguaa

SEQ ID NO: 2109563 - RNA, 17 nt, Human
auuuaauuugccaaaau

SEQ ID NO: 2109564 - RNA, 21 nt, Human
auuuaauuugccaaaauaaug

SEQ ID NO: 2109565 - RNA, 22 nt, Human
auuuaauuugccaaaauaaugu

SEQ ID NO: 2109566 - RNA, 14 nt, Human
auuuaacccagcuc

SEQ ID NO: 2109567 - RNA, 19 nt, Human
auuuaaaggcuaccuuauu

SEQ ID NO: 2109568 - RNA, 21 nt, Human
auuuaaaggcuaccuuauugu

SEQ ID NO: 2109569 - RNA, 22 nt, Human
auuuaaaggcuaccuuauugua

SEQ ID NO: 2109570 - RNA, 13 nt, Human
auuuaaaacauua

SEQ ID NO: 2109571 - RNA, 19 nt, Human
auuuaaacaauaaaugugc

SEQ ID NO: 2109572 - RNA, 15 nt, Human
auuuaaaagacacug

SEQ ID NO: 2109573 - RNA, 14 nt, Human
auugucuuuauaug

SEQ ID NO: 2109574 - RNA, 17 nt, Human
auugucuuuauaugaac

SEQ ID NO: 2109575 - RNA, 20 nt, Human
auugucuuuauaugaacaua

SEQ ID NO: 2109576 - RNA, 13 nt, Human
auuguuugcuuau

SEQ ID NO: 2109577 - RNA, 14 nt, Human
auuguuugcuuauu

SEQ ID NO: 2109578 - RNA, 15 nt, Human
auuguuugcuuauug

SEQ ID NO: 2109579 - RNA, 16 nt, Human
auuguuugcuuauugu

SEQ ID NO: 2109580 - RNA, 18 nt, Human
auuguuugcuuauuguuc

SEQ ID NO: 2109581 - RNA, 22 nt, Human
auuguuugcuuauuguuccaag

SEQ ID NO: 2109582 - RNA, 19 nt, Human
auuguuugcuuauuguucc

SEQ ID NO: 2109583 - RNA, 21 nt, Human
auuguuugcuuauuguuccaa

SEQ ID NO: 2109584 - RNA, 23 nt, Human
auuguuugcuuauuguuccaaga

SEQ ID NO: 2109585 - RNA, 22 nt, Human
auuguuucauugcgaaucuuuu

SEQ ID NO: 2109586 - RNA, 23 nt, Human
auuggcuuuggguugcaggaccu

SEQ ID NO: 2109587 - RNA, 21 nt, Human
auuguauaaaaauagaagaau

SEQ ID NO: 2109588 - RNA, 16 nt, Human
auuggcuuuucaugcg

SEQ ID NO: 2109589 - RNA, 20 nt, Human
auugcgucuuagcagugauu

SEQ ID NO: 2109590 - RNA, 21 nt, Human
auugcgucuuagcagugauuu

SEQ ID NO: 2109591 - RNA, 19 nt, Human
auugcgccauugcacucca

SEQ ID NO: 2109592 - RNA, 14 nt, Human
auuguaucuagugc

SEQ ID NO: 2109593 - RNA, 15 nt, Human
auuguaucuagugca

SEQ ID NO: 2109594 - RNA, 16 nt, Human
auuguaucuagugcag

SEQ ID NO: 2109595 - RNA, 18 nt, Human
auuguaucuagugcagcu

SEQ ID NO: 2109596 - RNA, 19 nt, Human
auuguaucuagugcagcug

SEQ ID NO: 2109597 - RNA, 21 nt, Human
auuguaucuagugcagcugau

SEQ ID NO: 2109598 - RNA, 12 nt, Human
auugcaauagaa

SEQ ID NO: 2109599 - RNA, 17 nt, Human
auugcaauuuuaacaca

SEQ ID NO: 2109600 - RNA, 18 nt, Human
auugcacaaaauauaaag

SEQ ID NO: 2109601 - RNA, 16 nt, Human
auugcaaugaaggaaa

SEQ ID NO: 2109602 - RNA, 21 nt, Human
auugcaacaggcugggcuuca

SEQ ID NO: 2109603 - RNA, 16 nt, Human
auugcaacaggcuggg

SEQ ID NO: 2109604 - RNA, 19 nt, Human
auugcagcugggagaaggg

SEQ ID NO: 2109605 - RNA, 15 nt, Human
auugcaacaggcugg

SEQ ID NO: 2109606 - RNA, 18 nt, Human
auugacaggauuauugga

SEQ ID NO: 2109607 - RNA, 17 nt, Human
auugcauuuccugacag

SEQ ID NO: 2109608 - RNA, 16 nt, Human
auugcauuuccugaca

SEQ ID NO: 2109609 - RNA, 18 nt, Human
auugcauuuuuuaaaaca

SEQ ID NO: 2109610 - RNA, 19 nt, Human
auugcauuuuuuaaaacaa

SEQ ID NO: 2109611 - RNA, 20 nt, Human
auugcauuuuuuaaaacaag

SEQ ID NO: 2109612 - RNA, 21 nt, Human
auugcauuuuuuaaaacaaga

SEQ ID NO: 2109613 - RNA, 14 nt, Human
auugccaccaggag

SEQ ID NO: 2109614 - RNA, 15 nt, Human
auugccaccaggaga

SEQ ID NO: 2109615 - RNA, 21 nt, Human
auugccaccaggagaaccacu

SEQ ID NO: 2109616 - RNA, 14 nt, Human
auugccagugacau

SEQ ID NO: 2109617 - RNA, 14 nt, Human
auugccagugucuu

SEQ ID NO: 2109618 - RNA, 15 nt, Human
auugccagugucuuu

SEQ ID NO: 2109619 - RNA, 16 nt, Human
auugccagugucuuuc

SEQ ID NO: 2109620 - RNA, 18 nt, Human
auugccagugucuuucuu

SEQ ID NO: 2109621 - RNA, 20 nt, Human
auugccagugucuuucuuug

SEQ ID NO: 2109622 - RNA, 21 nt, Human
auugccagugucuuucuuugg

SEQ ID NO: 2109623 - RNA, 21 nt, Human
auugcccacgcuggagugcag

SEQ ID NO: 2109624 - RNA, 17 nt, Human
auugcccacgcuggagu

SEQ ID NO: 2109625 - RNA, 19 nt, Human
auugcggacagccacggcc

SEQ ID NO: 2109626 - RNA, 18 nt, Human
auugcggacagccacggc

SEQ ID NO: 2109627 - RNA, 16 nt, Human
auugcggacagccacg

SEQ ID NO: 2109628 - RNA, 11 nt, Human
auugcccuggu

SEQ ID NO: 2109629 - RNA, 18 nt, Human
auucucagaaucucaaau

SEQ ID NO: 2109630 - RNA, 20 nt, Human
auucucagaaucucaaauaa

SEQ ID NO: 2109631 - RNA, 23 nt, Human
auucucagauauuuauauuuuua

SEQ ID NO: 2109632 - RNA, 17 nt, Human
auucucacuccaccacc

SEQ ID NO: 2109633 - RNA, 16 nt, Human
auucucagauauuuau

SEQ ID NO: 2109634 - RNA, 14 nt, Human
auucucacuccacc

SEQ ID NO: 2109635 - RNA, 15 nt, Human
auucucacuccacca

SEQ ID NO: 2109636 - RNA, 16 nt, Human
auucucacuccaccac

SEQ ID NO: 2109637 - RNA, 14 nt, Human
auucucagaaucuc

SEQ ID NO: 2109638 - RNA, 13 nt, Human
auucuacuuugag

SEQ ID NO: 2109639 - RNA, 16 nt, Human
auucuacuuugagugc

SEQ ID NO: 2109640 - RNA, 14 nt, Human
auuccguuuacauu

SEQ ID NO: 2109641 - RNA, 19 nt, Human
auuccguuuacauuuuaga

SEQ ID NO: 2109642 - RNA, 20 nt, Human
auuccguuuacauuuuagac

SEQ ID NO: 2109643 - RNA, 14 nt, Human
auugcuacuguccu

SEQ ID NO: 2109644 - RNA, 19 nt, Human
auuugaguguuuuaagaua

SEQ ID NO: 2109645 - RNA, 12 nt, Human
auuugaguguuu

SEQ ID NO: 2109646 - RNA, 22 nt, Human
auuugaguaaucugaucguucu

SEQ ID NO: 2109647 - RNA, 23 nt, Human
auuugaguaaucugaucguucuu

SEQ ID NO: 2109648 - RNA, 17 nt, Human
auuugagcagggcucag

SEQ ID NO: 2109649 - RNA, 13 nt, Human
auuugaggucaag

SEQ ID NO: 2109650 - RNA, 22 nt, Human
auuugaggucaaguaagaagac

SEQ ID NO: 2109651 - RNA, 19 nt, Human
auuugaaugaaaaauuuaa

SEQ ID NO: 2109652 - RNA, 17 nt, Human
auuugaauggguccauu

SEQ ID NO: 2109653 - RNA, 18 nt, Human
auuugaauggguccauuu

SEQ ID NO: 2109654 - RNA, 22 nt, Human
auuuguaaaaacagcauugcuu

SEQ ID NO: 2109655 - RNA, 15 nt, Human
auuuggugaauuuga

SEQ ID NO: 2109656 - RNA, 19 nt, Human
auuuggugaauuugaaucu

SEQ ID NO: 2109657 - RNA, 23 nt, Human
auuuguaaaaacagcauugcuuu

SEQ ID NO: 2109658 - RNA, 23 nt, Human
auuuggucaagauuuugaaugcu

SEQ ID NO: 2109659 - RNA, 21 nt, Human
auuugguaaauuaguauuuau

SEQ ID NO: 2109660 - RNA, 16 nt, Human
auuugggugguaagag

SEQ ID NO: 2109661 - RNA, 17 nt, Human
auuugggguugcaucag

SEQ ID NO: 2109662 - RNA, 22 nt, Human
auuugggguugcaucagaaaug

SEQ ID NO: 2109663 - RNA, 23 nt, Human
auuugggguugcaucagaaaugu

SEQ ID NO: 2109664 - RNA, 16 nt, Human
auuuggguaaaucaug

SEQ ID NO: 2109665 - RNA, 23 nt, Human
auuugggguagcuagaggaacca

SEQ ID NO: 2109666 - RNA, 21 nt, Human
auuugggguagcuagaggaac

SEQ ID NO: 2109667 - RNA, 15 nt, Human
auuuggaauucuguu

SEQ ID NO: 2109668 - RNA, 18 nt, Human
auuuagggaacugcuuga

SEQ ID NO: 2109669 - RNA, 15 nt, Human
auuuagggcaaggag

SEQ ID NO: 2109670 - RNA, 22 nt, Human
auuuaggcagauugaaaaggac

SEQ ID NO: 2109671 - RNA, 16 nt, Human
auuuagggaacugcuu

SEQ ID NO: 2109672 - RNA, 15 nt, Human
auuuagcuguaucaa

SEQ ID NO: 2109673 - RNA, 19 nt, Human
auuuagcuguaucaaacua

SEQ ID NO: 2109674 - RNA, 12 nt, Human
auuuaggaacuu

SEQ ID NO: 2109675 - RNA, 18 nt, Human
auuuagcguagcuaagug

SEQ ID NO: 2109676 - RNA, 14 nt, Human
auuuccugugucuu

SEQ ID NO: 2109677 - RNA, 18 nt, Human
auuuccuuaaacugugug

SEQ ID NO: 2109678 - RNA, 15 nt, Human
auuucuaacucugau

SEQ ID NO: 2109679 - RNA, 16 nt, Human
auuucuaacucugaug

SEQ ID NO: 2109680 - RNA, 18 nt, Human
auuucuaacucugaugua

SEQ ID NO: 2109681 - RNA, 19 nt, Human
auuucuaacucugauguaa

SEQ ID NO: 2109682 - RNA, 20 nt, Human
auuucuaacucugauguaaa

SEQ ID NO: 2109683 - RNA, 21 nt, Human
auuucuaacucugauguaaau

SEQ ID NO: 2109684 - RNA, 22 nt, Human
auuucuaacucugauguaaaug

SEQ ID NO: 2109685 - RNA, 23 nt, Human
auuucuaacucugauguaaauga

SEQ ID NO: 2109686 - RNA, 21 nt, Human
auuuuacuuuaaaaggagcca

SEQ ID NO: 2109687 - RNA, 18 nt, Human
auuuuacuacuguggaaa

SEQ ID NO: 2109688 - RNA, 20 nt, Human
auuuuauuacaucuuucaca

SEQ ID NO: 2109689 - RNA, 15 nt, Human
auuuuauuuuagcag

SEQ ID NO: 2109690 - RNA, 11 nt, Human
auuuuacaaaa

SEQ ID NO: 2109691 - RNA, 15 nt, Human
auuuuacaaaagaug

SEQ ID NO: 2109692 - RNA, 16 nt, Human
auuuuacaaaagaugu

SEQ ID NO: 2109693 - RNA, 17 nt, Human
auuuuacaaaagaugua

SEQ ID NO: 2109694 - RNA, 20 nt, Human
auuuuacaauaggugcuuau

SEQ ID NO: 2109695 - RNA, 13 nt, Human
auuuuacaauuga

SEQ ID NO: 2109696 - RNA, 18 nt, Human
auuuuaauuuaugaguuu

SEQ ID NO: 2109697 - RNA, 17 nt, Human
auuuuacaauugaaaug

SEQ ID NO: 2109698 - RNA, 21 nt, Human
auuuuacaauugaaaugacua

SEQ ID NO: 2109699 - RNA, 17 nt, Human
auuuuacuacuguggaa

SEQ ID NO: 2109700 - RNA, 22 nt, Human
auuuuacuacuguggaaaaaua

SEQ ID NO: 2109701 - RNA, 13 nt, Human
auuuuacugucuu

SEQ ID NO: 2109702 - RNA, 14 nt, Human
auuuuacugucuua

SEQ ID NO: 2109703 - RNA, 15 nt, Human
auuuuacugucuuaa

SEQ ID NO: 2109704 - RNA, 16 nt, Human
auuuuacugucuuaau

SEQ ID NO: 2109705 - RNA, 20 nt, Human
auuuuacugucuuaauuaag

SEQ ID NO: 2109706 - RNA, 23 nt, Human
auuuuacugucuuaauuaaguaa

SEQ ID NO: 2109707 - RNA, 18 nt, Human
auuuuacuucuagagaua

SEQ ID NO: 2109708 - RNA, 20 nt, Human
auuuguagaaggguuauauu

SEQ ID NO: 2109709 - RNA, 14 nt, Human
auuuguauaaaaug

SEQ ID NO: 2109710 - RNA, 16 nt, Human
auuuguaggguuucua

SEQ ID NO: 2109711 - RNA, 15 nt, Human
auuuguauauauaca

SEQ ID NO: 2109712 - RNA, 16 nt, Human
auuuguauauauacau

SEQ ID NO: 2109713 - RNA, 18 nt, Human
auuuguauauauacauaa

SEQ ID NO: 2109714 - RNA, 16 nt, Human
auuuguauguugugaa

SEQ ID NO: 2109715 - RNA, 18 nt, Human
auuuguauguugugaaga

SEQ ID NO: 2109716 - RNA, 16 nt, Human
auauaaaagacugacc

SEQ ID NO: 2109717 - RNA, 18 nt, Human
auauaaagagaaaauuga

SEQ ID NO: 2109718 - RNA, 19 nt, Human
auauaaagagaaaauugaa

SEQ ID NO: 2109719 - RNA, 20 nt, Human
auauaaagagaaaauugaau

SEQ ID NO: 2109720 - RNA, 21 nt, Human
auauaaagagaaaauugaauu

SEQ ID NO: 2109721 - RNA, 22 nt, Human
auauaaagagaaaauugaauuu

SEQ ID NO: 2109722 - RNA, 18 nt, Human
auauaaagcaucuaaacu

SEQ ID NO: 2109723 - RNA, 19 nt, Human
auauaaagcaucuaaacuu

SEQ ID NO: 2109724 - RNA, 20 nt, Human
auauaaagcaucuaaacuuu

SEQ ID NO: 2109725 - RNA, 18 nt, Human
auauaaauaaaacauuuu

SEQ ID NO: 2109726 - RNA, 15 nt, Human
auauaaauaaaacau

SEQ ID NO: 2109727 - RNA, 13 nt, Human
auauaacuaacaa

SEQ ID NO: 2109728 - RNA, 13 nt, Human
auauaacugccuu

SEQ ID NO: 2109729 - RNA, 20 nt, Human
auauaacugccuuaaaacuu

SEQ ID NO: 2109730 - RNA, 11 nt, Human
auauaaccaau

SEQ ID NO: 2109731 - RNA, 16 nt, Human
auauaaccaauguuua

SEQ ID NO: 2109732 - RNA, 17 nt, Human
auauaaccaauguuuaa

SEQ ID NO: 2109733 - RNA, 20 nt, Human
auauaaccaauguuuaaaaa

SEQ ID NO: 2109734 - RNA, 15 nt, Human
auauaucuaucuuau

SEQ ID NO: 2109735 - RNA, 14 nt, Human
auauaucuaucuua

SEQ ID NO: 2109736 - RNA, 20 nt, Human
auauauauguguguguaugu

SEQ ID NO: 2109737 - RNA, 18 nt, Human
auauauauguugauuucu

SEQ ID NO: 2109738 - RNA, 13 nt, Human
auauauauuuuaa

SEQ ID NO: 2109739 - RNA, 23 nt, Human
auauauauucuggcugauaaaag

SEQ ID NO: 2109740 - RNA, 13 nt, Human
auauauacacaca

SEQ ID NO: 2109741 - RNA, 14 nt, Human
auagugacgauacu

SEQ ID NO: 2109742 - RNA, 13 nt, Human
auagucuguguga

SEQ ID NO: 2109743 - RNA, 15 nt, Human
auaggccuucuugug

SEQ ID NO: 2109744 - RNA, 17 nt, Human
auaggccuucuugugau

SEQ ID NO: 2109745 - RNA, 11 nt, Human
auaggcucugc

SEQ ID NO: 2109746 - RNA, 12 nt, Human
auaggcucugca

SEQ ID NO: 2109747 - RNA, 13 nt, Human
auaggcucugcac

SEQ ID NO: 2109748 - RNA, 14 nt, Human
auaggcucugcaca

SEQ ID NO: 2109749 - RNA, 15 nt, Human
auaggcucugcacag

SEQ ID NO: 2109750 - RNA, 19 nt, Human
auaggcucugcacagaugg

SEQ ID NO: 2109751 - RNA, 22 nt, Human
auaggcucugcacagauggauu

SEQ ID NO: 2109752 - RNA, 17 nt, Human
auaguggcuuaaaacaa

SEQ ID NO: 2109753 - RNA, 17 nt, Human
auagugcuuaaaaauca

SEQ ID NO: 2109754 - RNA, 13 nt, Human
auaguggccagac

SEQ ID NO: 2109755 - RNA, 21 nt, Human
auaguggccagaccagagcuc

SEQ ID NO: 2109756 - RNA, 13 nt, Human
auagugugaggga

SEQ ID NO: 2109757 - RNA, 12 nt, Human
auaguguguucu

SEQ ID NO: 2109758 - RNA, 13 nt, Human
auaguguguucug

SEQ ID NO: 2109759 - RNA, 14 nt, Human
auaguguguucuga

SEQ ID NO: 2109760 - RNA, 15 nt, Human
auaguguaggcuuua

SEQ ID NO: 2109761 - RNA, 17 nt, Human
auaguguaggcuuuacu

SEQ ID NO: 2109762 - RNA, 20 nt, Human
auaguguaggcuuuacuuag

SEQ ID NO: 2109763 - RNA, 21 nt, Human
auagugguguuuuaaagagaa

SEQ ID NO: 2109764 - RNA, 17 nt, Human
auagugguucuuggaaa

SEQ ID NO: 2109765 - RNA, 18 nt, Human
auagugguucuuggaaaa

SEQ ID NO: 2109766 - RNA, 21 nt, Human
auagugguucuuggaaaaaug

SEQ ID NO: 2109767 - RNA, 15 nt, Human
auaguguguucugau

SEQ ID NO: 2109768 - RNA, 17 nt, Human
auaguguguucugauua

SEQ ID NO: 2109769 - RNA, 19 nt, Human
auaguguguucugauuaga

SEQ ID NO: 2109770 - RNA, 21 nt, Human
auaguguguucugauuagaaa

SEQ ID NO: 2109771 - RNA, 23 nt, Human
auaguguguucugauuagaaaug

SEQ ID NO: 2109772 - RNA, 22 nt, Human
auaguuggcuaggaccccucca

SEQ ID NO: 2109773 - RNA, 19 nt, Human
auaguugcuccgccucugc

SEQ ID NO: 2109774 - RNA, 14 nt, Human
auaguuuauugaca

SEQ ID NO: 2109775 - RNA, 13 nt, Human
auaguuuauugac

SEQ ID NO: 2109776 - RNA, 15 nt, Human
auaguuuacuauuuu

SEQ ID NO: 2109777 - RNA, 16 nt, Human
auaguuuacuauuuua

SEQ ID NO: 2109778 - RNA, 22 nt, Human
auaguuuacuauuuuacuucua

SEQ ID NO: 2109779 - RNA, 23 nt, Human
auauaaaaaccccaaacuguuga

SEQ ID NO: 2109780 - RNA, 22 nt, Human
auaguuaagcgugcauaaguua

SEQ ID NO: 2109781 - RNA, 15 nt, Human
auaguucaaagccaa

SEQ ID NO: 2109782 - RNA, 17 nt, Human
auaguucccauguuaaa

SEQ ID NO: 2109783 - RNA, 14 nt, Human
auaggccugggugc

SEQ ID NO: 2109784 - RNA, 22 nt, Human
auaggagagagaucaugagaaa

SEQ ID NO: 2109785 - RNA, 21 nt, Human
auaggaaaguauuuuuuuaag

SEQ ID NO: 2109786 - RNA, 15 nt, Human
auaggaacauaugaa

SEQ ID NO: 2109787 - RNA, 16 nt, Human
auaggaacauaugaaa

SEQ ID NO: 2109788 - RNA, 18 nt, Human
auaggaacauaugaaaau

SEQ ID NO: 2109789 - RNA, 21 nt, Human
auaggaacauaugaaaauaca

SEQ ID NO: 2109790 - RNA, 22 nt, Human
uucacauuaauauuugcugaca

SEQ ID NO: 2109791 - RNA, 16 nt, Human
uucaaguaauugugaa

SEQ ID NO: 2109792 - RNA, 20 nt, Human
uucaagucugugccuggagc

SEQ ID NO: 2109793 - RNA, 21 nt, Human
uucaagucugugccuggagcu

SEQ ID NO: 2109794 - RNA, 17 nt, Human
uucaagugaaucuaaaa

SEQ ID NO: 2109795 - RNA, 21 nt, Human
uucacacugcaagagccuugg

SEQ ID NO: 2109796 - RNA, 12 nt, Human
uucacacuucca

SEQ ID NO: 2109797 - RNA, 15 nt, Human
uucacacuuccacca

SEQ ID NO: 2109798 - RNA, 16 nt, Human
uucaagucaccuccuu

SEQ ID NO: 2109799 - RNA, 13 nt, Human
uucacaagcugcc

SEQ ID NO: 2109800 - RNA, 14 nt, Human
uucacaagcugccu

SEQ ID NO: 2109801 - RNA, 16 nt, Human
uucacaagcugccucc

SEQ ID NO: 2109802 - RNA, 17 nt, Human
uucacaagcugccuccc

SEQ ID NO: 2109803 - RNA, 18 nt, Human
uucacaagcugccucccu

SEQ ID NO: 2109804 - RNA, 19 nt, Human
uucacaagcugccucccug

SEQ ID NO: 2109805 - RNA, 13 nt, Human
uucacaauagaaa

SEQ ID NO: 2109806 - RNA, 20 nt, Human
uucacaaugaaaugcucucc

SEQ ID NO: 2109807 - RNA, 21 nt, Human
uucacacacaggcaacugagg

SEQ ID NO: 2109808 - RNA, 22 nt, Human
uucacaauggugcucauuucau

SEQ ID NO: 2109809 - RNA, 20 nt, Human
uucacacuuccaccagccug

SEQ ID NO: 2109810 - RNA, 18 nt, Human
uucacacuuccaccagcc

SEQ ID NO: 2109811 - RNA, 19 nt, Human
uucacacuuccaccagccu

SEQ ID NO: 2109812 - RNA, 18 nt, Human
uucacaugcaucaaguua

SEQ ID NO: 2109813 - RNA, 21 nt, Human
uucacauccuguguuucuagg

SEQ ID NO: 2109814 - RNA, 13 nt, Human
uucacaguuuuuc

SEQ ID NO: 2109815 - RNA, 13 nt, Human
uuauuuuuagaug

SEQ ID NO: 2109816 - RNA, 23 nt, Human
uuauuuuuguuucuuccaaagca

SEQ ID NO: 2109817 - RNA, 18 nt, Human
uuauuuuuuaaguauuua

SEQ ID NO: 2109818 - RNA, 18 nt, Human
uuauuuuuuacauuauua

SEQ ID NO: 2109819 - RNA, 14 nt, Human
uuauuuuuuacauu

SEQ ID NO: 2109820 - RNA, 13 nt, Human
uuauuuuuuauac

SEQ ID NO: 2109821 - RNA, 14 nt, Human
uuauuuuuuauaca

SEQ ID NO: 2109822 - RNA, 15 nt, Human
uuauuuuuuauacag

SEQ ID NO: 2109823 - RNA, 14 nt, Human
uuauuuuuuucuac

SEQ ID NO: 2109824 - RNA, 15 nt, Human
uuaguuuuaguugca

SEQ ID NO: 2109825 - RNA, 17 nt, Human
uuaguuuuaguugcaga

SEQ ID NO: 2109826 - RNA, 17 nt, Human
uuaguuuuuguaauuua

SEQ ID NO: 2109827 - RNA, 18 nt, Human
uuaguuuuuguaauuuau

SEQ ID NO: 2109828 - RNA, 19 nt, Human
uuaguuuuuguaauuuauu

SEQ ID NO: 2109829 - RNA, 17 nt, Human
uuauuuuuagacagagu

SEQ ID NO: 2109830 - RNA, 13 nt, Human
uuauuuuuauaca

SEQ ID NO: 2109831 - RNA, 14 nt, Human
uuauuuuuauacag

SEQ ID NO: 2109832 - RNA, 15 nt, Human
uuauuuuuauacagu

SEQ ID NO: 2109833 - RNA, 16 nt, Human
uuauuuuuauacagua

SEQ ID NO: 2109834 - RNA, 17 nt, Human
uuauuuuuauacaguag

SEQ ID NO: 2109835 - RNA, 20 nt, Human
uuauuuuuauacaguaguga

SEQ ID NO: 2109836 - RNA, 22 nt, Human
uuauuuuuauacaguagugaga

SEQ ID NO: 2109837 - RNA, 19 nt, Human
uuauuuuuauauagcuuga

SEQ ID NO: 2109838 - RNA, 18 nt, Human
uuauuuuuagacagaguc

SEQ ID NO: 2109839 - RNA, 14 nt, Human
uucaagaccagccu

SEQ ID NO: 2109840 - RNA, 17 nt, Human
uucaagaccagccuggc

SEQ ID NO: 2109841 - RNA, 18 nt, Human
uucaagaccuucucccca

SEQ ID NO: 2109842 - RNA, 23 nt, Human
uucaagcaucuccugaggaucag

SEQ ID NO: 2109843 - RNA, 17 nt, Human
uucaagcagauuggaga

SEQ ID NO: 2109844 - RNA, 21 nt, Human
uucaagcgauucuucugcuuc

SEQ ID NO: 2109845 - RNA, 12 nt, Human
uucaaggaauca

SEQ ID NO: 2109846 - RNA, 20 nt, Human
uucaagguaaaauucuaaau

SEQ ID NO: 2109847 - RNA, 14 nt, Human
uucaaaauaaaaac

SEQ ID NO: 2109848 - RNA, 17 nt, Human
uucaaaauaaaaaugag

SEQ ID NO: 2109849 - RNA, 21 nt, Human
uucaaaagaaucagaaacagg

SEQ ID NO: 2109850 - RNA, 16 nt, Human
uucaaaaguugaaauu

SEQ ID NO: 2109851 - RNA, 17 nt, Human
uucaaaaguugaaauua

SEQ ID NO: 2109852 - RNA, 18 nt, Human
uucauacacagccugggc

SEQ ID NO: 2109853 - RNA, 10 nt, Human
uucagugccc

SEQ ID NO: 2109854 - RNA, 14 nt, Human
uucagugcccacca

SEQ ID NO: 2109855 - RNA, 13 nt, Human
uucagaaauaugu

SEQ ID NO: 2109856 - RNA, 11 nt, Human
auauauguaug

SEQ ID NO: 2109857 - RNA, 12 nt, Human
auauauguaugu

SEQ ID NO: 2109858 - RNA, 15 nt, Human
auauauguauguaaa

SEQ ID NO: 2109859 - RNA, 16 nt, Human
auauauguauguaaaa

SEQ ID NO: 2109860 - RNA, 19 nt, Human
auauauguauguaaaaaug

SEQ ID NO: 2109861 - RNA, 21 nt, Human
uucaucccacuccaacucuuc

SEQ ID NO: 2109862 - RNA, 19 nt, Human
auauauguguguguauguu

SEQ ID NO: 2109863 - RNA, 16 nt, Human
auauauguguguguau

SEQ ID NO: 2109864 - RNA, 12 nt, Human
auauauucucuu

SEQ ID NO: 2109865 - RNA, 14 nt, Human
auauauucucuuug

SEQ ID NO: 2109866 - RNA, 16 nt, Human
auauauucucuuuggu

SEQ ID NO: 2109867 - RNA, 23 nt, Human
auauauucucuuugguguacaaa

SEQ ID NO: 2109868 - RNA, 20 nt, Human
auauauucuggcugauaaaa

SEQ ID NO: 2109869 - RNA, 22 nt, Human
auauauucuggcugauaaaaga

SEQ ID NO: 2109870 - RNA, 20 nt, Human
auauguaaaauaaaauuaug

SEQ ID NO: 2109871 - RNA, 17 nt, Human
auauguaacaagccacc

SEQ ID NO: 2109872 - RNA, 21 nt, Human
auaugauuaguaaagaaauga

SEQ ID NO: 2109873 - RNA, 12 nt, Human
auauguaaaaua

SEQ ID NO: 2109874 - RNA, 16 nt, Human
auauguaacaagccac

SEQ ID NO: 2109875 - RNA, 13 nt, Human
auauguaaaauaa

SEQ ID NO: 2109876 - RNA, 14 nt, Human
auauguaaaauaaa

SEQ ID NO: 2109877 - RNA, 15 nt, Human
auauguaaaauaaaa

SEQ ID NO: 2109878 - RNA, 16 nt, Human
auauguaaaauaaaau

SEQ ID NO: 2109879 - RNA, 15 nt, Human
auaugauauugcaua

SEQ ID NO: 2109880 - RNA, 16 nt, Human
auaugauauugcauau

SEQ ID NO: 2109881 - RNA, 14 nt, Human
auaugauauguaaa

SEQ ID NO: 2109882 - RNA, 16 nt, Human
auaugauauguaaaca

SEQ ID NO: 2109883 - RNA, 20 nt, Human
auaugagcuuuauguaauaa

SEQ ID NO: 2109884 - RNA, 23 nt, Human
auaugaaaauacaacuuaaauaa

SEQ ID NO: 2109885 - RNA, 23 nt, Human
auaugaggaugcagagucagcag

SEQ ID NO: 2109886 - RNA, 22 nt, Human
auauggguugcauuuggucaag

SEQ ID NO: 2109887 - RNA, 16 nt, Human
auaucugaaaauguau

SEQ ID NO: 2109888 - RNA, 17 nt, Human
auaucugaaaauguaug

SEQ ID NO: 2109889 - RNA, 20 nt, Human
auaucugaaaauguaugugu

SEQ ID NO: 2109890 - RNA, 16 nt, Human
auaugaaaauacaacu

SEQ ID NO: 2109891 - RNA, 18 nt, Human
auaugaaaaauaugauau

SEQ ID NO: 2109892 - RNA, 19 nt, Human
auaugaaaaauaugauauu

SEQ ID NO: 2109893 - RNA, 14 nt, Human
auaucuuuuuauug

SEQ ID NO: 2109894 - RNA, 15 nt, Human
auaucuuuuuauuga

SEQ ID NO: 2109895 - RNA, 16 nt, Human
auaucuuuuuauugau

SEQ ID NO: 2109896 - RNA, 21 nt, Human
auaucuuuuuauugaugugca

SEQ ID NO: 2109897 - RNA, 22 nt, Human
auaucuuuuuauugaugugcaa

SEQ ID NO: 2109898 - RNA, 13 nt, Human
auaugaaaaauau

SEQ ID NO: 2109899 - RNA, 14 nt, Human
auaugaaaaauaug

SEQ ID NO: 2109900 - RNA, 17 nt, Human
auaugaaaaauaugaua

SEQ ID NO: 2109901 - RNA, 22 nt, Human
uucauuuagagcuagucuuuca

SEQ ID NO: 2109902 - RNA, 12 nt, Human
uucauugugguu

SEQ ID NO: 2109903 - RNA, 17 nt, Human
uucauugugguuauuuu

SEQ ID NO: 2109904 - RNA, 19 nt, Human
uucauugugguuauuuuua

SEQ ID NO: 2109905 - RNA, 21 nt, Human
uucauugugguuauuuuuaua

SEQ ID NO: 2109906 - RNA, 23 nt, Human
uucauugugguuauuuuuauaca

SEQ ID NO: 2109907 - RNA, 24 nt, Human
uucauugugguuauuuuuauacag

SEQ ID NO: 2109908 - RNA, 13 nt, Human
uucauuguauaaa

SEQ ID NO: 2109909 - RNA, 17 nt, Human
uucauuguauaaaaaua

SEQ ID NO: 2109910 - RNA, 15 nt, Human
uuccaaggguacuaa

SEQ ID NO: 2109911 - RNA, 17 nt, Human
uuccaaggguacuaagg

SEQ ID NO: 2109912 - RNA, 12 nt, Human
uuccaagagcug

SEQ ID NO: 2109913 - RNA, 13 nt, Human
uuccaagagcuga

SEQ ID NO: 2109914 - RNA, 18 nt, Human
uucauuccuaacacagca

SEQ ID NO: 2109915 - RNA, 18 nt, Human
uucauuguaauguuacug

SEQ ID NO: 2109916 - RNA, 20 nt, Human
uucauuguaauguuacugau

SEQ ID NO: 2109917 - RNA, 18 nt, Human
auaugugcuugccucagu

SEQ ID NO: 2109918 - RNA, 16 nt, Human
uuccaagcaaauguua

SEQ ID NO: 2109919 - RNA, 19 nt, Human
uuccaagcaaauguuacau

SEQ ID NO: 2109920 - RNA, 13 nt, Human
uuccaaggagcug

SEQ ID NO: 2109921 - RNA, 18 nt, Human
uuccaaggagcugagaau

SEQ ID NO: 2109922 - RNA, 22 nt, Human
uuccaaggagcugagaauagaa

SEQ ID NO: 2109923 - RNA, 23 nt, Human
uuccaaggagcugagaauagaag

SEQ ID NO: 2109924 - RNA, 15 nt, Human
uuccaauccuggcuc

SEQ ID NO: 2109925 - RNA, 23 nt, Human
uuccaauccuggcucuguggcuu

SEQ ID NO: 2109926 - RNA, 19 nt, Human
uuccacaagauucccagag

SEQ ID NO: 2109927 - RNA, 20 nt, Human
uuccacaagauucccagaga

SEQ ID NO: 2109928 - RNA, 21 nt, Human
uuccacaagauucccagagac

SEQ ID NO: 2109929 - RNA, 19 nt, Human
uuccacaccuagcaucuca

SEQ ID NO: 2109930 - RNA, 18 nt, Human
uuccacacucaccucuaa

SEQ ID NO: 2109931 - RNA, 11 nt, Human
uuccaggcucc

SEQ ID NO: 2109932 - RNA, 16 nt, Human
uuccaggcugcauaga

SEQ ID NO: 2109933 - RNA, 19 nt, Human
uuccaggcugcauagaagg

SEQ ID NO: 2109934 - RNA, 20 nt, Human
uuccaggcugcauagaagga

SEQ ID NO: 2109935 - RNA, 21 nt, Human
uuccaggcugcauagaaggag

SEQ ID NO: 2109936 - RNA, 13 nt, Human
uuccaggaaaaag

SEQ ID NO: 2109937 - RNA, 17 nt, Human
uuccaggaaaaaggaca

SEQ ID NO: 2109938 - RNA, 12 nt, Human
uuccacccccuc

SEQ ID NO: 2109939 - RNA, 13 nt, Human
uuccacccccucc

SEQ ID NO: 2109940 - RNA, 14 nt, Human
uuccacccccuccc

SEQ ID NO: 2109941 - RNA, 15 nt, Human
uuccacccccucccu

SEQ ID NO: 2109942 - RNA, 18 nt, Human
uuccacccccucccuggc

SEQ ID NO: 2109943 - RNA, 20 nt, Human
uuccacccccucccuggccu

SEQ ID NO: 2109944 - RNA, 11 nt, Human
uuccacccugg

SEQ ID NO: 2109945 - RNA, 13 nt, Human
uuccacccuggaa

SEQ ID NO: 2109946 - RNA, 14 nt, Human
uuccauaguauauu

SEQ ID NO: 2109947 - RNA, 17 nt, Human
uuccauaguauauuaaa

SEQ ID NO: 2109948 - RNA, 18 nt, Human
uuccauaguauauuaaaa

SEQ ID NO: 2109949 - RNA, 22 nt, Human
uuccauaguauauuaaaaaugg

SEQ ID NO: 2109950 - RNA, 23 nt, Human
uuccauaguauauuaaaaauggu

SEQ ID NO: 2109951 - RNA, 18 nt, Human
uuccauaauuaugacagu

SEQ ID NO: 2109952 - RNA, 22 nt, Human
uuccauaauuaugacaguuaua

SEQ ID NO: 2109953 - RNA, 17 nt, Human
uuccauaaggaauguag

SEQ ID NO: 2109954 - RNA, 19 nt, Human
uuccauaaggaauguagcu

SEQ ID NO: 2109955 - RNA, 16 nt, Human
uuccauaauguauaaa

SEQ ID NO: 2109956 - RNA, 19 nt, Human
uuccauaauguauaaagaa

SEQ ID NO: 2109957 - RNA, 12 nt, Human
uuccauaauuau

SEQ ID NO: 2109958 - RNA, 13 nt, Human
uuccauaauuaug

SEQ ID NO: 2109959 - RNA, 14 nt, Human
uuccauaauuauga

SEQ ID NO: 2109960 - RNA, 16 nt, Human
uuccauaauuaugaca

SEQ ID NO: 2109961 - RNA, 23 nt, Human
uuccauaaucuggacuccucugu

SEQ ID NO: 2109962 - RNA, 22 nt, Human
uuccauaaucuggacuccucug

SEQ ID NO: 2109963 - RNA, 19 nt, Human
uuccauaaucuggacuccu

SEQ ID NO: 2109964 - RNA, 11 nt, Human
uuccaguuccc

SEQ ID NO: 2109965 - RNA, 20 nt, Human
uuccaguuuguuuauuacuu

SEQ ID NO: 2109966 - RNA, 17 nt, Human
uuccagguguuuauagu

SEQ ID NO: 2109967 - RNA, 23 nt, Human
uuccagguucugguuagcucagc

SEQ ID NO: 2109968 - RNA, 16 nt, Human
uuccaguggccuggcu

SEQ ID NO: 2109969 - RNA, 17 nt, Human
uuccaguggccuggcuc

SEQ ID NO: 2109970 - RNA, 22 nt, Human
uuccaguggccuggcuccgcug

SEQ ID NO: 2109971 - RNA, 21 nt, Human
uuccagugcaacacugaagcu

SEQ ID NO: 2109972 - RNA, 19 nt, Human
uuccagugcaacacugaag

SEQ ID NO: 2109973 - RNA, 15 nt, Human
uuccagugcaacacu

SEQ ID NO: 2109974 - RNA, 22 nt, Human
uuccagguagcugaaaggggaa

SEQ ID NO: 2109975 - RNA, 22 nt, Human
uuccaaguagaauugauuuccc

SEQ ID NO: 2109976 - RNA, 16 nt, Human
uucccaagcucugcuc

SEQ ID NO: 2109977 - RNA, 15 nt, Human
uucccaagcucugcu

SEQ ID NO: 2109978 - RNA, 14 nt, Human
uucccaagcucugc

SEQ ID NO: 2109979 - RNA, 13 nt, Human
uucccaagcucug

SEQ ID NO: 2109980 - RNA, 15 nt, Human
uucccaacugcaagu

SEQ ID NO: 2109981 - RNA, 19 nt, Human
uucccaacacuucagacug

SEQ ID NO: 2109982 - RNA, 18 nt, Human
uucccaagcucugcuccu

SEQ ID NO: 2109983 - RNA, 12 nt, Human
uucccaauaaau

SEQ ID NO: 2109984 - RNA, 14 nt, Human
uucccaauuaggaa

SEQ ID NO: 2109985 - RNA, 21 nt, Human
uucccaauagcacuuucauug

SEQ ID NO: 2109986 - RNA, 18 nt, Human
uucccaccaggcugcuca

SEQ ID NO: 2109987 - RNA, 15 nt, Human
aucccaccaacccuc

SEQ ID NO: 2109988 - RNA, 14 nt, Human
aucccacacccugg

SEQ ID NO: 2109989 - RNA, 15 nt, Human
aucccaagugccagu

SEQ ID NO: 2109990 - RNA, 18 nt, Human
auccauuucaucuauuuc

SEQ ID NO: 2109991 - RNA, 20 nt, Human
auccauuucaucuauuucug

SEQ ID NO: 2109992 - RNA, 21 nt, Human
auccauuucaucuauuucuga

SEQ ID NO: 2109993 - RNA, 22 nt, Human
auccauuucaucuauuucugag

SEQ ID NO: 2109994 - RNA, 23 nt, Human
auccauuucaucuauuucugaga

SEQ ID NO: 2109995 - RNA, 19 nt, Human
auccaaggagaaacagaga

SEQ ID NO: 2109996 - RNA, 22 nt, Human
auccaaggagaaacagagacag

SEQ ID NO: 2109997 - RNA, 13 nt, Human
auccaaggagaaa

SEQ ID NO: 2109998 - RNA, 14 nt, Human
auccaaggagaaac

SEQ ID NO: 2109999 - RNA, 16 nt, Human
auccaauaggaaugcu

SEQ ID NO: 2110000 - RNA, 14 nt, Human
auccaauccucacu

SEQ ID NO: 2110001 - RNA, 17 nt, Human
auccaauccucacuggg

SEQ ID NO: 2110002 - RNA, 18 nt, Human
auccaauccucacugggu

SEQ ID NO: 2110003 - RNA, 19 nt, Human
auccaauccucacugggug

SEQ ID NO: 2110004 - RNA, 20 nt, Human
auccaauccucacugggugg

SEQ ID NO: 2110005 - RNA, 19 nt, Human
auccaaucuuguuuccaaa

SEQ ID NO: 2110006 - RNA, 22 nt, Human
auccaaugcucaagaaacaacu

SEQ ID NO: 2110007 - RNA, 20 nt, Human
uucuguaguacuccuuaaga

SEQ ID NO: 2110008 - RNA, 21 nt, Human
uucuguaguacuccuuaagaa

SEQ ID NO: 2110009 - RNA, 17 nt, Human
uucuguaaaaugucugu

SEQ ID NO: 2110010 - RNA, 21 nt, Human
uucugguucuuguguuggcug

SEQ ID NO: 2110011 - RNA, 15 nt, Human
uucugguuagcucag

SEQ ID NO: 2110012 - RNA, 16 nt, Human
uucugguuagcucagc

SEQ ID NO: 2110013 - RNA, 19 nt, Human
uucugguuagcucagcccc

SEQ ID NO: 2110014 - RNA, 22 nt, Human
uucugguuagcucagccccagc

SEQ ID NO: 2110015 - RNA, 17 nt, Human
uucucuacucuagggaa

SEQ ID NO: 2110016 - RNA, 20 nt, Human
uucucuacagacuucuccag

SEQ ID NO: 2110017 - RNA, 15 nt, Human
uucucuuuaacucag

SEQ ID NO: 2110018 - RNA, 17 nt, Human
uucucuuuaacucagga

SEQ ID NO: 2110019 - RNA, 21 nt, Human
uucucuuuaacucaggacucc

SEQ ID NO: 2110020 - RNA, 16 nt, Human
uucucuuuucaaaaca

SEQ ID NO: 2110021 - RNA, 17 nt, Human
uucucuuugguguacaa

SEQ ID NO: 2110022 - RNA, 15 nt, Human
uucucuuuuccuuug

SEQ ID NO: 2110023 - RNA, 14 nt, Human
uucugaccauuuca

SEQ ID NO: 2110024 - RNA, 14 nt, Human
uucugaccacacuu

SEQ ID NO: 2110025 - RNA, 22 nt, Human
uucugaccacacuuccugucca

SEQ ID NO: 2110026 - RNA, 23 nt, Human
uucugacaucuuaguauuugcau

SEQ ID NO: 2110027 - RNA, 14 nt, Human
uucugacauuaaca

SEQ ID NO: 2110028 - RNA, 15 nt, Human
uucugacauuaacag

SEQ ID NO: 2110029 - RNA, 20 nt, Human
uucugacauuaacaguuuuc

SEQ ID NO: 2110030 - RNA, 22 nt, Human
uucugacauuaacaguuuucca

SEQ ID NO: 2110031 - RNA, 23 nt, Human
uucugacauuaacaguuuuccau

SEQ ID NO: 2110032 - RNA, 13 nt, Human
uucugaccacacu

SEQ ID NO: 2110033 - RNA, 21 nt, Human
uucugcagcaugaccugugac

SEQ ID NO: 2110034 - RNA, 22 nt, Human
uucugcagcaugaccugugacc

SEQ ID NO: 2110035 - RNA, 23 nt, Human
uucugcagcaugaccugugacca

SEQ ID NO: 2110036 - RNA, 20 nt, Human
uucugcagcaugaccuguga

SEQ ID NO: 2110037 - RNA, 15 nt, Human
uucugcaccuuaucu

SEQ ID NO: 2110038 - RNA, 16 nt, Human
uucugcaccuuaucuu

SEQ ID NO: 2110039 - RNA, 22 nt, Human
aucauuuauuuuuuacauuauu

SEQ ID NO: 2110040 - RNA, 19 nt, Human
aucauuuauuuuuuacauu

SEQ ID NO: 2110041 - RNA, 21 nt, Human
uucucuaacuucaaggcccau

SEQ ID NO: 2110042 - RNA, 14 nt, Human
uucuccucuccccu

SEQ ID NO: 2110043 - RNA, 11 nt, Human
aucauugcuua

SEQ ID NO: 2110044 - RNA, 18 nt, Human
aucauugauugucagcua

SEQ ID NO: 2110045 - RNA, 16 nt, Human
aucauuguaaacauua

SEQ ID NO: 2110046 - RNA, 15 nt, Human
uucuuacaaacaugu

SEQ ID NO: 2110047 - RNA, 17 nt, Human
uucuuaaacaaauguau

SEQ ID NO: 2110048 - RNA, 15 nt, Human
uucuuaaaauauauu

SEQ ID NO: 2110049 - RNA, 13 nt, Human
uucuuaaagaguu

SEQ ID NO: 2110050 - RNA, 13 nt, Human
uucuuccucugcu

SEQ ID NO: 2110051 - RNA, 12 nt, Human
uucuuccucugc

SEQ ID NO: 2110052 - RNA, 11 nt, Human
uucuuccucug

SEQ ID NO: 2110053 - RNA, 23 nt, Human
uucuuccucccucccucuuuccc

SEQ ID NO: 2110054 - RNA, 20 nt, Human
aucccaccucuggauaauuu

SEQ ID NO: 2110055 - RNA, 21 nt, Human
uucuguuuugccugaaguugg

SEQ ID NO: 2110056 - RNA, 12 nt, Human
uucuguuuuguu

SEQ ID NO: 2110057 - RNA, 17 nt, Human
uucuguuuugccugaag

SEQ ID NO: 2110058 - RNA, 21 nt, Human
uucuguuggccagugugacaa

SEQ ID NO: 2110059 - RNA, 14 nt, Human
uucuuaaaaaguua

SEQ ID NO: 2110060 - RNA, 21 nt, Human
uucuuaaaauauauuucagau

SEQ ID NO: 2110061 - RNA, 20 nt, Human
uucuguuuuucuaggccugg

SEQ ID NO: 2110062 - RNA, 21 nt, Human
uucuugaugacuggaauuuuu

SEQ ID NO: 2110063 - RNA, 22 nt, Human
uucuugaugacuggaauuuuua

SEQ ID NO: 2110064 - RNA, 18 nt, Human
uucuuccuuaaacuccug

SEQ ID NO: 2110065 - RNA, 14 nt, Human
uucuugcugguugu

SEQ ID NO: 2110066 - RNA, 14 nt, Human
uucuuggcuuuguu

SEQ ID NO: 2110067 - RNA, 14 nt, Human
uucuugggcccucc

SEQ ID NO: 2110068 - RNA, 23 nt, Human
uucuugcugguugucauuuuugc

SEQ ID NO: 2110069 - RNA, 15 nt, Human
uucuuucuuccucug

SEQ ID NO: 2110070 - RNA, 13 nt, Human
uucuuucuuccuc

SEQ ID NO: 2110071 - RNA, 15 nt, Human
uucuuugaaauuguu

SEQ ID NO: 2110072 - RNA, 18 nt, Human
uucuuuguuuuuagagac

SEQ ID NO: 2110073 - RNA, 21 nt, Human
uucuuuuaaaggggcagaaaa

SEQ ID NO: 2110074 - RNA, 16 nt, Human
uucuuuguuacaggca

SEQ ID NO: 2110075 - RNA, 19 nt, Human
auccuaaugaaugcauaaa

SEQ ID NO: 2110076 - RNA, 19 nt, Human
auccuaaucauccaaugcu

SEQ ID NO: 2110077 - RNA, 13 nt, Human
auccuaaugaaug

SEQ ID NO: 2110078 - RNA, 12 nt, Human
auccuaaugaau

SEQ ID NO: 2110079 - RNA, 21 nt, Human
auccuaggcauuugcugaaua

SEQ ID NO: 2110080 - RNA, 14 nt, Human
uugaaccaaaacau

SEQ ID NO: 2110081 - RNA, 15 nt, Human
uugaaccaaaacauu

SEQ ID NO: 2110082 - RNA, 18 nt, Human
uugaaccaaaacauuccg

SEQ ID NO: 2110083 - RNA, 13 nt, Human
uugaacacugggg

SEQ ID NO: 2110084 - RNA, 13 nt, Human
uugaacacaguau

SEQ ID NO: 2110085 - RNA, 14 nt, Human
uugaacacaguauu

SEQ ID NO: 2110086 - RNA, 18 nt, Human
uugaacacaguauuuucc

SEQ ID NO: 2110087 - RNA, 20 nt, Human
uugaacacaguauuuuccca

SEQ ID NO: 2110088 - RNA, 17 nt, Human
uugaacccaggaguuca

SEQ ID NO: 2110089 - RNA, 12 nt, Human
uugaacccagga

SEQ ID NO: 2110090 - RNA, 13 nt, Human
uugaacccaggag

SEQ ID NO: 2110091 - RNA, 19 nt, Human
auccuaaguuaccuuucua

SEQ ID NO: 2110092 - RNA, 21 nt, Human
uugaaaugaaaguauaacuga

SEQ ID NO: 2110093 - RNA, 21 nt, Human
uugaaauuuuuauuaaauuau

SEQ ID NO: 2110094 - RNA, 20 nt, Human
uugaacaaguuguuucauug

SEQ ID NO: 2110095 - RNA, 17 nt, Human
uugaaaguuuucagaac

SEQ ID NO: 2110096 - RNA, 15 nt, Human
uugaaauaauaaauc

SEQ ID NO: 2110097 - RNA, 16 nt, Human
uugaaauauaaugcaa

SEQ ID NO: 2110098 - RNA, 19 nt, Human
uugaaauauaaugcaaacc

SEQ ID NO: 2110099 - RNA, 16 nt, Human
uucuuuuuauuuucuu

SEQ ID NO: 2110100 - RNA, 16 nt, Human
uucuuuuuauuuuuua

SEQ ID NO: 2110101 - RNA, 15 nt, Human
uucuuuuuauuuucu

SEQ ID NO: 2110102 - RNA, 21 nt, Human
uucuuuuauaaaaaaaaugaa

SEQ ID NO: 2110103 - RNA, 12 nt, Human
uucuuuuaucac

SEQ ID NO: 2110104 - RNA, 19 nt, Human
uucuuuuacucaugaucuu

SEQ ID NO: 2110105 - RNA, 23 nt, Human
uucuuuucgccguggcugcggca

SEQ ID NO: 2110106 - RNA, 22 nt, Human
aucagacuagugacaagcuccu

SEQ ID NO: 2110107 - RNA, 18 nt, Human
aucagacuucacacugca

SEQ ID NO: 2110108 - RNA, 14 nt, Human
aucagacccuaccc

SEQ ID NO: 2110109 - RNA, 15 nt, Human
aucagacccuacccc

SEQ ID NO: 2110110 - RNA, 16 nt, Human
aucagacccuacccca

SEQ ID NO: 2110111 - RNA, 18 nt, Human
aucagacccuaccccacc

SEQ ID NO: 2110112 - RNA, 19 nt, Human
aucagacccuaccccacca

SEQ ID NO: 2110113 - RNA, 20 nt, Human
aucagacccuaccccaccac

SEQ ID NO: 2110114 - RNA, 13 nt, Human
uucucagcuccca

SEQ ID NO: 2110115 - RNA, 13 nt, Human
uucucagaaucuc

SEQ ID NO: 2110116 - RNA, 13 nt, Human
uucucagauauuu

SEQ ID NO: 2110117 - RNA, 14 nt, Human
uucucagauauuua

SEQ ID NO: 2110118 - RNA, 15 nt, Human
uucucagauauuuau

SEQ ID NO: 2110119 - RNA, 20 nt, Human
uucucagauauuuauauuuu

SEQ ID NO: 2110120 - RNA, 14 nt, Human
aucacuuuucugua

SEQ ID NO: 2110121 - RNA, 12 nt, Human
aucacuuugcuc

SEQ ID NO: 2110122 - RNA, 15 nt, Human
aucacuuugcucuga

SEQ ID NO: 2110123 - RNA, 20 nt, Human
uucuagagccugcuggaucu

SEQ ID NO: 2110124 - RNA, 21 nt, Human
uucuagagagggaauucucuu

SEQ ID NO: 2110125 - RNA, 21 nt, Human
uucuagaacaucccugccagc

SEQ ID NO: 2110126 - RNA, 22 nt, Human
uucuagaacaucccugccagcu

SEQ ID NO: 2110127 - RNA, 15 nt, Human
uucuagaauuuauca

SEQ ID NO: 2110128 - RNA, 21 nt, Human
uucuagaauuuaucacacuuc

SEQ ID NO: 2110129 - RNA, 21 nt, Human
uucucacugccaugccagcuu

SEQ ID NO: 2110130 - RNA, 20 nt, Human
uucgauacaccgggccugga

SEQ ID NO: 2110131 - RNA, 22 nt, Human
uucgagcuauauuuaaguauuc

SEQ ID NO: 2110132 - RNA, 21 nt, Human
uucgaugggcccaauucuuac

SEQ ID NO: 2110133 - RNA, 20 nt, Human
uucgaugggcccaauucuua

SEQ ID NO: 2110134 - RNA, 18 nt, Human
uucgaucucauucaguau

SEQ ID NO: 2110135 - RNA, 21 nt, Human
uucgcaggauucuuccucccu

SEQ ID NO: 2110136 - RNA, 19 nt, Human
uucgcccaaagccagacag

SEQ ID NO: 2110137 - RNA, 14 nt, Human
uucgccguggcugc

SEQ ID NO: 2110138 - RNA, 20 nt, Human
uucgccguggcugcggcacc

SEQ ID NO: 2110139 - RNA, 21 nt, Human
uucgccguggcugcggcaccc

SEQ ID NO: 2110140 - RNA, 14 nt, Human
uucgagaccagccu

SEQ ID NO: 2110141 - RNA, 18 nt, Human
uucgagaccaaccugacc

SEQ ID NO: 2110142 - RNA, 19 nt, Human
uucgagaccagccuggcca

SEQ ID NO: 2110143 - RNA, 17 nt, Human
uucgagaccagccuggc

SEQ ID NO: 2110144 - RNA, 16 nt, Human
uucgagaccagccugg

SEQ ID NO: 2110145 - RNA, 15 nt, Human
uucgagaccagccug

SEQ ID NO: 2110146 - RNA, 19 nt, Human
uucgacugugaccuguggg

SEQ ID NO: 2110147 - RNA, 22 nt, Human
uucgaagcucagcccacccccc

SEQ ID NO: 2110148 - RNA, 14 nt, Human
uucgaagcucagcc

SEQ ID NO: 2110149 - RNA, 16 nt, Human
uucgaagcucagccca

SEQ ID NO: 2110150 - RNA, 15 nt, Human
aucaauaaaauguga

SEQ ID NO: 2110151 - RNA, 16 nt, Human
aucaauaaaaugugau

SEQ ID NO: 2110152 - RNA, 17 nt, Human
aucaauaaaaugugauu

SEQ ID NO: 2110153 - RNA, 18 nt, Human
uucuaaccagagcaagcu

SEQ ID NO: 2110154 - RNA, 16 nt, Human
uucuaacucugaugua

SEQ ID NO: 2110155 - RNA, 17 nt, Human
uucuaacucugauguaa

SEQ ID NO: 2110156 - RNA, 23 nt, Human
uucuaacucugauguaaaugaag

SEQ ID NO: 2110157 - RNA, 15 nt, Human
uucuaacuccaguga

SEQ ID NO: 2110158 - RNA, 14 nt, Human
uucuaaggaauaug

SEQ ID NO: 2110159 - RNA, 18 nt, Human
uucuaaggaauaugagcu

SEQ ID NO: 2110160 - RNA, 22 nt, Human
uucuaaauaaaauauaauuguu

SEQ ID NO: 2110161 - RNA, 23 nt, Human
uucuaaauaaaauauaauuguuu

SEQ ID NO: 2110162 - RNA, 13 nt, Human
uucuaaauagcaa

SEQ ID NO: 2110163 - RNA, 13 nt, Human
uucgcuccugugu

SEQ ID NO: 2110164 - RNA, 13 nt, Human
uucccuacuuccu

SEQ ID NO: 2110165 - RNA, 23 nt, Human
uuccccuugcccagggcucagcc

SEQ ID NO: 2110166 - RNA, 22 nt, Human
uuccccuugcccagggcucagc

SEQ ID NO: 2110167 - RNA, 16 nt, Human
uucccuacuuccugug

SEQ ID NO: 2110168 - RNA, 14 nt, Human
uucccuacuuccug

SEQ ID NO: 2110169 - RNA, 17 nt, Human
uucccuacuuccuguga

SEQ ID NO: 2110170 - RNA, 18 nt, Human
uucccuagggcugggugu

SEQ ID NO: 2110171 - RNA, 12 nt, Human
uucccuaucacu

SEQ ID NO: 2110172 - RNA, 14 nt, Human
uuccccuguucacu

SEQ ID NO: 2110173 - RNA, 17 nt, Human
uuccccuguucacucua

SEQ ID NO: 2110174 - RNA, 13 nt, Human
uucccuaucuuuu

SEQ ID NO: 2110175 - RNA, 17 nt, Human
uucccuuuuacauacug

SEQ ID NO: 2110176 - RNA, 18 nt, Human
uucccuuuuacauacugc

SEQ ID NO: 2110177 - RNA, 19 nt, Human
uucccuuuuacauacugcu

SEQ ID NO: 2110178 - RNA, 21 nt, Human
uucccuuuuacauacugcugu

SEQ ID NO: 2110179 - RNA, 14 nt, Human
uucccccucuccca

SEQ ID NO: 2110180 - RNA, 18 nt, Human
uucccccucucccaguug

SEQ ID NO: 2110181 - RNA, 17 nt, Human
uucccccucucccaguu

SEQ ID NO: 2110182 - RNA, 15 nt, Human
uucccccucccaggg

SEQ ID NO: 2110183 - RNA, 17 nt, Human
uuccccggucccuugag

SEQ ID NO: 2110184 - RNA, 19 nt, Human
uuccccuaaccucauuccc

SEQ ID NO: 2110185 - RNA, 19 nt, Human
uuccccgcauuccaggcuc

SEQ ID NO: 2110186 - RNA, 16 nt, Human
uuccccggucccuuga

SEQ ID NO: 2110187 - RNA, 17 nt, Human
uuccccuccuucucccu

SEQ ID NO: 2110188 - RNA, 18 nt, Human
uuccccuccuucucccuu

SEQ ID NO: 2110189 - RNA, 13 nt, Human
uuccccucccugg

SEQ ID NO: 2110190 - RNA, 16 nt, Human
uuccccucccuggcuc

SEQ ID NO: 2110191 - RNA, 17 nt, Human
uuccccucccuggcucc

SEQ ID NO: 2110192 - RNA, 19 nt, Human
uucccagagacaggaaaau

SEQ ID NO: 2110193 - RNA, 22 nt, Human
uucccagagacaggaaaauccu

SEQ ID NO: 2110194 - RNA, 15 nt, Human
uucccagagacagga

SEQ ID NO: 2110195 - RNA, 11 nt, Human
auauuuuaauu

SEQ ID NO: 2110196 - RNA, 14 nt, Human
auauuuuaagcauu

SEQ ID NO: 2110197 - RNA, 15 nt, Human
auauuuuaagcauua

SEQ ID NO: 2110198 - RNA, 17 nt, Human
auauuuuaagcauuacu

SEQ ID NO: 2110199 - RNA, 21 nt, Human
auauuuuaagcauuacucuug

SEQ ID NO: 2110200 - RNA, 23 nt, Human
auauuuuaagcauuacucuugua

SEQ ID NO: 2110201 - RNA, 14 nt, Human
uucccagauacuuc

SEQ ID NO: 2110202 - RNA, 22 nt, Human
aucaaccccuucgcuccugugu

SEQ ID NO: 2110203 - RNA, 20 nt, Human
aucaaccccuucgcuccugu

SEQ ID NO: 2110204 - RNA, 19 nt, Human
aucaaccccuucgcuccug

SEQ ID NO: 2110205 - RNA, 23 nt, Human
aucaaguuggcuucuaaucaaag

SEQ ID NO: 2110206 - RNA, 15 nt, Human
aucaaguuuccaagc

SEQ ID NO: 2110207 - RNA, 18 nt, Human
aucaaguuuccaagcaaa

SEQ ID NO: 2110208 - RNA, 20 nt, Human
aucaaguuuccaagcaaaug

SEQ ID NO: 2110209 - RNA, 21 nt, Human
aucaaguuuccaagcaaaugu

SEQ ID NO: 2110210 - RNA, 22 nt, Human
aucaaguuuccaagcaaauguu

SEQ ID NO: 2110211 - RNA, 23 nt, Human
aucaaguuuccaagcaaauguua

SEQ ID NO: 2110212 - RNA, 22 nt, Human
aucaaguuggcuucuaaucaaa

SEQ ID NO: 2110213 - RNA, 22 nt, Human
aucaaguuauugacaaacucuc

SEQ ID NO: 2110214 - RNA, 17 nt, Human
aucaaguggcaugugcu

SEQ ID NO: 2110215 - RNA, 12 nt, Human
aucaagucaccg

SEQ ID NO: 2110216 - RNA, 19 nt, Human
auauuuuuauagacaaaua

SEQ ID NO: 2110217 - RNA, 19 nt, Human
auauuuucuuccaagcaaa

SEQ ID NO: 2110218 - RNA, 15 nt, Human
auauuuuuaauaaaa

SEQ ID NO: 2110219 - RNA, 19 nt, Human
auauuuuuaauaaaaguug

SEQ ID NO: 2110220 - RNA, 15 nt, Human
auauuuuuaauuaaa

SEQ ID NO: 2110221 - RNA, 13 nt, Human
auauuuuuauaga

SEQ ID NO: 2110222 - RNA, 14 nt, Human
auauuuuuauagac

SEQ ID NO: 2110223 - RNA, 17 nt, Human
uuccuucacauccugug

SEQ ID NO: 2110224 - RNA, 21 nt, Human
uuccuuagcuuagaccucagc

SEQ ID NO: 2110225 - RNA, 14 nt, Human
uuccuuagcauugu

SEQ ID NO: 2110226 - RNA, 20 nt, Human
uuccuuagcuuagaccucag

SEQ ID NO: 2110227 - RNA, 22 nt, Human
uuccuuagcuuagaccucagcc

SEQ ID NO: 2110228 - RNA, 23 nt, Human
uuccuuagcuuagaccucagccu

SEQ ID NO: 2110229 - RNA, 23 nt, Human
uuccuuauguauauuuaaaagaa

SEQ ID NO: 2110230 - RNA, 23 nt, Human
auauuuucuuccaagcaaaggug

SEQ ID NO: 2110231 - RNA, 18 nt, Human
auauuuuccaugaaaaug

SEQ ID NO: 2110232 - RNA, 16 nt, Human
auauuuuccaugaaaa

SEQ ID NO: 2110233 - RNA, 18 nt, Human
uuccuacuuuuccuuccc

SEQ ID NO: 2110234 - RNA, 19 nt, Human
uuccuacuuuuccuucccu

SEQ ID NO: 2110235 - RNA, 12 nt, Human
uuccucuccacu

SEQ ID NO: 2110236 - RNA, 21 nt, Human
uuccucucauccuuuucuccu

SEQ ID NO: 2110237 - RNA, 23 nt, Human
uuccucucauccuuuucuccuau

SEQ ID NO: 2110238 - RNA, 15 nt, Human
uuccucuccacugcc

SEQ ID NO: 2110239 - RNA, 14 nt, Human
uuccucuccacugc

SEQ ID NO: 2110240 - RNA, 13 nt, Human
uuccucuccacug

SEQ ID NO: 2110241 - RNA, 15 nt, Human
uuccuguccagagag

SEQ ID NO: 2110242 - RNA, 14 nt, Human
augauuuuuaaaga

SEQ ID NO: 2110243 - RNA, 14 nt, Human
augauuuuacuuag

SEQ ID NO: 2110244 - RNA, 21 nt, Human
augauuuuacuuagcaauguu

SEQ ID NO: 2110245 - RNA, 16 nt, Human
augauuuuuaaagaaa

SEQ ID NO: 2110246 - RNA, 13 nt, Human
augcaccagcccu

SEQ ID NO: 2110247 - RNA, 14 nt, Human
augcacaucccugg

SEQ ID NO: 2110248 - RNA, 13 nt, Human
augcacauuucau

SEQ ID NO: 2110249 - RNA, 14 nt, Human
augcaacaacaugu

SEQ ID NO: 2110250 - RNA, 16 nt, Human
augcaacaacauguau

SEQ ID NO: 2110251 - RNA, 21 nt, Human
augcaacaacauguauaauau

SEQ ID NO: 2110252 - RNA, 14 nt, Human
augcaccagcccuu

SEQ ID NO: 2110253 - RNA, 14 nt, Human
augcaaauucucaa

SEQ ID NO: 2110254 - RNA, 15 nt, Human
augauuaguaaagaa

SEQ ID NO: 2110255 - RNA, 14 nt, Human
augauuagcaaguu

SEQ ID NO: 2110256 - RNA, 23 nt, Human
augauuagcaaguuacagugaug

SEQ ID NO: 2110257 - RNA, 20 nt, Human
augauuaaccacuucagcug

SEQ ID NO: 2110258 - RNA, 21 nt, Human
augauuaaccacuucagcuga

SEQ ID NO: 2110259 - RNA, 19 nt, Human
augauuaaccacuucagcu

SEQ ID NO: 2110260 - RNA, 11 nt, Human
uuguggccuca

SEQ ID NO: 2110261 - RNA, 12 nt, Human
uuguggccucag

SEQ ID NO: 2110262 - RNA, 18 nt, Human
uugugagccaccacgucc

SEQ ID NO: 2110263 - RNA, 20 nt, Human
uugugaggcccaugguugag

SEQ ID NO: 2110264 - RNA, 13 nt, Human
uuguggccuggga

SEQ ID NO: 2110265 - RNA, 13 nt, Human
uuguggccucaga

SEQ ID NO: 2110266 - RNA, 15 nt, Human
uuguggcugucagca

SEQ ID NO: 2110267 - RNA, 20 nt, Human
uuguggcugucagcaggaag

SEQ ID NO: 2110268 - RNA, 14 nt, Human
uuguggcugggggc

SEQ ID NO: 2110269 - RNA, 16 nt, Human
augagacugaacugug

SEQ ID NO: 2110270 - RNA, 11 nt, Human
uugugagagcg

SEQ ID NO: 2110271 - RNA, 15 nt, Human
uugugagagcgaggc

SEQ ID NO: 2110272 - RNA, 13 nt, Human
uugugacuagugc

SEQ ID NO: 2110273 - RNA, 16 nt, Human
uugugacuagugcuga

SEQ ID NO: 2110274 - RNA, 17 nt, Human
uugugacuagugcugaa

SEQ ID NO: 2110275 - RNA, 21 nt, Human
uugugacuagugcugaagcuu

SEQ ID NO: 2110276 - RNA, 23 nt, Human
uugugacuagugcugaagcuuau

SEQ ID NO: 2110277 - RNA, 22 nt, Human
uugugacuagugcugaagcuua

SEQ ID NO: 2110278 - RNA, 15 nt, Human
uuguguguuauuuaa

SEQ ID NO: 2110279 - RNA, 16 nt, Human
uuguguguuauuuaaa

SEQ ID NO: 2110280 - RNA, 20 nt, Human
uuguguaagagaauguugaa

SEQ ID NO: 2110281 - RNA, 22 nt, Human
uuguguaagagaauguugaaua

SEQ ID NO: 2110282 - RNA, 14 nt, Human
uuguguaauaaagu

SEQ ID NO: 2110283 - RNA, 16 nt, Human
uuguguaauaaagugu

SEQ ID NO: 2110284 - RNA, 13 nt, Human
uugugguuaaucu

SEQ ID NO: 2110285 - RNA, 14 nt, Human
uugugguuauuuuu

SEQ ID NO: 2110286 - RNA, 19 nt, Human
uugugguuauuuuuauaca

SEQ ID NO: 2110287 - RNA, 13 nt, Human
uugugguuuguug

SEQ ID NO: 2110288 - RNA, 12 nt, Human
uugugugugugc

SEQ ID NO: 2110289 - RNA, 20 nt, Human
uuguguguuauuuaaaugag

SEQ ID NO: 2110290 - RNA, 21 nt, Human
uuguguguuauuuaaaugagu

SEQ ID NO: 2110291 - RNA, 15 nt, Human
augcaguuuuccuua

SEQ ID NO: 2110292 - RNA, 15 nt, Human
augcauaaagucagu

SEQ ID NO: 2110293 - RNA, 14 nt, Human
augccaacuugucc

SEQ ID NO: 2110294 - RNA, 22 nt, Human
augccaaagcuaggguggcccu

SEQ ID NO: 2110295 - RNA, 20 nt, Human
augccacccuguuuucagcu

SEQ ID NO: 2110296 - RNA, 22 nt, Human
augccacgcgguacaaaggaaa

SEQ ID NO: 2110297 - RNA, 23 nt, Human
augccacgcgguacaaaggaaaa

SEQ ID NO: 2110298 - RNA, 20 nt, Human
augcccagagggcccaggca

SEQ ID NO: 2110299 - RNA, 21 nt, Human
augcccagagggcccaggcag

SEQ ID NO: 2110300 - RNA, 22 nt, Human
augcccagagggcccaggcagg

SEQ ID NO: 2110301 - RNA, 23 nt, Human
augcccagagggcccaggcaggc

SEQ ID NO: 2110302 - RNA, 20 nt, Human
augcccaccugcccaucaca

SEQ ID NO: 2110303 - RNA, 21 nt, Human
augcccaccugcccaucacag

SEQ ID NO: 2110304 - RNA, 15 nt, Human
augcccaccugccca

SEQ ID NO: 2110305 - RNA, 16 nt, Human
augcccaccugcccau

SEQ ID NO: 2110306 - RNA, 19 nt, Human
augcccaccugcccaucac

SEQ ID NO: 2110307 - RNA, 16 nt, Human
augcagugaauuguga

SEQ ID NO: 2110308 - RNA, 17 nt, Human
augcagugccuuucuuc

SEQ ID NO: 2110309 - RNA, 17 nt, Human
augcaggggcaaacacc

SEQ ID NO: 2110310 - RNA, 20 nt, Human
augcaggggcaaacaccugc

SEQ ID NO: 2110311 - RNA, 22 nt, Human
augcaggggcaaacaccugcug

SEQ ID NO: 2110312 - RNA, 14 nt, Human
uuuaauuuuguaaa

SEQ ID NO: 2110313 - RNA, 19 nt, Human
uuuaaauucacaauagaaa

SEQ ID NO: 2110314 - RNA, 21 nt, Human
uuuaaauucacaauagaaacu

SEQ ID NO: 2110315 - RNA, 20 nt, Human
uuuaaauuauaacuuaaaau

SEQ ID NO: 2110316 - RNA, 15 nt, Human
uuuaaauuauaagga

SEQ ID NO: 2110317 - RNA, 16 nt, Human
uuuaaauuauaaggac

SEQ ID NO: 2110318 - RNA, 17 nt, Human
uuuaaauuauaaggacu

SEQ ID NO: 2110319 - RNA, 18 nt, Human
uuuaaauuauaaggacug

SEQ ID NO: 2110320 - RNA, 19 nt, Human
uuuaaauuauaaggacugc

SEQ ID NO: 2110321 - RNA, 20 nt, Human
uuuaaauuauaaggacugca

SEQ ID NO: 2110322 - RNA, 21 nt, Human
uuuaaauuauaaggacugcau

SEQ ID NO: 2110323 - RNA, 22 nt, Human
uuuaaauuauaaggacugcaug

SEQ ID NO: 2110324 - RNA, 15 nt, Human
uuuaagauaaauuau

SEQ ID NO: 2110325 - RNA, 15 nt, Human
uuuaagcauuacucu

SEQ ID NO: 2110326 - RNA, 16 nt, Human
uuuaagcauuacucuu

SEQ ID NO: 2110327 - RNA, 20 nt, Human
uuuaagcauuacucuuguaa

SEQ ID NO: 2110328 - RNA, 21 nt, Human
uuuaagcauuacucuuguaag

SEQ ID NO: 2110329 - RNA, 23 nt, Human
uuuaagcauuacucuuguaagau

SEQ ID NO: 2110330 - RNA, 13 nt, Human
uuuaagcauuguu

SEQ ID NO: 2110331 - RNA, 14 nt, Human
uuuaagcauuguuu

SEQ ID NO: 2110332 - RNA, 21 nt, Human
uuuaagcauuguuugcuuauu

SEQ ID NO: 2110333 - RNA, 22 nt, Human
uuuaagaugugucuucaauuug

SEQ ID NO: 2110334 - RNA, 17 nt, Human
uuuaagauuccuuuucu

SEQ ID NO: 2110335 - RNA, 18 nt, Human
uuuaagauuccuuuucuu

SEQ ID NO: 2110336 - RNA, 22 nt, Human
uuuaagauuccuuuucuuguuu

SEQ ID NO: 2110337 - RNA, 11 nt, Human
uuuaagauuua

SEQ ID NO: 2110338 - RNA, 22 nt, Human
uuuaagauuuaauuugccaaaa

SEQ ID NO: 2110339 - RNA, 13 nt, Human
uuguuuucagugu

SEQ ID NO: 2110340 - RNA, 16 nt, Human
uuguuuucaguguaca

SEQ ID NO: 2110341 - RNA, 15 nt, Human
uuuaauugaaggaaa

SEQ ID NO: 2110342 - RNA, 16 nt, Human
uuuaauugaaggaaag

SEQ ID NO: 2110343 - RNA, 19 nt, Human
uuuaauugaaggaaagauu

SEQ ID NO: 2110344 - RNA, 12 nt, Human
uuuaauuguaaa

SEQ ID NO: 2110345 - RNA, 15 nt, Human
uuuaauuguaaacug

SEQ ID NO: 2110346 - RNA, 16 nt, Human
uuuaauuguaaacugu

SEQ ID NO: 2110347 - RNA, 17 nt, Human
uuuaauuguaaacugua

SEQ ID NO: 2110348 - RNA, 19 nt, Human
uuuaauuguaaacuguacu

SEQ ID NO: 2110349 - RNA, 18 nt, Human
uuuaauuugaugaaagcu

SEQ ID NO: 2110350 - RNA, 19 nt, Human
uuuaauuugaugaaagcug

SEQ ID NO: 2110351 - RNA, 21 nt, Human
uuuaauuugaugaaagcugau

SEQ ID NO: 2110352 - RNA, 22 nt, Human
uuuaauuugaugaaagcugauu

SEQ ID NO: 2110353 - RNA, 20 nt, Human
uuuaauuugccaaaauaaug

SEQ ID NO: 2110354 - RNA, 21 nt, Human
uuuaauuugccaaaauaaugu

SEQ ID NO: 2110355 - RNA, 23 nt, Human
uuuaauucauguuucuuaaaugg

SEQ ID NO: 2110356 - RNA, 14 nt, Human
uuuaauucauguuu

SEQ ID NO: 2110357 - RNA, 16 nt, Human
uuuaauucauguuucu

SEQ ID NO: 2110358 - RNA, 19 nt, Human
uuuaauggggugcaccugu

SEQ ID NO: 2110359 - RNA, 20 nt, Human
uuuaagcccaucaauuauag

SEQ ID NO: 2110360 - RNA, 23 nt, Human
uuuaagcauuguuugcuuauugu

SEQ ID NO: 2110361 - RNA, 22 nt, Human
uuuaugggucagaguuccgacu

SEQ ID NO: 2110362 - RNA, 14 nt, Human
uuuauauaauuaug

SEQ ID NO: 2110363 - RNA, 17 nt, Human
uuuauauaauuauguua

SEQ ID NO: 2110364 - RNA, 19 nt, Human
uuuauauaauuauguuauu

SEQ ID NO: 2110365 - RNA, 22 nt, Human
uuuauggggcugaacggggaga

SEQ ID NO: 2110366 - RNA, 16 nt, Human
uuuauagcucaguuua

SEQ ID NO: 2110367 - RNA, 15 nt, Human
uuuauaguuuauaca

SEQ ID NO: 2110368 - RNA, 18 nt, Human
uuuauaguuuauacaguu

SEQ ID NO: 2110369 - RNA, 12 nt, Human
uuuauauaauaa

SEQ ID NO: 2110370 - RNA, 15 nt, Human
uuuauauaauaaagu

SEQ ID NO: 2110371 - RNA, 17 nt, Human
uuuauauaauaaaguau

SEQ ID NO: 2110372 - RNA, 20 nt, Human
uuuauauaauaaaguauucc

SEQ ID NO: 2110373 - RNA, 21 nt, Human
uuuauauaauaaaguauucca

SEQ ID NO: 2110374 - RNA, 13 nt, Human
uuuauuaaaaucu

SEQ ID NO: 2110375 - RNA, 12 nt, Human
uuuauguuuugu

SEQ ID NO: 2110376 - RNA, 17 nt, Human
uuuauguuuuguuucug

SEQ ID NO: 2110377 - RNA, 18 nt, Human
uuuauguuuuguuucuga

SEQ ID NO: 2110378 - RNA, 20 nt, Human
uuuauguuuuguuucugaaa

SEQ ID NO: 2110379 - RNA, 14 nt, Human
uuuauuaaaaucuu

SEQ ID NO: 2110380 - RNA, 15 nt, Human
uuuauuaaaaucuua

SEQ ID NO: 2110381 - RNA, 16 nt, Human
uuuauuaaaaucuuaa

SEQ ID NO: 2110382 - RNA, 18 nt, Human
uuuaugugugaggagcug

SEQ ID NO: 2110383 - RNA, 22 nt, Human
uuuaugugugaggagcugcugg

SEQ ID NO: 2110384 - RNA, 16 nt, Human
uuuagcuguaucaaac

SEQ ID NO: 2110385 - RNA, 15 nt, Human
uuuaguagagacagg

SEQ ID NO: 2110386 - RNA, 14 nt, Human
uuuagcaguucugc

SEQ ID NO: 2110387 - RNA, 15 nt, Human
uuuagcaguucugca

SEQ ID NO: 2110388 - RNA, 15 nt, Human
augccccagagcugu

SEQ ID NO: 2110389 - RNA, 14 nt, Human
uuuagauugaguaa

SEQ ID NO: 2110390 - RNA, 14 nt, Human
uuuagaugguuaca

SEQ ID NO: 2110391 - RNA, 17 nt, Human
uuuagaugguuacacug

SEQ ID NO: 2110392 - RNA, 18 nt, Human
uuuagaugguuacacugu

SEQ ID NO: 2110393 - RNA, 20 nt, Human
uuuagaugguuacacuguua

SEQ ID NO: 2110394 - RNA, 14 nt, Human
uuuagcacaaaaaa

SEQ ID NO: 2110395 - RNA, 13 nt, Human
uuuagcaccccca

SEQ ID NO: 2110396 - RNA, 18 nt, Human
uuuagcacguuuaaaguu

SEQ ID NO: 2110397 - RNA, 19 nt, Human
uuuagcacguuuaaaguuc

SEQ ID NO: 2110398 - RNA, 21 nt, Human
uuuagcacguuuaaaguucug

SEQ ID NO: 2110399 - RNA, 22 nt, Human
uuuagcacguuuaaaguucugu

SEQ ID NO: 2110400 - RNA, 18 nt, Human
uuuagcagaaucaaaaug

SEQ ID NO: 2110401 - RNA, 13 nt, Human
augcugguuuuuc

SEQ ID NO: 2110402 - RNA, 22 nt, Human
augcugguuuuccuaaaugcag

SEQ ID NO: 2110403 - RNA, 15 nt, Human
augcucugcauguua

SEQ ID NO: 2110404 - RNA, 23 nt, Human
augcucucugcagccagcccagc

SEQ ID NO: 2110405 - RNA, 15 nt, Human
uuuauuacccuucuu

SEQ ID NO: 2110406 - RNA, 14 nt, Human
augcucuccuuucc

SEQ ID NO: 2110407 - RNA, 13 nt, Human
augcucucugcag

SEQ ID NO: 2110408 - RNA, 19 nt, Human
augcucucugcagccagcc

SEQ ID NO: 2110409 - RNA, 21 nt, Human
augcucucugcagccagccca

SEQ ID NO: 2110410 - RNA, 22 nt, Human
augcucucugcagccagcccag

SEQ ID NO: 2110411 - RNA, 23 nt, Human
augcuggcauuugcaccuaccuc

SEQ ID NO: 2110412 - RNA, 20 nt, Human
uuuauuaccucugauaccuc

SEQ ID NO: 2110413 - RNA, 14 nt, Human
uuuauuaccucuga

SEQ ID NO: 2110414 - RNA, 13 nt, Human
uuuauuaccucug

SEQ ID NO: 2110415 - RNA, 16 nt, Human
uuuauuacaucuuuca

SEQ ID NO: 2110416 - RNA, 22 nt, Human
auggaacucauuccugccuguc

SEQ ID NO: 2110417 - RNA, 21 nt, Human
auggaacucuagggauaguca

SEQ ID NO: 2110418 - RNA, 15 nt, Human
augcuucaugaaaau

SEQ ID NO: 2110419 - RNA, 18 nt, Human
augcuucaugaaaauccu

SEQ ID NO: 2110420 - RNA, 21 nt, Human
augcuucaugaaaauccuacc

SEQ ID NO: 2110421 - RNA, 19 nt, Human
auggaacucauuccugccu

SEQ ID NO: 2110422 - RNA, 13 nt, Human
auggccuuugcuu

SEQ ID NO: 2110423 - RNA, 19 nt, Human
auggcgauucccauugaaa

SEQ ID NO: 2110424 - RNA, 21 nt, Human
auggcgauucccauugaaaau

SEQ ID NO: 2110425 - RNA, 22 nt, Human
auggcgauucccauugaaaaug

SEQ ID NO: 2110426 - RNA, 19 nt, Human
auggccugccuugaagcca

SEQ ID NO: 2110427 - RNA, 20 nt, Human
auggccugccuugaagccac

SEQ ID NO: 2110428 - RNA, 13 nt, Human
auggccucagcug

SEQ ID NO: 2110429 - RNA, 15 nt, Human
auggccucagcugcc

SEQ ID NO: 2110430 - RNA, 14 nt, Human
auggccucagcugc

SEQ ID NO: 2110431 - RNA, 16 nt, Human
auggccagguggccac

SEQ ID NO: 2110432 - RNA, 22 nt, Human
auggccagguggccacuccaga

SEQ ID NO: 2110433 - RNA, 21 nt, Human
auggccgggcgcgguggcuca

SEQ ID NO: 2110434 - RNA, 13 nt, Human
auggccggccggg

SEQ ID NO: 2110435 - RNA, 19 nt, Human
auggcaccaaagccaccag

SEQ ID NO: 2110436 - RNA, 19 nt, Human
auggcaaggacugcaggga

SEQ ID NO: 2110437 - RNA, 23 nt, Human
auggcaauucuuugaccucaacc

SEQ ID NO: 2110438 - RNA, 23 nt, Human
auggcacagcccaaagaaggaaa

SEQ ID NO: 2110439 - RNA, 18 nt, Human
auggauuuccagccaaag

SEQ ID NO: 2110440 - RNA, 21 nt, Human
auggauuugccugugccaccc

SEQ ID NO: 2110441 - RNA, 14 nt, Human
auggauuugccugu

SEQ ID NO: 2110442 - RNA, 18 nt, Human
uuucacugcuggcugccu

SEQ ID NO: 2110443 - RNA, 17 nt, Human
uuucacugcuggcugcc

SEQ ID NO: 2110444 - RNA, 14 nt, Human
uuucacugcuggcu

SEQ ID NO: 2110445 - RNA, 22 nt, Human
uuucacugcuggcugccuuaga

SEQ ID NO: 2110446 - RNA, 20 nt, Human
uuucacugcuggcugccuua

SEQ ID NO: 2110447 - RNA, 15 nt, Human
auggaauacaguguu

SEQ ID NO: 2110448 - RNA, 16 nt, Human
auggaauacaguguua

SEQ ID NO: 2110449 - RNA, 17 nt, Human
auggaauacaguguuau

SEQ ID NO: 2110450 - RNA, 22 nt, Human
auggaauacaguguuauuuucu

SEQ ID NO: 2110451 - RNA, 18 nt, Human
uuucagaaccucuucccc

SEQ ID NO: 2110452 - RNA, 19 nt, Human
uuucagaaccucuucccca

SEQ ID NO: 2110453 - RNA, 20 nt, Human
uuucagaaccucuuccccag

SEQ ID NO: 2110454 - RNA, 23 nt, Human
uuucagaaccucuuccccagaaa

SEQ ID NO: 2110455 - RNA, 14 nt, Human
uuucagaccccagc

SEQ ID NO: 2110456 - RNA, 11 nt, Human
uuucagaaucu

SEQ ID NO: 2110457 - RNA, 14 nt, Human
uuucagaaucugaa

SEQ ID NO: 2110458 - RNA, 17 nt, Human
uuucagaaucugaaugu

SEQ ID NO: 2110459 - RNA, 19 nt, Human
uuucagaaucugaauguaa

SEQ ID NO: 2110460 - RNA, 20 nt, Human
uuucagaaucugaauguaau

SEQ ID NO: 2110461 - RNA, 23 nt, Human
uuucagaaucugaauguaauuug

SEQ ID NO: 2110462 - RNA, 10 nt, Human
uuucagaccc

SEQ ID NO: 2110463 - RNA, 14 nt, Human
auggacaugaucuu

SEQ ID NO: 2110464 - RNA, 19 nt, Human
auggacagaagaaggcagc

SEQ ID NO: 2110465 - RNA, 20 nt, Human
auggacagaagaaggcagca

SEQ ID NO: 2110466 - RNA, 15 nt, Human
uuucccccaaagugg

SEQ ID NO: 2110467 - RNA, 19 nt, Human
uuuccccccacucucccca

SEQ ID NO: 2110468 - RNA, 17 nt, Human
uuuccccccacucuccc

SEQ ID NO: 2110469 - RNA, 12 nt, Human
uuuccccccacu

SEQ ID NO: 2110470 - RNA, 13 nt, Human
uuuccccccacuc

SEQ ID NO: 2110471 - RNA, 13 nt, Human
uuucauuaaagca

SEQ ID NO: 2110472 - RNA, 14 nt, Human
uuucauuaaagcau

SEQ ID NO: 2110473 - RNA, 16 nt, Human
uuucauuaaagcauuu

SEQ ID NO: 2110474 - RNA, 21 nt, Human
uuucaugauuagcaaguuaca

SEQ ID NO: 2110475 - RNA, 17 nt, Human
augagaaaaugucuuua

SEQ ID NO: 2110476 - RNA, 13 nt, Human
augacuucccaac

SEQ ID NO: 2110477 - RNA, 23 nt, Human
augaccaauauuauacuaagaaa

SEQ ID NO: 2110478 - RNA, 22 nt, Human
augaauuuuuuucaucuucucu

SEQ ID NO: 2110479 - RNA, 21 nt, Human
augaauuuuuuucaucuucuc

SEQ ID NO: 2110480 - RNA, 14 nt, Human
augacaaugaugau

SEQ ID NO: 2110481 - RNA, 18 nt, Human
augagaaggaauuugagu

SEQ ID NO: 2110482 - RNA, 21 nt, Human
augagacccauuccuauuucu

SEQ ID NO: 2110483 - RNA, 16 nt, Human
augagaauucagcugc

SEQ ID NO: 2110484 - RNA, 18 nt, Human
augagaauucagcugccc

SEQ ID NO: 2110485 - RNA, 19 nt, Human
augagaauucagcugcccc

SEQ ID NO: 2110486 - RNA, 13 nt, Human
augagaacagacu

SEQ ID NO: 2110487 - RNA, 14 nt, Human
augagaacagacug

SEQ ID NO: 2110488 - RNA, 19 nt, Human
augagaacagacuggccug

SEQ ID NO: 2110489 - RNA, 23 nt, Human
augagaacagacuggccugagga

SEQ ID NO: 2110490 - RNA, 14 nt, Human
augagaacucugag

SEQ ID NO: 2110491 - RNA, 12 nt, Human
augagaacaugu

SEQ ID NO: 2110492 - RNA, 17 nt, Human
augagaacauguuggua

SEQ ID NO: 2110493 - RNA, 19 nt, Human
augagaacauguugguauu

SEQ ID NO: 2110494 - RNA, 21 nt, Human
augagaacauguugguauuua

SEQ ID NO: 2110495 - RNA, 22 nt, Human
augagaaagguugaagcaccaa

SEQ ID NO: 2110496 - RNA, 21 nt, Human
augagaaagguugaagcacca

SEQ ID NO: 2110497 - RNA, 23 nt, Human
augaauuuuguuuggacuucuuu

SEQ ID NO: 2110498 - RNA, 22 nt, Human
augaauuuucaaguaauuguga

SEQ ID NO: 2110499 - RNA, 18 nt, Human
augaauuuucaaguaauu

SEQ ID NO: 2110500 - RNA, 19 nt, Human
uuguauauugucagauauu

SEQ ID NO: 2110501 - RNA, 13 nt, Human
augaauuucucua

SEQ ID NO: 2110502 - RNA, 15 nt, Human
augaauuuggagacu

SEQ ID NO: 2110503 - RNA, 20 nt, Human
augaauuuggagacucugug

SEQ ID NO: 2110504 - RNA, 21 nt, Human
augaauuuggagacucugugg

SEQ ID NO: 2110505 - RNA, 20 nt, Human
uuguauaccuuguaauuuga

SEQ ID NO: 2110506 - RNA, 14 nt, Human
uuguauaguaaagu

SEQ ID NO: 2110507 - RNA, 15 nt, Human
uuguauaguaaagug

SEQ ID NO: 2110508 - RNA, 16 nt, Human
uuguauauugucagau

SEQ ID NO: 2110509 - RNA, 18 nt, Human
uuguaguaaagaaauuua

SEQ ID NO: 2110510 - RNA, 16 nt, Human
uuguagguacuuuugg

SEQ ID NO: 2110511 - RNA, 18 nt, Human
uuguagguacuuuuggaa

SEQ ID NO: 2110512 - RNA, 20 nt, Human
uuguagguacuuuuggaauc

SEQ ID NO: 2110513 - RNA, 22 nt, Human
uuguagguacuuuuggaaucua

SEQ ID NO: 2110514 - RNA, 13 nt, Human
uuguaggguuucu

SEQ ID NO: 2110515 - RNA, 14 nt, Human
uuguaggguuucua

SEQ ID NO: 2110516 - RNA, 19 nt, Human
uugguucuaauagaacuca

SEQ ID NO: 2110517 - RNA, 15 nt, Human
uugguucuaauagaa

SEQ ID NO: 2110518 - RNA, 14 nt, Human
uugguucuggggcc

SEQ ID NO: 2110519 - RNA, 13 nt, Human
uugguucuggggc

SEQ ID NO: 2110520 - RNA, 13 nt, Human
augaauuaaauuu

SEQ ID NO: 2110521 - RNA, 12 nt, Human
uugggcccuccu

SEQ ID NO: 2110522 - RNA, 16 nt, Human
uugguucccuuugcuc

SEQ ID NO: 2110523 - RNA, 14 nt, Human
uugguucccuugug

SEQ ID NO: 2110524 - RNA, 22 nt, Human
uuggggggcugaggugggagga

SEQ ID NO: 2110525 - RNA, 23 nt, Human
uuggggggggcccgccuggcaga

SEQ ID NO: 2110526 - RNA, 16 nt, Human
uugggggcugugggga

SEQ ID NO: 2110527 - RNA, 14 nt, Human
uuggggcuucuugg

SEQ ID NO: 2110528 - RNA, 15 nt, Human
augaacggccuugcu

SEQ ID NO: 2110529 - RNA, 15 nt, Human
augaacggugagcau

SEQ ID NO: 2110530 - RNA, 16 nt, Human
augaacggugagcauu

SEQ ID NO: 2110531 - RNA, 13 nt, Human
augaacugcaugu

SEQ ID NO: 2110532 - RNA, 18 nt, Human
augaacugcauguauaaa

SEQ ID NO: 2110533 - RNA, 19 nt, Human
augaacugcauguauaaau

SEQ ID NO: 2110534 - RNA, 20 nt, Human
augaacugcauguauaaaug

SEQ ID NO: 2110535 - RNA, 12 nt, Human
augaacuggagg

SEQ ID NO: 2110536 - RNA, 18 nt, Human
augaacuggaggccagga

SEQ ID NO: 2110537 - RNA, 19 nt, Human
augaacuggaggccaggaa

SEQ ID NO: 2110538 - RNA, 15 nt, Human
augaaagggcccaga

SEQ ID NO: 2110539 - RNA, 19 nt, Human
augaaugaggucccaggca

SEQ ID NO: 2110540 - RNA, 20 nt, Human
augaaugaggucccaggcag

SEQ ID NO: 2110541 - RNA, 15 nt, Human
augaaugcacacuag

SEQ ID NO: 2110542 - RNA, 14 nt, Human
uuggcgggccaagg

SEQ ID NO: 2110543 - RNA, 23 nt, Human
aucuugcuuucuuuguuuggcug

SEQ ID NO: 2110544 - RNA, 23 nt, Human
aucuugcuuuuuuucaccaauau

SEQ ID NO: 2110545 - RNA, 22 nt, Human
uuggauaaugcuguugccucau

SEQ ID NO: 2110546 - RNA, 18 nt, Human
aucuuuuuauugaugugc

SEQ ID NO: 2110547 - RNA, 19 nt, Human
aucuuuuuauugaugugca

SEQ ID NO: 2110548 - RNA, 22 nt, Human
aucuuuuuauugaugugcaaaa

SEQ ID NO: 2110549 - RNA, 14 nt, Human
aucuuuuucucuaa

SEQ ID NO: 2110550 - RNA, 16 nt, Human
aucuuuuuuagcauaa

SEQ ID NO: 2110551 - RNA, 18 nt, Human
aucuuuuuuagcauaaaa

SEQ ID NO: 2110552 - RNA, 19 nt, Human
aucuuuuuuagcauaaaau

SEQ ID NO: 2110553 - RNA, 23 nt, Human
aucuuuuuuagcauaaaauuuuc

SEQ ID NO: 2110554 - RNA, 12 nt, Human
augaaagcaugu

SEQ ID NO: 2110555 - RNA, 18 nt, Human
augaaagcauguggcaug

SEQ ID NO: 2110556 - RNA, 21 nt, Human
augaaagcugauuacugucaa

SEQ ID NO: 2110557 - RNA, 22 nt, Human
augaaagcugauuacugucaau

SEQ ID NO: 2110558 - RNA, 23 nt, Human
augaaagcugauuacugucaaua

SEQ ID NO: 2110559 - RNA, 22 nt, Human
aucuuugccuugggcugcuccu

SEQ ID NO: 2110560 - RNA, 13 nt, Human
uuggcugcaggga

SEQ ID NO: 2110561 - RNA, 18 nt, Human
aucuuugcagacaggcaa

SEQ ID NO: 2110562 - RNA, 14 nt, Human
aucuuugccuuggg

SEQ ID NO: 2110563 - RNA, 20 nt, Human
aucuuugccuugggcugcuc

SEQ ID NO: 2110564 - RNA, 13 nt, Human
aucuuugccuugg

SEQ ID NO: 2110565 - RNA, 19 nt, Human
uugcacaaaccaauuaaac

SEQ ID NO: 2110566 - RNA, 12 nt, Human
uugaugguuuau

SEQ ID NO: 2110567 - RNA, 20 nt, Human
uugcaauuuuaacacacaua

SEQ ID NO: 2110568 - RNA, 17 nt, Human
uugcacacuccccugca

SEQ ID NO: 2110569 - RNA, 22 nt, Human
uugcacacuccccugcacugga

SEQ ID NO: 2110570 - RNA, 13 nt, Human
uugcacacuugug

SEQ ID NO: 2110571 - RNA, 16 nt, Human
uugaugugugucuagg

SEQ ID NO: 2110572 - RNA, 18 nt, Human
uugaugugcaaaaauuuu

SEQ ID NO: 2110573 - RNA, 23 nt, Human
uugauggugaugaaauguaaaua

SEQ ID NO: 2110574 - RNA, 21 nt, Human
uugauggucagacacaaacaa

SEQ ID NO: 2110575 - RNA, 16 nt, Human
aucucuuauuuuacaa

SEQ ID NO: 2110576 - RNA, 19 nt, Human
aucucuuauuuuacaauaa

SEQ ID NO: 2110577 - RNA, 14 nt, Human
uugauggggaagga

SEQ ID NO: 2110578 - RNA, 14 nt, Human
aucucaauuugagu

SEQ ID NO: 2110579 - RNA, 14 nt, Human
aucucagggccugg

SEQ ID NO: 2110580 - RNA, 16 nt, Human
aucucagggaagccca

SEQ ID NO: 2110581 - RNA, 17 nt, Human
aucucagggaagcccag

SEQ ID NO: 2110582 - RNA, 18 nt, Human
aucucagggaagcccagc

SEQ ID NO: 2110583 - RNA, 19 nt, Human
aucucagggaagcccagcu

SEQ ID NO: 2110584 - RNA, 20 nt, Human
aucucagggaagcccagcuc

SEQ ID NO: 2110585 - RNA, 22 nt, Human
aucucagggaagcccagcucca

SEQ ID NO: 2110586 - RNA, 23 nt, Human
aucucagggaagcccagcuccag

SEQ ID NO: 2110587 - RNA, 19 nt, Human
aucucaggccaccugcccc

SEQ ID NO: 2110588 - RNA, 20 nt, Human
aucucaggccaccugccccc

SEQ ID NO: 2110589 - RNA, 14 nt, Human
aucucaggccaccu

SEQ ID NO: 2110590 - RNA, 15 nt, Human
aucucaggccaccug

SEQ ID NO: 2110591 - RNA, 17 nt, Human
aucucaggccaccugcc

SEQ ID NO: 2110592 - RNA, 20 nt, Human
aucucagaauuccuuuucua

SEQ ID NO: 2110593 - RNA, 11 nt, Human
aucucagccca

SEQ ID NO: 2110594 - RNA, 15 nt, Human
aucucacuuuucucc

SEQ ID NO: 2110595 - RNA, 19 nt, Human
aucucacuuuucuccauga

SEQ ID NO: 2110596 - RNA, 19 nt, Human
auccuaucaacaacaaggu

SEQ ID NO: 2110597 - RNA, 16 nt, Human
auccuaucucuccaac

SEQ ID NO: 2110598 - RNA, 21 nt, Human
auccuaucucuccaaccagau

SEQ ID NO: 2110599 - RNA, 15 nt, Human
aucuccacuccagau

SEQ ID NO: 2110600 - RNA, 17 nt, Human
aucucagugcuguaaaa

SEQ ID NO: 2110601 - RNA, 15 nt, Human
aucugcaccccccug

SEQ ID NO: 2110602 - RNA, 17 nt, Human
aucugcaccccccuggg

SEQ ID NO: 2110603 - RNA, 18 nt, Human
aucugcaccccccugggc

SEQ ID NO: 2110604 - RNA, 19 nt, Human
aucugcaccccccugggcu

SEQ ID NO: 2110605 - RNA, 21 nt, Human
aucugcaccccccugggcuga

SEQ ID NO: 2110606 - RNA, 21 nt, Human
aucugcacccucgaugaagcc

SEQ ID NO: 2110607 - RNA, 18 nt, Human
aucugaugcaagcaagaa

SEQ ID NO: 2110608 - RNA, 16 nt, Human
aucugaucguucuuuc

SEQ ID NO: 2110609 - RNA, 18 nt, Human
aucugaucguucuuucua

SEQ ID NO: 2110610 - RNA, 20 nt, Human
aucugaucguucuuucuagc

SEQ ID NO: 2110611 - RNA, 17 nt, Human
uugccuacuaugccaga

SEQ ID NO: 2110612 - RNA, 18 nt, Human
uugccuccauggugccuc

SEQ ID NO: 2110613 - RNA, 20 nt, Human
uugccuccauggugccucug

SEQ ID NO: 2110614 - RNA, 22 nt, Human
aucugaggaaucaacagggcag

SEQ ID NO: 2110615 - RNA, 23 nt, Human
aucugaggaaucaacagggcagc

SEQ ID NO: 2110616 - RNA, 18 nt, Human
uugcccuuucuguaccau

SEQ ID NO: 2110617 - RNA, 15 nt, Human
uugccgaaacuggaa

SEQ ID NO: 2110618 - RNA, 16 nt, Human
uugccgaaacuggaag

SEQ ID NO: 2110619 - RNA, 17 nt, Human
uugccgaaacuggaagu

SEQ ID NO: 2110620 - RNA, 18 nt, Human
uugccgaaacuggaaguu

SEQ ID NO: 2110621 - RNA, 23 nt, Human
uugcccugguuucacuggcccaa

SEQ ID NO: 2110622 - RNA, 14 nt, Human
uugcccuucacagu

SEQ ID NO: 2110623 - RNA, 16 nt, Human
uugcccuucacagugu

SEQ ID NO: 2110624 - RNA, 17 nt, Human
uugcccuucacaguguu

SEQ ID NO: 2110625 - RNA, 18 nt, Human
uugcccuucacaguguuu

SEQ ID NO: 2110626 - RNA, 10 nt, Human
uugcccuggu

SEQ ID NO: 2110627 - RNA, 20 nt, Human
uugcccuuucuguaccauuu

SEQ ID NO: 2110628 - RNA, 18 nt, Human
uugccuaaguauuccuuu

SEQ ID NO: 2110629 - RNA, 19 nt, Human
uugccuaauaaacauccuu

SEQ ID NO: 2110630 - RNA, 18 nt, Human
uugccuaauacauuaaag

SEQ ID NO: 2110631 - RNA, 19 nt, Human
uugccuaauacauuaaagc

SEQ ID NO: 2110632 - RNA, 21 nt, Human
uugccuaauacauuaaagcag

SEQ ID NO: 2110633 - RNA, 22 nt, Human
uugccuaauacauuaaagcagu

SEQ ID NO: 2110634 - RNA, 23 nt, Human
uugccuaauacauuaaagcaguc

SEQ ID NO: 2110635 - RNA, 19 nt, Human
aucuggguucacugcaacc

SEQ ID NO: 2110636 - RNA, 21 nt, Human
uugccguugccaagaacugaa

SEQ ID NO: 2110637 - RNA, 23 nt, Human
aucugcauuuucuggguucuggg

SEQ ID NO: 2110638 - RNA, 17 nt, Human
aucugguagauuuuuaa

SEQ ID NO: 2110639 - RNA, 17 nt, Human
aucuggguucacugcaa

SEQ ID NO: 2110640 - RNA, 22 nt, Human
aucugcauuuucaccccacccu

SEQ ID NO: 2110641 - RNA, 23 nt, Human
aucugcauuuucaccccacccuu

SEQ ID NO: 2110642 - RNA, 11 nt, Human
aucugcauuua

SEQ ID NO: 2110643 - RNA, 14 nt, Human
aucugcauuuagca

SEQ ID NO: 2110644 - RNA, 15 nt, Human
aucugcauuuagcac

SEQ ID NO: 2110645 - RNA, 16 nt, Human
aucugcauuuagcaca

SEQ ID NO: 2110646 - RNA, 17 nt, Human
aucugcauuuagcacaa

SEQ ID NO: 2110647 - RNA, 19 nt, Human
aucugcauuuucaccccac

SEQ ID NO: 2110648 - RNA, 16 nt, Human
aucuguaagcucuuug

SEQ ID NO: 2110649 - RNA, 17 nt, Human
aucuggucccuugcagc

SEQ ID NO: 2110650 - RNA, 20 nt, Human
aucugguagggggaaaaugu

SEQ ID NO: 2110651 - RNA, 17 nt, Human
aucuguacuucuucgau

SEQ ID NO: 2110652 - RNA, 12 nt, Human
aucuguagauac

SEQ ID NO: 2110653 - RNA, 22 nt, Human
aucuguagauacuagcuaucua

SEQ ID NO: 2110654 - RNA, 19 nt, Human
aucuugcucugcugacaga

SEQ ID NO: 2110655 - RNA, 17 nt, Human
aucuugcucugcugaca

SEQ ID NO: 2110656 - RNA, 23 nt, Human
aucuugaccaagcaggaagcuca

SEQ ID NO: 2110657 - RNA, 17 nt, Human
aucuugaccaagcagga

SEQ ID NO: 2110658 - RNA, 19 nt, Human
aucuugaccaagcaggaag

SEQ ID NO: 2110659 - RNA, 21 nt, Human
aucuugaccaagcaggaagcu

SEQ ID NO: 2110660 - RNA, 22 nt, Human
aucuugaccaagcaggaagcuc

SEQ ID NO: 2110661 - RNA, 15 nt, Human
aucuuagcugccaag

SEQ ID NO: 2110662 - RNA, 16 nt, Human
aucuuagcugccaagu

SEQ ID NO: 2110663 - RNA, 20 nt, Human
aucuuaggggagagcuuucu

SEQ ID NO: 2110664 - RNA, 21 nt, Human
aucugugaaaugcuggcauuu

SEQ ID NO: 2110665 - RNA, 21 nt, Human
aucuguuguguacguggagag

SEQ ID NO: 2110666 - RNA, 16 nt, Human
aucuguguuuuugaaa

SEQ ID NO: 2110667 - RNA, 18 nt, Human
aucuguguuuuugaaaua

SEQ ID NO: 2110668 - RNA, 21 nt, Human
aucuguguuuuugaaauauua

SEQ ID NO: 2110669 - RNA, 14 nt, Human
aucuuacugaaggu

SEQ ID NO: 2110670 - RNA, 15 nt, Human
aucuuacugaaggua

SEQ ID NO: 2110671 - RNA, 23 nt, Human
aucuguuguguacguggagaggg

SEQ ID NO: 2110672 - RNA, 21 nt, Human
aucuguuuaaaguagauuaga

SEQ ID NO: 2110673 - RNA, 14 nt, Human
aucuuacaaagugu

SEQ ID NO: 2110674 - RNA, 18 nt, Human
aucuuacaaaguguauuu

SEQ ID NO: 2110675 - RNA, 22 nt, Human
aucuuacaaaguguauuuuaua

SEQ ID NO: 2110676 - RNA, 12 nt, Human
caaagaaauuuc

SEQ ID NO: 2110677 - RNA, 18 nt, Human
caaagaaauuuccacuca

SEQ ID NO: 2110678 - RNA, 19 nt, Human
caaagaaauuuccacucag

SEQ ID NO: 2110679 - RNA, 21 nt, Human
caaacucuugaccucagguga

SEQ ID NO: 2110680 - RNA, 14 nt, Human
caaacugaagccag

SEQ ID NO: 2110681 - RNA, 15 nt, Human
caaacugaagccaga

SEQ ID NO: 2110682 - RNA, 20 nt, Human
caaacucuugaccucaggug

SEQ ID NO: 2110683 - RNA, 19 nt, Human
caaacucuugaccucaggu

SEQ ID NO: 2110684 - RNA, 17 nt, Human
caaacucuugaccucag

SEQ ID NO: 2110685 - RNA, 16 nt, Human
caaacucugccagcca

SEQ ID NO: 2110686 - RNA, 12 nt, Human
caaaccuggaga

SEQ ID NO: 2110687 - RNA, 13 nt, Human
caaaccuggagau

SEQ ID NO: 2110688 - RNA, 13 nt, Human
caaaccugcccca

SEQ ID NO: 2110689 - RNA, 16 nt, Human
caaaccugccccaucc

SEQ ID NO: 2110690 - RNA, 18 nt, Human
caaaccuuuauuuuagaa

SEQ ID NO: 2110691 - RNA, 20 nt, Human
caaaccuuuauuuuagaauu

SEQ ID NO: 2110692 - RNA, 14 nt, Human
caaacaccugcuga

SEQ ID NO: 2110693 - RNA, 22 nt, Human
caaacaccugcugauguggcaa

SEQ ID NO: 2110694 - RNA, 17 nt, Human
caaacaaauaugcaaaa

SEQ ID NO: 2110695 - RNA, 20 nt, Human
caaacaaagccagaagcuga

SEQ ID NO: 2110696 - RNA, 20 nt, Human
caaacaaccccccaucacaa

SEQ ID NO: 2110697 - RNA, 15 nt, Human
caaacaaauaugcaa

SEQ ID NO: 2110698 - RNA, 14 nt, Human
caaacaaauaugca

SEQ ID NO: 2110699 - RNA, 17 nt, Human
caaaaucacuuccauag

SEQ ID NO: 2110700 - RNA, 15 nt, Human
caaacaaacaagcua

SEQ ID NO: 2110701 - RNA, 13 nt, Human
caaacaaagccag

SEQ ID NO: 2110702 - RNA, 14 nt, Human
caaacaaagccaga

SEQ ID NO: 2110703 - RNA, 16 nt, Human
caaacaaagccagaag

SEQ ID NO: 2110704 - RNA, 21 nt, Human
caaaaucuguagagcagggca

SEQ ID NO: 2110705 - RNA, 13 nt, Human
caaaaucugucca

SEQ ID NO: 2110706 - RNA, 21 nt, Human
caaaaucuguccaaaggaggc

SEQ ID NO: 2110707 - RNA, 14 nt, Human
caaaaugacaauga

SEQ ID NO: 2110708 - RNA, 15 nt, Human
caaaaugacaaugau

SEQ ID NO: 2110709 - RNA, 20 nt, Human
caaaauuuccaguaccuuug

SEQ ID NO: 2110710 - RNA, 12 nt, Human
caaaauuugaaa

SEQ ID NO: 2110711 - RNA, 14 nt, Human
caaaauuugaaauu

SEQ ID NO: 2110712 - RNA, 14 nt, Human
caaaauuuccagua

SEQ ID NO: 2110713 - RNA, 15 nt, Human
caaaauuuccaguac

SEQ ID NO: 2110714 - RNA, 17 nt, Human
caaaauuuccaguaccu

SEQ ID NO: 2110715 - RNA, 18 nt, Human
caaaauuuccaguaccuu

SEQ ID NO: 2110716 - RNA, 19 nt, Human
caaaauuuccaguaccuuu

SEQ ID NO: 2110717 - RNA, 23 nt, Human
caaaauuuuauagcucaguuuau

SEQ ID NO: 2110718 - RNA, 18 nt, Human
caaaauuuuauuccuaua

SEQ ID NO: 2110719 - RNA, 21 nt, Human
caaaauuuuauagcucaguuu

SEQ ID NO: 2110720 - RNA, 13 nt, Human
caaaauuuuauuc

SEQ ID NO: 2110721 - RNA, 14 nt, Human
caaaauuuuauucc

SEQ ID NO: 2110722 - RNA, 21 nt, Human
caaaaucgaugcagugcuucc

SEQ ID NO: 2110723 - RNA, 16 nt, Human
caaaaucauuuuaaug

SEQ ID NO: 2110724 - RNA, 14 nt, Human
caaaauauguucuu

SEQ ID NO: 2110725 - RNA, 13 nt, Human
caaaauauaaagc

SEQ ID NO: 2110726 - RNA, 19 nt, Human
caaaauauguugaugaaaa

SEQ ID NO: 2110727 - RNA, 14 nt, Human
caaaauaaugucuu

SEQ ID NO: 2110728 - RNA, 15 nt, Human
caaaauaaugucuug

SEQ ID NO: 2110729 - RNA, 16 nt, Human
caaaauaaugucuugu

SEQ ID NO: 2110730 - RNA, 17 nt, Human
caaaauaaugucuuguu

SEQ ID NO: 2110731 - RNA, 18 nt, Human
caaaauaaugucuuguua

SEQ ID NO: 2110732 - RNA, 20 nt, Human
caaaauaaugucuuguuaau

SEQ ID NO: 2110733 - RNA, 21 nt, Human
caaaauaaugucuuguuaaua

SEQ ID NO: 2110734 - RNA, 18 nt, Human
caaaauaaaguuacauug

SEQ ID NO: 2110735 - RNA, 19 nt, Human
caaaauaaaguuacauugc

SEQ ID NO: 2110736 - RNA, 23 nt, Human
caaaauaaaguuacauugcuggu

SEQ ID NO: 2110737 - RNA, 11 nt, Human
caaaauaaauu

SEQ ID NO: 2110738 - RNA, 14 nt, Human
caaaauaaauugaa

SEQ ID NO: 2110739 - RNA, 18 nt, Human
caaaauaaauugaaauau

SEQ ID NO: 2110740 - RNA, 11 nt, Human
caaaauaaaaa

SEQ ID NO: 2110741 - RNA, 15 nt, Human
caaaauaaaaaccaa

SEQ ID NO: 2110742 - RNA, 14 nt, Human
caaaaguuucucuu

SEQ ID NO: 2110743 - RNA, 16 nt, Human
caaaacuccugucuuu

SEQ ID NO: 2110744 - RNA, 21 nt, Human
caaaacucauuuccuauguaa

SEQ ID NO: 2110745 - RNA, 13 nt, Human
caaaacggggcag

SEQ ID NO: 2110746 - RNA, 19 nt, Human
caaaacgcauggagugugu

SEQ ID NO: 2110747 - RNA, 23 nt, Human
caaaacgcauggaguguguauug

SEQ ID NO: 2110748 - RNA, 15 nt, Human
caaaacgguuuuacu

SEQ ID NO: 2110749 - RNA, 21 nt, Human
caaaacgguuuuacugcagcu

SEQ ID NO: 2110750 - RNA, 13 nt, Human
caacaggcugggc

SEQ ID NO: 2110751 - RNA, 22 nt, Human
caaauaaccaacccuucccuga

SEQ ID NO: 2110752 - RNA, 13 nt, Human
caacgaaaagcac

SEQ ID NO: 2110753 - RNA, 18 nt, Human
caacgaaaagcacaucca

SEQ ID NO: 2110754 - RNA, 22 nt, Human
caacgaaaagcacauccaggca

SEQ ID NO: 2110755 - RNA, 13 nt, Human
caacgaagaaaaa

SEQ ID NO: 2110756 - RNA, 14 nt, Human
caacgaagaaaaaa

SEQ ID NO: 2110757 - RNA, 20 nt, Human
caacgaagaaaaaaaauaac

SEQ ID NO: 2110758 - RNA, 13 nt, Human
caacgacaaagcc

SEQ ID NO: 2110759 - RNA, 13 nt, Human
caacaucaauguu

SEQ ID NO: 2110760 - RNA, 14 nt, Human
caacguggcccaga

SEQ ID NO: 2110761 - RNA, 13 nt, Human
caacguggcccag

SEQ ID NO: 2110762 - RNA, 12 nt, Human
caacguggggca

SEQ ID NO: 2110763 - RNA, 15 nt, Human
caacguggggcagca

SEQ ID NO: 2110764 - RNA, 17 nt, Human
caacguggggcagcaca

SEQ ID NO: 2110765 - RNA, 21 nt, Human
caacguggcccagagaagcca

SEQ ID NO: 2110766 - RNA, 20 nt, Human
caacguggcccagagaagcc

SEQ ID NO: 2110767 - RNA, 19 nt, Human
caacguggcccagagaagc

SEQ ID NO: 2110768 - RNA, 17 nt, Human
caacguggcccagagaa

SEQ ID NO: 2110769 - RNA, 18 nt, Human
caacguggggcagcacag

SEQ ID NO: 2110770 - RNA, 16 nt, Human
caacuuguaaaugugg

SEQ ID NO: 2110771 - RNA, 12 nt, Human
caacuugggaac

SEQ ID NO: 2110772 - RNA, 23 nt, Human
caacuuguauuaaagacagaggc

SEQ ID NO: 2110773 - RNA, 17 nt, Human
caacuugucuuuuucug

SEQ ID NO: 2110774 - RNA, 19 nt, Human
caacuugucuuuuucugga

SEQ ID NO: 2110775 - RNA, 22 nt, Human
caacuugucuuuuucuggacug

SEQ ID NO: 2110776 - RNA, 14 nt, Human
caagaggagaucca

SEQ ID NO: 2110777 - RNA, 12 nt, Human
caagagcugagg

SEQ ID NO: 2110778 - RNA, 18 nt, Human
caagagcgaaacuccguc

SEQ ID NO: 2110779 - RNA, 22 nt, Human
caagagccuugguguccaccug

SEQ ID NO: 2110780 - RNA, 13 nt, Human
caagagcccagca

SEQ ID NO: 2110781 - RNA, 19 nt, Human
caagagcccagcagggccu

SEQ ID NO: 2110782 - RNA, 23 nt, Human
caagagccuugguguccaccugg

SEQ ID NO: 2110783 - RNA, 13 nt, Human
caagagccacagu

SEQ ID NO: 2110784 - RNA, 21 nt, Human
caagagcagccuguggcaucu

SEQ ID NO: 2110785 - RNA, 18 nt, Human
caagagcagccuguggca

SEQ ID NO: 2110786 - RNA, 20 nt, Human
caagagcagccuguggcauc

SEQ ID NO: 2110787 - RNA, 15 nt, Human
caagagcagaggcag

SEQ ID NO: 2110788 - RNA, 16 nt, Human
caagagcagaggcagc

SEQ ID NO: 2110789 - RNA, 14 nt, Human
caagagcagccugu

SEQ ID NO: 2110790 - RNA, 15 nt, Human
caagagcagccugug

SEQ ID NO: 2110791 - RNA, 16 nt, Human
caagagcagccugugg

SEQ ID NO: 2110792 - RNA, 17 nt, Human
caagagcagccuguggc

SEQ ID NO: 2110793 - RNA, 13 nt, Human
caagagagauguu

SEQ ID NO: 2110794 - RNA, 15 nt, Human
caagagagauguuuu

SEQ ID NO: 2110795 - RNA, 14 nt, Human
caagagagaaagaa

SEQ ID NO: 2110796 - RNA, 17 nt, Human
caagagagaaagaagua

SEQ ID NO: 2110797 - RNA, 23 nt, Human
caagagaugaagagugagagggc

SEQ ID NO: 2110798 - RNA, 22 nt, Human
caagagaauugcuugaacccag

SEQ ID NO: 2110799 - RNA, 13 nt, Human
caagagagaaaga

SEQ ID NO: 2110800 - RNA, 19 nt, Human
caagagaaggggaagcacu

SEQ ID NO: 2110801 - RNA, 13 nt, Human
caacuaacaagaa

SEQ ID NO: 2110802 - RNA, 15 nt, Human
caacagcucaagucu

SEQ ID NO: 2110803 - RNA, 22 nt, Human
caacagcucaagucuucccuga

SEQ ID NO: 2110804 - RNA, 14 nt, Human
caacaggaacugug

SEQ ID NO: 2110805 - RNA, 14 nt, Human
caacaggagcuggg

SEQ ID NO: 2110806 - RNA, 15 nt, Human
caacaggagcuggga

SEQ ID NO: 2110807 - RNA, 21 nt, Human
caacaggagcugggauccuaa

SEQ ID NO: 2110808 - RNA, 12 nt, Human
caacaggcuggg

SEQ ID NO: 2110809 - RNA, 22 nt, Human
caacaggagcugggauccuaag

SEQ ID NO: 2110810 - RNA, 18 nt, Human
caaccugcucuccucuug

SEQ ID NO: 2110811 - RNA, 23 nt, Human
caaccugcucuccucuugccacu

SEQ ID NO: 2110812 - RNA, 21 nt, Human
caaccugcucuccucuugcca

SEQ ID NO: 2110813 - RNA, 23 nt, Human
caacauagugagaccccugucuc

SEQ ID NO: 2110814 - RNA, 20 nt, Human
caaccuucuguggcucacag

SEQ ID NO: 2110815 - RNA, 19 nt, Human
caaccuucuguggcucaca

SEQ ID NO: 2110816 - RNA, 17 nt, Human
caaccuucuguggcuca

SEQ ID NO: 2110817 - RNA, 16 nt, Human
caaccuucuguggcuc

SEQ ID NO: 2110818 - RNA, 16 nt, Human
caaccuggucacagga

SEQ ID NO: 2110819 - RNA, 19 nt, Human
caaauuuguaggguuucua

SEQ ID NO: 2110820 - RNA, 21 nt, Human
caaauuagguuuuguacaauu

SEQ ID NO: 2110821 - RNA, 18 nt, Human
caaauuagguuuuguaca

SEQ ID NO: 2110822 - RNA, 19 nt, Human
caaauuagguuuuguacaa

SEQ ID NO: 2110823 - RNA, 20 nt, Human
caaauuagguuuuguacaau

SEQ ID NO: 2110824 - RNA, 15 nt, Human
caacacuucagacug

SEQ ID NO: 2110825 - RNA, 19 nt, Human
caacacuucagacugcaag

SEQ ID NO: 2110826 - RNA, 15 nt, Human
caacagaagcuucca

SEQ ID NO: 2110827 - RNA, 20 nt, Human
caacagaagucaugaagccc

SEQ ID NO: 2110828 - RNA, 22 nt, Human
caacagaagucaugaagcccaa

SEQ ID NO: 2110829 - RNA, 23 nt, Human
caacagaagucaugaagcccaag

SEQ ID NO: 2110830 - RNA, 18 nt, Human
caacagagaaggcaggaa

SEQ ID NO: 2110831 - RNA, 17 nt, Human
caacagagaaggcagga

SEQ ID NO: 2110832 - RNA, 14 nt, Human
caacagauacugga

SEQ ID NO: 2110833 - RNA, 17 nt, Human
caacagauacuggaagu

SEQ ID NO: 2110834 - RNA, 19 nt, Human
caacagagugagacccugu

SEQ ID NO: 2110835 - RNA, 23 nt, Human
caacagagugagacccugucucu

SEQ ID NO: 2110836 - RNA, 16 nt, Human
caaaucaaguuuccaa

SEQ ID NO: 2110837 - RNA, 21 nt, Human
caaaucaaguuuccaagcaaa

SEQ ID NO: 2110838 - RNA, 22 nt, Human
caaaucaaguuuccaagcaaau

SEQ ID NO: 2110839 - RNA, 23 nt, Human
caaaucaaguuuccaagcaaaug

SEQ ID NO: 2110840 - RNA, 24 nt, Human
caaaucaaguuuccaagcaaaugu

SEQ ID NO: 2110841 - RNA, 15 nt, Human
caaauauauucucuu

SEQ ID NO: 2110842 - RNA, 17 nt, Human
caaauauauucucuuug

SEQ ID NO: 2110843 - RNA, 18 nt, Human
caaauauauucucuuugg

SEQ ID NO: 2110844 - RNA, 20 nt, Human
caaauauauucucuuuggug

SEQ ID NO: 2110845 - RNA, 14 nt, Human
caaauggaggaaua

SEQ ID NO: 2110846 - RNA, 14 nt, Human
caaauguuacauag

SEQ ID NO: 2110847 - RNA, 15 nt, Human
caaauguuacauagu

SEQ ID NO: 2110848 - RNA, 18 nt, Human
caaauguuacauagugua

SEQ ID NO: 2110849 - RNA, 13 nt, Human
caaauguuaugca

SEQ ID NO: 2110850 - RNA, 21 nt, Human
caaauguuaugcauaaaguca

SEQ ID NO: 2110851 - RNA, 19 nt, Human
caaagugcugggauuacaa

SEQ ID NO: 2110852 - RNA, 13 nt, Human
caaagugcuggga

SEQ ID NO: 2110853 - RNA, 19 nt, Human
caaagagaguuaaucaacu

SEQ ID NO: 2110854 - RNA, 19 nt, Human
caaagaaggaaaaggcagg

SEQ ID NO: 2110855 - RNA, 14 nt, Human
caaagaagacaaca

SEQ ID NO: 2110856 - RNA, 17 nt, Human
caaagaaggaauucuag

SEQ ID NO: 2110857 - RNA, 20 nt, Human
caaaguucccuacuuccugu

SEQ ID NO: 2110858 - RNA, 16 nt, Human
caaaguuaaccuaccu

SEQ ID NO: 2110859 - RNA, 17 nt, Human
caaaguuaaccuaccug

SEQ ID NO: 2110860 - RNA, 20 nt, Human
caaaguuaaccuaccuguaa

SEQ ID NO: 2110861 - RNA, 21 nt, Human
caaaguuaaccuaccuguaac

SEQ ID NO: 2110862 - RNA, 11 nt, Human
caaaguguuaa

SEQ ID NO: 2110863 - RNA, 13 nt, Human
caaagagcugccu

SEQ ID NO: 2110864 - RNA, 14 nt, Human
caaagagcugccua

SEQ ID NO: 2110865 - RNA, 16 nt, Human
caaagagaaugccauu

SEQ ID NO: 2110866 - RNA, 19 nt, Human
caaaguguauuuuauaaaa

SEQ ID NO: 2110867 - RNA, 22 nt, Human
caaaguguauuuuauaaaauua

SEQ ID NO: 2110868 - RNA, 23 nt, Human
caaaguguauuuuauaaaauuaa

SEQ ID NO: 2110869 - RNA, 23 nt, Human
caaagugcugggauuacaagcgu

SEQ ID NO: 2110870 - RNA, 19 nt, Human
caauagauauuuaccuuuu

SEQ ID NO: 2110871 - RNA, 23 nt, Human
caauagaaacucaccauguaaaa

SEQ ID NO: 2110872 - RNA, 21 nt, Human
caauaagagcguuugcccaaa

SEQ ID NO: 2110873 - RNA, 12 nt, Human
caauagagacug

SEQ ID NO: 2110874 - RNA, 14 nt, Human
caauagagacugua

SEQ ID NO: 2110875 - RNA, 15 nt, Human
caauagagacuguag

SEQ ID NO: 2110876 - RNA, 16 nt, Human
caauagagacuguaga

SEQ ID NO: 2110877 - RNA, 22 nt, Human
caauagagacuguagauugcuu

SEQ ID NO: 2110878 - RNA, 23 nt, Human
caauagaaggauguacauuucca

SEQ ID NO: 2110879 - RNA, 14 nt, Human
caauaacuacugug

SEQ ID NO: 2110880 - RNA, 15 nt, Human
caauaacuacugugu

SEQ ID NO: 2110881 - RNA, 16 nt, Human
caauaacuacuguguu

SEQ ID NO: 2110882 - RNA, 17 nt, Human
caauaacuacuguguuc

SEQ ID NO: 2110883 - RNA, 18 nt, Human
caauaacuacuguguucc

SEQ ID NO: 2110884 - RNA, 19 nt, Human
caauaacuacuguguuccu

SEQ ID NO: 2110885 - RNA, 20 nt, Human
caauaacuacuguguuccug

SEQ ID NO: 2110886 - RNA, 21 nt, Human
caauaacuacuguguuccugg

SEQ ID NO: 2110887 - RNA, 18 nt, Human
caauaagcaucaaacucu

SEQ ID NO: 2110888 - RNA, 19 nt, Human
caauaagcaucaaacucuu

SEQ ID NO: 2110889 - RNA, 22 nt, Human
caauaacuacuguguuccuggc

SEQ ID NO: 2110890 - RNA, 14 nt, Human
caauaguguguucu

SEQ ID NO: 2110891 - RNA, 15 nt, Human
caauaguguguucug

SEQ ID NO: 2110892 - RNA, 16 nt, Human
caauaguguguucuga

SEQ ID NO: 2110893 - RNA, 17 nt, Human
caauaguguguucugau

SEQ ID NO: 2110894 - RNA, 23 nt, Human
caauaguguguucugauuagaaa

SEQ ID NO: 2110895 - RNA, 17 nt, Human
caauagcacuuucauug

SEQ ID NO: 2110896 - RNA, 20 nt, Human
caauagcacuuucauugcca

SEQ ID NO: 2110897 - RNA, 21 nt, Human
caauagcacuuucauugccag

SEQ ID NO: 2110898 - RNA, 23 nt, Human
caauagcacuuucauugccagug

SEQ ID NO: 2110899 - RNA, 19 nt, Human
caaggguucagagacucag

SEQ ID NO: 2110900 - RNA, 17 nt, Human
caagggucuagggagag

SEQ ID NO: 2110901 - RNA, 16 nt, Human
caaggguggcauccca

SEQ ID NO: 2110902 - RNA, 21 nt, Human
caaggguggcaucccaguggc

SEQ ID NO: 2110903 - RNA, 14 nt, Human
caauaaauguauuc

SEQ ID NO: 2110904 - RNA, 15 nt, Human
caauaaauguauuca

SEQ ID NO: 2110905 - RNA, 18 nt, Human
caauaaauguauucaaau

SEQ ID NO: 2110906 - RNA, 17 nt, Human
caauaaaugugcuuaug

SEQ ID NO: 2110907 - RNA, 12 nt, Human
caauaaaugaau

SEQ ID NO: 2110908 - RNA, 16 nt, Human
caauaaauagaccauu

SEQ ID NO: 2110909 - RNA, 16 nt, Human
caagggucuagggaga

SEQ ID NO: 2110910 - RNA, 23 nt, Human
caaggguauccaaguuggacugg

SEQ ID NO: 2110911 - RNA, 18 nt, Human
caaggcugggggaagaag

SEQ ID NO: 2110912 - RNA, 13 nt, Human
caagcuuuuuuau

SEQ ID NO: 2110913 - RNA, 14 nt, Human
caagcuuuuuuauu

SEQ ID NO: 2110914 - RNA, 15 nt, Human
caagcuuuuuuauuu

SEQ ID NO: 2110915 - RNA, 23 nt, Human
caagcuuuuuuauuuuuuauaca

SEQ ID NO: 2110916 - RNA, 14 nt, Human
caaggagaaacaga

SEQ ID NO: 2110917 - RNA, 16 nt, Human
caaggagaaacagaga

SEQ ID NO: 2110918 - RNA, 18 nt, Human
caaggagaaacagagaca

SEQ ID NO: 2110919 - RNA, 20 nt, Human
caaggagaaacagagacagg

SEQ ID NO: 2110920 - RNA, 19 nt, Human
caaggagaaacagagacag

SEQ ID NO: 2110921 - RNA, 23 nt, Human
caagcuggucccacucaguccau

SEQ ID NO: 2110922 - RNA, 22 nt, Human
caagcuggucccacucagucca

SEQ ID NO: 2110923 - RNA, 23 nt, Human
caaggagaugaagcaaacacauu

SEQ ID NO: 2110924 - RNA, 13 nt, Human
caaggagaugaag

SEQ ID NO: 2110925 - RNA, 17 nt, Human
caaggcugcagugagcc

SEQ ID NO: 2110926 - RNA, 22 nt, Human
caaggcugcagugagccgagau

SEQ ID NO: 2110927 - RNA, 18 nt, Human
caagcgauucuucugcuu

SEQ ID NO: 2110928 - RNA, 21 nt, Human
caagcugcacccucaggcagg

SEQ ID NO: 2110929 - RNA, 17 nt, Human
caagcgauucuucugcu

SEQ ID NO: 2110930 - RNA, 15 nt, Human
caagcgauucuucug

SEQ ID NO: 2110931 - RNA, 21 nt, Human
caagcuggucccacucagucc

SEQ ID NO: 2110932 - RNA, 12 nt, Human
caagcugccucc

SEQ ID NO: 2110933 - RNA, 13 nt, Human
caagcugccuccc

SEQ ID NO: 2110934 - RNA, 14 nt, Human
caagcugccucccu

SEQ ID NO: 2110935 - RNA, 15 nt, Human
caagcugccucccug

SEQ ID NO: 2110936 - RNA, 19 nt, Human
caagcugccucccugucca

SEQ ID NO: 2110937 - RNA, 20 nt, Human
caagcugccucccuguccac

SEQ ID NO: 2110938 - RNA, 14 nt, Human
caagcugcuguggc

SEQ ID NO: 2110939 - RNA, 22 nt, Human
caagcugcacccucaggcaggu

SEQ ID NO: 2110940 - RNA, 14 nt, Human
caagauaaaggaca

SEQ ID NO: 2110941 - RNA, 16 nt, Human
caagauaaaggacagu

SEQ ID NO: 2110942 - RNA, 18 nt, Human
caagauaaaggacaguga

SEQ ID NO: 2110943 - RNA, 18 nt, Human
caagaguuuucuuccuug

SEQ ID NO: 2110944 - RNA, 14 nt, Human
caagagugauucuu

SEQ ID NO: 2110945 - RNA, 15 nt, Human
caagagugauucuug

SEQ ID NO: 2110946 - RNA, 16 nt, Human
caagagugauucuugc

SEQ ID NO: 2110947 - RNA, 19 nt, Human
caagagugauucuugcugc

SEQ ID NO: 2110948 - RNA, 15 nt, Human
caagaggcugaggca

SEQ ID NO: 2110949 - RNA, 18 nt, Human
caagccuguaaucccagc

SEQ ID NO: 2110950 - RNA, 21 nt, Human
caagccuguaaucccagcuac

SEQ ID NO: 2110951 - RNA, 17 nt, Human
caagcgaggucaacaga

SEQ ID NO: 2110952 - RNA, 20 nt, Human
caagcgaggucaacagagaa

SEQ ID NO: 2110953 - RNA, 11 nt, Human
cacacacagcu

SEQ ID NO: 2110954 - RNA, 13 nt, Human
cacaaaggagagc

SEQ ID NO: 2110955 - RNA, 18 nt, Human
cacaaagcggggggaggg

SEQ ID NO: 2110956 - RNA, 19 nt, Human
cacaaagcggggggagggu

SEQ ID NO: 2110957 - RNA, 18 nt, Human
caauuccaugcuauaaaa

SEQ ID NO: 2110958 - RNA, 14 nt, Human
cacaaguuguguuu

SEQ ID NO: 2110959 - RNA, 21 nt, Human
cacacaaaauguacccaguau

SEQ ID NO: 2110960 - RNA, 13 nt, Human
cacacaaagagag

SEQ ID NO: 2110961 - RNA, 14 nt, Human
cacacaaagagagu

SEQ ID NO: 2110962 - RNA, 17 nt, Human
cacacaaagagaguuaa

SEQ ID NO: 2110963 - RNA, 13 nt, Human
cacacaaagguau

SEQ ID NO: 2110964 - RNA, 18 nt, Human
cacacaaagguauaauuu

SEQ ID NO: 2110965 - RNA, 13 nt, Human
cacacacacacac

SEQ ID NO: 2110966 - RNA, 15 nt, Human
cacacacacacacaa

SEQ ID NO: 2110967 - RNA, 15 nt, Human
cacacacacacacag

SEQ ID NO: 2110968 - RNA, 11 nt, Human
cacaauauuuu

SEQ ID NO: 2110969 - RNA, 22 nt, Human
cacaaugaaaugcucuccuuuc

SEQ ID NO: 2110970 - RNA, 22 nt, Human
cacaaugcagugccuuucuucu

SEQ ID NO: 2110971 - RNA, 11 nt, Human
cacaaugucuu

SEQ ID NO: 2110972 - RNA, 12 nt, Human
cacaaugucuug

SEQ ID NO: 2110973 - RNA, 14 nt, Human
cacaaugucuuggu

SEQ ID NO: 2110974 - RNA, 13 nt, Human
cacaauacaauaa

SEQ ID NO: 2110975 - RNA, 12 nt, Human
cacaauaugaau

SEQ ID NO: 2110976 - RNA, 19 nt, Human
cacaauaaauguauucaaa

SEQ ID NO: 2110977 - RNA, 20 nt, Human
cacaauaaauguauucaaau

SEQ ID NO: 2110978 - RNA, 17 nt, Human
cacacacgcgugcacac

SEQ ID NO: 2110979 - RNA, 12 nt, Human
cacacacguuau

SEQ ID NO: 2110980 - RNA, 23 nt, Human
cacacacagaggaagagcaggca

SEQ ID NO: 2110981 - RNA, 15 nt, Human
cacacaccuguaguc

SEQ ID NO: 2110982 - RNA, 20 nt, Human
cacacaccuguagucccagc

SEQ ID NO: 2110983 - RNA, 19 nt, Human
cacacaccuguagucccag

SEQ ID NO: 2110984 - RNA, 12 nt, Human
cacacacagagg

SEQ ID NO: 2110985 - RNA, 14 nt, Human
cacacacagaggaa

SEQ ID NO: 2110986 - RNA, 13 nt, Human
cacacacacucua

SEQ ID NO: 2110987 - RNA, 16 nt, Human
cacacacacacacagg

SEQ ID NO: 2110988 - RNA, 13 nt, Human
cacacacacacag

SEQ ID NO: 2110989 - RNA, 14 nt, Human
cacacacacacagg

SEQ ID NO: 2110990 - RNA, 16 nt, Human
cacacacacacaggag

SEQ ID NO: 2110991 - RNA, 14 nt, Human
cacacacacaggag

SEQ ID NO: 2110992 - RNA, 12 nt, Human
cacacacacagg

SEQ ID NO: 2110993 - RNA, 13 nt, Human
cacacacacagga

SEQ ID NO: 2110994 - RNA, 16 nt, Human
caauguuuaaaaaagu

SEQ ID NO: 2110995 - RNA, 18 nt, Human
caauguuuaaaaaaguuu

SEQ ID NO: 2110996 - RNA, 20 nt, Human
caauguuuaaaaaaguuuaa

SEQ ID NO: 2110997 - RNA, 21 nt, Human
caauguuuaaaaaaguuuaaa

SEQ ID NO: 2110998 - RNA, 23 nt, Human
caauguuuaaaaaaguuuaaaau

SEQ ID NO: 2110999 - RNA, 20 nt, Human
caauguuuaugcaaggaagg

SEQ ID NO: 2111000 - RNA, 23 nt, Human
caauguuuaugcaaggaaggaaa

SEQ ID NO: 2111001 - RNA, 13 nt, Human
caauguuucuuuu

SEQ ID NO: 2111002 - RNA, 16 nt, Human
caauguuucuuuuauc

SEQ ID NO: 2111003 - RNA, 18 nt, Human
caauguuucuuuuaucac

SEQ ID NO: 2111004 - RNA, 21 nt, Human
caauguggccuaaaaaugcaa

SEQ ID NO: 2111005 - RNA, 23 nt, Human
caaugugcuacugauuguuucau

SEQ ID NO: 2111006 - RNA, 21 nt, Human
caaugugguugcaaggccgcu

SEQ ID NO: 2111007 - RNA, 13 nt, Human
caauauccucgcu

SEQ ID NO: 2111008 - RNA, 14 nt, Human
caauauccucgcuc

SEQ ID NO: 2111009 - RNA, 19 nt, Human
caauauccucgcucccggg

SEQ ID NO: 2111010 - RNA, 22 nt, Human
caaugugaaaagaaaaaugagc

SEQ ID NO: 2111011 - RNA, 14 nt, Human
caaugugaaucaga

SEQ ID NO: 2111012 - RNA, 18 nt, Human
caaugugaaucagacccu

SEQ ID NO: 2111013 - RNA, 19 nt, Human
caaugugaaucagacccua

SEQ ID NO: 2111014 - RNA, 13 nt, Human
caaugugccccca

SEQ ID NO: 2111015 - RNA, 16 nt, Human
caaugugcuacugauu

SEQ ID NO: 2111016 - RNA, 15 nt, Human
caauuaggaagugua

SEQ ID NO: 2111017 - RNA, 16 nt, Human
caauuaggaaguguaa

SEQ ID NO: 2111018 - RNA, 20 nt, Human
caauuaggaaguguaacagc

SEQ ID NO: 2111019 - RNA, 23 nt, Human
caauuaggaaguguaacagcuga

SEQ ID NO: 2111020 - RNA, 22 nt, Human
caauuaggaaguguaacagcug

SEQ ID NO: 2111021 - RNA, 14 nt, Human
caauuccucuggga

SEQ ID NO: 2111022 - RNA, 13 nt, Human
caauuccucuggg

SEQ ID NO: 2111023 - RNA, 15 nt, Human
caauuccuagauaaa

SEQ ID NO: 2111024 - RNA, 16 nt, Human
caauuccuagauaaaa

SEQ ID NO: 2111025 - RNA, 18 nt, Human
caauuccuagauaaaaag

SEQ ID NO: 2111026 - RNA, 22 nt, Human
caauuccuagauaaaaagaugg

SEQ ID NO: 2111027 - RNA, 15 nt, Human
caauuccucugggaa

SEQ ID NO: 2111028 - RNA, 12 nt, Human
caauuccugggc

SEQ ID NO: 2111029 - RNA, 16 nt, Human
caauuccugggcccca

SEQ ID NO: 2111030 - RNA, 13 nt, Human
caauuccugggcc

SEQ ID NO: 2111031 - RNA, 22 nt, Human
cacaaaaaaaauuuaaaaaaau

SEQ ID NO: 2111032 - RNA, 15 nt, Human
cacaaaaucugucca

SEQ ID NO: 2111033 - RNA, 16 nt, Human
cacaaaauugggaaag

SEQ ID NO: 2111034 - RNA, 14 nt, Human
cacaaacaaacaag

SEQ ID NO: 2111035 - RNA, 18 nt, Human
cacaaacaaacaagcuag

SEQ ID NO: 2111036 - RNA, 19 nt, Human
cacaaacaaacaagcuagg

SEQ ID NO: 2111037 - RNA, 18 nt, Human
cacaaagcccuuccaugu

SEQ ID NO: 2111038 - RNA, 17 nt, Human
cacacuccccugcacug

SEQ ID NO: 2111039 - RNA, 14 nt, Human
cacacuccaucagc

SEQ ID NO: 2111040 - RNA, 15 nt, Human
cacacuccaucagcu

SEQ ID NO: 2111041 - RNA, 17 nt, Human
cacacuccaucagcuua

SEQ ID NO: 2111042 - RNA, 12 nt, Human
cacagagaaagu

SEQ ID NO: 2111043 - RNA, 13 nt, Human
cacagaggaagag

SEQ ID NO: 2111044 - RNA, 21 nt, Human
cacagagaaaguacuucucca

SEQ ID NO: 2111045 - RNA, 20 nt, Human
cacagagaaaguacuucucc

SEQ ID NO: 2111046 - RNA, 19 nt, Human
cacagagaaaguacuucuc

SEQ ID NO: 2111047 - RNA, 12 nt, Human
cacagauggauu

SEQ ID NO: 2111048 - RNA, 11 nt, Human
cacagaugccu

SEQ ID NO: 2111049 - RNA, 19 nt, Human
cacagauggauuugccugu

SEQ ID NO: 2111050 - RNA, 17 nt, Human
cacagauggauuugccu

SEQ ID NO: 2111051 - RNA, 18 nt, Human
cacagaguggucuuucug

SEQ ID NO: 2111052 - RNA, 22 nt, Human
cacagaucacagcuucagccag

SEQ ID NO: 2111053 - RNA, 19 nt, Human
cacagaucacagcuucagc

SEQ ID NO: 2111054 - RNA, 14 nt, Human
cacagaucacagcu

SEQ ID NO: 2111055 - RNA, 18 nt, Human
cacagaggcuucuucaga

SEQ ID NO: 2111056 - RNA, 17 nt, Human
cacagaggaagagcagg

SEQ ID NO: 2111057 - RNA, 15 nt, Human
cacagaggaagagca

SEQ ID NO: 2111058 - RNA, 16 nt, Human
cacagaggaagagcag

SEQ ID NO: 2111059 - RNA, 13 nt, Human
cacagaggcugcc

SEQ ID NO: 2111060 - RNA, 23 nt, Human
cacagcccugucagugcagcccg

SEQ ID NO: 2111061 - RNA, 18 nt, Human
cacagcugcagagacaga

SEQ ID NO: 2111062 - RNA, 19 nt, Human
cacagcugcagagacagag

SEQ ID NO: 2111063 - RNA, 21 nt, Human
cacagcccugucagugcagcc

SEQ ID NO: 2111064 - RNA, 14 nt, Human
cacagcccugucag

SEQ ID NO: 2111065 - RNA, 12 nt, Human
cacagcccuguc

SEQ ID NO: 2111066 - RNA, 18 nt, Human
cacagcccugucagugca

SEQ ID NO: 2111067 - RNA, 13 nt, Human
cacagcccuguca

SEQ ID NO: 2111068 - RNA, 10 nt, Human
cacagcccug

SEQ ID NO: 2111069 - RNA, 11 nt, Human
cacagcccugu

SEQ ID NO: 2111070 - RNA, 13 nt, Human
cacagccagaacc

SEQ ID NO: 2111071 - RNA, 16 nt, Human
cacagccagaaccccg

SEQ ID NO: 2111072 - RNA, 19 nt, Human
cacagccagaaccccgagc

SEQ ID NO: 2111073 - RNA, 14 nt, Human
cacagcccaggccu

SEQ ID NO: 2111074 - RNA, 16 nt, Human
cacagcccaggccucc

SEQ ID NO: 2111075 - RNA, 21 nt, Human
cacagcccaggccuccagcuc

SEQ ID NO: 2111076 - RNA, 22 nt, Human
cacagcccaggccuccagcuca

SEQ ID NO: 2111077 - RNA, 15 nt, Human
cacagcccgcaugca

SEQ ID NO: 2111078 - RNA, 17 nt, Human
cacagcccgcaugcagc

SEQ ID NO: 2111079 - RNA, 18 nt, Human
cacagcccgcaugcagca

SEQ ID NO: 2111080 - RNA, 21 nt, Human
cacagcccgcaugcagcagcu

SEQ ID NO: 2111081 - RNA, 23 nt, Human
cacagcccgcaugcagcagcuug

SEQ ID NO: 2111082 - RNA, 13 nt, Human
cacaguggaacca

SEQ ID NO: 2111083 - RNA, 19 nt, Human
cacaguggaaccagcccag

SEQ ID NO: 2111084 - RNA, 13 nt, Human
cacaguguguuug

SEQ ID NO: 2111085 - RNA, 16 nt, Human
cacaguguguuuguga

SEQ ID NO: 2111086 - RNA, 14 nt, Human
cacaguguugccca

SEQ ID NO: 2111087 - RNA, 19 nt, Human
cacaguguugcccaggcug

SEQ ID NO: 2111088 - RNA, 17 nt, Human
cacaguucaauucucau

SEQ ID NO: 2111089 - RNA, 10 nt, Human
cacaguguuu

SEQ ID NO: 2111090 - RNA, 19 nt, Human
cacagugcaucucagccca

SEQ ID NO: 2111091 - RNA, 18 nt, Human
cacagugcaucucagccc

SEQ ID NO: 2111092 - RNA, 17 nt, Human
cacagugcaucucagcc

SEQ ID NO: 2111093 - RNA, 21 nt, Human
cacaggcccuuccucuccacu

SEQ ID NO: 2111094 - RNA, 22 nt, Human
cacaguggaaagacagcuucuc

SEQ ID NO: 2111095 - RNA, 22 nt, Human
cacagugcuuuccguggcacug

SEQ ID NO: 2111096 - RNA, 16 nt, Human
cacagcuuccccucuc

SEQ ID NO: 2111097 - RNA, 22 nt, Human
cacagcuuccccucucuccucc

SEQ ID NO: 2111098 - RNA, 23 nt, Human
cacagcuuccccucucuccuccu

SEQ ID NO: 2111099 - RNA, 12 nt, Human
cacagcuugggg

SEQ ID NO: 2111100 - RNA, 15 nt, Human
cacagcuuggggcca

SEQ ID NO: 2111101 - RNA, 18 nt, Human
cacagcuuggggccaucg

SEQ ID NO: 2111102 - RNA, 19 nt, Human
cacaggcccuuccucucca

SEQ ID NO: 2111103 - RNA, 18 nt, Human
cacaggcccuuccucucc

SEQ ID NO: 2111104 - RNA, 17 nt, Human
cacaggcccuuccucuc

SEQ ID NO: 2111105 - RNA, 16 nt, Human
cacaggcccuuccucu

SEQ ID NO: 2111106 - RNA, 21 nt, Human
cacagcuuuuaguacccaccu

SEQ ID NO: 2111107 - RNA, 23 nt, Human
cacagcuuuuaguacccaccuga

SEQ ID NO: 2111108 - RNA, 13 nt, Human
cauaacuagaacu

SEQ ID NO: 2111109 - RNA, 12 nt, Human
cauaagaaugaa

SEQ ID NO: 2111110 - RNA, 21 nt, Human
cauaagaaugaauaauaauua

SEQ ID NO: 2111111 - RNA, 13 nt, Human
cauaacugacaaa

SEQ ID NO: 2111112 - RNA, 15 nt, Human
cauaacugacaaauc

SEQ ID NO: 2111113 - RNA, 16 nt, Human
cauaacugacaaauca

SEQ ID NO: 2111114 - RNA, 19 nt, Human
cauaacugacaaaucaagu

SEQ ID NO: 2111115 - RNA, 20 nt, Human
cauaacugacaaaucaaguu

SEQ ID NO: 2111116 - RNA, 21 nt, Human
cauaacugacaaaucaaguuu

SEQ ID NO: 2111117 - RNA, 22 nt, Human
cauaacugacaaaucaaguuuc

SEQ ID NO: 2111118 - RNA, 21 nt, Human
cauaagccuccauuuaguucu

SEQ ID NO: 2111119 - RNA, 23 nt, Human
cauaagccuccauuuaguucuuu

SEQ ID NO: 2111120 - RNA, 14 nt, Human
cauaagauaaaugu

SEQ ID NO: 2111121 - RNA, 18 nt, Human
cauaauaaauaucuguac

SEQ ID NO: 2111122 - RNA, 17 nt, Human
cauaauaagcuaaagag

SEQ ID NO: 2111123 - RNA, 18 nt, Human
cauaacaaauaaccaacc

SEQ ID NO: 2111124 - RNA, 22 nt, Human
cauaaggaauguagcugguuuc

SEQ ID NO: 2111125 - RNA, 22 nt, Human
cauaagcuauagacccgaggaa

SEQ ID NO: 2111126 - RNA, 21 nt, Human
cauaagggagcguagaaucug

SEQ ID NO: 2111127 - RNA, 17 nt, Human
cauacauuuauaauguu

SEQ ID NO: 2111128 - RNA, 21 nt, Human
cauacauuuauaauguuugcu

SEQ ID NO: 2111129 - RNA, 22 nt, Human
cauacauuuauaauguuugcua

SEQ ID NO: 2111130 - RNA, 23 nt, Human
cauacauuuauaauguuugcuau

SEQ ID NO: 2111131 - RNA, 24 nt, Human
cauacauuuauaauguuugcuauu

SEQ ID NO: 2111132 - RNA, 16 nt, Human
cauaaccuagccuuag

SEQ ID NO: 2111133 - RNA, 13 nt, Human
cauaaccacugcu

SEQ ID NO: 2111134 - RNA, 14 nt, Human
cauaaccacugcuu

SEQ ID NO: 2111135 - RNA, 15 nt, Human
cauaaccacugcuuc

SEQ ID NO: 2111136 - RNA, 13 nt, Human
cauaacagaaugc

SEQ ID NO: 2111137 - RNA, 17 nt, Human
cauaacagaaugcacca

SEQ ID NO: 2111138 - RNA, 17 nt, Human
cauaacaggguaaauua

SEQ ID NO: 2111139 - RNA, 19 nt, Human
cauaacaggguaaauuauu

SEQ ID NO: 2111140 - RNA, 22 nt, Human
cauaacaggguaaauuauucag

SEQ ID NO: 2111141 - RNA, 13 nt, Human
cauaacagugcca

SEQ ID NO: 2111142 - RNA, 14 nt, Human
cauaacagugccau

SEQ ID NO: 2111143 - RNA, 16 nt, Human
cauaacagugccauug

SEQ ID NO: 2111144 - RNA, 19 nt, Human
cauaacagugccauugucu

SEQ ID NO: 2111145 - RNA, 22 nt, Human
cauaacagugccauugucuuua

SEQ ID NO: 2111146 - RNA, 14 nt, Human
cauaaaugaggaaa

SEQ ID NO: 2111147 - RNA, 21 nt, Human
cauaaagccuuggauguauau

SEQ ID NO: 2111148 - RNA, 18 nt, Human
cauaaaggauaaacuuuu

SEQ ID NO: 2111149 - RNA, 21 nt, Human
cauaaaggauaaacuuuuaga

SEQ ID NO: 2111150 - RNA, 23 nt, Human
cauaaaggauaaacuuuuagaaa

SEQ ID NO: 2111151 - RNA, 20 nt, Human
cauaaaggugguaugugugu

SEQ ID NO: 2111152 - RNA, 22 nt, Human
cauaaaggugguaugugugugu

SEQ ID NO: 2111153 - RNA, 21 nt, Human
cauaaagguuauuuucuccug

SEQ ID NO: 2111154 - RNA, 22 nt, Human
cauaaagguuauuuucuccuga

SEQ ID NO: 2111155 - RNA, 15 nt, Human
cauaaagucagugcc

SEQ ID NO: 2111156 - RNA, 23 nt, Human
cauaaaggugguaugugugugua

SEQ ID NO: 2111157 - RNA, 22 nt, Human
cauaaauaaauuaaauaaaaua

SEQ ID NO: 2111158 - RNA, 14 nt, Human
cauaaacugugugc

SEQ ID NO: 2111159 - RNA, 15 nt, Human
cauaaacugugugca

SEQ ID NO: 2111160 - RNA, 13 nt, Human
cauaaaauuggau

SEQ ID NO: 2111161 - RNA, 22 nt, Human
cauaaaauuuucuacucuuuuu

SEQ ID NO: 2111162 - RNA, 20 nt, Human
cauaaaauaaaguauauaua

SEQ ID NO: 2111163 - RNA, 19 nt, Human
cauaaaauaaaguauauau

SEQ ID NO: 2111164 - RNA, 21 nt, Human
cauaaaaauuagccaagugug

SEQ ID NO: 2111165 - RNA, 14 nt, Human
cauaaaaaguuaaa

SEQ ID NO: 2111166 - RNA, 18 nt, Human
cauaaaaaguuaaaaaaa

SEQ ID NO: 2111167 - RNA, 22 nt, Human
cauaaaaaguuaaaaaaaauaa

SEQ ID NO: 2111168 - RNA, 15 nt, Human
caguuuuuauugcuu

SEQ ID NO: 2111169 - RNA, 23 nt, Human
caguugguaagcuuccaggaaaa

SEQ ID NO: 2111170 - RNA, 22 nt, Human
caguuuuccuucucaucuguga

SEQ ID NO: 2111171 - RNA, 15 nt, Human
caguugguguguuuu

SEQ ID NO: 2111172 - RNA, 16 nt, Human
caguugguguguuuuu

SEQ ID NO: 2111173 - RNA, 22 nt, Human
caguugucccgauuguaacuca

SEQ ID NO: 2111174 - RNA, 18 nt, Human
caguugucccgauuguaa

SEQ ID NO: 2111175 - RNA, 20 nt, Human
caguugucccgauuguaacu

SEQ ID NO: 2111176 - RNA, 21 nt, Human
caguugucccgauuguaacuc

SEQ ID NO: 2111177 - RNA, 16 nt, Human
caguuggccagagagc

SEQ ID NO: 2111178 - RNA, 16 nt, Human
caguuggguggaugcc

SEQ ID NO: 2111179 - RNA, 17 nt, Human
caguuggccagagagcc

SEQ ID NO: 2111180 - RNA, 18 nt, Human
caguugggaaaauauguc

SEQ ID NO: 2111181 - RNA, 17 nt, Human
caguugcgcguucugaa

SEQ ID NO: 2111182 - RNA, 22 nt, Human
caguugcgcguucugaaauauu

SEQ ID NO: 2111183 - RNA, 19 nt, Human
caguuggguggaugccugg

SEQ ID NO: 2111184 - RNA, 18 nt, Human
caguuggguggaugccug

SEQ ID NO: 2111185 - RNA, 16 nt, Human
caguugcacuuggccu

SEQ ID NO: 2111186 - RNA, 13 nt, Human
caguugcacuugg

SEQ ID NO: 2111187 - RNA, 19 nt, Human
caguugcacuuggccucug

SEQ ID NO: 2111188 - RNA, 20 nt, Human
caguugcacuuggccucugg

SEQ ID NO: 2111189 - RNA, 14 nt, Human
caguugaauuucau

SEQ ID NO: 2111190 - RNA, 20 nt, Human
caguucuuuuguuguaaaga

SEQ ID NO: 2111191 - RNA, 22 nt, Human
cauaccaggccgccccagccuc

SEQ ID NO: 2111192 - RNA, 17 nt, Human
caguguacagucuugua

SEQ ID NO: 2111193 - RNA, 18 nt, Human
caguguacagucuuguau

SEQ ID NO: 2111194 - RNA, 16 nt, Human
caguguacauggaaua

SEQ ID NO: 2111195 - RNA, 12 nt, Human
caguguacaguc

SEQ ID NO: 2111196 - RNA, 15 nt, Human
caguguacagucuug

SEQ ID NO: 2111197 - RNA, 20 nt, Human
caguguacauggaauaacau

SEQ ID NO: 2111198 - RNA, 23 nt, Human
caguguacauggaauaacaugua

SEQ ID NO: 2111199 - RNA, 20 nt, Human
cagugucauuuaugaaaaga

SEQ ID NO: 2111200 - RNA, 14 nt, Human
caguguagccccaa

SEQ ID NO: 2111201 - RNA, 21 nt, Human
caguguagccccaagaaggcu

SEQ ID NO: 2111202 - RNA, 22 nt, Human
caguguagccccaagaaggcug

SEQ ID NO: 2111203 - RNA, 19 nt, Human
caguguagccuugcccgga

SEQ ID NO: 2111204 - RNA, 12 nt, Human
caguguccuccc

SEQ ID NO: 2111205 - RNA, 18 nt, Human
caguguccuccccucaag

SEQ ID NO: 2111206 - RNA, 19 nt, Human
caguguccuccccucaagg

SEQ ID NO: 2111207 - RNA, 20 nt, Human
caguguccuccccucaagga

SEQ ID NO: 2111208 - RNA, 14 nt, Human
cagugugacaagga

SEQ ID NO: 2111209 - RNA, 15 nt, Human
cagugucuuucuuug

SEQ ID NO: 2111210 - RNA, 18 nt, Human
cagugucuuucuuuggug

SEQ ID NO: 2111211 - RNA, 22 nt, Human
cagugucuuucuuuggugccuu

SEQ ID NO: 2111212 - RNA, 14 nt, Human
cagugucucggagg

SEQ ID NO: 2111213 - RNA, 22 nt, Human
cagugucuguaucggagacagu

SEQ ID NO: 2111214 - RNA, 13 nt, Human
cagugucuuccau

SEQ ID NO: 2111215 - RNA, 23 nt, Human
cagugucuguaucggagacagug

SEQ ID NO: 2111216 - RNA, 24 nt, Human
cagugucuguaucggagacaguga

SEQ ID NO: 2111217 - RNA, 14 nt, Human
cagugucuuccaua

SEQ ID NO: 2111218 - RNA, 15 nt, Human
cagugucuuccauaa

SEQ ID NO: 2111219 - RNA, 16 nt, Human
cagugucuuccauaau

SEQ ID NO: 2111220 - RNA, 17 nt, Human
cagugucuuccauaaug

SEQ ID NO: 2111221 - RNA, 18 nt, Human
cagugucuuccauaaugu

SEQ ID NO: 2111222 - RNA, 20 nt, Human
cagugucuuccauaauguau

SEQ ID NO: 2111223 - RNA, 22 nt, Human
cagugucuuccauaauguauaa

SEQ ID NO: 2111224 - RNA, 23 nt, Human
cagugucuuccauaauguauaaa

SEQ ID NO: 2111225 - RNA, 21 nt, Human
cagugugggaaugcggcaaga

SEQ ID NO: 2111226 - RNA, 23 nt, Human
cagugugggaaugcggcaagaag

SEQ ID NO: 2111227 - RNA, 22 nt, Human
caguguguggcuuucagagccu

SEQ ID NO: 2111228 - RNA, 21 nt, Human
caguguguggcuuucagagcc

SEQ ID NO: 2111229 - RNA, 15 nt, Human
cagugugguaguuaa

SEQ ID NO: 2111230 - RNA, 13 nt, Human
cagugugucuccu

SEQ ID NO: 2111231 - RNA, 14 nt, Human
cagugugucuccug

SEQ ID NO: 2111232 - RNA, 15 nt, Human
cagugugucuccugc

SEQ ID NO: 2111233 - RNA, 16 nt, Human
cagugugucuccugca

SEQ ID NO: 2111234 - RNA, 17 nt, Human
cagugugucuccugcau

SEQ ID NO: 2111235 - RNA, 19 nt, Human
cagugugucuccugcaugc

SEQ ID NO: 2111236 - RNA, 18 nt, Human
cagugugaucccaagugc

SEQ ID NO: 2111237 - RNA, 19 nt, Human
cagugugaucccaagugcc

SEQ ID NO: 2111238 - RNA, 22 nt, Human
cagugugaucccaagugccagu

SEQ ID NO: 2111239 - RNA, 18 nt, Human
cagugugcacgaguggga

SEQ ID NO: 2111240 - RNA, 21 nt, Human
cagugugcacgagugggaagg

SEQ ID NO: 2111241 - RNA, 22 nt, Human
cagugugcacgagugggaagga

SEQ ID NO: 2111242 - RNA, 16 nt, Human
caguggaaccagccca

SEQ ID NO: 2111243 - RNA, 23 nt, Human
caguggaauauaaggaaagcaau

SEQ ID NO: 2111244 - RNA, 13 nt, Human
caguggacaccag

SEQ ID NO: 2111245 - RNA, 22 nt, Human
caguggacaccaggagucccug

SEQ ID NO: 2111246 - RNA, 16 nt, Human
caguggcagcugcuuu

SEQ ID NO: 2111247 - RNA, 15 nt, Human
caguggcagcugcuu

SEQ ID NO: 2111248 - RNA, 14 nt, Human
caguggcagcugcu

SEQ ID NO: 2111249 - RNA, 13 nt, Human
caguggcagcugc

SEQ ID NO: 2111250 - RNA, 21 nt, Human
caguggacuuuccacccccuc

SEQ ID NO: 2111251 - RNA, 22 nt, Human
caguggacuuuccacccccucc

SEQ ID NO: 2111252 - RNA, 23 nt, Human
caguggacuuuccacccccuccc

SEQ ID NO: 2111253 - RNA, 17 nt, Human
caguggacuuuccaccc

SEQ ID NO: 2111254 - RNA, 18 nt, Human
caguggacuuuccacccc

SEQ ID NO: 2111255 - RNA, 19 nt, Human
caguggacuuuccaccccc

SEQ ID NO: 2111256 - RNA, 20 nt, Human
caguggacuuuccacccccu

SEQ ID NO: 2111257 - RNA, 14 nt, Human
caguggaggugcug

SEQ ID NO: 2111258 - RNA, 15 nt, Human
caguggaggugcugc

SEQ ID NO: 2111259 - RNA, 12 nt, Human
caguggcagcug

SEQ ID NO: 2111260 - RNA, 11 nt, Human
cagugggaacu

SEQ ID NO: 2111261 - RNA, 22 nt, Human
cagugggaacgugacugcccca

SEQ ID NO: 2111262 - RNA, 14 nt, Human
cagugguuauuuag

SEQ ID NO: 2111263 - RNA, 21 nt, Human
cagugguucuacaaucuauuu

SEQ ID NO: 2111264 - RNA, 22 nt, Human
cagugguucuacaaucuauuua

SEQ ID NO: 2111265 - RNA, 19 nt, Human
cagugggaacgugacugcc

SEQ ID NO: 2111266 - RNA, 20 nt, Human
cagugggaacgugacugccc

SEQ ID NO: 2111267 - RNA, 21 nt, Human
cagugggaacgugacugcccc

SEQ ID NO: 2111268 - RNA, 13 nt, Human
caguggcugucac

SEQ ID NO: 2111269 - RNA, 16 nt, Human
caguggccucaacccu

SEQ ID NO: 2111270 - RNA, 19 nt, Human
caguggccucaacccuccc

SEQ ID NO: 2111271 - RNA, 20 nt, Human
caguggccucaacccucccu

SEQ ID NO: 2111272 - RNA, 21 nt, Human
caguggccucaacccucccuc

SEQ ID NO: 2111273 - RNA, 22 nt, Human
caguggccucaacccucccuca

SEQ ID NO: 2111274 - RNA, 13 nt, Human
caguggccuggcu

SEQ ID NO: 2111275 - RNA, 14 nt, Human
caguggccuggcuc

SEQ ID NO: 2111276 - RNA, 15 nt, Human
caguggccuggcucc

SEQ ID NO: 2111277 - RNA, 18 nt, Human
caguggccuggcuccgcu

SEQ ID NO: 2111278 - RNA, 23 nt, Human
caguggccuggcuccgcugugug

SEQ ID NO: 2111279 - RNA, 13 nt, Human
caguggcucuuuu

SEQ ID NO: 2111280 - RNA, 20 nt, Human
caguggcucacgccuaugau

SEQ ID NO: 2111281 - RNA, 23 nt, Human
caguggccucaacccucccucag

SEQ ID NO: 2111282 - RNA, 15 nt, Human
caguggcauggcucc

SEQ ID NO: 2111283 - RNA, 16 nt, Human
caguggcauggcucca

SEQ ID NO: 2111284 - RNA, 17 nt, Human
caguggcauggcuccag

SEQ ID NO: 2111285 - RNA, 19 nt, Human
caguggcauggcuccaguc

SEQ ID NO: 2111286 - RNA, 16 nt, Human
caguggauugcauuuc

SEQ ID NO: 2111287 - RNA, 14 nt, Human
caguggauuaauua

SEQ ID NO: 2111288 - RNA, 16 nt, Human
caguguuuuaggagca

SEQ ID NO: 2111289 - RNA, 16 nt, Human
caguuaacuuucagaa

SEQ ID NO: 2111290 - RNA, 20 nt, Human
caguuaacuuucagaagaga

SEQ ID NO: 2111291 - RNA, 22 nt, Human
caguuaacuuucagaagagaug

SEQ ID NO: 2111292 - RNA, 18 nt, Human
caguguuucccauaauuu

SEQ ID NO: 2111293 - RNA, 20 nt, Human
caguguuucccauaauuuuc

SEQ ID NO: 2111294 - RNA, 21 nt, Human
caguguuucccauaauuuucu

SEQ ID NO: 2111295 - RNA, 20 nt, Human
caguguuuuaggagcaugag

SEQ ID NO: 2111296 - RNA, 14 nt, Human
caguguuguuugua

SEQ ID NO: 2111297 - RNA, 15 nt, Human
caguguuguuuguaa

SEQ ID NO: 2111298 - RNA, 16 nt, Human
caguguuguuuguaaa

SEQ ID NO: 2111299 - RNA, 17 nt, Human
caguguuguuuguaaau

SEQ ID NO: 2111300 - RNA, 18 nt, Human
caguguuguuuguaaaua

SEQ ID NO: 2111301 - RNA, 19 nt, Human
caguguuguuuguaaauaa

SEQ ID NO: 2111302 - RNA, 20 nt, Human
caguguuguuuguaaauaag

SEQ ID NO: 2111303 - RNA, 21 nt, Human
caguguuguuuguaaauaaga

SEQ ID NO: 2111304 - RNA, 22 nt, Human
caguguuguuuguaaauaagag

SEQ ID NO: 2111305 - RNA, 23 nt, Human
caguguuguuuguaaauaagaga

SEQ ID NO: 2111306 - RNA, 14 nt, Human
caguguuucccaua

SEQ ID NO: 2111307 - RNA, 15 nt, Human
caguguuucccauaa

SEQ ID NO: 2111308 - RNA, 17 nt, Human
caguguuucccauaauu

SEQ ID NO: 2111309 - RNA, 14 nt, Human
caguguuauuuucu

SEQ ID NO: 2111310 - RNA, 17 nt, Human
caguguguuugugauug

SEQ ID NO: 2111311 - RNA, 14 nt, Human
caguguuaaaaaau

SEQ ID NO: 2111312 - RNA, 19 nt, Human
caguuaagcagccgccaca

SEQ ID NO: 2111313 - RNA, 12 nt, Human
caguuaaucuug

SEQ ID NO: 2111314 - RNA, 15 nt, Human
caguuaaucuugcuu

SEQ ID NO: 2111315 - RNA, 14 nt, Human
caguuaagaaaaaa

SEQ ID NO: 2111316 - RNA, 15 nt, Human
caguuaagaaaaaaa

SEQ ID NO: 2111317 - RNA, 16 nt, Human
caguuaagaaaaaaau

SEQ ID NO: 2111318 - RNA, 17 nt, Human
caguuaagaaaaaaaua

SEQ ID NO: 2111319 - RNA, 18 nt, Human
caguuaagaaaaaaauaa

SEQ ID NO: 2111320 - RNA, 19 nt, Human
caguuaagaaaaaaauaau

SEQ ID NO: 2111321 - RNA, 20 nt, Human
caguuaagaaaaaaauaauu

SEQ ID NO: 2111322 - RNA, 21 nt, Human
caguuaagaaaaaaauaauuu

SEQ ID NO: 2111323 - RNA, 22 nt, Human
caguuaagaaaaaaauaauuuu

SEQ ID NO: 2111324 - RNA, 13 nt, Human
caguucccuuggc

SEQ ID NO: 2111325 - RNA, 14 nt, Human
caguuccugcagca

SEQ ID NO: 2111326 - RNA, 16 nt, Human
caguuccugcagcaga

SEQ ID NO: 2111327 - RNA, 19 nt, Human
caguuccugcagcagagcc

SEQ ID NO: 2111328 - RNA, 21 nt, Human
caguuccugcagcagagccug

SEQ ID NO: 2111329 - RNA, 13 nt, Human
caguuccucgccc

SEQ ID NO: 2111330 - RNA, 14 nt, Human
caguuccucgcccu

SEQ ID NO: 2111331 - RNA, 17 nt, Human
caguuccucgcccuggg

SEQ ID NO: 2111332 - RNA, 18 nt, Human
caguuccucgcccugggu

SEQ ID NO: 2111333 - RNA, 14 nt, Human
caguucccuuggcc

SEQ ID NO: 2111334 - RNA, 15 nt, Human
caguucccuuggccu

SEQ ID NO: 2111335 - RNA, 16 nt, Human
caguucccuuggccuc

SEQ ID NO: 2111336 - RNA, 17 nt, Human
caguucccuuggccuca

SEQ ID NO: 2111337 - RNA, 18 nt, Human
caguucccuuggccucag

SEQ ID NO: 2111338 - RNA, 19 nt, Human
caguucccuuggccucaga

SEQ ID NO: 2111339 - RNA, 20 nt, Human
caguucccuuggccucagaa

SEQ ID NO: 2111340 - RNA, 15 nt, Human
caguuccuuucaaug

SEQ ID NO: 2111341 - RNA, 12 nt, Human
caguugaaaaac

SEQ ID NO: 2111342 - RNA, 18 nt, Human
caguugaaaaacagcuga

SEQ ID NO: 2111343 - RNA, 19 nt, Human
caguugaaaaacagcugag

SEQ ID NO: 2111344 - RNA, 20 nt, Human
caguucugggugcucccuac

SEQ ID NO: 2111345 - RNA, 17 nt, Human
caguucugggugcuccc

SEQ ID NO: 2111346 - RNA, 11 nt, Human
caguucugcaa

SEQ ID NO: 2111347 - RNA, 12 nt, Human
caguucugcaaa

SEQ ID NO: 2111348 - RNA, 13 nt, Human
caguucugcaaau

SEQ ID NO: 2111349 - RNA, 17 nt, Human
caguucugcaaauagaa

SEQ ID NO: 2111350 - RNA, 18 nt, Human
caguucugcaaauagaaa

SEQ ID NO: 2111351 - RNA, 20 nt, Human
caguucugcaaauagaaaac

SEQ ID NO: 2111352 - RNA, 14 nt, Human
cauaugcaaacaua

SEQ ID NO: 2111353 - RNA, 14 nt, Human
cauauuuacuucuu

SEQ ID NO: 2111354 - RNA, 20 nt, Human
cauauuuacuucuuauacau

SEQ ID NO: 2111355 - RNA, 16 nt, Human
cauauuuacuucuuau

SEQ ID NO: 2111356 - RNA, 17 nt, Human
cauauuuacuucuuaua

SEQ ID NO: 2111357 - RNA, 12 nt, Human
cauauuucaauu

SEQ ID NO: 2111358 - RNA, 22 nt, Human
cauauuuauagcaauccauguu

SEQ ID NO: 2111359 - RNA, 15 nt, Human
cauauuugagacuag

SEQ ID NO: 2111360 - RNA, 18 nt, Human
caucaagcacagaaggag

SEQ ID NO: 2111361 - RNA, 21 nt, Human
caucaagcacagaaggaggag

SEQ ID NO: 2111362 - RNA, 23 nt, Human
caucaagcacagaaggaggagga

SEQ ID NO: 2111363 - RNA, 16 nt, Human
caucaaaguggcaaaa

SEQ ID NO: 2111364 - RNA, 17 nt, Human
caucaaacucuuaguua

SEQ ID NO: 2111365 - RNA, 21 nt, Human
caucaaguuauugacaaacuc

SEQ ID NO: 2111366 - RNA, 22 nt, Human
caucaaguuauugacaaacucu

SEQ ID NO: 2111367 - RNA, 23 nt, Human
caucaaguuauugacaaacucuc

SEQ ID NO: 2111368 - RNA, 16 nt, Human
caucaauuauagaaag

SEQ ID NO: 2111369 - RNA, 15 nt, Human
caucaauguucauug

SEQ ID NO: 2111370 - RNA, 16 nt, Human
caucaauguucauugu

SEQ ID NO: 2111371 - RNA, 11 nt, Human
caucaauguuc

SEQ ID NO: 2111372 - RNA, 14 nt, Human
caucaauguucauu

SEQ ID NO: 2111373 - RNA, 18 nt, Human
caucaauguucauuguaa

SEQ ID NO: 2111374 - RNA, 11 nt, Human
caucacacaca

SEQ ID NO: 2111375 - RNA, 12 nt, Human
caucacacacac

SEQ ID NO: 2111376 - RNA, 22 nt, Human
caucacaggacacggggcagug

SEQ ID NO: 2111377 - RNA, 13 nt, Human
caucacagggcag

SEQ ID NO: 2111378 - RNA, 15 nt, Human
caucacagggcagag

SEQ ID NO: 2111379 - RNA, 20 nt, Human
caucacagggcagagccggg

SEQ ID NO: 2111380 - RNA, 19 nt, Human
caucacaggguugggccca

SEQ ID NO: 2111381 - RNA, 20 nt, Human
cauauauacacacacaaaga

SEQ ID NO: 2111382 - RNA, 22 nt, Human
cauauauacacacacaaagaga

SEQ ID NO: 2111383 - RNA, 18 nt, Human
cauauauaacuagcuaga

SEQ ID NO: 2111384 - RNA, 17 nt, Human
cauauauaucuaucuua

SEQ ID NO: 2111385 - RNA, 13 nt, Human
cauaucaguugag

SEQ ID NO: 2111386 - RNA, 22 nt, Human
cauauauauguuuuaagaggca

SEQ ID NO: 2111387 - RNA, 23 nt, Human
cauaugauugugcacauacuuga

SEQ ID NO: 2111388 - RNA, 14 nt, Human
cauauccugagcca

SEQ ID NO: 2111389 - RNA, 20 nt, Human
cauaugacucacaugaugca

SEQ ID NO: 2111390 - RNA, 23 nt, Human
cauauccugagccaucggugaaa

SEQ ID NO: 2111391 - RNA, 22 nt, Human
cauaugacucacaugaugcaua

SEQ ID NO: 2111392 - RNA, 15 nt, Human
cauauccugagccau

SEQ ID NO: 2111393 - RNA, 13 nt, Human
cauaugaggaugc

SEQ ID NO: 2111394 - RNA, 20 nt, Human
cauauaaacaucacacacac

SEQ ID NO: 2111395 - RNA, 14 nt, Human
cauauaauauaugu

SEQ ID NO: 2111396 - RNA, 15 nt, Human
cauauaauauauguu

SEQ ID NO: 2111397 - RNA, 16 nt, Human
cauauaauauauguuu

SEQ ID NO: 2111398 - RNA, 17 nt, Human
cauauaauauauguuuu

SEQ ID NO: 2111399 - RNA, 19 nt, Human
cauauaauauauguuuuaa

SEQ ID NO: 2111400 - RNA, 20 nt, Human
cauauaauauauguuuuaaa

SEQ ID NO: 2111401 - RNA, 22 nt, Human
cauauaauauauguuuuaaaua

SEQ ID NO: 2111402 - RNA, 19 nt, Human
cauauaaacaucacacaca

SEQ ID NO: 2111403 - RNA, 19 nt, Human
cauaguggugggcaccuau

SEQ ID NO: 2111404 - RNA, 22 nt, Human
cauaguggcuuaaaacaacacu

SEQ ID NO: 2111405 - RNA, 19 nt, Human
cauaguucccauguuaaau

SEQ ID NO: 2111406 - RNA, 21 nt, Human
cauagaggugagggaagccug

SEQ ID NO: 2111407 - RNA, 17 nt, Human
cauagaggugagggaag

SEQ ID NO: 2111408 - RNA, 22 nt, Human
cauagugaugguuccccuguuc

SEQ ID NO: 2111409 - RNA, 20 nt, Human
cauaguaugguggcuggguu

SEQ ID NO: 2111410 - RNA, 19 nt, Human
cauaguaugguggcugggu

SEQ ID NO: 2111411 - RNA, 18 nt, Human
cauaguaugguggcuggg

SEQ ID NO: 2111412 - RNA, 11 nt, Human
cauacucugcu

SEQ ID NO: 2111413 - RNA, 15 nt, Human
cauacucugucuccc

SEQ ID NO: 2111414 - RNA, 16 nt, Human
cauacucugucucccu

SEQ ID NO: 2111415 - RNA, 15 nt, Human
cauacugagggacca

SEQ ID NO: 2111416 - RNA, 19 nt, Human
cauacugagggaccaacug

SEQ ID NO: 2111417 - RNA, 20 nt, Human
cauacuccuuccaucaaaua

SEQ ID NO: 2111418 - RNA, 20 nt, Human
cauacugagggaccaacugg

SEQ ID NO: 2111419 - RNA, 11 nt, Human
cauacugcugu

SEQ ID NO: 2111420 - RNA, 21 nt, Human
cauagaaggaggagagggaaa

SEQ ID NO: 2111421 - RNA, 15 nt, Human
cauagacuagagaaa

SEQ ID NO: 2111422 - RNA, 16 nt, Human
cauagacuagagaaac

SEQ ID NO: 2111423 - RNA, 17 nt, Human
cauagacuagagaaacc

SEQ ID NO: 2111424 - RNA, 13 nt, Human
caucucagcccac

SEQ ID NO: 2111425 - RNA, 19 nt, Human
caucucacuggaugcaaag

SEQ ID NO: 2111426 - RNA, 14 nt, Human
caucucaggccacc

SEQ ID NO: 2111427 - RNA, 15 nt, Human
caucucaggccaccu

SEQ ID NO: 2111428 - RNA, 18 nt, Human
caucucaggccucccuca

SEQ ID NO: 2111429 - RNA, 17 nt, Human
caucucaggccaccugc

SEQ ID NO: 2111430 - RNA, 20 nt, Human
caucucaggccaccugcccc

SEQ ID NO: 2111431 - RNA, 21 nt, Human
caucucaggccaccugccccc

SEQ ID NO: 2111432 - RNA, 22 nt, Human
caucucaggccaccugcccccu

SEQ ID NO: 2111433 - RNA, 18 nt, Human
caucucagugcuguaaaa

SEQ ID NO: 2111434 - RNA, 17 nt, Human
caucucauuccaacuuc

SEQ ID NO: 2111435 - RNA, 16 nt, Human
caucuauuucugagaa

SEQ ID NO: 2111436 - RNA, 15 nt, Human
caucuauuucugaga

SEQ ID NO: 2111437 - RNA, 14 nt, Human
caucucaaccaucc

SEQ ID NO: 2111438 - RNA, 16 nt, Human
caucucaaccaucccc

SEQ ID NO: 2111439 - RNA, 13 nt, Human
caucuauuucuga

SEQ ID NO: 2111440 - RNA, 14 nt, Human
caucuauuucugag

SEQ ID NO: 2111441 - RNA, 19 nt, Human
caucuaugucccuugcugu

SEQ ID NO: 2111442 - RNA, 16 nt, Human
caucuaccuuuucucu

SEQ ID NO: 2111443 - RNA, 18 nt, Human
caucuaccuuuucucuuc

SEQ ID NO: 2111444 - RNA, 19 nt, Human
caucuaccuuuucucuuca

SEQ ID NO: 2111445 - RNA, 15 nt, Human
caucuacccuccgau

SEQ ID NO: 2111446 - RNA, 14 nt, Human
caucuagcaaaugu

SEQ ID NO: 2111447 - RNA, 18 nt, Human
caucuagcaaauguuaug

SEQ ID NO: 2111448 - RNA, 14 nt, Human
caucuaauaaaaaa

SEQ ID NO: 2111449 - RNA, 16 nt, Human
caucuaccccuggaug

SEQ ID NO: 2111450 - RNA, 19 nt, Human
cauccuccguccagccgcc

SEQ ID NO: 2111451 - RNA, 20 nt, Human
cauccuccguccagccgcca

SEQ ID NO: 2111452 - RNA, 13 nt, Human
cauccucccaagg

SEQ ID NO: 2111453 - RNA, 12 nt, Human
cauccuccccuu

SEQ ID NO: 2111454 - RNA, 13 nt, Human
cauccuccccuuc

SEQ ID NO: 2111455 - RNA, 14 nt, Human
cauccuccccuucc

SEQ ID NO: 2111456 - RNA, 15 nt, Human
cauccuccccuuccc

SEQ ID NO: 2111457 - RNA, 16 nt, Human
cauccuccccuucccu

SEQ ID NO: 2111458 - RNA, 19 nt, Human
cauccuccccuucccugca

SEQ ID NO: 2111459 - RNA, 20 nt, Human
cauccuccccuucccugcaa

SEQ ID NO: 2111460 - RNA, 21 nt, Human
cauccuccccuucccugcaaa

SEQ ID NO: 2111461 - RNA, 16 nt, Human
cauccuccguccagcc

SEQ ID NO: 2111462 - RNA, 20 nt, Human
cauccuaaucauccaaugcu

SEQ ID NO: 2111463 - RNA, 20 nt, Human
caucuugcucugcugacaga

SEQ ID NO: 2111464 - RNA, 15 nt, Human
caucucauccaucaa

SEQ ID NO: 2111465 - RNA, 20 nt, Human
caucuugccuccauggugcc

SEQ ID NO: 2111466 - RNA, 14 nt, Human
caucuugcucugcu

SEQ ID NO: 2111467 - RNA, 13 nt, Human
caucuugcucugc

SEQ ID NO: 2111468 - RNA, 15 nt, Human
caucuugaccaagca

SEQ ID NO: 2111469 - RNA, 16 nt, Human
caucuugaccaagcag

SEQ ID NO: 2111470 - RNA, 17 nt, Human
caucuugaccaagcagg

SEQ ID NO: 2111471 - RNA, 18 nt, Human
caucuugaccaagcagga

SEQ ID NO: 2111472 - RNA, 20 nt, Human
caucuugaccaagcaggaag

SEQ ID NO: 2111473 - RNA, 21 nt, Human
caucuugaccaagcaggaagc

SEQ ID NO: 2111474 - RNA, 22 nt, Human
caucuugaccaagcaggaagcu

SEQ ID NO: 2111475 - RNA, 23 nt, Human
caucuugaccaagcaggaagcuc

SEQ ID NO: 2111476 - RNA, 24 nt, Human
caucuugaccaagcaggaagcuca

SEQ ID NO: 2111477 - RNA, 19 nt, Human
caucuugcccgcucaggcu

SEQ ID NO: 2111478 - RNA, 20 nt, Human
caucuugcccgcucaggcug

SEQ ID NO: 2111479 - RNA, 13 nt, Human
caucuugccucca

SEQ ID NO: 2111480 - RNA, 18 nt, Human
caucuugcccgcucaggc

SEQ ID NO: 2111481 - RNA, 16 nt, Human
caucuucucacucccu

SEQ ID NO: 2111482 - RNA, 17 nt, Human
caucuucucacucccuu

SEQ ID NO: 2111483 - RNA, 22 nt, Human
caucuucccuagaggguuccug

SEQ ID NO: 2111484 - RNA, 14 nt, Human
caucuucuccaucu

SEQ ID NO: 2111485 - RNA, 16 nt, Human
caucuucuccaucugg

SEQ ID NO: 2111486 - RNA, 17 nt, Human
caucuucuccaucuggc

SEQ ID NO: 2111487 - RNA, 23 nt, Human
caucuuccccaacgaaaagcaca

SEQ ID NO: 2111488 - RNA, 15 nt, Human
caucucuugaggcca

SEQ ID NO: 2111489 - RNA, 20 nt, Human
caucucuugaggccaggagu

SEQ ID NO: 2111490 - RNA, 14 nt, Human
caucuccacuccag

SEQ ID NO: 2111491 - RNA, 14 nt, Human
caucuccaucagcu

SEQ ID NO: 2111492 - RNA, 15 nt, Human
caucuccaucagcug

SEQ ID NO: 2111493 - RNA, 16 nt, Human
caucuccaucagcugu

SEQ ID NO: 2111494 - RNA, 18 nt, Human
caucugcaccccccuggg

SEQ ID NO: 2111495 - RNA, 19 nt, Human
caucugcaccccccugggc

SEQ ID NO: 2111496 - RNA, 22 nt, Human
caucuuccaaggguacuaagga

SEQ ID NO: 2111497 - RNA, 21 nt, Human
caucuuccacaggucucagaa

SEQ ID NO: 2111498 - RNA, 22 nt, Human
caucuuccacaggucucagaau

SEQ ID NO: 2111499 - RNA, 20 nt, Human
caucuuauuuucauguauau

SEQ ID NO: 2111500 - RNA, 14 nt, Human
caucuucaaagcuu

SEQ ID NO: 2111501 - RNA, 14 nt, Human
caucuucacuucua

SEQ ID NO: 2111502 - RNA, 21 nt, Human
caucuucacuucuaaaugcau

SEQ ID NO: 2111503 - RNA, 16 nt, Human
caucugcacccucgau

SEQ ID NO: 2111504 - RNA, 20 nt, Human
caucuuaguauuugcauauu

SEQ ID NO: 2111505 - RNA, 14 nt, Human
caucuuagugccug

SEQ ID NO: 2111506 - RNA, 15 nt, Human
cauccagguucagcu

SEQ ID NO: 2111507 - RNA, 22 nt, Human
caucccuacccccuaagagcca

SEQ ID NO: 2111508 - RNA, 23 nt, Human
cauccaaggagaaacagagacag

SEQ ID NO: 2111509 - RNA, 17 nt, Human
cauccaauaggaaugcu

SEQ ID NO: 2111510 - RNA, 21 nt, Human
cauccaauaggaaugcuaaca

SEQ ID NO: 2111511 - RNA, 13 nt, Human
cauccaauccuca

SEQ ID NO: 2111512 - RNA, 14 nt, Human
cauccaauccucac

SEQ ID NO: 2111513 - RNA, 15 nt, Human
cauccaauccucacu

SEQ ID NO: 2111514 - RNA, 16 nt, Human
cauccaauccucacug

SEQ ID NO: 2111515 - RNA, 17 nt, Human
cauccaauccucacugg

SEQ ID NO: 2111516 - RNA, 14 nt, Human
cauccaaugcucaa

SEQ ID NO: 2111517 - RNA, 18 nt, Human
cauccaauccucacuggg

SEQ ID NO: 2111518 - RNA, 19 nt, Human
cauccaauccucacugggu

SEQ ID NO: 2111519 - RNA, 21 nt, Human
cauccaauccucacugggugg

SEQ ID NO: 2111520 - RNA, 23 nt, Human
cauccaaugcucaagaaacaacu

SEQ ID NO: 2111521 - RNA, 14 nt, Human
cauccacucuaccc

SEQ ID NO: 2111522 - RNA, 15 nt, Human
cauccacucuacccu

SEQ ID NO: 2111523 - RNA, 22 nt, Human
caucacaggguugggcccagau

SEQ ID NO: 2111524 - RNA, 21 nt, Human
cauccaaggagaaacagagac

SEQ ID NO: 2111525 - RNA, 22 nt, Human
cauccaaggagaaacagagaca

SEQ ID NO: 2111526 - RNA, 15 nt, Human
cauccaacugagaaa

SEQ ID NO: 2111527 - RNA, 14 nt, Human
cauccaaggagaaa

SEQ ID NO: 2111528 - RNA, 21 nt, Human
cauccaaccccccaccugcca

SEQ ID NO: 2111529 - RNA, 16 nt, Human
cauccaaccccccacc

SEQ ID NO: 2111530 - RNA, 19 nt, Human
cauccaaccccccaccugc

SEQ ID NO: 2111531 - RNA, 15 nt, Human
cauccaaccccccac

SEQ ID NO: 2111532 - RNA, 17 nt, Human
cauccguaguucccuga

SEQ ID NO: 2111533 - RNA, 18 nt, Human
cauccguaguucccugaa

SEQ ID NO: 2111534 - RNA, 21 nt, Human
cauccguaguucccugaaaac

SEQ ID NO: 2111535 - RNA, 17 nt, Human
cauccgugagcagugug

SEQ ID NO: 2111536 - RNA, 20 nt, Human
cauccgugagcagugugucu

SEQ ID NO: 2111537 - RNA, 23 nt, Human
cauccgugagcagugugucuccu

SEQ ID NO: 2111538 - RNA, 16 nt, Human
cauccguaguucccug

SEQ ID NO: 2111539 - RNA, 13 nt, Human
cauugcaauagaa

SEQ ID NO: 2111540 - RNA, 15 nt, Human
cauugcaauagaaau

SEQ ID NO: 2111541 - RNA, 18 nt, Human
cauugagaacugcauaug

SEQ ID NO: 2111542 - RNA, 19 nt, Human
cauugagaacugcauaugu

SEQ ID NO: 2111543 - RNA, 23 nt, Human
cauugagaacugcauauguuucg

SEQ ID NO: 2111544 - RNA, 14 nt, Human
cauugcaauagaaa

SEQ ID NO: 2111545 - RNA, 17 nt, Human
cauugcacuccagccug

SEQ ID NO: 2111546 - RNA, 16 nt, Human
cauugcacuccagccu

SEQ ID NO: 2111547 - RNA, 18 nt, Human
cauugcacuccagccugg

SEQ ID NO: 2111548 - RNA, 16 nt, Human
cauugcagucugcuuc

SEQ ID NO: 2111549 - RNA, 18 nt, Human
cauugcagucugcuucug

SEQ ID NO: 2111550 - RNA, 21 nt, Human
cauuuacuuuguguucaccuu

SEQ ID NO: 2111551 - RNA, 17 nt, Human
cauuuacuuuguguuca

SEQ ID NO: 2111552 - RNA, 16 nt, Human
cauuucugauauagaa

SEQ ID NO: 2111553 - RNA, 21 nt, Human
cauuucugauauagaauugca

SEQ ID NO: 2111554 - RNA, 11 nt, Human
cauuucucucu

SEQ ID NO: 2111555 - RNA, 17 nt, Human
cauuucucucuccaguc

SEQ ID NO: 2111556 - RNA, 13 nt, Human
cauuuccccagac

SEQ ID NO: 2111557 - RNA, 16 nt, Human
cauuuccccagaccug

SEQ ID NO: 2111558 - RNA, 20 nt, Human
cauuuccccagaccugagcu

SEQ ID NO: 2111559 - RNA, 23 nt, Human
cauuucuauuuauuuacugagcu

SEQ ID NO: 2111560 - RNA, 12 nt, Human
cauuucuugggc

SEQ ID NO: 2111561 - RNA, 18 nt, Human
cauugacuaucaaacuga

SEQ ID NO: 2111562 - RNA, 19 nt, Human
cauugacuaucaaacugaa

SEQ ID NO: 2111563 - RNA, 22 nt, Human
cauugacuaucaaacugaagcc

SEQ ID NO: 2111564 - RNA, 15 nt, Human
cauugaccaagaacu

SEQ ID NO: 2111565 - RNA, 16 nt, Human
cauugaccaagaacug

SEQ ID NO: 2111566 - RNA, 17 nt, Human
cauugaccaagaacugc

SEQ ID NO: 2111567 - RNA, 18 nt, Human
cauugaccaagaacugca

SEQ ID NO: 2111568 - RNA, 19 nt, Human
cauugaccaagaacugcau

SEQ ID NO: 2111569 - RNA, 20 nt, Human
cauugaccaagaacugcaug

SEQ ID NO: 2111570 - RNA, 21 nt, Human
cauugaccaagaacugcaugg

SEQ ID NO: 2111571 - RNA, 22 nt, Human
cauugaaagagaaccaguuuca

SEQ ID NO: 2111572 - RNA, 19 nt, Human
cauugaaagagaaccaguu

SEQ ID NO: 2111573 - RNA, 16 nt, Human
cauugaaagagaacca

SEQ ID NO: 2111574 - RNA, 17 nt, Human
cauugaaaauaggagag

SEQ ID NO: 2111575 - RNA, 16 nt, Human
cauugaaaauguaagu

SEQ ID NO: 2111576 - RNA, 18 nt, Human
cauugaaaauguaaguaa

SEQ ID NO: 2111577 - RNA, 22 nt, Human
cauugaaaauguaaguaaaugu

SEQ ID NO: 2111578 - RNA, 15 nt, Human
cauuuuauauuagaa

SEQ ID NO: 2111579 - RNA, 16 nt, Human
cauuuuaacuuuauca

SEQ ID NO: 2111580 - RNA, 18 nt, Human
cauuuuaaaguuaaacau

SEQ ID NO: 2111581 - RNA, 11 nt, Human
cauuuuaacau

SEQ ID NO: 2111582 - RNA, 14 nt, Human
cauuuugaccuacu

SEQ ID NO: 2111583 - RNA, 13 nt, Human
cauuuugaagcua

SEQ ID NO: 2111584 - RNA, 15 nt, Human
cauuuugaagcuaau

SEQ ID NO: 2111585 - RNA, 16 nt, Human
cauuuugaagcuaauu

SEQ ID NO: 2111586 - RNA, 17 nt, Human
cauuuugaagcuaauua

SEQ ID NO: 2111587 - RNA, 22 nt, Human
cauuuugaagcuaauuauuuua

SEQ ID NO: 2111588 - RNA, 12 nt, Human
cauuuugcaaaa

SEQ ID NO: 2111589 - RNA, 13 nt, Human
cauuuugcaaaau

SEQ ID NO: 2111590 - RNA, 14 nt, Human
cauuuugcaaaauu

SEQ ID NO: 2111591 - RNA, 15 nt, Human
cauuuugcaaaauuu

SEQ ID NO: 2111592 - RNA, 17 nt, Human
cauuuugcaaaauuucc

SEQ ID NO: 2111593 - RNA, 15 nt, Human
cauuuugcagcagug

SEQ ID NO: 2111594 - RNA, 16 nt, Human
cauuuugcagcaguga

SEQ ID NO: 2111595 - RNA, 18 nt, Human
cauuuugcagcagugagu

SEQ ID NO: 2111596 - RNA, 20 nt, Human
cauuuugcagcagugagucu

SEQ ID NO: 2111597 - RNA, 22 nt, Human
cauuuugcagcagugagucucu

SEQ ID NO: 2111598 - RNA, 10 nt, Human
cauuuucugg

SEQ ID NO: 2111599 - RNA, 21 nt, Human
cauuuucuggguucugggugg

SEQ ID NO: 2111600 - RNA, 22 nt, Human
cauuuugggguacccacugcuc

SEQ ID NO: 2111601 - RNA, 21 nt, Human
cauuuugggguacccacugcu

SEQ ID NO: 2111602 - RNA, 20 nt, Human
cauuuugggguacccacugc

SEQ ID NO: 2111603 - RNA, 22 nt, Human
cauuuuggaaguuuucaggacu

SEQ ID NO: 2111604 - RNA, 18 nt, Human
cauuuuggaaguuuucag

SEQ ID NO: 2111605 - RNA, 20 nt, Human
cauuuuggaaguuuucagga

SEQ ID NO: 2111606 - RNA, 18 nt, Human
cauuuugcuaaaugugaa

SEQ ID NO: 2111607 - RNA, 21 nt, Human
cauuuugcuaaaugugaauga

SEQ ID NO: 2111608 - RNA, 24 nt, Human
cauuuugcuaaaugugaaugauga

SEQ ID NO: 2111609 - RNA, 18 nt, Human
cauuuuuaguagagacag

SEQ ID NO: 2111610 - RNA, 19 nt, Human
cauuuuuaguagagacagg

SEQ ID NO: 2111611 - RNA, 23 nt, Human
cauuuugggguacccacugcucu

SEQ ID NO: 2111612 - RNA, 15 nt, Human
cauuuugcuucauag

SEQ ID NO: 2111613 - RNA, 14 nt, Human
ccaaaauaaugucu

SEQ ID NO: 2111614 - RNA, 22 nt, Human
ccaaaauaaugucuuguuaaua

SEQ ID NO: 2111615 - RNA, 22 nt, Human
cauuuuuauuacccuucuuucc

SEQ ID NO: 2111616 - RNA, 20 nt, Human
cauuuuuaguagagacaggg

SEQ ID NO: 2111617 - RNA, 12 nt, Human
ccaaagagcugc

SEQ ID NO: 2111618 - RNA, 14 nt, Human
ccaaagagcugccu

SEQ ID NO: 2111619 - RNA, 15 nt, Human
ccaaagagcugccua

SEQ ID NO: 2111620 - RNA, 16 nt, Human
ccaaagagcugccuaa

SEQ ID NO: 2111621 - RNA, 19 nt, Human
ccaaacugccuaagcccuc

SEQ ID NO: 2111622 - RNA, 13 nt, Human
ccaaaccuggaga

SEQ ID NO: 2111623 - RNA, 14 nt, Human
ccaaaccuggagau

SEQ ID NO: 2111624 - RNA, 14 nt, Human
ccaaacugccuaag

SEQ ID NO: 2111625 - RNA, 14 nt, Human
cauuugagcagggc

SEQ ID NO: 2111626 - RNA, 16 nt, Human
cauuugagcagggcuc

SEQ ID NO: 2111627 - RNA, 14 nt, Human
ccaauauuguacag

SEQ ID NO: 2111628 - RNA, 15 nt, Human
ccaauauuguacagu

SEQ ID NO: 2111629 - RNA, 16 nt, Human
ccaauauuguacaguu

SEQ ID NO: 2111630 - RNA, 18 nt, Human
ccaauauuguacaguuuu

SEQ ID NO: 2111631 - RNA, 17 nt, Human
ccaagugugugugcgug

SEQ ID NO: 2111632 - RNA, 20 nt, Human
ccaaguuauaaaucaauguc

SEQ ID NO: 2111633 - RNA, 18 nt, Human
ccaauucuuacaaacaug

SEQ ID NO: 2111634 - RNA, 19 nt, Human
ccaauucuuacaaacaugu

SEQ ID NO: 2111635 - RNA, 22 nt, Human
ccaaguuauaaaucaaugucac

SEQ ID NO: 2111636 - RNA, 20 nt, Human
ccaauuuguaaaaacagcau

SEQ ID NO: 2111637 - RNA, 18 nt, Human
ccacaacccuguuuuaua

SEQ ID NO: 2111638 - RNA, 18 nt, Human
ccacaaaggagagcuagc

SEQ ID NO: 2111639 - RNA, 22 nt, Human
ccacaaaugggaaaaccagacu

SEQ ID NO: 2111640 - RNA, 20 nt, Human
ccaagguggguagaucacga

SEQ ID NO: 2111641 - RNA, 17 nt, Human
ccaaggugggcugagcc

SEQ ID NO: 2111642 - RNA, 18 nt, Human
ccaaggugggcugagccc

SEQ ID NO: 2111643 - RNA, 20 nt, Human
ccaaggugggcugagcccug

SEQ ID NO: 2111644 - RNA, 23 nt, Human
ccaaggugggcugagcccuggca

SEQ ID NO: 2111645 - RNA, 14 nt, Human
ccaaggcuggggga

SEQ ID NO: 2111646 - RNA, 16 nt, Human
ccaaggcucugagcaa

SEQ ID NO: 2111647 - RNA, 20 nt, Human
ccaaguggaccuugagacca

SEQ ID NO: 2111648 - RNA, 16 nt, Human
ccaagugccagucuug

SEQ ID NO: 2111649 - RNA, 22 nt, Human
ccaagugccagucuugugucug

SEQ ID NO: 2111650 - RNA, 13 nt, Human
ccaaguggcuccc

SEQ ID NO: 2111651 - RNA, 14 nt, Human
ccaagugcaggcug

SEQ ID NO: 2111652 - RNA, 19 nt, Human
ccaagugcaggcuggcacc

SEQ ID NO: 2111653 - RNA, 16 nt, Human
ccaagugcaggcuggc

SEQ ID NO: 2111654 - RNA, 16 nt, Human
ccaaguggcucccaca

SEQ ID NO: 2111655 - RNA, 16 nt, Human
ccaagugggggcagag

SEQ ID NO: 2111656 - RNA, 18 nt, Human
ccaagugggggcagaggg

SEQ ID NO: 2111657 - RNA, 15 nt, Human
ccaaguuauaaauca

SEQ ID NO: 2111658 - RNA, 13 nt, Human
ccaagugugugug

SEQ ID NO: 2111659 - RNA, 14 nt, Human
ccaagugugugugc

SEQ ID NO: 2111660 - RNA, 12 nt, Human
ccaagugugugu

SEQ ID NO: 2111661 - RNA, 12 nt, Human
ccaagcagccaa

SEQ ID NO: 2111662 - RNA, 16 nt, Human
ccaagcagccaagcuc

SEQ ID NO: 2111663 - RNA, 18 nt, Human
ccaagcagccaagcuccu

SEQ ID NO: 2111664 - RNA, 12 nt, Human
ccaagcaggaag

SEQ ID NO: 2111665 - RNA, 13 nt, Human
ccaagcaggaagc

SEQ ID NO: 2111666 - RNA, 14 nt, Human
ccaagcaggaagcu

SEQ ID NO: 2111667 - RNA, 17 nt, Human
ccaagcaggaagcucag

SEQ ID NO: 2111668 - RNA, 18 nt, Human
ccaagcaggaagcucaga

SEQ ID NO: 2111669 - RNA, 22 nt, Human
ccaagagcugaggcaauucuaa

SEQ ID NO: 2111670 - RNA, 21 nt, Human
ccaagccguggcuucccgcuc

SEQ ID NO: 2111671 - RNA, 17 nt, Human
ccaagccguggcuuccc

SEQ ID NO: 2111672 - RNA, 16 nt, Human
ccaagccguggcuucc

SEQ ID NO: 2111673 - RNA, 15 nt, Human
ccaagccguggcuuc

SEQ ID NO: 2111674 - RNA, 14 nt, Human
ccaagccguggcuu

SEQ ID NO: 2111675 - RNA, 20 nt, Human
ccaagcaggaagcucagacu

SEQ ID NO: 2111676 - RNA, 23 nt, Human
ccaagccguggcuucccgcucag

SEQ ID NO: 2111677 - RNA, 14 nt, Human
ccaagcuccaucuc

SEQ ID NO: 2111678 - RNA, 15 nt, Human
ccacaaguuaaauaa

SEQ ID NO: 2111679 - RNA, 20 nt, Human
ccacaaguuaaauaaaucau

SEQ ID NO: 2111680 - RNA, 15 nt, Human
ccacaagauucccag

SEQ ID NO: 2111681 - RNA, 16 nt, Human
ccacaagauucccaga

SEQ ID NO: 2111682 - RNA, 17 nt, Human
ccacaagauucccagag

SEQ ID NO: 2111683 - RNA, 24 nt, Human
ccacaagauucccagagacaggaa

SEQ ID NO: 2111684 - RNA, 18 nt, Human
ccacaagauucccagaga

SEQ ID NO: 2111685 - RNA, 19 nt, Human
ccacaagauucccagagac

SEQ ID NO: 2111686 - RNA, 20 nt, Human
ccacaagauucccagagaca

SEQ ID NO: 2111687 - RNA, 21 nt, Human
ccacaagauucccagagacag

SEQ ID NO: 2111688 - RNA, 12 nt, Human
ccaagagaugaa

SEQ ID NO: 2111689 - RNA, 19 nt, Human
ccaagagcagaggcagcga

SEQ ID NO: 2111690 - RNA, 16 nt, Human
ccaagacuccagcccu

SEQ ID NO: 2111691 - RNA, 17 nt, Human
ccaagacuccagcccug

SEQ ID NO: 2111692 - RNA, 12 nt, Human
ccaagacauugu

SEQ ID NO: 2111693 - RNA, 16 nt, Human
ccaagacauugucaau

SEQ ID NO: 2111694 - RNA, 17 nt, Human
ccaagacauugucaaua

SEQ ID NO: 2111695 - RNA, 14 nt, Human
ccaagagaugaaga

SEQ ID NO: 2111696 - RNA, 15 nt, Human
ccaagaccugacuca

SEQ ID NO: 2111697 - RNA, 11 nt, Human
ccaagacauug

SEQ ID NO: 2111698 - RNA, 24 nt, Human
ccaagacagaugccccagagcugu

SEQ ID NO: 2111699 - RNA, 23 nt, Human
ccaagacagaugccccagagcug

SEQ ID NO: 2111700 - RNA, 19 nt, Human
ccaaccuuacuuacagcau

SEQ ID NO: 2111701 - RNA, 12 nt, Human
ccaaccugacca

SEQ ID NO: 2111702 - RNA, 13 nt, Human
ccaaccugaccaa

SEQ ID NO: 2111703 - RNA, 16 nt, Human
ccaaccugaccaacau

SEQ ID NO: 2111704 - RNA, 13 nt, Human
ccaaccuggacaa

SEQ ID NO: 2111705 - RNA, 14 nt, Human
ccaaccuggacaac

SEQ ID NO: 2111706 - RNA, 22 nt, Human
ccaaccugaccaacauggagaa

SEQ ID NO: 2111707 - RNA, 17 nt, Human
ccaacccugccccugcc

SEQ ID NO: 2111708 - RNA, 15 nt, Human
ccaacccuucccuga

SEQ ID NO: 2111709 - RNA, 18 nt, Human
ccaaccuaaccccuuucc

SEQ ID NO: 2111710 - RNA, 14 nt, Human
ccaaccuccugacc

SEQ ID NO: 2111711 - RNA, 11 nt, Human
ccaaccucagc

SEQ ID NO: 2111712 - RNA, 12 nt, Human
ccaaccucagca

SEQ ID NO: 2111713 - RNA, 20 nt, Human
ccaacaucccauugcccugg

SEQ ID NO: 2111714 - RNA, 21 nt, Human
ccaacaucccauugcccuggu

SEQ ID NO: 2111715 - RNA, 15 nt, Human
ccaacauggagaaac

SEQ ID NO: 2111716 - RNA, 22 nt, Human
ccaacauggagaaacccugucu

SEQ ID NO: 2111717 - RNA, 23 nt, Human
ccaacauggagaaacccugucuc

SEQ ID NO: 2111718 - RNA, 14 nt, Human
ccaacccugccccu

SEQ ID NO: 2111719 - RNA, 15 nt, Human
ccaacccugccccug

SEQ ID NO: 2111720 - RNA, 16 nt, Human
ccaacccugccccugc

SEQ ID NO: 2111721 - RNA, 17 nt, Human
ccaacaucccauugccc

SEQ ID NO: 2111722 - RNA, 16 nt, Human
ccaacaucaacaucuu

SEQ ID NO: 2111723 - RNA, 12 nt, Human
ccaacaguuccu

SEQ ID NO: 2111724 - RNA, 12 nt, Human
ccaacaccaggg

SEQ ID NO: 2111725 - RNA, 19 nt, Human
ccaacagucaaaacagaga

SEQ ID NO: 2111726 - RNA, 23 nt, Human
ccaaauuccuuggcaugccuucc

SEQ ID NO: 2111727 - RNA, 15 nt, Human
ccaaauucccuccuc

SEQ ID NO: 2111728 - RNA, 20 nt, Human
ccaaauuccuuggcaugccu

SEQ ID NO: 2111729 - RNA, 13 nt, Human
ccaacaccaggga

SEQ ID NO: 2111730 - RNA, 15 nt, Human
ccaaauucuuucagu

SEQ ID NO: 2111731 - RNA, 22 nt, Human
ccaaauucuuucaguggcuacc

SEQ ID NO: 2111732 - RNA, 20 nt, Human
caugccugccccaaacaaau

SEQ ID NO: 2111733 - RNA, 16 nt, Human
caugccugcuuuagaa

SEQ ID NO: 2111734 - RNA, 17 nt, Human
caugccugcuuuagaau

SEQ ID NO: 2111735 - RNA, 17 nt, Human
caugccuggacaaaccc

SEQ ID NO: 2111736 - RNA, 19 nt, Human
caugccuggacaaacccuu

SEQ ID NO: 2111737 - RNA, 13 nt, Human
caugccuuccagc

SEQ ID NO: 2111738 - RNA, 15 nt, Human
caugccuuccagcac

SEQ ID NO: 2111739 - RNA, 19 nt, Human
caugccuuccagcacccug

SEQ ID NO: 2111740 - RNA, 21 nt, Human
caugccuuccagcacccugca

SEQ ID NO: 2111741 - RNA, 20 nt, Human
caugccuuccagcacccugc

SEQ ID NO: 2111742 - RNA, 13 nt, Human
caugccuuuguaa

SEQ ID NO: 2111743 - RNA, 15 nt, Human
caugccuuuguaagu

SEQ ID NO: 2111744 - RNA, 16 nt, Human
caugccuuuguaaguu

SEQ ID NO: 2111745 - RNA, 16 nt, Human
caugccuguccagccu

SEQ ID NO: 2111746 - RNA, 17 nt, Human
caugccuguccagccug

SEQ ID NO: 2111747 - RNA, 18 nt, Human
caugccuguccagccugg

SEQ ID NO: 2111748 - RNA, 20 nt, Human
caugccuguccagccugggc

SEQ ID NO: 2111749 - RNA, 23 nt, Human
caugccuguccagccugggcagc

SEQ ID NO: 2111750 - RNA, 21 nt, Human
caugccuguccagccugggca

SEQ ID NO: 2111751 - RNA, 23 nt, Human
caugccugugugacaucaguggc

SEQ ID NO: 2111752 - RNA, 13 nt, Human
caugcgcacaagg

SEQ ID NO: 2111753 - RNA, 22 nt, Human
caugcguggguggggagggagg

SEQ ID NO: 2111754 - RNA, 23 nt, Human
caugcguggguggggagggaggu

SEQ ID NO: 2111755 - RNA, 16 nt, Human
cauggaauaacaugua

SEQ ID NO: 2111756 - RNA, 21 nt, Human
cauggaacucauuccugccug

SEQ ID NO: 2111757 - RNA, 17 nt, Human
cauggaacucauuccug

SEQ ID NO: 2111758 - RNA, 19 nt, Human
cauggaacucauuccugcc

SEQ ID NO: 2111759 - RNA, 14 nt, Human
cauggaagggaaga

SEQ ID NO: 2111760 - RNA, 18 nt, Human
cauggacaugaucuucuu

SEQ ID NO: 2111761 - RNA, 15 nt, Human
cauggacagaagaag

SEQ ID NO: 2111762 - RNA, 21 nt, Human
cauggacagaagaaggcagca

SEQ ID NO: 2111763 - RNA, 16 nt, Human
cauggaacucauuccu

SEQ ID NO: 2111764 - RNA, 19 nt, Human
caugcugugauugugccua

SEQ ID NO: 2111765 - RNA, 19 nt, Human
caugcuucaugaaaauccu

SEQ ID NO: 2111766 - RNA, 23 nt, Human
caugcuucaugaaaauccuacca

SEQ ID NO: 2111767 - RNA, 15 nt, Human
caugggccuccugug

SEQ ID NO: 2111768 - RNA, 21 nt, Human
cauggcagaauaaucuuuggg

SEQ ID NO: 2111769 - RNA, 22 nt, Human
cauggcagaauaaucuuugggu

SEQ ID NO: 2111770 - RNA, 17 nt, Human
caugggccuccugugug

SEQ ID NO: 2111771 - RNA, 16 nt, Human
caugggccuccugugu

SEQ ID NO: 2111772 - RNA, 14 nt, Human
caugggccccucug

SEQ ID NO: 2111773 - RNA, 16 nt, Human
caugggccccucugac

SEQ ID NO: 2111774 - RNA, 19 nt, Human
caugggccccucugacucc

SEQ ID NO: 2111775 - RNA, 20 nt, Human
cauggggguauuauccauuc

SEQ ID NO: 2111776 - RNA, 13 nt, Human
caugggggcaggg

SEQ ID NO: 2111777 - RNA, 14 nt, Human
caugggggcagggc

SEQ ID NO: 2111778 - RNA, 19 nt, Human
caugggggcagggcaugac

SEQ ID NO: 2111779 - RNA, 17 nt, Human
caugggggccucagggc

SEQ ID NO: 2111780 - RNA, 21 nt, Human
cauggggugggguagggcuga

SEQ ID NO: 2111781 - RNA, 14 nt, Human
cauggucacagaga

SEQ ID NO: 2111782 - RNA, 19 nt, Human
cauggcaccaaagccacca

SEQ ID NO: 2111783 - RNA, 20 nt, Human
cauggcaccaaagccaccag

SEQ ID NO: 2111784 - RNA, 21 nt, Human
cauggcaccugucgcccagug

SEQ ID NO: 2111785 - RNA, 23 nt, Human
cauggcaccugucgcccagugcc

SEQ ID NO: 2111786 - RNA, 16 nt, Human
cauggaguauauguca

SEQ ID NO: 2111787 - RNA, 21 nt, Human
cauggaguguguauuguuccc

SEQ ID NO: 2111788 - RNA, 18 nt, Human
cauggaguguguauuguu

SEQ ID NO: 2111789 - RNA, 20 nt, Human
cauggaguguguauuguucc

SEQ ID NO: 2111790 - RNA, 22 nt, Human
cauggaguguguauuguuccca

SEQ ID NO: 2111791 - RNA, 14 nt, Human
cauggaguguguau

SEQ ID NO: 2111792 - RNA, 17 nt, Human
cauggaguguguauugu

SEQ ID NO: 2111793 - RNA, 11 nt, Human
cauggagaaac

SEQ ID NO: 2111794 - RNA, 14 nt, Human
cauggagaaacccu

SEQ ID NO: 2111795 - RNA, 15 nt, Human
cauggagaaacccug

SEQ ID NO: 2111796 - RNA, 16 nt, Human
cauggagaaacccugu

SEQ ID NO: 2111797 - RNA, 17 nt, Human
cauggagaaacccuguc

SEQ ID NO: 2111798 - RNA, 20 nt, Human
cauggagaaacccugucucu

SEQ ID NO: 2111799 - RNA, 17 nt, Human
cauggagguuugaagau

SEQ ID NO: 2111800 - RNA, 19 nt, Human
cauggagaacagugauuuu

SEQ ID NO: 2111801 - RNA, 21 nt, Human
caugccgcugcauccgugagc

SEQ ID NO: 2111802 - RNA, 14 nt, Human
caugccgggcgcag

SEQ ID NO: 2111803 - RNA, 19 nt, Human
caugccagcuuaucucagg

SEQ ID NO: 2111804 - RNA, 20 nt, Human
caugccagcuuaucucaggg

SEQ ID NO: 2111805 - RNA, 17 nt, Human
caugcauuugaggucaa

SEQ ID NO: 2111806 - RNA, 14 nt, Human
caugcauuuugcag

SEQ ID NO: 2111807 - RNA, 22 nt, Human
caugccaaccccgcccuaggcc

SEQ ID NO: 2111808 - RNA, 21 nt, Human
caugccaccauggccagccaa

SEQ ID NO: 2111809 - RNA, 19 nt, Human
caugccacuacacuccagc

SEQ ID NO: 2111810 - RNA, 11 nt, Human
caugcauuguu

SEQ ID NO: 2111811 - RNA, 17 nt, Human
caugcauuguugaggug

SEQ ID NO: 2111812 - RNA, 20 nt, Human
caugcauuguugaggugguc

SEQ ID NO: 2111813 - RNA, 22 nt, Human
caugcauuguugagguggucug

SEQ ID NO: 2111814 - RNA, 20 nt, Human
caugcauuuugcagcaguga

SEQ ID NO: 2111815 - RNA, 19 nt, Human
caugcauuuugcagcagug

SEQ ID NO: 2111816 - RNA, 13 nt, Human
caugcccaccugc

SEQ ID NO: 2111817 - RNA, 14 nt, Human
caugcccaccugcc

SEQ ID NO: 2111818 - RNA, 16 nt, Human
caugcccaccugccca

SEQ ID NO: 2111819 - RNA, 17 nt, Human
caugcccaccugcccau

SEQ ID NO: 2111820 - RNA, 21 nt, Human
caugcccaccugcccaucaca

SEQ ID NO: 2111821 - RNA, 14 nt, Human
caugcaucuuacug

SEQ ID NO: 2111822 - RNA, 16 nt, Human
caugcaucuuacugaa

SEQ ID NO: 2111823 - RNA, 17 nt, Human
caugcaucuuacugaag

SEQ ID NO: 2111824 - RNA, 14 nt, Human
caugcaucaaguua

SEQ ID NO: 2111825 - RNA, 15 nt, Human
caugcauacacucuc

SEQ ID NO: 2111826 - RNA, 17 nt, Human
caugcauagucccagcu

SEQ ID NO: 2111827 - RNA, 18 nt, Human
caugcauagucccagcua

SEQ ID NO: 2111828 - RNA, 15 nt, Human
caugucgccucugca

SEQ ID NO: 2111829 - RNA, 14 nt, Human
caugucgccucugc

SEQ ID NO: 2111830 - RNA, 20 nt, Human
caugucgccucugcauucag

SEQ ID NO: 2111831 - RNA, 18 nt, Human
caugucgccucugcauuc

SEQ ID NO: 2111832 - RNA, 18 nt, Human
cauguaauuaaguacuau

SEQ ID NO: 2111833 - RNA, 21 nt, Human
cauguaauuaaguacuaugua

SEQ ID NO: 2111834 - RNA, 17 nt, Human
caugucuuucuccaggg

SEQ ID NO: 2111835 - RNA, 18 nt, Human
caugucuuucuccaggga

SEQ ID NO: 2111836 - RNA, 16 nt, Human
caugguccccaagacc

SEQ ID NO: 2111837 - RNA, 15 nt, Human
caugguccccauggc

SEQ ID NO: 2111838 - RNA, 18 nt, Human
caugguccccauggcaug

SEQ ID NO: 2111839 - RNA, 21 nt, Human
cauggugaggcuuaacaaugu

SEQ ID NO: 2111840 - RNA, 17 nt, Human
caugguccgguguccuu

SEQ ID NO: 2111841 - RNA, 20 nt, Human
caugguccgguguccuuuuc

SEQ ID NO: 2111842 - RNA, 14 nt, Human
cauggugccucugg

SEQ ID NO: 2111843 - RNA, 15 nt, Human
cauggugccucugga

SEQ ID NO: 2111844 - RNA, 16 nt, Human
cauggugccucuggag

SEQ ID NO: 2111845 - RNA, 16 nt, Human
caugguugagaaauga

SEQ ID NO: 2111846 - RNA, 16 nt, Human
cauguaaauuaccagu

SEQ ID NO: 2111847 - RNA, 21 nt, Human
cauguaaugguaucuuaaagu

SEQ ID NO: 2111848 - RNA, 12 nt, Human
cauguaauaaaa

SEQ ID NO: 2111849 - RNA, 21 nt, Human
cauguaauaaaaaguauaugu

SEQ ID NO: 2111850 - RNA, 22 nt, Human
cauguaauaaaaaguauauguu

SEQ ID NO: 2111851 - RNA, 19 nt, Human
caugguuaagguaaaguaa

SEQ ID NO: 2111852 - RNA, 14 nt, Human
caugguugagaaau

SEQ ID NO: 2111853 - RNA, 23 nt, Human
cauggugugaaagucagaugccc

SEQ ID NO: 2111854 - RNA, 22 nt, Human
cauggugugaaagucagaugcc

SEQ ID NO: 2111855 - RNA, 15 nt, Human
caugugcacaugcac

SEQ ID NO: 2111856 - RNA, 17 nt, Human
cauguggaaagugaauu

SEQ ID NO: 2111857 - RNA, 21 nt, Human
cauguggaaaaaaaaaagaug

SEQ ID NO: 2111858 - RNA, 16 nt, Human
cauguggaaagugaau

SEQ ID NO: 2111859 - RNA, 19 nt, Human
caugugcugugaccauuua

SEQ ID NO: 2111860 - RNA, 23 nt, Human
caugugcugugaccauuuauaau

SEQ ID NO: 2111861 - RNA, 21 nt, Human
caugugccagguuuuuggucu

SEQ ID NO: 2111862 - RNA, 13 nt, Human
caugugaagaggg

SEQ ID NO: 2111863 - RNA, 12 nt, Human
caugugggagcu

SEQ ID NO: 2111864 - RNA, 18 nt, Human
cauguggaaagugaauuu

SEQ ID NO: 2111865 - RNA, 20 nt, Human
cauguggaaagugaauuuga

SEQ ID NO: 2111866 - RNA, 21 nt, Human
cauguggaaagugaauuugaa

SEQ ID NO: 2111867 - RNA, 22 nt, Human
cauguggaaagugaauuugaau

SEQ ID NO: 2111868 - RNA, 23 nt, Human
cauguggaaagugaauuugaaug

SEQ ID NO: 2111869 - RNA, 17 nt, Human
cauguggaauauaaaga

SEQ ID NO: 2111870 - RNA, 17 nt, Human
caugugguuaaugccau

SEQ ID NO: 2111871 - RNA, 21 nt, Human
cauguggugggacagggaccc

SEQ ID NO: 2111872 - RNA, 12 nt, Human
caugugguggga

SEQ ID NO: 2111873 - RNA, 22 nt, Human
caugugguuaaugccauggaca

SEQ ID NO: 2111874 - RNA, 17 nt, Human
caugugugcgagugugu

SEQ ID NO: 2111875 - RNA, 19 nt, Human
caugugugcgagugugugc

SEQ ID NO: 2111876 - RNA, 13 nt, Human
caugugugcgugu

SEQ ID NO: 2111877 - RNA, 14 nt, Human
cauguguggacuca

SEQ ID NO: 2111878 - RNA, 14 nt, Human
caugugugcugaac

SEQ ID NO: 2111879 - RNA, 15 nt, Human
caugugugugcaagu

SEQ ID NO: 2111880 - RNA, 15 nt, Human
caugugugugcucag

SEQ ID NO: 2111881 - RNA, 21 nt, Human
caugugugugcaagugugugc

SEQ ID NO: 2111882 - RNA, 16 nt, Human
cauguuugagcucaga

SEQ ID NO: 2111883 - RNA, 18 nt, Human
cauguuugagcucagacc

SEQ ID NO: 2111884 - RNA, 23 nt, Human
cauguuugagcucagacccccac

SEQ ID NO: 2111885 - RNA, 19 nt, Human
cauguuugagcucagaccc

SEQ ID NO: 2111886 - RNA, 20 nt, Human
cauguuugagcucagacccc

SEQ ID NO: 2111887 - RNA, 23 nt, Human
cauguuugauguaucugagcagg

SEQ ID NO: 2111888 - RNA, 18 nt, Human
cauuagaccaagcuuguc

SEQ ID NO: 2111889 - RNA, 15 nt, Human
cauuacggcuccucu

SEQ ID NO: 2111890 - RNA, 16 nt, Human
cauuacggcuccucuc

SEQ ID NO: 2111891 - RNA, 17 nt, Human
cauuagcaguuugcuuu

SEQ ID NO: 2111892 - RNA, 14 nt, Human
cauuauuugcaugu

SEQ ID NO: 2111893 - RNA, 19 nt, Human
cauuauuugcauguuaccu

SEQ ID NO: 2111894 - RNA, 13 nt, Human
cauuauuugcaug

SEQ ID NO: 2111895 - RNA, 13 nt, Human
cauuauuuauuaa

SEQ ID NO: 2111896 - RNA, 17 nt, Human
cauuauuuauuaaauuu

SEQ ID NO: 2111897 - RNA, 18 nt, Human
cauuauuuauuaaauuuu

SEQ ID NO: 2111898 - RNA, 19 nt, Human
cauuaauuauuauugcugu

SEQ ID NO: 2111899 - RNA, 21 nt, Human
cauuaauuauuauugcuguug

SEQ ID NO: 2111900 - RNA, 20 nt, Human
cauuaauuauuauugcuguu

SEQ ID NO: 2111901 - RNA, 20 nt, Human
cauuaccagacgguucacca

SEQ ID NO: 2111902 - RNA, 23 nt, Human
cauuaccagacgguucaccagcc

SEQ ID NO: 2111903 - RNA, 13 nt, Human
cauuaacaguuuu

SEQ ID NO: 2111904 - RNA, 16 nt, Human
cauuaacaguuuucca

SEQ ID NO: 2111905 - RNA, 17 nt, Human
cauuaacaguuuuccau

SEQ ID NO: 2111906 - RNA, 20 nt, Human
cauuaacaguuuuccaugaa

SEQ ID NO: 2111907 - RNA, 16 nt, Human
cauuaauauuugcuga

SEQ ID NO: 2111908 - RNA, 17 nt, Human
cauuaauauuugcugac

SEQ ID NO: 2111909 - RNA, 15 nt, Human
cauguuuuguuuacg

SEQ ID NO: 2111910 - RNA, 13 nt, Human
cauuaaagcaguc

SEQ ID NO: 2111911 - RNA, 22 nt, Human
cauuaaagcagucacuuuuccu

SEQ ID NO: 2111912 - RNA, 18 nt, Human
cauuaaagcauuuacuuu

SEQ ID NO: 2111913 - RNA, 22 nt, Human
cauuaaagcauuuacuuugaau

SEQ ID NO: 2111914 - RNA, 18 nt, Human
cauguuuuucuucucccu

SEQ ID NO: 2111915 - RNA, 23 nt, Human
ccauguuggccaggcuggucuca

SEQ ID NO: 2111916 - RNA, 13 nt, Human
ccagugggaagau

SEQ ID NO: 2111917 - RNA, 17 nt, Human
ccagugccuuaccuccu

SEQ ID NO: 2111918 - RNA, 18 nt, Human
ccagugccuuaccuccug

SEQ ID NO: 2111919 - RNA, 19 nt, Human
ccagugccuuaccuccugc

SEQ ID NO: 2111920 - RNA, 20 nt, Human
ccagugccuuaccuccugcc

SEQ ID NO: 2111921 - RNA, 18 nt, Human
ccaguggaagaagaaaac

SEQ ID NO: 2111922 - RNA, 21 nt, Human
ccagugccuuaccuccugccc

SEQ ID NO: 2111923 - RNA, 22 nt, Human
ccagugccuuaccuccugccca

SEQ ID NO: 2111924 - RNA, 23 nt, Human
ccagugccuuaccuccugcccag

SEQ ID NO: 2111925 - RNA, 12 nt, Human
ccaggccugccu

SEQ ID NO: 2111926 - RNA, 13 nt, Human
ccaggccuccagc

SEQ ID NO: 2111927 - RNA, 14 nt, Human
ccaggccuccagcu

SEQ ID NO: 2111928 - RNA, 15 nt, Human
ccaggccuccagcuc

SEQ ID NO: 2111929 - RNA, 16 nt, Human
ccaggccuccagcuca

SEQ ID NO: 2111930 - RNA, 17 nt, Human
ccaggccuccagcucag

SEQ ID NO: 2111931 - RNA, 19 nt, Human
ccaggccuccagcucagca

SEQ ID NO: 2111932 - RNA, 22 nt, Human
ccaggcgagagacuuguggccu

SEQ ID NO: 2111933 - RNA, 18 nt, Human
ccaggcgaugugcaagug

SEQ ID NO: 2111934 - RNA, 18 nt, Human
ccaggccugggucugugu

SEQ ID NO: 2111935 - RNA, 19 nt, Human
ccaggccugggucuguguc

SEQ ID NO: 2111936 - RNA, 20 nt, Human
ccaggccugggucugugucu

SEQ ID NO: 2111937 - RNA, 16 nt, Human
ccaggccugggucugu

SEQ ID NO: 2111938 - RNA, 17 nt, Human
ccaggccugggucugug

SEQ ID NO: 2111939 - RNA, 16 nt, Human
ccaucaugucuggcua

SEQ ID NO: 2111940 - RNA, 14 nt, Human
ccaucaugucuggc

SEQ ID NO: 2111941 - RNA, 14 nt, Human
ccaucacuggagca

SEQ ID NO: 2111942 - RNA, 18 nt, Human
ccaucacuggagcaccag

SEQ ID NO: 2111943 - RNA, 17 nt, Human
ccaucauuauaaacgug

SEQ ID NO: 2111944 - RNA, 22 nt, Human
ccaucucaggccaccugccccc

SEQ ID NO: 2111945 - RNA, 23 nt, Human
ccaucucaggccaccugcccccu

SEQ ID NO: 2111946 - RNA, 16 nt, Human
ccaucucaggccaccu

SEQ ID NO: 2111947 - RNA, 17 nt, Human
ccaucucaggccaccug

SEQ ID NO: 2111948 - RNA, 18 nt, Human
ccaucucaggccaccugc

SEQ ID NO: 2111949 - RNA, 20 nt, Human
ccaucucaggccaccugccc

SEQ ID NO: 2111950 - RNA, 21 nt, Human
ccaucucaggccaccugcccc

SEQ ID NO: 2111951 - RNA, 16 nt, Human
ccaucgcugucaucuc

SEQ ID NO: 2111952 - RNA, 18 nt, Human
ccauauucuguuggccag

SEQ ID NO: 2111953 - RNA, 15 nt, Human
ccauauucuguuggc

SEQ ID NO: 2111954 - RNA, 18 nt, Human
ccauagccaccccagaaa

SEQ ID NO: 2111955 - RNA, 14 nt, Human
ccaguggugccuug

SEQ ID NO: 2111956 - RNA, 18 nt, Human
ccauagcaagauugcuua

SEQ ID NO: 2111957 - RNA, 21 nt, Human
ccauagcaagauugcuuaaaa

SEQ ID NO: 2111958 - RNA, 19 nt, Human
ccaucacgcggccgagaca

SEQ ID NO: 2111959 - RNA, 16 nt, Human
ccaucacgccugugca

SEQ ID NO: 2111960 - RNA, 13 nt, Human
ccaucaaccucug

SEQ ID NO: 2111961 - RNA, 16 nt, Human
ccaucaaaguggcaaa

SEQ ID NO: 2111962 - RNA, 22 nt, Human
ccauauucagugcuguggccug

SEQ ID NO: 2111963 - RNA, 17 nt, Human
ccacaaauaaaugacaa

SEQ ID NO: 2111964 - RNA, 22 nt, Human
ccagccucucuugguuuccuuc

SEQ ID NO: 2111965 - RNA, 19 nt, Human
ccagccucugagccccugg

SEQ ID NO: 2111966 - RNA, 21 nt, Human
ccagccucugagccccuggga

SEQ ID NO: 2111967 - RNA, 24 nt, Human
ccagccucugagccccugggacug

SEQ ID NO: 2111968 - RNA, 12 nt, Human
ccagccucucuu

SEQ ID NO: 2111969 - RNA, 15 nt, Human
ccagccucucuuccu

SEQ ID NO: 2111970 - RNA, 21 nt, Human
ccagccucucuuccuauccca

SEQ ID NO: 2111971 - RNA, 21 nt, Human
ccagccucucuugguuuccuu

SEQ ID NO: 2111972 - RNA, 11 nt, Human
ccagccugagc

SEQ ID NO: 2111973 - RNA, 12 nt, Human
ccagccugagca

SEQ ID NO: 2111974 - RNA, 11 nt, Human
ccagccuggcc

SEQ ID NO: 2111975 - RNA, 10 nt, Human
ccagccuggc

SEQ ID NO: 2111976 - RNA, 12 nt, Human
ccagccuggcca

SEQ ID NO: 2111977 - RNA, 22 nt, Human
ccagcucucccucuggcccugc

SEQ ID NO: 2111978 - RNA, 23 nt, Human
ccagcucucccucuggcccugcc

SEQ ID NO: 2111979 - RNA, 17 nt, Human
ccagcucucccucuggc

SEQ ID NO: 2111980 - RNA, 18 nt, Human
ccagcucucccucuggcc

SEQ ID NO: 2111981 - RNA, 20 nt, Human
ccagcucucccucuggcccu

SEQ ID NO: 2111982 - RNA, 21 nt, Human
ccagcucucccucuggcccug

SEQ ID NO: 2111983 - RNA, 13 nt, Human
ccagcucucagcc

SEQ ID NO: 2111984 - RNA, 14 nt, Human
ccagcucucagcca

SEQ ID NO: 2111985 - RNA, 15 nt, Human
ccagcucucagccaa

SEQ ID NO: 2111986 - RNA, 14 nt, Human
ccagcucucccucu

SEQ ID NO: 2111987 - RNA, 16 nt, Human
ccagcucucccucugg

SEQ ID NO: 2111988 - RNA, 12 nt, Human
ccagcucucagc

SEQ ID NO: 2111989 - RNA, 21 nt, Human
ccagcugaaauacugaggggu

SEQ ID NO: 2111990 - RNA, 15 nt, Human
ccagcucugcuugcc

SEQ ID NO: 2111991 - RNA, 21 nt, Human
ccagcucugaggacugcacca

SEQ ID NO: 2111992 - RNA, 21 nt, Human
ccagcugugcucuggacaggc

SEQ ID NO: 2111993 - RNA, 20 nt, Human
ccagcugugcucuggacagg

SEQ ID NO: 2111994 - RNA, 18 nt, Human
ccagcugugcucuggaca

SEQ ID NO: 2111995 - RNA, 13 nt, Human
ccagcugucugug

SEQ ID NO: 2111996 - RNA, 22 nt, Human
ccagcugucugugucagccugu

SEQ ID NO: 2111997 - RNA, 17 nt, Human
ccagcuggguuggaaaa

SEQ ID NO: 2111998 - RNA, 16 nt, Human
ccagcuggguuggaaa

SEQ ID NO: 2111999 - RNA, 18 nt, Human
ccagcugggaucugacug

SEQ ID NO: 2112000 - RNA, 23 nt, Human
ccagcugggaucugacugcacgu

SEQ ID NO: 2112001 - RNA, 17 nt, Human
ccagcugcaccugccag

SEQ ID NO: 2112002 - RNA, 18 nt, Human
ccagcugcaccugccagc

SEQ ID NO: 2112003 - RNA, 19 nt, Human
ccagcugcaccugccagcc

SEQ ID NO: 2112004 - RNA, 20 nt, Human
ccagcugcaccugccagccu

SEQ ID NO: 2112005 - RNA, 22 nt, Human
ccagcugcaccugccagccugg

SEQ ID NO: 2112006 - RNA, 23 nt, Human
ccagcugcaccugccagccuggc

SEQ ID NO: 2112007 - RNA, 15 nt, Human
ccaggcccggggcug

SEQ ID NO: 2112008 - RNA, 16 nt, Human
ccaggcccggggcugg

SEQ ID NO: 2112009 - RNA, 20 nt, Human
ccaggcccggggcuggcggc

SEQ ID NO: 2112010 - RNA, 21 nt, Human
ccaggcccggggcuggcggcu

SEQ ID NO: 2112011 - RNA, 19 nt, Human
ccaggccccugccacccug

SEQ ID NO: 2112012 - RNA, 23 nt, Human
ccaggccccugccacccugggga

SEQ ID NO: 2112013 - RNA, 21 nt, Human
ccaggccccugccacccuggg

SEQ ID NO: 2112014 - RNA, 21 nt, Human
ccaggccagagggagugacag

SEQ ID NO: 2112015 - RNA, 14 nt, Human
ccaggccagaggga

SEQ ID NO: 2112016 - RNA, 23 nt, Human
ccagcugugcucuggacaggcau

SEQ ID NO: 2112017 - RNA, 22 nt, Human
ccagcugugcucuggacaggca

SEQ ID NO: 2112018 - RNA, 22 nt, Human
ccagcuguggguacagagaggu

SEQ ID NO: 2112019 - RNA, 13 nt, Human
ccagcugugguuu

SEQ ID NO: 2112020 - RNA, 23 nt, Human
ccagcuguggguacagagagguc

SEQ ID NO: 2112021 - RNA, 14 nt, Human
ccagcugugguuuu

SEQ ID NO: 2112022 - RNA, 15 nt, Human
ccagcugugguuuuc

SEQ ID NO: 2112023 - RNA, 23 nt, Human
ccagcugugguuuucuuuugcca

SEQ ID NO: 2112024 - RNA, 21 nt, Human
ccaggagaaccacuacaugca

SEQ ID NO: 2112025 - RNA, 23 nt, Human
ccaggagaaccacuacaugcagc

SEQ ID NO: 2112026 - RNA, 19 nt, Human
ccaggagaaccacuacaug

SEQ ID NO: 2112027 - RNA, 10 nt, Human
cccagaggca

SEQ ID NO: 2112028 - RNA, 15 nt, Human
cccagaggcacagcc

SEQ ID NO: 2112029 - RNA, 16 nt, Human
cccagaggcacagccg

SEQ ID NO: 2112030 - RNA, 18 nt, Human
cccagaggcacagccggg

SEQ ID NO: 2112031 - RNA, 23 nt, Human
cccagagcuguuuauggccucag

SEQ ID NO: 2112032 - RNA, 21 nt, Human
cccagagcuguuuauggccuc

SEQ ID NO: 2112033 - RNA, 22 nt, Human
cccagagcuguuuauggccuca

SEQ ID NO: 2112034 - RNA, 14 nt, Human
cccagagcugggug

SEQ ID NO: 2112035 - RNA, 18 nt, Human
cccagagcugggugagug

SEQ ID NO: 2112036 - RNA, 13 nt, Human
cccagagcuguuu

SEQ ID NO: 2112037 - RNA, 11 nt, Human
cccagagcugu

SEQ ID NO: 2112038 - RNA, 15 nt, Human
cccagauuucagucu

SEQ ID NO: 2112039 - RNA, 16 nt, Human
cccagauuucagucuu

SEQ ID NO: 2112040 - RNA, 19 nt, Human
cccagauuucagucuuuuc

SEQ ID NO: 2112041 - RNA, 16 nt, Human
cccagcaacuccaacu

SEQ ID NO: 2112042 - RNA, 19 nt, Human
cccagcaacccuccuauca

SEQ ID NO: 2112043 - RNA, 21 nt, Human
cccagcaacccuccuaucacc

SEQ ID NO: 2112044 - RNA, 13 nt, Human
cccagcaacccuc

SEQ ID NO: 2112045 - RNA, 17 nt, Human
cccagcaacccuccuau

SEQ ID NO: 2112046 - RNA, 20 nt, Human
cccagccuccaagcuccauc

SEQ ID NO: 2112047 - RNA, 18 nt, Human
cccagccuccaagcucca

SEQ ID NO: 2112048 - RNA, 21 nt, Human
cccagccucuucuagagccgu

SEQ ID NO: 2112049 - RNA, 12 nt, Human
cccagccucucu

SEQ ID NO: 2112050 - RNA, 21 nt, Human
cccagccucucuuccuauccc

SEQ ID NO: 2112051 - RNA, 13 nt, Human
cccagcucugcuu

SEQ ID NO: 2112052 - RNA, 20 nt, Human
cccagcucugcuugccgaaa

SEQ ID NO: 2112053 - RNA, 13 nt, Human
cccagcucuggcu

SEQ ID NO: 2112054 - RNA, 18 nt, Human
cccagcucugaggacugc

SEQ ID NO: 2112055 - RNA, 22 nt, Human
cccagcucugaggacugcacca

SEQ ID NO: 2112056 - RNA, 14 nt, Human
cccagcgagcccug

SEQ ID NO: 2112057 - RNA, 14 nt, Human
cccagcuacucagg

SEQ ID NO: 2112058 - RNA, 23 nt, Human
cccagcucucccucuggcccugc

SEQ ID NO: 2112059 - RNA, 14 nt, Human
cccagcucagaggg

SEQ ID NO: 2112060 - RNA, 15 nt, Human
cccagcucagagggu

SEQ ID NO: 2112061 - RNA, 15 nt, Human
cccagcuacuuggga

SEQ ID NO: 2112062 - RNA, 15 nt, Human
cccagcuacucagga

SEQ ID NO: 2112063 - RNA, 20 nt, Human
cccagcuacucaggaggcug

SEQ ID NO: 2112064 - RNA, 14 nt, Human
cccaggagccccga

SEQ ID NO: 2112065 - RNA, 13 nt, Human
cccaggagccccg

SEQ ID NO: 2112066 - RNA, 14 nt, Human
cccaggagagccag

SEQ ID NO: 2112067 - RNA, 15 nt, Human
cccaggagagccagc

SEQ ID NO: 2112068 - RNA, 18 nt, Human
cccaggagagccagcccu

SEQ ID NO: 2112069 - RNA, 19 nt, Human
cccaggagagccagcccuc

SEQ ID NO: 2112070 - RNA, 21 nt, Human
cccaggagagccagcccuccc

SEQ ID NO: 2112071 - RNA, 22 nt, Human
cccaggagagccagcccucccu

SEQ ID NO: 2112072 - RNA, 23 nt, Human
cccaggagagccagcccucccug

SEQ ID NO: 2112073 - RNA, 15 nt, Human
cccagagaggaauca

SEQ ID NO: 2112074 - RNA, 23 nt, Human
cccagacuugcugaaucggaauc

SEQ ID NO: 2112075 - RNA, 19 nt, Human
cccagagaggaaucagacu

SEQ ID NO: 2112076 - RNA, 21 nt, Human
cccagagaggaaucagacuuc

SEQ ID NO: 2112077 - RNA, 14 nt, Human
cccagagaugccuc

SEQ ID NO: 2112078 - RNA, 16 nt, Human
cccagagaugccucca

SEQ ID NO: 2112079 - RNA, 17 nt, Human
cccagagaugccuccac

SEQ ID NO: 2112080 - RNA, 18 nt, Human
cccagagaugccuccacc

SEQ ID NO: 2112081 - RNA, 19 nt, Human
cccagagaugccuccaccg

SEQ ID NO: 2112082 - RNA, 20 nt, Human
cccagagaugccuccaccgc

SEQ ID NO: 2112083 - RNA, 20 nt, Human
cccagagaugggacugggag

SEQ ID NO: 2112084 - RNA, 21 nt, Human
cccagagaugccuccaccgcu

SEQ ID NO: 2112085 - RNA, 23 nt, Human
cccagagaugccuccaccgcugc

SEQ ID NO: 2112086 - RNA, 21 nt, Human
cccagagaugggacugggagg

SEQ ID NO: 2112087 - RNA, 21 nt, Human
cccagaccuuuuauccacuua

SEQ ID NO: 2112088 - RNA, 21 nt, Human
cccagaccccucuggccagga

SEQ ID NO: 2112089 - RNA, 18 nt, Human
cccagaaugucagauucc

SEQ ID NO: 2112090 - RNA, 21 nt, Human
cccagaaugucagauuccuuu

SEQ ID NO: 2112091 - RNA, 17 nt, Human
cccagaauucccagcug

SEQ ID NO: 2112092 - RNA, 21 nt, Human
cccagaauucccagcugucug

SEQ ID NO: 2112093 - RNA, 18 nt, Human
cccagaccccucuggcca

SEQ ID NO: 2112094 - RNA, 19 nt, Human
cccagaccccucuggccag

SEQ ID NO: 2112095 - RNA, 20 nt, Human
cccagaccccucuggccagg

SEQ ID NO: 2112096 - RNA, 12 nt, Human
cccagacagcuc

SEQ ID NO: 2112097 - RNA, 13 nt, Human
cccagacagcucc

SEQ ID NO: 2112098 - RNA, 14 nt, Human
cccagacagcuccc

SEQ ID NO: 2112099 - RNA, 16 nt, Human
cccagacagcucccuc

SEQ ID NO: 2112100 - RNA, 20 nt, Human
cccagacagcucccucugcc

SEQ ID NO: 2112101 - RNA, 21 nt, Human
cccagacagcucccucugccu

SEQ ID NO: 2112102 - RNA, 20 nt, Human
cccaccuuggcugcagggag

SEQ ID NO: 2112103 - RNA, 19 nt, Human
cccaccuuggcugcaggga

SEQ ID NO: 2112104 - RNA, 17 nt, Human
cccaccuuggcugcagg

SEQ ID NO: 2112105 - RNA, 16 nt, Human
cccaccuuggcugcag

SEQ ID NO: 2112106 - RNA, 12 nt, Human
cccaccugcuga

SEQ ID NO: 2112107 - RNA, 13 nt, Human
cccaccugcugag

SEQ ID NO: 2112108 - RNA, 19 nt, Human
cccaccugcugagagaccc

SEQ ID NO: 2112109 - RNA, 16 nt, Human
ccauuccuggagcccg

SEQ ID NO: 2112110 - RNA, 24 nt, Human
ccauuccuggagcccgaggcacca

SEQ ID NO: 2112111 - RNA, 21 nt, Human
ccauguuggccaggcuggucu

SEQ ID NO: 2112112 - RNA, 19 nt, Human
ccauguuggccaggcuggu

SEQ ID NO: 2112113 - RNA, 15 nt, Human
ccauguuggccaggc

SEQ ID NO: 2112114 - RNA, 18 nt, Human
ccauguuggccaggcugg

SEQ ID NO: 2112115 - RNA, 13 nt, Human
ccauuccacaucc

SEQ ID NO: 2112116 - RNA, 12 nt, Human
ccauuccucagg

SEQ ID NO: 2112117 - RNA, 13 nt, Human
ccauuccucaggg

SEQ ID NO: 2112118 - RNA, 16 nt, Human
ccauuccucagggaca

SEQ ID NO: 2112119 - RNA, 16 nt, Human
ccauuccccagccucu

SEQ ID NO: 2112120 - RNA, 18 nt, Human
ccauuccccagccucucu

SEQ ID NO: 2112121 - RNA, 19 nt, Human
ccauuccccagccucucuu

SEQ ID NO: 2112122 - RNA, 13 nt, Human
ccaugcuccuggc

SEQ ID NO: 2112123 - RNA, 18 nt, Human
ccaugccuguccagccug

SEQ ID NO: 2112124 - RNA, 19 nt, Human
ccaugccuguccagccugg

SEQ ID NO: 2112125 - RNA, 13 nt, Human
ccaugccugucca

SEQ ID NO: 2112126 - RNA, 14 nt, Human
ccaugccuguccag

SEQ ID NO: 2112127 - RNA, 17 nt, Human
ccaugccuguccagccu

SEQ ID NO: 2112128 - RNA, 13 nt, Human
ccaugaacuggag

SEQ ID NO: 2112129 - RNA, 18 nt, Human
ccaugaacuggaggccag

SEQ ID NO: 2112130 - RNA, 13 nt, Human
ccaugaaacaaag

SEQ ID NO: 2112131 - RNA, 19 nt, Human
ccaugaaaacguuuuauug

SEQ ID NO: 2112132 - RNA, 20 nt, Human
ccaugaaaacguuuuauugu

SEQ ID NO: 2112133 - RNA, 22 nt, Human
ccaugaaaaugcaacaacaugu

SEQ ID NO: 2112134 - RNA, 21 nt, Human
ccaugaaaacguuuuauugug

SEQ ID NO: 2112135 - RNA, 23 nt, Human
ccaugaaaacguuuuauuguguu

SEQ ID NO: 2112136 - RNA, 14 nt, Human
ccaugcugccucca

SEQ ID NO: 2112137 - RNA, 15 nt, Human
ccaugcuugggugua

SEQ ID NO: 2112138 - RNA, 15 nt, Human
ccaugcuccuggccc

SEQ ID NO: 2112139 - RNA, 18 nt, Human
ccaugcuccuggcccacu

SEQ ID NO: 2112140 - RNA, 13 nt, Human
ccaugugccaggu

SEQ ID NO: 2112141 - RNA, 14 nt, Human
ccauguuggccagg

SEQ ID NO: 2112142 - RNA, 13 nt, Human
ccauguuggccag

SEQ ID NO: 2112143 - RNA, 13 nt, Human
ccaugugcccagu

SEQ ID NO: 2112144 - RNA, 15 nt, Human
ccaugugccugcacc

SEQ ID NO: 2112145 - RNA, 17 nt, Human
ccaugugccugcaccag

SEQ ID NO: 2112146 - RNA, 18 nt, Human
ccaugugccugcaccagg

SEQ ID NO: 2112147 - RNA, 19 nt, Human
ccaugugccugcaccagga

SEQ ID NO: 2112148 - RNA, 20 nt, Human
ccaugugccugcaccaggag

SEQ ID NO: 2112149 - RNA, 13 nt, Human
ccauggaggcaca

SEQ ID NO: 2112150 - RNA, 21 nt, Human
ccauggaggcacacagcugca

SEQ ID NO: 2112151 - RNA, 17 nt, Human
ccauggaggcacacagc

SEQ ID NO: 2112152 - RNA, 20 nt, Human
ccauggaggcacacagcugc

SEQ ID NO: 2112153 - RNA, 17 nt, Human
ccauggagacaagaagg

SEQ ID NO: 2112154 - RNA, 20 nt, Human
cccagagcuguuuauggccu

SEQ ID NO: 2112155 - RNA, 18 nt, Human
ccccaacccaaaccugga

SEQ ID NO: 2112156 - RNA, 13 nt, Human
ccccaacccccac

SEQ ID NO: 2112157 - RNA, 11 nt, Human
ccccaaagugg

SEQ ID NO: 2112158 - RNA, 13 nt, Human
ccccaacuccugg

SEQ ID NO: 2112159 - RNA, 16 nt, Human
ccccaacgaaaagcac

SEQ ID NO: 2112160 - RNA, 20 nt, Human
ccccaacgaaaagcacaucc

SEQ ID NO: 2112161 - RNA, 14 nt, Human
ccccaacuccugga

SEQ ID NO: 2112162 - RNA, 15 nt, Human
ccccaacuccuggaa

SEQ ID NO: 2112163 - RNA, 22 nt, Human
ccccacacuuguuccagcucuu

SEQ ID NO: 2112164 - RNA, 13 nt, Human
ccccaacccugcc

SEQ ID NO: 2112165 - RNA, 15 nt, Human
ccccaacccugcccc

SEQ ID NO: 2112166 - RNA, 17 nt, Human
ccccaacccugccccug

SEQ ID NO: 2112167 - RNA, 18 nt, Human
ccccaacccugccccugc

SEQ ID NO: 2112168 - RNA, 23 nt, Human
ccccaacccugccccugccccgu

SEQ ID NO: 2112169 - RNA, 19 nt, Human
cccaugugccugcaccagg

SEQ ID NO: 2112170 - RNA, 22 nt, Human
cccaugugccugcaccaggaga

SEQ ID NO: 2112171 - RNA, 14 nt, Human
cccaugugugagug

SEQ ID NO: 2112172 - RNA, 19 nt, Human
cccaugugugagugugugc

SEQ ID NO: 2112173 - RNA, 20 nt, Human
cccaugugugagugugugca

SEQ ID NO: 2112174 - RNA, 18 nt, Human
cccauuagaccaagcuug

SEQ ID NO: 2112175 - RNA, 12 nt, Human
ccccaaagcccc

SEQ ID NO: 2112176 - RNA, 17 nt, Human
cccaugucuacacagau

SEQ ID NO: 2112177 - RNA, 16 nt, Human
cccaugucucucagaa

SEQ ID NO: 2112178 - RNA, 20 nt, Human
cccaugagccucagcauccu

SEQ ID NO: 2112179 - RNA, 14 nt, Human
cccaugccugucca

SEQ ID NO: 2112180 - RNA, 16 nt, Human
cccaugccuguccagc

SEQ ID NO: 2112181 - RNA, 19 nt, Human
cccaugccuguccagccug

SEQ ID NO: 2112182 - RNA, 16 nt, Human
cccaugagccucagca

SEQ ID NO: 2112183 - RNA, 15 nt, Human
cccaugagccucagc

SEQ ID NO: 2112184 - RNA, 20 nt, Human
cccaugccuguccagccugg

SEQ ID NO: 2112185 - RNA, 15 nt, Human
cccaucuugccucca

SEQ ID NO: 2112186 - RNA, 24 nt, Human
cccaucuugccuccauggugccuc

SEQ ID NO: 2112187 - RNA, 18 nt, Human
cccaugaagacaggacag

SEQ ID NO: 2112188 - RNA, 19 nt, Human
cccaugaagacaggacagu

SEQ ID NO: 2112189 - RNA, 22 nt, Human
cccaugaagacaggacagugcu

SEQ ID NO: 2112190 - RNA, 12 nt, Human
cccaugaagcca

SEQ ID NO: 2112191 - RNA, 16 nt, Human
cccaugaagccacagc

SEQ ID NO: 2112192 - RNA, 19 nt, Human
cccaucgguguccauuuau

SEQ ID NO: 2112193 - RNA, 20 nt, Human
cccaucgguguccauuuaua

SEQ ID NO: 2112194 - RNA, 21 nt, Human
cccaucuaugucccuugcugu

SEQ ID NO: 2112195 - RNA, 19 nt, Human
cccagucuggaaugcagug

SEQ ID NO: 2112196 - RNA, 18 nt, Human
cccagucuggaaugcagu

SEQ ID NO: 2112197 - RNA, 10 nt, Human
cccagucugg

SEQ ID NO: 2112198 - RNA, 21 nt, Human
cccagugcccacaggaucagu

SEQ ID NO: 2112199 - RNA, 15 nt, Human
cccagugccgagaag

SEQ ID NO: 2112200 - RNA, 15 nt, Human
cccagugcccugggg

SEQ ID NO: 2112201 - RNA, 16 nt, Human
cccagugcccuggggc

SEQ ID NO: 2112202 - RNA, 17 nt, Human
cccagugcccuggggcu

SEQ ID NO: 2112203 - RNA, 23 nt, Human
cccagugcccuggggcugaucuc

SEQ ID NO: 2112204 - RNA, 14 nt, Human
cccaguuagcucuc

SEQ ID NO: 2112205 - RNA, 14 nt, Human
cccaguuaaucuug

SEQ ID NO: 2112206 - RNA, 19 nt, Human
cccaguucaggagucccaa

SEQ ID NO: 2112207 - RNA, 22 nt, Human
cccaguucaggagucccaagga

SEQ ID NO: 2112208 - RNA, 17 nt, Human
cccaguguuuuaggagc

SEQ ID NO: 2112209 - RNA, 16 nt, Human
cccaguguuuuaggag

SEQ ID NO: 2112210 - RNA, 16 nt, Human
cccaguguuguuugua

SEQ ID NO: 2112211 - RNA, 17 nt, Human
cccaguguuguuuguaa

SEQ ID NO: 2112212 - RNA, 18 nt, Human
cccaguguuguuuguaaa

SEQ ID NO: 2112213 - RNA, 21 nt, Human
cccaguguuguuuguaaauaa

SEQ ID NO: 2112214 - RNA, 23 nt, Human
cccaggcaggucuugaacuccug

SEQ ID NO: 2112215 - RNA, 19 nt, Human
cccaggguuaauagggccu

SEQ ID NO: 2112216 - RNA, 18 nt, Human
cccaggguucccccagcc

SEQ ID NO: 2112217 - RNA, 13 nt, Human
cccagguuucuau

SEQ ID NO: 2112218 - RNA, 14 nt, Human
cccaguaagccacu

SEQ ID NO: 2112219 - RNA, 12 nt, Human
cccagucccugg

SEQ ID NO: 2112220 - RNA, 13 nt, Human
cccagucccuggg

SEQ ID NO: 2112221 - RNA, 14 nt, Human
cccagucccugggg

SEQ ID NO: 2112222 - RNA, 16 nt, Human
cccagucccuggggga

SEQ ID NO: 2112223 - RNA, 23 nt, Human
cccagucccugggggaagcccug

SEQ ID NO: 2112224 - RNA, 23 nt, Human
ccucccaaagugcugggauuaca

SEQ ID NO: 2112225 - RNA, 17 nt, Human
ccuccccccacugcagg

SEQ ID NO: 2112226 - RNA, 18 nt, Human
ccuccccccacugcaggc

SEQ ID NO: 2112227 - RNA, 14 nt, Human
ccucccccuccuuc

SEQ ID NO: 2112228 - RNA, 15 nt, Human
ccucccccuccuucc

SEQ ID NO: 2112229 - RNA, 16 nt, Human
ccucccccuccuuccc

SEQ ID NO: 2112230 - RNA, 21 nt, Human
ccucccccuccuucccagcug

SEQ ID NO: 2112231 - RNA, 12 nt, Human
ccucccccugcc

SEQ ID NO: 2112232 - RNA, 12 nt, Human
ccucccccuccu

SEQ ID NO: 2112233 - RNA, 20 nt, Human
ccuccccccacugcaggccc

SEQ ID NO: 2112234 - RNA, 23 nt, Human
ccuccccggcucgagcaguccug

SEQ ID NO: 2112235 - RNA, 13 nt, Human
ccuccccuaucca

SEQ ID NO: 2112236 - RNA, 15 nt, Human
ccuccccuauccacc

SEQ ID NO: 2112237 - RNA, 17 nt, Human
ccuccccuauccaccca

SEQ ID NO: 2112238 - RNA, 18 nt, Human
ccuccccuauccacccag

SEQ ID NO: 2112239 - RNA, 22 nt, Human
ccuccccuauccacccagccca

SEQ ID NO: 2112240 - RNA, 14 nt, Human
ccucccccuguccc

SEQ ID NO: 2112241 - RNA, 20 nt, Human
ccucccccugccagugccuu

SEQ ID NO: 2112242 - RNA, 18 nt, Human
ccucccccugccagugcc

SEQ ID NO: 2112243 - RNA, 19 nt, Human
ccucccccugccagugccu

SEQ ID NO: 2112244 - RNA, 14 nt, Human
ccucccccugcccc

SEQ ID NO: 2112245 - RNA, 15 nt, Human
ccucccccugccagu

SEQ ID NO: 2112246 - RNA, 17 nt, Human
ccucccccugccagugc

SEQ ID NO: 2112247 - RNA, 14 nt, Human
ccucccccugccag

SEQ ID NO: 2112248 - RNA, 13 nt, Human
ccucccccugcca

SEQ ID NO: 2112249 - RNA, 13 nt, Human
ccuccccucaagg

SEQ ID NO: 2112250 - RNA, 14 nt, Human
ccuccccucaagga

SEQ ID NO: 2112251 - RNA, 18 nt, Human
ccucccgaauagcuggga

SEQ ID NO: 2112252 - RNA, 14 nt, Human
ccuccccugccauu

SEQ ID NO: 2112253 - RNA, 13 nt, Human
ccuccccugcccu

SEQ ID NO: 2112254 - RNA, 14 nt, Human
ccuccccugcccua

SEQ ID NO: 2112255 - RNA, 14 nt, Human
ccuccccugcccuc

SEQ ID NO: 2112256 - RNA, 15 nt, Human
ccuccccugcccucg

SEQ ID NO: 2112257 - RNA, 15 nt, Human
ccuccccugcccugg

SEQ ID NO: 2112258 - RNA, 20 nt, Human
ccucccgaauagcugggacu

SEQ ID NO: 2112259 - RNA, 19 nt, Human
ccucccgaauagcugggac

SEQ ID NO: 2112260 - RNA, 21 nt, Human
ccucccgaauagcugggacua

SEQ ID NO: 2112261 - RNA, 16 nt, Human
ccuccccugcccuggu

SEQ ID NO: 2112262 - RNA, 18 nt, Human
ccucccgaguagcuggga

SEQ ID NO: 2112263 - RNA, 17 nt, Human
ccucccgaguagcuggg

SEQ ID NO: 2112264 - RNA, 13 nt, Human
ccucccucuaauu

SEQ ID NO: 2112265 - RNA, 13 nt, Human
ccucccucucucu

SEQ ID NO: 2112266 - RNA, 18 nt, Human
ccucccucucucuucugc

SEQ ID NO: 2112267 - RNA, 12 nt, Human
ccucccuccuuc

SEQ ID NO: 2112268 - RNA, 14 nt, Human
ccucccuccuuccu

SEQ ID NO: 2112269 - RNA, 13 nt, Human
ccucccucuuucc

SEQ ID NO: 2112270 - RNA, 20 nt, Human
ccucccucucucuucugcuc

SEQ ID NO: 2112271 - RNA, 22 nt, Human
ccucccucucucuucugcucca

SEQ ID NO: 2112272 - RNA, 14 nt, Human
ccucccucugaccu

SEQ ID NO: 2112273 - RNA, 18 nt, Human
ccucccucugaccugcag

SEQ ID NO: 2112274 - RNA, 19 nt, Human
ccucccucugaccugcagg

SEQ ID NO: 2112275 - RNA, 13 nt, Human
ccuccucaccucu

SEQ ID NO: 2112276 - RNA, 14 nt, Human
ccuccucaccucug

SEQ ID NO: 2112277 - RNA, 15 nt, Human
ccuccucaccucugg

SEQ ID NO: 2112278 - RNA, 16 nt, Human
ccuccucaccucugga

SEQ ID NO: 2112279 - RNA, 21 nt, Human
ccuccucaccucuggacuggc

SEQ ID NO: 2112280 - RNA, 22 nt, Human
ccuccucaccucuggacuggcu

SEQ ID NO: 2112281 - RNA, 14 nt, Human
ccuccucacucccu

SEQ ID NO: 2112282 - RNA, 12 nt, Human
ccuccuccagcc

SEQ ID NO: 2112283 - RNA, 17 nt, Human
ccucaggugagaagcag

SEQ ID NO: 2112284 - RNA, 18 nt, Human
ccucaggugagaagcaga

SEQ ID NO: 2112285 - RNA, 20 nt, Human
ccucaggugagaagcagagg

SEQ ID NO: 2112286 - RNA, 21 nt, Human
ccucaguggacuuuccacccc

SEQ ID NO: 2112287 - RNA, 23 nt, Human
ccucaguggacuuuccacccccu

SEQ ID NO: 2112288 - RNA, 11 nt, Human
ccucaguguca

SEQ ID NO: 2112289 - RNA, 12 nt, Human
ccucagugucau

SEQ ID NO: 2112290 - RNA, 23 nt, Human
ccucagugucauuuaugaaaaga

SEQ ID NO: 2112291 - RNA, 15 nt, Human
ccucaguuucccuau

SEQ ID NO: 2112292 - RNA, 16 nt, Human
ccuccacuccuuccug

SEQ ID NO: 2112293 - RNA, 15 nt, Human
ccucaguucccuugg

SEQ ID NO: 2112294 - RNA, 16 nt, Human
ccucaguucccuuggc

SEQ ID NO: 2112295 - RNA, 17 nt, Human
ccucaguucccuuggcc

SEQ ID NO: 2112296 - RNA, 18 nt, Human
ccucaguucccuuggccu

SEQ ID NO: 2112297 - RNA, 19 nt, Human
ccucaguucccuuggccuc

SEQ ID NO: 2112298 - RNA, 20 nt, Human
ccucaguucccuuggccuca

SEQ ID NO: 2112299 - RNA, 21 nt, Human
ccucaguucccuuggccucag

SEQ ID NO: 2112300 - RNA, 22 nt, Human
ccucaguucccuuggccucaga

SEQ ID NO: 2112301 - RNA, 17 nt, Human
ccuccagaagccucugg

SEQ ID NO: 2112302 - RNA, 13 nt, Human
ccuccagaagccu

SEQ ID NO: 2112303 - RNA, 11 nt, Human
ccuccagcuca

SEQ ID NO: 2112304 - RNA, 13 nt, Human
ccuccagcucagc

SEQ ID NO: 2112305 - RNA, 15 nt, Human
ccuccagcucagcag

SEQ ID NO: 2112306 - RNA, 18 nt, Human
ccuccagcucagcaguga

SEQ ID NO: 2112307 - RNA, 12 nt, Human
ccuccagaagcc

SEQ ID NO: 2112308 - RNA, 13 nt, Human
ccuccacugcccu

SEQ ID NO: 2112309 - RNA, 14 nt, Human
ccuccacugcccuc

SEQ ID NO: 2112310 - RNA, 15 nt, Human
ccuccacugcccucu

SEQ ID NO: 2112311 - RNA, 16 nt, Human
ccuccacugcccucug

SEQ ID NO: 2112312 - RNA, 12 nt, Human
ccuccagcuguu

SEQ ID NO: 2112313 - RNA, 11 nt, Human
ccuccagcugu

SEQ ID NO: 2112314 - RNA, 13 nt, Human
ccuccaggcaaaa

SEQ ID NO: 2112315 - RNA, 16 nt, Human
ccuccaugcugccucc

SEQ ID NO: 2112316 - RNA, 19 nt, Human
ccuccaugcugccuccaga

SEQ ID NO: 2112317 - RNA, 15 nt, Human
ccuccauggugccuc

SEQ ID NO: 2112318 - RNA, 18 nt, Human
ccuccauggugccucugg

SEQ ID NO: 2112319 - RNA, 21 nt, Human
ccuccauggugccucuggagg

SEQ ID NO: 2112320 - RNA, 17 nt, Human
ccucccaaagugcuggg

SEQ ID NO: 2112321 - RNA, 15 nt, Human
ccuccaugugggcua

SEQ ID NO: 2112322 - RNA, 12 nt, Human
ccuccauguggg

SEQ ID NO: 2112323 - RNA, 15 nt, Human
ccuccaucccgacau

SEQ ID NO: 2112324 - RNA, 14 nt, Human
ccuccaucccgaca

SEQ ID NO: 2112325 - RNA, 20 nt, Human
ccucguccucccccugccag

SEQ ID NO: 2112326 - RNA, 21 nt, Human
ccucguccucccccugccagu

SEQ ID NO: 2112327 - RNA, 15 nt, Human
ccucguccucccccu

SEQ ID NO: 2112328 - RNA, 16 nt, Human
ccucguccucccccug

SEQ ID NO: 2112329 - RNA, 17 nt, Human
ccucguccucccccugc

SEQ ID NO: 2112330 - RNA, 19 nt, Human
ccucguccucccccugcca

SEQ ID NO: 2112331 - RNA, 12 nt, Human
ccuccuuuccca

SEQ ID NO: 2112332 - RNA, 20 nt, Human
ccuccuugucuuggcagccu

SEQ ID NO: 2112333 - RNA, 16 nt, Human
ccuccuuuacccucau

SEQ ID NO: 2112334 - RNA, 17 nt, Human
ccuccuuuacccucauc

SEQ ID NO: 2112335 - RNA, 19 nt, Human
ccuccuuuacccucaucug

SEQ ID NO: 2112336 - RNA, 17 nt, Human
ccuccuugccuccugug

SEQ ID NO: 2112337 - RNA, 18 nt, Human
ccuccuugccuccugugu

SEQ ID NO: 2112338 - RNA, 19 nt, Human
ccuccuugccuccugugua

SEQ ID NO: 2112339 - RNA, 20 nt, Human
ccuccuugccuccuguguaa

SEQ ID NO: 2112340 - RNA, 15 nt, Human
ccucuaaugcucacg

SEQ ID NO: 2112341 - RNA, 18 nt, Human
ccucuaaugcucacgcuc

SEQ ID NO: 2112342 - RNA, 22 nt, Human
ccucuaaugcucacgcucccaa

SEQ ID NO: 2112343 - RNA, 21 nt, Human
ccuccucuaacaggggcuggu

SEQ ID NO: 2112344 - RNA, 14 nt, Human
ccuccuugccuccu

SEQ ID NO: 2112345 - RNA, 21 nt, Human
ccuccuccagccgccaugcuc

SEQ ID NO: 2112346 - RNA, 15 nt, Human
ccucuccccagcaag

SEQ ID NO: 2112347 - RNA, 12 nt, Human
ccucucccagga

SEQ ID NO: 2112348 - RNA, 13 nt, Human
ccucucccaggac

SEQ ID NO: 2112349 - RNA, 14 nt, Human
ccucucccaggacc

SEQ ID NO: 2112350 - RNA, 13 nt, Human
ccucgugcuuuaa

SEQ ID NO: 2112351 - RNA, 20 nt, Human
ccucuacuuaaugagauagu

SEQ ID NO: 2112352 - RNA, 14 nt, Human
ccucuaccaagcug

SEQ ID NO: 2112353 - RNA, 20 nt, Human
ccucuccccagcaagugaga

SEQ ID NO: 2112354 - RNA, 22 nt, Human
ccucuccccaagacuugguguc

SEQ ID NO: 2112355 - RNA, 14 nt, Human
ccucuccccaagac

SEQ ID NO: 2112356 - RNA, 10 nt, Human
ccucucccug

SEQ ID NO: 2112357 - RNA, 13 nt, Human
ccucucccuggcc

SEQ ID NO: 2112358 - RNA, 15 nt, Human
ccucucccuggcccu

SEQ ID NO: 2112359 - RNA, 20 nt, Human
ccucugacacacagcucugu

SEQ ID NO: 2112360 - RNA, 19 nt, Human
ccucugacacacagcucug

SEQ ID NO: 2112361 - RNA, 14 nt, Human
ccucugacacacag

SEQ ID NO: 2112362 - RNA, 15 nt, Human
ccucugacacacagc

SEQ ID NO: 2112363 - RNA, 12 nt, Human
ccucuccugccu

SEQ ID NO: 2112364 - RNA, 11 nt, Human
ccucuccugcc

SEQ ID NO: 2112365 - RNA, 13 nt, Human
ccucugacacaca

SEQ ID NO: 2112366 - RNA, 13 nt, Human
ccucucccuguug

SEQ ID NO: 2112367 - RNA, 14 nt, Human
ccucugacucccaa

SEQ ID NO: 2112368 - RNA, 21 nt, Human
ccucugacucccaaagagcug

SEQ ID NO: 2112369 - RNA, 22 nt, Human
ccucugacucccaaagagcugc

SEQ ID NO: 2112370 - RNA, 19 nt, Human
ccucugaccugcaggccaa

SEQ ID NO: 2112371 - RNA, 20 nt, Human
ccucugaccugcaggccaag

SEQ ID NO: 2112372 - RNA, 15 nt, Human
ccucugaccugcagg

SEQ ID NO: 2112373 - RNA, 16 nt, Human
ccucugaccugcaggc

SEQ ID NO: 2112374 - RNA, 17 nt, Human
ccucugaccugcaggcc

SEQ ID NO: 2112375 - RNA, 21 nt, Human
ccucugacacacagcucuguc

SEQ ID NO: 2112376 - RNA, 13 nt, Human
ccucuccugccua

SEQ ID NO: 2112377 - RNA, 20 nt, Human
ccucugaaguuggacagcaa

SEQ ID NO: 2112378 - RNA, 22 nt, Human
ccucugacccuagcucuuuccu

SEQ ID NO: 2112379 - RNA, 13 nt, Human
ccucugccaccuc

SEQ ID NO: 2112380 - RNA, 14 nt, Human
ccucugccaccucc

SEQ ID NO: 2112381 - RNA, 15 nt, Human
ccucugccaccuccc

SEQ ID NO: 2112382 - RNA, 16 nt, Human
ccucugccaccucccc

SEQ ID NO: 2112383 - RNA, 19 nt, Human
ccucugagccccugggacu

SEQ ID NO: 2112384 - RNA, 15 nt, Human
ccucugauaccucaa

SEQ ID NO: 2112385 - RNA, 14 nt, Human
ccucugauaccuca

SEQ ID NO: 2112386 - RNA, 17 nt, Human
ccucuagaaauuuuuca

SEQ ID NO: 2112387 - RNA, 11 nt, Human
cccuucuuuuu

SEQ ID NO: 2112388 - RNA, 19 nt, Human
cccuucuuuuucuucuuuu

SEQ ID NO: 2112389 - RNA, 21 nt, Human
cccuugaaagucaugaacaca

SEQ ID NO: 2112390 - RNA, 22 nt, Human
cccuugaaagucaugaacacau

SEQ ID NO: 2112391 - RNA, 23 nt, Human
cccuugacgucaagucuccuucc

SEQ ID NO: 2112392 - RNA, 13 nt, Human
cccuuggaggcca

SEQ ID NO: 2112393 - RNA, 15 nt, Human
cccuuggaggccagc

SEQ ID NO: 2112394 - RNA, 17 nt, Human
cccuuggaggccagcca

SEQ ID NO: 2112395 - RNA, 18 nt, Human
cccuuggaggccagccag

SEQ ID NO: 2112396 - RNA, 17 nt, Human
cccuuggaggcugucuu

SEQ ID NO: 2112397 - RNA, 12 nt, Human
cccuuggccuca

SEQ ID NO: 2112398 - RNA, 13 nt, Human
cccuuggccucag

SEQ ID NO: 2112399 - RNA, 17 nt, Human
cccuugugcguggguga

SEQ ID NO: 2112400 - RNA, 12 nt, Human
cccuugugugug

SEQ ID NO: 2112401 - RNA, 23 nt, Human
cccuuuagcacguuuaaaguucu

SEQ ID NO: 2112402 - RNA, 14 nt, Human
cccuuggccucaga

SEQ ID NO: 2112403 - RNA, 12 nt, Human
cccuuggccugu

SEQ ID NO: 2112404 - RNA, 15 nt, Human
cccuugucccacuca

SEQ ID NO: 2112405 - RNA, 12 nt, Human
cccuuccccacu

SEQ ID NO: 2112406 - RNA, 21 nt, Human
cccuuccccacugccugccca

SEQ ID NO: 2112407 - RNA, 19 nt, Human
cccuucccuugagcccucu

SEQ ID NO: 2112408 - RNA, 11 nt, Human
cccuucauuug

SEQ ID NO: 2112409 - RNA, 22 nt, Human
cccuguucacucuacuuagcau

SEQ ID NO: 2112410 - RNA, 14 nt, Human
cccuguucacucua

SEQ ID NO: 2112411 - RNA, 23 nt, Human
cccuucacuucugaccacacuuc

SEQ ID NO: 2112412 - RNA, 17 nt, Human
cccuucagugcccacca

SEQ ID NO: 2112413 - RNA, 12 nt, Human
cccuguucauug

SEQ ID NO: 2112414 - RNA, 13 nt, Human
cccuguucauugu

SEQ ID NO: 2112415 - RNA, 13 nt, Human
cccuucagugccc

SEQ ID NO: 2112416 - RNA, 13 nt, Human
cccuguucacucu

SEQ ID NO: 2112417 - RNA, 19 nt, Human
cccugguuauauucucacg

SEQ ID NO: 2112418 - RNA, 18 nt, Human
cccugguuauauucucac

SEQ ID NO: 2112419 - RNA, 11 nt, Human
ccgguguccuu

SEQ ID NO: 2112420 - RNA, 15 nt, Human
ccggugugccugcag

SEQ ID NO: 2112421 - RNA, 16 nt, Human
ccggugugccugcagc

SEQ ID NO: 2112422 - RNA, 17 nt, Human
ccggugugccugcagcc

SEQ ID NO: 2112423 - RNA, 23 nt, Human
ccggucccuugagaccucagcca

SEQ ID NO: 2112424 - RNA, 20 nt, Human
ccggucccuugagaccucag

SEQ ID NO: 2112425 - RNA, 22 nt, Human
ccggucccuugagaccucagcc

SEQ ID NO: 2112426 - RNA, 15 nt, Human
ccgguggaaggccuu

SEQ ID NO: 2112427 - RNA, 23 nt, Human
ccguggagaugggaugcuugccu

SEQ ID NO: 2112428 - RNA, 15 nt, Human
ccguggcacugcaua

SEQ ID NO: 2112429 - RNA, 23 nt, Human
ccguggcaucaccuuaggcaggg

SEQ ID NO: 2112430 - RNA, 15 nt, Human
ccgggaagccacccu

SEQ ID NO: 2112431 - RNA, 17 nt, Human
ccgggaagccacccucc

SEQ ID NO: 2112432 - RNA, 13 nt, Human
ccgggacucacug

SEQ ID NO: 2112433 - RNA, 19 nt, Human
ccgggacucacuggcagcc

SEQ ID NO: 2112434 - RNA, 20 nt, Human
ccgggacucacuggcagccc

SEQ ID NO: 2112435 - RNA, 22 nt, Human
ccgggacucacuggcagcccca

SEQ ID NO: 2112436 - RNA, 23 nt, Human
ccgggacucacuggcagccccag

SEQ ID NO: 2112437 - RNA, 12 nt, Human
ccgggagagggg

SEQ ID NO: 2112438 - RNA, 18 nt, Human
ccggucccuugagaccuc

SEQ ID NO: 2112439 - RNA, 18 nt, Human
ccggggcagcugccagag

SEQ ID NO: 2112440 - RNA, 19 nt, Human
ccggggcagcugccagaga

SEQ ID NO: 2112441 - RNA, 20 nt, Human
ccggggcagcugccagagaa

SEQ ID NO: 2112442 - RNA, 21 nt, Human
ccggaggggccuggcagccgu

SEQ ID NO: 2112443 - RNA, 17 nt, Human
ccggagguagagguugu

SEQ ID NO: 2112444 - RNA, 17 nt, Human
ccggaggggccuggcag

SEQ ID NO: 2112445 - RNA, 18 nt, Human
ccggagauguagcaaaac

SEQ ID NO: 2112446 - RNA, 15 nt, Human
ccggauccugggugg

SEQ ID NO: 2112447 - RNA, 14 nt, Human
ccggagauguagca

SEQ ID NO: 2112448 - RNA, 17 nt, Human
ccggagauguagcaaaa

SEQ ID NO: 2112449 - RNA, 17 nt, Human
ccggagauuggacggcc

SEQ ID NO: 2112450 - RNA, 19 nt, Human
ccggagauuggacggccug

SEQ ID NO: 2112451 - RNA, 20 nt, Human
ccggagauuggacggccuga

SEQ ID NO: 2112452 - RNA, 21 nt, Human
ccggagauuggacggccugau

SEQ ID NO: 2112453 - RNA, 22 nt, Human
ccguuacucuccaaccuggaca

SEQ ID NO: 2112454 - RNA, 13 nt, Human
ccguuacucucca

SEQ ID NO: 2112455 - RNA, 14 nt, Human
ccguuacucuccaa

SEQ ID NO: 2112456 - RNA, 17 nt, Human
ccguuacucuccaaccu

SEQ ID NO: 2112457 - RNA, 16 nt, Human
ccuaaaauucagugga

SEQ ID NO: 2112458 - RNA, 22 nt, Human
ccuacaguugaaaaacagcuga

SEQ ID NO: 2112459 - RNA, 14 nt, Human
ccuacagaugaacu

SEQ ID NO: 2112460 - RNA, 18 nt, Human
ccuaacacagcaugugua

SEQ ID NO: 2112461 - RNA, 21 nt, Human
ccuacagaauacuagccagag

SEQ ID NO: 2112462 - RNA, 17 nt, Human
ccggggccugccuagca

SEQ ID NO: 2112463 - RNA, 13 nt, Human
ccuaccaaccucu

SEQ ID NO: 2112464 - RNA, 14 nt, Human
ccuaccaaccucug

SEQ ID NO: 2112465 - RNA, 15 nt, Human
ccuaccaaccucuga

SEQ ID NO: 2112466 - RNA, 13 nt, Human
ccuacccacccuc

SEQ ID NO: 2112467 - RNA, 18 nt, Human
ccuacccacccuccuuuc

SEQ ID NO: 2112468 - RNA, 21 nt, Human
ccuagaaauuccccacccuga

SEQ ID NO: 2112469 - RNA, 17 nt, Human
ccuacuuccagguucug

SEQ ID NO: 2112470 - RNA, 13 nt, Human
ccuaggugacaga

SEQ ID NO: 2112471 - RNA, 16 nt, Human
ccuagacccuccuccu

SEQ ID NO: 2112472 - RNA, 16 nt, Human
ccucagagccaccccu

SEQ ID NO: 2112473 - RNA, 15 nt, Human
ccucagagccccgca

SEQ ID NO: 2112474 - RNA, 13 nt, Human
ccucagaguccag

SEQ ID NO: 2112475 - RNA, 15 nt, Human
ccucagaguccaggc

SEQ ID NO: 2112476 - RNA, 16 nt, Human
ccucagaguccaggcc

SEQ ID NO: 2112477 - RNA, 17 nt, Human
ccucagaguccaggccc

SEQ ID NO: 2112478 - RNA, 18 nt, Human
ccucagaguccaggcccc

SEQ ID NO: 2112479 - RNA, 16 nt, Human
ccucacuguugaauuu

SEQ ID NO: 2112480 - RNA, 14 nt, Human
ccucacuugaaugu

SEQ ID NO: 2112481 - RNA, 14 nt, Human
ccucagacugcuca

SEQ ID NO: 2112482 - RNA, 15 nt, Human
ccucagacugcucaa

SEQ ID NO: 2112483 - RNA, 19 nt, Human
ccucacugggguccugggg

SEQ ID NO: 2112484 - RNA, 20 nt, Human
ccucacugggguccuggggc

SEQ ID NO: 2112485 - RNA, 23 nt, Human
ccucacugggguccuggggccuc

SEQ ID NO: 2112486 - RNA, 12 nt, Human
ccucacugggug

SEQ ID NO: 2112487 - RNA, 13 nt, Human
ccucacugggugg

SEQ ID NO: 2112488 - RNA, 14 nt, Human
ccucacuggguggg

SEQ ID NO: 2112489 - RNA, 21 nt, Human
ccucacuggguggggugagga

SEQ ID NO: 2112490 - RNA, 20 nt, Human
ccucacucccuucccauaag

SEQ ID NO: 2112491 - RNA, 16 nt, Human
ccucacaucuuucaca

SEQ ID NO: 2112492 - RNA, 15 nt, Human
ccucacaucuuucac

SEQ ID NO: 2112493 - RNA, 20 nt, Human
ccucagaugcacaugagcug

SEQ ID NO: 2112494 - RNA, 19 nt, Human
ccucagaguccaggcccca

SEQ ID NO: 2112495 - RNA, 22 nt, Human
ccucagcaaccuguaagacuga

SEQ ID NO: 2112496 - RNA, 18 nt, Human
ccucagccccucuugccc

SEQ ID NO: 2112497 - RNA, 19 nt, Human
ccucagccccucuugcccc

SEQ ID NO: 2112498 - RNA, 20 nt, Human
ccucagccccucuugccccc

SEQ ID NO: 2112499 - RNA, 23 nt, Human
ccucagccccucuugccccccac

SEQ ID NO: 2112500 - RNA, 13 nt, Human
ccucagccccucu

SEQ ID NO: 2112501 - RNA, 14 nt, Human
ccucagccccucuu

SEQ ID NO: 2112502 - RNA, 16 nt, Human
ccucagccccucuugc

SEQ ID NO: 2112503 - RNA, 16 nt, Human
ccucagccaugaggag

SEQ ID NO: 2112504 - RNA, 21 nt, Human
ccucagccaugaggaguugcu

SEQ ID NO: 2112505 - RNA, 24 nt, Human
ccucagggacagagacaccugcac

SEQ ID NO: 2112506 - RNA, 22 nt, Human
ccucagggacagagacaccugc

SEQ ID NO: 2112507 - RNA, 23 nt, Human
ccucagggacagagacaccugca

SEQ ID NO: 2112508 - RNA, 16 nt, Human
ccucaggcuuccuugg

SEQ ID NO: 2112509 - RNA, 17 nt, Human
ccucaggcuuccuuggc

SEQ ID NO: 2112510 - RNA, 18 nt, Human
ccucaggcugcuggagga

SEQ ID NO: 2112511 - RNA, 11 nt, Human
ccucagggaca

SEQ ID NO: 2112512 - RNA, 20 nt, Human
ccucagggacagagacaccu

SEQ ID NO: 2112513 - RNA, 21 nt, Human
ccucagggacagagacaccug

SEQ ID NO: 2112514 - RNA, 12 nt, Human
ccucaggcugcu

SEQ ID NO: 2112515 - RNA, 14 nt, Human
ccucaggcugcugg

SEQ ID NO: 2112516 - RNA, 15 nt, Human
ccucaggcugcugga

SEQ ID NO: 2112517 - RNA, 16 nt, Human
ccucaggcugcuggag

SEQ ID NO: 2112518 - RNA, 17 nt, Human
ccucaggcugcuggagg

SEQ ID NO: 2112519 - RNA, 15 nt, Human
ccuaggugacagagu

SEQ ID NO: 2112520 - RNA, 18 nt, Human
ccuauccacccagcccau

SEQ ID NO: 2112521 - RNA, 21 nt, Human
ccuauccacccagcccauucu

SEQ ID NO: 2112522 - RNA, 13 nt, Human
ccuaucccauccc

SEQ ID NO: 2112523 - RNA, 14 nt, Human
ccuaucccauccca

SEQ ID NO: 2112524 - RNA, 15 nt, Human
ccuaucccaucccau

SEQ ID NO: 2112525 - RNA, 17 nt, Human
ccuaguggggucucccu

SEQ ID NO: 2112526 - RNA, 18 nt, Human
ccuaguggggucucccuc

SEQ ID NO: 2112527 - RNA, 19 nt, Human
ccuaguggggucucccucu

SEQ ID NO: 2112528 - RNA, 20 nt, Human
ccuaguggggucucccucuc

SEQ ID NO: 2112529 - RNA, 16 nt, Human
ccuauccacccagccc

SEQ ID NO: 2112530 - RNA, 17 nt, Human
ccuauccacccagccca

SEQ ID NO: 2112531 - RNA, 21 nt, Human
ccuaguggggucucccucucc

SEQ ID NO: 2112532 - RNA, 16 nt, Human
ccuauuguaaauacaa

SEQ ID NO: 2112533 - RNA, 16 nt, Human
ccuauuagagaagaga

SEQ ID NO: 2112534 - RNA, 11 nt, Human
ccuauguuugc

SEQ ID NO: 2112535 - RNA, 17 nt, Human
ccuauuagagaagagau

SEQ ID NO: 2112536 - RNA, 22 nt, Human
ccucaggugagaagcagaggaa

SEQ ID NO: 2112537 - RNA, 12 nt, Human
cccuggagccca

SEQ ID NO: 2112538 - RNA, 18 nt, Human
cccuggagccuccacugc

SEQ ID NO: 2112539 - RNA, 15 nt, Human
cccugggauguccac

SEQ ID NO: 2112540 - RNA, 14 nt, Human
cccugggccccacc

SEQ ID NO: 2112541 - RNA, 20 nt, Human
cccuggggcugaucucaggg

SEQ ID NO: 2112542 - RNA, 21 nt, Human
cccuggggcugaucucaggga

SEQ ID NO: 2112543 - RNA, 21 nt, Human
cccuggugcugccacacuuca

SEQ ID NO: 2112544 - RNA, 17 nt, Human
cccuggugcugccacac

SEQ ID NO: 2112545 - RNA, 19 nt, Human
cccugggggaagcccugga

SEQ ID NO: 2112546 - RNA, 20 nt, Human
cccugggggaagcccuggau

SEQ ID NO: 2112547 - RNA, 21 nt, Human
cccuggggcuaggcuggagcc

SEQ ID NO: 2112548 - RNA, 17 nt, Human
cccugggggaagcccug

SEQ ID NO: 2112549 - RNA, 18 nt, Human
cccugggggaagcccugg

SEQ ID NO: 2112550 - RNA, 23 nt, Human
cccugguggacaguccugggaga

SEQ ID NO: 2112551 - RNA, 20 nt, Human
cccugguggacaguccuggg

SEQ ID NO: 2112552 - RNA, 21 nt, Human
cccugguggacaguccuggga

SEQ ID NO: 2112553 - RNA, 17 nt, Human
cccugguggacaguccu

SEQ ID NO: 2112554 - RNA, 18 nt, Human
cccugguggacaguccug

SEQ ID NO: 2112555 - RNA, 19 nt, Human
cccugguggacaguccugg

SEQ ID NO: 2112556 - RNA, 22 nt, Human
cccugguggcagugggagcugc

SEQ ID NO: 2112557 - RNA, 22 nt, Human
cccugcuuugggcugcccuggu

SEQ ID NO: 2112558 - RNA, 23 nt, Human
cccugcuuugggcugcccuggug

SEQ ID NO: 2112559 - RNA, 20 nt, Human
cccugcugguucaggguugg

SEQ ID NO: 2112560 - RNA, 19 nt, Human
cccugcugguucaggguug

SEQ ID NO: 2112561 - RNA, 13 nt, Human
cccugcugguuca

SEQ ID NO: 2112562 - RNA, 14 nt, Human
cccucccuccuucc

SEQ ID NO: 2112563 - RNA, 19 nt, Human
cccugcaaaaugagacccu

SEQ ID NO: 2112564 - RNA, 22 nt, Human
cccugcacuugcagacucuaca

SEQ ID NO: 2112565 - RNA, 20 nt, Human
cccugcagagaugcgguggc

SEQ ID NO: 2112566 - RNA, 18 nt, Human
cccuccgccaggcgagau

SEQ ID NO: 2112567 - RNA, 15 nt, Human
cccucuauuuagcau

SEQ ID NO: 2112568 - RNA, 19 nt, Human
cccucuagaaauuuuucag

SEQ ID NO: 2112569 - RNA, 16 nt, Human
cccugauuucuugcuu

SEQ ID NO: 2112570 - RNA, 21 nt, Human
cccucucaggcaugccugugu

SEQ ID NO: 2112571 - RNA, 16 nt, Human
cccucucaggcaugcc

SEQ ID NO: 2112572 - RNA, 20 nt, Human
cccugaucaagucaccggag

SEQ ID NO: 2112573 - RNA, 15 nt, Human
cccugccacccuggg

SEQ ID NO: 2112574 - RNA, 14 nt, Human
cccugccacccugg

SEQ ID NO: 2112575 - RNA, 12 nt, Human
cccugccacccu

SEQ ID NO: 2112576 - RNA, 18 nt, Human
cccugccacccuggggag

SEQ ID NO: 2112577 - RNA, 17 nt, Human
cccugccacccugggga

SEQ ID NO: 2112578 - RNA, 20 nt, Human
cccugcccacccucuggaga

SEQ ID NO: 2112579 - RNA, 14 nt, Human
cccugccagugccu

SEQ ID NO: 2112580 - RNA, 15 nt, Human
cccugccagugccuu

SEQ ID NO: 2112581 - RNA, 16 nt, Human
cccuuggccugucuca

SEQ ID NO: 2112582 - RNA, 13 nt, Human
ccccagccugcua

SEQ ID NO: 2112583 - RNA, 17 nt, Human
ccccagcucuggcuucc

SEQ ID NO: 2112584 - RNA, 17 nt, Human
ccccaccacuucuuuua

SEQ ID NO: 2112585 - RNA, 23 nt, Human
ccccaaaggaagcuuucucugcu

SEQ ID NO: 2112586 - RNA, 14 nt, Human
ccccaccaccccag

SEQ ID NO: 2112587 - RNA, 12 nt, Human
ccccaccaccua

SEQ ID NO: 2112588 - RNA, 23 nt, Human
ccccaccacgauguggcccuggc

SEQ ID NO: 2112589 - RNA, 23 nt, Human
ccccacacuuguuccagcucuuu

SEQ ID NO: 2112590 - RNA, 17 nt, Human
ccccaggggucccagcc

SEQ ID NO: 2112591 - RNA, 19 nt, Human
ccccaggggucccagccac

SEQ ID NO: 2112592 - RNA, 22 nt, Human
ccccaggggucccagccacccc

SEQ ID NO: 2112593 - RNA, 13 nt, Human
ccccagguggcug

SEQ ID NO: 2112594 - RNA, 20 nt, Human
ccccagguggcugacccagu

SEQ ID NO: 2112595 - RNA, 21 nt, Human
ccccagguggcugacccaguc

SEQ ID NO: 2112596 - RNA, 23 nt, Human
ccccagguggcugacccaguccc

SEQ ID NO: 2112597 - RNA, 22 nt, Human
ccccaggugguuauggagaggg

SEQ ID NO: 2112598 - RNA, 16 nt, Human
ccccagggucuucccu

SEQ ID NO: 2112599 - RNA, 19 nt, Human
ccccagggucuucccuacc

SEQ ID NO: 2112600 - RNA, 23 nt, Human
cccgcucagcccucccugccccu

SEQ ID NO: 2112601 - RNA, 13 nt, Human
cccgcucaggcug

SEQ ID NO: 2112602 - RNA, 20 nt, Human
cccgcucaugggccccucug

SEQ ID NO: 2112603 - RNA, 20 nt, Human
cccgcuuucuugcugguugu

SEQ ID NO: 2112604 - RNA, 14 nt, Human
cccggaacaagccu

SEQ ID NO: 2112605 - RNA, 14 nt, Human
cccgcuuguccagc

SEQ ID NO: 2112606 - RNA, 15 nt, Human
cccgcuuguccagcg

SEQ ID NO: 2112607 - RNA, 18 nt, Human
cccgcuuguccagcgccu

SEQ ID NO: 2112608 - RNA, 15 nt, Human
cccgcucuuuuccua

SEQ ID NO: 2112609 - RNA, 19 nt, Human
cccgcucagcccucccugc

SEQ ID NO: 2112610 - RNA, 15 nt, Human
cccgcgccuccuucc

SEQ ID NO: 2112611 - RNA, 17 nt, Human
cccgccuggcagaacug

SEQ ID NO: 2112612 - RNA, 22 nt, Human
cccgccuggcagaacugagcuc

SEQ ID NO: 2112613 - RNA, 22 nt, Human
cccgcaaugugcccccagacgc

SEQ ID NO: 2112614 - RNA, 13 nt, Human
cccgcacccccac

SEQ ID NO: 2112615 - RNA, 16 nt, Human
cccgcacccccacccu

SEQ ID NO: 2112616 - RNA, 17 nt, Human
cccgcacccccacccuu

SEQ ID NO: 2112617 - RNA, 14 nt, Human
cccgauuguaacuc

SEQ ID NO: 2112618 - RNA, 18 nt, Human
cccgcaaugugcccccag

SEQ ID NO: 2112619 - RNA, 15 nt, Human
cccgaggccuucucu

SEQ ID NO: 2112620 - RNA, 15 nt, Human
cccgaggcccgcaug

SEQ ID NO: 2112621 - RNA, 12 nt, Human
cccgaggcccgc

SEQ ID NO: 2112622 - RNA, 20 nt, Human
cccgaggccuucucugaagg

SEQ ID NO: 2112623 - RNA, 13 nt, Human
cccgaggcccgca

SEQ ID NO: 2112624 - RNA, 23 nt, Human
ccccuggcuuuucacugcuggcu

SEQ ID NO: 2112625 - RNA, 22 nt, Human
ccccuggcuuuucacugcuggc

SEQ ID NO: 2112626 - RNA, 11 nt, Human
ccccugggcuc

SEQ ID NO: 2112627 - RNA, 13 nt, Human
ccccugggcucug

SEQ ID NO: 2112628 - RNA, 15 nt, Human
ccccugggcucugcc

SEQ ID NO: 2112629 - RNA, 21 nt, Human
ccccugggcucugccccagcu

SEQ ID NO: 2112630 - RNA, 23 nt, Human
ccccugggcucugccccagcucu

SEQ ID NO: 2112631 - RNA, 14 nt, Human
ccccuguacuccag

SEQ ID NO: 2112632 - RNA, 13 nt, Human
ccccuucccugca

SEQ ID NO: 2112633 - RNA, 18 nt, Human
ccccuucccugcaaacau

SEQ ID NO: 2112634 - RNA, 14 nt, Human
ccccuucccugcaa

SEQ ID NO: 2112635 - RNA, 12 nt, Human
ccccuucccccu

SEQ ID NO: 2112636 - RNA, 13 nt, Human
ccccuucagugcc

SEQ ID NO: 2112637 - RNA, 14 nt, Human
ccccuucagugccc

SEQ ID NO: 2112638 - RNA, 23 nt, Human
ccccuuccccacugccugcccac

SEQ ID NO: 2112639 - RNA, 18 nt, Human
ccccuucacaccauaacu

SEQ ID NO: 2112640 - RNA, 17 nt, Human
ccccuucacuucugacc

SEQ ID NO: 2112641 - RNA, 19 nt, Human
ccccuucacuucugaccac

SEQ ID NO: 2112642 - RNA, 22 nt, Human
ccccuucacuucugaccacacu

SEQ ID NO: 2112643 - RNA, 23 nt, Human
ccccuucacuucugaccacacuu

SEQ ID NO: 2112644 - RNA, 20 nt, Human
ccccuuagccaguuguauau

SEQ ID NO: 2112645 - RNA, 16 nt, Human
cccuccacagccgcag

SEQ ID NO: 2112646 - RNA, 15 nt, Human
cccuccaucccgaca

SEQ ID NO: 2112647 - RNA, 17 nt, Human
cccuccaugugggcuag

SEQ ID NO: 2112648 - RNA, 13 nt, Human
cccucccccugcc

SEQ ID NO: 2112649 - RNA, 14 nt, Human
cccucccccugccc

SEQ ID NO: 2112650 - RNA, 21 nt, Human
cccuccccuaaugccugcgga

SEQ ID NO: 2112651 - RNA, 14 nt, Human
cccucccuucaacc

SEQ ID NO: 2112652 - RNA, 13 nt, Human
cccucccuguccu

SEQ ID NO: 2112653 - RNA, 13 nt, Human
cccucccuccucu

SEQ ID NO: 2112654 - RNA, 11 nt, Human
cccucccuguc

SEQ ID NO: 2112655 - RNA, 14 nt, Human
cccuccgccauucu

SEQ ID NO: 2112656 - RNA, 16 nt, Human
cccuccgccaggcgag

SEQ ID NO: 2112657 - RNA, 13 nt, Human
cccucccucuuuc

SEQ ID NO: 2112658 - RNA, 19 nt, Human
cccucaguuucccuaucuc

SEQ ID NO: 2112659 - RNA, 20 nt, Human
cccucagucuggcccuuccu

SEQ ID NO: 2112660 - RNA, 22 nt, Human
cccucauuccaccuucccaugc

SEQ ID NO: 2112661 - RNA, 19 nt, Human
cccucauuacggcuccucu

SEQ ID NO: 2112662 - RNA, 15 nt, Human
cccucauucaggaaa

SEQ ID NO: 2112663 - RNA, 16 nt, Human
cccucauucaggaaaa

SEQ ID NO: 2112664 - RNA, 17 nt, Human
cccucauucaggaaaac

SEQ ID NO: 2112665 - RNA, 13 nt, Human
cccucaucugucu

SEQ ID NO: 2112666 - RNA, 14 nt, Human
cccucaucugucug

SEQ ID NO: 2112667 - RNA, 14 nt, Human
cccucaugccaacc

SEQ ID NO: 2112668 - RNA, 18 nt, Human
cccggaggggccuggcag

SEQ ID NO: 2112669 - RNA, 17 nt, Human
cccggaggggccuggca

SEQ ID NO: 2112670 - RNA, 19 nt, Human
cccggagauuggacggccu

SEQ ID NO: 2112671 - RNA, 21 nt, Human
cccggagcuaacacuggcccc

SEQ ID NO: 2112672 - RNA, 16 nt, Human
cccggauucugggagg

SEQ ID NO: 2112673 - RNA, 20 nt, Human
cccggagcuaacacuggccc

SEQ ID NO: 2112674 - RNA, 14 nt, Human
cccggauucuggga

SEQ ID NO: 2112675 - RNA, 16 nt, Human
cccggcaggguccuag

SEQ ID NO: 2112676 - RNA, 13 nt, Human
cccgucuucagcc

SEQ ID NO: 2112677 - RNA, 14 nt, Human
cccgucuucagccu

SEQ ID NO: 2112678 - RNA, 15 nt, Human
cccgucuucagccua

SEQ ID NO: 2112679 - RNA, 16 nt, Human
cccgucuucagccuag

SEQ ID NO: 2112680 - RNA, 17 nt, Human
cccgucuucagccuagc

SEQ ID NO: 2112681 - RNA, 18 nt, Human
cccgucuucagccuagcc

SEQ ID NO: 2112682 - RNA, 16 nt, Human
cccgugcaaaacaugc

SEQ ID NO: 2112683 - RNA, 18 nt, Human
cccgugcaaaacaugcua

SEQ ID NO: 2112684 - RNA, 13 nt, Human
cccgugcagacug

SEQ ID NO: 2112685 - RNA, 21 nt, Human
cccgugaggaugucacucaga

SEQ ID NO: 2112686 - RNA, 15 nt, Human
cccgugcagacugga

SEQ ID NO: 2112687 - RNA, 18 nt, Human
cccgugcagacuggaggg

SEQ ID NO: 2112688 - RNA, 19 nt, Human
cccguuuuaugauuuacuc

SEQ ID NO: 2112689 - RNA, 15 nt, Human
cccuaaaucugagga

SEQ ID NO: 2112690 - RNA, 21 nt, Human
cccuaaggucauuaccacagg

SEQ ID NO: 2112691 - RNA, 17 nt, Human
cccuaaccucuuuucug

SEQ ID NO: 2112692 - RNA, 17 nt, Human
cccuaagccaagggccu

SEQ ID NO: 2112693 - RNA, 19 nt, Human
cccuagaaucagccuaggg

SEQ ID NO: 2112694 - RNA, 19 nt, Human
cccuagaggguuccuguag

SEQ ID NO: 2112695 - RNA, 14 nt, Human
cccuccacaucccu

SEQ ID NO: 2112696 - RNA, 20 nt, Human
cuaagcacgggccauaugaa

SEQ ID NO: 2112697 - RNA, 23 nt, Human
cuaagcacgggccauaugaauaa

SEQ ID NO: 2112698 - RNA, 11 nt, Human
cuaagccaagg

SEQ ID NO: 2112699 - RNA, 14 nt, Human
cuaagccaagggcc

SEQ ID NO: 2112700 - RNA, 18 nt, Human
cuaagccaagggccucuu

SEQ ID NO: 2112701 - RNA, 17 nt, Human
cuaaccacgcuggaccu

SEQ ID NO: 2112702 - RNA, 12 nt, Human
cuaacauuauau

SEQ ID NO: 2112703 - RNA, 15 nt, Human
cuaacauuauauugc

SEQ ID NO: 2112704 - RNA, 16 nt, Human
cuaacauuauauugca

SEQ ID NO: 2112705 - RNA, 17 nt, Human
cuaacauuauauugcaa

SEQ ID NO: 2112706 - RNA, 18 nt, Human
cuaacauuauauugcaau

SEQ ID NO: 2112707 - RNA, 20 nt, Human
cuaacauuauauugcaauga

SEQ ID NO: 2112708 - RNA, 22 nt, Human
cuaacauuauauugcaaugaag

SEQ ID NO: 2112709 - RNA, 20 nt, Human
cuaaccacgucugucuucac

SEQ ID NO: 2112710 - RNA, 21 nt, Human
cuaaccacgucugucuucaca

SEQ ID NO: 2112711 - RNA, 16 nt, Human
cuaacacuggccccua

SEQ ID NO: 2112712 - RNA, 18 nt, Human
cuaaccagagcaagcuuu

SEQ ID NO: 2112713 - RNA, 21 nt, Human
cuaaccagggaagcugucccu

SEQ ID NO: 2112714 - RNA, 19 nt, Human
cuaagcuauucaguaauaa

SEQ ID NO: 2112715 - RNA, 21 nt, Human
cuaagcuauucaguaauaacu

SEQ ID NO: 2112716 - RNA, 15 nt, Human
cuaagcuaacccccu

SEQ ID NO: 2112717 - RNA, 23 nt, Human
cuaagcgcuagaggaagcagcca

SEQ ID NO: 2112718 - RNA, 17 nt, Human
cuaagccuuuccauaag

SEQ ID NO: 2112719 - RNA, 20 nt, Human
cuaaggcacccacaaauaaa

SEQ ID NO: 2112720 - RNA, 20 nt, Human
cuaagauuuauuuuguuaaa

SEQ ID NO: 2112721 - RNA, 15 nt, Human
cuaaggugugcucug

SEQ ID NO: 2112722 - RNA, 19 nt, Human
cuaaggucauuaccacagg

SEQ ID NO: 2112723 - RNA, 18 nt, Human
cuaaggguguaaguaauu

SEQ ID NO: 2112724 - RNA, 16 nt, Human
cuaagccuuuccauaa

SEQ ID NO: 2112725 - RNA, 15 nt, Human
cuacaagagcagccu

SEQ ID NO: 2112726 - RNA, 17 nt, Human
cuacaagagcagccugu

SEQ ID NO: 2112727 - RNA, 18 nt, Human
cuacaagagcagccugug

SEQ ID NO: 2112728 - RNA, 19 nt, Human
cuacaagagcagccugugg

SEQ ID NO: 2112729 - RNA, 20 nt, Human
cuacaagagcagccuguggc

SEQ ID NO: 2112730 - RNA, 18 nt, Human
cuacaaguauucugccuu

SEQ ID NO: 2112731 - RNA, 12 nt, Human
cuacaauauaua

SEQ ID NO: 2112732 - RNA, 23 nt, Human
cuacaagagcagccuguggcauc

SEQ ID NO: 2112733 - RNA, 21 nt, Human
cuacaagagcagccuguggca

SEQ ID NO: 2112734 - RNA, 22 nt, Human
cuacaagagcagccuguggcau

SEQ ID NO: 2112735 - RNA, 17 nt, Human
cuaauguuuaugagcca

SEQ ID NO: 2112736 - RNA, 18 nt, Human
cuaauguuuaugagccag

SEQ ID NO: 2112737 - RNA, 20 nt, Human
cuaauguuuaugagccagac

SEQ ID NO: 2112738 - RNA, 14 nt, Human
cuaauuaacauaua

SEQ ID NO: 2112739 - RNA, 15 nt, Human
cuaauuaacauauaa

SEQ ID NO: 2112740 - RNA, 17 nt, Human
cuaauuaacauauaaua

SEQ ID NO: 2112741 - RNA, 13 nt, Human
cuaauuaauaaag

SEQ ID NO: 2112742 - RNA, 19 nt, Human
cuaaugugccuaguucuuu

SEQ ID NO: 2112743 - RNA, 22 nt, Human
cuaaucuucagggcacugcugc

SEQ ID NO: 2112744 - RNA, 15 nt, Human
cuaaucuucagggca

SEQ ID NO: 2112745 - RNA, 16 nt, Human
cuaaugagaagucaac

SEQ ID NO: 2112746 - RNA, 18 nt, Human
cuaaugaagggaaaggau

SEQ ID NO: 2112747 - RNA, 23 nt, Human
cuaaugaagggaaaggauauuuu

SEQ ID NO: 2112748 - RNA, 22 nt, Human
cuaaugaaugcauaaaauguua

SEQ ID NO: 2112749 - RNA, 19 nt, Human
cuaaugaaugcauaaaaug

SEQ ID NO: 2112750 - RNA, 16 nt, Human
cuaauguacugcauau

SEQ ID NO: 2112751 - RNA, 12 nt, Human
cuaaugauguuu

SEQ ID NO: 2112752 - RNA, 13 nt, Human
cuaaugauguuuu

SEQ ID NO: 2112753 - RNA, 14 nt, Human
cuaauguacugcau

SEQ ID NO: 2112754 - RNA, 19 nt, Human
cuaaugaguuucuuuuaua

SEQ ID NO: 2112755 - RNA, 22 nt, Human
cuaaugaguuucuuuuauaaaa

SEQ ID NO: 2112756 - RNA, 16 nt, Human
cuaaggugugcucuga

SEQ ID NO: 2112757 - RNA, 14 nt, Human
cuaauauuuuaugu

SEQ ID NO: 2112758 - RNA, 16 nt, Human
cuaauccucuuuuucu

SEQ ID NO: 2112759 - RNA, 21 nt, Human
cuaaucccugggcauugcuuu

SEQ ID NO: 2112760 - RNA, 22 nt, Human
cuaaucccugggcauugcuuuc

SEQ ID NO: 2112761 - RNA, 23 nt, Human
cuaaucccugggcauugcuuucc

SEQ ID NO: 2112762 - RNA, 20 nt, Human
cuaaucugcuaugcuugaau

SEQ ID NO: 2112763 - RNA, 22 nt, Human
cuaaucugcuaugcuugaaugc

SEQ ID NO: 2112764 - RNA, 21 nt, Human
cuaaucuauuggguucauuau

SEQ ID NO: 2112765 - RNA, 19 nt, Human
cuaaucuauuggguucauu

SEQ ID NO: 2112766 - RNA, 20 nt, Human
cuaaucuauuggguucauua

SEQ ID NO: 2112767 - RNA, 17 nt, Human
cuaaucuaacaauggaa

SEQ ID NO: 2112768 - RNA, 18 nt, Human
cuaaucuaacaauggaag

SEQ ID NO: 2112769 - RNA, 14 nt, Human
cuaaucuauugggu

SEQ ID NO: 2112770 - RNA, 17 nt, Human
cuaaucuauuggguuca

SEQ ID NO: 2112771 - RNA, 18 nt, Human
cuaaucuauuggguucau

SEQ ID NO: 2112772 - RNA, 22 nt, Human
cuaaucuauuggguucauuauu

SEQ ID NO: 2112773 - RNA, 17 nt, Human
cuaaucagcauucucac

SEQ ID NO: 2112774 - RNA, 19 nt, Human
cuaaucagcauucucacuc

SEQ ID NO: 2112775 - RNA, 18 nt, Human
cuaaucccgauucacccu

SEQ ID NO: 2112776 - RNA, 19 nt, Human
cuaaucccugggcauugcu

SEQ ID NO: 2112777 - RNA, 20 nt, Human
cuaaucccugggcauugcuu

SEQ ID NO: 2112778 - RNA, 15 nt, Human
cuacagaggccaugg

SEQ ID NO: 2112779 - RNA, 22 nt, Human
cuacagaauacuagccagagcu

SEQ ID NO: 2112780 - RNA, 14 nt, Human
cuacagacauuaaa

SEQ ID NO: 2112781 - RNA, 17 nt, Human
cuacagacauuaaauaa

SEQ ID NO: 2112782 - RNA, 19 nt, Human
cuacagacauuaaauaauc

SEQ ID NO: 2112783 - RNA, 16 nt, Human
cuacagacuucuccag

SEQ ID NO: 2112784 - RNA, 21 nt, Human
cuacagacuucuccagaccca

SEQ ID NO: 2112785 - RNA, 12 nt, Human
cuacacucuccu

SEQ ID NO: 2112786 - RNA, 14 nt, Human
cuacacucuccugg

SEQ ID NO: 2112787 - RNA, 15 nt, Human
cuacacucuccuggg

SEQ ID NO: 2112788 - RNA, 16 nt, Human
cuacacucuccugggc

SEQ ID NO: 2112789 - RNA, 17 nt, Human
cuacacucuccugggcc

SEQ ID NO: 2112790 - RNA, 19 nt, Human
cuacacucuccugggcccc

SEQ ID NO: 2112791 - RNA, 21 nt, Human
cuacacucuccugggccccuc

SEQ ID NO: 2112792 - RNA, 23 nt, Human
cuacacucuccugggccccuccc

SEQ ID NO: 2112793 - RNA, 16 nt, Human
cuacaauuuaaagcaa

SEQ ID NO: 2112794 - RNA, 17 nt, Human
cuacacuccagccugag

SEQ ID NO: 2112795 - RNA, 18 nt, Human
cuacacuccagccugagc

SEQ ID NO: 2112796 - RNA, 19 nt, Human
cuacccagcgagcccuggu

SEQ ID NO: 2112797 - RNA, 20 nt, Human
cuacccagcgagcccuggug

SEQ ID NO: 2112798 - RNA, 16 nt, Human
cuacccacuucuaaau

SEQ ID NO: 2112799 - RNA, 22 nt, Human
cuacccacuucuaaauagcaau

SEQ ID NO: 2112800 - RNA, 19 nt, Human
cuacccaggaggcugaggu

SEQ ID NO: 2112801 - RNA, 20 nt, Human
cuacccaggaggcugaggug

SEQ ID NO: 2112802 - RNA, 14 nt, Human
cuaccccuggauga

SEQ ID NO: 2112803 - RNA, 22 nt, Human
cuacccacccuccuuucaccac

SEQ ID NO: 2112804 - RNA, 14 nt, Human
cuacccacuucuaa

SEQ ID NO: 2112805 - RNA, 17 nt, Human
cuacccacccuccuuuc

SEQ ID NO: 2112806 - RNA, 15 nt, Human
cuaccagguguucua

SEQ ID NO: 2112807 - RNA, 18 nt, Human
cuagacucccaagcugga

SEQ ID NO: 2112808 - RNA, 18 nt, Human
cuagagccugcuggaucu

SEQ ID NO: 2112809 - RNA, 22 nt, Human
cuagagcuucaagucugugccu

SEQ ID NO: 2112810 - RNA, 23 nt, Human
cuagagcuucaagucugugccug

SEQ ID NO: 2112811 - RNA, 19 nt, Human
cuagaggaaccaaccccca

SEQ ID NO: 2112812 - RNA, 16 nt, Human
cuagaggaagcagcca

SEQ ID NO: 2112813 - RNA, 14 nt, Human
cuagaggcagggag

SEQ ID NO: 2112814 - RNA, 15 nt, Human
cuagaggcagggagg

SEQ ID NO: 2112815 - RNA, 18 nt, Human
cuagaggcagggagggga

SEQ ID NO: 2112816 - RNA, 17 nt, Human
cuagaggccagccccac

SEQ ID NO: 2112817 - RNA, 14 nt, Human
cuacuuuguccuuu

SEQ ID NO: 2112818 - RNA, 20 nt, Human
cuacuuuguccuuuuuguua

SEQ ID NO: 2112819 - RNA, 22 nt, Human
cuacuuuguccuuuuuguuauu

SEQ ID NO: 2112820 - RNA, 16 nt, Human
cuagaccuccagcugu

SEQ ID NO: 2112821 - RNA, 17 nt, Human
cuagaccuccagcuguu

SEQ ID NO: 2112822 - RNA, 20 nt, Human
cuagacguucauuugugugc

SEQ ID NO: 2112823 - RNA, 17 nt, Human
cuagagugaacuugggc

SEQ ID NO: 2112824 - RNA, 21 nt, Human
cuagagugaacuugggccacu

SEQ ID NO: 2112825 - RNA, 15 nt, Human
cuagaguccucacuc

SEQ ID NO: 2112826 - RNA, 19 nt, Human
cuagaguccucacucccag

SEQ ID NO: 2112827 - RNA, 18 nt, Human
cuagaggccagccccacc

SEQ ID NO: 2112828 - RNA, 19 nt, Human
cuagaggccagccccaccc

SEQ ID NO: 2112829 - RNA, 20 nt, Human
cuagaggccagccccaccca

SEQ ID NO: 2112830 - RNA, 19 nt, Human
cuagaggcagggaggggac

SEQ ID NO: 2112831 - RNA, 21 nt, Human
cuagaggccagccccacccag

SEQ ID NO: 2112832 - RNA, 22 nt, Human
cuagagggauacacugaaguua

SEQ ID NO: 2112833 - RNA, 19 nt, Human
cuagaggguuccuguagac

SEQ ID NO: 2112834 - RNA, 15 nt, Human
cuagaggguuccugu

SEQ ID NO: 2112835 - RNA, 16 nt, Human
cuagaggguuccugua

SEQ ID NO: 2112836 - RNA, 13 nt, Human
cuagauuuaugaa

SEQ ID NO: 2112837 - RNA, 15 nt, Human
cuagcaaaagaagua

SEQ ID NO: 2112838 - RNA, 19 nt, Human
cuagcaaaagaaguaacaa

SEQ ID NO: 2112839 - RNA, 20 nt, Human
cuagauucuacauauucuuu

SEQ ID NO: 2112840 - RNA, 17 nt, Human
cuagcacuuugggaggc

SEQ ID NO: 2112841 - RNA, 15 nt, Human
cuagcacucacaugc

SEQ ID NO: 2112842 - RNA, 16 nt, Human
cuagcacucacaugcu

SEQ ID NO: 2112843 - RNA, 17 nt, Human
cuagcacucacaugcug

SEQ ID NO: 2112844 - RNA, 21 nt, Human
cuagcacucacaugcuggaca

SEQ ID NO: 2112845 - RNA, 21 nt, Human
cuagauuacccccucauuguu

SEQ ID NO: 2112846 - RNA, 13 nt, Human
cuagaugucuuua

SEQ ID NO: 2112847 - RNA, 21 nt, Human
cuagaugagaauucagcugcc

SEQ ID NO: 2112848 - RNA, 22 nt, Human
cuagaugagaauucagcugccc

SEQ ID NO: 2112849 - RNA, 23 nt, Human
cuagaugagcccagcccuguucu

SEQ ID NO: 2112850 - RNA, 18 nt, Human
cuagaucaugaagaaccu

SEQ ID NO: 2112851 - RNA, 13 nt, Human
cuagauccacaca

SEQ ID NO: 2112852 - RNA, 17 nt, Human
cuagauccacacacaga

SEQ ID NO: 2112853 - RNA, 18 nt, Human
cuagauccacacacagag

SEQ ID NO: 2112854 - RNA, 19 nt, Human
cuagauccacacacagagg

SEQ ID NO: 2112855 - RNA, 21 nt, Human
cuagauccacacacagaggaa

SEQ ID NO: 2112856 - RNA, 21 nt, Human
cuacucugugucagguggggc

SEQ ID NO: 2112857 - RNA, 16 nt, Human
cuacucugugucaggu

SEQ ID NO: 2112858 - RNA, 15 nt, Human
cuacucuguuccuuc

SEQ ID NO: 2112859 - RNA, 16 nt, Human
cuacucuguuccuuca

SEQ ID NO: 2112860 - RNA, 19 nt, Human
cuacucuguuccuucacau

SEQ ID NO: 2112861 - RNA, 22 nt, Human
cuacucuguuccuucacauccu

SEQ ID NO: 2112862 - RNA, 14 nt, Human
cuacuguggaaaaa

SEQ ID NO: 2112863 - RNA, 14 nt, Human
cuacugaggugcua

SEQ ID NO: 2112864 - RNA, 17 nt, Human
cuacugacuuucucagc

SEQ ID NO: 2112865 - RNA, 20 nt, Human
cuacuuccugugacuucagc

SEQ ID NO: 2112866 - RNA, 15 nt, Human
cuacuuccugcacug

SEQ ID NO: 2112867 - RNA, 14 nt, Human
cuacuuccugccug

SEQ ID NO: 2112868 - RNA, 15 nt, Human
cuacuuccugccugg

SEQ ID NO: 2112869 - RNA, 20 nt, Human
cuacuuccugccuggucucc

SEQ ID NO: 2112870 - RNA, 20 nt, Human
cuacuguguuccuggcaaua

SEQ ID NO: 2112871 - RNA, 15 nt, Human
cuacuguguuccugg

SEQ ID NO: 2112872 - RNA, 19 nt, Human
cuacuguguuccuggcaau

SEQ ID NO: 2112873 - RNA, 12 nt, Human
cuacuguguucc

SEQ ID NO: 2112874 - RNA, 13 nt, Human
cuacuguguuccu

SEQ ID NO: 2112875 - RNA, 14 nt, Human
cuacuguguuccug

SEQ ID NO: 2112876 - RNA, 21 nt, Human
cuacuguggaaaaauauuuaa

SEQ ID NO: 2112877 - RNA, 22 nt, Human
cuacuguggaaaaauauuuaag

SEQ ID NO: 2112878 - RNA, 15 nt, Human
cuacuguggaaaaau

SEQ ID NO: 2112879 - RNA, 17 nt, Human
cuacuguggaaaaauau

SEQ ID NO: 2112880 - RNA, 18 nt, Human
cuacuguggaaaaauauu

SEQ ID NO: 2112881 - RNA, 20 nt, Human
cuacuguggaaaaauauuua

SEQ ID NO: 2112882 - RNA, 12 nt, Human
cuacuugggagg

SEQ ID NO: 2112883 - RNA, 15 nt, Human
cuacuugagaggcug

SEQ ID NO: 2112884 - RNA, 15 nt, Human
cuaggcaggaccugu

SEQ ID NO: 2112885 - RNA, 16 nt, Human
cuaggcaggaccugug

SEQ ID NO: 2112886 - RNA, 14 nt, Human
cuaggcaucccagg

SEQ ID NO: 2112887 - RNA, 21 nt, Human
cuaggcauuugcugaauacag

SEQ ID NO: 2112888 - RNA, 19 nt, Human
cuaggcaucccaggggacc

SEQ ID NO: 2112889 - RNA, 18 nt, Human
cuaggcaguuagagaugc

SEQ ID NO: 2112890 - RNA, 20 nt, Human
cuaggcaguuagagaugccu

SEQ ID NO: 2112891 - RNA, 22 nt, Human
cuaggcaguuagagaugccucc

SEQ ID NO: 2112892 - RNA, 23 nt, Human
cuaggcaguuagagaugccuccc

SEQ ID NO: 2112893 - RNA, 15 nt, Human
cuaggcaucccaggg

SEQ ID NO: 2112894 - RNA, 18 nt, Human
cuaggcaucccaggggac

SEQ ID NO: 2112895 - RNA, 19 nt, Human
cuaggccacuccuccaaag

SEQ ID NO: 2112896 - RNA, 16 nt, Human
cuaggccacuccucca

SEQ ID NO: 2112897 - RNA, 17 nt, Human
cuaggccacuccuccaa

SEQ ID NO: 2112898 - RNA, 19 nt, Human
cuaggccacaccaucuccu

SEQ ID NO: 2112899 - RNA, 14 nt, Human
cuaggccacuccuc

SEQ ID NO: 2112900 - RNA, 15 nt, Human
cuaggccacuccucc

SEQ ID NO: 2112901 - RNA, 20 nt, Human
cuagucccuuccccucccug

SEQ ID NO: 2112902 - RNA, 21 nt, Human
cuagucccuuccccucccugg

SEQ ID NO: 2112903 - RNA, 12 nt, Human
cuaguccuuguu

SEQ ID NO: 2112904 - RNA, 15 nt, Human
cuaguccuuuacuaa

SEQ ID NO: 2112905 - RNA, 23 nt, Human
cuagucccuuccccucccuggcu

SEQ ID NO: 2112906 - RNA, 22 nt, Human
cuagucccuuccccucccuggc

SEQ ID NO: 2112907 - RNA, 14 nt, Human
cuagugcagcugau

SEQ ID NO: 2112908 - RNA, 15 nt, Human
cuagugcagcugauu

SEQ ID NO: 2112909 - RNA, 19 nt, Human
cuagugcagcugauuuuaa

SEQ ID NO: 2112910 - RNA, 13 nt, Human
cuagucugugugc

SEQ ID NO: 2112911 - RNA, 14 nt, Human
cuagucugugugcu

SEQ ID NO: 2112912 - RNA, 18 nt, Human
cuagucugugugcugugg

SEQ ID NO: 2112913 - RNA, 20 nt, Human
cuagucugugugggacugua

SEQ ID NO: 2112914 - RNA, 23 nt, Human
cuagucugugugggacuguacac

SEQ ID NO: 2112915 - RNA, 23 nt, Human
cuagugcccuccacagccgcagc

SEQ ID NO: 2112916 - RNA, 12 nt, Human
cuagugcugaag

SEQ ID NO: 2112917 - RNA, 13 nt, Human
cuagugcugaagc

SEQ ID NO: 2112918 - RNA, 14 nt, Human
cuagugcugaagcu

SEQ ID NO: 2112919 - RNA, 15 nt, Human
cuagugcugaagcuu

SEQ ID NO: 2112920 - RNA, 20 nt, Human
cuagugcagcugauuuuaac

SEQ ID NO: 2112921 - RNA, 21 nt, Human
cuagugcagcugauuuuaaca

SEQ ID NO: 2112922 - RNA, 22 nt, Human
cuagugcagcugauuuuaacaa

SEQ ID NO: 2112923 - RNA, 23 nt, Human
cuagugcagcugauuuuaacaau

SEQ ID NO: 2112924 - RNA, 18 nt, Human
cuagugcccuccacagcc

SEQ ID NO: 2112925 - RNA, 19 nt, Human
cuagugcccuccacagccg

SEQ ID NO: 2112926 - RNA, 12 nt, Human
cuagugguggcu

SEQ ID NO: 2112927 - RNA, 19 nt, Human
cuagugguggcucugagaa

SEQ ID NO: 2112928 - RNA, 22 nt, Human
cuagugcugaagcuuauuaaug

SEQ ID NO: 2112929 - RNA, 16 nt, Human
cuagugcugaagcuua

SEQ ID NO: 2112930 - RNA, 17 nt, Human
cuagugcugaagcuuau

SEQ ID NO: 2112931 - RNA, 20 nt, Human
cuagugcugaagcuuauuaa

SEQ ID NO: 2112932 - RNA, 21 nt, Human
cuagugcugaagcuuauuaau

SEQ ID NO: 2112933 - RNA, 14 nt, Human
cuaguguugcuugg

SEQ ID NO: 2112934 - RNA, 20 nt, Human
cuaggauguugcucagaagu

SEQ ID NO: 2112935 - RNA, 13 nt, Human
cuaggagcacugu

SEQ ID NO: 2112936 - RNA, 15 nt, Human
cuaggagcugggagg

SEQ ID NO: 2112937 - RNA, 16 nt, Human
cuaggagcugggagga

SEQ ID NO: 2112938 - RNA, 19 nt, Human
cuaggagcugggaggaaaa

SEQ ID NO: 2112939 - RNA, 15 nt, Human
cuaggacucugaggc

SEQ ID NO: 2112940 - RNA, 16 nt, Human
cuaggacucugaggcu

SEQ ID NO: 2112941 - RNA, 12 nt, Human
cuaggacucuga

SEQ ID NO: 2112942 - RNA, 14 nt, Human
cuaggacucugagg

SEQ ID NO: 2112943 - RNA, 22 nt, Human
cuaggacucugaggcucuuucu

SEQ ID NO: 2112944 - RNA, 16 nt, Human
cuaggagaccaaggcg

SEQ ID NO: 2112945 - RNA, 20 nt, Human
cuaggagaccaaggcgggag

SEQ ID NO: 2112946 - RNA, 15 nt, Human
cuaggaauucccagc

SEQ ID NO: 2112947 - RNA, 22 nt, Human
cuaggaccccuccaugugggcu

SEQ ID NO: 2112948 - RNA, 16 nt, Human
cuaggacauguucccu

SEQ ID NO: 2112949 - RNA, 22 nt, Human
cuaggacauguucccuucuccu

SEQ ID NO: 2112950 - RNA, 16 nt, Human
cuagcacuuggagcca

SEQ ID NO: 2112951 - RNA, 17 nt, Human
cuagcagaaaucuagaa

SEQ ID NO: 2112952 - RNA, 19 nt, Human
cuagcagagcaggggcagg

SEQ ID NO: 2112953 - RNA, 23 nt, Human
cuagcagagcaggggcaggguga

SEQ ID NO: 2112954 - RNA, 16 nt, Human
cuauauaguuuauuga

SEQ ID NO: 2112955 - RNA, 22 nt, Human
cuauauaguuuauugacaauaa

SEQ ID NO: 2112956 - RNA, 12 nt, Human
cuauauccaugu

SEQ ID NO: 2112957 - RNA, 13 nt, Human
cuauauccaugua

SEQ ID NO: 2112958 - RNA, 14 nt, Human
cuauauccauguac

SEQ ID NO: 2112959 - RNA, 15 nt, Human
cuauauccauguacu

SEQ ID NO: 2112960 - RNA, 16 nt, Human
cuauauccauguacug

SEQ ID NO: 2112961 - RNA, 20 nt, Human
cuaguucauccaauccucac

SEQ ID NO: 2112962 - RNA, 21 nt, Human
cuaguucauccaauccucacu

SEQ ID NO: 2112963 - RNA, 22 nt, Human
cuaguucauccaauccucacug

SEQ ID NO: 2112964 - RNA, 24 nt, Human
cuaguucauccaauccucacuggg

SEQ ID NO: 2112965 - RNA, 20 nt, Human
cuaguucagacacuuuggaa

SEQ ID NO: 2112966 - RNA, 12 nt, Human
cuaguucaucca

SEQ ID NO: 2112967 - RNA, 18 nt, Human
cuaguucauccaauccuc

SEQ ID NO: 2112968 - RNA, 19 nt, Human
cuaguucauccaauccuca

SEQ ID NO: 2112969 - RNA, 13 nt, Human
cuauaucuguuuu

SEQ ID NO: 2112970 - RNA, 14 nt, Human
cuauaucuguuuua

SEQ ID NO: 2112971 - RNA, 15 nt, Human
cuauaucuguuuuac

SEQ ID NO: 2112972 - RNA, 18 nt, Human
cuauaucuguuuuacugc

SEQ ID NO: 2112973 - RNA, 22 nt, Human
cuauaucuguuuuacugcuuuu

SEQ ID NO: 2112974 - RNA, 23 nt, Human
cuauaucuguuuuacugcuuuua

SEQ ID NO: 2112975 - RNA, 20 nt, Human
cuauauccauguacuguagu

SEQ ID NO: 2112976 - RNA, 18 nt, Human
cuauauccauguacugua

SEQ ID NO: 2112977 - RNA, 19 nt, Human
cuauauccauguacuguag

SEQ ID NO: 2112978 - RNA, 21 nt, Human
cuauauccauguacuguaguu

SEQ ID NO: 2112979 - RNA, 23 nt, Human
cuauauuguuuucaguguacaug

SEQ ID NO: 2112980 - RNA, 22 nt, Human
cuauauuguuuucaguguacau

SEQ ID NO: 2112981 - RNA, 15 nt, Human
cuaucaaaauaaauu

SEQ ID NO: 2112982 - RNA, 13 nt, Human
cuaucaaacugaa

SEQ ID NO: 2112983 - RNA, 16 nt, Human
cuaucaaacugaagcc

SEQ ID NO: 2112984 - RNA, 20 nt, Human
cuaucaaacugaagccagaa

SEQ ID NO: 2112985 - RNA, 21 nt, Human
cuaucaaacugaagccagaaa

SEQ ID NO: 2112986 - RNA, 21 nt, Human
cuaucuuauauaguuuacuau

SEQ ID NO: 2112987 - RNA, 20 nt, Human
cucacauagcuuacaagcca

SEQ ID NO: 2112988 - RNA, 20 nt, Human
cucacaucuuucacacuucc

SEQ ID NO: 2112989 - RNA, 21 nt, Human
cucacaguuccucgcccuggg

SEQ ID NO: 2112990 - RNA, 22 nt, Human
cucacaguuccucgcccugggu

SEQ ID NO: 2112991 - RNA, 23 nt, Human
cucacaguuccucgcccuggguc

SEQ ID NO: 2112992 - RNA, 13 nt, Human
cucacaugcugga

SEQ ID NO: 2112993 - RNA, 15 nt, Human
cucacaugcuggaca

SEQ ID NO: 2112994 - RNA, 21 nt, Human
cucacaugcuggacaggucug

SEQ ID NO: 2112995 - RNA, 22 nt, Human
cucacaugcuggacaggucugg

SEQ ID NO: 2112996 - RNA, 23 nt, Human
cucacaugcuggacaggucuggg

SEQ ID NO: 2112997 - RNA, 19 nt, Human
cucaccagccccagugccc

SEQ ID NO: 2112998 - RNA, 21 nt, Human
cucaccagccccagugcccac

SEQ ID NO: 2112999 - RNA, 20 nt, Human
cucaccagccccagugccca

SEQ ID NO: 2113000 - RNA, 13 nt, Human
cucacaguuccuc

SEQ ID NO: 2113001 - RNA, 16 nt, Human
cucacaguuccucgcc

SEQ ID NO: 2113002 - RNA, 17 nt, Human
cucacaguuccucgccc

SEQ ID NO: 2113003 - RNA, 18 nt, Human
cucacaguuccucgcccu

SEQ ID NO: 2113004 - RNA, 19 nt, Human
cucacaguuccucgcccug

SEQ ID NO: 2113005 - RNA, 20 nt, Human
cucacaguuccucgcccugg

SEQ ID NO: 2113006 - RNA, 22 nt, Human
cucacagugggagccagggcug

SEQ ID NO: 2113007 - RNA, 19 nt, Human
cucacagugggagccaggg

SEQ ID NO: 2113008 - RNA, 17 nt, Human
cucacaguguugcccag

SEQ ID NO: 2113009 - RNA, 21 nt, Human
cucacaguguugcccaggcug

SEQ ID NO: 2113010 - RNA, 19 nt, Human
cucacagucucuuuaaucu

SEQ ID NO: 2113011 - RNA, 18 nt, Human
cucacagugggagccagg

SEQ ID NO: 2113012 - RNA, 20 nt, Human
cucacagucucuuuaaucuu

SEQ ID NO: 2113013 - RNA, 20 nt, Human
cucaagugauucuccugccu

SEQ ID NO: 2113014 - RNA, 19 nt, Human
cucaagugauucuccugcc

SEQ ID NO: 2113015 - RNA, 18 nt, Human
cucaagugauucuccugc

SEQ ID NO: 2113016 - RNA, 20 nt, Human
cucaaggacuugaaagcauc

SEQ ID NO: 2113017 - RNA, 17 nt, Human
cucacuauguugcccag

SEQ ID NO: 2113018 - RNA, 16 nt, Human
cucacuauguugccca

SEQ ID NO: 2113019 - RNA, 18 nt, Human
cucaccccugcccuggga

SEQ ID NO: 2113020 - RNA, 15 nt, Human
cucaccccgucuggg

SEQ ID NO: 2113021 - RNA, 15 nt, Human
cucaccccugcccug

SEQ ID NO: 2113022 - RNA, 16 nt, Human
cucaccccugcccugg

SEQ ID NO: 2113023 - RNA, 17 nt, Human
cucaccccugcccuggg

SEQ ID NO: 2113024 - RNA, 16 nt, Human
cucaccccgucugggg

SEQ ID NO: 2113025 - RNA, 17 nt, Human
cucaagagggcacuggu

SEQ ID NO: 2113026 - RNA, 14 nt, Human
cucaagaggcugag

SEQ ID NO: 2113027 - RNA, 16 nt, Human
cucaagaggcugaggc

SEQ ID NO: 2113028 - RNA, 21 nt, Human
cucaagagggcacugguggcc

SEQ ID NO: 2113029 - RNA, 19 nt, Human
cucaagagggcacuggugg

SEQ ID NO: 2113030 - RNA, 22 nt, Human
cucaagcccugcagucacagcu

SEQ ID NO: 2113031 - RNA, 17 nt, Human
cucaagaggcugaggca

SEQ ID NO: 2113032 - RNA, 16 nt, Human
cucaaggacaaagucu

SEQ ID NO: 2113033 - RNA, 17 nt, Human
cucaaggacaaagucuc

SEQ ID NO: 2113034 - RNA, 18 nt, Human
cucaaggacaaagucucc

SEQ ID NO: 2113035 - RNA, 19 nt, Human
cucaaggacaaagucucca

SEQ ID NO: 2113036 - RNA, 20 nt, Human
cucaaggacaaagucuccag

SEQ ID NO: 2113037 - RNA, 21 nt, Human
cucaaggacaaagucuccagc

SEQ ID NO: 2113038 - RNA, 22 nt, Human
cucaaggacaaagucuccagcc

SEQ ID NO: 2113039 - RNA, 23 nt, Human
cucaaggacaaagucuccagccc

SEQ ID NO: 2113040 - RNA, 10 nt, Human
cucaaggacu

SEQ ID NO: 2113041 - RNA, 15 nt, Human
cucaaggacuugaaa

SEQ ID NO: 2113042 - RNA, 18 nt, Human
cucaaggacuugaaagca

SEQ ID NO: 2113043 - RNA, 19 nt, Human
cucaaggacuugaaagcau

SEQ ID NO: 2113044 - RNA, 21 nt, Human
cucaaccugugaugaggggag

SEQ ID NO: 2113045 - RNA, 15 nt, Human
cucaaccuguaaauu

SEQ ID NO: 2113046 - RNA, 17 nt, Human
cucaaccuguaaauuau

SEQ ID NO: 2113047 - RNA, 18 nt, Human
cucaaccuguaaauuauu

SEQ ID NO: 2113048 - RNA, 19 nt, Human
cucaaccuguaaauuauuu

SEQ ID NO: 2113049 - RNA, 20 nt, Human
cucaaccuguaaauuauuuu

SEQ ID NO: 2113050 - RNA, 21 nt, Human
cucaaccuguaaauuauuuua

SEQ ID NO: 2113051 - RNA, 13 nt, Human
cucaaccugugau

SEQ ID NO: 2113052 - RNA, 22 nt, Human
cuauuuguauauauacauaaca

SEQ ID NO: 2113053 - RNA, 12 nt, Human
cuauuuuauucc

SEQ ID NO: 2113054 - RNA, 14 nt, Human
cuauuuuacugucu

SEQ ID NO: 2113055 - RNA, 15 nt, Human
cuauuuuacugucuu

SEQ ID NO: 2113056 - RNA, 17 nt, Human
cuauuuuacugucuuaa

SEQ ID NO: 2113057 - RNA, 18 nt, Human
cuauuuuacugucuuaau

SEQ ID NO: 2113058 - RNA, 21 nt, Human
cuauuuuacugucuuaauuaa

SEQ ID NO: 2113059 - RNA, 23 nt, Human
cuauuuuacugucuuaauuaagu

SEQ ID NO: 2113060 - RNA, 23 nt, Human
cuauuuguuuucuucuguauguu

SEQ ID NO: 2113061 - RNA, 12 nt, Human
cuauuuucagaa

SEQ ID NO: 2113062 - RNA, 14 nt, Human
cuauuuucagaauc

SEQ ID NO: 2113063 - RNA, 15 nt, Human
cuauuuucagaaucu

SEQ ID NO: 2113064 - RNA, 16 nt, Human
cuauuuucagaaucug

SEQ ID NO: 2113065 - RNA, 18 nt, Human
cuauuuucagaaucugaa

SEQ ID NO: 2113066 - RNA, 22 nt, Human
cuauuuucagaaucugaaugua

SEQ ID NO: 2113067 - RNA, 23 nt, Human
cuauuuucagaaucugaauguaa

SEQ ID NO: 2113068 - RNA, 18 nt, Human
cuauuugcuuauuuaaua

SEQ ID NO: 2113069 - RNA, 19 nt, Human
cuauuugcuuauuuaauaa

SEQ ID NO: 2113070 - RNA, 21 nt, Human
cuaugaccucgcccuccacaa

SEQ ID NO: 2113071 - RNA, 20 nt, Human
cguggaacguuuuuccuguu

SEQ ID NO: 2113072 - RNA, 15 nt, Human
cguggaaagggugcu

SEQ ID NO: 2113073 - RNA, 21 nt, Human
cguggaaagggugcugcuucc

SEQ ID NO: 2113074 - RNA, 17 nt, Human
cguggagagcuggugcc

SEQ ID NO: 2113075 - RNA, 12 nt, Human
cguggagaggga

SEQ ID NO: 2113076 - RNA, 20 nt, Human
cguggagagcuggugcccgg

SEQ ID NO: 2113077 - RNA, 13 nt, Human
cguggagagggau

SEQ ID NO: 2113078 - RNA, 21 nt, Human
cguggagagggaugaggugcu

SEQ ID NO: 2113079 - RNA, 15 nt, Human
cguggagccagggag

SEQ ID NO: 2113080 - RNA, 16 nt, Human
cguggagccagggagc

SEQ ID NO: 2113081 - RNA, 18 nt, Human
cguggaggaaugcucccc

SEQ ID NO: 2113082 - RNA, 22 nt, Human
cguggaggaaugcucccccauc

SEQ ID NO: 2113083 - RNA, 15 nt, Human
cguggaacguuuuuc

SEQ ID NO: 2113084 - RNA, 22 nt, Human
cgugcuuguuugcucaccuggg

SEQ ID NO: 2113085 - RNA, 14 nt, Human
cgugcuaaauuuuc

SEQ ID NO: 2113086 - RNA, 13 nt, Human
cgugccaggcccg

SEQ ID NO: 2113087 - RNA, 19 nt, Human
cgugccaggcccggggcug

SEQ ID NO: 2113088 - RNA, 20 nt, Human
cguggcagauaaucagccuc

SEQ ID NO: 2113089 - RNA, 21 nt, Human
cguggcagauaaucagccucu

SEQ ID NO: 2113090 - RNA, 22 nt, Human
cguggcagauaaucagccucuu

SEQ ID NO: 2113091 - RNA, 13 nt, Human
cguggcaucaccu

SEQ ID NO: 2113092 - RNA, 19 nt, Human
cguggcuucccgcucagcc

SEQ ID NO: 2113093 - RNA, 18 nt, Human
cguggcuucccgcucagc

SEQ ID NO: 2113094 - RNA, 16 nt, Human
cguggcccagagaagc

SEQ ID NO: 2113095 - RNA, 15 nt, Human
cguggcccagagaag

SEQ ID NO: 2113096 - RNA, 17 nt, Human
cgugggcggcagagagg

SEQ ID NO: 2113097 - RNA, 13 nt, Human
cgugggccauggc

SEQ ID NO: 2113098 - RNA, 21 nt, Human
cguggcuucccgcucagcccu

SEQ ID NO: 2113099 - RNA, 20 nt, Human
cguggcuucccgcucagccc

SEQ ID NO: 2113100 - RNA, 14 nt, Human
cguggcuucugaug

SEQ ID NO: 2113101 - RNA, 21 nt, Human
cguggcuucugaugaaucuug

SEQ ID NO: 2113102 - RNA, 18 nt, Human
cguugaagaggaagggca

SEQ ID NO: 2113103 - RNA, 12 nt, Human
cguggggcagca

SEQ ID NO: 2113104 - RNA, 18 nt, Human
cguggggcagcacagaga

SEQ ID NO: 2113105 - RNA, 23 nt, Human
cguccugacggcgcccccagugu

SEQ ID NO: 2113106 - RNA, 13 nt, Human
cguccugccaccu

SEQ ID NO: 2113107 - RNA, 14 nt, Human
cguccugccaccug

SEQ ID NO: 2113108 - RNA, 16 nt, Human
cguccugccaccuggg

SEQ ID NO: 2113109 - RNA, 20 nt, Human
cguccugccaccuggggcag

SEQ ID NO: 2113110 - RNA, 16 nt, Human
cgucucauacucaccu

SEQ ID NO: 2113111 - RNA, 17 nt, Human
cgucucaaccccucaca

SEQ ID NO: 2113112 - RNA, 19 nt, Human
cggugccuggguggggcug

SEQ ID NO: 2113113 - RNA, 20 nt, Human
cggugccuggguggggcugc

SEQ ID NO: 2113114 - RNA, 19 nt, Human
cgugcacacaccagagccc

SEQ ID NO: 2113115 - RNA, 18 nt, Human
cgugcacacaccagagcc

SEQ ID NO: 2113116 - RNA, 17 nt, Human
cgugcacguggagagcu

SEQ ID NO: 2113117 - RNA, 20 nt, Human
cgugcacguggagagcuggu

SEQ ID NO: 2113118 - RNA, 21 nt, Human
cgugcacguggagagcuggug

SEQ ID NO: 2113119 - RNA, 22 nt, Human
cgugcacguggagagcuggugc

SEQ ID NO: 2113120 - RNA, 22 nt, Human
cgugcaguggugcgaucugggu

SEQ ID NO: 2113121 - RNA, 14 nt, Human
cgugcagcauauga

SEQ ID NO: 2113122 - RNA, 16 nt, Human
cgugcagacuggaggg

SEQ ID NO: 2113123 - RNA, 17 nt, Human
cgugcagacuggagggg

SEQ ID NO: 2113124 - RNA, 21 nt, Human
cgugcaguggugcgaucuggg

SEQ ID NO: 2113125 - RNA, 13 nt, Human
cgugcaugugcac

SEQ ID NO: 2113126 - RNA, 22 nt, Human
cgucugacaggcaaugcuggcu

SEQ ID NO: 2113127 - RNA, 16 nt, Human
cgucugacccucucca

SEQ ID NO: 2113128 - RNA, 23 nt, Human
cgucuuagaaguggaccaggaca

SEQ ID NO: 2113129 - RNA, 15 nt, Human
cgucugacccucucc

SEQ ID NO: 2113130 - RNA, 21 nt, Human
cgucuuagcagugauuuuuau

SEQ ID NO: 2113131 - RNA, 13 nt, Human
cgucuucagccua

SEQ ID NO: 2113132 - RNA, 14 nt, Human
cgucuucagccuag

SEQ ID NO: 2113133 - RNA, 21 nt, Human
cgucugacaggcaaugcuggc

SEQ ID NO: 2113134 - RNA, 20 nt, Human
cgucugacaggcaaugcugg

SEQ ID NO: 2113135 - RNA, 19 nt, Human
cgucuucuguauacugugg

SEQ ID NO: 2113136 - RNA, 15 nt, Human
cgucuucagccuagc

SEQ ID NO: 2113137 - RNA, 16 nt, Human
cgugcacacaccagag

SEQ ID NO: 2113138 - RNA, 13 nt, Human
cuaaauauuuccu

SEQ ID NO: 2113139 - RNA, 14 nt, Human
cuaaauauuuccuu

SEQ ID NO: 2113140 - RNA, 22 nt, Human
cuaaauauuuccuuaaacugug

SEQ ID NO: 2113141 - RNA, 15 nt, Human
cuaaauauuuccuua

SEQ ID NO: 2113142 - RNA, 21 nt, Human
cuaaaugcauauccugagcca

SEQ ID NO: 2113143 - RNA, 14 nt, Human
cuaaaugcccugcu

SEQ ID NO: 2113144 - RNA, 13 nt, Human
cuaaaugcccugc

SEQ ID NO: 2113145 - RNA, 22 nt, Human
cuaaaugcauauccugagccau

SEQ ID NO: 2113146 - RNA, 15 nt, Human
cuaacacuggccccu

SEQ ID NO: 2113147 - RNA, 13 nt, Human
cuaacacuggccc

SEQ ID NO: 2113148 - RNA, 14 nt, Human
cuaacacuggcccc

SEQ ID NO: 2113149 - RNA, 17 nt, Human
cuaacacauuaucggga

SEQ ID NO: 2113150 - RNA, 14 nt, Human
cuaacacagcaugu

SEQ ID NO: 2113151 - RNA, 16 nt, Human
cuaacacagcaugugu

SEQ ID NO: 2113152 - RNA, 17 nt, Human
cuaacacagcaugugua

SEQ ID NO: 2113153 - RNA, 19 nt, Human
cuaacacuagucugugugc

SEQ ID NO: 2113154 - RNA, 21 nt, Human
cuaaauguggagaaacuguag

SEQ ID NO: 2113155 - RNA, 17 nt, Human
cuaaauguaagaaucau

SEQ ID NO: 2113156 - RNA, 18 nt, Human
cuaaauguaagaaucauu

SEQ ID NO: 2113157 - RNA, 22 nt, Human
cuaaauguaagaaucauuguaa

SEQ ID NO: 2113158 - RNA, 16 nt, Human
cuaaauguugaaagau

SEQ ID NO: 2113159 - RNA, 18 nt, Human
cuaaauggucgcccagga

SEQ ID NO: 2113160 - RNA, 19 nt, Human
cuaaauggucgcccaggag

SEQ ID NO: 2113161 - RNA, 20 nt, Human
cuaaauggucgcccaggaga

SEQ ID NO: 2113162 - RNA, 21 nt, Human
cuaaauggucgcccaggagac

SEQ ID NO: 2113163 - RNA, 20 nt, Human
cuaaacgagucaauccccuc

SEQ ID NO: 2113164 - RNA, 21 nt, Human
cuaaacgagucaauccccuca

SEQ ID NO: 2113165 - RNA, 22 nt, Human
cuaaaaauauuauaacuuaaaa

SEQ ID NO: 2113166 - RNA, 16 nt, Human
cguuuacauuuuagac

SEQ ID NO: 2113167 - RNA, 13 nt, Human
cuaaaaaugcaac

SEQ ID NO: 2113168 - RNA, 17 nt, Human
cguuggaauuaaaacaa

SEQ ID NO: 2113169 - RNA, 18 nt, Human
cguuggaauuaaaacaau

SEQ ID NO: 2113170 - RNA, 20 nt, Human
cguuggaauuaaaacaaugu

SEQ ID NO: 2113171 - RNA, 18 nt, Human
cguuggacuuuucguuaa

SEQ ID NO: 2113172 - RNA, 23 nt, Human
cguuggacuuuucguuaacauug

SEQ ID NO: 2113173 - RNA, 19 nt, Human
cguuuaaaguguauuauaa

SEQ ID NO: 2113174 - RNA, 23 nt, Human
cguuuaaaguguauuauaacagu

SEQ ID NO: 2113175 - RNA, 13 nt, Human
cguuuaaaguucu

SEQ ID NO: 2113176 - RNA, 15 nt, Human
cguuuaaaguucugu

SEQ ID NO: 2113177 - RNA, 17 nt, Human
cguuuaaaguucugugu

SEQ ID NO: 2113178 - RNA, 19 nt, Human
cguuuaaaguucuguguau

SEQ ID NO: 2113179 - RNA, 16 nt, Human
cgggguggauuggauu

SEQ ID NO: 2113180 - RNA, 11 nt, Human
cggggggaggg

SEQ ID NO: 2113181 - RNA, 13 nt, Human
cggggggaggguu

SEQ ID NO: 2113182 - RNA, 22 nt, Human
cggggggaggguuggggagggg

SEQ ID NO: 2113183 - RNA, 16 nt, Human
cgggggcugaggggca

SEQ ID NO: 2113184 - RNA, 13 nt, Human
cgggggcuggggc

SEQ ID NO: 2113185 - RNA, 14 nt, Human
cgggggcuggggca

SEQ ID NO: 2113186 - RNA, 15 nt, Human
cggggggacagcucc

SEQ ID NO: 2113187 - RNA, 23 nt, Human
cggggacagcuccuucuguccua

SEQ ID NO: 2113188 - RNA, 16 nt, Human
cggggagcccccgccc

SEQ ID NO: 2113189 - RNA, 13 nt, Human
cggggaggccaag

SEQ ID NO: 2113190 - RNA, 14 nt, Human
cggggaggccaagu

SEQ ID NO: 2113191 - RNA, 19 nt, Human
cggggaggccaagugcagg

SEQ ID NO: 2113192 - RNA, 21 nt, Human
cggggaggccaagugcaggcu

SEQ ID NO: 2113193 - RNA, 23 nt, Human
cggggaggccaagugcaggcugg

SEQ ID NO: 2113194 - RNA, 15 nt, Human
cggggccugccuagc

SEQ ID NO: 2113195 - RNA, 16 nt, Human
cggggccugccuagca

SEQ ID NO: 2113196 - RNA, 19 nt, Human
cggggcuccccuucgcgua

SEQ ID NO: 2113197 - RNA, 22 nt, Human
cgggcacucagaagacacugau

SEQ ID NO: 2113198 - RNA, 14 nt, Human
cgggcacucagaag

SEQ ID NO: 2113199 - RNA, 19 nt, Human
cgggcaccuauagucccag

SEQ ID NO: 2113200 - RNA, 21 nt, Human
cgggcaccuauagucccagcu

SEQ ID NO: 2113201 - RNA, 22 nt, Human
cggggacagcuccuucuguccu

SEQ ID NO: 2113202 - RNA, 14 nt, Human
cgggcacaauaaau

SEQ ID NO: 2113203 - RNA, 15 nt, Human
cgggcacaauaaauc

SEQ ID NO: 2113204 - RNA, 14 nt, Human
cgggcacagcugug

SEQ ID NO: 2113205 - RNA, 18 nt, Human
cgggcacagcugugguga

SEQ ID NO: 2113206 - RNA, 16 nt, Human
cgggaugguccugggg

SEQ ID NO: 2113207 - RNA, 18 nt, Human
cgggaugguccuggggcu

SEQ ID NO: 2113208 - RNA, 18 nt, Human
cgggaggucgaggcagga

SEQ ID NO: 2113209 - RNA, 20 nt, Human
cgggaggucgaggcaggagg

SEQ ID NO: 2113210 - RNA, 21 nt, Human
cgggacucacuggcagcccca

SEQ ID NO: 2113211 - RNA, 23 nt, Human
cgggacucacuggcagccccagc

SEQ ID NO: 2113212 - RNA, 14 nt, Human
cgggagcagugucu

SEQ ID NO: 2113213 - RNA, 15 nt, Human
cgggagcagugucuu

SEQ ID NO: 2113214 - RNA, 20 nt, Human
cgggagcagugucuuccaua

SEQ ID NO: 2113215 - RNA, 23 nt, Human
cgggagcagugucuuccauaaug

SEQ ID NO: 2113216 - RNA, 14 nt, Human
cgggagcaucucuu

SEQ ID NO: 2113217 - RNA, 22 nt, Human
cgggagcaucucuugaggccag

SEQ ID NO: 2113218 - RNA, 23 nt, Human
cggguuuggcgggccaaggacug

SEQ ID NO: 2113219 - RNA, 19 nt, Human
cggguuuggcgggccaagg

SEQ ID NO: 2113220 - RNA, 20 nt, Human
cgguccacccaggagccccg

SEQ ID NO: 2113221 - RNA, 16 nt, Human
cgguccacccaggagc

SEQ ID NO: 2113222 - RNA, 15 nt, Human
cgguccacccaggag

SEQ ID NO: 2113223 - RNA, 14 nt, Human
cgguccacccagga

SEQ ID NO: 2113224 - RNA, 15 nt, Human
cgggugcucagggcu

SEQ ID NO: 2113225 - RNA, 18 nt, Human
cggguggaucaccugagg

SEQ ID NO: 2113226 - RNA, 19 nt, Human
cggguggaucaccugaggu

SEQ ID NO: 2113227 - RNA, 18 nt, Human
cgggugcucagggcugac

SEQ ID NO: 2113228 - RNA, 18 nt, Human
cggguggcuagucagaga

SEQ ID NO: 2113229 - RNA, 11 nt, Human
cgguccugucu

SEQ ID NO: 2113230 - RNA, 15 nt, Human
cgguccugucucccc

SEQ ID NO: 2113231 - RNA, 14 nt, Human
cggucaaggccagc

SEQ ID NO: 2113232 - RNA, 18 nt, Human
cgguccccuccgccaggc

SEQ ID NO: 2113233 - RNA, 19 nt, Human
cggucccuugagaccucag

SEQ ID NO: 2113234 - RNA, 21 nt, Human
cggucccuugagaccucagcc

SEQ ID NO: 2113235 - RNA, 22 nt, Human
cggucccuugagaccucagcca

SEQ ID NO: 2113236 - RNA, 23 nt, Human
cggucccuugagaccucagccau

SEQ ID NO: 2113237 - RNA, 23 nt, Human
cggugcauacacccccaccuccu

SEQ ID NO: 2113238 - RNA, 21 nt, Human
cggugagaggggaacagacug

SEQ ID NO: 2113239 - RNA, 20 nt, Human
cggugagaggggaacagacu

SEQ ID NO: 2113240 - RNA, 19 nt, Human
cggccgucuucacucgccc

SEQ ID NO: 2113241 - RNA, 22 nt, Human
cggcugagucaugaucucccug

SEQ ID NO: 2113242 - RNA, 23 nt, Human
cggcugagucaugaucucccugc

SEQ ID NO: 2113243 - RNA, 24 nt, Human
cggccaggccagagggagugacag

SEQ ID NO: 2113244 - RNA, 22 nt, Human
cggccaugaccacuuuccccgu

SEQ ID NO: 2113245 - RNA, 12 nt, Human
cggcccacagcu

SEQ ID NO: 2113246 - RNA, 19 nt, Human
cggccccugcugguucagg

SEQ ID NO: 2113247 - RNA, 18 nt, Human
cggccccugcugguucag

SEQ ID NO: 2113248 - RNA, 13 nt, Human
cggccccugcugg

SEQ ID NO: 2113249 - RNA, 17 nt, Human
cggcccaggauggcuuu

SEQ ID NO: 2113250 - RNA, 19 nt, Human
cggcccacagcucccaccc

SEQ ID NO: 2113251 - RNA, 22 nt, Human
cggcccacagcucccaccccac

SEQ ID NO: 2113252 - RNA, 15 nt, Human
cggcccacagcuccc

SEQ ID NO: 2113253 - RNA, 23 nt, Human
cggcauugguucccuuugcucca

SEQ ID NO: 2113254 - RNA, 14 nt, Human
cggcauuccugcuu

SEQ ID NO: 2113255 - RNA, 21 nt, Human
cggcaggacaacgaggaagcc

SEQ ID NO: 2113256 - RNA, 22 nt, Human
cggcaggacaacgaggaagccc

SEQ ID NO: 2113257 - RNA, 14 nt, Human
cggaauaguuggcu

SEQ ID NO: 2113258 - RNA, 20 nt, Human
cggcacccacaagugccacu

SEQ ID NO: 2113259 - RNA, 15 nt, Human
cggcacccacccagc

SEQ ID NO: 2113260 - RNA, 11 nt, Human
cggcagagagg

SEQ ID NO: 2113261 - RNA, 13 nt, Human
cggcagagaggac

SEQ ID NO: 2113262 - RNA, 15 nt, Human
cggcacuguggccuu

SEQ ID NO: 2113263 - RNA, 13 nt, Human
cggaagagccuug

SEQ ID NO: 2113264 - RNA, 19 nt, Human
cgcuuuugcuggucacugc

SEQ ID NO: 2113265 - RNA, 14 nt, Human
cggaagcagugccu

SEQ ID NO: 2113266 - RNA, 20 nt, Human
cggaagcagugccuuccaua

SEQ ID NO: 2113267 - RNA, 22 nt, Human
cggaagcagugccuuccauaau

SEQ ID NO: 2113268 - RNA, 23 nt, Human
cggaagcagugccuuccauaauu

SEQ ID NO: 2113269 - RNA, 14 nt, Human
cggaagcuccuggu

SEQ ID NO: 2113270 - RNA, 15 nt, Human
cggaagcuccuggua

SEQ ID NO: 2113271 - RNA, 18 nt, Human
cggaaggaccuauguuug

SEQ ID NO: 2113272 - RNA, 19 nt, Human
cggaaggaccuauguuugc

SEQ ID NO: 2113273 - RNA, 18 nt, Human
cggaaggcuggcugggca

SEQ ID NO: 2113274 - RNA, 12 nt, Human
cgcccagucugg

SEQ ID NO: 2113275 - RNA, 21 nt, Human
cgccccucauuuaucccucaa

SEQ ID NO: 2113276 - RNA, 17 nt, Human
cgccccgccccacauuc

SEQ ID NO: 2113277 - RNA, 13 nt, Human
cgccccgccccac

SEQ ID NO: 2113278 - RNA, 14 nt, Human
cgccccgccccaca

SEQ ID NO: 2113279 - RNA, 23 nt, Human
cgccaggggaaaaucagccugcu

SEQ ID NO: 2113280 - RNA, 18 nt, Human
cgccaggaccgccaaaga

SEQ ID NO: 2113281 - RNA, 20 nt, Human
cgccaggaccgccaaagaau

SEQ ID NO: 2113282 - RNA, 14 nt, Human
ccucugccccgucu

SEQ ID NO: 2113283 - RNA, 20 nt, Human
ccucugccaccuccccuauc

SEQ ID NO: 2113284 - RNA, 20 nt, Human
cgcgccacucgcuuccccca

SEQ ID NO: 2113285 - RNA, 22 nt, Human
cgcgccacucgcuucccccaua

SEQ ID NO: 2113286 - RNA, 22 nt, Human
cgcgccacuacacuccagccug

SEQ ID NO: 2113287 - RNA, 23 nt, Human
cgcgccacuacacuccagccuga

SEQ ID NO: 2113288 - RNA, 15 nt, Human
cgcgccacucgcuuc

SEQ ID NO: 2113289 - RNA, 18 nt, Human
cgcgccacucgcuucccc

SEQ ID NO: 2113290 - RNA, 21 nt, Human
cgcuaaucccgauucacccug

SEQ ID NO: 2113291 - RNA, 12 nt, Human
cgcucagcccuc

SEQ ID NO: 2113292 - RNA, 21 nt, Human
cgcucagcccucccugccccu

SEQ ID NO: 2113293 - RNA, 16 nt, Human
cgcucagcccucccug

SEQ ID NO: 2113294 - RNA, 18 nt, Human
cgcucaugggccccucug

SEQ ID NO: 2113295 - RNA, 20 nt, Human
cgcucaugggccccucugac

SEQ ID NO: 2113296 - RNA, 22 nt, Human
cgcucaugggccccucugacuc

SEQ ID NO: 2113297 - RNA, 11 nt, Human
cgcuacccacu

SEQ ID NO: 2113298 - RNA, 17 nt, Human
cgcuuguccagcgccua

SEQ ID NO: 2113299 - RNA, 20 nt, Human
cgcuuguccagcgccuagug

SEQ ID NO: 2113300 - RNA, 16 nt, Human
cgcugucuccagaccc

SEQ ID NO: 2113301 - RNA, 23 nt, Human
cgcugucccuaguaaaaauacaa

SEQ ID NO: 2113302 - RNA, 15 nt, Human
cgcugucuccagacc

SEQ ID NO: 2113303 - RNA, 14 nt, Human
cgcugucuccagac

SEQ ID NO: 2113304 - RNA, 15 nt, Human
cgcugguagagaugg

SEQ ID NO: 2113305 - RNA, 23 nt, Human
cgcugguagagauggaggaggag

SEQ ID NO: 2113306 - RNA, 18 nt, Human
cggaaaaugccaaucucu

SEQ ID NO: 2113307 - RNA, 22 nt, Human
cucccaaagugcugggauuaca

SEQ ID NO: 2113308 - RNA, 18 nt, Human
cucccaaagugcugggau

SEQ ID NO: 2113309 - RNA, 12 nt, Human
cuccauggugcc

SEQ ID NO: 2113310 - RNA, 15 nt, Human
cuccauggugccucu

SEQ ID NO: 2113311 - RNA, 16 nt, Human
cuccauggugccucug

SEQ ID NO: 2113312 - RNA, 17 nt, Human
cuccauggugccucugg

SEQ ID NO: 2113313 - RNA, 18 nt, Human
cuccauggugccucugga

SEQ ID NO: 2113314 - RNA, 17 nt, Human
cucccaagaacagcagg

SEQ ID NO: 2113315 - RNA, 18 nt, Human
cucccaagaacagcaggc

SEQ ID NO: 2113316 - RNA, 23 nt, Human
cucccaagaacagcaggcccacc

SEQ ID NO: 2113317 - RNA, 22 nt, Human
cucccagggccagggcccugca

SEQ ID NO: 2113318 - RNA, 23 nt, Human
cucccagggccagggcccugcag

SEQ ID NO: 2113319 - RNA, 14 nt, Human
cucccagggccaug

SEQ ID NO: 2113320 - RNA, 20 nt, Human
cucccagggccaugaacuuu

SEQ ID NO: 2113321 - RNA, 21 nt, Human
cucccagggccaugaacuuug

SEQ ID NO: 2113322 - RNA, 23 nt, Human
cucccagggccuuaaaagccauc

SEQ ID NO: 2113323 - RNA, 12 nt, Human
cucccagggcua

SEQ ID NO: 2113324 - RNA, 16 nt, Human
cuccauccuaccacaa

SEQ ID NO: 2113325 - RNA, 18 nt, Human
cucacuauguugcccagg

SEQ ID NO: 2113326 - RNA, 17 nt, Human
cucacuauccuacccca

SEQ ID NO: 2113327 - RNA, 14 nt, Human
cuccaucuccacuc

SEQ ID NO: 2113328 - RNA, 16 nt, Human
cuccaucuccacucca

SEQ ID NO: 2113329 - RNA, 16 nt, Human
cuccaucuggcagggu

SEQ ID NO: 2113330 - RNA, 21 nt, Human
cuccaugagacacaucuccuc

SEQ ID NO: 2113331 - RNA, 17 nt, Human
cuccaugaguuuuuucu

SEQ ID NO: 2113332 - RNA, 12 nt, Human
cuccaucuuauu

SEQ ID NO: 2113333 - RNA, 13 nt, Human
cuccaugugggcu

SEQ ID NO: 2113334 - RNA, 17 nt, Human
cucccaaagugcuggga

SEQ ID NO: 2113335 - RNA, 17 nt, Human
cucccaucuuaacucuu

SEQ ID NO: 2113336 - RNA, 18 nt, Human
cucccaucuuaacucuuu

SEQ ID NO: 2113337 - RNA, 20 nt, Human
cucccaucuuaacucuuugc

SEQ ID NO: 2113338 - RNA, 23 nt, Human
cucccaucuuaacucuuugccuu

SEQ ID NO: 2113339 - RNA, 16 nt, Human
cucccaugaccauacu

SEQ ID NO: 2113340 - RNA, 21 nt, Human
cucccaugaccauacugaggg

SEQ ID NO: 2113341 - RNA, 12 nt, Human
cuccccaaaaac

SEQ ID NO: 2113342 - RNA, 21 nt, Human
cuccccacacuaaccuggguu

SEQ ID NO: 2113343 - RNA, 20 nt, Human
cuccccaacccugccccugc

SEQ ID NO: 2113344 - RNA, 17 nt, Human
cuccccaacccugcccc

SEQ ID NO: 2113345 - RNA, 19 nt, Human
cuccccaacccugccccug

SEQ ID NO: 2113346 - RNA, 12 nt, Human
cuccccaacccu

SEQ ID NO: 2113347 - RNA, 14 nt, Human
cuccccaacccugc

SEQ ID NO: 2113348 - RNA, 15 nt, Human
cuccccaacccugcc

SEQ ID NO: 2113349 - RNA, 12 nt, Human
cuccccagcaag

SEQ ID NO: 2113350 - RNA, 15 nt, Human
cuccccugcccugcu

SEQ ID NO: 2113351 - RNA, 16 nt, Human
cuccccugcccugcug

SEQ ID NO: 2113352 - RNA, 14 nt, Human
cuccccugcccugg

SEQ ID NO: 2113353 - RNA, 21 nt, Human
cuccccaggccguggcugccc

SEQ ID NO: 2113354 - RNA, 20 nt, Human
cuccccagcaagugagagcu

SEQ ID NO: 2113355 - RNA, 22 nt, Human
cucccuaccaccuccccagccu

SEQ ID NO: 2113356 - RNA, 17 nt, Human
cucccuaguuccuucau

SEQ ID NO: 2113357 - RNA, 16 nt, Human
cucccuauaaugcugg

SEQ ID NO: 2113358 - RNA, 17 nt, Human
cucccuauaaugcugga

SEQ ID NO: 2113359 - RNA, 20 nt, Human
cucccuauaaugcuggagcg

SEQ ID NO: 2113360 - RNA, 16 nt, Human
cucccgggacucacug

SEQ ID NO: 2113361 - RNA, 19 nt, Human
cucccgggacucacuggca

SEQ ID NO: 2113362 - RNA, 21 nt, Human
cucccgggacucacuggcagc

SEQ ID NO: 2113363 - RNA, 22 nt, Human
cucccgggacucacuggcagcc

SEQ ID NO: 2113364 - RNA, 23 nt, Human
cucccgggacucacuggcagccc

SEQ ID NO: 2113365 - RNA, 20 nt, Human
cucccggcuaugggggcacu

SEQ ID NO: 2113366 - RNA, 14 nt, Human
cucccuaccaccuc

SEQ ID NO: 2113367 - RNA, 15 nt, Human
cucccuaccaccucc

SEQ ID NO: 2113368 - RNA, 11 nt, Human
cucccuaccuc

SEQ ID NO: 2113369 - RNA, 12 nt, Human
cucccuaccuca

SEQ ID NO: 2113370 - RNA, 16 nt, Human
cucccuaccucaaccu

SEQ ID NO: 2113371 - RNA, 17 nt, Human
cucccuaccucaaccug

SEQ ID NO: 2113372 - RNA, 18 nt, Human
cucccuaccucaaccugu

SEQ ID NO: 2113373 - RNA, 20 nt, Human
cucccuaccucaaccuguaa

SEQ ID NO: 2113374 - RNA, 21 nt, Human
cucccuaccucaaccuguaaa

SEQ ID NO: 2113375 - RNA, 22 nt, Human
cucccuaccucaaccuguaaau

SEQ ID NO: 2113376 - RNA, 18 nt, Human
cucccgaguagcugggac

SEQ ID NO: 2113377 - RNA, 19 nt, Human
cucccgaauagcugggacu

SEQ ID NO: 2113378 - RNA, 17 nt, Human
cucccgaguagcuggga

SEQ ID NO: 2113379 - RNA, 16 nt, Human
cucccgaguagcuggg

SEQ ID NO: 2113380 - RNA, 18 nt, Human
cucccgaauagcugggac

SEQ ID NO: 2113381 - RNA, 15 nt, Human
cucccgaguagcugg

SEQ ID NO: 2113382 - RNA, 16 nt, Human
cucccgaauagcuggg

SEQ ID NO: 2113383 - RNA, 17 nt, Human
cucccgaauagcuggga

SEQ ID NO: 2113384 - RNA, 17 nt, Human
cuccucccggugcccaa

SEQ ID NO: 2113385 - RNA, 15 nt, Human
cuccucccggugccc

SEQ ID NO: 2113386 - RNA, 14 nt, Human
cuccucccggugcc

SEQ ID NO: 2113387 - RNA, 22 nt, Human
cuccucuccccagcaagugaga

SEQ ID NO: 2113388 - RNA, 15 nt, Human
cuccucgcaagcugg

SEQ ID NO: 2113389 - RNA, 16 nt, Human
cuccucgcaagcuggg

SEQ ID NO: 2113390 - RNA, 14 nt, Human
cuccucgcaagcug

SEQ ID NO: 2113391 - RNA, 22 nt, Human
cuccuccagccgccaugcuccu

SEQ ID NO: 2113392 - RNA, 15 nt, Human
cuccuccaaaggaag

SEQ ID NO: 2113393 - RNA, 18 nt, Human
cuccuccaaaggaagucu

SEQ ID NO: 2113394 - RNA, 23 nt, Human
cuccuccaaaggaagucuaggag

SEQ ID NO: 2113395 - RNA, 11 nt, Human
cuccuccaggg

SEQ ID NO: 2113396 - RNA, 13 nt, Human
cuccuccagggcc

SEQ ID NO: 2113397 - RNA, 14 nt, Human
cuccuccagggcca

SEQ ID NO: 2113398 - RNA, 19 nt, Human
cuccuccagggccacgugc

SEQ ID NO: 2113399 - RNA, 20 nt, Human
cuccuccagggccacgugcc

SEQ ID NO: 2113400 - RNA, 22 nt, Human
cuccuccagggccacgugccag

SEQ ID NO: 2113401 - RNA, 23 nt, Human
cuccgccaggcgagauggggugg

SEQ ID NO: 2113402 - RNA, 13 nt, Human
cuccgccaggcga

SEQ ID NO: 2113403 - RNA, 23 nt, Human
cuccgccauucucaagcccugca

SEQ ID NO: 2113404 - RNA, 15 nt, Human
cuccucaccccgucu

SEQ ID NO: 2113405 - RNA, 18 nt, Human
cuccucaccccgucuggg

SEQ ID NO: 2113406 - RNA, 22 nt, Human
cuccucaccucuggacuggcua

SEQ ID NO: 2113407 - RNA, 18 nt, Human
cuccucaccucuggacug

SEQ ID NO: 2113408 - RNA, 21 nt, Human
cuccucaccucuggacuggcu

SEQ ID NO: 2113409 - RNA, 13 nt, Human
cuccucaccucug

SEQ ID NO: 2113410 - RNA, 14 nt, Human
cuccucaccucugg

SEQ ID NO: 2113411 - RNA, 15 nt, Human
cuccucaccucugga

SEQ ID NO: 2113412 - RNA, 16 nt, Human
cuccucaccucuggac

SEQ ID NO: 2113413 - RNA, 13 nt, Human
cucccucauucca

SEQ ID NO: 2113414 - RNA, 17 nt, Human
cucccuuucuucccuac

SEQ ID NO: 2113415 - RNA, 22 nt, Human
cuccgaacacccucgaagcgcg

SEQ ID NO: 2113416 - RNA, 15 nt, Human
cuccgaccagacacc

SEQ ID NO: 2113417 - RNA, 14 nt, Human
cucccuuuuuauau

SEQ ID NO: 2113418 - RNA, 14 nt, Human
cucccuuugaaaug

SEQ ID NO: 2113419 - RNA, 21 nt, Human
cucccuuuuuauaucccauuu

SEQ ID NO: 2113420 - RNA, 14 nt, Human
cuccugccucagcc

SEQ ID NO: 2113421 - RNA, 13 nt, Human
cuccugccucagc

SEQ ID NO: 2113422 - RNA, 13 nt, Human
cuccugcccccac

SEQ ID NO: 2113423 - RNA, 15 nt, Human
cuccugcccccacac

SEQ ID NO: 2113424 - RNA, 17 nt, Human
cuccugcccccacaccu

SEQ ID NO: 2113425 - RNA, 20 nt, Human
cuccugcccccacaccuggc

SEQ ID NO: 2113426 - RNA, 22 nt, Human
cuccugcccccacaccuggccc

SEQ ID NO: 2113427 - RNA, 23 nt, Human
cuccugcccccacaccuggcccu

SEQ ID NO: 2113428 - RNA, 12 nt, Human
cuccugcccagg

SEQ ID NO: 2113429 - RNA, 13 nt, Human
cuccugcccagga

SEQ ID NO: 2113430 - RNA, 14 nt, Human
cuccugcccaggag

SEQ ID NO: 2113431 - RNA, 15 nt, Human
cuccugcccaggaga

SEQ ID NO: 2113432 - RNA, 16 nt, Human
cuccugcccaggagag

SEQ ID NO: 2113433 - RNA, 17 nt, Human
cuccugcccaggagagc

SEQ ID NO: 2113434 - RNA, 20 nt, Human
cuccugcccaggagagccag

SEQ ID NO: 2113435 - RNA, 22 nt, Human
cuccugcccaggagagccagcc

SEQ ID NO: 2113436 - RNA, 13 nt, Human
cuccugauauaga

SEQ ID NO: 2113437 - RNA, 15 nt, Human
cuccugauuauuuau

SEQ ID NO: 2113438 - RNA, 14 nt, Human
cuccucuccccucu

SEQ ID NO: 2113439 - RNA, 17 nt, Human
cuccucgcaagcugggu

SEQ ID NO: 2113440 - RNA, 16 nt, Human
cuccugagugauccca

SEQ ID NO: 2113441 - RNA, 15 nt, Human
cuccucuccccucua

SEQ ID NO: 2113442 - RNA, 16 nt, Human
cuccugugcaugggug

SEQ ID NO: 2113443 - RNA, 17 nt, Human
cuccugugcaacuuucc

SEQ ID NO: 2113444 - RNA, 17 nt, Human
cuccugugcauggguga

SEQ ID NO: 2113445 - RNA, 20 nt, Human
cuccugugcaugggugaagg

SEQ ID NO: 2113446 - RNA, 11 nt, Human
cuccuguguaa

SEQ ID NO: 2113447 - RNA, 19 nt, Human
cuccugugugugcgccuac

SEQ ID NO: 2113448 - RNA, 16 nt, Human
cuccugugugugcgcc

SEQ ID NO: 2113449 - RNA, 17 nt, Human
cuccugucugccagcca

SEQ ID NO: 2113450 - RNA, 19 nt, Human
cuccugucugccagccagc

SEQ ID NO: 2113451 - RNA, 22 nt, Human
cuccugucugccagccagcagc

SEQ ID NO: 2113452 - RNA, 23 nt, Human
cuccugucugccagccagcagcc

SEQ ID NO: 2113453 - RNA, 18 nt, Human
cuccugccugugcuguga

SEQ ID NO: 2113454 - RNA, 18 nt, Human
cuccugcuacucuguucc

SEQ ID NO: 2113455 - RNA, 15 nt, Human
cuccugccucagccu

SEQ ID NO: 2113456 - RNA, 14 nt, Human
cuccugccugugcu

SEQ ID NO: 2113457 - RNA, 15 nt, Human
cucuccacugccuuc

SEQ ID NO: 2113458 - RNA, 24 nt, Human
cucuccccagcaagugagagcugg

SEQ ID NO: 2113459 - RNA, 22 nt, Human
cucuccccagcaagugagagcu

SEQ ID NO: 2113460 - RNA, 14 nt, Human
cucuccccagcaag

SEQ ID NO: 2113461 - RNA, 22 nt, Human
cucuccucuugccacugccucu

SEQ ID NO: 2113462 - RNA, 19 nt, Human
cucuccucuugccacugcc

SEQ ID NO: 2113463 - RNA, 12 nt, Human
cucuccugccua

SEQ ID NO: 2113464 - RNA, 17 nt, Human
cucuccucuugccacug

SEQ ID NO: 2113465 - RNA, 16 nt, Human
cucuccucuugccacu

SEQ ID NO: 2113466 - RNA, 15 nt, Human
cucuccucuugccac

SEQ ID NO: 2113467 - RNA, 14 nt, Human
cucuccucuugcca

SEQ ID NO: 2113468 - RNA, 14 nt, Human
cucucuccacccua

SEQ ID NO: 2113469 - RNA, 17 nt, Human
cucucuccagucuucca

SEQ ID NO: 2113470 - RNA, 18 nt, Human
cucucuccagucuuccac

SEQ ID NO: 2113471 - RNA, 20 nt, Human
cucucuccagucuuccaccu

SEQ ID NO: 2113472 - RNA, 12 nt, Human
cucucuccauca

SEQ ID NO: 2113473 - RNA, 14 nt, Human
cucucuccaucaga

SEQ ID NO: 2113474 - RNA, 21 nt, Human
cucucuccaucagaggacacc

SEQ ID NO: 2113475 - RNA, 18 nt, Human
cucucuaugguaaagaua

SEQ ID NO: 2113476 - RNA, 20 nt, Human
cucucuaugguaaagauauu

SEQ ID NO: 2113477 - RNA, 23 nt, Human
cucucuaugguaaagauauuauu

SEQ ID NO: 2113478 - RNA, 20 nt, Human
cucucuauuaccacugaaga

SEQ ID NO: 2113479 - RNA, 22 nt, Human
cucucuacuccuaccucagccu

SEQ ID NO: 2113480 - RNA, 18 nt, Human
cucucuacccagcccauc

SEQ ID NO: 2113481 - RNA, 19 nt, Human
cucucuacccagcccaucu

SEQ ID NO: 2113482 - RNA, 22 nt, Human
cucucuacccagcccaucuugc

SEQ ID NO: 2113483 - RNA, 19 nt, Human
cucucuacuccuaccucag

SEQ ID NO: 2113484 - RNA, 20 nt, Human
cucucuacuccuaccucagc

SEQ ID NO: 2113485 - RNA, 16 nt, Human
cucuccuuucuuucua

SEQ ID NO: 2113486 - RNA, 21 nt, Human
cucuccuguccaaccuaaccc

SEQ ID NO: 2113487 - RNA, 13 nt, Human
cucuccugccuac

SEQ ID NO: 2113488 - RNA, 21 nt, Human
cucuagugcccuccacagccg

SEQ ID NO: 2113489 - RNA, 16 nt, Human
cucuauaauugccacu

SEQ ID NO: 2113490 - RNA, 17 nt, Human
cucuauaauugccacug

SEQ ID NO: 2113491 - RNA, 11 nt, Human
cucucauuccc

SEQ ID NO: 2113492 - RNA, 14 nt, Human
cucucauuccccag

SEQ ID NO: 2113493 - RNA, 15 nt, Human
cucucauuccccagg

SEQ ID NO: 2113494 - RNA, 21 nt, Human
cucucauuccccagguggcug

SEQ ID NO: 2113495 - RNA, 16 nt, Human
cucucauuccccaggu

SEQ ID NO: 2113496 - RNA, 20 nt, Human
cucucauuccccagguggcu

SEQ ID NO: 2113497 - RNA, 13 nt, Human
cucuccaaccugg

SEQ ID NO: 2113498 - RNA, 14 nt, Human
cucuccaaccugga

SEQ ID NO: 2113499 - RNA, 16 nt, Human
cucuccaaccuggaca

SEQ ID NO: 2113500 - RNA, 11 nt, Human
cucuccacugc

SEQ ID NO: 2113501 - RNA, 14 nt, Human
cucuccacugccuu

SEQ ID NO: 2113502 - RNA, 12 nt, Human
cucuccacugcc

SEQ ID NO: 2113503 - RNA, 13 nt, Human
cucuacccuggca

SEQ ID NO: 2113504 - RNA, 22 nt, Human
cucuacccucccacccccuucu

SEQ ID NO: 2113505 - RNA, 20 nt, Human
cucuaccucauaucaguuug

SEQ ID NO: 2113506 - RNA, 14 nt, Human
cucuacccucccac

SEQ ID NO: 2113507 - RNA, 15 nt, Human
cucuacccucccacc

SEQ ID NO: 2113508 - RNA, 16 nt, Human
cucuacccucccaccc

SEQ ID NO: 2113509 - RNA, 17 nt, Human
cucuacccucccacccc

SEQ ID NO: 2113510 - RNA, 18 nt, Human
cucuacccucccaccccc

SEQ ID NO: 2113511 - RNA, 20 nt, Human
cucuaccauccccuguagag

SEQ ID NO: 2113512 - RNA, 12 nt, Human
cucuacccagcc

SEQ ID NO: 2113513 - RNA, 14 nt, Human
cucuacccagccca

SEQ ID NO: 2113514 - RNA, 15 nt, Human
cucuacccagcccau

SEQ ID NO: 2113515 - RNA, 17 nt, Human
cucuacccagcccaucu

SEQ ID NO: 2113516 - RNA, 18 nt, Human
cucuacccagcccaucuu

SEQ ID NO: 2113517 - RNA, 19 nt, Human
cucuacccagcccaucuug

SEQ ID NO: 2113518 - RNA, 20 nt, Human
cucuacccagcccaucuugc

SEQ ID NO: 2113519 - RNA, 20 nt, Human
cucuacuuagcaugucccua

SEQ ID NO: 2113520 - RNA, 15 nt, Human
cucuacuuaaugaga

SEQ ID NO: 2113521 - RNA, 19 nt, Human
cucuacuuagcaugucccu

SEQ ID NO: 2113522 - RNA, 17 nt, Human
cucuacuuagcaugucc

SEQ ID NO: 2113523 - RNA, 16 nt, Human
cucuacuuagcauguc

SEQ ID NO: 2113524 - RNA, 22 nt, Human
cucuacuaaaaauacaaaaauu

SEQ ID NO: 2113525 - RNA, 18 nt, Human
cucuacuaaaaauacaaa

SEQ ID NO: 2113526 - RNA, 19 nt, Human
cucuacuaaaaauacagaa

SEQ ID NO: 2113527 - RNA, 19 nt, Human
cucuacuccuaccucagcc

SEQ ID NO: 2113528 - RNA, 16 nt, Human
cucuacuccuaccuca

SEQ ID NO: 2113529 - RNA, 22 nt, Human
cucuaggugcccuuggaggcca

SEQ ID NO: 2113530 - RNA, 13 nt, Human
cucuagugcccuc

SEQ ID NO: 2113531 - RNA, 14 nt, Human
cucuagugcccucc

SEQ ID NO: 2113532 - RNA, 18 nt, Human
cucuagugcccuccacag

SEQ ID NO: 2113533 - RNA, 18 nt, Human
cucuagggaaggccaccu

SEQ ID NO: 2113534 - RNA, 19 nt, Human
cucuagggaaggccaccug

SEQ ID NO: 2113535 - RNA, 20 nt, Human
cucuagggaaggccaccugc

SEQ ID NO: 2113536 - RNA, 21 nt, Human
cucuagggaaggccaccugca

SEQ ID NO: 2113537 - RNA, 22 nt, Human
cucuagggaaggccaccugcag

SEQ ID NO: 2113538 - RNA, 23 nt, Human
cucuagggaaggccaccugcagg

SEQ ID NO: 2113539 - RNA, 23 nt, Human
cucuagggaaaaaccagcgugug

SEQ ID NO: 2113540 - RNA, 20 nt, Human
cucuagaauuuuaagugcuu

SEQ ID NO: 2113541 - RNA, 23 nt, Human
cucuagaauuuuaagugcuuugu

SEQ ID NO: 2113542 - RNA, 17 nt, Human
cucuagacaacccugca

SEQ ID NO: 2113543 - RNA, 18 nt, Human
cucuagacaacccugcaa

SEQ ID NO: 2113544 - RNA, 23 nt, Human
cucuagacaacccugcaaaggac

SEQ ID NO: 2113545 - RNA, 12 nt, Human
cucuagaaauuu

SEQ ID NO: 2113546 - RNA, 14 nt, Human
cucuagccugggca

SEQ ID NO: 2113547 - RNA, 21 nt, Human
cucuagccggagugacagagu

SEQ ID NO: 2113548 - RNA, 13 nt, Human
cucuagccugggc

SEQ ID NO: 2113549 - RNA, 18 nt, Human
cuccuguguagcugggau

SEQ ID NO: 2113550 - RNA, 20 nt, Human
cuccugugugugcgccuaca

SEQ ID NO: 2113551 - RNA, 12 nt, Human
cucgcuggcccc

SEQ ID NO: 2113552 - RNA, 15 nt, Human
cucgcuggcccccac

SEQ ID NO: 2113553 - RNA, 16 nt, Human
cucgcuggcccccacu

SEQ ID NO: 2113554 - RNA, 17 nt, Human
cucgcuggcccccacug

SEQ ID NO: 2113555 - RNA, 20 nt, Human
cucgcuggcccccacuggcu

SEQ ID NO: 2113556 - RNA, 21 nt, Human
cucgcuggcccccacuggcug

SEQ ID NO: 2113557 - RNA, 22 nt, Human
cucgcuggcccccacuggcugu

SEQ ID NO: 2113558 - RNA, 20 nt, Human
cucggaguaucugggaacug

SEQ ID NO: 2113559 - RNA, 21 nt, Human
cucggaguaucugggaacugu

SEQ ID NO: 2113560 - RNA, 17 nt, Human
cucggagggauuccccu

SEQ ID NO: 2113561 - RNA, 17 nt, Human
cucggaguaucugggaa

SEQ ID NO: 2113562 - RNA, 13 nt, Human
cucgcuucucugu

SEQ ID NO: 2113563 - RNA, 14 nt, Human
cucgcuucucugug

SEQ ID NO: 2113564 - RNA, 19 nt, Human
cucgcuucccccauagcca

SEQ ID NO: 2113565 - RNA, 16 nt, Human
cucgcuucccccauag

SEQ ID NO: 2113566 - RNA, 18 nt, Human
cucgcuucccccauagcc

SEQ ID NO: 2113567 - RNA, 14 nt, Human
cucgcuucccccau

SEQ ID NO: 2113568 - RNA, 13 nt, Human
cucggagccucau

SEQ ID NO: 2113569 - RNA, 16 nt, Human
cucggagccucauccg

SEQ ID NO: 2113570 - RNA, 22 nt, Human
cucggagccucauccgaggcag

SEQ ID NO: 2113571 - RNA, 23 nt, Human
cucggagccucauccgaggcagg

SEQ ID NO: 2113572 - RNA, 16 nt, Human
cucuacagaggccaug

SEQ ID NO: 2113573 - RNA, 14 nt, Human
cucuacagaggcca

SEQ ID NO: 2113574 - RNA, 21 nt, Human
cucuacagcuaaucagcauuc

SEQ ID NO: 2113575 - RNA, 19 nt, Human
cucuacagaggccaugggc

SEQ ID NO: 2113576 - RNA, 14 nt, Human
cucuacacugugaa

SEQ ID NO: 2113577 - RNA, 20 nt, Human
cucuaauucccauuuugcaa

SEQ ID NO: 2113578 - RNA, 18 nt, Human
cucuaauugaauuuucaa

SEQ ID NO: 2113579 - RNA, 13 nt, Human
cucuacagaggcc

SEQ ID NO: 2113580 - RNA, 14 nt, Human
cucuaaccuccuuu

SEQ ID NO: 2113581 - RNA, 15 nt, Human
cucuaaccacacagc

SEQ ID NO: 2113582 - RNA, 20 nt, Human
cucggaucaccgagaguagc

SEQ ID NO: 2113583 - RNA, 12 nt, Human
cucggcuccugg

SEQ ID NO: 2113584 - RNA, 17 nt, Human
cucggcuccuggacuca

SEQ ID NO: 2113585 - RNA, 18 nt, Human
cucggcuccuggacucau

SEQ ID NO: 2113586 - RNA, 12 nt, Human
cucuaauucuaa

SEQ ID NO: 2113587 - RNA, 13 nt, Human
cucuaauucuaac

SEQ ID NO: 2113588 - RNA, 18 nt, Human
cucuaauucuaaccagag

SEQ ID NO: 2113589 - RNA, 22 nt, Human
cucuaauucuaaccagagcaag

SEQ ID NO: 2113590 - RNA, 13 nt, Human
cucuacaaaaagc

SEQ ID NO: 2113591 - RNA, 15 nt, Human
cugaccaauauugua

SEQ ID NO: 2113592 - RNA, 18 nt, Human
cugaccaauauuguacag

SEQ ID NO: 2113593 - RNA, 19 nt, Human
cugaccaacaguuccuuca

SEQ ID NO: 2113594 - RNA, 16 nt, Human
cugaccaacauggaga

SEQ ID NO: 2113595 - RNA, 14 nt, Human
cugaccaagagaga

SEQ ID NO: 2113596 - RNA, 17 nt, Human
cugaccaagagagaaag

SEQ ID NO: 2113597 - RNA, 22 nt, Human
cugacauuguuggccaaagcca

SEQ ID NO: 2113598 - RNA, 15 nt, Human
cugacauuaacaguu

SEQ ID NO: 2113599 - RNA, 18 nt, Human
cugacauuaacaguuuuc

SEQ ID NO: 2113600 - RNA, 20 nt, Human
cugacauuaacaguuuucca

SEQ ID NO: 2113601 - RNA, 19 nt, Human
cugaccaauauuguacagu

SEQ ID NO: 2113602 - RNA, 20 nt, Human
cugaccaauauuguacaguu

SEQ ID NO: 2113603 - RNA, 21 nt, Human
cugaccaauauuguacaguuu

SEQ ID NO: 2113604 - RNA, 12 nt, Human
cugacccacugc

SEQ ID NO: 2113605 - RNA, 12 nt, Human
cugaccacacuu

SEQ ID NO: 2113606 - RNA, 13 nt, Human
cugaccacacuuc

SEQ ID NO: 2113607 - RNA, 16 nt, Human
cugaccacacuuccug

SEQ ID NO: 2113608 - RNA, 17 nt, Human
cugaccacacuuccugu

SEQ ID NO: 2113609 - RNA, 18 nt, Human
cugaccacacuuccuguc

SEQ ID NO: 2113610 - RNA, 19 nt, Human
cugaccacacuuccugucc

SEQ ID NO: 2113611 - RNA, 20 nt, Human
cugaccacacuuccugucca

SEQ ID NO: 2113612 - RNA, 14 nt, Human
cugacccacugcuu

SEQ ID NO: 2113613 - RNA, 13 nt, Human
cugacccacugcu

SEQ ID NO: 2113614 - RNA, 21 nt, Human
cugacccagccccuugagaaa

SEQ ID NO: 2113615 - RNA, 23 nt, Human
cugacuagaagggccaguccugc

SEQ ID NO: 2113616 - RNA, 21 nt, Human
cugacauuaacaguuuuccau

SEQ ID NO: 2113617 - RNA, 22 nt, Human
cugacuagaagggccaguccug

SEQ ID NO: 2113618 - RNA, 21 nt, Human
cugacaggcaaugcuggcugu

SEQ ID NO: 2113619 - RNA, 21 nt, Human
cugacauuguuggccaaagcc

SEQ ID NO: 2113620 - RNA, 14 nt, Human
cugacauuaacagu

SEQ ID NO: 2113621 - RNA, 21 nt, Human
cugacaucuuaguauuugcau

SEQ ID NO: 2113622 - RNA, 19 nt, Human
cugaagauacaugucuuuc

SEQ ID NO: 2113623 - RNA, 21 nt, Human
cugaagauacaugucuuucuc

SEQ ID NO: 2113624 - RNA, 14 nt, Human
cugaagauagaaga

SEQ ID NO: 2113625 - RNA, 15 nt, Human
cugaagauagaagaa

SEQ ID NO: 2113626 - RNA, 16 nt, Human
cugaagauagaagaaa

SEQ ID NO: 2113627 - RNA, 17 nt, Human
cugaagauagaagaaaa

SEQ ID NO: 2113628 - RNA, 21 nt, Human
cugaagauagaagaaaaaaga

SEQ ID NO: 2113629 - RNA, 22 nt, Human
cugaagauagaagaaaaaagaa

SEQ ID NO: 2113630 - RNA, 19 nt, Human
cugaagacucauucuucug

SEQ ID NO: 2113631 - RNA, 20 nt, Human
cugaagaguggguuucacaa

SEQ ID NO: 2113632 - RNA, 13 nt, Human
cugacagaggggg

SEQ ID NO: 2113633 - RNA, 12 nt, Human
cugacagccucc

SEQ ID NO: 2113634 - RNA, 13 nt, Human
cugacagccuccc

SEQ ID NO: 2113635 - RNA, 14 nt, Human
cugacagccuccca

SEQ ID NO: 2113636 - RNA, 17 nt, Human
cugacagccucccaccc

SEQ ID NO: 2113637 - RNA, 20 nt, Human
cugacagccucccaccccca

SEQ ID NO: 2113638 - RNA, 15 nt, Human
cugacuuugcucuuu

SEQ ID NO: 2113639 - RNA, 16 nt, Human
cugacuuugcucuuuc

SEQ ID NO: 2113640 - RNA, 22 nt, Human
cugagaacagaucuccaaagcu

SEQ ID NO: 2113641 - RNA, 23 nt, Human
cugagaacagaucuccaaagcuu

SEQ ID NO: 2113642 - RNA, 14 nt, Human
cugacuuugcucuu

SEQ ID NO: 2113643 - RNA, 17 nt, Human
cugagacaaauggaggc

SEQ ID NO: 2113644 - RNA, 18 nt, Human
cugagaagucaaacauuu

SEQ ID NO: 2113645 - RNA, 15 nt, Human
cugagaauagaagga

SEQ ID NO: 2113646 - RNA, 16 nt, Human
cugagaauagaaggaa

SEQ ID NO: 2113647 - RNA, 17 nt, Human
cugagaauagaaggaaa

SEQ ID NO: 2113648 - RNA, 18 nt, Human
cugagaauagaaggaaac

SEQ ID NO: 2113649 - RNA, 23 nt, Human
cugagaauagaaggaaacuagcu

SEQ ID NO: 2113650 - RNA, 24 nt, Human
cugagaauagaaggaaacuagcuu

SEQ ID NO: 2113651 - RNA, 23 nt, Human
cugagaagguccuuaaugauccg

SEQ ID NO: 2113652 - RNA, 16 nt, Human
cugagaaggggaggac

SEQ ID NO: 2113653 - RNA, 18 nt, Human
cugagaaggggaggaccu

SEQ ID NO: 2113654 - RNA, 21 nt, Human
cugagaaggggaggaccucug

SEQ ID NO: 2113655 - RNA, 22 nt, Human
cugagaaggggaggaccucugg

SEQ ID NO: 2113656 - RNA, 23 nt, Human
cugagaaggggaggaccucuggg

SEQ ID NO: 2113657 - RNA, 17 nt, Human
cugagaagguccuuaau

SEQ ID NO: 2113658 - RNA, 16 nt, Human
cugacuguuuucucuu

SEQ ID NO: 2113659 - RNA, 16 nt, Human
cugacucucugugacc

SEQ ID NO: 2113660 - RNA, 18 nt, Human
cugacucucugugaccug

SEQ ID NO: 2113661 - RNA, 15 nt, Human
cugacucaggcauca

SEQ ID NO: 2113662 - RNA, 21 nt, Human
cugacucuaggugcccuugga

SEQ ID NO: 2113663 - RNA, 13 nt, Human
cugacucucugug

SEQ ID NO: 2113664 - RNA, 14 nt, Human
cugacucucuguga

SEQ ID NO: 2113665 - RNA, 18 nt, Human
cugacucaacauguuacu

SEQ ID NO: 2113666 - RNA, 18 nt, Human
cugacuguuuucucuuga

SEQ ID NO: 2113667 - RNA, 21 nt, Human
cugacuuccccgcauuccagg

SEQ ID NO: 2113668 - RNA, 23 nt, Human
cugacuuccccgcauuccaggcu

SEQ ID NO: 2113669 - RNA, 12 nt, Human
cugagccuucag

SEQ ID NO: 2113670 - RNA, 17 nt, Human
cugagccuucagucuug

SEQ ID NO: 2113671 - RNA, 16 nt, Human
cugagcuccaguggaa

SEQ ID NO: 2113672 - RNA, 18 nt, Human
cugagcuccccaccaccc

SEQ ID NO: 2113673 - RNA, 17 nt, Human
cugagcucgguggaccc

SEQ ID NO: 2113674 - RNA, 18 nt, Human
cugagcucgguggaccca

SEQ ID NO: 2113675 - RNA, 20 nt, Human
cugagcucgguggacccagg

SEQ ID NO: 2113676 - RNA, 20 nt, Human
cugagcuccccaccacccca

SEQ ID NO: 2113677 - RNA, 14 nt, Human
cugagcuccucugg

SEQ ID NO: 2113678 - RNA, 15 nt, Human
cugagcuccucuggg

SEQ ID NO: 2113679 - RNA, 16 nt, Human
cugagcuccucugggc

SEQ ID NO: 2113680 - RNA, 17 nt, Human
cugagcuccucugggca

SEQ ID NO: 2113681 - RNA, 18 nt, Human
cugagcuccucugggcag

SEQ ID NO: 2113682 - RNA, 20 nt, Human
cugagcuccucugggcagga

SEQ ID NO: 2113683 - RNA, 23 nt, Human
cugagcuccucugggcaggaccu

SEQ ID NO: 2113684 - RNA, 14 nt, Human
cugagcccuggcag

SEQ ID NO: 2113685 - RNA, 15 nt, Human
cugagcccuggcagg

SEQ ID NO: 2113686 - RNA, 11 nt, Human
cugagcccugg

SEQ ID NO: 2113687 - RNA, 12 nt, Human
cugagcccuggc

SEQ ID NO: 2113688 - RNA, 13 nt, Human
cugagcccuggca

SEQ ID NO: 2113689 - RNA, 17 nt, Human
cugagccuacagaugaa

SEQ ID NO: 2113690 - RNA, 18 nt, Human
cugagccuacagaugaac

SEQ ID NO: 2113691 - RNA, 20 nt, Human
cugagacaaauggaggccug

SEQ ID NO: 2113692 - RNA, 16 nt, Human
cugagccagugucagg

SEQ ID NO: 2113693 - RNA, 22 nt, Human
cugagccagugucaggaggaag

SEQ ID NO: 2113694 - RNA, 15 nt, Human
cugaggaucagaaag

SEQ ID NO: 2113695 - RNA, 16 nt, Human
cugaggaucagaaagu

SEQ ID NO: 2113696 - RNA, 17 nt, Human
cugaggaucagaaagua

SEQ ID NO: 2113697 - RNA, 18 nt, Human
cugaggaucagaaaguaa

SEQ ID NO: 2113698 - RNA, 19 nt, Human
cugaggaucagaaaguaau

SEQ ID NO: 2113699 - RNA, 16 nt, Human
cugaggcaagagaauu

SEQ ID NO: 2113700 - RNA, 12 nt, Human
cugaggcaagag

SEQ ID NO: 2113701 - RNA, 13 nt, Human
cugaggcacgagc

SEQ ID NO: 2113702 - RNA, 13 nt, Human
cugaggcagacag

SEQ ID NO: 2113703 - RNA, 22 nt, Human
cugaggauuuaagggauggaaa

SEQ ID NO: 2113704 - RNA, 14 nt, Human
cugaggauuucaag

SEQ ID NO: 2113705 - RNA, 17 nt, Human
cugaggauuucaagccu

SEQ ID NO: 2113706 - RNA, 18 nt, Human
cugaggauuucaagccug

SEQ ID NO: 2113707 - RNA, 22 nt, Human
cugagcucgguggacccaggga

SEQ ID NO: 2113708 - RNA, 22 nt, Human
cugaggcagggaaguccccagg

SEQ ID NO: 2113709 - RNA, 14 nt, Human
cugaggcaggagaa

SEQ ID NO: 2113710 - RNA, 15 nt, Human
cugaggcaggagaau

SEQ ID NO: 2113711 - RNA, 16 nt, Human
cugaggcaggagaauc

SEQ ID NO: 2113712 - RNA, 15 nt, Human
cugaggcagaagaau

SEQ ID NO: 2113713 - RNA, 15 nt, Human
cugaggcaggaggau

SEQ ID NO: 2113714 - RNA, 14 nt, Human
cugaggcagggaag

SEQ ID NO: 2113715 - RNA, 16 nt, Human
cugaggcagggaaguc

SEQ ID NO: 2113716 - RNA, 20 nt, Human
cugaggcagggaagucccca

SEQ ID NO: 2113717 - RNA, 21 nt, Human
cugaggcagggaaguccccag

SEQ ID NO: 2113718 - RNA, 18 nt, Human
cugaggcagacagcagcu

SEQ ID NO: 2113719 - RNA, 22 nt, Human
cugaggcagacagcagcucagg

SEQ ID NO: 2113720 - RNA, 14 nt, Human
cugaggcagacagc

SEQ ID NO: 2113721 - RNA, 15 nt, Human
cugaggcagacagca

SEQ ID NO: 2113722 - RNA, 16 nt, Human
cugaggcagacagcag

SEQ ID NO: 2113723 - RNA, 17 nt, Human
cugaggcagacagcagc

SEQ ID NO: 2113724 - RNA, 19 nt, Human
cucuuggguucaagugauu

SEQ ID NO: 2113725 - RNA, 21 nt, Human
cucuuggguucaagcgauucu

SEQ ID NO: 2113726 - RNA, 19 nt, Human
cucuuggguucaagcgauu

SEQ ID NO: 2113727 - RNA, 20 nt, Human
cucuucuuccagguagcuga

SEQ ID NO: 2113728 - RNA, 15 nt, Human
cucuucuucuucaga

SEQ ID NO: 2113729 - RNA, 17 nt, Human
cucuucuucuucagaag

SEQ ID NO: 2113730 - RNA, 18 nt, Human
cucuucuucuucagaaga

SEQ ID NO: 2113731 - RNA, 12 nt, Human
cucuuccuaucc

SEQ ID NO: 2113732 - RNA, 15 nt, Human
cucuuccuaucccau

SEQ ID NO: 2113733 - RNA, 16 nt, Human
cucuuccuaucccauc

SEQ ID NO: 2113734 - RNA, 17 nt, Human
cucuuccuaucccaucc

SEQ ID NO: 2113735 - RNA, 18 nt, Human
cucuuccuaucccauccc

SEQ ID NO: 2113736 - RNA, 19 nt, Human
cucuuccuaucccauccca

SEQ ID NO: 2113737 - RNA, 19 nt, Human
cucuucuuaacuuaaauuu

SEQ ID NO: 2113738 - RNA, 19 nt, Human
cucuuccggagauguagca

SEQ ID NO: 2113739 - RNA, 22 nt, Human
cucuuccggagauguagcaaaa

SEQ ID NO: 2113740 - RNA, 23 nt, Human
cucuuccggagauguagcaaaac

SEQ ID NO: 2113741 - RNA, 13 nt, Human
cucuuucccuccc

SEQ ID NO: 2113742 - RNA, 17 nt, Human
cucuuucccucccuucc

SEQ ID NO: 2113743 - RNA, 21 nt, Human
cucuuuaagaguuaguuucuu

SEQ ID NO: 2113744 - RNA, 16 nt, Human
cucuuuaaucuucagu

SEQ ID NO: 2113745 - RNA, 23 nt, Human
cucuuuaaugucacaggcagguc

SEQ ID NO: 2113746 - RNA, 22 nt, Human
cucuuuaaugucacaggcaggu

SEQ ID NO: 2113747 - RNA, 21 nt, Human
cucuuuaaugucacaggcagg

SEQ ID NO: 2113748 - RNA, 20 nt, Human
cucuuuaaugucacaggcag

SEQ ID NO: 2113749 - RNA, 16 nt, Human
cucuuguuuucaguuu

SEQ ID NO: 2113750 - RNA, 16 nt, Human
cucuuuaacucaggac

SEQ ID NO: 2113751 - RNA, 18 nt, Human
cucuuuaacucaggacuc

SEQ ID NO: 2113752 - RNA, 21 nt, Human
cucuuuaacucaggacuccag

SEQ ID NO: 2113753 - RNA, 22 nt, Human
cucuuuaacucaggacuccagc

SEQ ID NO: 2113754 - RNA, 23 nt, Human
cucuuuaacucaggacuccagcc

SEQ ID NO: 2113755 - RNA, 18 nt, Human
cucuuuaaugucacaggc

SEQ ID NO: 2113756 - RNA, 17 nt, Human
cugaacggggagaaaag

SEQ ID NO: 2113757 - RNA, 14 nt, Human
cugaacagccaaau

SEQ ID NO: 2113758 - RNA, 17 nt, Human
cugaacaucacagcuua

SEQ ID NO: 2113759 - RNA, 23 nt, Human
cugaagacaccguucauucaggc

SEQ ID NO: 2113760 - RNA, 17 nt, Human
cugaacucgcuucucug

SEQ ID NO: 2113761 - RNA, 20 nt, Human
cugaacucgcuucucuguga

SEQ ID NO: 2113762 - RNA, 19 nt, Human
cugaacugauggguuucuc

SEQ ID NO: 2113763 - RNA, 20 nt, Human
cugaacacuuuuguuguaaa

SEQ ID NO: 2113764 - RNA, 16 nt, Human
cugaacacuuauugcu

SEQ ID NO: 2113765 - RNA, 20 nt, Human
cugaacacuuauugcuuuga

SEQ ID NO: 2113766 - RNA, 22 nt, Human
cugaacacuuauugcuuugaaa

SEQ ID NO: 2113767 - RNA, 19 nt, Human
cugaacacuuuuguuguaa

SEQ ID NO: 2113768 - RNA, 17 nt, Human
cugaaaugccuuacuuu

SEQ ID NO: 2113769 - RNA, 18 nt, Human
cugaaaugccuuacuuug

SEQ ID NO: 2113770 - RNA, 21 nt, Human
cugaaaugccuuacuuuguau

SEQ ID NO: 2113771 - RNA, 23 nt, Human
cugaaaugccuuacuuuguauga

SEQ ID NO: 2113772 - RNA, 19 nt, Human
cugaaaucucagaauuccu

SEQ ID NO: 2113773 - RNA, 15 nt, Human
cugaaagcccugagc

SEQ ID NO: 2113774 - RNA, 14 nt, Human
cugaaagccagcug

SEQ ID NO: 2113775 - RNA, 21 nt, Human
cugaaagccacguuccuuacu

SEQ ID NO: 2113776 - RNA, 15 nt, Human
cucuuugagauagaa

SEQ ID NO: 2113777 - RNA, 23 nt, Human
cucuuugagauagaagaacugca

SEQ ID NO: 2113778 - RNA, 13 nt, Human
cucuuugaaacaa

SEQ ID NO: 2113779 - RNA, 22 nt, Human
cucuuugaaauagucuguguga

SEQ ID NO: 2113780 - RNA, 23 nt, Human
cucuuugacaauuccuagauaaa

SEQ ID NO: 2113781 - RNA, 22 nt, Human
cucuuuccuguuguuguuaaug

SEQ ID NO: 2113782 - RNA, 19 nt, Human
cugaaauauacacacagca

SEQ ID NO: 2113783 - RNA, 18 nt, Human
cugaaauauacacacagc

SEQ ID NO: 2113784 - RNA, 23 nt, Human
cugaaagcccugagcuuucugcu

SEQ ID NO: 2113785 - RNA, 23 nt, Human
cugaaagccagcugccgaccaga

SEQ ID NO: 2113786 - RNA, 16 nt, Human
cugaaagcccugagcu

SEQ ID NO: 2113787 - RNA, 17 nt, Human
cugaaagcccugagcuu

SEQ ID NO: 2113788 - RNA, 18 nt, Human
cugaaagcccugagcuuu

SEQ ID NO: 2113789 - RNA, 19 nt, Human
cugaaagcccugagcuuuc

SEQ ID NO: 2113790 - RNA, 13 nt, Human
cucuggcuggcua

SEQ ID NO: 2113791 - RNA, 23 nt, Human
cucuggcuggcuaacuggaagca

SEQ ID NO: 2113792 - RNA, 19 nt, Human
cucugggaaauaagagaga

SEQ ID NO: 2113793 - RNA, 22 nt, Human
cucugucugaguaagaaacaga

SEQ ID NO: 2113794 - RNA, 19 nt, Human
cucugucucaaaaauaaau

SEQ ID NO: 2113795 - RNA, 14 nt, Human
cucugucuguccgu

SEQ ID NO: 2113796 - RNA, 23 nt, Human
cucugucuucuuugcccacaaug

SEQ ID NO: 2113797 - RNA, 14 nt, Human
cucugugacugaug

SEQ ID NO: 2113798 - RNA, 20 nt, Human
cucugugcacuuauuuauga

SEQ ID NO: 2113799 - RNA, 13 nt, Human
cucuuagaaaaac

SEQ ID NO: 2113800 - RNA, 15 nt, Human
cucuuagaaaaacca

SEQ ID NO: 2113801 - RNA, 19 nt, Human
cucuuacccuucugugccc

SEQ ID NO: 2113802 - RNA, 20 nt, Human
cucuuacccuucugugccca

SEQ ID NO: 2113803 - RNA, 22 nt, Human
cucuuacccuucugugcccagc

SEQ ID NO: 2113804 - RNA, 23 nt, Human
cucuuacccuucugugcccagcu

SEQ ID NO: 2113805 - RNA, 15 nt, Human
cucugugucaggugg

SEQ ID NO: 2113806 - RNA, 14 nt, Human
cucuguucaguaac

SEQ ID NO: 2113807 - RNA, 21 nt, Human
cucuguucaguaacagggccu

SEQ ID NO: 2113808 - RNA, 19 nt, Human
cucugugucagguggggca

SEQ ID NO: 2113809 - RNA, 22 nt, Human
cucuggacaggcauguucucug

SEQ ID NO: 2113810 - RNA, 16 nt, Human
cucuggacaggcaugu

SEQ ID NO: 2113811 - RNA, 24 nt, Human
cucugcuuugacugagcagacugg

SEQ ID NO: 2113812 - RNA, 13 nt, Human
cucuggaggccuc

SEQ ID NO: 2113813 - RNA, 15 nt, Human
cucuggaggccucug

SEQ ID NO: 2113814 - RNA, 16 nt, Human
cucuggaggccucugg

SEQ ID NO: 2113815 - RNA, 17 nt, Human
cucuggaggccucuggg

SEQ ID NO: 2113816 - RNA, 20 nt, Human
cucuggaggccucugggccu

SEQ ID NO: 2113817 - RNA, 22 nt, Human
cucuggaggccucugggccucc

SEQ ID NO: 2113818 - RNA, 20 nt, Human
cucuggcuagaggccagccc

SEQ ID NO: 2113819 - RNA, 21 nt, Human
cucuggcuagaggccagcccc

SEQ ID NO: 2113820 - RNA, 22 nt, Human
cucuggcuagaggccagcccca

SEQ ID NO: 2113821 - RNA, 15 nt, Human
cucuggcucacagac

SEQ ID NO: 2113822 - RNA, 18 nt, Human
cucuggcucacagacugg

SEQ ID NO: 2113823 - RNA, 22 nt, Human
cucuggcucacagacuggagac

SEQ ID NO: 2113824 - RNA, 11 nt, Human
cucuggccucu

SEQ ID NO: 2113825 - RNA, 15 nt, Human
cucuggccucuguca

SEQ ID NO: 2113826 - RNA, 19 nt, Human
cucuggcuagaggccagcc

SEQ ID NO: 2113827 - RNA, 18 nt, Human
cucuggcccugccuucuu

SEQ ID NO: 2113828 - RNA, 15 nt, Human
cucuggcccugccuu

SEQ ID NO: 2113829 - RNA, 15 nt, Human
cucuggacaggcaug

SEQ ID NO: 2113830 - RNA, 19 nt, Human
cucugcuuugacugagcag

SEQ ID NO: 2113831 - RNA, 13 nt, Human
cucugcuugccga

SEQ ID NO: 2113832 - RNA, 18 nt, Human
cucugcuugccgaaacug

SEQ ID NO: 2113833 - RNA, 20 nt, Human
cucugcuugccgaaacugga

SEQ ID NO: 2113834 - RNA, 21 nt, Human
cucugcuugccgaaacuggaa

SEQ ID NO: 2113835 - RNA, 22 nt, Human
cucugcuugccgaaacuggaag

SEQ ID NO: 2113836 - RNA, 23 nt, Human
cucugcuugccgaaacuggaagu

SEQ ID NO: 2113837 - RNA, 16 nt, Human
cucugcuggucuucaa

SEQ ID NO: 2113838 - RNA, 17 nt, Human
cucugcuggucuucaau

SEQ ID NO: 2113839 - RNA, 18 nt, Human
cucugcuggucuucaauu

SEQ ID NO: 2113840 - RNA, 23 nt, Human
cucugcuguacauauuugagacu

SEQ ID NO: 2113841 - RNA, 13 nt, Human
cucugcuucagcu

SEQ ID NO: 2113842 - RNA, 15 nt, Human
cucugcuucagcuug

SEQ ID NO: 2113843 - RNA, 18 nt, Human
cucugccugaaccuucca

SEQ ID NO: 2113844 - RNA, 14 nt, Human
cucugccugcauuc

SEQ ID NO: 2113845 - RNA, 16 nt, Human
cucugccugcauucug

SEQ ID NO: 2113846 - RNA, 22 nt, Human
cucugccugcauucugccgugu

SEQ ID NO: 2113847 - RNA, 22 nt, Human
cucugccugaagucacacagug

SEQ ID NO: 2113848 - RNA, 21 nt, Human
cucugccugaagucacacagu

SEQ ID NO: 2113849 - RNA, 21 nt, Human
cucucucuucugcuccacccu

SEQ ID NO: 2113850 - RNA, 14 nt, Human
cucucuccuccugc

SEQ ID NO: 2113851 - RNA, 17 nt, Human
cucucuccuccugccca

SEQ ID NO: 2113852 - RNA, 15 nt, Human
cucucuccuguacuu

SEQ ID NO: 2113853 - RNA, 13 nt, Human
cucucuccucccu

SEQ ID NO: 2113854 - RNA, 20 nt, Human
cucucuccuguacuuuuucc

SEQ ID NO: 2113855 - RNA, 20 nt, Human
cucucuccuccugcccaccu

SEQ ID NO: 2113856 - RNA, 14 nt, Human
cucucuccugucca

SEQ ID NO: 2113857 - RNA, 19 nt, Human
cucucuccuguccaaccua

SEQ ID NO: 2113858 - RNA, 15 nt, Human
cucucuccuguccaa

SEQ ID NO: 2113859 - RNA, 13 nt, Human
cucucucuguugu

SEQ ID NO: 2113860 - RNA, 12 nt, Human
cucucucuucug

SEQ ID NO: 2113861 - RNA, 18 nt, Human
cucucucuucugcuccac

SEQ ID NO: 2113862 - RNA, 20 nt, Human
cuguaugucucgugguagga

SEQ ID NO: 2113863 - RNA, 20 nt, Human
cuguaugucaacuuuaugca

SEQ ID NO: 2113864 - RNA, 19 nt, Human
cuguaucccaugagccuca

SEQ ID NO: 2113865 - RNA, 18 nt, Human
cuguaucccaugagccuc

SEQ ID NO: 2113866 - RNA, 17 nt, Human
cuguauuacauaaauaa

SEQ ID NO: 2113867 - RNA, 18 nt, Human
cuguauuugaaucagccu

SEQ ID NO: 2113868 - RNA, 18 nt, Human
cuguauuuaugugugagg

SEQ ID NO: 2113869 - RNA, 23 nt, Human
cuguauuuaugugugaggagcug

SEQ ID NO: 2113870 - RNA, 15 nt, Human
cuguauauacaauaa

SEQ ID NO: 2113871 - RNA, 18 nt, Human
cuguauauacaauaacau

SEQ ID NO: 2113872 - RNA, 19 nt, Human
cuguauauacaauaacaua

SEQ ID NO: 2113873 - RNA, 23 nt, Human
cuguauauacaauaacauaauuu

SEQ ID NO: 2113874 - RNA, 15 nt, Human
cuguaucccaugagc

SEQ ID NO: 2113875 - RNA, 14 nt, Human
cuguaucccaugag

SEQ ID NO: 2113876 - RNA, 15 nt, Human
cuguauaguacuggc

SEQ ID NO: 2113877 - RNA, 16 nt, Human
cuguccaaccuaaccc

SEQ ID NO: 2113878 - RNA, 20 nt, Human
cuguccaaccuaaccccuuu

SEQ ID NO: 2113879 - RNA, 23 nt, Human
cuguccaaccuaaccccuuuccu

SEQ ID NO: 2113880 - RNA, 19 nt, Human
cuguccaaaggaggcuggc

SEQ ID NO: 2113881 - RNA, 20 nt, Human
cuguccaaaggaggcuggca

SEQ ID NO: 2113882 - RNA, 21 nt, Human
cuguccaaaggaggcuggcag

SEQ ID NO: 2113883 - RNA, 22 nt, Human
cuguccaaaggaggcuggcagg

SEQ ID NO: 2113884 - RNA, 20 nt, Human
cuguccaaacugccuaagcc

SEQ ID NO: 2113885 - RNA, 15 nt, Human
cuguccaaacugccu

SEQ ID NO: 2113886 - RNA, 17 nt, Human
cuguccaaaggaggcug

SEQ ID NO: 2113887 - RNA, 18 nt, Human
cuguccaaaggaggcugg

SEQ ID NO: 2113888 - RNA, 19 nt, Human
cuguccaggcacugcugcc

SEQ ID NO: 2113889 - RNA, 18 nt, Human
cuguccaggcacugcugc

SEQ ID NO: 2113890 - RNA, 22 nt, Human
cuguccaggcacugcugcccag

SEQ ID NO: 2113891 - RNA, 21 nt, Human
cuguccaggcacugcugccca

SEQ ID NO: 2113892 - RNA, 20 nt, Human
cuguccaggcacugcugccc

SEQ ID NO: 2113893 - RNA, 17 nt, Human
cuguccaggcacugcug

SEQ ID NO: 2113894 - RNA, 13 nt, Human
cugucccaccuca

SEQ ID NO: 2113895 - RNA, 22 nt, Human
cugucccagugccgagaaggaa

SEQ ID NO: 2113896 - RNA, 17 nt, Human
cugucucaguuucacuu

SEQ ID NO: 2113897 - RNA, 20 nt, Human
cugucucauccccagggguc

SEQ ID NO: 2113898 - RNA, 20 nt, Human
cugucuccucucucuguaau

SEQ ID NO: 2113899 - RNA, 12 nt, Human
cugucuccagac

SEQ ID NO: 2113900 - RNA, 13 nt, Human
cugucucaucccc

SEQ ID NO: 2113901 - RNA, 14 nt, Human
cugucucaucccca

SEQ ID NO: 2113902 - RNA, 15 nt, Human
cugucucauccccag

SEQ ID NO: 2113903 - RNA, 16 nt, Human
cugucucauccccagg

SEQ ID NO: 2113904 - RNA, 17 nt, Human
cugucucauccccaggg

SEQ ID NO: 2113905 - RNA, 19 nt, Human
cugucucauccccaggggu

SEQ ID NO: 2113906 - RNA, 21 nt, Human
cugucucauccccaggggucc

SEQ ID NO: 2113907 - RNA, 21 nt, Human
cugucucaagagggcacuggu

SEQ ID NO: 2113908 - RNA, 20 nt, Human
cugucucaagagggcacugg

SEQ ID NO: 2113909 - RNA, 19 nt, Human
cugucucaagagggcacug

SEQ ID NO: 2113910 - RNA, 18 nt, Human
cugucucaagagggcacu

SEQ ID NO: 2113911 - RNA, 21 nt, Human
cuguccuacucugugucaggu

SEQ ID NO: 2113912 - RNA, 15 nt, Human
cuguccuaggccaca

SEQ ID NO: 2113913 - RNA, 22 nt, Human
cugucucaaaaaaagaaaaaga

SEQ ID NO: 2113914 - RNA, 20 nt, Human
cuguccuacucugugucagg

SEQ ID NO: 2113915 - RNA, 18 nt, Human
cuguccuacucuguguca

SEQ ID NO: 2113916 - RNA, 17 nt, Human
cuguccuacucuguguc

SEQ ID NO: 2113917 - RNA, 16 nt, Human
cuguccuacucugugu

SEQ ID NO: 2113918 - RNA, 21 nt, Human
cugucccuucucuuaauuuaa

SEQ ID NO: 2113919 - RNA, 19 nt, Human
cugucccuucccccauaag

SEQ ID NO: 2113920 - RNA, 16 nt, Human
cugucccuucucuuaa

SEQ ID NO: 2113921 - RNA, 21 nt, Human
cugucccuaguaaaaauacaa

SEQ ID NO: 2113922 - RNA, 19 nt, Human
cugucccuaguaaaaauac

SEQ ID NO: 2113923 - RNA, 17 nt, Human
cugucccuaggucagcu

SEQ ID NO: 2113924 - RNA, 22 nt, Human
cugucccccugagaucagaguc

SEQ ID NO: 2113925 - RNA, 23 nt, Human
cugucccccugagaucagagucc

SEQ ID NO: 2113926 - RNA, 12 nt, Human
cugucccucacu

SEQ ID NO: 2113927 - RNA, 13 nt, Human
cugucccucacug

SEQ ID NO: 2113928 - RNA, 22 nt, Human
cuggucacugccauggaggcac

SEQ ID NO: 2113929 - RNA, 14 nt, Human
cuggucacugccau

SEQ ID NO: 2113930 - RNA, 19 nt, Human
cugguaguuaguagcaugu

SEQ ID NO: 2113931 - RNA, 21 nt, Human
cugguaguuaguagcauguug

SEQ ID NO: 2113932 - RNA, 23 nt, Human
cuggucacaggacucugccuccu

SEQ ID NO: 2113933 - RNA, 22 nt, Human
cuggucacaggacucugccucc

SEQ ID NO: 2113934 - RNA, 21 nt, Human
cuggucacaggacucugccuc

SEQ ID NO: 2113935 - RNA, 20 nt, Human
cuggucacaggacucugccu

SEQ ID NO: 2113936 - RNA, 19 nt, Human
cuggucacaggacucugcc

SEQ ID NO: 2113937 - RNA, 20 nt, Human
cugguaggaauagcauguca

SEQ ID NO: 2113938 - RNA, 22 nt, Human
cugguaggaauagcaugucacu

SEQ ID NO: 2113939 - RNA, 23 nt, Human
cugguaggaauagcaugucacua

SEQ ID NO: 2113940 - RNA, 14 nt, Human
cugguagauagaaa

SEQ ID NO: 2113941 - RNA, 15 nt, Human
cugguagauagaaau

SEQ ID NO: 2113942 - RNA, 23 nt, Human
cugguagauagaaauaaauagcu

SEQ ID NO: 2113943 - RNA, 20 nt, Human
cugguagacacaggauagau

SEQ ID NO: 2113944 - RNA, 21 nt, Human
cugguagacacaggauagaua

SEQ ID NO: 2113945 - RNA, 14 nt, Human
cugguagagaugga

SEQ ID NO: 2113946 - RNA, 21 nt, Human
cugguccagggaagcuggccg

SEQ ID NO: 2113947 - RNA, 22 nt, Human
cugguccagggaagcuggccga

SEQ ID NO: 2113948 - RNA, 15 nt, Human
cugguccagggaagc

SEQ ID NO: 2113949 - RNA, 17 nt, Human
cugguccagggaagcug

SEQ ID NO: 2113950 - RNA, 13 nt, Human
cuggucccacuca

SEQ ID NO: 2113951 - RNA, 16 nt, Human
cugguccaugauggag

SEQ ID NO: 2113952 - RNA, 17 nt, Human
cugguccaugauggagu

SEQ ID NO: 2113953 - RNA, 19 nt, Human
cugguccaugauggaguca

SEQ ID NO: 2113954 - RNA, 14 nt, Human
cuggucccacucag

SEQ ID NO: 2113955 - RNA, 23 nt, Human
cuggucucaaacucuugaccuca

SEQ ID NO: 2113956 - RNA, 14 nt, Human
cuggguacuugugg

SEQ ID NO: 2113957 - RNA, 16 nt, Human
cuggguacuuguggac

SEQ ID NO: 2113958 - RNA, 18 nt, Human
cuggguacuuguggacac

SEQ ID NO: 2113959 - RNA, 19 nt, Human
cuggguacuuguggacaca

SEQ ID NO: 2113960 - RNA, 15 nt, Human
cuggguuggagggug

SEQ ID NO: 2113961 - RNA, 18 nt, Human
cuggguuucucuguauag

SEQ ID NO: 2113962 - RNA, 22 nt, Human
cugggucucgcuuuguugccca

SEQ ID NO: 2113963 - RNA, 15 nt, Human
cugggucugugucuc

SEQ ID NO: 2113964 - RNA, 16 nt, Human
cugggucugugucucu

SEQ ID NO: 2113965 - RNA, 17 nt, Human
cugggucugugucucuu

SEQ ID NO: 2113966 - RNA, 20 nt, Human
cuguacagauugcugcuucu

SEQ ID NO: 2113967 - RNA, 22 nt, Human
cuguacagauugcugcuucugc

SEQ ID NO: 2113968 - RNA, 22 nt, Human
cuguaauaaacucauuucuagc

SEQ ID NO: 2113969 - RNA, 12 nt, Human
cugguggcagcu

SEQ ID NO: 2113970 - RNA, 21 nt, Human
cuggucucaaacuccugggcu

SEQ ID NO: 2113971 - RNA, 22 nt, Human
cuggucuccucuuuguuuuguu

SEQ ID NO: 2113972 - RNA, 17 nt, Human
cuggucuccugccccca

SEQ ID NO: 2113973 - RNA, 18 nt, Human
cuggucuccugcccccac

SEQ ID NO: 2113974 - RNA, 20 nt, Human
cuggucuccugcccccacac

SEQ ID NO: 2113975 - RNA, 22 nt, Human
cuggucuccugcccccacaccu

SEQ ID NO: 2113976 - RNA, 22 nt, Human
cugguuagguuaggacuugccc

SEQ ID NO: 2113977 - RNA, 20 nt, Human
cugguucaggguuggccccu

SEQ ID NO: 2113978 - RNA, 17 nt, Human
cuguaagcucuuugaaa

SEQ ID NO: 2113979 - RNA, 20 nt, Human
cuguaagcucuuugaaacaa

SEQ ID NO: 2113980 - RNA, 15 nt, Human
cuggcauggcaccug

SEQ ID NO: 2113981 - RNA, 17 nt, Human
cuggcauggcaccuguc

SEQ ID NO: 2113982 - RNA, 19 nt, Human
cuggcauggcaccugucgc

SEQ ID NO: 2113983 - RNA, 14 nt, Human
cuggcaucuuugcu

SEQ ID NO: 2113984 - RNA, 22 nt, Human
cuggcaucuuugcuauggggac

SEQ ID NO: 2113985 - RNA, 23 nt, Human
cuggcaucuuugcuauggggaca

SEQ ID NO: 2113986 - RNA, 17 nt, Human
cuggcaucugacacaaa

SEQ ID NO: 2113987 - RNA, 18 nt, Human
cuggcaucugacacaaaa

SEQ ID NO: 2113988 - RNA, 19 nt, Human
cuggcaucugacacaaaaa

SEQ ID NO: 2113989 - RNA, 22 nt, Human
cuggcacuauaauguaagcucu

SEQ ID NO: 2113990 - RNA, 20 nt, Human
cuggcaauaguguguucuga

SEQ ID NO: 2113991 - RNA, 17 nt, Human
cuggcaccgccuucucu

SEQ ID NO: 2113992 - RNA, 21 nt, Human
cuggcacgguggcucaggccu

SEQ ID NO: 2113993 - RNA, 15 nt, Human
cuggcacuauaaugu

SEQ ID NO: 2113994 - RNA, 16 nt, Human
cuggcacuauaaugua

SEQ ID NO: 2113995 - RNA, 16 nt, Human
cuggcacagggcagug

SEQ ID NO: 2113996 - RNA, 15 nt, Human
cuggcacagggcagu

SEQ ID NO: 2113997 - RNA, 15 nt, Human
cuggcaauagugugu

SEQ ID NO: 2113998 - RNA, 19 nt, Human
cuggcaauaguguguucug

SEQ ID NO: 2113999 - RNA, 18 nt, Human
cuggcacccggccccugc

SEQ ID NO: 2114000 - RNA, 17 nt, Human
cuggcacccggccccug

SEQ ID NO: 2114001 - RNA, 16 nt, Human
cuggcacccggccccu

SEQ ID NO: 2114002 - RNA, 23 nt, Human
cuggaaucaagaugucagacugg

SEQ ID NO: 2114003 - RNA, 14 nt, Human
cuggcaagaaugug

SEQ ID NO: 2114004 - RNA, 23 nt, Human
cuggccucaagugauucuccugc

SEQ ID NO: 2114005 - RNA, 19 nt, Human
cuggccccaugucucucag

SEQ ID NO: 2114006 - RNA, 21 nt, Human
cuggccccaugucucucagaa

SEQ ID NO: 2114007 - RNA, 13 nt, Human
cuggcccccacug

SEQ ID NO: 2114008 - RNA, 14 nt, Human
cuggcccccacugg

SEQ ID NO: 2114009 - RNA, 15 nt, Human
cuggcccccacuggc

SEQ ID NO: 2114010 - RNA, 19 nt, Human
cuggcccccacuggcugug

SEQ ID NO: 2114011 - RNA, 21 nt, Human
cuggcccccacuggcuguggg

SEQ ID NO: 2114012 - RNA, 22 nt, Human
cuggcccccacuggcugugggc

SEQ ID NO: 2114013 - RNA, 23 nt, Human
cuggcccccacuggcugugggcu

SEQ ID NO: 2114014 - RNA, 15 nt, Human
cuggcccccagcugu

SEQ ID NO: 2114015 - RNA, 16 nt, Human
cuggccccaugucucu

SEQ ID NO: 2114016 - RNA, 21 nt, Human
cuggccucagacucauacaga

SEQ ID NO: 2114017 - RNA, 12 nt, Human
cuggccucagac

SEQ ID NO: 2114018 - RNA, 13 nt, Human
cuggccaggcaga

SEQ ID NO: 2114019 - RNA, 14 nt, Human
cuggccaggcagau

SEQ ID NO: 2114020 - RNA, 21 nt, Human
cuggccaggcagaucugugcc

SEQ ID NO: 2114021 - RNA, 22 nt, Human
cuggccaggcagaucugugccc

SEQ ID NO: 2114022 - RNA, 12 nt, Human
cuggccaggagc

SEQ ID NO: 2114023 - RNA, 13 nt, Human
cuggccaggagcu

SEQ ID NO: 2114024 - RNA, 15 nt, Human
cuggccaggagcucu

SEQ ID NO: 2114025 - RNA, 17 nt, Human
cuggccaggagcucuuc

SEQ ID NO: 2114026 - RNA, 20 nt, Human
cuggccaggagcucuucagg

SEQ ID NO: 2114027 - RNA, 22 nt, Human
cuggccaggagcucuucaggcc

SEQ ID NO: 2114028 - RNA, 12 nt, Human
cuggccaggaug

SEQ ID NO: 2114029 - RNA, 23 nt, Human
cuggccaggauggaggggugguc

SEQ ID NO: 2114030 - RNA, 11 nt, Human
cuggccaggca

SEQ ID NO: 2114031 - RNA, 15 nt, Human
cuggccugcugggcu

SEQ ID NO: 2114032 - RNA, 19 nt, Human
cuggccugcugggcucucc

SEQ ID NO: 2114033 - RNA, 20 nt, Human
cuggccugcugggcucucca

SEQ ID NO: 2114034 - RNA, 12 nt, Human
cuggccugagga

SEQ ID NO: 2114035 - RNA, 13 nt, Human
cuggccugaggag

SEQ ID NO: 2114036 - RNA, 16 nt, Human
cuggccugaggagcag

SEQ ID NO: 2114037 - RNA, 21 nt, Human
cuggccugaggagcagcaguu

SEQ ID NO: 2114038 - RNA, 21 nt, Human
cugggaggaagcagguugagg

SEQ ID NO: 2114039 - RNA, 19 nt, Human
cugggaggucaaggcugca

SEQ ID NO: 2114040 - RNA, 21 nt, Human
cugggaggucaaggcugcagu

SEQ ID NO: 2114041 - RNA, 15 nt, Human
cugggaggcagaggu

SEQ ID NO: 2114042 - RNA, 23 nt, Human
cugggaggcagagguugcaguga

SEQ ID NO: 2114043 - RNA, 22 nt, Human
cugggcccagaggcacagccgg

SEQ ID NO: 2114044 - RNA, 24 nt, Human
cugggccccaaacgggcugcccug

SEQ ID NO: 2114045 - RNA, 13 nt, Human
cugggccccacca

SEQ ID NO: 2114046 - RNA, 14 nt, Human
cugggccccaccac

SEQ ID NO: 2114047 - RNA, 16 nt, Human
cugggccccaccaccu

SEQ ID NO: 2114048 - RNA, 18 nt, Human
cugggccccaccaccuag

SEQ ID NO: 2114049 - RNA, 17 nt, Human
cugggauuacaggugug

SEQ ID NO: 2114050 - RNA, 17 nt, Human
cugggauccuaagggcu

SEQ ID NO: 2114051 - RNA, 20 nt, Human
cugggauuacaggugugaac

SEQ ID NO: 2114052 - RNA, 13 nt, Human
cugggauccuaag

SEQ ID NO: 2114053 - RNA, 16 nt, Human
cugggaucugacugca

SEQ ID NO: 2114054 - RNA, 17 nt, Human
cugggaucugacugcac

SEQ ID NO: 2114055 - RNA, 19 nt, Human
cuggcugucaguaugacau

SEQ ID NO: 2114056 - RNA, 12 nt, Human
cuggcugugggc

SEQ ID NO: 2114057 - RNA, 13 nt, Human
cuggcugugggcu

SEQ ID NO: 2114058 - RNA, 14 nt, Human
cuggcugugggcuc

SEQ ID NO: 2114059 - RNA, 15 nt, Human
cuggcugugggcucc

SEQ ID NO: 2114060 - RNA, 16 nt, Human
cuggcugugggcuccc

SEQ ID NO: 2114061 - RNA, 17 nt, Human
cuggcugugggcucccu

SEQ ID NO: 2114062 - RNA, 18 nt, Human
cuggcugugggcucccuu

SEQ ID NO: 2114063 - RNA, 19 nt, Human
cuggcugugggcucccuuc

SEQ ID NO: 2114064 - RNA, 21 nt, Human
cuggcugugggcucccuuccu

SEQ ID NO: 2114065 - RNA, 22 nt, Human
cuggcugugggcucccuuccuc

SEQ ID NO: 2114066 - RNA, 17 nt, Human
cuggcuguuggcugggg

SEQ ID NO: 2114067 - RNA, 16 nt, Human
cuggcuguuggcuggg

SEQ ID NO: 2114068 - RNA, 18 nt, Human
cuggcugguaagggccaa

SEQ ID NO: 2114069 - RNA, 19 nt, Human
cuggcugguaagggccaag

SEQ ID NO: 2114070 - RNA, 15 nt, Human
cuggcuggcugcagu

SEQ ID NO: 2114071 - RNA, 17 nt, Human
cuggcuggcugcaguga

SEQ ID NO: 2114072 - RNA, 20 nt, Human
cuggcgacaguuuuccuucu

SEQ ID NO: 2114073 - RNA, 19 nt, Human
cuggcgacaguuuuccuuc

SEQ ID NO: 2114074 - RNA, 13 nt, Human
cuggccuuacacc

SEQ ID NO: 2114075 - RNA, 14 nt, Human
cuggccuuacaccu

SEQ ID NO: 2114076 - RNA, 12 nt, Human
cuggccuguucu

SEQ ID NO: 2114077 - RNA, 18 nt, Human
cuggcuguuggcuggggg

SEQ ID NO: 2114078 - RNA, 20 nt, Human
cuggcuuguaacuccaccaa

SEQ ID NO: 2114079 - RNA, 23 nt, Human
cuggcuugggacuaaaugcccug

SEQ ID NO: 2114080 - RNA, 17 nt, Human
cuggcuuguaacuccac

SEQ ID NO: 2114081 - RNA, 19 nt, Human
cuggcuuguaacuccacca

SEQ ID NO: 2114082 - RNA, 14 nt, Human
cuggcuuugcccaa

SEQ ID NO: 2114083 - RNA, 15 nt, Human
cuggcuuugcccaac

SEQ ID NO: 2114084 - RNA, 16 nt, Human
cuggcuuugcccaacc

SEQ ID NO: 2114085 - RNA, 17 nt, Human
cuggcuuugcccaaccu

SEQ ID NO: 2114086 - RNA, 19 nt, Human
cuggcuuugcccaaccuca

SEQ ID NO: 2114087 - RNA, 21 nt, Human
cuggcuuugcccaaccucagc

SEQ ID NO: 2114088 - RNA, 22 nt, Human
cuggcuuugcccaaccucagca

SEQ ID NO: 2114089 - RNA, 23 nt, Human
cuggcuuuucacugcuggcugcc

SEQ ID NO: 2114090 - RNA, 14 nt, Human
cuggcuuuguccca

SEQ ID NO: 2114091 - RNA, 15 nt, Human
cuggcuuugucccac

SEQ ID NO: 2114092 - RNA, 19 nt, Human
cuggcuuugucccacagcu

SEQ ID NO: 2114093 - RNA, 20 nt, Human
cuggcuuugucccacagcuu

SEQ ID NO: 2114094 - RNA, 21 nt, Human
cuggcuuugucccacagcuug

SEQ ID NO: 2114095 - RNA, 20 nt, Human
cugggaaagggauuuucagc

SEQ ID NO: 2114096 - RNA, 12 nt, Human
cugggagaaccu

SEQ ID NO: 2114097 - RNA, 14 nt, Human
cugggagaaccuca

SEQ ID NO: 2114098 - RNA, 15 nt, Human
cugggagaaccucag

SEQ ID NO: 2114099 - RNA, 16 nt, Human
cugggagaaccucagg

SEQ ID NO: 2114100 - RNA, 17 nt, Human
cugggagaggcagagug

SEQ ID NO: 2114101 - RNA, 23 nt, Human
cugggagaggcagagugccccac

SEQ ID NO: 2114102 - RNA, 24 nt, Human
cugggagaggcagagugccccacc

SEQ ID NO: 2114103 - RNA, 17 nt, Human
cugggagaaccucaggc

SEQ ID NO: 2114104 - RNA, 18 nt, Human
cugggagaaccucaggcu

SEQ ID NO: 2114105 - RNA, 21 nt, Human
cugccugcaguacuuuaccuc

SEQ ID NO: 2114106 - RNA, 20 nt, Human
cugccugcaguacuuuaccu

SEQ ID NO: 2114107 - RNA, 15 nt, Human
cugccugcaccccug

SEQ ID NO: 2114108 - RNA, 19 nt, Human
cugccugaagucacacagu

SEQ ID NO: 2114109 - RNA, 12 nt, Human
cugccugcccac

SEQ ID NO: 2114110 - RNA, 16 nt, Human
cugccugaagucacac

SEQ ID NO: 2114111 - RNA, 18 nt, Human
cugccugaagucacacag

SEQ ID NO: 2114112 - RNA, 18 nt, Human
cugcccugcccuagcucc

SEQ ID NO: 2114113 - RNA, 16 nt, Human
cugcgcccuuccccag

SEQ ID NO: 2114114 - RNA, 13 nt, Human
cugcgcccuuccc

SEQ ID NO: 2114115 - RNA, 14 nt, Human
cugcgcccuucccc

SEQ ID NO: 2114116 - RNA, 23 nt, Human
cugcgguccacccaggagccccg

SEQ ID NO: 2114117 - RNA, 19 nt, Human
cugccuggaagagcagccc

SEQ ID NO: 2114118 - RNA, 15 nt, Human
cugcucuccgaccag

SEQ ID NO: 2114119 - RNA, 17 nt, Human
cugcucuaagcacacgg

SEQ ID NO: 2114120 - RNA, 20 nt, Human
cugcuccucuccccagcaag

SEQ ID NO: 2114121 - RNA, 19 nt, Human
cugcuccucuccccagcaa

SEQ ID NO: 2114122 - RNA, 23 nt, Human
cugcucccccacccccuccccag

SEQ ID NO: 2114123 - RNA, 21 nt, Human
cugcucccccacccccucccc

SEQ ID NO: 2114124 - RNA, 22 nt, Human
cugcucccccacccccucccca

SEQ ID NO: 2114125 - RNA, 23 nt, Human
cugcuccucuccccagcaaguga

SEQ ID NO: 2114126 - RNA, 12 nt, Human
cugcucccccac

SEQ ID NO: 2114127 - RNA, 13 nt, Human
cugcucccccacc

SEQ ID NO: 2114128 - RNA, 14 nt, Human
cugcucccccaccc

SEQ ID NO: 2114129 - RNA, 17 nt, Human
cugcucccccacccccu

SEQ ID NO: 2114130 - RNA, 11 nt, Human
cugcucugccc

SEQ ID NO: 2114131 - RNA, 12 nt, Human
cugcucugccca

SEQ ID NO: 2114132 - RNA, 13 nt, Human
cugcucugcccag

SEQ ID NO: 2114133 - RNA, 14 nt, Human
cugcucugcccaga

SEQ ID NO: 2114134 - RNA, 15 nt, Human
cugcucugcccagag

SEQ ID NO: 2114135 - RNA, 17 nt, Human
cugcucugcccagagcu

SEQ ID NO: 2114136 - RNA, 18 nt, Human
cugcucugcccagagcug

SEQ ID NO: 2114137 - RNA, 21 nt, Human
cugcucugcccagagcugggu

SEQ ID NO: 2114138 - RNA, 23 nt, Human
cugcucugcccagagcuggguga

SEQ ID NO: 2114139 - RNA, 21 nt, Human
cugcucuuaugccauuuguuu

SEQ ID NO: 2114140 - RNA, 12 nt, Human
cugcucugguua

SEQ ID NO: 2114141 - RNA, 14 nt, Human
cugcugccucccca

SEQ ID NO: 2114142 - RNA, 21 nt, Human
cugcugccgccucccagccug

SEQ ID NO: 2114143 - RNA, 15 nt, Human
cugcugccuccccaa

SEQ ID NO: 2114144 - RNA, 19 nt, Human
cugcugccuccccaacccu

SEQ ID NO: 2114145 - RNA, 14 nt, Human
cugcugcugcugug

SEQ ID NO: 2114146 - RNA, 15 nt, Human
cugcugcugcugcug

SEQ ID NO: 2114147 - RNA, 19 nt, Human
cugcugggacuggccaggu

SEQ ID NO: 2114148 - RNA, 12 nt, Human
cugcuggcugcc

SEQ ID NO: 2114149 - RNA, 14 nt, Human
cugcuggcuugcag

SEQ ID NO: 2114150 - RNA, 16 nt, Human
cugcuggcuugcagug

SEQ ID NO: 2114151 - RNA, 17 nt, Human
cugcugggacuggccag

SEQ ID NO: 2114152 - RNA, 15 nt, Human
cugcuggcugccuua

SEQ ID NO: 2114153 - RNA, 14 nt, Human
cugcuggcugccuu

SEQ ID NO: 2114154 - RNA, 13 nt, Human
cugcuggcugccu

SEQ ID NO: 2114155 - RNA, 14 nt, Human
cugcugggcucucc

SEQ ID NO: 2114156 - RNA, 15 nt, Human
cugcugggcucucca

SEQ ID NO: 2114157 - RNA, 19 nt, Human
cugcuggguuuuccuccgg

SEQ ID NO: 2114158 - RNA, 13 nt, Human
cugcuugaggcaa

SEQ ID NO: 2114159 - RNA, 20 nt, Human
cugcuugaggcaacucaucu

SEQ ID NO: 2114160 - RNA, 21 nt, Human
cugcuugaggcaacucaucuu

SEQ ID NO: 2114161 - RNA, 13 nt, Human
cugcuucugcacc

SEQ ID NO: 2114162 - RNA, 14 nt, Human
cugcuucugcaccu

SEQ ID NO: 2114163 - RNA, 20 nt, Human
cugcuucugcaccuuaucuu

SEQ ID NO: 2114164 - RNA, 16 nt, Human
cugcuucuuaacccca

SEQ ID NO: 2114165 - RNA, 18 nt, Human
cugcuucuaccaacugga

SEQ ID NO: 2114166 - RNA, 19 nt, Human
cugcuucuaccaacuggaa

SEQ ID NO: 2114167 - RNA, 20 nt, Human
cugcuucuaccaacuggaag

SEQ ID NO: 2114168 - RNA, 21 nt, Human
cugcuucuaccaacuggaagc

SEQ ID NO: 2114169 - RNA, 15 nt, Human
cugcugucagucugc

SEQ ID NO: 2114170 - RNA, 16 nt, Human
cugcugucagucugcu

SEQ ID NO: 2114171 - RNA, 14 nt, Human
cugcuggucuucaa

SEQ ID NO: 2114172 - RNA, 17 nt, Human
cugcuggucuucaauua

SEQ ID NO: 2114173 - RNA, 23 nt, Human
cugcuuuaaaaaaaauccuucua

SEQ ID NO: 2114174 - RNA, 21 nt, Human
cugcuuuaauugugaauugau

SEQ ID NO: 2114175 - RNA, 23 nt, Human
cugcuuuagaauguuuuccuucu

SEQ ID NO: 2114176 - RNA, 20 nt, Human
cugcuuugacugagcagacu

SEQ ID NO: 2114177 - RNA, 21 nt, Human
cugcuuugacugagcagacug

SEQ ID NO: 2114178 - RNA, 17 nt, Human
cugcuuugggcugcccu

SEQ ID NO: 2114179 - RNA, 15 nt, Human
cugcuuuuggucugu

SEQ ID NO: 2114180 - RNA, 13 nt, Human
cugcuuuggaaau

SEQ ID NO: 2114181 - RNA, 23 nt, Human
cugcuuugacugagcagacuggu

SEQ ID NO: 2114182 - RNA, 16 nt, Human
cugcuuugggcugccc

SEQ ID NO: 2114183 - RNA, 22 nt, Human
cugcuuugacugagcagacugg

SEQ ID NO: 2114184 - RNA, 17 nt, Human
cugcuuuuggucugugu

SEQ ID NO: 2114185 - RNA, 19 nt, Human
cugcuuuugucuaugggac

SEQ ID NO: 2114186 - RNA, 16 nt, Human
cuggaagcccucucug

SEQ ID NO: 2114187 - RNA, 12 nt, Human
cuggaagcugug

SEQ ID NO: 2114188 - RNA, 16 nt, Human
cuggaagcuguguccu

SEQ ID NO: 2114189 - RNA, 22 nt, Human
cuggaagcuguguccuugcacc

SEQ ID NO: 2114190 - RNA, 17 nt, Human
cuggaaggggcccgugg

SEQ ID NO: 2114191 - RNA, 19 nt, Human
cuggaaggggcccguggga

SEQ ID NO: 2114192 - RNA, 18 nt, Human
cugcuugguccuugauuu

SEQ ID NO: 2114193 - RNA, 17 nt, Human
cugcuugucccugccca

SEQ ID NO: 2114194 - RNA, 21 nt, Human
cugcuugucccugcccagaau

SEQ ID NO: 2114195 - RNA, 22 nt, Human
cugcuugaggcaacucaucuua

SEQ ID NO: 2114196 - RNA, 20 nt, Human
cugcuugcuugcuuuuuaau

SEQ ID NO: 2114197 - RNA, 18 nt, Human
cugcuugccgaaacugga

SEQ ID NO: 2114198 - RNA, 19 nt, Human
cugcuugccgaaacuggaa

SEQ ID NO: 2114199 - RNA, 20 nt, Human
cugcuugccgaaacuggaag

SEQ ID NO: 2114200 - RNA, 21 nt, Human
cugcuugccgaaacuggaagu

SEQ ID NO: 2114201 - RNA, 23 nt, Human
cugcuugccgaaacuggaaguua

SEQ ID NO: 2114202 - RNA, 20 nt, Human
cugcuuggaccucgugcuuu

SEQ ID NO: 2114203 - RNA, 22 nt, Human
cugcuuggaccucgugcuuuaa

SEQ ID NO: 2114204 - RNA, 11 nt, Human
cugccaccucc

SEQ ID NO: 2114205 - RNA, 15 nt, Human
cugcagugagcugug

SEQ ID NO: 2114206 - RNA, 21 nt, Human
cugccacccuggggagaaagu

SEQ ID NO: 2114207 - RNA, 14 nt, Human
cugccacccugggg

SEQ ID NO: 2114208 - RNA, 12 nt, Human
cugccacccugg

SEQ ID NO: 2114209 - RNA, 13 nt, Human
cugccaccucccc

SEQ ID NO: 2114210 - RNA, 12 nt, Human
cugccaccuccc

SEQ ID NO: 2114211 - RNA, 14 nt, Human
cugccaccuccccu

SEQ ID NO: 2114212 - RNA, 22 nt, Human
cugccaccuccccuauccaccc

SEQ ID NO: 2114213 - RNA, 22 nt, Human
cugccagacggcacccacccag

SEQ ID NO: 2114214 - RNA, 11 nt, Human
cugccagagaa

SEQ ID NO: 2114215 - RNA, 15 nt, Human
cugcauaugaaagga

SEQ ID NO: 2114216 - RNA, 16 nt, Human
cugcauaccaaccugg

SEQ ID NO: 2114217 - RNA, 14 nt, Human
cugcauagaaggag

SEQ ID NO: 2114218 - RNA, 16 nt, Human
cugcauagaaggagga

SEQ ID NO: 2114219 - RNA, 20 nt, Human
cugcauagaaggaggagagg

SEQ ID NO: 2114220 - RNA, 15 nt, Human
cugcauaccaaccug

SEQ ID NO: 2114221 - RNA, 14 nt, Human
cugcauacaaucug

SEQ ID NO: 2114222 - RNA, 21 nt, Human
cugcauaguauuccauugugu

SEQ ID NO: 2114223 - RNA, 20 nt, Human
cugccagagaagcaucggag

SEQ ID NO: 2114224 - RNA, 13 nt, Human
cugccagagaagc

SEQ ID NO: 2114225 - RNA, 22 nt, Human
cugccauggcgugucccucucg

SEQ ID NO: 2114226 - RNA, 21 nt, Human
cugccauggaggcacacagcu

SEQ ID NO: 2114227 - RNA, 23 nt, Human
cugccauggaggcacacagcugc

SEQ ID NO: 2114228 - RNA, 14 nt, Human
cugccauggcgugu

SEQ ID NO: 2114229 - RNA, 21 nt, Human
cugccauggcgugucccucuc

SEQ ID NO: 2114230 - RNA, 21 nt, Human
cugccauccagguucagcuug

SEQ ID NO: 2114231 - RNA, 15 nt, Human
cugccauccucccaa

SEQ ID NO: 2114232 - RNA, 20 nt, Human
cugcccaggccccugccacc

SEQ ID NO: 2114233 - RNA, 19 nt, Human
cugcccaggccccugccac

SEQ ID NO: 2114234 - RNA, 18 nt, Human
cugcccaggccccugcca

SEQ ID NO: 2114235 - RNA, 16 nt, Human
cugcccaggccccugc

SEQ ID NO: 2114236 - RNA, 17 nt, Human
cugcccaggccugccug

SEQ ID NO: 2114237 - RNA, 12 nt, Human
cugcccacccgu

SEQ ID NO: 2114238 - RNA, 14 nt, Human
cugccccaacuccu

SEQ ID NO: 2114239 - RNA, 21 nt, Human
cugccccaacuccuggaagcu

SEQ ID NO: 2114240 - RNA, 16 nt, Human
cugccccaacuccugg

SEQ ID NO: 2114241 - RNA, 17 nt, Human
cugccccaacuccugga

SEQ ID NO: 2114242 - RNA, 18 nt, Human
cugccccaacuccuggaa

SEQ ID NO: 2114243 - RNA, 20 nt, Human
cugccccaacuccuggaagc

SEQ ID NO: 2114244 - RNA, 15 nt, Human
cugcccaggccccug

SEQ ID NO: 2114245 - RNA, 14 nt, Human
cugcccaggccccu

SEQ ID NO: 2114246 - RNA, 15 nt, Human
cugccauuucugaga

SEQ ID NO: 2114247 - RNA, 17 nt, Human
cugcccacauuggaccc

SEQ ID NO: 2114248 - RNA, 23 nt, Human
cugcccggggcagcugccagaga

SEQ ID NO: 2114249 - RNA, 13 nt, Human
cugcccggggcag

SEQ ID NO: 2114250 - RNA, 15 nt, Human
cugcccggggcagcu

SEQ ID NO: 2114251 - RNA, 16 nt, Human
cugcccggggcagcug

SEQ ID NO: 2114252 - RNA, 19 nt, Human
cugcccggggcagcugcca

SEQ ID NO: 2114253 - RNA, 20 nt, Human
cugcccggggcagcugccag

SEQ ID NO: 2114254 - RNA, 21 nt, Human
cugcccggggcagcugccaga

SEQ ID NO: 2114255 - RNA, 22 nt, Human
cugcccggggcagcugccagag

SEQ ID NO: 2114256 - RNA, 15 nt, Human
cugcccgucuucagc

SEQ ID NO: 2114257 - RNA, 16 nt, Human
cugcccgucuucagcc

SEQ ID NO: 2114258 - RNA, 17 nt, Human
cugcccgucuucagccu

SEQ ID NO: 2114259 - RNA, 18 nt, Human
cugcccgucuucagccua

SEQ ID NO: 2114260 - RNA, 21 nt, Human
cugcccgucuucagccuagcc

SEQ ID NO: 2114261 - RNA, 16 nt, Human
cugcccuacucacucu

SEQ ID NO: 2114262 - RNA, 15 nt, Human
cugcccuagagcaca

SEQ ID NO: 2114263 - RNA, 13 nt, Human
cugccccagcucu

SEQ ID NO: 2114264 - RNA, 15 nt, Human
cugccccagcucugg

SEQ ID NO: 2114265 - RNA, 13 nt, Human
cugcccgagcugg

SEQ ID NO: 2114266 - RNA, 18 nt, Human
cugccccuucuacacucu

SEQ ID NO: 2114267 - RNA, 19 nt, Human
cugccccuucuacacucuc

SEQ ID NO: 2114268 - RNA, 20 nt, Human
cugccccuucuacacucucc

SEQ ID NO: 2114269 - RNA, 21 nt, Human
cugccccuucuacacucuccu

SEQ ID NO: 2114270 - RNA, 22 nt, Human
cugccccuucuacacucuccug

SEQ ID NO: 2114271 - RNA, 23 nt, Human
cugccccuucuacacucuccugg

SEQ ID NO: 2114272 - RNA, 24 nt, Human
cugccccuucuacacucuccuggg

SEQ ID NO: 2114273 - RNA, 14 nt, Human
cugccccagcucug

SEQ ID NO: 2114274 - RNA, 16 nt, Human
cugccccuggcucuga

SEQ ID NO: 2114275 - RNA, 13 nt, Human
cugcccggcaggg

SEQ ID NO: 2114276 - RNA, 20 nt, Human
cugcccggcaggguccuaga

SEQ ID NO: 2114277 - RNA, 21 nt, Human
cugcccgagcuggugcauuac

SEQ ID NO: 2114278 - RNA, 14 nt, Human
cugcccgagcuggu

SEQ ID NO: 2114279 - RNA, 15 nt, Human
cugcccgagcuggug

SEQ ID NO: 2114280 - RNA, 16 nt, Human
cugcccgagcuggugc

SEQ ID NO: 2114281 - RNA, 17 nt, Human
cugcccgagcuggugca

SEQ ID NO: 2114282 - RNA, 19 nt, Human
cugcaguuugagacaggag

SEQ ID NO: 2114283 - RNA, 21 nt, Human
cugcaguuugagacaggagac

SEQ ID NO: 2114284 - RNA, 22 nt, Human
cugcagucaucuugaccaagca

SEQ ID NO: 2114285 - RNA, 14 nt, Human
cugcagucacagcu

SEQ ID NO: 2114286 - RNA, 13 nt, Human
cugcagucacagc

SEQ ID NO: 2114287 - RNA, 21 nt, Human
cugcagucagucaugauggca

SEQ ID NO: 2114288 - RNA, 23 nt, Human
cugcagaggggaaaccaguguag

SEQ ID NO: 2114289 - RNA, 13 nt, Human
cugcagcagagcc

SEQ ID NO: 2114290 - RNA, 14 nt, Human
cugcagcagagccu

SEQ ID NO: 2114291 - RNA, 15 nt, Human
cugcagcagagccug

SEQ ID NO: 2114292 - RNA, 11 nt, Human
cugcagcauga

SEQ ID NO: 2114293 - RNA, 17 nt, Human
cugcagcaugaccugug

SEQ ID NO: 2114294 - RNA, 22 nt, Human
cugcagcaugaccugugaccag

SEQ ID NO: 2114295 - RNA, 19 nt, Human
cugcagcaugaccugugac

SEQ ID NO: 2114296 - RNA, 12 nt, Human
cugcagccagcc

SEQ ID NO: 2114297 - RNA, 14 nt, Human
cugcagccagccca

SEQ ID NO: 2114298 - RNA, 15 nt, Human
cugcagccagcccag

SEQ ID NO: 2114299 - RNA, 16 nt, Human
cugcagccagcccagc

SEQ ID NO: 2114300 - RNA, 17 nt, Human
cugcagccagcccagcc

SEQ ID NO: 2114301 - RNA, 18 nt, Human
cugcagccagcccagccc

SEQ ID NO: 2114302 - RNA, 22 nt, Human
cugcagccagcccagcccagcu

SEQ ID NO: 2114303 - RNA, 23 nt, Human
cugcagccagcccagcccagcug

SEQ ID NO: 2114304 - RNA, 15 nt, Human
cugcaccgggccaca

SEQ ID NO: 2114305 - RNA, 14 nt, Human
cugcaccgggccac

SEQ ID NO: 2114306 - RNA, 20 nt, Human
cugcaccgggccacagagaa

SEQ ID NO: 2114307 - RNA, 18 nt, Human
cugcaccgggccacagag

SEQ ID NO: 2114308 - RNA, 20 nt, Human
cugcacuccagccuggguga

SEQ ID NO: 2114309 - RNA, 21 nt, Human
cugcagaggggaaaccagugu

SEQ ID NO: 2114310 - RNA, 21 nt, Human
cugcacuggaguccagucucu

SEQ ID NO: 2114311 - RNA, 19 nt, Human
cuugcacguauuuuaauag

SEQ ID NO: 2114312 - RNA, 19 nt, Human
cuugcacgcccauguguga

SEQ ID NO: 2114313 - RNA, 13 nt, Human
cuugcaccugcau

SEQ ID NO: 2114314 - RNA, 14 nt, Human
cuugcaccugcauc

SEQ ID NO: 2114315 - RNA, 12 nt, Human
cuugcaccugca

SEQ ID NO: 2114316 - RNA, 22 nt, Human
cuugcaagaaucagugcaaaga

SEQ ID NO: 2114317 - RNA, 18 nt, Human
cuugcaagaaucagugca

SEQ ID NO: 2114318 - RNA, 14 nt, Human
cuugcaauggcagc

SEQ ID NO: 2114319 - RNA, 14 nt, Human
cuugcaacacacag

SEQ ID NO: 2114320 - RNA, 15 nt, Human
cuugcaacacacaga

SEQ ID NO: 2114321 - RNA, 17 nt, Human
cuugcaacacacagaca

SEQ ID NO: 2114322 - RNA, 19 nt, Human
cuugcaacacacagacaca

SEQ ID NO: 2114323 - RNA, 14 nt, Human
cuugcaagaaucag

SEQ ID NO: 2114324 - RNA, 16 nt, Human
cuugagugcucaguag

SEQ ID NO: 2114325 - RNA, 21 nt, Human
cuugcauaauaagcuaaagag

SEQ ID NO: 2114326 - RNA, 22 nt, Human
cuugcauaauaagcuaaagagg

SEQ ID NO: 2114327 - RNA, 20 nt, Human
cuugcauaauaagcuaaaga

SEQ ID NO: 2114328 - RNA, 22 nt, Human
cuugcaguucagcaccacccua

SEQ ID NO: 2114329 - RNA, 20 nt, Human
cuugcaguggaagauacuug

SEQ ID NO: 2114330 - RNA, 18 nt, Human
cuugcaguucagcaccac

SEQ ID NO: 2114331 - RNA, 18 nt, Human
cuugcagacucuacagag

SEQ ID NO: 2114332 - RNA, 16 nt, Human
cuugagcauguuacug

SEQ ID NO: 2114333 - RNA, 22 nt, Human
cuugagcauguuacugacagag

SEQ ID NO: 2114334 - RNA, 20 nt, Human
cuugagaguagaugguuuga

SEQ ID NO: 2114335 - RNA, 15 nt, Human
cuugagaugucuucu

SEQ ID NO: 2114336 - RNA, 14 nt, Human
cuugagagggugga

SEQ ID NO: 2114337 - RNA, 13 nt, Human
cuugagcucagga

SEQ ID NO: 2114338 - RNA, 12 nt, Human
cuugagcccagg

SEQ ID NO: 2114339 - RNA, 18 nt, Human
cuugaggucuuuugacau

SEQ ID NO: 2114340 - RNA, 22 nt, Human
cuugaggucuuuugacaugugg

SEQ ID NO: 2114341 - RNA, 23 nt, Human
cuugaggucuuuugacaugugga

SEQ ID NO: 2114342 - RNA, 14 nt, Human
cuugaggucuuuug

SEQ ID NO: 2114343 - RNA, 17 nt, Human
cuugaggucuuuugaca

SEQ ID NO: 2114344 - RNA, 14 nt, Human
cuugaggaguguga

SEQ ID NO: 2114345 - RNA, 22 nt, Human
cuugaggagugugagaaucaaa

SEQ ID NO: 2114346 - RNA, 18 nt, Human
cuugagggcaagagccac

SEQ ID NO: 2114347 - RNA, 16 nt, Human
cuugagggagcuuagc

SEQ ID NO: 2114348 - RNA, 14 nt, Human
cuugaggccaggag

SEQ ID NO: 2114349 - RNA, 18 nt, Human
cuugaacuccuggccuca

SEQ ID NO: 2114350 - RNA, 17 nt, Human
cuugaacuccuggccuc

SEQ ID NO: 2114351 - RNA, 15 nt, Human
cuugaacuccuggcc

SEQ ID NO: 2114352 - RNA, 14 nt, Human
cuugaacuccuggc

SEQ ID NO: 2114353 - RNA, 20 nt, Human
cuugaacuggguacuugugg

SEQ ID NO: 2114354 - RNA, 18 nt, Human
cuugaacuggguacuugu

SEQ ID NO: 2114355 - RNA, 23 nt, Human
cuugaccagcagaucccagcuca

SEQ ID NO: 2114356 - RNA, 16 nt, Human
cuugaacuggguacuu

SEQ ID NO: 2114357 - RNA, 19 nt, Human
cuugaacuccuggccucaa

SEQ ID NO: 2114358 - RNA, 12 nt, Human
cuucuuuccauu

SEQ ID NO: 2114359 - RNA, 20 nt, Human
cugucugacaaccucuuggu

SEQ ID NO: 2114360 - RNA, 21 nt, Human
cugucucuuaaaaaaauaaaa

SEQ ID NO: 2114361 - RNA, 23 nt, Human
cuucuuuuuauuuucuuuuguaa

SEQ ID NO: 2114362 - RNA, 22 nt, Human
cuugaaaugaaaguauaacuga

SEQ ID NO: 2114363 - RNA, 23 nt, Human
cuucuuuuaagaugugucuucaa

SEQ ID NO: 2114364 - RNA, 13 nt, Human
cuucuuuuacuca

SEQ ID NO: 2114365 - RNA, 15 nt, Human
cuucuuuuuauuuuc

SEQ ID NO: 2114366 - RNA, 20 nt, Human
cuucuuuuuauuuucuuuug

SEQ ID NO: 2114367 - RNA, 22 nt, Human
cuuguauuaaguuguuaauaaa

SEQ ID NO: 2114368 - RNA, 23 nt, Human
cuuguauuaaguuguuaauaaaa

SEQ ID NO: 2114369 - RNA, 13 nt, Human
cuuguauuaaguu

SEQ ID NO: 2114370 - RNA, 17 nt, Human
cuuguauuaaguuguua

SEQ ID NO: 2114371 - RNA, 18 nt, Human
cuuguauccucugguucu

SEQ ID NO: 2114372 - RNA, 17 nt, Human
cuuguauuaaagacaga

SEQ ID NO: 2114373 - RNA, 14 nt, Human
cuuguaacuccacc

SEQ ID NO: 2114374 - RNA, 17 nt, Human
cuuguaacaagaaaaca

SEQ ID NO: 2114375 - RNA, 21 nt, Human
cuuguaugaaagauggcugug

SEQ ID NO: 2114376 - RNA, 19 nt, Human
cuuguaagagcuauacagu

SEQ ID NO: 2114377 - RNA, 20 nt, Human
cuuguaagagcuauacaguu

SEQ ID NO: 2114378 - RNA, 12 nt, Human
cuuguaagauuu

SEQ ID NO: 2114379 - RNA, 15 nt, Human
cuuguaagauuuuga

SEQ ID NO: 2114380 - RNA, 16 nt, Human
cuuguaagauuuugaa

SEQ ID NO: 2114381 - RNA, 18 nt, Human
cuuguaagauuuugaaaa

SEQ ID NO: 2114382 - RNA, 15 nt, Human
cuuguaacuccacca

SEQ ID NO: 2114383 - RNA, 17 nt, Human
cuuguaacuccaccaac

SEQ ID NO: 2114384 - RNA, 21 nt, Human
cuuguaacuccaccaacccau

SEQ ID NO: 2114385 - RNA, 13 nt, Human
cuugucagagcug

SEQ ID NO: 2114386 - RNA, 21 nt, Human
cuugucagagcugggaggggu

SEQ ID NO: 2114387 - RNA, 14 nt, Human
cuugucagagcugg

SEQ ID NO: 2114388 - RNA, 15 nt, Human
cuugucagagcuggg

SEQ ID NO: 2114389 - RNA, 18 nt, Human
cuuguggacacagcucuu

SEQ ID NO: 2114390 - RNA, 17 nt, Human
cuuguggacacagcucu

SEQ ID NO: 2114391 - RNA, 12 nt, Human
cuuguauuuaaa

SEQ ID NO: 2114392 - RNA, 18 nt, Human
cuuguauuuaaauauuaa

SEQ ID NO: 2114393 - RNA, 20 nt, Human
cuuguauuuaaauauuaaau

SEQ ID NO: 2114394 - RNA, 18 nt, Human
cuuguaaaaauuaaaagu

SEQ ID NO: 2114395 - RNA, 13 nt, Human
cuuggggccaucg

SEQ ID NO: 2114396 - RNA, 18 nt, Human
cuuguaaagacuguagaa

SEQ ID NO: 2114397 - RNA, 21 nt, Human
cuuguaaauagcucagguguc

SEQ ID NO: 2114398 - RNA, 14 nt, Human
cuuggggcaggcag

SEQ ID NO: 2114399 - RNA, 15 nt, Human
cuuggggcaggcagu

SEQ ID NO: 2114400 - RNA, 17 nt, Human
cuuggcuguagaaggag

SEQ ID NO: 2114401 - RNA, 22 nt, Human
cuuggcuguagaaggagacaga

SEQ ID NO: 2114402 - RNA, 20 nt, Human
cuuggcuucaggggaguccc

SEQ ID NO: 2114403 - RNA, 24 nt, Human
cuuggcucacugcaacuucugccu

SEQ ID NO: 2114404 - RNA, 21 nt, Human
cuuggcucaauccucuaagcu

SEQ ID NO: 2114405 - RNA, 23 nt, Human
cuuggcucaaguccucuuuucug

SEQ ID NO: 2114406 - RNA, 14 nt, Human
cuuggcguggagcc

SEQ ID NO: 2114407 - RNA, 17 nt, Human
cuuggcguggagccagg

SEQ ID NO: 2114408 - RNA, 18 nt, Human
cuuggcguggagccaggg

SEQ ID NO: 2114409 - RNA, 21 nt, Human
cuuggcguggagccagggagc

SEQ ID NO: 2114410 - RNA, 13 nt, Human
cuuggcugcaggg

SEQ ID NO: 2114411 - RNA, 12 nt, Human
cuuggcugcagg

SEQ ID NO: 2114412 - RNA, 18 nt, Human
cuuggaccucgugcuuua

SEQ ID NO: 2114413 - RNA, 22 nt, Human
cuuggaccucgugcuuuaagug

SEQ ID NO: 2114414 - RNA, 21 nt, Human
cuuggagccccagugccaagc

SEQ ID NO: 2114415 - RNA, 15 nt, Human
cuuggauguauaugu

SEQ ID NO: 2114416 - RNA, 23 nt, Human
cuuggauaaugcuguugccucau

SEQ ID NO: 2114417 - RNA, 18 nt, Human
cuuggauaaugcuguugc

SEQ ID NO: 2114418 - RNA, 22 nt, Human
cuuggauaaugcuguugccuca

SEQ ID NO: 2114419 - RNA, 14 nt, Human
cuugcugcuauuuu

SEQ ID NO: 2114420 - RNA, 19 nt, Human
cuugcugcuauuuuacugu

SEQ ID NO: 2114421 - RNA, 18 nt, Human
cuugcauugaauauauua

SEQ ID NO: 2114422 - RNA, 13 nt, Human
cuugcuugcuuuu

SEQ ID NO: 2114423 - RNA, 14 nt, Human
cuugcuguccuagg

SEQ ID NO: 2114424 - RNA, 21 nt, Human
cuugcuuucuuuguuuggcug

SEQ ID NO: 2114425 - RNA, 15 nt, Human
cuugcuguccuaggc

SEQ ID NO: 2114426 - RNA, 15 nt, Human
cuuugaaauuguuua

SEQ ID NO: 2114427 - RNA, 21 nt, Human
cuuugaaauagucugugugaa

SEQ ID NO: 2114428 - RNA, 19 nt, Human
cuuugaaauagucugugug

SEQ ID NO: 2114429 - RNA, 16 nt, Human
cuuugaaaugaauaua

SEQ ID NO: 2114430 - RNA, 17 nt, Human
cuuucuuucuaacucca

SEQ ID NO: 2114431 - RNA, 13 nt, Human
cuuucuuuggugc

SEQ ID NO: 2114432 - RNA, 15 nt, Human
cuuucuuuggugccu

SEQ ID NO: 2114433 - RNA, 18 nt, Human
cuuucuuuggugccuuuc

SEQ ID NO: 2114434 - RNA, 20 nt, Human
cuuucuuuggugccuuuccu

SEQ ID NO: 2114435 - RNA, 21 nt, Human
cuuucuuuggugccuuuccug

SEQ ID NO: 2114436 - RNA, 23 nt, Human
cuuucuuuggugccuuuccuguu

SEQ ID NO: 2114437 - RNA, 18 nt, Human
cuuucuuuguuuggcugg

SEQ ID NO: 2114438 - RNA, 21 nt, Human
cuuucuuuucgccguggcugc

SEQ ID NO: 2114439 - RNA, 16 nt, Human
cuuucuguugccacaa

SEQ ID NO: 2114440 - RNA, 15 nt, Human
cuuugcagacaggca

SEQ ID NO: 2114441 - RNA, 14 nt, Human
cuuugcagacaggc

SEQ ID NO: 2114442 - RNA, 16 nt, Human
cuuugaaugcggccca

SEQ ID NO: 2114443 - RNA, 14 nt, Human
cuuugcccacaaug

SEQ ID NO: 2114444 - RNA, 15 nt, Human
cuuugcccaaccuca

SEQ ID NO: 2114445 - RNA, 17 nt, Human
cuuugcccaaccucagc

SEQ ID NO: 2114446 - RNA, 18 nt, Human
cuuugcccaaccucagca

SEQ ID NO: 2114447 - RNA, 21 nt, Human
cuuugcccaaccucagcaacc

SEQ ID NO: 2114448 - RNA, 15 nt, Human
cuuugcagaaacaga

SEQ ID NO: 2114449 - RNA, 23 nt, Human
cuuugcagaaacagauuugguga

SEQ ID NO: 2114450 - RNA, 18 nt, Human
cuuugccagaaagcauaa

SEQ ID NO: 2114451 - RNA, 23 nt, Human
cuuugccccaccuuuauuaaaau

SEQ ID NO: 2114452 - RNA, 16 nt, Human
cuuucaauaacgaagu

SEQ ID NO: 2114453 - RNA, 16 nt, Human
cuuucauccccaccuu

SEQ ID NO: 2114454 - RNA, 17 nt, Human
cuuucauccccaccuug

SEQ ID NO: 2114455 - RNA, 20 nt, Human
cuuucauuaaagcauuuacu

SEQ ID NO: 2114456 - RNA, 14 nt, Human
cuuucaaauuucac

SEQ ID NO: 2114457 - RNA, 15 nt, Human
cuuucaaauuucaca

SEQ ID NO: 2114458 - RNA, 15 nt, Human
cuuucaaagaaggaa

SEQ ID NO: 2114459 - RNA, 18 nt, Human
cuuucaaagaaggaauuc

SEQ ID NO: 2114460 - RNA, 21 nt, Human
cuuucaaagaaggaauucuag

SEQ ID NO: 2114461 - RNA, 21 nt, Human
cuuucaaauugagagaaugga

SEQ ID NO: 2114462 - RNA, 21 nt, Human
cuuguggacacagcucuucuc

SEQ ID NO: 2114463 - RNA, 13 nt, Human
cuugugucugcgu

SEQ ID NO: 2114464 - RNA, 18 nt, Human
cuuuauuuuuuaaguauu

SEQ ID NO: 2114465 - RNA, 21 nt, Human
cuuuauuuuuuaaguauuuau

SEQ ID NO: 2114466 - RNA, 22 nt, Human
cuuuauuuuuuaaguauuuaua

SEQ ID NO: 2114467 - RNA, 23 nt, Human
cuuuauuuuuuaaguauuuauau

SEQ ID NO: 2114468 - RNA, 19 nt, Human
cuugugugugggcugugag

SEQ ID NO: 2114469 - RNA, 21 nt, Human
cuugugugugggcugugagug

SEQ ID NO: 2114470 - RNA, 20 nt, Human
cuugugugugggcugugagu

SEQ ID NO: 2114471 - RNA, 13 nt, Human
cuuuauuuucugg

SEQ ID NO: 2114472 - RNA, 18 nt, Human
cuuuauuuucugguagau

SEQ ID NO: 2114473 - RNA, 15 nt, Human
cuuucauugccagug

SEQ ID NO: 2114474 - RNA, 18 nt, Human
cuuucauugccagugucu

SEQ ID NO: 2114475 - RNA, 16 nt, Human
cuuuccaaaugcccag

SEQ ID NO: 2114476 - RNA, 23 nt, Human
cuuuccacccccucccuggccug

SEQ ID NO: 2114477 - RNA, 17 nt, Human
cuuuccccauacucugu

SEQ ID NO: 2114478 - RNA, 18 nt, Human
cuuuccccauacucuguc

SEQ ID NO: 2114479 - RNA, 22 nt, Human
cuuuccacccccucccuggccu

SEQ ID NO: 2114480 - RNA, 19 nt, Human
cuuucccccaccagcuaag

SEQ ID NO: 2114481 - RNA, 17 nt, Human
cuuuccguggcacugca

SEQ ID NO: 2114482 - RNA, 19 nt, Human
cuuuccguggcacugcaua

SEQ ID NO: 2114483 - RNA, 12 nt, Human
cuuuucacugcu

SEQ ID NO: 2114484 - RNA, 21 nt, Human
cuuuuccuacuuuuccuuccc

SEQ ID NO: 2114485 - RNA, 22 nt, Human
cuuuuccuacuuuuccuucccu

SEQ ID NO: 2114486 - RNA, 16 nt, Human
cuuuucacugcuggcu

SEQ ID NO: 2114487 - RNA, 14 nt, Human
cuuuucccuucuuu

SEQ ID NO: 2114488 - RNA, 13 nt, Human
cuuuuccuucccu

SEQ ID NO: 2114489 - RNA, 20 nt, Human
cuuuuccuucccucaaagcu

SEQ ID NO: 2114490 - RNA, 13 nt, Human
cuuuuccuugggg

SEQ ID NO: 2114491 - RNA, 17 nt, Human
cuuuuccuuggggcagg

SEQ ID NO: 2114492 - RNA, 21 nt, Human
cuuuuccuuggggcaggcagu

SEQ ID NO: 2114493 - RNA, 20 nt, Human
cuuuucgcaggauucuuccu

SEQ ID NO: 2114494 - RNA, 21 nt, Human
cuuuucgcaggauucuuccuc

SEQ ID NO: 2114495 - RNA, 12 nt, Human
cuuuuaaauccu

SEQ ID NO: 2114496 - RNA, 14 nt, Human
cuuuuaaauccugu

SEQ ID NO: 2114497 - RNA, 17 nt, Human
cuuuuaaauccuguuga

SEQ ID NO: 2114498 - RNA, 18 nt, Human
cuuuuaaauccuguugaa

SEQ ID NO: 2114499 - RNA, 19 nt, Human
cuuuuaaauccuguugaaa

SEQ ID NO: 2114500 - RNA, 20 nt, Human
cuuuuaaauccuguugaaaa

SEQ ID NO: 2114501 - RNA, 23 nt, Human
cuuuuaaaggggcagaaaaacuc

SEQ ID NO: 2114502 - RNA, 22 nt, Human
cuuuuaaaggggcagaaaaacu

SEQ ID NO: 2114503 - RNA, 16 nt, Human
cuuuuaauacagggua

SEQ ID NO: 2114504 - RNA, 19 nt, Human
cuuuuaagaugugucuuca

SEQ ID NO: 2114505 - RNA, 20 nt, Human
cuuuuaagaugugucuucaa

SEQ ID NO: 2114506 - RNA, 18 nt, Human
cuuuuaaaacacuuccau

SEQ ID NO: 2114507 - RNA, 23 nt, Human
cuuuguuuuuuuuuccuguccuu

SEQ ID NO: 2114508 - RNA, 16 nt, Human
cuuuguuuuuuuuucc

SEQ ID NO: 2114509 - RNA, 21 nt, Human
cuuuguuuuuuuuuccugucc

SEQ ID NO: 2114510 - RNA, 19 nt, Human
cuuuguuuuguuuuaagga

SEQ ID NO: 2114511 - RNA, 16 nt, Human
cuuuguuuuuaaauga

SEQ ID NO: 2114512 - RNA, 18 nt, Human
cuuuguuuuuaugaagaa

SEQ ID NO: 2114513 - RNA, 16 nt, Human
cuuuggacgcacacag

SEQ ID NO: 2114514 - RNA, 17 nt, Human
cuuuggacgcacacagc

SEQ ID NO: 2114515 - RNA, 18 nt, Human
cuuuggacgcacacagcu

SEQ ID NO: 2114516 - RNA, 19 nt, Human
cuuuggacgcacacagcuu

SEQ ID NO: 2114517 - RNA, 15 nt, Human
cuuuggacucucccc

SEQ ID NO: 2114518 - RNA, 21 nt, Human
cuuuggacucuccccucuuau

SEQ ID NO: 2114519 - RNA, 13 nt, Human
cuuuucuacagca

SEQ ID NO: 2114520 - RNA, 14 nt, Human
cuuuucuacagcaa

SEQ ID NO: 2114521 - RNA, 15 nt, Human
cuuuucuacagcaaa

SEQ ID NO: 2114522 - RNA, 17 nt, Human
cuuuucuacagcaaauu

SEQ ID NO: 2114523 - RNA, 11 nt, Human
cuuuucguuaa

SEQ ID NO: 2114524 - RNA, 15 nt, Human
cuuuucguuaacauu

SEQ ID NO: 2114525 - RNA, 16 nt, Human
cuuuucguuaacauug

SEQ ID NO: 2114526 - RNA, 20 nt, Human
cuuuucguuaacauugacca

SEQ ID NO: 2114527 - RNA, 20 nt, Human
cuuuuccuuggggcaggcag

SEQ ID NO: 2114528 - RNA, 16 nt, Human
cuuuucgccguggcug

SEQ ID NO: 2114529 - RNA, 18 nt, Human
cuuuuccuguuuuuguua

SEQ ID NO: 2114530 - RNA, 23 nt, Human
cuuuucuuugaaggaugacuaca

SEQ ID NO: 2114531 - RNA, 16 nt, Human
cuuuugauauuaaauu

SEQ ID NO: 2114532 - RNA, 13 nt, Human
cuuuugauauuaa

SEQ ID NO: 2114533 - RNA, 17 nt, Human
cuuuuuaagcuuauuua

SEQ ID NO: 2114534 - RNA, 19 nt, Human
cuuuuuaagcuuauuuaau

SEQ ID NO: 2114535 - RNA, 20 nt, Human
cuuuuuaauaaaaaggcacc

SEQ ID NO: 2114536 - RNA, 14 nt, Human
cuuuuuaauaaaaa

SEQ ID NO: 2114537 - RNA, 15 nt, Human
cuuuuuaauaaaaag

SEQ ID NO: 2114538 - RNA, 22 nt, Human
cuuuuuaauauugauaugcuua

SEQ ID NO: 2114539 - RNA, 15 nt, Human
cuuuuuacuccccuu

SEQ ID NO: 2114540 - RNA, 19 nt, Human
cuuuuuacuccccuugagc

SEQ ID NO: 2114541 - RNA, 21 nt, Human
cuuuuuuauggcgauucccau

SEQ ID NO: 2114542 - RNA, 18 nt, Human
cuuuuuuaugugccgugu

SEQ ID NO: 2114543 - RNA, 23 nt, Human
cuuuuuuaugugccguguuauug

SEQ ID NO: 2114544 - RNA, 18 nt, Human
cuuuuuuauuuuuuauac

SEQ ID NO: 2114545 - RNA, 11 nt, Human
gaaaaagaaaa

SEQ ID NO: 2114546 - RNA, 16 nt, Human
gaaaaagaaaaaauau

SEQ ID NO: 2114547 - RNA, 22 nt, Human
cuuuuuccagacacuuuuuuga

SEQ ID NO: 2114548 - RNA, 16 nt, Human
cuuuuucccaauaaau

SEQ ID NO: 2114549 - RNA, 17 nt, Human
cuuuuucccaauaaauu

SEQ ID NO: 2114550 - RNA, 20 nt, Human
gaaauuuccacucaggucug

SEQ ID NO: 2114551 - RNA, 19 nt, Human
gaaauuuccacucaggucu

SEQ ID NO: 2114552 - RNA, 13 nt, Human
gaaauucccugga

SEQ ID NO: 2114553 - RNA, 15 nt, Human
gaaauucccuggacc

SEQ ID NO: 2114554 - RNA, 18 nt, Human
gaaauucccuggaccaga

SEQ ID NO: 2114555 - RNA, 22 nt, Human
gaaauucccuggaccagaugcu

SEQ ID NO: 2114556 - RNA, 23 nt, Human
gaaauucccuggaccagaugcug

SEQ ID NO: 2114557 - RNA, 19 nt, Human
gaaauuacuacaaaauuug

SEQ ID NO: 2114558 - RNA, 13 nt, Human
gaaauuagccggg

SEQ ID NO: 2114559 - RNA, 16 nt, Human
gaaauuagcuguguga

SEQ ID NO: 2114560 - RNA, 19 nt, Human
gaaauuagcugugugaaau

SEQ ID NO: 2114561 - RNA, 13 nt, Human
gaaauuagggccc

SEQ ID NO: 2114562 - RNA, 19 nt, Human
gaacagacuggaagcacag

SEQ ID NO: 2114563 - RNA, 20 nt, Human
gaacagacuggaagcacagc

SEQ ID NO: 2114564 - RNA, 11 nt, Human
gaaauuugaau

SEQ ID NO: 2114565 - RNA, 16 nt, Human
gaacauguacacuggu

SEQ ID NO: 2114566 - RNA, 14 nt, Human
gaacaguuuguaca

SEQ ID NO: 2114567 - RNA, 16 nt, Human
gaacaguuaagcagcc

SEQ ID NO: 2114568 - RNA, 20 nt, Human
gaacaguuaagcagccgcca

SEQ ID NO: 2114569 - RNA, 21 nt, Human
gaacaguuaagcagccgccac

SEQ ID NO: 2114570 - RNA, 14 nt, Human
gaacaucccugcca

SEQ ID NO: 2114571 - RNA, 15 nt, Human
gaacaucccugccag

SEQ ID NO: 2114572 - RNA, 23 nt, Human
gaacaugaaaacagaaaacgguu

SEQ ID NO: 2114573 - RNA, 22 nt, Human
gaacagacuggaagcacagcuu

SEQ ID NO: 2114574 - RNA, 15 nt, Human
gaacagacuggccug

SEQ ID NO: 2114575 - RNA, 14 nt, Human
gaacaguaacugcc

SEQ ID NO: 2114576 - RNA, 15 nt, Human
gaacaggaaaagaaa

SEQ ID NO: 2114577 - RNA, 16 nt, Human
gaacaguguuucccau

SEQ ID NO: 2114578 - RNA, 17 nt, Human
gaacaguguuucccaua

SEQ ID NO: 2114579 - RNA, 18 nt, Human
gaacaguguuucccauaa

SEQ ID NO: 2114580 - RNA, 21 nt, Human
gaacaguguuucccauaauuu

SEQ ID NO: 2114581 - RNA, 20 nt, Human
gaaauaucugaaaauguaug

SEQ ID NO: 2114582 - RNA, 14 nt, Human
gaaauaucauuuau

SEQ ID NO: 2114583 - RNA, 13 nt, Human
gaaauaucauuua

SEQ ID NO: 2114584 - RNA, 18 nt, Human
gaaauaucugaaaaugua

SEQ ID NO: 2114585 - RNA, 19 nt, Human
gaaauaucugaaaauguau

SEQ ID NO: 2114586 - RNA, 22 nt, Human
gaaauaucaguuacucagcccu

SEQ ID NO: 2114587 - RNA, 12 nt, Human
gaaaugaauaua

SEQ ID NO: 2114588 - RNA, 14 nt, Human
gaaaugaauuucuc

SEQ ID NO: 2114589 - RNA, 14 nt, Human
gaaaugaccaauau

SEQ ID NO: 2114590 - RNA, 19 nt, Human
gaaaugacuaaaaaacaaa

SEQ ID NO: 2114591 - RNA, 20 nt, Human
gaaauaucaguuacucagcc

SEQ ID NO: 2114592 - RNA, 21 nt, Human
gaaauaucaguuacucagccc

SEQ ID NO: 2114593 - RNA, 12 nt, Human
gaaauaucauuu

SEQ ID NO: 2114594 - RNA, 23 nt, Human
gaaauaucaguuacucagcccug

SEQ ID NO: 2114595 - RNA, 23 nt, Human
gaaauauauauguguguguaugu

SEQ ID NO: 2114596 - RNA, 14 nt, Human
gaaauauauaugug

SEQ ID NO: 2114597 - RNA, 17 nt, Human
gaaauauauaugugugu

SEQ ID NO: 2114598 - RNA, 12 nt, Human
gaaaugcacaau

SEQ ID NO: 2114599 - RNA, 13 nt, Human
gaaaugcacaaug

SEQ ID NO: 2114600 - RNA, 16 nt, Human
gaaaugcacaaugucu

SEQ ID NO: 2114601 - RNA, 17 nt, Human
gaaaugcacaaugucuu

SEQ ID NO: 2114602 - RNA, 23 nt, Human
gaaaugcauccauuccucaggga

SEQ ID NO: 2114603 - RNA, 17 nt, Human
gaaaugccuaagaagau

SEQ ID NO: 2114604 - RNA, 18 nt, Human
gaaaugccuaagaagaug

SEQ ID NO: 2114605 - RNA, 23 nt, Human
gaaaugccuaagaagaugacuuc

SEQ ID NO: 2114606 - RNA, 16 nt, Human
gaaaugccuuacuuug

SEQ ID NO: 2114607 - RNA, 17 nt, Human
gaaaugccuuacuuugu

SEQ ID NO: 2114608 - RNA, 20 nt, Human
gaaaugccuuacuuuguaug

SEQ ID NO: 2114609 - RNA, 21 nt, Human
gaaaugccuuacuuuguauga

SEQ ID NO: 2114610 - RNA, 22 nt, Human
gaaaugccuuacuuuguaugau

SEQ ID NO: 2114611 - RNA, 23 nt, Human
gaaaugccuuacuuuguaugaua

SEQ ID NO: 2114612 - RNA, 18 nt, Human
gaaaugaggucagagccu

SEQ ID NO: 2114613 - RNA, 15 nt, Human
gaaaugucuggagaa

SEQ ID NO: 2114614 - RNA, 17 nt, Human
gaaaugucuggagaaua

SEQ ID NO: 2114615 - RNA, 18 nt, Human
gaaaugucuggagaauaa

SEQ ID NO: 2114616 - RNA, 18 nt, Human
gaaauuacuacaaaauuu

SEQ ID NO: 2114617 - RNA, 21 nt, Human
gaaaguggccaugccacccug

SEQ ID NO: 2114618 - RNA, 20 nt, Human
gaaagucuugugacuagugc

SEQ ID NO: 2114619 - RNA, 21 nt, Human
gaaagucuugugacuagugcu

SEQ ID NO: 2114620 - RNA, 19 nt, Human
gaaagucuugugacuagug

SEQ ID NO: 2114621 - RNA, 22 nt, Human
gaaagucuugugacuagugcug

SEQ ID NO: 2114622 - RNA, 13 nt, Human
gaaagugaauuug

SEQ ID NO: 2114623 - RNA, 19 nt, Human
gaaagugaagcaaaucaga

SEQ ID NO: 2114624 - RNA, 16 nt, Human
gaaagugaauaaaaau

SEQ ID NO: 2114625 - RNA, 17 nt, Human
gaaagugaauaaaaauu

SEQ ID NO: 2114626 - RNA, 16 nt, Human
gaaagugaauuugaau

SEQ ID NO: 2114627 - RNA, 17 nt, Human
gaaagugaauuugaaug

SEQ ID NO: 2114628 - RNA, 19 nt, Human
gaaagugaauuugaaugaa

SEQ ID NO: 2114629 - RNA, 23 nt, Human
gaaagugaauuugaaugaaaaau

SEQ ID NO: 2114630 - RNA, 20 nt, Human
gaaaguuuccccaccaguga

SEQ ID NO: 2114631 - RNA, 14 nt, Human
gaaauaaaaccuuu

SEQ ID NO: 2114632 - RNA, 14 nt, Human
gaaauaaaaaaguc

SEQ ID NO: 2114633 - RNA, 15 nt, Human
gaaauaaaaaagucu

SEQ ID NO: 2114634 - RNA, 16 nt, Human
gaaauaaaaaagucuc

SEQ ID NO: 2114635 - RNA, 17 nt, Human
gaaauaaaaaagucucu

SEQ ID NO: 2114636 - RNA, 18 nt, Human
gaaauaaaaaagucucua

SEQ ID NO: 2114637 - RNA, 19 nt, Human
gaaauaaaaaagucucuau

SEQ ID NO: 2114638 - RNA, 20 nt, Human
gaaauaaaaaagucucuauu

SEQ ID NO: 2114639 - RNA, 22 nt, Human
gaaauaaaaaagucucuauuua

SEQ ID NO: 2114640 - RNA, 23 nt, Human
gaaaguuuccccaccagugaaug

SEQ ID NO: 2114641 - RNA, 22 nt, Human
gaaaguuuucagaaccucuucc

SEQ ID NO: 2114642 - RNA, 15 nt, Human
gaaauaaaaccuuuc

SEQ ID NO: 2114643 - RNA, 16 nt, Human
gaaauaaaaccuuuca

SEQ ID NO: 2114644 - RNA, 17 nt, Human
gaaauaaaaccuuucaa

SEQ ID NO: 2114645 - RNA, 18 nt, Human
gaaauaaaaccuuucaaa

SEQ ID NO: 2114646 - RNA, 17 nt, Human
gaaaguuacaaauugcu

SEQ ID NO: 2114647 - RNA, 11 nt, Human
gaaaguuuccc

SEQ ID NO: 2114648 - RNA, 14 nt, Human
gaaaguguuuccuu

SEQ ID NO: 2114649 - RNA, 17 nt, Human
gaaaguuccuuauguau

SEQ ID NO: 2114650 - RNA, 23 nt, Human
gaaagcacuccucccugauguac

SEQ ID NO: 2114651 - RNA, 21 nt, Human
gaaagcauguggcauguucau

SEQ ID NO: 2114652 - RNA, 22 nt, Human
gaaagcauguggcauguucauc

SEQ ID NO: 2114653 - RNA, 14 nt, Human
gaaagccagucuua

SEQ ID NO: 2114654 - RNA, 15 nt, Human
gaaagccagucuuaa

SEQ ID NO: 2114655 - RNA, 19 nt, Human
gaaagccagucuuaacauu

SEQ ID NO: 2114656 - RNA, 14 nt, Human
gaaaggauucaugu

SEQ ID NO: 2114657 - RNA, 22 nt, Human
gaaaguacuucuccacccugcu

SEQ ID NO: 2114658 - RNA, 22 nt, Human
gaaaggauguaaacagugccug

SEQ ID NO: 2114659 - RNA, 16 nt, Human
gaaaggcauucucuga

SEQ ID NO: 2114660 - RNA, 17 nt, Human
gaaagucagaugcccag

SEQ ID NO: 2114661 - RNA, 20 nt, Human
gaaagucagaugcccagagg

SEQ ID NO: 2114662 - RNA, 17 nt, Human
gaaagucaugaacacau

SEQ ID NO: 2114663 - RNA, 19 nt, Human
gaaagucaugaacacauca

SEQ ID NO: 2114664 - RNA, 11 nt, Human
gaaaggagacu

SEQ ID NO: 2114665 - RNA, 13 nt, Human
gaaaggagacuag

SEQ ID NO: 2114666 - RNA, 15 nt, Human
gaaaggaguagaaaa

SEQ ID NO: 2114667 - RNA, 16 nt, Human
gaaaggaguagaaaaa

SEQ ID NO: 2114668 - RNA, 14 nt, Human
gaaaggauauuuaa

SEQ ID NO: 2114669 - RNA, 16 nt, Human
gaaaggauauuuaaga

SEQ ID NO: 2114670 - RNA, 17 nt, Human
gaaaggauauuuaagaa

SEQ ID NO: 2114671 - RNA, 20 nt, Human
gaaaggauauuuaagaaaau

SEQ ID NO: 2114672 - RNA, 21 nt, Human
gaaaggauauuuaagaaaaua

SEQ ID NO: 2114673 - RNA, 22 nt, Human
gaaaggauauuuaagaaaauac

SEQ ID NO: 2114674 - RNA, 20 nt, Human
gaaaggauguaaacagugcc

SEQ ID NO: 2114675 - RNA, 17 nt, Human
gaaacucaccauguaaa

SEQ ID NO: 2114676 - RNA, 20 nt, Human
gaaacucaccauguaaaaga

SEQ ID NO: 2114677 - RNA, 21 nt, Human
gaaacucacccccaaggggca

SEQ ID NO: 2114678 - RNA, 18 nt, Human
gaaacucaccugcuggcc

SEQ ID NO: 2114679 - RNA, 23 nt, Human
gaaacucaccugcuggccccuca

SEQ ID NO: 2114680 - RNA, 22 nt, Human
gaaacucagagucggaacggag

SEQ ID NO: 2114681 - RNA, 19 nt, Human
gaaacucaccugcuggccc

SEQ ID NO: 2114682 - RNA, 20 nt, Human
gaaacucaccugcuggcccc

SEQ ID NO: 2114683 - RNA, 21 nt, Human
gaaacucaccugcuggccccu

SEQ ID NO: 2114684 - RNA, 22 nt, Human
gaaacucaccugcuggccccuc

SEQ ID NO: 2114685 - RNA, 16 nt, Human
gaaacugacacaugcu

SEQ ID NO: 2114686 - RNA, 16 nt, Human
gaaaaaugagccuggc

SEQ ID NO: 2114687 - RNA, 20 nt, Human
gaaaaaugcccuuaaaucau

SEQ ID NO: 2114688 - RNA, 22 nt, Human
gaaaaagcaguaacugacaacu

SEQ ID NO: 2114689 - RNA, 22 nt, Human
gaaaaauggauccccagugaaa

SEQ ID NO: 2114690 - RNA, 14 nt, Human
gaaagacugagcuc

SEQ ID NO: 2114691 - RNA, 16 nt, Human
gaaagagauacagagg

SEQ ID NO: 2114692 - RNA, 23 nt, Human
gaaagagauaccaagaugccauc

SEQ ID NO: 2114693 - RNA, 19 nt, Human
gaaagagagagaauucuuu

SEQ ID NO: 2114694 - RNA, 16 nt, Human
gaaagagagcacugac

SEQ ID NO: 2114695 - RNA, 17 nt, Human
gaaagaguuaagaaugu

SEQ ID NO: 2114696 - RNA, 18 nt, Human
gaaagaguuaagaauguc

SEQ ID NO: 2114697 - RNA, 22 nt, Human
gaaagauggcugugccucugcc

SEQ ID NO: 2114698 - RNA, 16 nt, Human
gaaagaucaaaagguu

SEQ ID NO: 2114699 - RNA, 23 nt, Human
gaaagauggcugugccucugccu

SEQ ID NO: 2114700 - RNA, 12 nt, Human
gaaagauuugua

SEQ ID NO: 2114701 - RNA, 14 nt, Human
gaaagcaauaaaug

SEQ ID NO: 2114702 - RNA, 21 nt, Human
gaaagaugcucagguacagag

SEQ ID NO: 2114703 - RNA, 23 nt, Human
gaaagaugcucagguacagagaa

SEQ ID NO: 2114704 - RNA, 13 nt, Human
gaagaaaugaaau

SEQ ID NO: 2114705 - RNA, 14 nt, Human
gaagaaaugaaauu

SEQ ID NO: 2114706 - RNA, 15 nt, Human
gaagaaaugaaauuu

SEQ ID NO: 2114707 - RNA, 16 nt, Human
gaagaaaugaaauuuu

SEQ ID NO: 2114708 - RNA, 23 nt, Human
gaagaaaugaaauuuuaccaagu

SEQ ID NO: 2114709 - RNA, 13 nt, Human
gaagaacauagaa

SEQ ID NO: 2114710 - RNA, 16 nt, Human
gaagaacauccaagga

SEQ ID NO: 2114711 - RNA, 17 nt, Human
gaagaacauccaaggag

SEQ ID NO: 2114712 - RNA, 20 nt, Human
gaagaacauccaaggagaaa

SEQ ID NO: 2114713 - RNA, 14 nt, Human
gaagaagcucucuc

SEQ ID NO: 2114714 - RNA, 12 nt, Human
gaagaaggaaau

SEQ ID NO: 2114715 - RNA, 21 nt, Human
gaagaaggaaaugaauuucuc

SEQ ID NO: 2114716 - RNA, 17 nt, Human
gaacuuggggaacaagg

SEQ ID NO: 2114717 - RNA, 17 nt, Human
gaacuugggccacugug

SEQ ID NO: 2114718 - RNA, 24 nt, Human
gaacuuuccacauucagagcuuac

SEQ ID NO: 2114719 - RNA, 18 nt, Human
gaaccacaucuugcucug

SEQ ID NO: 2114720 - RNA, 20 nt, Human
gaaccacaucuugcucugcu

SEQ ID NO: 2114721 - RNA, 23 nt, Human
gaaccaaguggaccuugagacca

SEQ ID NO: 2114722 - RNA, 24 nt, Human
gaaccaaguggaccuugagaccac

SEQ ID NO: 2114723 - RNA, 16 nt, Human
gaacuccuaaaucaag

SEQ ID NO: 2114724 - RNA, 13 nt, Human
gaaccaauauuug

SEQ ID NO: 2114725 - RNA, 17 nt, Human
gaacugugccuuugagu

SEQ ID NO: 2114726 - RNA, 15 nt, Human
gaacuccuaaaucaa

SEQ ID NO: 2114727 - RNA, 15 nt, Human
gaacuuaaauaaaug

SEQ ID NO: 2114728 - RNA, 18 nt, Human
gaacuuaaauaaauguca

SEQ ID NO: 2114729 - RNA, 18 nt, Human
gaagaucguuaguaucua

SEQ ID NO: 2114730 - RNA, 19 nt, Human
gaagaucacuuugcucuga

SEQ ID NO: 2114731 - RNA, 17 nt, Human
gaagaguggguuucaca

SEQ ID NO: 2114732 - RNA, 18 nt, Human
gaagaguggguuucacaa

SEQ ID NO: 2114733 - RNA, 14 nt, Human
gaagagugagaggg

SEQ ID NO: 2114734 - RNA, 16 nt, Human
gaagagugagagggca

SEQ ID NO: 2114735 - RNA, 16 nt, Human
gaagagucuggaggga

SEQ ID NO: 2114736 - RNA, 14 nt, Human
gaagauaucuugaa

SEQ ID NO: 2114737 - RNA, 20 nt, Human
gaagauaggcucugcacaga

SEQ ID NO: 2114738 - RNA, 15 nt, Human
gaagaugacuuccca

SEQ ID NO: 2114739 - RNA, 18 nt, Human
gaagaauacaaacauauu

SEQ ID NO: 2114740 - RNA, 19 nt, Human
gaagaauacaaacauauuu

SEQ ID NO: 2114741 - RNA, 12 nt, Human
gaagagccuugc

SEQ ID NO: 2114742 - RNA, 17 nt, Human
gaagaggaacugggccu

SEQ ID NO: 2114743 - RNA, 17 nt, Human
gaagagcuauuauauaa

SEQ ID NO: 2114744 - RNA, 19 nt, Human
gaaggaaagaaagaaggaa

SEQ ID NO: 2114745 - RNA, 22 nt, Human
gaagcuuauuaaugcuaagggc

SEQ ID NO: 2114746 - RNA, 15 nt, Human
gaaggaaagaugcuc

SEQ ID NO: 2114747 - RNA, 17 nt, Human
gaaggaaauaaaaaagu

SEQ ID NO: 2114748 - RNA, 23 nt, Human
gaaggaaauaaaaaagucucuau

SEQ ID NO: 2114749 - RNA, 15 nt, Human
gaaggaaaugaauuu

SEQ ID NO: 2114750 - RNA, 20 nt, Human
gaaggaaaugaauuucucua

SEQ ID NO: 2114751 - RNA, 13 nt, Human
gaaggaagacuuu

SEQ ID NO: 2114752 - RNA, 23 nt, Human
gaaggaaggagacucaccucugc

SEQ ID NO: 2114753 - RNA, 16 nt, Human
gaaggaagugaagagg

SEQ ID NO: 2114754 - RNA, 22 nt, Human
gaaggacccggaggggccuggc

SEQ ID NO: 2114755 - RNA, 16 nt, Human
gaaggacaaggcuaga

SEQ ID NO: 2114756 - RNA, 12 nt, Human
gaaggaggagag

SEQ ID NO: 2114757 - RNA, 15 nt, Human
gaaggaggaggagga

SEQ ID NO: 2114758 - RNA, 21 nt, Human
gaaggacauugcggacagcca

SEQ ID NO: 2114759 - RNA, 20 nt, Human
gaaggacauugcggacagcc

SEQ ID NO: 2114760 - RNA, 22 nt, Human
gaaggaauaaauugcuccuuga

SEQ ID NO: 2114761 - RNA, 16 nt, Human
gaaggaaugucuuugg

SEQ ID NO: 2114762 - RNA, 15 nt, Human
gaaggaauugacuuc

SEQ ID NO: 2114763 - RNA, 19 nt, Human
gaaggacauugcggacagc

SEQ ID NO: 2114764 - RNA, 23 nt, Human
gaagcuguguccuugcaccugca

SEQ ID NO: 2114765 - RNA, 24 nt, Human
gaagcuguguccuugcaccugcau

SEQ ID NO: 2114766 - RNA, 14 nt, Human
gaagcuuauuaaug

SEQ ID NO: 2114767 - RNA, 15 nt, Human
gaagcuuauuaaugc

SEQ ID NO: 2114768 - RNA, 16 nt, Human
gaagcuuauuaaugcu

SEQ ID NO: 2114769 - RNA, 17 nt, Human
gaagcuuauuaaugcua

SEQ ID NO: 2114770 - RNA, 19 nt, Human
gaagcuuauuaaugcuaag

SEQ ID NO: 2114771 - RNA, 20 nt, Human
gaagcuuauuaaugcuaagg

SEQ ID NO: 2114772 - RNA, 21 nt, Human
gaagcuuauuaaugcuaaggg

SEQ ID NO: 2114773 - RNA, 23 nt, Human
gaagcuuauuaaugcuaagggca

SEQ ID NO: 2114774 - RNA, 14 nt, Human
gaagccgcugcugg

SEQ ID NO: 2114775 - RNA, 16 nt, Human
gaagccgccaggaccg

SEQ ID NO: 2114776 - RNA, 23 nt, Human
gaagccgccaggaccgccaaaga

SEQ ID NO: 2114777 - RNA, 12 nt, Human
gaagccugaggc

SEQ ID NO: 2114778 - RNA, 13 nt, Human
gaagccugaggcu

SEQ ID NO: 2114779 - RNA, 15 nt, Human
gaagccugcaggagu

SEQ ID NO: 2114780 - RNA, 21 nt, Human
gaagauuugcccauuuacacu

SEQ ID NO: 2114781 - RNA, 18 nt, Human
gaaggaggaggaggaggu

SEQ ID NO: 2114782 - RNA, 14 nt, Human
gaaggaggcuggcu

SEQ ID NO: 2114783 - RNA, 19 nt, Human
gaaggaggguuagggaggg

SEQ ID NO: 2114784 - RNA, 16 nt, Human
gaaggaugagcauuua

SEQ ID NO: 2114785 - RNA, 14 nt, Human
gaaggaugcugucu

SEQ ID NO: 2114786 - RNA, 22 nt, Human
gaaggaucuguuuuuaaaaauc

SEQ ID NO: 2114787 - RNA, 14 nt, Human
gaaggaugagcauu

SEQ ID NO: 2114788 - RNA, 15 nt, Human
gaaggauguacauuu

SEQ ID NO: 2114789 - RNA, 16 nt, Human
gaaggauguacauuuc

SEQ ID NO: 2114790 - RNA, 17 nt, Human
gaaggauguacauuucc

SEQ ID NO: 2114791 - RNA, 20 nt, Human
gaaggauguacauuuccaaa

SEQ ID NO: 2114792 - RNA, 12 nt, Human
gaaggggcugga

SEQ ID NO: 2114793 - RNA, 19 nt, Human
gaaggggcuggacuggcug

SEQ ID NO: 2114794 - RNA, 20 nt, Human
gaaggggcuggacuggcugu

SEQ ID NO: 2114795 - RNA, 23 nt, Human
gaaggggcccugguccuuccagg

SEQ ID NO: 2114796 - RNA, 14 nt, Human
gaaggccacagcaa

SEQ ID NO: 2114797 - RNA, 18 nt, Human
gaaggcaugccuggacaa

SEQ ID NO: 2114798 - RNA, 12 nt, Human
gaaggcaaaaaa

SEQ ID NO: 2114799 - RNA, 13 nt, Human
gaaggucuugauu

SEQ ID NO: 2114800 - RNA, 15 nt, Human
gaaggucuugauuug

SEQ ID NO: 2114801 - RNA, 17 nt, Human
gaaggucuugauuuguu

SEQ ID NO: 2114802 - RNA, 23 nt, Human
gaaggucuugauuuguuuuagaa

SEQ ID NO: 2114803 - RNA, 22 nt, Human
gaagggggccaugaggccucag

SEQ ID NO: 2114804 - RNA, 17 nt, Human
gaaggucaccugagccc

SEQ ID NO: 2114805 - RNA, 19 nt, Human
gaagggggcaucuggccuu

SEQ ID NO: 2114806 - RNA, 14 nt, Human
gaagggggccauga

SEQ ID NO: 2114807 - RNA, 20 nt, Human
gaagggggccaugaggccuc

SEQ ID NO: 2114808 - RNA, 13 nt, Human
gaagucacacagu

SEQ ID NO: 2114809 - RNA, 17 nt, Human
gaaguaacuugucuuaa

SEQ ID NO: 2114810 - RNA, 20 nt, Human
gaaguaacuugucuuaaaua

SEQ ID NO: 2114811 - RNA, 15 nt, Human
gaagucaaacauuuc

SEQ ID NO: 2114812 - RNA, 15 nt, Human
gaagucacugcacag

SEQ ID NO: 2114813 - RNA, 18 nt, Human
gaagucacucaauuguuu

SEQ ID NO: 2114814 - RNA, 20 nt, Human
gaagucacucaauuguuuuu

SEQ ID NO: 2114815 - RNA, 18 nt, Human
gaagucuuagauguauau

SEQ ID NO: 2114816 - RNA, 17 nt, Human
gaaguccccaggcccca

SEQ ID NO: 2114817 - RNA, 16 nt, Human
gaaguccccaggcccc

SEQ ID NO: 2114818 - RNA, 23 nt, Human
gaaguccccaggccccaggaagc

SEQ ID NO: 2114819 - RNA, 14 nt, Human
gagccgugaugccu

SEQ ID NO: 2114820 - RNA, 20 nt, Human
gagccgagaucgcgccacug

SEQ ID NO: 2114821 - RNA, 21 nt, Human
gagccgcaucuucuccaucug

SEQ ID NO: 2114822 - RNA, 22 nt, Human
gagccgcaucuucuccaucugg

SEQ ID NO: 2114823 - RNA, 22 nt, Human
gagccgagaucacgccacugca

SEQ ID NO: 2114824 - RNA, 21 nt, Human
gagccgagaucacgccacugc

SEQ ID NO: 2114825 - RNA, 20 nt, Human
gagccgagaucacgccacug

SEQ ID NO: 2114826 - RNA, 19 nt, Human
gagccgagaucacgccacu

SEQ ID NO: 2114827 - RNA, 15 nt, Human
gagccucagcauccu

SEQ ID NO: 2114828 - RNA, 14 nt, Human
gagccucagcaucc

SEQ ID NO: 2114829 - RNA, 17 nt, Human
gagccucagcauccugg

SEQ ID NO: 2114830 - RNA, 13 nt, Human
gagccucagcauc

SEQ ID NO: 2114831 - RNA, 12 nt, Human
gagccugcaguu

SEQ ID NO: 2114832 - RNA, 18 nt, Human
gagccuccuuucuggcuu

SEQ ID NO: 2114833 - RNA, 18 nt, Human
gagccugaaauagugguu

SEQ ID NO: 2114834 - RNA, 17 nt, Human
gagccucauccgaggca

SEQ ID NO: 2114835 - RNA, 18 nt, Human
gagccucauccgaggcag

SEQ ID NO: 2114836 - RNA, 19 nt, Human
gagccucauccgaggcagg

SEQ ID NO: 2114837 - RNA, 20 nt, Human
gagccucauccgaggcaggg

SEQ ID NO: 2114838 - RNA, 18 nt, Human
gagagugcaacaguagca

SEQ ID NO: 2114839 - RNA, 21 nt, Human
gagauaccaagaugccaucug

SEQ ID NO: 2114840 - RNA, 17 nt, Human
gagauaccaagaugcca

SEQ ID NO: 2114841 - RNA, 15 nt, Human
gagauaauaugagaa

SEQ ID NO: 2114842 - RNA, 13 nt, Human
gagcagaggcagc

SEQ ID NO: 2114843 - RNA, 20 nt, Human
gagccacugcaccgggccac

SEQ ID NO: 2114844 - RNA, 13 nt, Human
gagccacugcacc

SEQ ID NO: 2114845 - RNA, 16 nt, Human
gagcagccuguggcau

SEQ ID NO: 2114846 - RNA, 18 nt, Human
gagcagccuguggcaucu

SEQ ID NO: 2114847 - RNA, 11 nt, Human
gagcagccugu

SEQ ID NO: 2114848 - RNA, 13 nt, Human
gagcagccugugg

SEQ ID NO: 2114849 - RNA, 14 nt, Human
gagcagccuguggc

SEQ ID NO: 2114850 - RNA, 15 nt, Human
gagcagccuguggca

SEQ ID NO: 2114851 - RNA, 19 nt, Human
gagccacugcaccgggcca

SEQ ID NO: 2114852 - RNA, 18 nt, Human
gagccacugcaccgggcc

SEQ ID NO: 2114853 - RNA, 17 nt, Human
gagcccaccuuggcuca

SEQ ID NO: 2114854 - RNA, 15 nt, Human
gagcccaccuuggcu

SEQ ID NO: 2114855 - RNA, 13 nt, Human
gagcccaccuugg

SEQ ID NO: 2114856 - RNA, 12 nt, Human
gagccaggccug

SEQ ID NO: 2114857 - RNA, 21 nt, Human
gagccaggccugggucugugu

SEQ ID NO: 2114858 - RNA, 22 nt, Human
gagccaggccugggucuguguc

SEQ ID NO: 2114859 - RNA, 19 nt, Human
gagccagcccucccugucc

SEQ ID NO: 2114860 - RNA, 20 nt, Human
gagccagcccucccuguccu

SEQ ID NO: 2114861 - RNA, 21 nt, Human
gagccagcccucccuguccuc

SEQ ID NO: 2114862 - RNA, 15 nt, Human
gagcuagcagcaggg

SEQ ID NO: 2114863 - RNA, 17 nt, Human
gagcuagcagcagggag

SEQ ID NO: 2114864 - RNA, 14 nt, Human
gagcuagcgcugcc

SEQ ID NO: 2114865 - RNA, 18 nt, Human
gagcuagcgcugccgcac

SEQ ID NO: 2114866 - RNA, 19 nt, Human
gagcuagcgcugccgcacc

SEQ ID NO: 2114867 - RNA, 23 nt, Human
gagcuagcgcugccgcaccccag

SEQ ID NO: 2114868 - RNA, 15 nt, Human
gagccugcaguuauu

SEQ ID NO: 2114869 - RNA, 14 nt, Human
gagcuauacaguuu

SEQ ID NO: 2114870 - RNA, 19 nt, Human
gagcuauacaguuuuccua

SEQ ID NO: 2114871 - RNA, 20 nt, Human
gagcuauacaguuuuccuaa

SEQ ID NO: 2114872 - RNA, 23 nt, Human
gagcuauauuuaaguauucaaga

SEQ ID NO: 2114873 - RNA, 13 nt, Human
gagcuccagaccc

SEQ ID NO: 2114874 - RNA, 15 nt, Human
gagcuccagaccccc

SEQ ID NO: 2114875 - RNA, 17 nt, Human
gagcuccagacccccag

SEQ ID NO: 2114876 - RNA, 19 nt, Human
gagcuccagacccccagca

SEQ ID NO: 2114877 - RNA, 22 nt, Human
gagcuccagacccccagcaacc

SEQ ID NO: 2114878 - RNA, 15 nt, Human
gagcucagaccccca

SEQ ID NO: 2114879 - RNA, 14 nt, Human
gagcucagaccccc

SEQ ID NO: 2114880 - RNA, 18 nt, Human
gagcucagacccccacuc

SEQ ID NO: 2114881 - RNA, 20 nt, Human
gagcucagacccccacucuc

SEQ ID NO: 2114882 - RNA, 21 nt, Human
gagcucagacccccacucuca

SEQ ID NO: 2114883 - RNA, 20 nt, Human
gagcuccagacccccagcaa

SEQ ID NO: 2114884 - RNA, 14 nt, Human
gagcuccaguggaa

SEQ ID NO: 2114885 - RNA, 15 nt, Human
gagcucgguggaccc

SEQ ID NO: 2114886 - RNA, 15 nt, Human
gagcugaguggggga

SEQ ID NO: 2114887 - RNA, 17 nt, Human
gagcugaggcaauucua

SEQ ID NO: 2114888 - RNA, 13 nt, Human
gagcugacaaaau

SEQ ID NO: 2114889 - RNA, 16 nt, Human
gagcugacaaaauuuu

SEQ ID NO: 2114890 - RNA, 17 nt, Human
gagcugacaaaauuuug

SEQ ID NO: 2114891 - RNA, 15 nt, Human
gagcugagaauagaa

SEQ ID NO: 2114892 - RNA, 19 nt, Human
gagcugagaauagaaggaa

SEQ ID NO: 2114893 - RNA, 20 nt, Human
gagcugagaauagaaggaaa

SEQ ID NO: 2114894 - RNA, 10 nt, Human
gagcugagau

SEQ ID NO: 2114895 - RNA, 20 nt, Human
gagcugagaucgcgccacug

SEQ ID NO: 2114896 - RNA, 13 nt, Human
gagcugagaucgu

SEQ ID NO: 2114897 - RNA, 16 nt, Human
gagcugagcagggaga

SEQ ID NO: 2114898 - RNA, 13 nt, Human
gagcugagaugga

SEQ ID NO: 2114899 - RNA, 13 nt, Human
gagcugagcaggg

SEQ ID NO: 2114900 - RNA, 13 nt, Human
gaggaaaggccag

SEQ ID NO: 2114901 - RNA, 14 nt, Human
gaggaaaggccagc

SEQ ID NO: 2114902 - RNA, 19 nt, Human
gaggaaaggccagcuggca

SEQ ID NO: 2114903 - RNA, 23 nt, Human
gaggaaacucaccugcuggcccc

SEQ ID NO: 2114904 - RNA, 14 nt, Human
gaggaaacucagag

SEQ ID NO: 2114905 - RNA, 23 nt, Human
gaggaaaggccagcuggcagcag

SEQ ID NO: 2114906 - RNA, 14 nt, Human
gaggaaccagagcc

SEQ ID NO: 2114907 - RNA, 15 nt, Human
gaggaaccagagcca

SEQ ID NO: 2114908 - RNA, 18 nt, Human
gaggaaccagagccaugg

SEQ ID NO: 2114909 - RNA, 22 nt, Human
gaggaaccagagccauggacuc

SEQ ID NO: 2114910 - RNA, 15 nt, Human
gaggaaccgaaaggc

SEQ ID NO: 2114911 - RNA, 14 nt, Human
gaggaacugggccu

SEQ ID NO: 2114912 - RNA, 17 nt, Human
gaggaagagaaaaaaua

SEQ ID NO: 2114913 - RNA, 13 nt, Human
gaggaagagcagg

SEQ ID NO: 2114914 - RNA, 17 nt, Human
gaggaagagcaggcaca

SEQ ID NO: 2114915 - RNA, 19 nt, Human
gaggaagagcaggcacaug

SEQ ID NO: 2114916 - RNA, 19 nt, Human
gaggaagagugcaaaacau

SEQ ID NO: 2114917 - RNA, 14 nt, Human
gaggaaacucaccu

SEQ ID NO: 2114918 - RNA, 17 nt, Human
gaggaaacucaccugcu

SEQ ID NO: 2114919 - RNA, 20 nt, Human
gaggaaacucaccugcuggc

SEQ ID NO: 2114920 - RNA, 22 nt, Human
gaggaaacucaccugcuggccc

SEQ ID NO: 2114921 - RNA, 23 nt, Human
gaggaaaaccaagccguggcuuc

SEQ ID NO: 2114922 - RNA, 21 nt, Human
gaggaaaaccaagccguggcu

SEQ ID NO: 2114923 - RNA, 20 nt, Human
gaggaaaaccaagccguggc

SEQ ID NO: 2114924 - RNA, 14 nt, Human
gagcuuuggacaca

SEQ ID NO: 2114925 - RNA, 21 nt, Human
gagcuuuggacacacacagcu

SEQ ID NO: 2114926 - RNA, 18 nt, Human
gagcuuuggacgcacaca

SEQ ID NO: 2114927 - RNA, 20 nt, Human
gagcuuugaaaauucagugg

SEQ ID NO: 2114928 - RNA, 21 nt, Human
gagcuuucuguccuuuuggca

SEQ ID NO: 2114929 - RNA, 23 nt, Human
gagcuuucuguccuuuuggcacu

SEQ ID NO: 2114930 - RNA, 22 nt, Human
gagcuuucugcuaucaaagagg

SEQ ID NO: 2114931 - RNA, 20 nt, Human
gagcuugggggaugacuaga

SEQ ID NO: 2114932 - RNA, 22 nt, Human
gagcuuuauguaauaaugugaa

SEQ ID NO: 2114933 - RNA, 15 nt, Human
gagcuuucaaagaag

SEQ ID NO: 2114934 - RNA, 18 nt, Human
gagcuuucaaagaaggaa

SEQ ID NO: 2114935 - RNA, 17 nt, Human
gagcugccuaagaggca

SEQ ID NO: 2114936 - RNA, 19 nt, Human
gagcugccuaagaggcaau

SEQ ID NO: 2114937 - RNA, 16 nt, Human
gagcuuuacaaaaaga

SEQ ID NO: 2114938 - RNA, 19 nt, Human
gagcuuuacaaaaagacac

SEQ ID NO: 2114939 - RNA, 14 nt, Human
gagcuuggccagaa

SEQ ID NO: 2114940 - RNA, 15 nt, Human
gagcuuggccagaag

SEQ ID NO: 2114941 - RNA, 18 nt, Human
gagaauugcuugaaccca

SEQ ID NO: 2114942 - RNA, 18 nt, Human
gagaauucuuacauguuu

SEQ ID NO: 2114943 - RNA, 22 nt, Human
gagaauucuuacauguuuucuu

SEQ ID NO: 2114944 - RNA, 15 nt, Human
gagaauuuuaaauua

SEQ ID NO: 2114945 - RNA, 16 nt, Human
gagaauuuuaaauuau

SEQ ID NO: 2114946 - RNA, 15 nt, Human
gagaauuguaucauu

SEQ ID NO: 2114947 - RNA, 21 nt, Human
gagaauuguaucauuugaaca

SEQ ID NO: 2114948 - RNA, 11 nt, Human
gagacaaaaau

SEQ ID NO: 2114949 - RNA, 15 nt, Human
gagacaaaaauuauc

SEQ ID NO: 2114950 - RNA, 20 nt, Human
gagacaaaaauuaucuauuu

SEQ ID NO: 2114951 - RNA, 16 nt, Human
gagacaaauggaggcc

SEQ ID NO: 2114952 - RNA, 16 nt, Human
gagacaaugcagaugc

SEQ ID NO: 2114953 - RNA, 17 nt, Human
gagacaaugcagaugcc

SEQ ID NO: 2114954 - RNA, 18 nt, Human
gagacaaugcagaugcca

SEQ ID NO: 2114955 - RNA, 21 nt, Human
gagacaaugcagaugccagag

SEQ ID NO: 2114956 - RNA, 23 nt, Human
gagacaaugcagaugccagagca

SEQ ID NO: 2114957 - RNA, 14 nt, Human
gagacagagcuggu

SEQ ID NO: 2114958 - RNA, 20 nt, Human
gagacagacagagaaggcag

SEQ ID NO: 2114959 - RNA, 19 nt, Human
gagacagaguuuucacucu

SEQ ID NO: 2114960 - RNA, 22 nt, Human
gagacagagaggacgugggcgg

SEQ ID NO: 2114961 - RNA, 20 nt, Human
gagacaccugcaccuccccc

SEQ ID NO: 2114962 - RNA, 21 nt, Human
gagacaccugcaccucccccc

SEQ ID NO: 2114963 - RNA, 20 nt, Human
gagacacuaacgacuucagg

SEQ ID NO: 2114964 - RNA, 17 nt, Human
gagacacagggcaucca

SEQ ID NO: 2114965 - RNA, 12 nt, Human
gagacaccucag

SEQ ID NO: 2114966 - RNA, 13 nt, Human
gagacaccucaga

SEQ ID NO: 2114967 - RNA, 16 nt, Human
gagacaccucagagcc

SEQ ID NO: 2114968 - RNA, 19 nt, Human
gagacaccucagagccccg

SEQ ID NO: 2114969 - RNA, 21 nt, Human
gagacaccucagagccccgca

SEQ ID NO: 2114970 - RNA, 13 nt, Human
gagacaccugcac

SEQ ID NO: 2114971 - RNA, 15 nt, Human
gagacaccugcaccu

SEQ ID NO: 2114972 - RNA, 17 nt, Human
gagacaccugcaccucc

SEQ ID NO: 2114973 - RNA, 18 nt, Human
gagacaccugcaccuccc

SEQ ID NO: 2114974 - RNA, 19 nt, Human
gagacaccugcaccucccc

SEQ ID NO: 2114975 - RNA, 13 nt, Human
gagaaugaggguc

SEQ ID NO: 2114976 - RNA, 17 nt, Human
gagaaugagggccaaga

SEQ ID NO: 2114977 - RNA, 18 nt, Human
gagaauucagcugccccc

SEQ ID NO: 2114978 - RNA, 16 nt, Human
gagaauucuuacaugu

SEQ ID NO: 2114979 - RNA, 23 nt, Human
gagaagcaagaaagaaacccgac

SEQ ID NO: 2114980 - RNA, 15 nt, Human
gagaagaauauuguu

SEQ ID NO: 2114981 - RNA, 19 nt, Human
gagaagaauauuguuccua

SEQ ID NO: 2114982 - RNA, 12 nt, Human
gagaaaauugaa

SEQ ID NO: 2114983 - RNA, 13 nt, Human
gagaaaauugaau

SEQ ID NO: 2114984 - RNA, 14 nt, Human
gagaaaauugaauu

SEQ ID NO: 2114985 - RNA, 15 nt, Human
gagaaaauugaauuu

SEQ ID NO: 2114986 - RNA, 18 nt, Human
gagaaaauugaauuuaac

SEQ ID NO: 2114987 - RNA, 19 nt, Human
gagaaaauugaauuuaaca

SEQ ID NO: 2114988 - RNA, 13 nt, Human
gagaaacagagac

SEQ ID NO: 2114989 - RNA, 14 nt, Human
gagaaacagagaca

SEQ ID NO: 2114990 - RNA, 18 nt, Human
gacuuguuuuaugcucag

SEQ ID NO: 2114991 - RNA, 16 nt, Human
gacuuggaagcuccgc

SEQ ID NO: 2114992 - RNA, 15 nt, Human
gacuuggaagcuccg

SEQ ID NO: 2114993 - RNA, 14 nt, Human
gacuuggaagcucc

SEQ ID NO: 2114994 - RNA, 23 nt, Human
gagaaaguacuucuccacccugc

SEQ ID NO: 2114995 - RNA, 18 nt, Human
gagaaagaaguaggcaug

SEQ ID NO: 2114996 - RNA, 18 nt, Human
gagaaagugugagcaaac

SEQ ID NO: 2114997 - RNA, 17 nt, Human
gagaacauguugguauu

SEQ ID NO: 2114998 - RNA, 20 nt, Human
gagaacagaucuccaaagcu

SEQ ID NO: 2114999 - RNA, 21 nt, Human
gagaacagaucuccaaagcuu

SEQ ID NO: 2115000 - RNA, 19 nt, Human
gagaaccacuacaugcagc

SEQ ID NO: 2115001 - RNA, 23 nt, Human
gagaaaccuuauuguaccucucu

SEQ ID NO: 2115002 - RNA, 21 nt, Human
gagaaaccuuauuguaccucu

SEQ ID NO: 2115003 - RNA, 12 nt, Human
gagaaacccugu

SEQ ID NO: 2115004 - RNA, 22 nt, Human
gagaaaccguccucuuuuucca

SEQ ID NO: 2115005 - RNA, 19 nt, Human
gagaaacagagacaggccc

SEQ ID NO: 2115006 - RNA, 21 nt, Human
gagagggcaugcgcacaaggc

SEQ ID NO: 2115007 - RNA, 13 nt, Human
gagagccuggugc

SEQ ID NO: 2115008 - RNA, 17 nt, Human
gagagccuggugcugcu

SEQ ID NO: 2115009 - RNA, 11 nt, Human
gagagccuggu

SEQ ID NO: 2115010 - RNA, 19 nt, Human
gagagccuggugcugcugc

SEQ ID NO: 2115011 - RNA, 18 nt, Human
gagaggggaacagacugg

SEQ ID NO: 2115012 - RNA, 13 nt, Human
gagaggggaacag

SEQ ID NO: 2115013 - RNA, 17 nt, Human
gagagguugucuguggc

SEQ ID NO: 2115014 - RNA, 14 nt, Human
gagagucugucuca

SEQ ID NO: 2115015 - RNA, 19 nt, Human
gagagguuauaggucacuc

SEQ ID NO: 2115016 - RNA, 15 nt, Human
gagagucuugcagug

SEQ ID NO: 2115017 - RNA, 17 nt, Human
gagagucuugcagugau

SEQ ID NO: 2115018 - RNA, 18 nt, Human
gagaggucaagcccagga

SEQ ID NO: 2115019 - RNA, 19 nt, Human
gagaggucaagcccaggag

SEQ ID NO: 2115020 - RNA, 24 nt, Human
gagaggucaagcccaggaggacug

SEQ ID NO: 2115021 - RNA, 17 nt, Human
gagaggucuuuuuuaaa

SEQ ID NO: 2115022 - RNA, 11 nt, Human
gagagcccagc

SEQ ID NO: 2115023 - RNA, 13 nt, Human
gagagcccagcca

SEQ ID NO: 2115024 - RNA, 23 nt, Human
gagagccugcucccccacccccu

SEQ ID NO: 2115025 - RNA, 13 nt, Human
gagagccugcugc

SEQ ID NO: 2115026 - RNA, 14 nt, Human
gagagccugcugca

SEQ ID NO: 2115027 - RNA, 11 nt, Human
gagagccagcc

SEQ ID NO: 2115028 - RNA, 12 nt, Human
gagagccagccc

SEQ ID NO: 2115029 - RNA, 13 nt, Human
gagagccagcccu

SEQ ID NO: 2115030 - RNA, 14 nt, Human
gagagccagcccuc

SEQ ID NO: 2115031 - RNA, 20 nt, Human
gagagccagcccucccuguc

SEQ ID NO: 2115032 - RNA, 10 nt, Human
gagagcccag

SEQ ID NO: 2115033 - RNA, 12 nt, Human
gagagaggggaa

SEQ ID NO: 2115034 - RNA, 19 nt, Human
gagacuuuuugguggaugu

SEQ ID NO: 2115035 - RNA, 21 nt, Human
gagacuuuuugguggauguaa

SEQ ID NO: 2115036 - RNA, 12 nt, Human
gagagaagggga

SEQ ID NO: 2115037 - RNA, 15 nt, Human
gagagaaggggagga

SEQ ID NO: 2115038 - RNA, 17 nt, Human
gagagaaggggaggagg

SEQ ID NO: 2115039 - RNA, 16 nt, Human
gagagaaggggaggag

SEQ ID NO: 2115040 - RNA, 13 nt, Human
gagagaagugccc

SEQ ID NO: 2115041 - RNA, 21 nt, Human
gagagaagugccccugcugcc

SEQ ID NO: 2115042 - RNA, 18 nt, Human
gagagaagugccccugcu

SEQ ID NO: 2115043 - RNA, 13 nt, Human
gagagacaagaag

SEQ ID NO: 2115044 - RNA, 17 nt, Human
gagagacaagaagcaaa

SEQ ID NO: 2115045 - RNA, 13 nt, Human
gagacuuguauga

SEQ ID NO: 2115046 - RNA, 17 nt, Human
gagacuguuuugaauuu

SEQ ID NO: 2115047 - RNA, 23 nt, Human
gagacugucucaagagggcacug

SEQ ID NO: 2115048 - RNA, 22 nt, Human
gagacugcgggaugguccuggg

SEQ ID NO: 2115049 - RNA, 23 nt, Human
gagacugcgggaugguccugggg

SEQ ID NO: 2115050 - RNA, 22 nt, Human
gagacugucucaagagggcacu

SEQ ID NO: 2115051 - RNA, 14 nt, Human
gagacucugucuca

SEQ ID NO: 2115052 - RNA, 19 nt, Human
gagacugcgggaugguccu

SEQ ID NO: 2115053 - RNA, 12 nt, Human
gagacucugugg

SEQ ID NO: 2115054 - RNA, 23 nt, Human
gagacucuguggggccuugguuc

SEQ ID NO: 2115055 - RNA, 14 nt, Human
gagaccagccuggc

SEQ ID NO: 2115056 - RNA, 18 nt, Human
gagaccaaggcgggagca

SEQ ID NO: 2115057 - RNA, 16 nt, Human
gagaccagccugggca

SEQ ID NO: 2115058 - RNA, 19 nt, Human
gagaccagccugggcagca

SEQ ID NO: 2115059 - RNA, 13 nt, Human
gagaccagccugg

SEQ ID NO: 2115060 - RNA, 16 nt, Human
gagaccaaccugacca

SEQ ID NO: 2115061 - RNA, 17 nt, Human
gagaccaaccugaccaa

SEQ ID NO: 2115062 - RNA, 22 nt, Human
gagaccaagacucugaaaucuc

SEQ ID NO: 2115063 - RNA, 23 nt, Human
gagaccaagacucugaaaucuca

SEQ ID NO: 2115064 - RNA, 19 nt, Human
gagacauaaccacugcuuc

SEQ ID NO: 2115065 - RNA, 14 nt, Human
gagaccaaccugac

SEQ ID NO: 2115066 - RNA, 15 nt, Human
gagaccaaccugacc

SEQ ID NO: 2115067 - RNA, 18 nt, Human
gagacauuccaaaacgaa

SEQ ID NO: 2115068 - RNA, 18 nt, Human
gacacaggcccggcucca

SEQ ID NO: 2115069 - RNA, 13 nt, Human
gacacaaaaaaag

SEQ ID NO: 2115070 - RNA, 17 nt, Human
gacaccuacugaguggc

SEQ ID NO: 2115071 - RNA, 20 nt, Human
gacaccugcaccucccccca

SEQ ID NO: 2115072 - RNA, 22 nt, Human
gacaccugcaccuccccccacu

SEQ ID NO: 2115073 - RNA, 13 nt, Human
gacaccugcaccu

SEQ ID NO: 2115074 - RNA, 15 nt, Human
gacaccugcaccucc

SEQ ID NO: 2115075 - RNA, 16 nt, Human
gacaccugcaccuccc

SEQ ID NO: 2115076 - RNA, 17 nt, Human
gacaccugcaccucccc

SEQ ID NO: 2115077 - RNA, 19 nt, Human
gacaccugcaccucccccc

SEQ ID NO: 2115078 - RNA, 11 nt, Human
gacaccucaga

SEQ ID NO: 2115079 - RNA, 13 nt, Human
gacaccucagagc

SEQ ID NO: 2115080 - RNA, 18 nt, Human
gacacuaaccacgcugga

SEQ ID NO: 2115081 - RNA, 17 nt, Human
gacacuaaccacgcugg

SEQ ID NO: 2115082 - RNA, 16 nt, Human
gacacuaaccacgcug

SEQ ID NO: 2115083 - RNA, 15 nt, Human
gacacuaaccacgcu

SEQ ID NO: 2115084 - RNA, 14 nt, Human
gacacguccacccc

SEQ ID NO: 2115085 - RNA, 15 nt, Human
gacacggggcagugg

SEQ ID NO: 2115086 - RNA, 17 nt, Human
gacaccuugacagggca

SEQ ID NO: 2115087 - RNA, 15 nt, Human
gacaccuugacaggg

SEQ ID NO: 2115088 - RNA, 20 nt, Human
gacaccuugacagggcacac

SEQ ID NO: 2115089 - RNA, 18 nt, Human
gacaccuugacagggcac

SEQ ID NO: 2115090 - RNA, 16 nt, Human
gacaccuguacuggag

SEQ ID NO: 2115091 - RNA, 17 nt, Human
gacaccuguacuggaga

SEQ ID NO: 2115092 - RNA, 18 nt, Human
gacaccuguacuggagag

SEQ ID NO: 2115093 - RNA, 20 nt, Human
gacaccuguacuggagagca

SEQ ID NO: 2115094 - RNA, 12 nt, Human
gacaagccccag

SEQ ID NO: 2115095 - RNA, 15 nt, Human
gacaagccccaggca

SEQ ID NO: 2115096 - RNA, 22 nt, Human
gacaaggauugcuacuguccua

SEQ ID NO: 2115097 - RNA, 24 nt, Human
gacaagacuucgggaaggugucug

SEQ ID NO: 2115098 - RNA, 14 nt, Human
gacaauagaacauu

SEQ ID NO: 2115099 - RNA, 13 nt, Human
gacaauaauuuca

SEQ ID NO: 2115100 - RNA, 19 nt, Human
gacaauaauuucagguuuu

SEQ ID NO: 2115101 - RNA, 17 nt, Human
gacaaucaacucuaaua

SEQ ID NO: 2115102 - RNA, 20 nt, Human
gacaaucaugaaauaugcau

SEQ ID NO: 2115103 - RNA, 19 nt, Human
gacaaucaugaaauaugca

SEQ ID NO: 2115104 - RNA, 21 nt, Human
gacaaucaugaaauaugcauc

SEQ ID NO: 2115105 - RNA, 23 nt, Human
gacaagguagcccuggccagagg

SEQ ID NO: 2115106 - RNA, 14 nt, Human
gacaagguagcccu

SEQ ID NO: 2115107 - RNA, 21 nt, Human
gacaagguagcccuggccaga

SEQ ID NO: 2115108 - RNA, 23 nt, Human
gacaaggccccagagacucagag

SEQ ID NO: 2115109 - RNA, 16 nt, Human
gacaaggccccagaga

SEQ ID NO: 2115110 - RNA, 17 nt, Human
gacaaggccccagagac

SEQ ID NO: 2115111 - RNA, 16 nt, Human
gacaagccccaggcag

SEQ ID NO: 2115112 - RNA, 17 nt, Human
gacaagccccaggcagg

SEQ ID NO: 2115113 - RNA, 13 nt, Human
gacaaggccccag

SEQ ID NO: 2115114 - RNA, 14 nt, Human
gacaaggccccaga

SEQ ID NO: 2115115 - RNA, 22 nt, Human
gacaagguucuucccuuuuaca

SEQ ID NO: 2115116 - RNA, 19 nt, Human
gacaagugacuguaucugu

SEQ ID NO: 2115117 - RNA, 20 nt, Human
gacaagugacuguaucugug

SEQ ID NO: 2115118 - RNA, 17 nt, Human
gacacaggcccggcucc

SEQ ID NO: 2115119 - RNA, 15 nt, Human
gacacaggcccggcu

SEQ ID NO: 2115120 - RNA, 13 nt, Human
gacacacagcucu

SEQ ID NO: 2115121 - RNA, 13 nt, Human
gacacacacagcu

SEQ ID NO: 2115122 - RNA, 14 nt, Human
gacacacacagcuu

SEQ ID NO: 2115123 - RNA, 12 nt, Human
gacacacacaca

SEQ ID NO: 2115124 - RNA, 20 nt, Human
gacaaugaugaugauaauga

SEQ ID NO: 2115125 - RNA, 22 nt, Human
gacagcuucucauccugcaggc

SEQ ID NO: 2115126 - RNA, 21 nt, Human
gacagcuucucauccugcagg

SEQ ID NO: 2115127 - RNA, 15 nt, Human
gacagcugugcugua

SEQ ID NO: 2115128 - RNA, 18 nt, Human
gacaggagaccuggcacu

SEQ ID NO: 2115129 - RNA, 21 nt, Human
gacaggagaccuggcacugga

SEQ ID NO: 2115130 - RNA, 11 nt, Human
gacaggagaaa

SEQ ID NO: 2115131 - RNA, 12 nt, Human
gacaggagaaau

SEQ ID NO: 2115132 - RNA, 24 nt, Human
gacaggagaaaugcauccauuccu

SEQ ID NO: 2115133 - RNA, 15 nt, Human
gacaggaccugacua

SEQ ID NO: 2115134 - RNA, 20 nt, Human
gacaggacgggcuugggcuu

SEQ ID NO: 2115135 - RNA, 22 nt, Human
gacagcugucccugucaccaag

SEQ ID NO: 2115136 - RNA, 18 nt, Human
gacagcugucccugucac

SEQ ID NO: 2115137 - RNA, 19 nt, Human
gacagcugucccugucacc

SEQ ID NO: 2115138 - RNA, 14 nt, Human
gacagcugucccug

SEQ ID NO: 2115139 - RNA, 15 nt, Human
gacagcugucccugu

SEQ ID NO: 2115140 - RNA, 16 nt, Human
gacagcugucccuguc

SEQ ID NO: 2115141 - RNA, 17 nt, Human
gacagcugucccuguca

SEQ ID NO: 2115142 - RNA, 19 nt, Human
gacaggcauguucucugag

SEQ ID NO: 2115143 - RNA, 18 nt, Human
gacaggcauguucucuga

SEQ ID NO: 2115144 - RNA, 17 nt, Human
gacaggcaaugcuggcu

SEQ ID NO: 2115145 - RNA, 24 nt, Human
gacaggcaaugcuggcuguuggcu

SEQ ID NO: 2115146 - RNA, 16 nt, Human
gacaggcaaugcuggc

SEQ ID NO: 2115147 - RNA, 14 nt, Human
gacaggcaaugcug

SEQ ID NO: 2115148 - RNA, 23 nt, Human
gacagaucucugcuuuggaaauc

SEQ ID NO: 2115149 - RNA, 21 nt, Human
gacagaucucugcuuuggaaa

SEQ ID NO: 2115150 - RNA, 19 nt, Human
gacagaucucugcuuugga

SEQ ID NO: 2115151 - RNA, 20 nt, Human
gacagaucauagauuucuga

SEQ ID NO: 2115152 - RNA, 21 nt, Human
gacagaucauagauuucugau

SEQ ID NO: 2115153 - RNA, 23 nt, Human
gacagaucauagauuucugauuu

SEQ ID NO: 2115154 - RNA, 16 nt, Human
gacagacacaggcccg

SEQ ID NO: 2115155 - RNA, 15 nt, Human
gacagacacaggccc

SEQ ID NO: 2115156 - RNA, 21 nt, Human
gacacuaaccacgcuggaccu

SEQ ID NO: 2115157 - RNA, 20 nt, Human
gacacuaaccacgcuggacc

SEQ ID NO: 2115158 - RNA, 15 nt, Human
gacacguccacccca

SEQ ID NO: 2115159 - RNA, 14 nt, Human
gacagacacaggcc

SEQ ID NO: 2115160 - RNA, 13 nt, Human
gacagccacggcc

SEQ ID NO: 2115161 - RNA, 14 nt, Human
gacagaugccccag

SEQ ID NO: 2115162 - RNA, 18 nt, Human
gacagaugccccagagcu

SEQ ID NO: 2115163 - RNA, 19 nt, Human
gacagaugccccagagcug

SEQ ID NO: 2115164 - RNA, 13 nt, Human
gacagcauggugc

SEQ ID NO: 2115165 - RNA, 18 nt, Human
gacagcauggugcaugcc

SEQ ID NO: 2115166 - RNA, 21 nt, Human
gacagcauggugcaugccgcu

SEQ ID NO: 2115167 - RNA, 22 nt, Human
gacagcauggugcaugccgcug

SEQ ID NO: 2115168 - RNA, 21 nt, Human
gacaggcccaagagaugaaga

SEQ ID NO: 2115169 - RNA, 16 nt, Human
gacaggcccaagagau

SEQ ID NO: 2115170 - RNA, 14 nt, Human
gacaggcagaaaga

SEQ ID NO: 2115171 - RNA, 15 nt, Human
gacaggcagaaagag

SEQ ID NO: 2115172 - RNA, 18 nt, Human
gacaggcccaagagauga

SEQ ID NO: 2115173 - RNA, 22 nt, Human
gacaggcccaagagaugaagag

SEQ ID NO: 2115174 - RNA, 16 nt, Human
gacauaauuucacuga

SEQ ID NO: 2115175 - RNA, 13 nt, Human
gacauauucauuu

SEQ ID NO: 2115176 - RNA, 20 nt, Human
gacauauucauuuggaaaua

SEQ ID NO: 2115177 - RNA, 21 nt, Human
gacaucuguuucuaaauguuu

SEQ ID NO: 2115178 - RNA, 16 nt, Human
gacaucuuaguauuug

SEQ ID NO: 2115179 - RNA, 19 nt, Human
gacaucuuaguauuugcau

SEQ ID NO: 2115180 - RNA, 20 nt, Human
gacaucuucaaagcuugaag

SEQ ID NO: 2115181 - RNA, 21 nt, Human
gacaucuucaaagcuugaaga

SEQ ID NO: 2115182 - RNA, 22 nt, Human
gaccaaauuccuuggcaugccu

SEQ ID NO: 2115183 - RNA, 17 nt, Human
gaccaacaagggcagug

SEQ ID NO: 2115184 - RNA, 18 nt, Human
gaccaacaagggcagugg

SEQ ID NO: 2115185 - RNA, 16 nt, Human
gaccaacauggagaaa

SEQ ID NO: 2115186 - RNA, 23 nt, Human
gaccaaauuccuuggcaugccuu

SEQ ID NO: 2115187 - RNA, 17 nt, Human
gaccaacauggagaaac

SEQ ID NO: 2115188 - RNA, 17 nt, Human
gaccaaaaugacaauga

SEQ ID NO: 2115189 - RNA, 21 nt, Human
gaccaaaaugacaaugaugau

SEQ ID NO: 2115190 - RNA, 14 nt, Human
gaccaaaaaaauaa

SEQ ID NO: 2115191 - RNA, 17 nt, Human
gaccaaaaaaauaaggu

SEQ ID NO: 2115192 - RNA, 15 nt, Human
gacauggggaggaag

SEQ ID NO: 2115193 - RNA, 16 nt, Human
gacauggggaggaagg

SEQ ID NO: 2115194 - RNA, 12 nt, Human
gacaugaauaug

SEQ ID NO: 2115195 - RNA, 14 nt, Human
gacaugaauaugau

SEQ ID NO: 2115196 - RNA, 16 nt, Human
gacaugaaugcacacu

SEQ ID NO: 2115197 - RNA, 16 nt, Human
gacauggacccggagc

SEQ ID NO: 2115198 - RNA, 17 nt, Human
gacauggacccggagcu

SEQ ID NO: 2115199 - RNA, 12 nt, Human
gaccccucaccu

SEQ ID NO: 2115200 - RNA, 13 nt, Human
gaccccuccaugu

SEQ ID NO: 2115201 - RNA, 23 nt, Human
gacccugucucaaaaaaagaaaa

SEQ ID NO: 2115202 - RNA, 15 nt, Human
gacccagucccuggg

SEQ ID NO: 2115203 - RNA, 16 nt, Human
gacccaggcugccuga

SEQ ID NO: 2115204 - RNA, 18 nt, Human
gacccaggcugccugagc

SEQ ID NO: 2115205 - RNA, 14 nt, Human
gacccagucccugg

SEQ ID NO: 2115206 - RNA, 19 nt, Human
gaccccagcggcugaguca

SEQ ID NO: 2115207 - RNA, 12 nt, Human
gacccacugcuu

SEQ ID NO: 2115208 - RNA, 22 nt, Human
gacccaccugguggccucugcc

SEQ ID NO: 2115209 - RNA, 11 nt, Human
gacccacugcu

SEQ ID NO: 2115210 - RNA, 18 nt, Human
gaccaagagagaaagaag

SEQ ID NO: 2115211 - RNA, 21 nt, Human
gacauggcuugccacagcucu

SEQ ID NO: 2115212 - RNA, 19 nt, Human
gaccaacugggcccaagac

SEQ ID NO: 2115213 - RNA, 12 nt, Human
gaccaagaacug

SEQ ID NO: 2115214 - RNA, 13 nt, Human
gaccaagaacugc

SEQ ID NO: 2115215 - RNA, 15 nt, Human
gaccaagaacugcau

SEQ ID NO: 2115216 - RNA, 14 nt, Human
gaccaagagagaaa

SEQ ID NO: 2115217 - RNA, 12 nt, Human
gaccaagcagga

SEQ ID NO: 2115218 - RNA, 15 nt, Human
gaccaagagagaaag

SEQ ID NO: 2115219 - RNA, 16 nt, Human
gaccaagagagaaaga

SEQ ID NO: 2115220 - RNA, 14 nt, Human
gaccaagcaggaag

SEQ ID NO: 2115221 - RNA, 21 nt, Human
gaccaacauggagaaacccug

SEQ ID NO: 2115222 - RNA, 22 nt, Human
gaccaacauggagaaacccugu

SEQ ID NO: 2115223 - RNA, 13 nt, Human
gaccaaccugacc

SEQ ID NO: 2115224 - RNA, 14 nt, Human
gaccaaccugacca

SEQ ID NO: 2115225 - RNA, 13 nt, Human
gaccaacugggcc

SEQ ID NO: 2115226 - RNA, 14 nt, Human
gaccaacugggccc

SEQ ID NO: 2115227 - RNA, 13 nt, Human
gaccugcaggcca

SEQ ID NO: 2115228 - RNA, 21 nt, Human
gaccugccccgcccagcugca

SEQ ID NO: 2115229 - RNA, 20 nt, Human
gaccugcaggccaagagcag

SEQ ID NO: 2115230 - RNA, 15 nt, Human
gaccgguacagaaag

SEQ ID NO: 2115231 - RNA, 13 nt, Human
gaccccucaccuu

SEQ ID NO: 2115232 - RNA, 14 nt, Human
gaccccucaccuug

SEQ ID NO: 2115233 - RNA, 12 nt, Human
gacccugucucu

SEQ ID NO: 2115234 - RNA, 22 nt, Human
gaccccucaccuugcaacacac

SEQ ID NO: 2115235 - RNA, 21 nt, Human
gaccggaggcaaaaggcagug

SEQ ID NO: 2115236 - RNA, 19 nt, Human
gacccuucccuugagcccu

SEQ ID NO: 2115237 - RNA, 16 nt, Human
gaccucacugugaccu

SEQ ID NO: 2115238 - RNA, 17 nt, Human
gaccucagaguccaggc

SEQ ID NO: 2115239 - RNA, 18 nt, Human
gaccucagaguccaggcc

SEQ ID NO: 2115240 - RNA, 19 nt, Human
gaccucagaguccaggccc

SEQ ID NO: 2115241 - RNA, 10 nt, Human
gaccucagcc

SEQ ID NO: 2115242 - RNA, 21 nt, Human
gaccucagaguccaggcccca

SEQ ID NO: 2115243 - RNA, 11 nt, Human
gaccucagcca

SEQ ID NO: 2115244 - RNA, 11 nt, Human
gaccucagccu

SEQ ID NO: 2115245 - RNA, 12 nt, Human
gaccucagccug

SEQ ID NO: 2115246 - RNA, 13 nt, Human
gaccucagccugu

SEQ ID NO: 2115247 - RNA, 14 nt, Human
gaccucagccugug

SEQ ID NO: 2115248 - RNA, 16 nt, Human
gaccucagccugugcu

SEQ ID NO: 2115249 - RNA, 19 nt, Human
gaccucagccugugcugcc

SEQ ID NO: 2115250 - RNA, 13 nt, Human
gaccucagccuuc

SEQ ID NO: 2115251 - RNA, 14 nt, Human
gaccucagccuucc

SEQ ID NO: 2115252 - RNA, 20 nt, Human
gaccucagccuuccccuugc

SEQ ID NO: 2115253 - RNA, 14 nt, Human
gacccacagccucu

SEQ ID NO: 2115254 - RNA, 17 nt, Human
gaccuaacauucgaucu

SEQ ID NO: 2115255 - RNA, 21 nt, Human
gaccucaccaagcugcugugg

SEQ ID NO: 2115256 - RNA, 14 nt, Human
gacgaggcugggcc

SEQ ID NO: 2115257 - RNA, 21 nt, Human
gacggagucccaccuuggcug

SEQ ID NO: 2115258 - RNA, 23 nt, Human
gacggagucccaccuuggcugca

SEQ ID NO: 2115259 - RNA, 22 nt, Human
gacgcaugcccucaaucccagc

SEQ ID NO: 2115260 - RNA, 18 nt, Human
gacggagucccaccuugg

SEQ ID NO: 2115261 - RNA, 14 nt, Human
gacggagucccacc

SEQ ID NO: 2115262 - RNA, 13 nt, Human
gacgcacacagcu

SEQ ID NO: 2115263 - RNA, 14 nt, Human
gacgcacacagcuu

SEQ ID NO: 2115264 - RNA, 23 nt, Human
gacgauacuccaaccauauggau

SEQ ID NO: 2115265 - RNA, 21 nt, Human
gaccuaaccuaagcaaaacca

SEQ ID NO: 2115266 - RNA, 19 nt, Human
gacgguucaccagccucuc

SEQ ID NO: 2115267 - RNA, 17 nt, Human
gacgguucaccagccuc

SEQ ID NO: 2115268 - RNA, 18 nt, Human
gacgguucaccagccucu

SEQ ID NO: 2115269 - RNA, 21 nt, Human
gacggugggcauuugugaggc

SEQ ID NO: 2115270 - RNA, 15 nt, Human
gacgguucaccagcc

SEQ ID NO: 2115271 - RNA, 18 nt, Human
gacgucaagucuccuucc

SEQ ID NO: 2115272 - RNA, 12 nt, Human
gacgucccucca

SEQ ID NO: 2115273 - RNA, 22 nt, Human
gacgucccuccacguucacccc

SEQ ID NO: 2115274 - RNA, 23 nt, Human
gacguaugcuuauuuuaaaauuu

SEQ ID NO: 2115275 - RNA, 14 nt, Human
gacgucaagucucc

SEQ ID NO: 2115276 - RNA, 20 nt, Human
gacguaggaacgguaaauuu

SEQ ID NO: 2115277 - RNA, 23 nt, Human
gaccuugaacuggguacuugugg

SEQ ID NO: 2115278 - RNA, 19 nt, Human
gaccugcugagggaccagc

SEQ ID NO: 2115279 - RNA, 20 nt, Human
gaccugcugagggaccagcc

SEQ ID NO: 2115280 - RNA, 21 nt, Human
gaccugcugagggaccagcca

SEQ ID NO: 2115281 - RNA, 21 nt, Human
gaccuuugucaucuuucuucu

SEQ ID NO: 2115282 - RNA, 15 nt, Human
gacuccagaucugca

SEQ ID NO: 2115283 - RNA, 16 nt, Human
gacuccagaucugcac

SEQ ID NO: 2115284 - RNA, 18 nt, Human
gacuccagaucugcaccg

SEQ ID NO: 2115285 - RNA, 15 nt, Human
gacucagguugucug

SEQ ID NO: 2115286 - RNA, 21 nt, Human
gacucagguuguaguaaagaa

SEQ ID NO: 2115287 - RNA, 23 nt, Human
gacucagguuguaguaaagaaau

SEQ ID NO: 2115288 - RNA, 12 nt, Human
gacucaguguuc

SEQ ID NO: 2115289 - RNA, 15 nt, Human
gacucaguuugucag

SEQ ID NO: 2115290 - RNA, 20 nt, Human
gacucccuccucaccucugg

SEQ ID NO: 2115291 - RNA, 23 nt, Human
gacucccuccucaccucuggacu

SEQ ID NO: 2115292 - RNA, 24 nt, Human
gacucccuccucaccucuggacug

SEQ ID NO: 2115293 - RNA, 12 nt, Human
gacucccuccuc

SEQ ID NO: 2115294 - RNA, 13 nt, Human
gacucccuccuca

SEQ ID NO: 2115295 - RNA, 14 nt, Human
gacucccuccucac

SEQ ID NO: 2115296 - RNA, 16 nt, Human
gacucccuccucaccu

SEQ ID NO: 2115297 - RNA, 19 nt, Human
gacucccuccucaccucug

SEQ ID NO: 2115298 - RNA, 23 nt, Human
gacuccaugagaagccgugggug

SEQ ID NO: 2115299 - RNA, 16 nt, Human
gacucccaaagagcug

SEQ ID NO: 2115300 - RNA, 17 nt, Human
gacucccaaagagcugc

SEQ ID NO: 2115301 - RNA, 18 nt, Human
gacucccaaagagcugcc

SEQ ID NO: 2115302 - RNA, 19 nt, Human
gacucccaaagagcugccu

SEQ ID NO: 2115303 - RNA, 18 nt, Human
gacuacuugggagcaccg

SEQ ID NO: 2115304 - RNA, 20 nt, Human
gacuagaaaauuuaaaacau

SEQ ID NO: 2115305 - RNA, 18 nt, Human
gacuagaaagugaauaaa

SEQ ID NO: 2115306 - RNA, 20 nt, Human
gacuacuugggagcaccgcc

SEQ ID NO: 2115307 - RNA, 15 nt, Human
gacuagaagggccag

SEQ ID NO: 2115308 - RNA, 12 nt, Human
gacuacaggcac

SEQ ID NO: 2115309 - RNA, 17 nt, Human
gacuacucccccaggug

SEQ ID NO: 2115310 - RNA, 20 nt, Human
gacguucauuugugugcuca

SEQ ID NO: 2115311 - RNA, 23 nt, Human
gacuagaagggccaguccugccu

SEQ ID NO: 2115312 - RNA, 19 nt, Human
gacuagaccuccagcuguu

SEQ ID NO: 2115313 - RNA, 16 nt, Human
gacuagacguucauuu

SEQ ID NO: 2115314 - RNA, 15 nt, Human
gacucaggaugccca

SEQ ID NO: 2115315 - RNA, 16 nt, Human
gacucaggaugcccag

SEQ ID NO: 2115316 - RNA, 17 nt, Human
gacucaggaugcccagg

SEQ ID NO: 2115317 - RNA, 18 nt, Human
gacucaggaugcccaggg

SEQ ID NO: 2115318 - RNA, 19 nt, Human
gacucaggaugcccagggc

SEQ ID NO: 2115319 - RNA, 23 nt, Human
gacucaggaugcccagggccacu

SEQ ID NO: 2115320 - RNA, 14 nt, Human
gacucagggcccca

SEQ ID NO: 2115321 - RNA, 15 nt, Human
gacucagggccccag

SEQ ID NO: 2115322 - RNA, 17 nt, Human
gacucagggccccagca

SEQ ID NO: 2115323 - RNA, 18 nt, Human
gacucagggccccagcac

SEQ ID NO: 2115324 - RNA, 20 nt, Human
gacucagggccccagcacua

SEQ ID NO: 2115325 - RNA, 14 nt, Human
gcacguauuuuaau

SEQ ID NO: 2115326 - RNA, 15 nt, Human
gcacguauuuuaaua

SEQ ID NO: 2115327 - RNA, 15 nt, Human
gcacguggagagcug

SEQ ID NO: 2115328 - RNA, 16 nt, Human
gcacguggagagcugg

SEQ ID NO: 2115329 - RNA, 18 nt, Human
gcacguggagagcuggug

SEQ ID NO: 2115330 - RNA, 16 nt, Human
gcacguaguaggguca

SEQ ID NO: 2115331 - RNA, 20 nt, Human
gcacguaguagggucaggcc

SEQ ID NO: 2115332 - RNA, 21 nt, Human
gcacguaguagggucaggcca

SEQ ID NO: 2115333 - RNA, 20 nt, Human
gcacguggagagcuggugcc

SEQ ID NO: 2115334 - RNA, 17 nt, Human
gcacguggcuucugaug

SEQ ID NO: 2115335 - RNA, 23 nt, Human
gcacguggcuucugaugaaucuu

SEQ ID NO: 2115336 - RNA, 23 nt, Human
gcacgugggucuucagggggcca

SEQ ID NO: 2115337 - RNA, 24 nt, Human
gcacugguggcccgacagccuggc

SEQ ID NO: 2115338 - RNA, 23 nt, Human
gcacugguggcccgacagccugg

SEQ ID NO: 2115339 - RNA, 22 nt, Human
gcacugguggcccgacagccug

SEQ ID NO: 2115340 - RNA, 12 nt, Human
gcacugcugccc

SEQ ID NO: 2115341 - RNA, 19 nt, Human
gcagacaggcaagcaccuc

SEQ ID NO: 2115342 - RNA, 23 nt, Human
gcagacaggcaagcaccuccugc

SEQ ID NO: 2115343 - RNA, 14 nt, Human
gcagaauaguauuu

SEQ ID NO: 2115344 - RNA, 18 nt, Human
gcagaauaaucuuugggu

SEQ ID NO: 2115345 - RNA, 21 nt, Human
gcacuuaaauaucaaucauuu

SEQ ID NO: 2115346 - RNA, 22 nt, Human
gcacuuaaauaucaaucauuuu

SEQ ID NO: 2115347 - RNA, 20 nt, Human
gcaaugaguguguuggcuug

SEQ ID NO: 2115348 - RNA, 22 nt, Human
gcacuuacagauaggccuucuu

SEQ ID NO: 2115349 - RNA, 22 nt, Human
gcacccaccaucaugucuggcu

SEQ ID NO: 2115350 - RNA, 14 nt, Human
gcaccauugcugcu

SEQ ID NO: 2115351 - RNA, 22 nt, Human
gcaccauugcugcuccuuagcu

SEQ ID NO: 2115352 - RNA, 19 nt, Human
gcacccggccccugcuggu

SEQ ID NO: 2115353 - RNA, 22 nt, Human
gcacccacccagcacccagcaa

SEQ ID NO: 2115354 - RNA, 22 nt, Human
gcacccacaaauaaaugacaag

SEQ ID NO: 2115355 - RNA, 19 nt, Human
gcacccacaagugccacug

SEQ ID NO: 2115356 - RNA, 19 nt, Human
gcacccacccagcacccag

SEQ ID NO: 2115357 - RNA, 17 nt, Human
gcaccagccggggaaga

SEQ ID NO: 2115358 - RNA, 16 nt, Human
gcaccagcagccugga

SEQ ID NO: 2115359 - RNA, 15 nt, Human
gcaccauucaggaac

SEQ ID NO: 2115360 - RNA, 16 nt, Human
gcaccauucaggaacc

SEQ ID NO: 2115361 - RNA, 22 nt, Human
gcaccauucaggaaccuggacc

SEQ ID NO: 2115362 - RNA, 23 nt, Human
gcaccauucaggaaccuggacca

SEQ ID NO: 2115363 - RNA, 14 nt, Human
gcaauggcagccuu

SEQ ID NO: 2115364 - RNA, 20 nt, Human
gcaccacugcacuccagccu

SEQ ID NO: 2115365 - RNA, 13 nt, Human
gcaauggcagccu

SEQ ID NO: 2115366 - RNA, 12 nt, Human
gcaauggcagcc

SEQ ID NO: 2115367 - RNA, 15 nt, Human
gcaccagcagccugg

SEQ ID NO: 2115368 - RNA, 23 nt, Human
gcaccacugcacuccagccuggg

SEQ ID NO: 2115369 - RNA, 21 nt, Human
gcaccacugcacuccagccug

SEQ ID NO: 2115370 - RNA, 22 nt, Human
gcaccacugcacuccagccugg

SEQ ID NO: 2115371 - RNA, 15 nt, Human
gcacgaacccaccug

SEQ ID NO: 2115372 - RNA, 16 nt, Human
gcacgaacccaccugc

SEQ ID NO: 2115373 - RNA, 17 nt, Human
gcacgaacccaccugcu

SEQ ID NO: 2115374 - RNA, 19 nt, Human
gcacgaacccaccugcuga

SEQ ID NO: 2115375 - RNA, 23 nt, Human
gcacgaacccaccugcugagaga

SEQ ID NO: 2115376 - RNA, 20 nt, Human
gcacgagugggaaggacuug

SEQ ID NO: 2115377 - RNA, 15 nt, Human
gcacccucaggcagg

SEQ ID NO: 2115378 - RNA, 19 nt, Human
gcagacaugugcacuugaa

SEQ ID NO: 2115379 - RNA, 20 nt, Human
gcagauucauuuuucuuucu

SEQ ID NO: 2115380 - RNA, 17 nt, Human
gcagauugaaaaggaca

SEQ ID NO: 2115381 - RNA, 19 nt, Human
gcagauucauuuuucuuuc

SEQ ID NO: 2115382 - RNA, 16 nt, Human
gcagauuuuacaaaag

SEQ ID NO: 2115383 - RNA, 17 nt, Human
gcagauuuuacaaaaga

SEQ ID NO: 2115384 - RNA, 20 nt, Human
gcagauuuuacaaaagaugu

SEQ ID NO: 2115385 - RNA, 21 nt, Human
gcagauuuuacaaaagaugua

SEQ ID NO: 2115386 - RNA, 14 nt, Human
gcagauuggagaaa

SEQ ID NO: 2115387 - RNA, 19 nt, Human
gcagauuggagaaacccuu

SEQ ID NO: 2115388 - RNA, 20 nt, Human
gcagauuuagugaaagcuag

SEQ ID NO: 2115389 - RNA, 23 nt, Human
gcagauuuagugaaagcuagaga

SEQ ID NO: 2115390 - RNA, 22 nt, Human
gcagauacaggaaaagcugcug

SEQ ID NO: 2115391 - RNA, 16 nt, Human
gcagauaaucagccuc

SEQ ID NO: 2115392 - RNA, 17 nt, Human
gcagauaaucagccucu

SEQ ID NO: 2115393 - RNA, 18 nt, Human
gcagauaaucagccucuu

SEQ ID NO: 2115394 - RNA, 19 nt, Human
gcagauaaucagccucuua

SEQ ID NO: 2115395 - RNA, 24 nt, Human
gcagccccauucugccugcccagg

SEQ ID NO: 2115396 - RNA, 21 nt, Human
gcagccccauucugccugccc

SEQ ID NO: 2115397 - RNA, 19 nt, Human
gcagccccauucugccugc

SEQ ID NO: 2115398 - RNA, 18 nt, Human
gcagccccauucugccug

SEQ ID NO: 2115399 - RNA, 17 nt, Human
gcagccccauucugccu

SEQ ID NO: 2115400 - RNA, 15 nt, Human
gcagcccguguggcc

SEQ ID NO: 2115401 - RNA, 23 nt, Human
gcagccccgcgccuccuuccuug

SEQ ID NO: 2115402 - RNA, 17 nt, Human
gcagcccguguggcccc

SEQ ID NO: 2115403 - RNA, 18 nt, Human
gcagcccguguggccccu

SEQ ID NO: 2115404 - RNA, 19 nt, Human
gcagcccguguggccccuu

SEQ ID NO: 2115405 - RNA, 20 nt, Human
gcagcccguguggccccuuc

SEQ ID NO: 2115406 - RNA, 21 nt, Human
gcagcccguguggccccuuca

SEQ ID NO: 2115407 - RNA, 14 nt, Human
gcagcacagagagg

SEQ ID NO: 2115408 - RNA, 23 nt, Human
gcaggaggaucacuugaguccag

SEQ ID NO: 2115409 - RNA, 18 nt, Human
gcaggacaacgaggaagc

SEQ ID NO: 2115410 - RNA, 19 nt, Human
gcaggacaacgaggaagcc

SEQ ID NO: 2115411 - RNA, 14 nt, Human
gcaggaggauugcu

SEQ ID NO: 2115412 - RNA, 20 nt, Human
gcaggaaggcugagaggaga

SEQ ID NO: 2115413 - RNA, 17 nt, Human
gcaggaauguguggcag

SEQ ID NO: 2115414 - RNA, 18 nt, Human
gcaggaauugguggcaga

SEQ ID NO: 2115415 - RNA, 19 nt, Human
gcaggaauugguggcagau

SEQ ID NO: 2115416 - RNA, 17 nt, Human
gcaggacaacgaggaag

SEQ ID NO: 2115417 - RNA, 20 nt, Human
gcaggaggaucacuugaguc

SEQ ID NO: 2115418 - RNA, 16 nt, Human
gcaggaaggagagccu

SEQ ID NO: 2115419 - RNA, 17 nt, Human
gcaggaaggagagccug

SEQ ID NO: 2115420 - RNA, 23 nt, Human
gcaggaaggagagccugcugcau

SEQ ID NO: 2115421 - RNA, 23 nt, Human
gcaggaggauugcuugagcccag

SEQ ID NO: 2115422 - RNA, 11 nt, Human
gcaggagggag

SEQ ID NO: 2115423 - RNA, 15 nt, Human
gcaggcacauggagg

SEQ ID NO: 2115424 - RNA, 15 nt, Human
gcagccuuggcaaac

SEQ ID NO: 2115425 - RNA, 18 nt, Human
gcagccuuugccuccccg

SEQ ID NO: 2115426 - RNA, 17 nt, Human
gcagccuuugccucccc

SEQ ID NO: 2115427 - RNA, 14 nt, Human
gcagcuaguuuucu

SEQ ID NO: 2115428 - RNA, 14 nt, Human
gcagcucaaaggca

SEQ ID NO: 2115429 - RNA, 17 nt, Human
gcagcucaaaggcacag

SEQ ID NO: 2115430 - RNA, 21 nt, Human
gcagcuugcguuagaaugagg

SEQ ID NO: 2115431 - RNA, 15 nt, Human
gcagcuugcugcacc

SEQ ID NO: 2115432 - RNA, 15 nt, Human
gcagcucaaaggcac

SEQ ID NO: 2115433 - RNA, 13 nt, Human
gcagcccugcuuu

SEQ ID NO: 2115434 - RNA, 13 nt, Human
gcagcccuccuca

SEQ ID NO: 2115435 - RNA, 15 nt, Human
gcagcccuccucacc

SEQ ID NO: 2115436 - RNA, 18 nt, Human
gcagcccuccucaccccg

SEQ ID NO: 2115437 - RNA, 14 nt, Human
gcagccuguggcau

SEQ ID NO: 2115438 - RNA, 16 nt, Human
gcagccuguggcaucu

SEQ ID NO: 2115439 - RNA, 22 nt, Human
gcagccuguggcaucuuugccu

SEQ ID NO: 2115440 - RNA, 20 nt, Human
gcaggggcaaacaccugcug

SEQ ID NO: 2115441 - RNA, 21 nt, Human
gcaggucacugaaacuucaag

SEQ ID NO: 2115442 - RNA, 15 nt, Human
gcaggugacagugag

SEQ ID NO: 2115443 - RNA, 16 nt, Human
gcaggugacagugagg

SEQ ID NO: 2115444 - RNA, 17 nt, Human
gcaggugaccuucuggg

SEQ ID NO: 2115445 - RNA, 20 nt, Human
gcaggucuugaacuccuggc

SEQ ID NO: 2115446 - RNA, 19 nt, Human
gcaggucuugaacuccugg

SEQ ID NO: 2115447 - RNA, 22 nt, Human
gcagguccaggguuugaguuca

SEQ ID NO: 2115448 - RNA, 14 nt, Human
gcagguaccacuga

SEQ ID NO: 2115449 - RNA, 15 nt, Human
gcagggugggaugga

SEQ ID NO: 2115450 - RNA, 19 nt, Human
gcaggugaccuucugggaa

SEQ ID NO: 2115451 - RNA, 14 nt, Human
gcagugauuaaggu

SEQ ID NO: 2115452 - RNA, 22 nt, Human
gcagugauuaaggucucucuuu

SEQ ID NO: 2115453 - RNA, 13 nt, Human
gcagugauuuuua

SEQ ID NO: 2115454 - RNA, 14 nt, Human
gcagugauuuuuau

SEQ ID NO: 2115455 - RNA, 16 nt, Human
gcagugcagcaaccag

SEQ ID NO: 2115456 - RNA, 21 nt, Human
gcagugcagcaaccagagcac

SEQ ID NO: 2115457 - RNA, 22 nt, Human
gcagugcagcaaccagagcacu

SEQ ID NO: 2115458 - RNA, 23 nt, Human
gcagugcagcaaccagagcacug

SEQ ID NO: 2115459 - RNA, 16 nt, Human
gcaguggaggugcugc

SEQ ID NO: 2115460 - RNA, 14 nt, Human
gcaguggagaggga

SEQ ID NO: 2115461 - RNA, 15 nt, Human
gcaguggagagggac

SEQ ID NO: 2115462 - RNA, 15 nt, Human
gcaguggacaccagg

SEQ ID NO: 2115463 - RNA, 15 nt, Human
gcagugccuuccaua

SEQ ID NO: 2115464 - RNA, 21 nt, Human
gcagggcucagcggggacagc

SEQ ID NO: 2115465 - RNA, 19 nt, Human
gcagggcucagcggggaca

SEQ ID NO: 2115466 - RNA, 22 nt, Human
gcagggcaucuccugugcaugg

SEQ ID NO: 2115467 - RNA, 14 nt, Human
gcagggcaucuccu

SEQ ID NO: 2115468 - RNA, 15 nt, Human
gcagggcaucuccug

SEQ ID NO: 2115469 - RNA, 19 nt, Human
gcagggcaucuccugugca

SEQ ID NO: 2115470 - RNA, 21 nt, Human
gcagggcaucuccugugcaug

SEQ ID NO: 2115471 - RNA, 18 nt, Human
gcagggucucacucuguc

SEQ ID NO: 2115472 - RNA, 17 nt, Human
gcagggucucacucugu

SEQ ID NO: 2115473 - RNA, 22 nt, Human
gcagggcucagcggggacagcu

SEQ ID NO: 2115474 - RNA, 14 nt, Human
gcagggcucagcgg

SEQ ID NO: 2115475 - RNA, 16 nt, Human
gcauauccugagccau

SEQ ID NO: 2115476 - RNA, 15 nt, Human
gcauauccugagcca

SEQ ID NO: 2115477 - RNA, 20 nt, Human
gcauaguauuccauugugug

SEQ ID NO: 2115478 - RNA, 21 nt, Human
gcauaguauuccauuguguga

SEQ ID NO: 2115479 - RNA, 22 nt, Human
gcauaguauuccauugugugag

SEQ ID NO: 2115480 - RNA, 23 nt, Human
gcauaguauuccauugugugagu

SEQ ID NO: 2115481 - RNA, 18 nt, Human
gcauaguucccauguuaa

SEQ ID NO: 2115482 - RNA, 12 nt, Human
gcauagaaggag

SEQ ID NO: 2115483 - RNA, 14 nt, Human
gcauagaaggagga

SEQ ID NO: 2115484 - RNA, 23 nt, Human
gcauagaaggaggagagggaaaa

SEQ ID NO: 2115485 - RNA, 23 nt, Human
gcauauuuauagcaauccauguu

SEQ ID NO: 2115486 - RNA, 14 nt, Human
gcaucaccucaggc

SEQ ID NO: 2115487 - RNA, 15 nt, Human
gcaucaccucaggcc

SEQ ID NO: 2115488 - RNA, 17 nt, Human
gcaucaccucaggccag

SEQ ID NO: 2115489 - RNA, 11 nt, Human
gcaguucugca

SEQ ID NO: 2115490 - RNA, 15 nt, Human
gcaguucugcaaaua

SEQ ID NO: 2115491 - RNA, 18 nt, Human
gcaguucugcaaauagaa

SEQ ID NO: 2115492 - RNA, 19 nt, Human
gcaguucugcaaauagaaa

SEQ ID NO: 2115493 - RNA, 19 nt, Human
gcaguucugggugcucccu

SEQ ID NO: 2115494 - RNA, 20 nt, Human
gcagugucuuccauaaugua

SEQ ID NO: 2115495 - RNA, 17 nt, Human
gcaguuauuaacacuaa

SEQ ID NO: 2115496 - RNA, 15 nt, Human
gcagugggagcugcc

SEQ ID NO: 2115497 - RNA, 14 nt, Human
gcagugggagcugc

SEQ ID NO: 2115498 - RNA, 12 nt, Human
gcagugggagcu

SEQ ID NO: 2115499 - RNA, 13 nt, Human
gcagugggagcug

SEQ ID NO: 2115500 - RNA, 11 nt, Human
gcagugucuuc

SEQ ID NO: 2115501 - RNA, 14 nt, Human
gcagugucuuccau

SEQ ID NO: 2115502 - RNA, 15 nt, Human
gcagugucuuccaua

SEQ ID NO: 2115503 - RNA, 16 nt, Human
gcagugucuuccauaa

SEQ ID NO: 2115504 - RNA, 13 nt, Human
gcaucuuugccuu

SEQ ID NO: 2115505 - RNA, 15 nt, Human
gcaucuuugccuugg

SEQ ID NO: 2115506 - RNA, 18 nt, Human
gcaucuuugccuugggcu

SEQ ID NO: 2115507 - RNA, 16 nt, Human
gcaucuuacugaaggu

SEQ ID NO: 2115508 - RNA, 23 nt, Human
gcaucuuacugaagguaaaauug

SEQ ID NO: 2115509 - RNA, 17 nt, Human
gcaucuucucacucccu

SEQ ID NO: 2115510 - RNA, 19 nt, Human
gcaucuucucacucccuuc

SEQ ID NO: 2115511 - RNA, 13 nt, Human
gcaucuucuccau

SEQ ID NO: 2115512 - RNA, 14 nt, Human
gcaucuucuccauc

SEQ ID NO: 2115513 - RNA, 22 nt, Human
gcaucuuugccuugggcugcuc

SEQ ID NO: 2115514 - RNA, 23 nt, Human
gcaucuuugccuugggcugcucc

SEQ ID NO: 2115515 - RNA, 13 nt, Human
gcaugaagguuuc

SEQ ID NO: 2115516 - RNA, 20 nt, Human
gcaucaccuuaggcagggaa

SEQ ID NO: 2115517 - RNA, 10 nt, Human
gcaucagaaa

SEQ ID NO: 2115518 - RNA, 18 nt, Human
gcaucaccuuaggcaggg

SEQ ID NO: 2115519 - RNA, 22 nt, Human
gcaucaccuuaggcagggaagu

SEQ ID NO: 2115520 - RNA, 11 nt, Human
gcaucagaaau

SEQ ID NO: 2115521 - RNA, 12 nt, Human
gcaucagaaaug

SEQ ID NO: 2115522 - RNA, 13 nt, Human
gcaucagaaaugu

SEQ ID NO: 2115523 - RNA, 16 nt, Human
gcaucucuugaggcca

SEQ ID NO: 2115524 - RNA, 17 nt, Human
gcaucucuugaggccag

SEQ ID NO: 2115525 - RNA, 18 nt, Human
gcaucucuugaggccagg

SEQ ID NO: 2115526 - RNA, 20 nt, Human
gcaucucuugaggccaggag

SEQ ID NO: 2115527 - RNA, 21 nt, Human
gcaucucuugaggccaggagu

SEQ ID NO: 2115528 - RNA, 15 nt, Human
gcaucuuacugaagg

SEQ ID NO: 2115529 - RNA, 12 nt, Human
gcaucugcaccc

SEQ ID NO: 2115530 - RNA, 12 nt, Human
gcaucugccccu

SEQ ID NO: 2115531 - RNA, 14 nt, Human
gcaucugacacaaa

SEQ ID NO: 2115532 - RNA, 16 nt, Human
gcaucugacacaaaaa

SEQ ID NO: 2115533 - RNA, 17 nt, Human
gcaucugacacaaaaaa

SEQ ID NO: 2115534 - RNA, 19 nt, Human
gcaucugacacaaaaaaag

SEQ ID NO: 2115535 - RNA, 20 nt, Human
gcaugauguuaaccagaaua

SEQ ID NO: 2115536 - RNA, 19 nt, Human
gcaugagggaucacagggc

SEQ ID NO: 2115537 - RNA, 20 nt, Human
gcaugagggaucacagggcc

SEQ ID NO: 2115538 - RNA, 21 nt, Human
gcaugagggaucacagggccc

SEQ ID NO: 2115539 - RNA, 17 nt, Human
gcaugaccugugaccag

SEQ ID NO: 2115540 - RNA, 22 nt, Human
gcaugaccugugaccagcacug

SEQ ID NO: 2115541 - RNA, 15 nt, Human
gcaugcuggggcaag

SEQ ID NO: 2115542 - RNA, 22 nt, Human
gcaugcucucugcagccagccc

SEQ ID NO: 2115543 - RNA, 23 nt, Human
gcaugcucucugcagccagccca

SEQ ID NO: 2115544 - RNA, 13 nt, Human
gcaugcugcuuua

SEQ ID NO: 2115545 - RNA, 14 nt, Human
gcaugcugcuuuaa

SEQ ID NO: 2115546 - RNA, 13 nt, Human
gcaugcuggggca

SEQ ID NO: 2115547 - RNA, 15 nt, Human
gcaugcggcccagga

SEQ ID NO: 2115548 - RNA, 13 nt, Human
gcaugcucucugc

SEQ ID NO: 2115549 - RNA, 14 nt, Human
gcaugcucucugca

SEQ ID NO: 2115550 - RNA, 15 nt, Human
gcaugcucucugcag

SEQ ID NO: 2115551 - RNA, 17 nt, Human
gcaugcucucugcagcc

SEQ ID NO: 2115552 - RNA, 18 nt, Human
gcaugcucucugcagcca

SEQ ID NO: 2115553 - RNA, 21 nt, Human
gcaugcucucugcagccagcc

SEQ ID NO: 2115554 - RNA, 22 nt, Human
gcauguucucugaggacacuaa

SEQ ID NO: 2115555 - RNA, 21 nt, Human
gcauguucucugaggacacua

SEQ ID NO: 2115556 - RNA, 15 nt, Human
gcauguucucugagg

SEQ ID NO: 2115557 - RNA, 20 nt, Human
gcauggcaaggacugcaggg

SEQ ID NO: 2115558 - RNA, 16 nt, Human
gcaugcuggggcaagu

SEQ ID NO: 2115559 - RNA, 14 nt, Human
gcauggcaccuguc

SEQ ID NO: 2115560 - RNA, 21 nt, Human
gcauggcaccugucgcccagu

SEQ ID NO: 2115561 - RNA, 22 nt, Human
gcauggcaccugucgcccagug

SEQ ID NO: 2115562 - RNA, 14 nt, Human
gcauggcagcaggc

SEQ ID NO: 2115563 - RNA, 17 nt, Human
gcauggaguguguauug

SEQ ID NO: 2115564 - RNA, 18 nt, Human
gcauggaguguguauugu

SEQ ID NO: 2115565 - RNA, 19 nt, Human
gcauggaguguguauuguu

SEQ ID NO: 2115566 - RNA, 20 nt, Human
gcauggaguguguauuguuc

SEQ ID NO: 2115567 - RNA, 22 nt, Human
gcauggaguguguauuguuccc

SEQ ID NO: 2115568 - RNA, 23 nt, Human
gcauggaguguguauuguuccca

SEQ ID NO: 2115569 - RNA, 24 nt, Human
gcauggaguguguauuguucccag

SEQ ID NO: 2115570 - RNA, 15 nt, Human
gcauuuuuuaaaaca

SEQ ID NO: 2115571 - RNA, 16 nt, Human
gcauuuuuuaaaacaa

SEQ ID NO: 2115572 - RNA, 18 nt, Human
gcauuuuugugaaaugaa

SEQ ID NO: 2115573 - RNA, 21 nt, Human
gcauuuuugugaaaugaaaac

SEQ ID NO: 2115574 - RNA, 17 nt, Human
gcauuuuuuaaaacaag

SEQ ID NO: 2115575 - RNA, 18 nt, Human
gcauuuuuuaaaacaaga

SEQ ID NO: 2115576 - RNA, 22 nt, Human
gccaaacccaugaggcaauguc

SEQ ID NO: 2115577 - RNA, 15 nt, Human
gccaaacccugucug

SEQ ID NO: 2115578 - RNA, 20 nt, Human
gccaaagcuaggguggcccu

SEQ ID NO: 2115579 - RNA, 16 nt, Human
gccaaagcuagggugg

SEQ ID NO: 2115580 - RNA, 22 nt, Human
gccaaagcuaggccuggccaga

SEQ ID NO: 2115581 - RNA, 16 nt, Human
gccaaagcuaggccug

SEQ ID NO: 2115582 - RNA, 20 nt, Human
gccaaagccaaagcuaggcc

SEQ ID NO: 2115583 - RNA, 13 nt, Human
gccaaagccaaag

SEQ ID NO: 2115584 - RNA, 16 nt, Human
gccaaagccuccucca

SEQ ID NO: 2115585 - RNA, 19 nt, Human
gccaaagccuccuccagcc

SEQ ID NO: 2115586 - RNA, 15 nt, Human
gcauuauugcauuau

SEQ ID NO: 2115587 - RNA, 14 nt, Human
gcauuauugcauua

SEQ ID NO: 2115588 - RNA, 19 nt, Human
gcauuauauaccauuuauc

SEQ ID NO: 2115589 - RNA, 15 nt, Human
gcauuauauaccauu

SEQ ID NO: 2115590 - RNA, 19 nt, Human
gcauucuugucacaauaaa

SEQ ID NO: 2115591 - RNA, 21 nt, Human
gcauucuugucacaauaaaug

SEQ ID NO: 2115592 - RNA, 22 nt, Human
gcauucuugucacaauaaaugu

SEQ ID NO: 2115593 - RNA, 22 nt, Human
gcauucuuagccuguggcagua

SEQ ID NO: 2115594 - RNA, 20 nt, Human
gcauucugccgugugcccuc

SEQ ID NO: 2115595 - RNA, 22 nt, Human
gcauucugccgugugcccucgg

SEQ ID NO: 2115596 - RNA, 22 nt, Human
gcauucaauuuauucaagaaaa

SEQ ID NO: 2115597 - RNA, 12 nt, Human
gcauucacccag

SEQ ID NO: 2115598 - RNA, 15 nt, Human
gcauucacccagaca

SEQ ID NO: 2115599 - RNA, 19 nt, Human
gcauucacccagacagcuc

SEQ ID NO: 2115600 - RNA, 20 nt, Human
gcauucacccagacagcucc

SEQ ID NO: 2115601 - RNA, 13 nt, Human
gcauuugcugaau

SEQ ID NO: 2115602 - RNA, 14 nt, Human
gcauuugcugaaua

SEQ ID NO: 2115603 - RNA, 13 nt, Human
gcauuugugaggc

SEQ ID NO: 2115604 - RNA, 13 nt, Human
gcauuugugauca

SEQ ID NO: 2115605 - RNA, 17 nt, Human
gcauuugcugaauacag

SEQ ID NO: 2115606 - RNA, 16 nt, Human
gauaaauaacuuuuuu

SEQ ID NO: 2115607 - RNA, 21 nt, Human
gauaaauaacuuuuuuuuaag

SEQ ID NO: 2115608 - RNA, 18 nt, Human
gauaaauaaucggcccac

SEQ ID NO: 2115609 - RNA, 16 nt, Human
gauaagaguuggcugg

SEQ ID NO: 2115610 - RNA, 13 nt, Human
gauaaagauuucu

SEQ ID NO: 2115611 - RNA, 16 nt, Human
gauaaagauuucuuga

SEQ ID NO: 2115612 - RNA, 19 nt, Human
gaggaagcccuaagacguc

SEQ ID NO: 2115613 - RNA, 20 nt, Human
gaggaagcgugaaggccgag

SEQ ID NO: 2115614 - RNA, 19 nt, Human
gaggaagcuccaguccugc

SEQ ID NO: 2115615 - RNA, 21 nt, Human
gaggaagcuccaguccugcuc

SEQ ID NO: 2115616 - RNA, 22 nt, Human
gauaaagaugcaaggaccagga

SEQ ID NO: 2115617 - RNA, 19 nt, Human
gauacaccgggccuggaga

SEQ ID NO: 2115618 - RNA, 19 nt, Human
gauacaggaaaagcugcug

SEQ ID NO: 2115619 - RNA, 20 nt, Human
gauacacugaaguuaacaga

SEQ ID NO: 2115620 - RNA, 22 nt, Human
gauacacugaaguuaacagaga

SEQ ID NO: 2115621 - RNA, 14 nt, Human
gauagaugcccugc

SEQ ID NO: 2115622 - RNA, 18 nt, Human
gauacaggaaaagcugcu

SEQ ID NO: 2115623 - RNA, 19 nt, Human
gauagcacugagcaaagca

SEQ ID NO: 2115624 - RNA, 16 nt, Human
gauaguauugugcaua

SEQ ID NO: 2115625 - RNA, 18 nt, Human
gauaguagcauacauuua

SEQ ID NO: 2115626 - RNA, 16 nt, Human
gauagucaccuuuuaa

SEQ ID NO: 2115627 - RNA, 14 nt, Human
gaucaauaaaaugu

SEQ ID NO: 2115628 - RNA, 18 nt, Human
gaucaauaaaaugugauu

SEQ ID NO: 2115629 - RNA, 21 nt, Human
gaucaauaaaaugugauuuuu

SEQ ID NO: 2115630 - RNA, 19 nt, Human
gaucaauaaaaugugauuu

SEQ ID NO: 2115631 - RNA, 18 nt, Human
gaucacgccacugcacua

SEQ ID NO: 2115632 - RNA, 16 nt, Human
gaucacgccacugcac

SEQ ID NO: 2115633 - RNA, 22 nt, Human
gaucagucugauucccaagcuc

SEQ ID NO: 2115634 - RNA, 13 nt, Human
gaucaggugggga

SEQ ID NO: 2115635 - RNA, 14 nt, Human
gaucagguggggag

SEQ ID NO: 2115636 - RNA, 12 nt, Human
gaucagccuggg

SEQ ID NO: 2115637 - RNA, 15 nt, Human
gaucagccugggcaa

SEQ ID NO: 2115638 - RNA, 18 nt, Human
gaucagccagugaccaac

SEQ ID NO: 2115639 - RNA, 12 nt, Human
gaucacggcuca

SEQ ID NO: 2115640 - RNA, 15 nt, Human
gaucaauuaaaugua

SEQ ID NO: 2115641 - RNA, 16 nt, Human
gaucaauuaaauguag

SEQ ID NO: 2115642 - RNA, 23 nt, Human
gaucacgccacugcacuccagcc

SEQ ID NO: 2115643 - RNA, 24 nt, Human
gaucacgccacugcacuccagccu

SEQ ID NO: 2115644 - RNA, 10 nt, Human
gaucaugaga

SEQ ID NO: 2115645 - RNA, 12 nt, Human
gaucaugcauug

SEQ ID NO: 2115646 - RNA, 13 nt, Human
gaucaugcauugu

SEQ ID NO: 2115647 - RNA, 14 nt, Human
gaucaugcauuguu

SEQ ID NO: 2115648 - RNA, 15 nt, Human
gaucaugcauuguug

SEQ ID NO: 2115649 - RNA, 14 nt, Human
gaucauggcucacu

SEQ ID NO: 2115650 - RNA, 16 nt, Human
gaucauggcucacugc

SEQ ID NO: 2115651 - RNA, 20 nt, Human
gaucauggcucacugcagcc

SEQ ID NO: 2115652 - RNA, 21 nt, Human
gaucauggcucacugcagccu

SEQ ID NO: 2115653 - RNA, 21 nt, Human
gaucauccacugugccaugug

SEQ ID NO: 2115654 - RNA, 16 nt, Human
gaucauccacugugcc

SEQ ID NO: 2115655 - RNA, 19 nt, Human
gaucauccacugugccaug

SEQ ID NO: 2115656 - RNA, 17 nt, Human
gaucauccacugugcca

SEQ ID NO: 2115657 - RNA, 20 nt, Human
gaucaguauaauuuuuuaaa

SEQ ID NO: 2115658 - RNA, 23 nt, Human
gaucaguccuuugaucaguauaa

SEQ ID NO: 2115659 - RNA, 17 nt, Human
gaucagaugacuagaaa

SEQ ID NO: 2115660 - RNA, 18 nt, Human
gaucauuuuccccccacu

SEQ ID NO: 2115661 - RNA, 19 nt, Human
gaucauuuuccccccacuc

SEQ ID NO: 2115662 - RNA, 23 nt, Human
gaucauuuuccccccacucuccc

SEQ ID NO: 2115663 - RNA, 14 nt, Human
gaucauuuuccccc

SEQ ID NO: 2115664 - RNA, 15 nt, Human
gaucauuuucccccc

SEQ ID NO: 2115665 - RNA, 14 nt, Human
gauccccagcuguu

SEQ ID NO: 2115666 - RNA, 21 nt, Human
gaucccgccucuucuucuuca

SEQ ID NO: 2115667 - RNA, 18 nt, Human
gaucgugcuaaauuuuca

SEQ ID NO: 2115668 - RNA, 23 nt, Human
gaucgugccguuacucuccaacc

SEQ ID NO: 2115669 - RNA, 23 nt, Human
gaucgcgccacuacacuccagcc

SEQ ID NO: 2115670 - RNA, 22 nt, Human
gaucggaggcuugucagagcug

SEQ ID NO: 2115671 - RNA, 17 nt, Human
gaucgcgccacugcacu

SEQ ID NO: 2115672 - RNA, 15 nt, Human
gaucgugcuaaauuu

SEQ ID NO: 2115673 - RNA, 14 nt, Human
gaucucagggaagc

SEQ ID NO: 2115674 - RNA, 18 nt, Human
gaucucagggaagcccag

SEQ ID NO: 2115675 - RNA, 19 nt, Human
gaucucagggaagcccagc

SEQ ID NO: 2115676 - RNA, 20 nt, Human
gaucucagggaagcccagcu

SEQ ID NO: 2115677 - RNA, 21 nt, Human
gaucucagggaagcccagcuc

SEQ ID NO: 2115678 - RNA, 17 nt, Human
gaucuuugcagacaggc

SEQ ID NO: 2115679 - RNA, 18 nt, Human
gaucuuugcagacaggca

SEQ ID NO: 2115680 - RNA, 20 nt, Human
gaucuguuguguacguggag

SEQ ID NO: 2115681 - RNA, 16 nt, Human
gaucugugcccagaga

SEQ ID NO: 2115682 - RNA, 13 nt, Human
gaucugugcccca

SEQ ID NO: 2115683 - RNA, 19 nt, Human
gaucugugcccagagaugg

SEQ ID NO: 2115684 - RNA, 14 nt, Human
gaucugugccccau

SEQ ID NO: 2115685 - RNA, 18 nt, Human
gaucugugccccaugccu

SEQ ID NO: 2115686 - RNA, 20 nt, Human
gaugaagaaaagugggccag

SEQ ID NO: 2115687 - RNA, 14 nt, Human
gaugaagagugaga

SEQ ID NO: 2115688 - RNA, 19 nt, Human
gaugaacucuuucuggccu

SEQ ID NO: 2115689 - RNA, 19 nt, Human
gaugaagcaaacacauuaa

SEQ ID NO: 2115690 - RNA, 16 nt, Human
gaugaagcaaacacau

SEQ ID NO: 2115691 - RNA, 15 nt, Human
gaugaagcaaacaca

SEQ ID NO: 2115692 - RNA, 21 nt, Human
gaugaagagugagagggcaug

SEQ ID NO: 2115693 - RNA, 13 nt, Human
gaugcaccagccc

SEQ ID NO: 2115694 - RNA, 16 nt, Human
gaugcacaucccugga

SEQ ID NO: 2115695 - RNA, 15 nt, Human
gaugcacaucccugg

SEQ ID NO: 2115696 - RNA, 17 nt, Human
gaugaaguuaucuggcu

SEQ ID NO: 2115697 - RNA, 19 nt, Human
gaugaaguuaucuggcuuc

SEQ ID NO: 2115698 - RNA, 16 nt, Human
gaugcagcauuaugau

SEQ ID NO: 2115699 - RNA, 17 nt, Human
gaugccacacagagugg

SEQ ID NO: 2115700 - RNA, 19 nt, Human
gaugccugguggcagcugc

SEQ ID NO: 2115701 - RNA, 18 nt, Human
gaugccugguggcagcug

SEQ ID NO: 2115702 - RNA, 20 nt, Human
gaugccugguggcagcugcg

SEQ ID NO: 2115703 - RNA, 14 nt, Human
gauggauucucaga

SEQ ID NO: 2115704 - RNA, 22 nt, Human
gauggauuuccagccaaagccu

SEQ ID NO: 2115705 - RNA, 14 nt, Human
gauggauuugccug

SEQ ID NO: 2115706 - RNA, 19 nt, Human
gauggauuugccugugcca

SEQ ID NO: 2115707 - RNA, 16 nt, Human
gauggauucucagaua

SEQ ID NO: 2115708 - RNA, 18 nt, Human
gauggauucucagauauu

SEQ ID NO: 2115709 - RNA, 19 nt, Human
gauggauucucagauauuu

SEQ ID NO: 2115710 - RNA, 22 nt, Human
gauggauucucagauauuuaua

SEQ ID NO: 2115711 - RNA, 14 nt, Human
gauggcgcuaggca

SEQ ID NO: 2115712 - RNA, 20 nt, Human
gauggcugugccucugccug

SEQ ID NO: 2115713 - RNA, 19 nt, Human
gauggcugugccucugccu

SEQ ID NO: 2115714 - RNA, 18 nt, Human
gauggcugugccucugcc

SEQ ID NO: 2115715 - RNA, 17 nt, Human
gauggcugugccucugc

SEQ ID NO: 2115716 - RNA, 13 nt, Human
gauggcugugccu

SEQ ID NO: 2115717 - RNA, 21 nt, Human
gauggcuaaaaccaucauagu

SEQ ID NO: 2115718 - RNA, 20 nt, Human
gauuugucuuuggugaacau

SEQ ID NO: 2115719 - RNA, 22 nt, Human
gauuugucuuuggugaacauug

SEQ ID NO: 2115720 - RNA, 19 nt, Human
gauuuguacuacaguucuu

SEQ ID NO: 2115721 - RNA, 21 nt, Human
gauuuguacuacaguucuuuu

SEQ ID NO: 2115722 - RNA, 21 nt, Human
gauuuguccuuggggacaucu

SEQ ID NO: 2115723 - RNA, 13 nt, Human
gauuuuccugugg

SEQ ID NO: 2115724 - RNA, 19 nt, Human
gauuuucagcccucagaau

SEQ ID NO: 2115725 - RNA, 15 nt, Human
gauuuucagcccuca

SEQ ID NO: 2115726 - RNA, 11 nt, Human
gauuuucagcc

SEQ ID NO: 2115727 - RNA, 13 nt, Human
gauuuuuauccaa

SEQ ID NO: 2115728 - RNA, 14 nt, Human
gauuuuuauccaau

SEQ ID NO: 2115729 - RNA, 20 nt, Human
gauuuuuauccaaucuuguu

SEQ ID NO: 2115730 - RNA, 23 nt, Human
gauuuucuacaaguauucugccu

SEQ ID NO: 2115731 - RNA, 15 nt, Human
gauuucccuucuucu

SEQ ID NO: 2115732 - RNA, 22 nt, Human
gauuucccuucuucugucaucu

SEQ ID NO: 2115733 - RNA, 11 nt, Human
gauuucuccca

SEQ ID NO: 2115734 - RNA, 20 nt, Human
gauuucucccagcucuagac

SEQ ID NO: 2115735 - RNA, 17 nt, Human
gauuuggugaauuugaa

SEQ ID NO: 2115736 - RNA, 18 nt, Human
gauuuggugaauuugaau

SEQ ID NO: 2115737 - RNA, 22 nt, Human
gauuuggagcacucugaguuua

SEQ ID NO: 2115738 - RNA, 18 nt, Human
gauuugcuaucaaaauaa

SEQ ID NO: 2115739 - RNA, 21 nt, Human
gauuugcuaucaaaauaaauu

SEQ ID NO: 2115740 - RNA, 17 nt, Human
gauuugcccauuuacac

SEQ ID NO: 2115741 - RNA, 19 nt, Human
gauuugcccauuuacacuu

SEQ ID NO: 2115742 - RNA, 15 nt, Human
gauuugccugugcca

SEQ ID NO: 2115743 - RNA, 11 nt, Human
gauuucugauu

SEQ ID NO: 2115744 - RNA, 12 nt, Human
gauuucugauuu

SEQ ID NO: 2115745 - RNA, 21 nt, Human
gauugcaacaggcugggcuuc

SEQ ID NO: 2115746 - RNA, 16 nt, Human
gauugcaccacugcac

SEQ ID NO: 2115747 - RNA, 23 nt, Human
gauugcaccacugcacuccagcc

SEQ ID NO: 2115748 - RNA, 20 nt, Human
gauugcaacaggcugggcuu

SEQ ID NO: 2115749 - RNA, 20 nt, Human
gauucccaagcucugcuccu

SEQ ID NO: 2115750 - RNA, 19 nt, Human
gauucccaagcucugcucc

SEQ ID NO: 2115751 - RNA, 21 nt, Human
gauucccaagcucugcuccuc

SEQ ID NO: 2115752 - RNA, 21 nt, Human
gauucgagcuauauuuaagua

SEQ ID NO: 2115753 - RNA, 18 nt, Human
gauucgcccaaagccaga

SEQ ID NO: 2115754 - RNA, 13 nt, Human
gauuccuuucccu

SEQ ID NO: 2115755 - RNA, 20 nt, Human
gauuccuuucccuuuagcac

SEQ ID NO: 2115756 - RNA, 10 nt, Human
gauuccuuuu

SEQ ID NO: 2115757 - RNA, 15 nt, Human
gauuccuuuucuugu

SEQ ID NO: 2115758 - RNA, 16 nt, Human
gauuccuuuucuuguu

SEQ ID NO: 2115759 - RNA, 20 nt, Human
gauggggagaucggggccag

SEQ ID NO: 2115760 - RNA, 21 nt, Human
gauggggagaucggggccaga

SEQ ID NO: 2115761 - RNA, 13 nt, Human
gauggggccacag

SEQ ID NO: 2115762 - RNA, 14 nt, Human
gauggggccacagc

SEQ ID NO: 2115763 - RNA, 15 nt, Human
gauggggccacagcc

SEQ ID NO: 2115764 - RNA, 15 nt, Human
gaugggggaugcuuc

SEQ ID NO: 2115765 - RNA, 21 nt, Human
gaugggggagucugaagcaga

SEQ ID NO: 2115766 - RNA, 23 nt, Human
gauggggucucacaguguugccc

SEQ ID NO: 2115767 - RNA, 13 nt, Human
gauucagcucugc

SEQ ID NO: 2115768 - RNA, 15 nt, Human
gauucagcucugcaa

SEQ ID NO: 2115769 - RNA, 22 nt, Human
gauucaucuacccugcugaccu

SEQ ID NO: 2115770 - RNA, 22 nt, Human
gauuccagagaguggcuccucc

SEQ ID NO: 2115771 - RNA, 20 nt, Human
gauuccagagaguggcuccu

SEQ ID NO: 2115772 - RNA, 19 nt, Human
gauuccagagaguggcucc

SEQ ID NO: 2115773 - RNA, 18 nt, Human
gauucccaagcucugcuc

SEQ ID NO: 2115774 - RNA, 14 nt, Human
gauuccaucuccuu

SEQ ID NO: 2115775 - RNA, 15 nt, Human
gauuccaucuccuug

SEQ ID NO: 2115776 - RNA, 19 nt, Human
gauuccaucuccuugucuu

SEQ ID NO: 2115777 - RNA, 17 nt, Human
gauucauauuuacuucu

SEQ ID NO: 2115778 - RNA, 18 nt, Human
gauucauauuuacuucuu

SEQ ID NO: 2115779 - RNA, 19 nt, Human
gauucauauuuacuucuua

SEQ ID NO: 2115780 - RNA, 15 nt, Human
gauuuuugucuugug

SEQ ID NO: 2115781 - RNA, 10 nt, Human
gcaaaauuuc

SEQ ID NO: 2115782 - RNA, 13 nt, Human
gcaaacaccugcu

SEQ ID NO: 2115783 - RNA, 15 nt, Human
gcaaacaccugcuga

SEQ ID NO: 2115784 - RNA, 16 nt, Human
gcaaaauuuuauagcu

SEQ ID NO: 2115785 - RNA, 17 nt, Human
gcaaacacacaaaggua

SEQ ID NO: 2115786 - RNA, 12 nt, Human
gcaaagcauuga

SEQ ID NO: 2115787 - RNA, 20 nt, Human
gcaaaggggucccauagagg

SEQ ID NO: 2115788 - RNA, 23 nt, Human
gcaaaggggucccauagagguga

SEQ ID NO: 2115789 - RNA, 12 nt, Human
gcaaaucaaugc

SEQ ID NO: 2115790 - RNA, 13 nt, Human
gcaaaucagaaac

SEQ ID NO: 2115791 - RNA, 15 nt, Human
gcaaaucagaaacuu

SEQ ID NO: 2115792 - RNA, 20 nt, Human
gcaaaucagaaacuugugaa

SEQ ID NO: 2115793 - RNA, 22 nt, Human
gcaaaucagaaacuugugaagu

SEQ ID NO: 2115794 - RNA, 17 nt, Human
gcaagaauugaagcagg

SEQ ID NO: 2115795 - RNA, 14 nt, Human
gcaagaaggaauug

SEQ ID NO: 2115796 - RNA, 17 nt, Human
gcaagaaagaaacccga

SEQ ID NO: 2115797 - RNA, 17 nt, Human
gcaacacucuauauuua

SEQ ID NO: 2115798 - RNA, 19 nt, Human
gcaacagacaagugacugu

SEQ ID NO: 2115799 - RNA, 19 nt, Human
gcaacagagugagacccug

SEQ ID NO: 2115800 - RNA, 13 nt, Human
gcaacagacaagu

SEQ ID NO: 2115801 - RNA, 14 nt, Human
gcaacagagugaga

SEQ ID NO: 2115802 - RNA, 13 nt, Human
gcaacagaaaaaa

SEQ ID NO: 2115803 - RNA, 15 nt, Human
gcaagaauuugaucg

SEQ ID NO: 2115804 - RNA, 16 nt, Human
gcaagacccugucucu

SEQ ID NO: 2115805 - RNA, 19 nt, Human
gcaagagaauugcuugaac

SEQ ID NO: 2115806 - RNA, 17 nt, Human
gcaagagagauguuuug

SEQ ID NO: 2115807 - RNA, 14 nt, Human
gcaagagagauguu

SEQ ID NO: 2115808 - RNA, 13 nt, Human
gcaagagccuugg

SEQ ID NO: 2115809 - RNA, 22 nt, Human
gcaagagccuugguguccaccu

SEQ ID NO: 2115810 - RNA, 23 nt, Human
gcaagagccuugguguccaccug

SEQ ID NO: 2115811 - RNA, 19 nt, Human
gcaagccuguaaucccagc

SEQ ID NO: 2115812 - RNA, 20 nt, Human
gcaagccuguaaucccagcu

SEQ ID NO: 2115813 - RNA, 20 nt, Human
gcaagcauuuauguuuauuu

SEQ ID NO: 2115814 - RNA, 15 nt, Human
gcaaggggaaaaucu

SEQ ID NO: 2115815 - RNA, 16 nt, Human
gcaaggggaaaaucuc

SEQ ID NO: 2115816 - RNA, 14 nt, Human
gcaaggggcucugc

SEQ ID NO: 2115817 - RNA, 14 nt, Human
gcaaggggugccug

SEQ ID NO: 2115818 - RNA, 16 nt, Human
gcaaggggugccuggg

SEQ ID NO: 2115819 - RNA, 18 nt, Human
gcaaggggugccugggaa

SEQ ID NO: 2115820 - RNA, 19 nt, Human
gcaaggggugccugggaac

SEQ ID NO: 2115821 - RNA, 20 nt, Human
gcaaggccgcuguucaccca

SEQ ID NO: 2115822 - RNA, 21 nt, Human
gcaaggccgcuguucacccac

SEQ ID NO: 2115823 - RNA, 23 nt, Human
gcaaugcuggcuguuggcugggg

SEQ ID NO: 2115824 - RNA, 22 nt, Human
gcaaugcuggcuguuggcuggg

SEQ ID NO: 2115825 - RNA, 14 nt, Human
gcaaugcuggcugu

SEQ ID NO: 2115826 - RNA, 13 nt, Human
gcaaugcuggcug

SEQ ID NO: 2115827 - RNA, 13 nt, Human
gcaauccauguua

SEQ ID NO: 2115828 - RNA, 20 nt, Human
gcaauccauguuaguuuuua

SEQ ID NO: 2115829 - RNA, 21 nt, Human
gcaauccauguuaguuuuuac

SEQ ID NO: 2115830 - RNA, 22 nt, Human
gcaauccauguuaguuuuuacu

SEQ ID NO: 2115831 - RNA, 16 nt, Human
gcaaugauuacucuuu

SEQ ID NO: 2115832 - RNA, 14 nt, Human
gcaaugauuacucu

SEQ ID NO: 2115833 - RNA, 15 nt, Human
gcaaucaaaucugcu

SEQ ID NO: 2115834 - RNA, 17 nt, Human
gcaauauuuaaggagau

SEQ ID NO: 2115835 - RNA, 22 nt, Human
gcaauauuuaaggagauguaag

SEQ ID NO: 2115836 - RNA, 20 nt, Human
gcaaucagauuuuccugugg

SEQ ID NO: 2115837 - RNA, 17 nt, Human
gcaaucaaaucugcuuu

SEQ ID NO: 2115838 - RNA, 15 nt, Human
gcccaggcuggagug

SEQ ID NO: 2115839 - RNA, 15 nt, Human
gcccaggccuccagc

SEQ ID NO: 2115840 - RNA, 16 nt, Human
gcccaggccuccagcu

SEQ ID NO: 2115841 - RNA, 17 nt, Human
gcccaggccuccagcuc

SEQ ID NO: 2115842 - RNA, 18 nt, Human
gcccaggccuccagcuca

SEQ ID NO: 2115843 - RNA, 21 nt, Human
gcccaggccuccagcucagca

SEQ ID NO: 2115844 - RNA, 23 nt, Human
gcccaggccccugccacccuggg

SEQ ID NO: 2115845 - RNA, 19 nt, Human
gcccagagaugccuccacc

SEQ ID NO: 2115846 - RNA, 20 nt, Human
gcccagagaugccuccaccg

SEQ ID NO: 2115847 - RNA, 22 nt, Human
gcccagagaugccuccaccgcu

SEQ ID NO: 2115848 - RNA, 21 nt, Human
gcccagagaugggacugggag

SEQ ID NO: 2115849 - RNA, 22 nt, Human
gcccagagaugggacugggagg

SEQ ID NO: 2115850 - RNA, 16 nt, Human
gcccagagaugccucc

SEQ ID NO: 2115851 - RNA, 17 nt, Human
gcccagagaugccucca

SEQ ID NO: 2115852 - RNA, 18 nt, Human
gcccagagaugccuccac

SEQ ID NO: 2115853 - RNA, 15 nt, Human
gcccagagagggugg

SEQ ID NO: 2115854 - RNA, 21 nt, Human
gcccagagaggguggugaccu

SEQ ID NO: 2115855 - RNA, 12 nt, Human
gcccaggcuggc

SEQ ID NO: 2115856 - RNA, 18 nt, Human
gcccagggagaggccaug

SEQ ID NO: 2115857 - RNA, 19 nt, Human
gcccagggagaggccauga

SEQ ID NO: 2115858 - RNA, 16 nt, Human
gcccagggagcggaaa

SEQ ID NO: 2115859 - RNA, 17 nt, Human
gcccagggagcggaaag

SEQ ID NO: 2115860 - RNA, 20 nt, Human
gcccagggagcggaaagcag

SEQ ID NO: 2115861 - RNA, 13 nt, Human
gcccagggccacu

SEQ ID NO: 2115862 - RNA, 15 nt, Human
gcccagggccacucu

SEQ ID NO: 2115863 - RNA, 18 nt, Human
gcccagggccacucugcc

SEQ ID NO: 2115864 - RNA, 17 nt, Human
gcccagggauuuguccu

SEQ ID NO: 2115865 - RNA, 21 nt, Human
gcccagggagcggaaagcagc

SEQ ID NO: 2115866 - RNA, 23 nt, Human
gcccagggagcggaaagcagcuc

SEQ ID NO: 2115867 - RNA, 19 nt, Human
gcccagggccacucugccu

SEQ ID NO: 2115868 - RNA, 20 nt, Human
gcccagggccacucugccuc

SEQ ID NO: 2115869 - RNA, 22 nt, Human
gcccagggccacucugccucug

SEQ ID NO: 2115870 - RNA, 21 nt, Human
gccccaccuuuauuaaaaucu

SEQ ID NO: 2115871 - RNA, 23 nt, Human
gccccaccuuuauuaaaaucuua

SEQ ID NO: 2115872 - RNA, 15 nt, Human
gccccaccuuuauua

SEQ ID NO: 2115873 - RNA, 20 nt, Human
gccccaccuuuauuaaaauc

SEQ ID NO: 2115874 - RNA, 12 nt, Human
gccccaccugcc

SEQ ID NO: 2115875 - RNA, 14 nt, Human
gccccaccugccac

SEQ ID NO: 2115876 - RNA, 15 nt, Human
gccccaccugccacu

SEQ ID NO: 2115877 - RNA, 17 nt, Human
gccccaccugccacuag

SEQ ID NO: 2115878 - RNA, 20 nt, Human
gccccaccugccacuaggcu

SEQ ID NO: 2115879 - RNA, 23 nt, Human
gccccaccugccacuaggcuggg

SEQ ID NO: 2115880 - RNA, 15 nt, Human
gccccagaaggcagg

SEQ ID NO: 2115881 - RNA, 12 nt, Human
gccccacugccc

SEQ ID NO: 2115882 - RNA, 18 nt, Human
gccccacugcccuucuca

SEQ ID NO: 2115883 - RNA, 13 nt, Human
gccccacugggga

SEQ ID NO: 2115884 - RNA, 14 nt, Human
gccccacuggggaa

SEQ ID NO: 2115885 - RNA, 15 nt, Human
gccccacuggggaaa

SEQ ID NO: 2115886 - RNA, 18 nt, Human
gccccagaaggcagggaa

SEQ ID NO: 2115887 - RNA, 11 nt, Human
gccccagagac

SEQ ID NO: 2115888 - RNA, 15 nt, Human
gccccagagacucag

SEQ ID NO: 2115889 - RNA, 17 nt, Human
gccccagagacucagag

SEQ ID NO: 2115890 - RNA, 12 nt, Human
gccccagagcug

SEQ ID NO: 2115891 - RNA, 13 nt, Human
gccccagagcugu

SEQ ID NO: 2115892 - RNA, 14 nt, Human
gccccagagcuguu

SEQ ID NO: 2115893 - RNA, 22 nt, Human
gccccagagcuguuuauggccu

SEQ ID NO: 2115894 - RNA, 23 nt, Human
gccccagagcuguuuauggccuc

SEQ ID NO: 2115895 - RNA, 16 nt, Human
gcccaggguuccccca

SEQ ID NO: 2115896 - RNA, 17 nt, Human
gcccaucaauuauagaa

SEQ ID NO: 2115897 - RNA, 13 nt, Human
gcccaucacaggg

SEQ ID NO: 2115898 - RNA, 17 nt, Human
gcccaucacaggguugg

SEQ ID NO: 2115899 - RNA, 21 nt, Human
gcccaucacaggguugggccc

SEQ ID NO: 2115900 - RNA, 22 nt, Human
gcccaucacaggguugggccca

SEQ ID NO: 2115901 - RNA, 23 nt, Human
gcccccugguggacaguccuggg

SEQ ID NO: 2115902 - RNA, 21 nt, Human
gcccccugguggacaguccug

SEQ ID NO: 2115903 - RNA, 22 nt, Human
gcccccugguggacaguccugg

SEQ ID NO: 2115904 - RNA, 16 nt, Human
gcccccacaccuggcc

SEQ ID NO: 2115905 - RNA, 17 nt, Human
gcccccacaccuggccc

SEQ ID NO: 2115906 - RNA, 18 nt, Human
gcccccacaccuggcccu

SEQ ID NO: 2115907 - RNA, 19 nt, Human
gcccccacaccuggcccug

SEQ ID NO: 2115908 - RNA, 23 nt, Human
gcccccacaccuggcccuggggc

SEQ ID NO: 2115909 - RNA, 23 nt, Human
gcccccacagaaagacugagcuc

SEQ ID NO: 2115910 - RNA, 14 nt, Human
gcccccaagccugc

SEQ ID NO: 2115911 - RNA, 21 nt, Human
gcccccaccacuaggacucug

SEQ ID NO: 2115912 - RNA, 18 nt, Human
gccccaugucucucagaa

SEQ ID NO: 2115913 - RNA, 15 nt, Human
gccccaugucucuca

SEQ ID NO: 2115914 - RNA, 16 nt, Human
gccccaugucucucag

SEQ ID NO: 2115915 - RNA, 14 nt, Human
gccccauucugccu

SEQ ID NO: 2115916 - RNA, 15 nt, Human
gccccauucugccug

SEQ ID NO: 2115917 - RNA, 12 nt, Human
gccccagugccc

SEQ ID NO: 2115918 - RNA, 23 nt, Human
gccccagggucuucccuaccuca

SEQ ID NO: 2115919 - RNA, 16 nt, Human
gccccagggcuacccu

SEQ ID NO: 2115920 - RNA, 18 nt, Human
gccccagggcuacccucc

SEQ ID NO: 2115921 - RNA, 16 nt, Human
gccccagggucuuccc

SEQ ID NO: 2115922 - RNA, 17 nt, Human
gccccagggucuucccu

SEQ ID NO: 2115923 - RNA, 20 nt, Human
gccccagggucuucccuacc

SEQ ID NO: 2115924 - RNA, 21 nt, Human
gccccagggucuucccuaccu

SEQ ID NO: 2115925 - RNA, 18 nt, Human
gccccagcaccaccaggu

SEQ ID NO: 2115926 - RNA, 19 nt, Human
gccccagcaccaccagguc

SEQ ID NO: 2115927 - RNA, 19 nt, Human
gccccagcacuaacguaaa

SEQ ID NO: 2115928 - RNA, 11 nt, Human
gccccaccugc

SEQ ID NO: 2115929 - RNA, 12 nt, Human
gccccagcacua

SEQ ID NO: 2115930 - RNA, 17 nt, Human
gccccagcacuaaagca

SEQ ID NO: 2115931 - RNA, 19 nt, Human
gccccagcacuaaagcagu

SEQ ID NO: 2115932 - RNA, 23 nt, Human
gccccagcacuaaagcaguggac

SEQ ID NO: 2115933 - RNA, 21 nt, Human
gccccauaauuuuuuuuuucc

SEQ ID NO: 2115934 - RNA, 17 nt, Human
gccccaucagcuccagc

SEQ ID NO: 2115935 - RNA, 16 nt, Human
gccccaucagcuccag

SEQ ID NO: 2115936 - RNA, 15 nt, Human
gccccaucagcucca

SEQ ID NO: 2115937 - RNA, 14 nt, Human
gccccagugcccac

SEQ ID NO: 2115938 - RNA, 13 nt, Human
gccccagugccca

SEQ ID NO: 2115939 - RNA, 14 nt, Human
gccccagugccaag

SEQ ID NO: 2115940 - RNA, 15 nt, Human
gcccgcacccccacc

SEQ ID NO: 2115941 - RNA, 16 nt, Human
gcccgcacccccaccc

SEQ ID NO: 2115942 - RNA, 17 nt, Human
gcccgcacccccacccu

SEQ ID NO: 2115943 - RNA, 21 nt, Human
gcccgcacccccacccuuugg

SEQ ID NO: 2115944 - RNA, 14 nt, Human
gcccgcaugcagca

SEQ ID NO: 2115945 - RNA, 16 nt, Human
gcccgcaugcagcagc

SEQ ID NO: 2115946 - RNA, 17 nt, Human
gcccgcaugcagcagcu

SEQ ID NO: 2115947 - RNA, 19 nt, Human
gcccgcacccccacccuuu

SEQ ID NO: 2115948 - RNA, 17 nt, Human
gcccucauuacggcucc

SEQ ID NO: 2115949 - RNA, 18 nt, Human
gcccucauuacggcuccu

SEQ ID NO: 2115950 - RNA, 20 nt, Human
gcccucauuacggcuccucu

SEQ ID NO: 2115951 - RNA, 21 nt, Human
gcccucauuacggcuccucuc

SEQ ID NO: 2115952 - RNA, 13 nt, Human
gcccuccacugcc

SEQ ID NO: 2115953 - RNA, 15 nt, Human
gcccuccacugcccu

SEQ ID NO: 2115954 - RNA, 16 nt, Human
gcccuccacugcccuc

SEQ ID NO: 2115955 - RNA, 18 nt, Human
gcccuccacugcccucug

SEQ ID NO: 2115956 - RNA, 23 nt, Human
gcccuccacugcccucuguucag

SEQ ID NO: 2115957 - RNA, 16 nt, Human
gcccuccaucccgaca

SEQ ID NO: 2115958 - RNA, 22 nt, Human
gcccuccaucccgacauggacc

SEQ ID NO: 2115959 - RNA, 14 nt, Human
gcccuccacagccg

SEQ ID NO: 2115960 - RNA, 20 nt, Human
gcccuccacagccgcagccu

SEQ ID NO: 2115961 - RNA, 17 nt, Human
gcccuccacaucccuga

SEQ ID NO: 2115962 - RNA, 23 nt, Human
gcccuccacagccgcagccuccc

SEQ ID NO: 2115963 - RNA, 21 nt, Human
gcccucccugccccucccuuc

SEQ ID NO: 2115964 - RNA, 14 nt, Human
gcccucccuguccu

SEQ ID NO: 2115965 - RNA, 16 nt, Human
gcccucccuguccucc

SEQ ID NO: 2115966 - RNA, 18 nt, Human
gcccucccuguccuccuc

SEQ ID NO: 2115967 - RNA, 21 nt, Human
gcccucccuguccuccucgga

SEQ ID NO: 2115968 - RNA, 23 nt, Human
gcccuccgccauucucaagcccu

SEQ ID NO: 2115969 - RNA, 14 nt, Human
gcccugagcuuucu

SEQ ID NO: 2115970 - RNA, 15 nt, Human
gcccugagcucggug

SEQ ID NO: 2115971 - RNA, 16 nt, Human
gcccugagcucggugg

SEQ ID NO: 2115972 - RNA, 13 nt, Human
gcccugagcucgg

SEQ ID NO: 2115973 - RNA, 13 nt, Human
gcccucuucuuac

SEQ ID NO: 2115974 - RNA, 14 nt, Human
gcccucuucuuacu

SEQ ID NO: 2115975 - RNA, 22 nt, Human
gcccugagcucgguggacccag

SEQ ID NO: 2115976 - RNA, 13 nt, Human
gcccugcagaggg

SEQ ID NO: 2115977 - RNA, 18 nt, Human
gccccgaggccuucucug

SEQ ID NO: 2115978 - RNA, 15 nt, Human
gccccgaggccuucu

SEQ ID NO: 2115979 - RNA, 15 nt, Human
gcccccuucucccac

SEQ ID NO: 2115980 - RNA, 16 nt, Human
gcccccuucucccaca

SEQ ID NO: 2115981 - RNA, 17 nt, Human
gcccccuucucccacac

SEQ ID NO: 2115982 - RNA, 18 nt, Human
gcccccuucucccacacu

SEQ ID NO: 2115983 - RNA, 19 nt, Human
gcccccuucucccacacug

SEQ ID NO: 2115984 - RNA, 20 nt, Human
gcccccuucucccacacugc

SEQ ID NO: 2115985 - RNA, 22 nt, Human
gcccccuucucccacacugcua

SEQ ID NO: 2115986 - RNA, 22 nt, Human
gccccucccccaacccccaccc

SEQ ID NO: 2115987 - RNA, 23 nt, Human
gccccucccccaacccccacccc

SEQ ID NO: 2115988 - RNA, 16 nt, Human
gccccucccaccacag

SEQ ID NO: 2115989 - RNA, 14 nt, Human
gccccucccuaccu

SEQ ID NO: 2115990 - RNA, 15 nt, Human
gccccucccuaccuc

SEQ ID NO: 2115991 - RNA, 16 nt, Human
gccccucccuaccuca

SEQ ID NO: 2115992 - RNA, 17 nt, Human
gccccucccuaccucaa

SEQ ID NO: 2115993 - RNA, 18 nt, Human
gccccucccuaccucaac

SEQ ID NO: 2115994 - RNA, 21 nt, Human
gccccucccuaccucaaccug

SEQ ID NO: 2115995 - RNA, 14 nt, Human
gccccucaccuggg

SEQ ID NO: 2115996 - RNA, 20 nt, Human
gccccucaccugggcaccug

SEQ ID NO: 2115997 - RNA, 17 nt, Human
gccccucaccugggcac

SEQ ID NO: 2115998 - RNA, 12 nt, Human
gccccucccacc

SEQ ID NO: 2115999 - RNA, 13 nt, Human
gccccucccacca

SEQ ID NO: 2116000 - RNA, 14 nt, Human
gccccucccaccac

SEQ ID NO: 2116001 - RNA, 15 nt, Human
gccccucccaccaca

SEQ ID NO: 2116002 - RNA, 12 nt, Human
gccccuccccca

SEQ ID NO: 2116003 - RNA, 15 nt, Human
gccccucccccaacc

SEQ ID NO: 2116004 - RNA, 21 nt, Human
gccccucccccaacccccacc

SEQ ID NO: 2116005 - RNA, 15 nt, Human
gcccgaggcaccagu

SEQ ID NO: 2116006 - RNA, 16 nt, Human
gcccgagguggcugcc

SEQ ID NO: 2116007 - RNA, 17 nt, Human
gcccgagguggcugccu

SEQ ID NO: 2116008 - RNA, 18 nt, Human
gcccgagguggcugccug

SEQ ID NO: 2116009 - RNA, 19 nt, Human
gcccgagguggcugccugg

SEQ ID NO: 2116010 - RNA, 22 nt, Human
gcccgagguggcugccuggagc

SEQ ID NO: 2116011 - RNA, 22 nt, Human
gcccgagcuggugcauuacaga

SEQ ID NO: 2116012 - RNA, 15 nt, Human
gcccgacagccuggc

SEQ ID NO: 2116013 - RNA, 14 nt, Human
gcccgacagccugg

SEQ ID NO: 2116014 - RNA, 12 nt, Human
gcccgacagccu

SEQ ID NO: 2116015 - RNA, 20 nt, Human
gccccuugcucuccccugcc

SEQ ID NO: 2116016 - RNA, 16 nt, Human
gccccuuuuuacuccc

SEQ ID NO: 2116017 - RNA, 18 nt, Human
gccccuuuuuacuccccu

SEQ ID NO: 2116018 - RNA, 19 nt, Human
gccccuuuuuacuccccuu

SEQ ID NO: 2116019 - RNA, 20 nt, Human
gccccuuuuuacuccccuug

SEQ ID NO: 2116020 - RNA, 21 nt, Human
gccccuuuuuacuccccuuga

SEQ ID NO: 2116021 - RNA, 22 nt, Human
gccccuguuaccuaauuagagc

SEQ ID NO: 2116022 - RNA, 22 nt, Human
gccccugagacaaauggaggcc

SEQ ID NO: 2116023 - RNA, 19 nt, Human
gccccucuugccccccacc

SEQ ID NO: 2116024 - RNA, 21 nt, Human
gccccucuugccccccacccc

SEQ ID NO: 2116025 - RNA, 13 nt, Human
gccccucuugccc

SEQ ID NO: 2116026 - RNA, 16 nt, Human
gccccucuugcccccc

SEQ ID NO: 2116027 - RNA, 18 nt, Human
gccccucuugccccccac

SEQ ID NO: 2116028 - RNA, 13 nt, Human
gccagcuggagaa

SEQ ID NO: 2116029 - RNA, 14 nt, Human
gccaggacaggccc

SEQ ID NO: 2116030 - RNA, 15 nt, Human
gccaggacaggcccg

SEQ ID NO: 2116031 - RNA, 17 nt, Human
gccaggaccgccaaaga

SEQ ID NO: 2116032 - RNA, 16 nt, Human
gccaggcgagaugggg

SEQ ID NO: 2116033 - RNA, 17 nt, Human
gccaggcucaggccaug

SEQ ID NO: 2116034 - RNA, 18 nt, Human
gccaggcucaggccaugg

SEQ ID NO: 2116035 - RNA, 20 nt, Human
gccaggcuccuuccugucuu

SEQ ID NO: 2116036 - RNA, 21 nt, Human
gccaggcuccuuccugucuuc

SEQ ID NO: 2116037 - RNA, 14 nt, Human
gccaggcuccuucc

SEQ ID NO: 2116038 - RNA, 15 nt, Human
gccaggcuccuuccu

SEQ ID NO: 2116039 - RNA, 18 nt, Human
gccaggcuccuuccuguc

SEQ ID NO: 2116040 - RNA, 19 nt, Human
gccaggcuccuuccugucu

SEQ ID NO: 2116041 - RNA, 20 nt, Human
gccagcugccgaccagagcc

SEQ ID NO: 2116042 - RNA, 20 nt, Human
gccagcugcagcugggcugu

SEQ ID NO: 2116043 - RNA, 15 nt, Human
gccagcugccgacca

SEQ ID NO: 2116044 - RNA, 14 nt, Human
gccagcugcaucua

SEQ ID NO: 2116045 - RNA, 18 nt, Human
gccagcugcaucuacuca

SEQ ID NO: 2116046 - RNA, 19 nt, Human
gccagcugcaucuacucag

SEQ ID NO: 2116047 - RNA, 22 nt, Human
gccagcugcaucuacucaggcc

SEQ ID NO: 2116048 - RNA, 12 nt, Human
gccagccuggcu

SEQ ID NO: 2116049 - RNA, 16 nt, Human
gccagccuggcuucug

SEQ ID NO: 2116050 - RNA, 17 nt, Human
gccagccuggcuucugg

SEQ ID NO: 2116051 - RNA, 18 nt, Human
gccagccuggcuucugga

SEQ ID NO: 2116052 - RNA, 19 nt, Human
gccagccuggcuucuggag

SEQ ID NO: 2116053 - RNA, 11 nt, Human
gccagccuggc

SEQ ID NO: 2116054 - RNA, 14 nt, Human
gccagcugcagcug

SEQ ID NO: 2116055 - RNA, 19 nt, Human
gccagcugcagcugggcug

SEQ ID NO: 2116056 - RNA, 20 nt, Human
gccagccuggcuucuggagc

SEQ ID NO: 2116057 - RNA, 21 nt, Human
gccagccuggcuucuggagcc

SEQ ID NO: 2116058 - RNA, 22 nt, Human
gccagccuggcuucuggagccc

SEQ ID NO: 2116059 - RNA, 17 nt, Human
gccagagggagugacag

SEQ ID NO: 2116060 - RNA, 14 nt, Human
gccagaugcaccag

SEQ ID NO: 2116061 - RNA, 22 nt, Human
gccagaugcacaucccuggaag

SEQ ID NO: 2116062 - RNA, 21 nt, Human
gccagaugcacaucccuggaa

SEQ ID NO: 2116063 - RNA, 20 nt, Human
gccagaggcagaacccuggu

SEQ ID NO: 2116064 - RNA, 23 nt, Human
gccagaggcagaacccuggugag

SEQ ID NO: 2116065 - RNA, 13 nt, Human
gccagaucuguua

SEQ ID NO: 2116066 - RNA, 21 nt, Human
gccagagagccuggugcugcu

SEQ ID NO: 2116067 - RNA, 15 nt, Human
gccagaugcaccagc

SEQ ID NO: 2116068 - RNA, 15 nt, Human
gccagauugccaucc

SEQ ID NO: 2116069 - RNA, 22 nt, Human
gccacugcaccgggccacagag

SEQ ID NO: 2116070 - RNA, 19 nt, Human
gccacugcaccgggccaca

SEQ ID NO: 2116071 - RNA, 22 nt, Human
gccacuccagaccccuggcuuu

SEQ ID NO: 2116072 - RNA, 21 nt, Human
gccacugcaccgggccacaga

SEQ ID NO: 2116073 - RNA, 20 nt, Human
gccacugcaccgggccacag

SEQ ID NO: 2116074 - RNA, 17 nt, Human
gccaacagaagcuucca

SEQ ID NO: 2116075 - RNA, 14 nt, Human
gccaacaccaggga

SEQ ID NO: 2116076 - RNA, 14 nt, Human
gccaaauuuuggcc

SEQ ID NO: 2116077 - RNA, 20 nt, Human
gccacuccagaccccuggcu

SEQ ID NO: 2116078 - RNA, 21 nt, Human
gccacuccagaccccuggcuu

SEQ ID NO: 2116079 - RNA, 19 nt, Human
gccaacagaagcuuccauu

SEQ ID NO: 2116080 - RNA, 20 nt, Human
gccaaggccagaguggccug

SEQ ID NO: 2116081 - RNA, 21 nt, Human
gccaaggccagaguggccugg

SEQ ID NO: 2116082 - RNA, 21 nt, Human
gccaucauguaaauuaccagu

SEQ ID NO: 2116083 - RNA, 12 nt, Human
gccaucuguggg

SEQ ID NO: 2116084 - RNA, 13 nt, Human
gccaucugugggc

SEQ ID NO: 2116085 - RNA, 15 nt, Human
gccaucugugggcac

SEQ ID NO: 2116086 - RNA, 17 nt, Human
gccaucugugggcacgc

SEQ ID NO: 2116087 - RNA, 18 nt, Human
gccaucuguguccugguu

SEQ ID NO: 2116088 - RNA, 14 nt, Human
gccauccagguuca

SEQ ID NO: 2116089 - RNA, 14 nt, Human
gccaugcuccuggc

SEQ ID NO: 2116090 - RNA, 13 nt, Human
gccaugaacuuug

SEQ ID NO: 2116091 - RNA, 20 nt, Human
gccaugauucgcccaaagcc

SEQ ID NO: 2116092 - RNA, 20 nt, Human
gccaugaggaguugcuguuu

SEQ ID NO: 2116093 - RNA, 19 nt, Human
gccaugacaacuucuaauu

SEQ ID NO: 2116094 - RNA, 23 nt, Human
gccaugacaacuucuaauugcca

SEQ ID NO: 2116095 - RNA, 15 nt, Human
gccaugaacuggagg

SEQ ID NO: 2116096 - RNA, 16 nt, Human
gccaugaacuggaggc

SEQ ID NO: 2116097 - RNA, 20 nt, Human
gccaugaacuggaggccagg

SEQ ID NO: 2116098 - RNA, 20 nt, Human
gccaugaggccucaguggac

SEQ ID NO: 2116099 - RNA, 16 nt, Human
gccaugaggccucagu

SEQ ID NO: 2116100 - RNA, 19 nt, Human
gccaugaggccucagugga

SEQ ID NO: 2116101 - RNA, 14 nt, Human
gccaguccugccug

SEQ ID NO: 2116102 - RNA, 16 nt, Human
gccaguccugccuggc

SEQ ID NO: 2116103 - RNA, 17 nt, Human
gccaguccugccuggcc

SEQ ID NO: 2116104 - RNA, 15 nt, Human
gccaggcuggucuca

SEQ ID NO: 2116105 - RNA, 13 nt, Human
gccaggcuggucu

SEQ ID NO: 2116106 - RNA, 24 nt, Human
gcccaaccugcucuccucuugcca

SEQ ID NO: 2116107 - RNA, 22 nt, Human
gcccaagaauagaugcugacug

SEQ ID NO: 2116108 - RNA, 21 nt, Human
gcccaagaauagaugcugacu

SEQ ID NO: 2116109 - RNA, 19 nt, Human
gcccaagacagaugcccca

SEQ ID NO: 2116110 - RNA, 20 nt, Human
gcccaagacagaugccccag

SEQ ID NO: 2116111 - RNA, 21 nt, Human
gcccaagacagaugccccaga

SEQ ID NO: 2116112 - RNA, 23 nt, Human
gcccaagacagaugccccagagc

SEQ ID NO: 2116113 - RNA, 16 nt, Human
gccaugggccuccugu

SEQ ID NO: 2116114 - RNA, 15 nt, Human
gccaugggccuccug

SEQ ID NO: 2116115 - RNA, 24 nt, Human
gccaugcuccuggcccacugcauc

SEQ ID NO: 2116116 - RNA, 22 nt, Human
gcccacauguguccaucccagc

SEQ ID NO: 2116117 - RNA, 23 nt, Human
gcccacauguguccaucccagcg

SEQ ID NO: 2116118 - RNA, 17 nt, Human
gcccaccaacaucccau

SEQ ID NO: 2116119 - RNA, 16 nt, Human
gcccacauuggaccca

SEQ ID NO: 2116120 - RNA, 21 nt, Human
gcccaccaacaucccauugcc

SEQ ID NO: 2116121 - RNA, 20 nt, Human
gcccacauagugaugguucc

SEQ ID NO: 2116122 - RNA, 18 nt, Human
gcccacagguguccccag

SEQ ID NO: 2116123 - RNA, 22 nt, Human
gcccacagguguccccagccca

SEQ ID NO: 2116124 - RNA, 23 nt, Human
gcccacagguguccccagcccac

SEQ ID NO: 2116125 - RNA, 12 nt, Human
gcccacagucug

SEQ ID NO: 2116126 - RNA, 19 nt, Human
gcccacagucugacuuccc

SEQ ID NO: 2116127 - RNA, 13 nt, Human
gcccaagcccuga

SEQ ID NO: 2116128 - RNA, 17 nt, Human
gcccaccuuggcucaag

SEQ ID NO: 2116129 - RNA, 16 nt, Human
gcccaccuuggcucaa

SEQ ID NO: 2116130 - RNA, 15 nt, Human
gcccaccuuggcuca

SEQ ID NO: 2116131 - RNA, 13 nt, Human
gcccaccuuggcu

SEQ ID NO: 2116132 - RNA, 14 nt, Human
gcccacuucugcca

SEQ ID NO: 2116133 - RNA, 22 nt, Human
gcccaccugucaaacaaagcca

SEQ ID NO: 2116134 - RNA, 23 nt, Human
gcccacuuguauccucugguucu

SEQ ID NO: 2116135 - RNA, 18 nt, Human
gcccagaauucccagcug

SEQ ID NO: 2116136 - RNA, 21 nt, Human
gcccagaauucccagcugucu

SEQ ID NO: 2116137 - RNA, 23 nt, Human
gcccagaauucccagcugucugu

SEQ ID NO: 2116138 - RNA, 14 nt, Human
gcccaccccccuca

SEQ ID NO: 2116139 - RNA, 13 nt, Human
gcccaccccccuc

SEQ ID NO: 2116140 - RNA, 14 nt, Human
gccugaccuccccc

SEQ ID NO: 2116141 - RNA, 15 nt, Human
gccugaccucccccu

SEQ ID NO: 2116142 - RNA, 19 nt, Human
gccugaccucccccuccuu

SEQ ID NO: 2116143 - RNA, 20 nt, Human
gccugaccucccccuccuuc

SEQ ID NO: 2116144 - RNA, 22 nt, Human
gccugaccucccccuccuuccc

SEQ ID NO: 2116145 - RNA, 18 nt, Human
gccucugccucugacaca

SEQ ID NO: 2116146 - RNA, 13 nt, Human
gccucugccucug

SEQ ID NO: 2116147 - RNA, 12 nt, Human
gccucugccucu

SEQ ID NO: 2116148 - RNA, 15 nt, Human
gccucugcauucagg

SEQ ID NO: 2116149 - RNA, 15 nt, Human
gccucugccccgucu

SEQ ID NO: 2116150 - RNA, 16 nt, Human
gccucugccccgucuc

SEQ ID NO: 2116151 - RNA, 23 nt, Human
gccugagggcgaggggagggugg

SEQ ID NO: 2116152 - RNA, 21 nt, Human
gccucugacacacagcucugu

SEQ ID NO: 2116153 - RNA, 20 nt, Human
gccucugacacacagcucug

SEQ ID NO: 2116154 - RNA, 19 nt, Human
gccucugacacacagcucu

SEQ ID NO: 2116155 - RNA, 18 nt, Human
gccucugacacacagcuc

SEQ ID NO: 2116156 - RNA, 17 nt, Human
gccucugacacacagcu

SEQ ID NO: 2116157 - RNA, 12 nt, Human
gccucucauccc

SEQ ID NO: 2116158 - RNA, 17 nt, Human
gccucucaucccccauu

SEQ ID NO: 2116159 - RNA, 16 nt, Human
gccuccguauuucaga

SEQ ID NO: 2116160 - RNA, 19 nt, Human
gccucccgaguagcuggga

SEQ ID NO: 2116161 - RNA, 18 nt, Human
gccucccgaguagcuggg

SEQ ID NO: 2116162 - RNA, 20 nt, Human
gccucccgaguagcugggac

SEQ ID NO: 2116163 - RNA, 21 nt, Human
gccucccuguugaagcucugg

SEQ ID NO: 2116164 - RNA, 13 nt, Human
gccucccugucca

SEQ ID NO: 2116165 - RNA, 14 nt, Human
gccucccuguccac

SEQ ID NO: 2116166 - RNA, 20 nt, Human
gccucccuguugaagcucug

SEQ ID NO: 2116167 - RNA, 10 nt, Human
gccucccagc

SEQ ID NO: 2116168 - RNA, 13 nt, Human
gccucccagccug

SEQ ID NO: 2116169 - RNA, 14 nt, Human
gccucccagccugg

SEQ ID NO: 2116170 - RNA, 19 nt, Human
gccucccaaagugcuggga

SEQ ID NO: 2116171 - RNA, 18 nt, Human
gccucccaaagugcuggg

SEQ ID NO: 2116172 - RNA, 16 nt, Human
gccucagcauccuggc

SEQ ID NO: 2116173 - RNA, 15 nt, Human
gccucagcauccugg

SEQ ID NO: 2116174 - RNA, 16 nt, Human
gccucagacucauaca

SEQ ID NO: 2116175 - RNA, 18 nt, Human
gccgucagccaaauguaa

SEQ ID NO: 2116176 - RNA, 19 nt, Human
gccgugccuucagcucuac

SEQ ID NO: 2116177 - RNA, 17 nt, Human
gccgugccuucagcucu

SEQ ID NO: 2116178 - RNA, 15 nt, Human
gccgugccuucagcu

SEQ ID NO: 2116179 - RNA, 14 nt, Human
gccgugccuucagc

SEQ ID NO: 2116180 - RNA, 19 nt, Human
gccguggcuucccgcucag

SEQ ID NO: 2116181 - RNA, 15 nt, Human
gccguggcuucccgc

SEQ ID NO: 2116182 - RNA, 22 nt, Human
gccguggcuucccgcucagccc

SEQ ID NO: 2116183 - RNA, 21 nt, Human
gccguggcuucccgcucagcc

SEQ ID NO: 2116184 - RNA, 14 nt, Human
gccgugcccugccc

SEQ ID NO: 2116185 - RNA, 20 nt, Human
gccguguaaccauggaccca

SEQ ID NO: 2116186 - RNA, 23 nt, Human
gccguggugauuuagcaggaagc

SEQ ID NO: 2116187 - RNA, 13 nt, Human
gccucaaggacuu

SEQ ID NO: 2116188 - RNA, 16 nt, Human
gccucacagaagaaua

SEQ ID NO: 2116189 - RNA, 22 nt, Human
gccuaugugcaugcagcaucua

SEQ ID NO: 2116190 - RNA, 19 nt, Human
gccucaaccuccugggcua

SEQ ID NO: 2116191 - RNA, 18 nt, Human
gccucaaccuccugggcu

SEQ ID NO: 2116192 - RNA, 18 nt, Human
gccuaugaucccagcacu

SEQ ID NO: 2116193 - RNA, 15 nt, Human
gccuaugaucccagc

SEQ ID NO: 2116194 - RNA, 18 nt, Human
gccguugaagaggaaggg

SEQ ID NO: 2116195 - RNA, 14 nt, Human
gccguuacucucca

SEQ ID NO: 2116196 - RNA, 15 nt, Human
gccguuacucuccaa

SEQ ID NO: 2116197 - RNA, 18 nt, Human
gccguuacucuccaaccu

SEQ ID NO: 2116198 - RNA, 20 nt, Human
gccguuacucuccaaccugg

SEQ ID NO: 2116199 - RNA, 22 nt, Human
gccgugugugugcguccugucg

SEQ ID NO: 2116200 - RNA, 13 nt, Human
gccgcaccccaga

SEQ ID NO: 2116201 - RNA, 23 nt, Human
gccgcaccccagagugugggaag

SEQ ID NO: 2116202 - RNA, 15 nt, Human
gccgcaccccagagu

SEQ ID NO: 2116203 - RNA, 16 nt, Human
gccgcaccccagagug

SEQ ID NO: 2116204 - RNA, 21 nt, Human
gccgagaucacgccacugcac

SEQ ID NO: 2116205 - RNA, 20 nt, Human
gccgagaucacgccacugca

SEQ ID NO: 2116206 - RNA, 22 nt, Human
gccgagaucacgccacugcacu

SEQ ID NO: 2116207 - RNA, 22 nt, Human
gccgaccgaggcuggagcuggc

SEQ ID NO: 2116208 - RNA, 11 nt, Human
gccgaccucag

SEQ ID NO: 2116209 - RNA, 12 nt, Human
gccggucauuuu

SEQ ID NO: 2116210 - RNA, 21 nt, Human
gccgggcgcgguggcucacgc

SEQ ID NO: 2116211 - RNA, 19 nt, Human
gccgggcgugguggcgggc

SEQ ID NO: 2116212 - RNA, 20 nt, Human
gccgggaacagacaacagaa

SEQ ID NO: 2116213 - RNA, 22 nt, Human
gccgggaacagacaacagaagu

SEQ ID NO: 2116214 - RNA, 14 nt, Human
gccgaccagagccc

SEQ ID NO: 2116215 - RNA, 17 nt, Human
gccgaccagagccccac

SEQ ID NO: 2116216 - RNA, 12 nt, Human
gccgaaacugga

SEQ ID NO: 2116217 - RNA, 13 nt, Human
gccgaaacuggaa

SEQ ID NO: 2116218 - RNA, 19 nt, Human
gccgaagaaggguccuucc

SEQ ID NO: 2116219 - RNA, 22 nt, Human
gccgaagaaggguccuucccuc

SEQ ID NO: 2116220 - RNA, 21 nt, Human
gcccuugucccacucaagcca

SEQ ID NO: 2116221 - RNA, 24 nt, Human
gcccuugucccacucaagccaagc

SEQ ID NO: 2116222 - RNA, 12 nt, Human
gcccuuguccca

SEQ ID NO: 2116223 - RNA, 16 nt, Human
gcccuuggaggccagc

SEQ ID NO: 2116224 - RNA, 18 nt, Human
gcccugcuuugggcugcc

SEQ ID NO: 2116225 - RNA, 16 nt, Human
gcccugcuuugggcug

SEQ ID NO: 2116226 - RNA, 19 nt, Human
gcgacagagcgagagucug

SEQ ID NO: 2116227 - RNA, 15 nt, Human
gcgaaccaauauuug

SEQ ID NO: 2116228 - RNA, 23 nt, Human
gcgacagagcgagagucugucuc

SEQ ID NO: 2116229 - RNA, 15 nt, Human
gcgccuacaggagug

SEQ ID NO: 2116230 - RNA, 21 nt, Human
gcgaacggaacguuggacuuu

SEQ ID NO: 2116231 - RNA, 20 nt, Human
gcgcgcccucccuuggcgug

SEQ ID NO: 2116232 - RNA, 14 nt, Human
gcgcgccacucgcu

SEQ ID NO: 2116233 - RNA, 13 nt, Human
gcgcuacccacuu

SEQ ID NO: 2116234 - RNA, 16 nt, Human
gcgcuacccacuucua

SEQ ID NO: 2116235 - RNA, 13 nt, Human
gcggacagccacg

SEQ ID NO: 2116236 - RNA, 11 nt, Human
gcggacagcca

SEQ ID NO: 2116237 - RNA, 19 nt, Human
gcgucucauacucaccuca

SEQ ID NO: 2116238 - RNA, 18 nt, Human
gcguagagggugcugccc

SEQ ID NO: 2116239 - RNA, 14 nt, Human
gcgguuuggggagc

SEQ ID NO: 2116240 - RNA, 19 nt, Human
gcggguggaucaccugagg

SEQ ID NO: 2116241 - RNA, 20 nt, Human
gcgggcaccuauagucccag

SEQ ID NO: 2116242 - RNA, 15 nt, Human
gcgggcacaauaaau

SEQ ID NO: 2116243 - RNA, 16 nt, Human
gcgggaugguccuggg

SEQ ID NO: 2116244 - RNA, 17 nt, Human
gcgggaugguccugggg

SEQ ID NO: 2116245 - RNA, 15 nt, Human
gcggacagccacggc

SEQ ID NO: 2116246 - RNA, 11 nt, Human
gcggggggagg

SEQ ID NO: 2116247 - RNA, 13 nt, Human
gcgggccaaggac

SEQ ID NO: 2116248 - RNA, 15 nt, Human
gcgggccaaggacug

SEQ ID NO: 2116249 - RNA, 17 nt, Human
gcgggccaaggacugcc

SEQ ID NO: 2116250 - RNA, 20 nt, Human
gcgggccaaggacugccgac

SEQ ID NO: 2116251 - RNA, 19 nt, Human
gcgggcgaaucacgagguc

SEQ ID NO: 2116252 - RNA, 18 nt, Human
gcgucugucuucaagggc

SEQ ID NO: 2116253 - RNA, 18 nt, Human
gcgucucccaucuuaacu

SEQ ID NO: 2116254 - RNA, 23 nt, Human
gcgucucccaucuuaacucuuug

SEQ ID NO: 2116255 - RNA, 18 nt, Human
gcuaagagcuagcgcugc

SEQ ID NO: 2116256 - RNA, 16 nt, Human
gcuacacagaucacag

SEQ ID NO: 2116257 - RNA, 20 nt, Human
gcuaagagcuagcgcugccg

SEQ ID NO: 2116258 - RNA, 19 nt, Human
gcuacaggaagcaccccau

SEQ ID NO: 2116259 - RNA, 20 nt, Human
gcuacaggaagcaccccaug

SEQ ID NO: 2116260 - RNA, 21 nt, Human
gcuacaggaagcaccccaugc

SEQ ID NO: 2116261 - RNA, 21 nt, Human
gcuagaagugggccaggacag

SEQ ID NO: 2116262 - RNA, 20 nt, Human
gcuagaagugggccaggaca

SEQ ID NO: 2116263 - RNA, 16 nt, Human
gcuauagcuacaggaa

SEQ ID NO: 2116264 - RNA, 18 nt, Human
gcuauagcuacaggaagc

SEQ ID NO: 2116265 - RNA, 19 nt, Human
gcuauagacccgaggaaac

SEQ ID NO: 2116266 - RNA, 23 nt, Human
gcuauagacccgaggaaacucag

SEQ ID NO: 2116267 - RNA, 23 nt, Human
gcuacagggcgagacucugucuc

SEQ ID NO: 2116268 - RNA, 22 nt, Human
gcuacaggaagcaccccaugcc

SEQ ID NO: 2116269 - RNA, 23 nt, Human
gcuacaggaagcaccccaugcca

SEQ ID NO: 2116270 - RNA, 23 nt, Human
gcuaccugaacacuuauugcuuu

SEQ ID NO: 2116271 - RNA, 18 nt, Human
gcuaccugaucccacucc

SEQ ID NO: 2116272 - RNA, 19 nt, Human
gcuaccugaucccacuccu

SEQ ID NO: 2116273 - RNA, 15 nt, Human
gcuaccuuauuguac

SEQ ID NO: 2116274 - RNA, 17 nt, Human
gcuaccuuauuguacgu

SEQ ID NO: 2116275 - RNA, 14 nt, Human
gccugguggcagcu

SEQ ID NO: 2116276 - RNA, 13 nt, Human
gccuggugcugcu

SEQ ID NO: 2116277 - RNA, 18 nt, Human
gccugguggcagcugcgg

SEQ ID NO: 2116278 - RNA, 21 nt, Human
gccugguggcagcugcggucc

SEQ ID NO: 2116279 - RNA, 19 nt, Human
gccugguggcagcugcggu

SEQ ID NO: 2116280 - RNA, 12 nt, Human
gccuggucuccu

SEQ ID NO: 2116281 - RNA, 16 nt, Human
gccuggucuccugccc

SEQ ID NO: 2116282 - RNA, 19 nt, Human
gccuggucuccugccccca

SEQ ID NO: 2116283 - RNA, 13 nt, Human
gccuggugcagug

SEQ ID NO: 2116284 - RNA, 13 nt, Human
gccugguggcagc

SEQ ID NO: 2116285 - RNA, 18 nt, Human
gccuuagaagucacacag

SEQ ID NO: 2116286 - RNA, 17 nt, Human
gccuuagaagucacaca

SEQ ID NO: 2116287 - RNA, 19 nt, Human
gccuuagaagucacacagu

SEQ ID NO: 2116288 - RNA, 17 nt, Human
gccuuagaaccuuucuu

SEQ ID NO: 2116289 - RNA, 13 nt, Human
gccuggugggccu

SEQ ID NO: 2116290 - RNA, 15 nt, Human
gccuggugggccucc

SEQ ID NO: 2116291 - RNA, 12 nt, Human
gccuuaaaacuu

SEQ ID NO: 2116292 - RNA, 13 nt, Human
gccuuaaaacuuu

SEQ ID NO: 2116293 - RNA, 22 nt, Human
gccuucgauacaccgggccugg

SEQ ID NO: 2116294 - RNA, 18 nt, Human
gccuucgauacaccgggc

SEQ ID NO: 2116295 - RNA, 23 nt, Human
gccuucgauacaccgggccugga

SEQ ID NO: 2116296 - RNA, 18 nt, Human
gccuuccagcacccugca

SEQ ID NO: 2116297 - RNA, 23 nt, Human
gccuuccacgcugucuccagacc

SEQ ID NO: 2116298 - RNA, 19 nt, Human
gccuuccacgcugucucca

SEQ ID NO: 2116299 - RNA, 22 nt, Human
gccuuccacgcugucuccagac

SEQ ID NO: 2116300 - RNA, 23 nt, Human
gccuuugccaccaacuggcccuc

SEQ ID NO: 2116301 - RNA, 15 nt, Human
gccuuugccuccccg

SEQ ID NO: 2116302 - RNA, 22 nt, Human
gccuuugaguuuccucaggcug

SEQ ID NO: 2116303 - RNA, 17 nt, Human
gccuuugaucagguggg

SEQ ID NO: 2116304 - RNA, 15 nt, Human
gccuuugcagaaaca

SEQ ID NO: 2116305 - RNA, 16 nt, Human
gccuuugcagaaacag

SEQ ID NO: 2116306 - RNA, 21 nt, Human
gccuuggauaaugcuguugcc

SEQ ID NO: 2116307 - RNA, 19 nt, Human
gccuuggauaaugcuguug

SEQ ID NO: 2116308 - RNA, 23 nt, Human
gccuuggauaaugcuguugccuc

SEQ ID NO: 2116309 - RNA, 23 nt, Human
gcgaaaggauguaaacagugccu

SEQ ID NO: 2116310 - RNA, 13 nt, Human
gccuuuggcuuca

SEQ ID NO: 2116311 - RNA, 13 nt, Human
uuuugucuugugu

SEQ ID NO: 2116312 - RNA, 16 nt, Human
uuuugucauauaagau

SEQ ID NO: 2116313 - RNA, 22 nt, Human
uuuugugaaaugaaaacaugua

SEQ ID NO: 2116314 - RNA, 23 nt, Human
uuuuuaaaaaucauaaacugugu

SEQ ID NO: 2116315 - RNA, 14 nt, Human
uuuuuaaaaagcaa

SEQ ID NO: 2116316 - RNA, 12 nt, Human
uuuuuaaagaaa

SEQ ID NO: 2116317 - RNA, 20 nt, Human
uuuuuaaagaaaaguuuugu

SEQ ID NO: 2116318 - RNA, 17 nt, Human
uuuuuaaagacagaguc

SEQ ID NO: 2116319 - RNA, 16 nt, Human
uuuuuaaauaaaagca

SEQ ID NO: 2116320 - RNA, 18 nt, Human
uuuuguauaguaaaguga

SEQ ID NO: 2116321 - RNA, 16 nt, Human
uuuuguauaguaaagu

SEQ ID NO: 2116322 - RNA, 17 nt, Human
uuuuguauaguaaagug

SEQ ID NO: 2116323 - RNA, 14 nt, Human
uuuuguagguacuu

SEQ ID NO: 2116324 - RNA, 15 nt, Human
uuuuguagguacuuu

SEQ ID NO: 2116325 - RNA, 16 nt, Human
uuuuguagguacuuuu

SEQ ID NO: 2116326 - RNA, 19 nt, Human
uuuuguagguacuuuugga

SEQ ID NO: 2116327 - RNA, 19 nt, Human
uuuuguagagccagggucu

SEQ ID NO: 2116328 - RNA, 14 nt, Human
uuuuguaauuuucu

SEQ ID NO: 2116329 - RNA, 17 nt, Human
uuuuguaauuuucuuga

SEQ ID NO: 2116330 - RNA, 21 nt, Human
uuuuguaaagaugccggguuu

SEQ ID NO: 2116331 - RNA, 15 nt, Human
uuuuguaaagaugcc

SEQ ID NO: 2116332 - RNA, 16 nt, Human
uuuuguaaaggugaaa

SEQ ID NO: 2116333 - RNA, 14 nt, Human
uuuugguuaaguug

SEQ ID NO: 2116334 - RNA, 22 nt, Human
uuuugguuaaguuggcuucugu

SEQ ID NO: 2116335 - RNA, 14 nt, Human
uuuugguggaugua

SEQ ID NO: 2116336 - RNA, 17 nt, Human
uuuugguggauguaaau

SEQ ID NO: 2116337 - RNA, 18 nt, Human
uuuugguggauguaaaua

SEQ ID NO: 2116338 - RNA, 12 nt, Human
uuuuccugugga

SEQ ID NO: 2116339 - RNA, 13 nt, Human
uuuuaauuauugu

SEQ ID NO: 2116340 - RNA, 14 nt, Human
uuuuaauuauuguu

SEQ ID NO: 2116341 - RNA, 13 nt, Human
uuuucuacaguua

SEQ ID NO: 2116342 - RNA, 14 nt, Human
uuuucuuugaaauu

SEQ ID NO: 2116343 - RNA, 16 nt, Human
uuuucuacaaguauuc

SEQ ID NO: 2116344 - RNA, 15 nt, Human
uuuucuacagcaaau

SEQ ID NO: 2116345 - RNA, 16 nt, Human
uuuucuacagcaaauu

SEQ ID NO: 2116346 - RNA, 17 nt, Human
uuuucuacagcaaauuu

SEQ ID NO: 2116347 - RNA, 21 nt, Human
uuuucuacagcaaauuuauaa

SEQ ID NO: 2116348 - RNA, 15 nt, Human
uuuuggucuguguga

SEQ ID NO: 2116349 - RNA, 19 nt, Human
uuuuggcccccgagcuggg

SEQ ID NO: 2116350 - RNA, 12 nt, Human
uuuugggauguc

SEQ ID NO: 2116351 - RNA, 14 nt, Human
uuuugggaugucuu

SEQ ID NO: 2116352 - RNA, 18 nt, Human
uuuugaaugcuuccugac

SEQ ID NO: 2116353 - RNA, 16 nt, Human
uuuugaauccaugcuu

SEQ ID NO: 2116354 - RNA, 22 nt, Human
uuuugaaugcuuccugacaauc

SEQ ID NO: 2116355 - RNA, 17 nt, Human
uuuuggccaaaguguua

SEQ ID NO: 2116356 - RNA, 15 nt, Human
uuuuggccaaagugu

SEQ ID NO: 2116357 - RNA, 16 nt, Human
uuuuggccaaaguguu

SEQ ID NO: 2116358 - RNA, 19 nt, Human
uuuuggcacugagauauuu

SEQ ID NO: 2116359 - RNA, 19 nt, Human
uuuuggauugacaguaacu

SEQ ID NO: 2116360 - RNA, 20 nt, Human
uuuuggauugacaguaacuu

SEQ ID NO: 2116361 - RNA, 12 nt, Human
uuuuuuguuuca

SEQ ID NO: 2116362 - RNA, 14 nt, Human
uuuuugaaauaaua

SEQ ID NO: 2116363 - RNA, 13 nt, Human
uuuuugaaaacau

SEQ ID NO: 2116364 - RNA, 13 nt, Human
uuuuucuuuauaa

SEQ ID NO: 2116365 - RNA, 16 nt, Human
uuuuucuuuauaaacu

SEQ ID NO: 2116366 - RNA, 17 nt, Human
uuuuucuuuauaaacuu

SEQ ID NO: 2116367 - RNA, 13 nt, Human
uuuuuuguuucau

SEQ ID NO: 2116368 - RNA, 14 nt, Human
uuuuuccuguccuu

SEQ ID NO: 2116369 - RNA, 14 nt, Human
uuuuuaagucuuuu

SEQ ID NO: 2116370 - RNA, 14 nt, Human
uuuuuaaauauauu

SEQ ID NO: 2116371 - RNA, 18 nt, Human
uuuuuaaaguuacuuugu

SEQ ID NO: 2116372 - RNA, 18 nt, Human
uuuuuaagcuguuuccau

SEQ ID NO: 2116373 - RNA, 20 nt, Human
uuuuuaaaugauguugaaua

SEQ ID NO: 2116374 - RNA, 16 nt, Human
uuuuuaaguauuuaua

SEQ ID NO: 2116375 - RNA, 11 nt, Human
uuuuuccuuuu

SEQ ID NO: 2116376 - RNA, 17 nt, Human
uuuuuccuuguauuuaa

SEQ ID NO: 2116377 - RNA, 16 nt, Human
uuuuucguuuguuugu

SEQ ID NO: 2116378 - RNA, 17 nt, Human
uuuuucguuuguuuguu

SEQ ID NO: 2116379 - RNA, 11 nt, Human
uuuuucucuaa

SEQ ID NO: 2116380 - RNA, 23 nt, Human
uuuggugaacauugcaauagaaa

SEQ ID NO: 2116381 - RNA, 22 nt, Human
uuuggugaacauugcaauagaa

SEQ ID NO: 2116382 - RNA, 15 nt, Human
uuuggucucuugcuu

SEQ ID NO: 2116383 - RNA, 15 nt, Human
uuuggauagcauguc

SEQ ID NO: 2116384 - RNA, 20 nt, Human
uuuggauauaggucagugag

SEQ ID NO: 2116385 - RNA, 18 nt, Human
uuuggagcacucugaguu

SEQ ID NO: 2116386 - RNA, 21 nt, Human
uuuggaauuuugugcccccau

SEQ ID NO: 2116387 - RNA, 12 nt, Human
uuuggugccuuu

SEQ ID NO: 2116388 - RNA, 15 nt, Human
uuuggugccuuuccu

SEQ ID NO: 2116389 - RNA, 18 nt, Human
uuuggugccuuuccuguu

SEQ ID NO: 2116390 - RNA, 15 nt, Human
uuugguggagauaaa

SEQ ID NO: 2116391 - RNA, 16 nt, Human
uuugguggauguaaau

SEQ ID NO: 2116392 - RNA, 17 nt, Human
uuugguggauguaaaua

SEQ ID NO: 2116393 - RNA, 13 nt, Human
uuugguuucuagc

SEQ ID NO: 2116394 - RNA, 21 nt, Human
uuuguaaaaacagcauugcuu

SEQ ID NO: 2116395 - RNA, 15 nt, Human
uuugcauauguauga

SEQ ID NO: 2116396 - RNA, 13 nt, Human
uuugaaugaaaaa

SEQ ID NO: 2116397 - RNA, 14 nt, Human
uuugaaugaaaaau

SEQ ID NO: 2116398 - RNA, 24 nt, Human
uuugaaugaaaaauuuaagcauug

SEQ ID NO: 2116399 - RNA, 15 nt, Human
uuugaaugaaaaauu

SEQ ID NO: 2116400 - RNA, 21 nt, Human
uuugaaugaaaaauuuaagca

SEQ ID NO: 2116401 - RNA, 22 nt, Human
uuugaaugaaaaauuuaagcau

SEQ ID NO: 2116402 - RNA, 23 nt, Human
uuugaaugaaaaauuuaagcauu

SEQ ID NO: 2116403 - RNA, 16 nt, Human
uuugaaugcuuccuga

SEQ ID NO: 2116404 - RNA, 14 nt, Human
uuuggaauuuugug

SEQ ID NO: 2116405 - RNA, 16 nt, Human
uuuggaaucuagaaga

SEQ ID NO: 2116406 - RNA, 17 nt, Human
uuuggaaucuagaagaa

SEQ ID NO: 2116407 - RNA, 18 nt, Human
uuuggaaucuagaagaaa

SEQ ID NO: 2116408 - RNA, 20 nt, Human
uuuggaaucuagaagaaaug

SEQ ID NO: 2116409 - RNA, 21 nt, Human
uuuggaaucuagaagaaauga

SEQ ID NO: 2116410 - RNA, 23 nt, Human
uuuggaaucuagaagaaaugaaa

SEQ ID NO: 2116411 - RNA, 22 nt, Human
uuuggaaucuucucuuugacaa

SEQ ID NO: 2116412 - RNA, 22 nt, Human
uuugcuuuuccuuuguuuuuau

SEQ ID NO: 2116413 - RNA, 15 nt, Human
uuuuaaagaaaaguu

SEQ ID NO: 2116414 - RNA, 14 nt, Human
uuuuaaagaaaagu

SEQ ID NO: 2116415 - RNA, 16 nt, Human
uuuuaaaaguuauuaa

SEQ ID NO: 2116416 - RNA, 17 nt, Human
uuuuaaagaaugcucuu

SEQ ID NO: 2116417 - RNA, 12 nt, Human
uuuguauauugu

SEQ ID NO: 2116418 - RNA, 19 nt, Human
uuuguauauauacauaaca

SEQ ID NO: 2116419 - RNA, 14 nt, Human
uuuguaucuugaug

SEQ ID NO: 2116420 - RNA, 17 nt, Human
uuuguauaguaaaguga

SEQ ID NO: 2116421 - RNA, 22 nt, Human
uuuguaaaaacagcauugcuuu

SEQ ID NO: 2116422 - RNA, 12 nt, Human
uuuguaugauau

SEQ ID NO: 2116423 - RNA, 13 nt, Human
uuuguaugauauu

SEQ ID NO: 2116424 - RNA, 21 nt, Human
uuuuaaauuauaacuuaaaau

SEQ ID NO: 2116425 - RNA, 17 nt, Human
uuuuaaauuuucuucag

SEQ ID NO: 2116426 - RNA, 18 nt, Human
uuuuaaauuuucuucagu

SEQ ID NO: 2116427 - RNA, 19 nt, Human
uuuuaaauuuucuucaguu

SEQ ID NO: 2116428 - RNA, 20 nt, Human
uuuuaaauuuucuucaguug

SEQ ID NO: 2116429 - RNA, 16 nt, Human
uuuuaaauuauaagga

SEQ ID NO: 2116430 - RNA, 19 nt, Human
uuuuaaauuauaaggacug

SEQ ID NO: 2116431 - RNA, 21 nt, Human
uuuuaaauuauaaggacugca

SEQ ID NO: 2116432 - RNA, 23 nt, Human
uuuuaaauuauaaggacugcaug

SEQ ID NO: 2116433 - RNA, 19 nt, Human
uuuuaaauggguagagaaa

SEQ ID NO: 2116434 - RNA, 18 nt, Human
uuuuaaauccuguugaaa

SEQ ID NO: 2116435 - RNA, 19 nt, Human
uuuuaaauccuguugaaaa

SEQ ID NO: 2116436 - RNA, 13 nt, Human
uuuuaaauauauu

SEQ ID NO: 2116437 - RNA, 19 nt, Human
uuuuaacaauaacuacugu

SEQ ID NO: 2116438 - RNA, 12 nt, Human
uuuuaauacagg

SEQ ID NO: 2116439 - RNA, 21 nt, Human
uuuuaauagaauauaauuauc

SEQ ID NO: 2116440 - RNA, 13 nt, Human
uuuuaauauguaa

SEQ ID NO: 2116441 - RNA, 13 nt, Human
uuuuaauuaaaua

SEQ ID NO: 2116442 - RNA, 22 nt, Human
uuugaagaugccgcauuuggau

SEQ ID NO: 2116443 - RNA, 17 nt, Human
uuugaauccaugcuugg

SEQ ID NO: 2116444 - RNA, 14 nt, Human
uuugaacucuucaa

SEQ ID NO: 2116445 - RNA, 22 nt, Human
uuucuugacucuuguuuucagu

SEQ ID NO: 2116446 - RNA, 23 nt, Human
uuucuugccaaugaggucugaaa

SEQ ID NO: 2116447 - RNA, 16 nt, Human
uuucuugcagaucaaa

SEQ ID NO: 2116448 - RNA, 13 nt, Human
uuucuuccucugc

SEQ ID NO: 2116449 - RNA, 11 nt, Human
uuucuuccucu

SEQ ID NO: 2116450 - RNA, 18 nt, Human
uuucuucaugcaaugaca

SEQ ID NO: 2116451 - RNA, 19 nt, Human
uuucuucaugcaaugacau

SEQ ID NO: 2116452 - RNA, 22 nt, Human
uuucuucaugcaaugacaucuu

SEQ ID NO: 2116453 - RNA, 14 nt, Human
uuucuucccaucac

SEQ ID NO: 2116454 - RNA, 18 nt, Human
uuucuucaacaucaaugu

SEQ ID NO: 2116455 - RNA, 21 nt, Human
uuucuucaacaucaauguuca

SEQ ID NO: 2116456 - RNA, 16 nt, Human
uuucuucaugcaauga

SEQ ID NO: 2116457 - RNA, 13 nt, Human
uuucuucucccuc

SEQ ID NO: 2116458 - RNA, 12 nt, Human
uuucuucuauuu

SEQ ID NO: 2116459 - RNA, 16 nt, Human
uuucuuccucugcuga

SEQ ID NO: 2116460 - RNA, 14 nt, Human
uuucuuccucugcu

SEQ ID NO: 2116461 - RNA, 12 nt, Human
uuucuucucccu

SEQ ID NO: 2116462 - RNA, 18 nt, Human
uuucuuauuuaacuuaac

SEQ ID NO: 2116463 - RNA, 17 nt, Human
uuucuuaaaaaguuaua

SEQ ID NO: 2116464 - RNA, 16 nt, Human
uuucuuaaacaaaugu

SEQ ID NO: 2116465 - RNA, 15 nt, Human
uuucuguugaaguuu

SEQ ID NO: 2116466 - RNA, 14 nt, Human
uuucuguugccaca

SEQ ID NO: 2116467 - RNA, 14 nt, Human
uuaccaaguuauau

SEQ ID NO: 2116468 - RNA, 16 nt, Human
uuaccaaguuauauaa

SEQ ID NO: 2116469 - RNA, 17 nt, Human
uuaccaaguuauauaaa

SEQ ID NO: 2116470 - RNA, 16 nt, Human
uuuccuccccagcagg

SEQ ID NO: 2116471 - RNA, 18 nt, Human
uuuccucauuuuuauaau

SEQ ID NO: 2116472 - RNA, 19 nt, Human
uuuccucauuccugaaaga

SEQ ID NO: 2116473 - RNA, 12 nt, Human
uuuccuccccag

SEQ ID NO: 2116474 - RNA, 14 nt, Human
uuuccuccccagca

SEQ ID NO: 2116475 - RNA, 21 nt, Human
uuuccucaggcugcuggagga

SEQ ID NO: 2116476 - RNA, 20 nt, Human
uuucuagaacaucccugcca

SEQ ID NO: 2116477 - RNA, 22 nt, Human
uuucuagaacaucccugccagc

SEQ ID NO: 2116478 - RNA, 21 nt, Human
uuucuagaauuuaucacacuu

SEQ ID NO: 2116479 - RNA, 16 nt, Human
uuucuagacuugugcu

SEQ ID NO: 2116480 - RNA, 18 nt, Human
uuucuagagccugcugga

SEQ ID NO: 2116481 - RNA, 17 nt, Human
uuucucuguauaguacu

SEQ ID NO: 2116482 - RNA, 14 nt, Human
uuucucugcuucag

SEQ ID NO: 2116483 - RNA, 18 nt, Human
uuucucugcuucagcuug

SEQ ID NO: 2116484 - RNA, 21 nt, Human
uuucucugcuucagcuugcuu

SEQ ID NO: 2116485 - RNA, 23 nt, Human
guauagaaaugcugguuuuucag

SEQ ID NO: 2116486 - RNA, 15 nt, Human
guauagaaaugcugg

SEQ ID NO: 2116487 - RNA, 22 nt, Human
guauagaaaugcugguuuuuca

SEQ ID NO: 2116488 - RNA, 14 nt, Human
guauagaaaugcug

SEQ ID NO: 2116489 - RNA, 19 nt, Human
guauaguacuggcauggua

SEQ ID NO: 2116490 - RNA, 12 nt, Human
guauauaauuuu

SEQ ID NO: 2116491 - RNA, 21 nt, Human
guauauaauuuuuuuauguuu

SEQ ID NO: 2116492 - RNA, 14 nt, Human
guauauauacauaa

SEQ ID NO: 2116493 - RNA, 16 nt, Human
guauauauacauaaca

SEQ ID NO: 2116494 - RNA, 17 nt, Human
guauauauacauaacag

SEQ ID NO: 2116495 - RNA, 14 nt, Human
guauauauagaauc

SEQ ID NO: 2116496 - RNA, 13 nt, Human
guaucuagugcag

SEQ ID NO: 2116497 - RNA, 15 nt, Human
guaucuagugcagcu

SEQ ID NO: 2116498 - RNA, 16 nt, Human
guaucuagugcagcug

SEQ ID NO: 2116499 - RNA, 17 nt, Human
guaucuagugcagcuga

SEQ ID NO: 2116500 - RNA, 14 nt, Human
guaucggagacagu

SEQ ID NO: 2116501 - RNA, 15 nt, Human
guaucggagacagug

SEQ ID NO: 2116502 - RNA, 11 nt, Human
guaucgggggc

SEQ ID NO: 2116503 - RNA, 17 nt, Human
guaucgggggcuggggc

SEQ ID NO: 2116504 - RNA, 20 nt, Human
guaucgggggcuggggcagg

SEQ ID NO: 2116505 - RNA, 17 nt, Human
guaucggagacagugau

SEQ ID NO: 2116506 - RNA, 18 nt, Human
guaucuagugcagcugau

SEQ ID NO: 2116507 - RNA, 15 nt, Human
guaucuccucgcaag

SEQ ID NO: 2116508 - RNA, 16 nt, Human
guauauguugggugca

SEQ ID NO: 2116509 - RNA, 21 nt, Human
guauaugucucaggucccugc

SEQ ID NO: 2116510 - RNA, 15 nt, Human
guauaugucucaggu

SEQ ID NO: 2116511 - RNA, 13 nt, Human
guauaugucucag

SEQ ID NO: 2116512 - RNA, 16 nt, Human
guauccugcccagugu

SEQ ID NO: 2116513 - RNA, 17 nt, Human
guauccugcccaguguu

SEQ ID NO: 2116514 - RNA, 18 nt, Human
guauccugcccaguguug

SEQ ID NO: 2116515 - RNA, 14 nt, Human
guauauuaaaaaug

SEQ ID NO: 2116516 - RNA, 15 nt, Human
guauauuaaaaaugg

SEQ ID NO: 2116517 - RNA, 16 nt, Human
guauauuaaaaauggu

SEQ ID NO: 2116518 - RNA, 18 nt, Human
guauauuaaaaaugguaa

SEQ ID NO: 2116519 - RNA, 21 nt, Human
guauauuaaaaaugguaaaau

SEQ ID NO: 2116520 - RNA, 22 nt, Human
guauauuaaaaaugguaaaauu

SEQ ID NO: 2116521 - RNA, 16 nt, Human
guauauguaugugugu

SEQ ID NO: 2116522 - RNA, 17 nt, Human
guauauguaugugugua

SEQ ID NO: 2116523 - RNA, 14 nt, Human
guauaucugggcug

SEQ ID NO: 2116524 - RNA, 21 nt, Human
guauaucugggcuggccaguu

SEQ ID NO: 2116525 - RNA, 22 nt, Human
guauaugucaagccauaauugu

SEQ ID NO: 2116526 - RNA, 21 nt, Human
guauguuugcacacuugugug

SEQ ID NO: 2116527 - RNA, 14 nt, Human
guauguuuuagcau

SEQ ID NO: 2116528 - RNA, 16 nt, Human
guauguuuuagcaugu

SEQ ID NO: 2116529 - RNA, 21 nt, Human
guauguugugaagauguuugc

SEQ ID NO: 2116530 - RNA, 14 nt, Human
guauguuugcacac

SEQ ID NO: 2116531 - RNA, 14 nt, Human
guauguuuacacug

SEQ ID NO: 2116532 - RNA, 17 nt, Human
guauguuuacacuguca

SEQ ID NO: 2116533 - RNA, 13 nt, Human
guauuaaagacag

SEQ ID NO: 2116534 - RNA, 14 nt, Human
guauuaaagggggg

SEQ ID NO: 2116535 - RNA, 19 nt, Human
guauuaaaggggggagggg

SEQ ID NO: 2116536 - RNA, 22 nt, Human
guauguuuuuuauuaugcugua

SEQ ID NO: 2116537 - RNA, 23 nt, Human
guauguuuuuguguauuuguuaa

SEQ ID NO: 2116538 - RNA, 19 nt, Human
guauguuuuuguguauuug

SEQ ID NO: 2116539 - RNA, 20 nt, Human
guaugaucacggcucacugc

SEQ ID NO: 2116540 - RNA, 16 nt, Human
guauguguguguaugc

SEQ ID NO: 2116541 - RNA, 18 nt, Human
guauguguguguaugcua

SEQ ID NO: 2116542 - RNA, 15 nt, Human
guauguguguguaug

SEQ ID NO: 2116543 - RNA, 14 nt, Human
guauguguguaugg

SEQ ID NO: 2116544 - RNA, 21 nt, Human
guaugaucacggcucacugca

SEQ ID NO: 2116545 - RNA, 19 nt, Human
guaugaauaaagacaccua

SEQ ID NO: 2116546 - RNA, 18 nt, Human
guaugaauaaagacaccu

SEQ ID NO: 2116547 - RNA, 14 nt, Human
guaugacuaaagag

SEQ ID NO: 2116548 - RNA, 18 nt, Human
guaugacuaaagagagaa

SEQ ID NO: 2116549 - RNA, 20 nt, Human
guaugacuaaagagagaaug

SEQ ID NO: 2116550 - RNA, 23 nt, Human
guaucuuguuuuuccacuacugc

SEQ ID NO: 2116551 - RNA, 22 nt, Human
guaucuuugggucuuugauaaa

SEQ ID NO: 2116552 - RNA, 23 nt, Human
guaugaaagauggcugugccucu

SEQ ID NO: 2116553 - RNA, 22 nt, Human
guaugaaagauggcugugccuc

SEQ ID NO: 2116554 - RNA, 12 nt, Human
guaucugagcag

SEQ ID NO: 2116555 - RNA, 14 nt, Human
guaucugggaacug

SEQ ID NO: 2116556 - RNA, 15 nt, Human
guaggggugugugug

SEQ ID NO: 2116557 - RNA, 17 nt, Human
guaggguaaggugccuu

SEQ ID NO: 2116558 - RNA, 21 nt, Human
guagggucaggccacggcagc

SEQ ID NO: 2116559 - RNA, 22 nt, Human
guagggucaggccacggcagcc

SEQ ID NO: 2116560 - RNA, 16 nt, Human
guaggguuauaauaau

SEQ ID NO: 2116561 - RNA, 13 nt, Human
guagguacuuuug

SEQ ID NO: 2116562 - RNA, 12 nt, Human
guaggguuucua

SEQ ID NO: 2116563 - RNA, 23 nt, Human
guagguaucauuuucugcauuua

SEQ ID NO: 2116564 - RNA, 16 nt, Human
guaguauaaagaaaag

SEQ ID NO: 2116565 - RNA, 18 nt, Human
guaguagggucaggccac

SEQ ID NO: 2116566 - RNA, 21 nt, Human
guaguacuccugcaaaauuuu

SEQ ID NO: 2116567 - RNA, 19 nt, Human
guaguacuccuuaagaaca

SEQ ID NO: 2116568 - RNA, 20 nt, Human
guaguacuccuuaagaacac

SEQ ID NO: 2116569 - RNA, 22 nt, Human
guaguacuccugcaaaauuuua

SEQ ID NO: 2116570 - RNA, 22 nt, Human
guauaauuuuuuaaaguuacuu

SEQ ID NO: 2116571 - RNA, 21 nt, Human
guauacaguggauuaauuaaa

SEQ ID NO: 2116572 - RNA, 18 nt, Human
guauacaagauaagcuuc

SEQ ID NO: 2116573 - RNA, 17 nt, Human
guagucaagauuguguu

SEQ ID NO: 2116574 - RNA, 15 nt, Human
guaggugauuugaag

SEQ ID NO: 2116575 - RNA, 12 nt, Human
guagucccagcu

SEQ ID NO: 2116576 - RNA, 13 nt, Human
guagucccagcua

SEQ ID NO: 2116577 - RNA, 14 nt, Human
guagugagaagaau

SEQ ID NO: 2116578 - RNA, 15 nt, Human
guagugagaagaaua

SEQ ID NO: 2116579 - RNA, 14 nt, Human
guagucuaaccaaa

SEQ ID NO: 2116580 - RNA, 15 nt, Human
guagucuaaccaaau

SEQ ID NO: 2116581 - RNA, 16 nt, Human
guagucuaaccaaaug

SEQ ID NO: 2116582 - RNA, 18 nt, Human
guagucuaaccaaaugca

SEQ ID NO: 2116583 - RNA, 19 nt, Human
guagucuaaccaaaugcau

SEQ ID NO: 2116584 - RNA, 15 nt, Human
guagagugugccuga

SEQ ID NO: 2116585 - RNA, 14 nt, Human
guagauagaaauaa

SEQ ID NO: 2116586 - RNA, 12 nt, Human
guagauagaaau

SEQ ID NO: 2116587 - RNA, 13 nt, Human
guagauagaaaua

SEQ ID NO: 2116588 - RNA, 21 nt, Human
guagaugugcauuuuugugaa

SEQ ID NO: 2116589 - RNA, 15 nt, Human
guagauuuguuuugu

SEQ ID NO: 2116590 - RNA, 16 nt, Human
guagauuuguuuugug

SEQ ID NO: 2116591 - RNA, 21 nt, Human
guagauuuuaaaaguuauuaa

SEQ ID NO: 2116592 - RNA, 14 nt, Human
guagauugcuucug

SEQ ID NO: 2116593 - RNA, 16 nt, Human
guagauugcuucugua

SEQ ID NO: 2116594 - RNA, 15 nt, Human
guagcaguagaugca

SEQ ID NO: 2116595 - RNA, 17 nt, Human
guagcagguaccacuga

SEQ ID NO: 2116596 - RNA, 16 nt, Human
guagggcgggaggaug

SEQ ID NO: 2116597 - RNA, 17 nt, Human
guaggcuuuacuuagcu

SEQ ID NO: 2116598 - RNA, 21 nt, Human
guagcaaucagauuuuccugu

SEQ ID NO: 2116599 - RNA, 22 nt, Human
guagggcgggaggauguucugg

SEQ ID NO: 2116600 - RNA, 21 nt, Human
guagggcgggaggauguucug

SEQ ID NO: 2116601 - RNA, 12 nt, Human
guagggcugacu

SEQ ID NO: 2116602 - RNA, 21 nt, Human
guagggcugccaccaagguga

SEQ ID NO: 2116603 - RNA, 23 nt, Human
guagggcgggaggauguucuggg

SEQ ID NO: 2116604 - RNA, 14 nt, Human
guagccccaagaag

SEQ ID NO: 2116605 - RNA, 21 nt, Human
guagccccaagaaggcugggg

SEQ ID NO: 2116606 - RNA, 23 nt, Human
guagccccaagaaggcuggggcu

SEQ ID NO: 2116607 - RNA, 21 nt, Human
guagcauguugagccaggccu

SEQ ID NO: 2116608 - RNA, 15 nt, Human
guagcauuacagugg

SEQ ID NO: 2116609 - RNA, 18 nt, Human
guagcagguaccacugau

SEQ ID NO: 2116610 - RNA, 13 nt, Human
guagcauacauuu

SEQ ID NO: 2116611 - RNA, 12 nt, Human
guagcaugagag

SEQ ID NO: 2116612 - RNA, 18 nt, Human
guagccaaggugggcuga

SEQ ID NO: 2116613 - RNA, 19 nt, Human
guagccaaggugggcugag

SEQ ID NO: 2116614 - RNA, 16 nt, Human
guccacaguggaacca

SEQ ID NO: 2116615 - RNA, 16 nt, Human
gucauugcuuuacugg

SEQ ID NO: 2116616 - RNA, 19 nt, Human
guccacaguggaaccagcc

SEQ ID NO: 2116617 - RNA, 21 nt, Human
guccacaguggaaccagccca

SEQ ID NO: 2116618 - RNA, 21 nt, Human
gucauuaugagaggcaaugau

SEQ ID NO: 2116619 - RNA, 16 nt, Human
gucagcuugcugcccu

SEQ ID NO: 2116620 - RNA, 20 nt, Human
gucagcuugcugcccuaggc

SEQ ID NO: 2116621 - RNA, 16 nt, Human
gucagcuuugccuucc

SEQ ID NO: 2116622 - RNA, 17 nt, Human
gucagcuuugccuucca

SEQ ID NO: 2116623 - RNA, 23 nt, Human
gucagcuuugccuuccacgcugu

SEQ ID NO: 2116624 - RNA, 14 nt, Human
gucauuaaaauaaa

SEQ ID NO: 2116625 - RNA, 18 nt, Human
gucagcuuugccuuccac

SEQ ID NO: 2116626 - RNA, 22 nt, Human
gucauuaaaauaaauaaaugca

SEQ ID NO: 2116627 - RNA, 17 nt, Human
gucagcuacuaaugaug

SEQ ID NO: 2116628 - RNA, 23 nt, Human
guccagagagagaagugccccug

SEQ ID NO: 2116629 - RNA, 20 nt, Human
guccacugucacuguuucuc

SEQ ID NO: 2116630 - RNA, 12 nt, Human
guccacugucac

SEQ ID NO: 2116631 - RNA, 20 nt, Human
guccagagagagaagugccc

SEQ ID NO: 2116632 - RNA, 22 nt, Human
guccagagagagaagugccccu

SEQ ID NO: 2116633 - RNA, 22 nt, Human
guccaccugagcugccauccag

SEQ ID NO: 2116634 - RNA, 13 nt, Human
guccacccaggag

SEQ ID NO: 2116635 - RNA, 17 nt, Human
guccaccaauagaauga

SEQ ID NO: 2116636 - RNA, 12 nt, Human
guccacccagga

SEQ ID NO: 2116637 - RNA, 21 nt, Human
guccaccuggccccaugucuc

SEQ ID NO: 2116638 - RNA, 23 nt, Human
guccacccaggagccccgaggcc

SEQ ID NO: 2116639 - RNA, 17 nt, Human
guccaggucgggcucag

SEQ ID NO: 2116640 - RNA, 18 nt, Human
guccaggucgggcucagc

SEQ ID NO: 2116641 - RNA, 19 nt, Human
guccaggucgggcucagcu

SEQ ID NO: 2116642 - RNA, 22 nt, Human
guccaggucgggcucagcucug

SEQ ID NO: 2116643 - RNA, 23 nt, Human
guccaggucgggcucagcucugg

SEQ ID NO: 2116644 - RNA, 16 nt, Human
guccagucucuucugc

SEQ ID NO: 2116645 - RNA, 21 nt, Human
gucccaccuuggcugcaggga

SEQ ID NO: 2116646 - RNA, 11 nt, Human
guccaggggau

SEQ ID NO: 2116647 - RNA, 20 nt, Human
guccagggcccugagcucgg

SEQ ID NO: 2116648 - RNA, 11 nt, Human
guccagccugg

SEQ ID NO: 2116649 - RNA, 13 nt, Human
guccagccugggc

SEQ ID NO: 2116650 - RNA, 20 nt, Human
guccagccgccauugccacc

SEQ ID NO: 2116651 - RNA, 22 nt, Human
guccagccgccauugccaccag

SEQ ID NO: 2116652 - RNA, 12 nt, Human
gucccaggcaga

SEQ ID NO: 2116653 - RNA, 23 nt, Human
gucccaccuuggcugcagggagu

SEQ ID NO: 2116654 - RNA, 20 nt, Human
gucccaccuuggcugcaggg

SEQ ID NO: 2116655 - RNA, 21 nt, Human
gucccugcacuugcagacucu

SEQ ID NO: 2116656 - RNA, 19 nt, Human
gucccugcacuugcagacu

SEQ ID NO: 2116657 - RNA, 16 nt, Human
gucccugcacuugcag

SEQ ID NO: 2116658 - RNA, 20 nt, Human
gucccugacucucugugacc

SEQ ID NO: 2116659 - RNA, 17 nt, Human
gucccugacucucugug

SEQ ID NO: 2116660 - RNA, 18 nt, Human
gucccugacucucuguga

SEQ ID NO: 2116661 - RNA, 16 nt, Human
gucccucucaggcaug

SEQ ID NO: 2116662 - RNA, 13 nt, Human
gucccucucucug

SEQ ID NO: 2116663 - RNA, 14 nt, Human
gucccucucucugg

SEQ ID NO: 2116664 - RNA, 21 nt, Human
gucccucucggaaggcuggcu

SEQ ID NO: 2116665 - RNA, 13 nt, Human
gucccucucaggc

SEQ ID NO: 2116666 - RNA, 14 nt, Human
gucccucucaggca

SEQ ID NO: 2116667 - RNA, 23 nt, Human
gucccuaccgagucucuucucca

SEQ ID NO: 2116668 - RNA, 22 nt, Human
gucccuaccgagucucuucucc

SEQ ID NO: 2116669 - RNA, 21 nt, Human
gucccuaccgagucucuucuc

SEQ ID NO: 2116670 - RNA, 16 nt, Human
gucccuacaccccucc

SEQ ID NO: 2116671 - RNA, 21 nt, Human
gucccuacaccccuccccugc

SEQ ID NO: 2116672 - RNA, 15 nt, Human
gucccuaugcauauc

SEQ ID NO: 2116673 - RNA, 19 nt, Human
gucccuccacguucacccc

SEQ ID NO: 2116674 - RNA, 20 nt, Human
gucccuccacguucaccccu

SEQ ID NO: 2116675 - RNA, 21 nt, Human
gucccuccacguucaccccuc

SEQ ID NO: 2116676 - RNA, 22 nt, Human
guauuaaguuguuaauaaaagu

SEQ ID NO: 2116677 - RNA, 14 nt, Human
guauuaauauucau

SEQ ID NO: 2116678 - RNA, 21 nt, Human
guauuuuaguaagagauuccu

SEQ ID NO: 2116679 - RNA, 15 nt, Human
guauuuuaguauauu

SEQ ID NO: 2116680 - RNA, 18 nt, Human
guauuuuauaaaauuaaa

SEQ ID NO: 2116681 - RNA, 21 nt, Human
guauuuuauaaaauuaaagaa

SEQ ID NO: 2116682 - RNA, 22 nt, Human
guauuuuauaaaauuaaagaaa

SEQ ID NO: 2116683 - RNA, 13 nt, Human
guauuuuauguau

SEQ ID NO: 2116684 - RNA, 15 nt, Human
guauuuuauguaugu

SEQ ID NO: 2116685 - RNA, 23 nt, Human
guauuuuauguauguuuacacug

SEQ ID NO: 2116686 - RNA, 10 nt, Human
guauuuuauu

SEQ ID NO: 2116687 - RNA, 19 nt, Human
gucaauccugugggugaag

SEQ ID NO: 2116688 - RNA, 17 nt, Human
gucaauccccucauuca

SEQ ID NO: 2116689 - RNA, 22 nt, Human
gucaauccccucauucaggaaa

SEQ ID NO: 2116690 - RNA, 15 nt, Human
gucaauccugugggu

SEQ ID NO: 2116691 - RNA, 16 nt, Human
gucaauccugugggug

SEQ ID NO: 2116692 - RNA, 16 nt, Human
gucaauccccucauuc

SEQ ID NO: 2116693 - RNA, 21 nt, Human
gucaauacaguacaggcagca

SEQ ID NO: 2116694 - RNA, 23 nt, Human
gucaccaggaauguuaaagucag

SEQ ID NO: 2116695 - RNA, 18 nt, Human
gucaccaggaauguuaaa

SEQ ID NO: 2116696 - RNA, 15 nt, Human
gucaccaucucaggc

SEQ ID NO: 2116697 - RNA, 22 nt, Human
gucaccaccuucccagcucucc

SEQ ID NO: 2116698 - RNA, 19 nt, Human
gucaccaccuucccagcuc

SEQ ID NO: 2116699 - RNA, 20 nt, Human
gucaccaccuucccagcucu

SEQ ID NO: 2116700 - RNA, 13 nt, Human
gucaccaccucuc

SEQ ID NO: 2116701 - RNA, 11 nt, Human
gucaccaccuu

SEQ ID NO: 2116702 - RNA, 14 nt, Human
gucaccaccuuccc

SEQ ID NO: 2116703 - RNA, 15 nt, Human
gucaccaccuuccca

SEQ ID NO: 2116704 - RNA, 16 nt, Human
gucaccaccuucccag

SEQ ID NO: 2116705 - RNA, 17 nt, Human
gucaccaccuucccagc

SEQ ID NO: 2116706 - RNA, 13 nt, Human
gucaauaaacagc

SEQ ID NO: 2116707 - RNA, 20 nt, Human
gucaauaaacagcuucaugc

SEQ ID NO: 2116708 - RNA, 19 nt, Human
gucaauacaguacaggcag

SEQ ID NO: 2116709 - RNA, 20 nt, Human
gucaauacaguacaggcagc

SEQ ID NO: 2116710 - RNA, 21 nt, Human
gucaagucucugcuggcccag

SEQ ID NO: 2116711 - RNA, 15 nt, Human
gucaagugaaaaagg

SEQ ID NO: 2116712 - RNA, 19 nt, Human
guauuuuguuuuugucuua

SEQ ID NO: 2116713 - RNA, 15 nt, Human
gucaaggugcuguug

SEQ ID NO: 2116714 - RNA, 14 nt, Human
gucaaguaagaaga

SEQ ID NO: 2116715 - RNA, 15 nt, Human
gucaaguaagaagac

SEQ ID NO: 2116716 - RNA, 13 nt, Human
gucaagucaacca

SEQ ID NO: 2116717 - RNA, 14 nt, Human
gucaagucucugcu

SEQ ID NO: 2116718 - RNA, 17 nt, Human
gucaagucucugcuggc

SEQ ID NO: 2116719 - RNA, 18 nt, Human
gucagaugggaagacaug

SEQ ID NO: 2116720 - RNA, 12 nt, Human
gucagauuccuu

SEQ ID NO: 2116721 - RNA, 13 nt, Human
gucagauuccuuu

SEQ ID NO: 2116722 - RNA, 14 nt, Human
gucagauuccuuuc

SEQ ID NO: 2116723 - RNA, 16 nt, Human
gucagauuccuuuccc

SEQ ID NO: 2116724 - RNA, 19 nt, Human
gucagcuacuaaugauguu

SEQ ID NO: 2116725 - RNA, 18 nt, Human
gucagaguaagcugcuuu

SEQ ID NO: 2116726 - RNA, 19 nt, Human
gucagaguaagcugcuuuu

SEQ ID NO: 2116727 - RNA, 14 nt, Human
gucagagccugcag

SEQ ID NO: 2116728 - RNA, 22 nt, Human
gucagacuggcuggcugcagug

SEQ ID NO: 2116729 - RNA, 16 nt, Human
gucagacuuuaaagaa

SEQ ID NO: 2116730 - RNA, 15 nt, Human
gucagacuuuaaaga

SEQ ID NO: 2116731 - RNA, 12 nt, Human
gucagagagaau

SEQ ID NO: 2116732 - RNA, 17 nt, Human
gucagagaggagucaga

SEQ ID NO: 2116733 - RNA, 14 nt, Human
gucagacugcuggg

SEQ ID NO: 2116734 - RNA, 15 nt, Human
gucagacugcuggga

SEQ ID NO: 2116735 - RNA, 16 nt, Human
gucagacugcugggac

SEQ ID NO: 2116736 - RNA, 20 nt, Human
gucagacugcugggacuggc

SEQ ID NO: 2116737 - RNA, 22 nt, Human
gucagacugcugggacuggcca

SEQ ID NO: 2116738 - RNA, 24 nt, Human
gucagacugcugggacuggccagg

SEQ ID NO: 2116739 - RNA, 14 nt, Human
gucagacuggcugg

SEQ ID NO: 2116740 - RNA, 18 nt, Human
gucagacuggcuggcugc

SEQ ID NO: 2116741 - RNA, 16 nt, Human
gucagagccugcaguu

SEQ ID NO: 2116742 - RNA, 15 nt, Human
gucagagccugcagu

SEQ ID NO: 2116743 - RNA, 19 nt, Human
gucagagaggagucagaga

SEQ ID NO: 2116744 - RNA, 21 nt, Human
gucagagaggagucagagaga

SEQ ID NO: 2116745 - RNA, 14 nt, Human
gucagagcugggag

SEQ ID NO: 2116746 - RNA, 12 nt, Human
gucagagcuggg

SEQ ID NO: 2116747 - RNA, 13 nt, Human
gucagagcuggga

SEQ ID NO: 2116748 - RNA, 12 nt, Human
gucacuccuggg

SEQ ID NO: 2116749 - RNA, 13 nt, Human
gucacuccugggg

SEQ ID NO: 2116750 - RNA, 21 nt, Human
gucacuccuggggccucuugg

SEQ ID NO: 2116751 - RNA, 22 nt, Human
gucacuaaagcaggccuuuuga

SEQ ID NO: 2116752 - RNA, 15 nt, Human
gucacccggccccca

SEQ ID NO: 2116753 - RNA, 23 nt, Human
gucacucaacaaaagugcuuugg

SEQ ID NO: 2116754 - RNA, 23 nt, Human
gucacucagauggaaccgcagga

SEQ ID NO: 2116755 - RNA, 23 nt, Human
gucacuacgugacuguggcacac

SEQ ID NO: 2116756 - RNA, 14 nt, Human
gucacuacucacag

SEQ ID NO: 2116757 - RNA, 17 nt, Human
gucacuacucacagucu

SEQ ID NO: 2116758 - RNA, 22 nt, Human
gucacuacucacagucucuuua

SEQ ID NO: 2116759 - RNA, 19 nt, Human
gucucgugguaggacugua

SEQ ID NO: 2116760 - RNA, 12 nt, Human
gucucaggagca

SEQ ID NO: 2116761 - RNA, 16 nt, Human
gucucaggagcauggg

SEQ ID NO: 2116762 - RNA, 13 nt, Human
gucucagccuccc

SEQ ID NO: 2116763 - RNA, 15 nt, Human
gucucaggaccuagg

SEQ ID NO: 2116764 - RNA, 22 nt, Human
gucucacucugucgcccagucu

SEQ ID NO: 2116765 - RNA, 19 nt, Human
gucucacucugucgcccag

SEQ ID NO: 2116766 - RNA, 18 nt, Human
gucucacucugucgccca

SEQ ID NO: 2116767 - RNA, 16 nt, Human
gucucacucugucgcc

SEQ ID NO: 2116768 - RNA, 15 nt, Human
gucucacucugucgc

SEQ ID NO: 2116769 - RNA, 13 nt, Human
gucucuugaggga

SEQ ID NO: 2116770 - RNA, 12 nt, Human
gucucuugcuug

SEQ ID NO: 2116771 - RNA, 23 nt, Human
gucucuugagggagcuuagccaa

SEQ ID NO: 2116772 - RNA, 18 nt, Human
gucucuucuccacuggau

SEQ ID NO: 2116773 - RNA, 20 nt, Human
gucucugcuggcccagccaa

SEQ ID NO: 2116774 - RNA, 11 nt, Human
gucucucuuug

SEQ ID NO: 2116775 - RNA, 16 nt, Human
gucucucuuuggacuc

SEQ ID NO: 2116776 - RNA, 20 nt, Human
gucucucuuuggacucuccc

SEQ ID NO: 2116777 - RNA, 21 nt, Human
gucucucuuuggacucucccc

SEQ ID NO: 2116778 - RNA, 13 nt, Human
gucucugcuggcc

SEQ ID NO: 2116779 - RNA, 15 nt, Human
gucucugcuggccca

SEQ ID NO: 2116780 - RNA, 16 nt, Human
gucucugcuggcccag

SEQ ID NO: 2116781 - RNA, 17 nt, Human
gucucugcuggcccagc

SEQ ID NO: 2116782 - RNA, 11 nt, Human
gucucugccau

SEQ ID NO: 2116783 - RNA, 21 nt, Human
gucucugccaugaacuggagg

SEQ ID NO: 2116784 - RNA, 22 nt, Human
gucucugccaugaacuggaggc

SEQ ID NO: 2116785 - RNA, 12 nt, Human
gucucugcugaa

SEQ ID NO: 2116786 - RNA, 20 nt, Human
gucguagccaaggugggcug

SEQ ID NO: 2116787 - RNA, 17 nt, Human
gucggggggacagcucc

SEQ ID NO: 2116788 - RNA, 23 nt, Human
gucguggcagauaaucagccucu

SEQ ID NO: 2116789 - RNA, 15 nt, Human
gucguggcagauaau

SEQ ID NO: 2116790 - RNA, 22 nt, Human
gucguggcagauaaucagccuc

SEQ ID NO: 2116791 - RNA, 18 nt, Human
gucuaacuuuugugugaa

SEQ ID NO: 2116792 - RNA, 16 nt, Human
gucuaaccaaaugcau

SEQ ID NO: 2116793 - RNA, 17 nt, Human
gucuaaccaaaugcauc

SEQ ID NO: 2116794 - RNA, 13 nt, Human
gucuaaauauuuc

SEQ ID NO: 2116795 - RNA, 16 nt, Human
gucuaaauauuuccuu

SEQ ID NO: 2116796 - RNA, 23 nt, Human
gucuaaauauuuccuuaaacugu

SEQ ID NO: 2116797 - RNA, 19 nt, Human
gucucacuauguugcccag

SEQ ID NO: 2116798 - RNA, 11 nt, Human
gucucacucug

SEQ ID NO: 2116799 - RNA, 18 nt, Human
gucucacuauguugccca

SEQ ID NO: 2116800 - RNA, 14 nt, Human
gucccugcccccuc

SEQ ID NO: 2116801 - RNA, 17 nt, Human
gucccugcccccucccc

SEQ ID NO: 2116802 - RNA, 12 nt, Human
gucggagcccug

SEQ ID NO: 2116803 - RNA, 16 nt, Human
gucggagcccugucuc

SEQ ID NO: 2116804 - RNA, 18 nt, Human
gucgggaguucgagacca

SEQ ID NO: 2116805 - RNA, 12 nt, Human
gucgggcucagc

SEQ ID NO: 2116806 - RNA, 21 nt, Human
gucgggcucagcucuggcuca

SEQ ID NO: 2116807 - RNA, 14 nt, Human
gucgggggcugagg

SEQ ID NO: 2116808 - RNA, 18 nt, Human
gucgggggcugaggggca

SEQ ID NO: 2116809 - RNA, 16 nt, Human
gucuuuuuucacuaca

SEQ ID NO: 2116810 - RNA, 15 nt, Human
gucuugguacuugcu

SEQ ID NO: 2116811 - RNA, 21 nt, Human
gucuugguacuugcugcuauu

SEQ ID NO: 2116812 - RNA, 12 nt, Human
gucuuguaagag

SEQ ID NO: 2116813 - RNA, 21 nt, Human
gucuuguaagagcuauacagu

SEQ ID NO: 2116814 - RNA, 21 nt, Human
gucuugcaauggcagccuugg

SEQ ID NO: 2116815 - RNA, 20 nt, Human
gucuugcaauggcagccuug

SEQ ID NO: 2116816 - RNA, 23 nt, Human
gucuugcaauggcagccuuggca

SEQ ID NO: 2116817 - RNA, 17 nt, Human
gucuugauuuguuuuag

SEQ ID NO: 2116818 - RNA, 18 nt, Human
gucuugauuuguuuuaga

SEQ ID NO: 2116819 - RNA, 19 nt, Human
gucuugcagugauuaaggu

SEQ ID NO: 2116820 - RNA, 21 nt, Human
gucuugcagugauuaaggucu

SEQ ID NO: 2116821 - RNA, 22 nt, Human
gucuugcuauggggagaaaaga

SEQ ID NO: 2116822 - RNA, 12 nt, Human
gucuugcugugg

SEQ ID NO: 2116823 - RNA, 16 nt, Human
gucuucuuacaugcau

SEQ ID NO: 2116824 - RNA, 17 nt, Human
gucuucuuugcccacaa

SEQ ID NO: 2116825 - RNA, 17 nt, Human
gucuugaacuccuggcc

SEQ ID NO: 2116826 - RNA, 16 nt, Human
gucuugaacuccuggc

SEQ ID NO: 2116827 - RNA, 21 nt, Human
gucuuaaaaaguggaaaaaua

SEQ ID NO: 2116828 - RNA, 15 nt, Human
gucuucucaggcucu

SEQ ID NO: 2116829 - RNA, 18 nt, Human
gucuucucaggcucugcc

SEQ ID NO: 2116830 - RNA, 19 nt, Human
gucuucucaggcucugccc

SEQ ID NO: 2116831 - RNA, 22 nt, Human
gucuucucaggcucugcccugc

SEQ ID NO: 2116832 - RNA, 16 nt, Human
gucuucucauagcauu

SEQ ID NO: 2116833 - RNA, 17 nt, Human
gucuucucauagcauua

SEQ ID NO: 2116834 - RNA, 19 nt, Human
gucuucucauagcauuaac

SEQ ID NO: 2116835 - RNA, 20 nt, Human
gucuucucauagcauuaacu

SEQ ID NO: 2116836 - RNA, 23 nt, Human
gucuucucauagcauuaacuaau

SEQ ID NO: 2116837 - RNA, 19 nt, Human
gucuugcaauggcagccuu

SEQ ID NO: 2116838 - RNA, 18 nt, Human
gucuugcaauggcagccu

SEQ ID NO: 2116839 - RNA, 17 nt, Human
gucuugcaauggcagcc

SEQ ID NO: 2116840 - RNA, 16 nt, Human
gucuugcaauggcagc

SEQ ID NO: 2116841 - RNA, 20 nt, Human
gucuugaacuccuggccuca

SEQ ID NO: 2116842 - RNA, 18 nt, Human
gucuugaacuccuggccu

SEQ ID NO: 2116843 - RNA, 21 nt, Human
gucuugaacuccuggccucaa

SEQ ID NO: 2116844 - RNA, 20 nt, Human
gucuucuuugcccacaaugc

SEQ ID NO: 2116845 - RNA, 17 nt, Human
gucugugugcaagugug

SEQ ID NO: 2116846 - RNA, 15 nt, Human
gucugugugcugugg

SEQ ID NO: 2116847 - RNA, 17 nt, Human
gucugugugcugugguu

SEQ ID NO: 2116848 - RNA, 16 nt, Human
gucugugugggacugu

SEQ ID NO: 2116849 - RNA, 18 nt, Human
gucugugugggacuguac

SEQ ID NO: 2116850 - RNA, 20 nt, Human
gucugugugggacuguacac

SEQ ID NO: 2116851 - RNA, 16 nt, Human
gucuguuaacuuaaua

SEQ ID NO: 2116852 - RNA, 22 nt, Human
gucuguguugcgugucgugggu

SEQ ID NO: 2116853 - RNA, 21 nt, Human
gucugugaauuggaccauccu

SEQ ID NO: 2116854 - RNA, 13 nt, Human
gucugugccugga

SEQ ID NO: 2116855 - RNA, 16 nt, Human
gucugugccuggagcu

SEQ ID NO: 2116856 - RNA, 17 nt, Human
gucugugccuggagcuc

SEQ ID NO: 2116857 - RNA, 16 nt, Human
gucugucuucacagcu

SEQ ID NO: 2116858 - RNA, 22 nt, Human
gucugucuucacagcucugugu

SEQ ID NO: 2116859 - RNA, 17 nt, Human
gucugagccaaagagaa

SEQ ID NO: 2116860 - RNA, 17 nt, Human
gucugccagccagcagc

SEQ ID NO: 2116861 - RNA, 18 nt, Human
gucugccagccagcagcc

SEQ ID NO: 2116862 - RNA, 21 nt, Human
gugaaugaugauccuaggcau

SEQ ID NO: 2116863 - RNA, 22 nt, Human
gugaaugaaagucuugugacua

SEQ ID NO: 2116864 - RNA, 21 nt, Human
gugaauuaucccuuuucuuga

SEQ ID NO: 2116865 - RNA, 20 nt, Human
gugacaaggauugcuacugu

SEQ ID NO: 2116866 - RNA, 14 nt, Human
gugaauuugaauga

SEQ ID NO: 2116867 - RNA, 16 nt, Human
gugaauuugaaugaaa

SEQ ID NO: 2116868 - RNA, 18 nt, Human
gugaauuugaaugaaaaa

SEQ ID NO: 2116869 - RNA, 13 nt, Human
gugaauuugaauc

SEQ ID NO: 2116870 - RNA, 14 nt, Human
gugaauuugaaucu

SEQ ID NO: 2116871 - RNA, 15 nt, Human
gugaauuugaaucuc

SEQ ID NO: 2116872 - RNA, 13 nt, Human
gugaauuugaaug

SEQ ID NO: 2116873 - RNA, 19 nt, Human
gugaauugugaccaaguua

SEQ ID NO: 2116874 - RNA, 13 nt, Human
gugaauugauaau

SEQ ID NO: 2116875 - RNA, 14 nt, Human
gugaauugauaaua

SEQ ID NO: 2116876 - RNA, 16 nt, Human
gugaauugauaauaaa

SEQ ID NO: 2116877 - RNA, 17 nt, Human
gugaauugauaauaaac

SEQ ID NO: 2116878 - RNA, 20 nt, Human
gucuuuuuuuuuuuugucua

SEQ ID NO: 2116879 - RNA, 14 nt, Human
gucuuuuuuucugu

SEQ ID NO: 2116880 - RNA, 19 nt, Human
gucuuuuuuucuguuaauu

SEQ ID NO: 2116881 - RNA, 23 nt, Human
gugaaucugcauuuucuggguuc

SEQ ID NO: 2116882 - RNA, 15 nt, Human
gugaaucuaaaagcu

SEQ ID NO: 2116883 - RNA, 20 nt, Human
gugaaaaaagcuuuuaugag

SEQ ID NO: 2116884 - RNA, 19 nt, Human
gugaacaagugaacacauu

SEQ ID NO: 2116885 - RNA, 15 nt, Human
gugaccucugccuga

SEQ ID NO: 2116886 - RNA, 15 nt, Human
gugaccuucugggaa

SEQ ID NO: 2116887 - RNA, 14 nt, Human
gugaccucugccug

SEQ ID NO: 2116888 - RNA, 13 nt, Human
gugaccucugccu

SEQ ID NO: 2116889 - RNA, 15 nt, Human
gugacagaggcagcc

SEQ ID NO: 2116890 - RNA, 12 nt, Human
gugaccucugcc

SEQ ID NO: 2116891 - RNA, 14 nt, Human
gugacagaggcagc

SEQ ID NO: 2116892 - RNA, 13 nt, Human
gugacagaggcag

SEQ ID NO: 2116893 - RNA, 12 nt, Human
gugacagaggca

SEQ ID NO: 2116894 - RNA, 22 nt, Human
gugacacuucagagagcuggua

SEQ ID NO: 2116895 - RNA, 23 nt, Human
gugacaccagccuuucucccagg

SEQ ID NO: 2116896 - RNA, 18 nt, Human
gugacacuucagagagcu

SEQ ID NO: 2116897 - RNA, 20 nt, Human
gugacacuucagagagcugg

SEQ ID NO: 2116898 - RNA, 21 nt, Human
gugacacuucagagagcuggu

SEQ ID NO: 2116899 - RNA, 16 nt, Human
gugacaauuuuguaca

SEQ ID NO: 2116900 - RNA, 18 nt, Human
gugacaaggccccagaga

SEQ ID NO: 2116901 - RNA, 19 nt, Human
gugacaaggccccagagac

SEQ ID NO: 2116902 - RNA, 23 nt, Human
gugacaagcuccuggucuugaga

SEQ ID NO: 2116903 - RNA, 13 nt, Human
gugacaaggcccc

SEQ ID NO: 2116904 - RNA, 14 nt, Human
gugacaaggcccca

SEQ ID NO: 2116905 - RNA, 17 nt, Human
gugacaaggccccagag

SEQ ID NO: 2116906 - RNA, 22 nt, Human
gugauccacccaccucagccuc

SEQ ID NO: 2116907 - RNA, 16 nt, Human
gugaucaauaaaaugu

SEQ ID NO: 2116908 - RNA, 17 nt, Human
gugaucaauaaaaugug

SEQ ID NO: 2116909 - RNA, 19 nt, Human
gugaucaauaaaaugugau

SEQ ID NO: 2116910 - RNA, 18 nt, Human
gugaucaauaaaauguga

SEQ ID NO: 2116911 - RNA, 17 nt, Human
gugaucaauuaaaugua

SEQ ID NO: 2116912 - RNA, 20 nt, Human
gugauacccauagcuuccau

SEQ ID NO: 2116913 - RNA, 21 nt, Human
gugaggauaacacaaguaaaa

SEQ ID NO: 2116914 - RNA, 20 nt, Human
gugauacaacuucaagugca

SEQ ID NO: 2116915 - RNA, 20 nt, Human
gugaguguguguuugugcug

SEQ ID NO: 2116916 - RNA, 16 nt, Human
gugaguguggcucccc

SEQ ID NO: 2116917 - RNA, 22 nt, Human
gugaguguguccaagugugugu

SEQ ID NO: 2116918 - RNA, 23 nt, Human
gugaguguguccaagugugugug

SEQ ID NO: 2116919 - RNA, 13 nt, Human
gugagugugugca

SEQ ID NO: 2116920 - RNA, 15 nt, Human
gugagugugugcaag

SEQ ID NO: 2116921 - RNA, 21 nt, Human
gugacuagugcugaagcuuau

SEQ ID NO: 2116922 - RNA, 11 nt, Human
gugacuagugc

SEQ ID NO: 2116923 - RNA, 13 nt, Human
gugacuagugcug

SEQ ID NO: 2116924 - RNA, 14 nt, Human
gugacuagugcuga

SEQ ID NO: 2116925 - RNA, 15 nt, Human
gugacuagugcugaa

SEQ ID NO: 2116926 - RNA, 17 nt, Human
gugacuagugcugaagc

SEQ ID NO: 2116927 - RNA, 18 nt, Human
gugacuagugcugaagcu

SEQ ID NO: 2116928 - RNA, 22 nt, Human
gugacuagugcugaagcuuauu

SEQ ID NO: 2116929 - RNA, 20 nt, Human
gugagccacugcaccgggcc

SEQ ID NO: 2116930 - RNA, 15 nt, Human
gugagccacugcacc

SEQ ID NO: 2116931 - RNA, 15 nt, Human
gugacucacccaagc

SEQ ID NO: 2116932 - RNA, 18 nt, Human
gugacucauccucuugaa

SEQ ID NO: 2116933 - RNA, 19 nt, Human
gugagccgagaucacgcca

SEQ ID NO: 2116934 - RNA, 12 nt, Human
gugagccgcauc

SEQ ID NO: 2116935 - RNA, 18 nt, Human
gugagccgcaucuucucc

SEQ ID NO: 2116936 - RNA, 21 nt, Human
gugagccgcaucuucuccauc

SEQ ID NO: 2116937 - RNA, 18 nt, Human
gugaggagcugcuggcuu

SEQ ID NO: 2116938 - RNA, 17 nt, Human
gugaggagcugcuggcu

SEQ ID NO: 2116939 - RNA, 15 nt, Human
gugaggagcugcugg

SEQ ID NO: 2116940 - RNA, 15 nt, Human
gugaguguggcuccc

SEQ ID NO: 2116941 - RNA, 16 nt, Human
gugaguguaaguguga

SEQ ID NO: 2116942 - RNA, 18 nt, Human
gugaggaugucacucaga

SEQ ID NO: 2116943 - RNA, 22 nt, Human
gugaggaugucacucagaugga

SEQ ID NO: 2116944 - RNA, 21 nt, Human
gugaggauggccucugcuaag

SEQ ID NO: 2116945 - RNA, 17 nt, Human
gugaggaugggaaggag

SEQ ID NO: 2116946 - RNA, 19 nt, Human
gugaggaugggaaggaggg

SEQ ID NO: 2116947 - RNA, 20 nt, Human
gugccccugcugccucccca

SEQ ID NO: 2116948 - RNA, 15 nt, Human
gugccuucagcucua

SEQ ID NO: 2116949 - RNA, 20 nt, Human
gugcccuccacagccgcagc

SEQ ID NO: 2116950 - RNA, 14 nt, Human
gugcccuccacugc

SEQ ID NO: 2116951 - RNA, 15 nt, Human
gugcccuccacugcc

SEQ ID NO: 2116952 - RNA, 18 nt, Human
gugcccuccacugcccuc

SEQ ID NO: 2116953 - RNA, 20 nt, Human
gugcccuccacugcccucug

SEQ ID NO: 2116954 - RNA, 12 nt, Human
gugccuuccaua

SEQ ID NO: 2116955 - RNA, 15 nt, Human
gugccuuccauaauu

SEQ ID NO: 2116956 - RNA, 17 nt, Human
gugccuuccauaauuau

SEQ ID NO: 2116957 - RNA, 22 nt, Human
gugccuuccauaauuaugacag

SEQ ID NO: 2116958 - RNA, 21 nt, Human
gugcgaucuggguucacugca

SEQ ID NO: 2116959 - RNA, 19 nt, Human
gugccuucuuauucucacu

SEQ ID NO: 2116960 - RNA, 23 nt, Human
gugccuucuuauucucacuccac

SEQ ID NO: 2116961 - RNA, 16 nt, Human
gugccaugugccaggu

SEQ ID NO: 2116962 - RNA, 14 nt, Human
gugccaugugccag

SEQ ID NO: 2116963 - RNA, 19 nt, Human
gugccaggcccggggcugg

SEQ ID NO: 2116964 - RNA, 20 nt, Human
gugccaggcccggggcuggc

SEQ ID NO: 2116965 - RNA, 12 nt, Human
gugccaggcccg

SEQ ID NO: 2116966 - RNA, 13 nt, Human
gugccaggcccgg

SEQ ID NO: 2116967 - RNA, 17 nt, Human
gugccaggcccggggcu

SEQ ID NO: 2116968 - RNA, 20 nt, Human
gugcccaagaauagaugcug

SEQ ID NO: 2116969 - RNA, 13 nt, Human
gugccauugucuu

SEQ ID NO: 2116970 - RNA, 14 nt, Human
gugccauugucuuu

SEQ ID NO: 2116971 - RNA, 15 nt, Human
gugccauugucuuua

SEQ ID NO: 2116972 - RNA, 13 nt, Human
gugccccccuugc

SEQ ID NO: 2116973 - RNA, 20 nt, Human
gugccccccuugccagacau

SEQ ID NO: 2116974 - RNA, 13 nt, Human
gugccccugcugc

SEQ ID NO: 2116975 - RNA, 19 nt, Human
gugccccugcugccucccc

SEQ ID NO: 2116976 - RNA, 22 nt, Human
gugcuaaauggucgcccaggag

SEQ ID NO: 2116977 - RNA, 13 nt, Human
gugcuaaauuuuc

SEQ ID NO: 2116978 - RNA, 23 nt, Human
gugcuaaccacgucugucuucac

SEQ ID NO: 2116979 - RNA, 13 nt, Human
gugcgugugucca

SEQ ID NO: 2116980 - RNA, 13 nt, Human
gugcgugugugca

SEQ ID NO: 2116981 - RNA, 14 nt, Human
gugcgugggugaag

SEQ ID NO: 2116982 - RNA, 12 nt, Human
gugcguggguga

SEQ ID NO: 2116983 - RNA, 21 nt, Human
gugcgugaaacacaccaggcu

SEQ ID NO: 2116984 - RNA, 16 nt, Human
gugcuaaauuuucagu

SEQ ID NO: 2116985 - RNA, 14 nt, Human
gugcgccuacagga

SEQ ID NO: 2116986 - RNA, 14 nt, Human
gugcgagugugugc

SEQ ID NO: 2116987 - RNA, 23 nt, Human
gugcgagugugugcaugugugug

SEQ ID NO: 2116988 - RNA, 23 nt, Human
gugcgaucauggcucacugcagc

SEQ ID NO: 2116989 - RNA, 22 nt, Human
gugcgcugacaaccaccgcucc

SEQ ID NO: 2116990 - RNA, 17 nt, Human
gugcgggcacaauaaau

SEQ ID NO: 2116991 - RNA, 14 nt, Human
gugcgugaaacaca

SEQ ID NO: 2116992 - RNA, 15 nt, Human
gugcgugaaacacac

SEQ ID NO: 2116993 - RNA, 13 nt, Human
gugcguccugucg

SEQ ID NO: 2116994 - RNA, 14 nt, Human
gugcggccuuuggc

SEQ ID NO: 2116995 - RNA, 16 nt, Human
gugcagcaaccagagc

SEQ ID NO: 2116996 - RNA, 18 nt, Human
gugcagcaaccagagcac

SEQ ID NO: 2116997 - RNA, 16 nt, Human
gugcagagugcccaga

SEQ ID NO: 2116998 - RNA, 18 nt, Human
gugcagagugcccagaac

SEQ ID NO: 2116999 - RNA, 15 nt, Human
gugcagcauaugagg

SEQ ID NO: 2117000 - RNA, 17 nt, Human
gugcagcauaugaggau

SEQ ID NO: 2117001 - RNA, 20 nt, Human
gugcagcccguguggccccu

SEQ ID NO: 2117002 - RNA, 21 nt, Human
gugcagcccguguggccccuu

SEQ ID NO: 2117003 - RNA, 19 nt, Human
gugcagcccguguggcccc

SEQ ID NO: 2117004 - RNA, 12 nt, Human
gugcagcugauu

SEQ ID NO: 2117005 - RNA, 13 nt, Human
gugcagcugauuu

SEQ ID NO: 2117006 - RNA, 14 nt, Human
gugcagcugauuuu

SEQ ID NO: 2117007 - RNA, 16 nt, Human
gugcagcugauuuuaa

SEQ ID NO: 2117008 - RNA, 18 nt, Human
gugcagcugauuuuaaca

SEQ ID NO: 2117009 - RNA, 23 nt, Human
gugcagcugauuuuaacaauaac

SEQ ID NO: 2117010 - RNA, 23 nt, Human
gugcaguggugcgaucuggguuc

SEQ ID NO: 2117011 - RNA, 20 nt, Human
gugcaguggugcgaucuggg

SEQ ID NO: 2117012 - RNA, 13 nt, Human
gugcaucucagcc

SEQ ID NO: 2117013 - RNA, 15 nt, Human
gugcaggcuggcacc

SEQ ID NO: 2117014 - RNA, 14 nt, Human
gugcagacuggagg

SEQ ID NO: 2117015 - RNA, 23 nt, Human
gugcagacuggaggggacgcugg

SEQ ID NO: 2117016 - RNA, 15 nt, Human
gugcagacuggaggg

SEQ ID NO: 2117017 - RNA, 15 nt, Human
gugauuuuuuuuuag

SEQ ID NO: 2117018 - RNA, 19 nt, Human
gugcaaaacaugcuaccug

SEQ ID NO: 2117019 - RNA, 14 nt, Human
gugcaaaaauuuuu

SEQ ID NO: 2117020 - RNA, 18 nt, Human
gugcaaaaauuuuuggau

SEQ ID NO: 2117021 - RNA, 19 nt, Human
gugcaaaaauuuuuggauu

SEQ ID NO: 2117022 - RNA, 15 nt, Human
gugauuugaaggucu

SEQ ID NO: 2117023 - RNA, 12 nt, Human
gugauuuucauu

SEQ ID NO: 2117024 - RNA, 24 nt, Human
gugauccacccaccucagccuccc

SEQ ID NO: 2117025 - RNA, 23 nt, Human
gugauccacccaccucagccucc

SEQ ID NO: 2117026 - RNA, 19 nt, Human
gugucuaggcaggaccugu

SEQ ID NO: 2117027 - RNA, 15 nt, Human
gugucguagccaagg

SEQ ID NO: 2117028 - RNA, 19 nt, Human
guguccuugcaccugcauc

SEQ ID NO: 2117029 - RNA, 16 nt, Human
guguccuuucccucca

SEQ ID NO: 2117030 - RNA, 17 nt, Human
guguccuuucccuccac

SEQ ID NO: 2117031 - RNA, 14 nt, Human
gugucuaaaaacac

SEQ ID NO: 2117032 - RNA, 17 nt, Human
gugucuaaaaacaccaa

SEQ ID NO: 2117033 - RNA, 22 nt, Human
gugucucaguccaccugagcug

SEQ ID NO: 2117034 - RNA, 14 nt, Human
gugucuccugcaug

SEQ ID NO: 2117035 - RNA, 15 nt, Human
gugucuccugcaugc

SEQ ID NO: 2117036 - RNA, 16 nt, Human
gugucuccugcaugca

SEQ ID NO: 2117037 - RNA, 23 nt, Human
gugucuccugcaugcagaaaggg

SEQ ID NO: 2117038 - RNA, 17 nt, Human
guguccuugcaccugca

SEQ ID NO: 2117039 - RNA, 18 nt, Human
guguccuugcaccugcau

SEQ ID NO: 2117040 - RNA, 18 nt, Human
guguccuccccucaagga

SEQ ID NO: 2117041 - RNA, 16 nt, Human
gugucccucucucugg

SEQ ID NO: 2117042 - RNA, 18 nt, Human
gugucccucucucuggaa

SEQ ID NO: 2117043 - RNA, 14 nt, Human
guguccuaggagua

SEQ ID NO: 2117044 - RNA, 23 nt, Human
gugucccugcacuugcagacucu

SEQ ID NO: 2117045 - RNA, 14 nt, Human
guguccggucccug

SEQ ID NO: 2117046 - RNA, 22 nt, Human
gugucucuuuucucuuucuccu

SEQ ID NO: 2117047 - RNA, 22 nt, Human
gugucuggacauucagaacacc

SEQ ID NO: 2117048 - RNA, 21 nt, Human
gugucucggagggauuccccu

SEQ ID NO: 2117049 - RNA, 18 nt, Human
gugucucuuuucucuuuc

SEQ ID NO: 2117050 - RNA, 19 nt, Human
gugucucuuuucucuuucu

SEQ ID NO: 2117051 - RNA, 16 nt, Human
gugucugagagauuca

SEQ ID NO: 2117052 - RNA, 14 nt, Human
gugugagugugugc

SEQ ID NO: 2117053 - RNA, 11 nt, Human
gugugagugug

SEQ ID NO: 2117054 - RNA, 20 nt, Human
gugugagucaccaagcccag

SEQ ID NO: 2117055 - RNA, 17 nt, Human
gugugaucccaagugcc

SEQ ID NO: 2117056 - RNA, 19 nt, Human
gugugaucccaagugccag

SEQ ID NO: 2117057 - RNA, 12 nt, Human
gugugcaugugu

SEQ ID NO: 2117058 - RNA, 18 nt, Human
gugugcaugugugugcuc

SEQ ID NO: 2117059 - RNA, 20 nt, Human
gugugcaugugugugcucag

SEQ ID NO: 2117060 - RNA, 16 nt, Human
gugugcaagugugugc

SEQ ID NO: 2117061 - RNA, 16 nt, Human
gugugcaaguauguga

SEQ ID NO: 2117062 - RNA, 16 nt, Human
gugugcaacagacaag

SEQ ID NO: 2117063 - RNA, 15 nt, Human
gugugcaacagacaa

SEQ ID NO: 2117064 - RNA, 22 nt, Human
gugugcacacacaccacacaua

SEQ ID NO: 2117065 - RNA, 22 nt, Human
gugugcucugaucauccacugu

SEQ ID NO: 2117066 - RNA, 15 nt, Human
gugugcucugaucau

SEQ ID NO: 2117067 - RNA, 12 nt, Human
gugugcucugau

SEQ ID NO: 2117068 - RNA, 13 nt, Human
gugugccugcagc

SEQ ID NO: 2117069 - RNA, 14 nt, Human
gugugccugcagcc

SEQ ID NO: 2117070 - RNA, 15 nt, Human
gugugccugcagccc

SEQ ID NO: 2117071 - RNA, 16 nt, Human
gugugccugcagcccc

SEQ ID NO: 2117072 - RNA, 16 nt, Human
gugugcguccugucgg

SEQ ID NO: 2117073 - RNA, 18 nt, Human
gugugccugcagccccgc

SEQ ID NO: 2117074 - RNA, 14 nt, Human
gugugcguccuguc

SEQ ID NO: 2117075 - RNA, 15 nt, Human
guguguuucugaucu

SEQ ID NO: 2117076 - RNA, 14 nt, Human
guguguuugugauu

SEQ ID NO: 2117077 - RNA, 21 nt, Human
guguggagaagcggcuggcag

SEQ ID NO: 2117078 - RNA, 16 nt, Human
guguggacugugaugc

SEQ ID NO: 2117079 - RNA, 18 nt, Human
guguggacucaaguccuu

SEQ ID NO: 2117080 - RNA, 15 nt, Human
guguggacugugaug

SEQ ID NO: 2117081 - RNA, 13 nt, Human
guguggagaagcg

SEQ ID NO: 2117082 - RNA, 15 nt, Human
gugugcacgaguggg

SEQ ID NO: 2117083 - RNA, 15 nt, Human
guguggcuccccucu

SEQ ID NO: 2117084 - RNA, 15 nt, Human
guguggccccuucac

SEQ ID NO: 2117085 - RNA, 19 nt, Human
guguggcucacguguguga

SEQ ID NO: 2117086 - RNA, 14 nt, Human
gugugggcuguguc

SEQ ID NO: 2117087 - RNA, 15 nt, Human
gugugggacuguaca

SEQ ID NO: 2117088 - RNA, 17 nt, Human
gugugggacuguacaca

SEQ ID NO: 2117089 - RNA, 13 nt, Human
gugugggaaggga

SEQ ID NO: 2117090 - RNA, 16 nt, Human
gugugggaagggagag

SEQ ID NO: 2117091 - RNA, 19 nt, Human
guguggcuuucagagccuc

SEQ ID NO: 2117092 - RNA, 19 nt, Human
guuaaacuuacuuaguguu

SEQ ID NO: 2117093 - RNA, 15 nt, Human
guuaaaauuccaucc

SEQ ID NO: 2117094 - RNA, 20 nt, Human
guuaaagucagugggaacgu

SEQ ID NO: 2117095 - RNA, 20 nt, Human
guuaaauagaguauaugcac

SEQ ID NO: 2117096 - RNA, 19 nt, Human
guuaaauagaguauaugca

SEQ ID NO: 2117097 - RNA, 21 nt, Human
guuaaauagaguauaugcacu

SEQ ID NO: 2117098 - RNA, 12 nt, Human
guuaaauauuua

SEQ ID NO: 2117099 - RNA, 22 nt, Human
guguuuuuuuuucguuuguuug

SEQ ID NO: 2117100 - RNA, 14 nt, Human
guuaaaaaaaauaa

SEQ ID NO: 2117101 - RNA, 16 nt, Human
guuaaaaaaaauaaua

SEQ ID NO: 2117102 - RNA, 18 nt, Human
guuaaaaaaaauaauaaa

SEQ ID NO: 2117103 - RNA, 19 nt, Human
guuaaaaaaaauaauaaau

SEQ ID NO: 2117104 - RNA, 12 nt, Human
guuaaaacuguc

SEQ ID NO: 2117105 - RNA, 14 nt, Human
guuaaacauugaag

SEQ ID NO: 2117106 - RNA, 21 nt, Human
guuaaaauaacuaguguugcu

SEQ ID NO: 2117107 - RNA, 16 nt, Human
guuacacauuuuucag

SEQ ID NO: 2117108 - RNA, 13 nt, Human
guuaacuuugggu

SEQ ID NO: 2117109 - RNA, 12 nt, Human
guuaagaaaaaa

SEQ ID NO: 2117110 - RNA, 16 nt, Human
guuaagaaaaaaauaa

SEQ ID NO: 2117111 - RNA, 18 nt, Human
guuaagaaaaaaauaauu

SEQ ID NO: 2117112 - RNA, 15 nt, Human
guuacacuaaaaggu

SEQ ID NO: 2117113 - RNA, 16 nt, Human
guuacacuaaaaggug

SEQ ID NO: 2117114 - RNA, 17 nt, Human
guuacacauuuuucaga

SEQ ID NO: 2117115 - RNA, 14 nt, Human
guuacacuguuaga

SEQ ID NO: 2117116 - RNA, 19 nt, Human
guuacacuguuagaacacu

SEQ ID NO: 2117117 - RNA, 20 nt, Human
guuacacuguuagaacacua

SEQ ID NO: 2117118 - RNA, 22 nt, Human
guuacacuguuagaacacuauu

SEQ ID NO: 2117119 - RNA, 13 nt, Human
guuaaauauuuac

SEQ ID NO: 2117120 - RNA, 15 nt, Human
guuaaauauuuacau

SEQ ID NO: 2117121 - RNA, 16 nt, Human
guuaaauauuuacaua

SEQ ID NO: 2117122 - RNA, 22 nt, Human
guuaaauauuuacauaugaaau

SEQ ID NO: 2117123 - RNA, 23 nt, Human
guuaacagagacagauaacucuc

SEQ ID NO: 2117124 - RNA, 15 nt, Human
guuaacauugaccaa

SEQ ID NO: 2117125 - RNA, 18 nt, Human
guuaacauugaccaagaa

SEQ ID NO: 2117126 - RNA, 21 nt, Human
guuaacauugaccaagaacug

SEQ ID NO: 2117127 - RNA, 23 nt, Human
guuaacauugaccaagaacugca

SEQ ID NO: 2117128 - RNA, 21 nt, Human
guuaacuauuuuauuuucuaa

SEQ ID NO: 2117129 - RNA, 12 nt, Human
guuaaccuaccu

SEQ ID NO: 2117130 - RNA, 17 nt, Human
guuaaccucagugucau

SEQ ID NO: 2117131 - RNA, 20 nt, Human
guuaaccagaauaaaguucu

SEQ ID NO: 2117132 - RNA, 16 nt, Human
guuaacuauguacaau

SEQ ID NO: 2117133 - RNA, 18 nt, Human
guuaacuauguacaauau

SEQ ID NO: 2117134 - RNA, 19 nt, Human
guuaacuauguacaauauu

SEQ ID NO: 2117135 - RNA, 20 nt, Human
guuaacuauguacaauauuu

SEQ ID NO: 2117136 - RNA, 23 nt, Human
guuaacuauguacaauauuuuaa

SEQ ID NO: 2117137 - RNA, 19 nt, Human
guguguuuuugggaugucu

SEQ ID NO: 2117138 - RNA, 21 nt, Human
guguguuuuugggaugucuua

SEQ ID NO: 2117139 - RNA, 14 nt, Human
guguguuuguguga

SEQ ID NO: 2117140 - RNA, 17 nt, Human
guguguuuucauaauaa

SEQ ID NO: 2117141 - RNA, 18 nt, Human
guguguuuucauaauaaa

SEQ ID NO: 2117142 - RNA, 21 nt, Human
guguuauuuauugcuacuucc

SEQ ID NO: 2117143 - RNA, 15 nt, Human
guguuuucauaauaa

SEQ ID NO: 2117144 - RNA, 16 nt, Human
guguuuucauaauaaa

SEQ ID NO: 2117145 - RNA, 16 nt, Human
guguucugauuagaaa

SEQ ID NO: 2117146 - RNA, 12 nt, Human
guguuuucagag

SEQ ID NO: 2117147 - RNA, 13 nt, Human
guguuuucauaau

SEQ ID NO: 2117148 - RNA, 14 nt, Human
guguuuucauaaua

SEQ ID NO: 2117149 - RNA, 15 nt, Human
guguuuuuaacucaa

SEQ ID NO: 2117150 - RNA, 13 nt, Human
guguuuuguuuug

SEQ ID NO: 2117151 - RNA, 22 nt, Human
guguuuuguuuugauuuaauaa

SEQ ID NO: 2117152 - RNA, 15 nt, Human
guguuuuugaaauau

SEQ ID NO: 2117153 - RNA, 15 nt, Human
guguuuuugggaugu

SEQ ID NO: 2117154 - RNA, 18 nt, Human
guguuuuugggaugucuu

SEQ ID NO: 2117155 - RNA, 19 nt, Human
guguuuuugggaugucuua

SEQ ID NO: 2117156 - RNA, 11 nt, Human
guguucguucu

SEQ ID NO: 2117157 - RNA, 15 nt, Human
guguucguucuuguu

SEQ ID NO: 2117158 - RNA, 21 nt, Human
guguucguucuuguucuguuu

SEQ ID NO: 2117159 - RNA, 10 nt, Human
guguuccugg

SEQ ID NO: 2117160 - RNA, 15 nt, Human
guguuccuggcaaua

SEQ ID NO: 2117161 - RNA, 18 nt, Human
guguuccuggcaauagug

SEQ ID NO: 2117162 - RNA, 15 nt, Human
guguuccaacaacca

SEQ ID NO: 2117163 - RNA, 17 nt, Human
guguuauuuaaaugagu

SEQ ID NO: 2117164 - RNA, 13 nt, Human
guguacagucuug

SEQ ID NO: 2117165 - RNA, 16 nt, Human
guguacagucuuguau

SEQ ID NO: 2117166 - RNA, 22 nt, Human
guguacagucuuguauuaaguu

SEQ ID NO: 2117167 - RNA, 12 nt, Human
guguaagagaau

SEQ ID NO: 2117168 - RNA, 12 nt, Human
guguacagugug

SEQ ID NO: 2117169 - RNA, 17 nt, Human
guguacauggaauaaca

SEQ ID NO: 2117170 - RNA, 18 nt, Human
guguacagaauucugcua

SEQ ID NO: 2117171 - RNA, 23 nt, Human
guguaaucauuucuugggcccuc

SEQ ID NO: 2117172 - RNA, 22 nt, Human
guguacauggaauaacauguaa

SEQ ID NO: 2117173 - RNA, 16 nt, Human
guguacguggagaggg

SEQ ID NO: 2117174 - RNA, 20 nt, Human
guguacguggagagggauga

SEQ ID NO: 2117175 - RNA, 13 nt, Human
guguacucuggcc

SEQ ID NO: 2117176 - RNA, 15 nt, Human
guguacucuggccuc

SEQ ID NO: 2117177 - RNA, 16 nt, Human
guguacucuggccucu

SEQ ID NO: 2117178 - RNA, 17 nt, Human
guguacucuggccucug

SEQ ID NO: 2117179 - RNA, 18 nt, Human
guguacucuggccucugu

SEQ ID NO: 2117180 - RNA, 19 nt, Human
guguacucuggccucuguc

SEQ ID NO: 2117181 - RNA, 14 nt, Human
guguacuguaaaga

SEQ ID NO: 2117182 - RNA, 16 nt, Human
guguagccuugcccgg

SEQ ID NO: 2117183 - RNA, 15 nt, Human
guguagccccaagaa

SEQ ID NO: 2117184 - RNA, 20 nt, Human
guguagccccaagaaggcug

SEQ ID NO: 2117185 - RNA, 17 nt, Human
guguagccuugcccgga

SEQ ID NO: 2117186 - RNA, 14 nt, Human
guguagccaagguc

SEQ ID NO: 2117187 - RNA, 17 nt, Human
guguagauuuguuuugu

SEQ ID NO: 2117188 - RNA, 22 nt, Human
guguagacgaagggggcaucug

SEQ ID NO: 2117189 - RNA, 17 nt, Human
guguauauguaugugug

SEQ ID NO: 2117190 - RNA, 14 nt, Human
guguauauguaugu

SEQ ID NO: 2117191 - RNA, 15 nt, Human
guguaugacuaaaga

SEQ ID NO: 2117192 - RNA, 16 nt, Human
guguaugacuaaagag

SEQ ID NO: 2117193 - RNA, 15 nt, Human
guguaggcuuuacuu

SEQ ID NO: 2117194 - RNA, 16 nt, Human
guguaggcuuuacuua

SEQ ID NO: 2117195 - RNA, 20 nt, Human
guguaggcuuuacuuagcuu

SEQ ID NO: 2117196 - RNA, 18 nt, Human
gugucccugcacuugcag

SEQ ID NO: 2117197 - RNA, 16 nt, Human
gugucccugcacuugc

SEQ ID NO: 2117198 - RNA, 13 nt, Human
gugucccugcacu

SEQ ID NO: 2117199 - RNA, 12 nt, Human
guguccccagcc

SEQ ID NO: 2117200 - RNA, 15 nt, Human
guguccccagcccac

SEQ ID NO: 2117201 - RNA, 22 nt, Human
guguccccagcccacuggauca

SEQ ID NO: 2117202 - RNA, 17 nt, Human
guguauguacauauaua

SEQ ID NO: 2117203 - RNA, 16 nt, Human
guguaugggugugugu

SEQ ID NO: 2117204 - RNA, 22 nt, Human
guguauggguguguguuugugu

SEQ ID NO: 2117205 - RNA, 16 nt, Human
guguaugugcgugugu

SEQ ID NO: 2117206 - RNA, 19 nt, Human
guguaugcuacuacaaaaa

SEQ ID NO: 2117207 - RNA, 14 nt, Human
gugguauagaaaug

SEQ ID NO: 2117208 - RNA, 19 nt, Human
gugguaugaucacggcuca

SEQ ID NO: 2117209 - RNA, 12 nt, Human
gugguaugugug

SEQ ID NO: 2117210 - RNA, 15 nt, Human
gugguaugugugugu

SEQ ID NO: 2117211 - RNA, 17 nt, Human
gugguagagugugccug

SEQ ID NO: 2117212 - RNA, 17 nt, Human
gugguaagagaauguua

SEQ ID NO: 2117213 - RNA, 18 nt, Human
gugguaagagaauguuau

SEQ ID NO: 2117214 - RNA, 19 nt, Human
gugguaagagaauguuaua

SEQ ID NO: 2117215 - RNA, 16 nt, Human
guggucauuaagcauu

SEQ ID NO: 2117216 - RNA, 12 nt, Human
gugguccugacu

SEQ ID NO: 2117217 - RNA, 13 nt, Human
guggucugaaugu

SEQ ID NO: 2117218 - RNA, 14 nt, Human
guggucugaauguu

SEQ ID NO: 2117219 - RNA, 17 nt, Human
guggucugaauguucug

SEQ ID NO: 2117220 - RNA, 18 nt, Human
guggucugaauguucuga

SEQ ID NO: 2117221 - RNA, 17 nt, Human
guggugaccucugccug

SEQ ID NO: 2117222 - RNA, 14 nt, Human
guggugaccucugc

SEQ ID NO: 2117223 - RNA, 16 nt, Human
guggucuuucuggaga

SEQ ID NO: 2117224 - RNA, 17 nt, Human
guggucuuucuggagag

SEQ ID NO: 2117225 - RNA, 20 nt, Human
guggucugaauguucugaca

SEQ ID NO: 2117226 - RNA, 23 nt, Human
guggucugaauguucugacauua

SEQ ID NO: 2117227 - RNA, 21 nt, Human
guggucugagccaaagagaau

SEQ ID NO: 2117228 - RNA, 14 nt, Human
guggucugcaggca

SEQ ID NO: 2117229 - RNA, 24 nt, Human
guggucugaauguucugacauuaa

SEQ ID NO: 2117230 - RNA, 15 nt, Human
guggucugcaggcag

SEQ ID NO: 2117231 - RNA, 16 nt, Human
guggucugcaggcagg

SEQ ID NO: 2117232 - RNA, 19 nt, Human
guggugaucaauuaaaugu

SEQ ID NO: 2117233 - RNA, 13 nt, Human
guggugagaucau

SEQ ID NO: 2117234 - RNA, 19 nt, Human
guggugcgaucuggguuca

SEQ ID NO: 2117235 - RNA, 21 nt, Human
guguaaguauucuuauuuaau

SEQ ID NO: 2117236 - RNA, 13 nt, Human
guguaauaaagug

SEQ ID NO: 2117237 - RNA, 14 nt, Human
guguaauaaagugu

SEQ ID NO: 2117238 - RNA, 15 nt, Human
guguaauaaaguguu

SEQ ID NO: 2117239 - RNA, 18 nt, Human
guguaauaaaguguuuuc

SEQ ID NO: 2117240 - RNA, 20 nt, Human
guguaauaaaguguuuucag

SEQ ID NO: 2117241 - RNA, 21 nt, Human
guguaauaaaguguuuucaga

SEQ ID NO: 2117242 - RNA, 22 nt, Human
guguaauaaaguguuuucagag

SEQ ID NO: 2117243 - RNA, 22 nt, Human
guguaagugugaguaagagcug

SEQ ID NO: 2117244 - RNA, 19 nt, Human
guguaaucauuucuugggc

SEQ ID NO: 2117245 - RNA, 21 nt, Human
guguaaucauuucuugggccc

SEQ ID NO: 2117246 - RNA, 12 nt, Human
gugggcuaagca

SEQ ID NO: 2117247 - RNA, 15 nt, Human
gugggcuaguugggc

SEQ ID NO: 2117248 - RNA, 13 nt, Human
gugggcucccuuc

SEQ ID NO: 2117249 - RNA, 13 nt, Human
gugggcugagccc

SEQ ID NO: 2117250 - RNA, 14 nt, Human
gugggcugagcccu

SEQ ID NO: 2117251 - RNA, 15 nt, Human
gugggcugagcccug

SEQ ID NO: 2117252 - RNA, 16 nt, Human
gugggcugagcccugg

SEQ ID NO: 2117253 - RNA, 13 nt, Human
gugggcggcagag

SEQ ID NO: 2117254 - RNA, 16 nt, Human
gugggcggcagagagg

SEQ ID NO: 2117255 - RNA, 19 nt, Human
gugggccagccccucccac

SEQ ID NO: 2117256 - RNA, 14 nt, Human
gugggccaggacag

SEQ ID NO: 2117257 - RNA, 18 nt, Human
gugggccaggacaggccc

SEQ ID NO: 2117258 - RNA, 20 nt, Human
gugggcaggugggagcuuga

SEQ ID NO: 2117259 - RNA, 20 nt, Human
gugggcauugauggggaagg

SEQ ID NO: 2117260 - RNA, 12 nt, Human
gugggccagccc

SEQ ID NO: 2117261 - RNA, 13 nt, Human
gugggccagcccc

SEQ ID NO: 2117262 - RNA, 15 nt, Human
gugggccagccccuc

SEQ ID NO: 2117263 - RNA, 17 nt, Human
gugggccagccccuccc

SEQ ID NO: 2117264 - RNA, 15 nt, Human
gugggccuccucugu

SEQ ID NO: 2117265 - RNA, 20 nt, Human
gugggccuccucuguccagg

SEQ ID NO: 2117266 - RNA, 23 nt, Human
gugggccuccucuguccagggcc

SEQ ID NO: 2117267 - RNA, 19 nt, Human
gugggccucaaggacuuga

SEQ ID NO: 2117268 - RNA, 17 nt, Human
gugggccagugugggaa

SEQ ID NO: 2117269 - RNA, 15 nt, Human
gugggccauggcaau

SEQ ID NO: 2117270 - RNA, 16 nt, Human
guggguuuucuuccca

SEQ ID NO: 2117271 - RNA, 17 nt, Human
guggggcagcuugaggg

SEQ ID NO: 2117272 - RNA, 13 nt, Human
guggggcagcuug

SEQ ID NO: 2117273 - RNA, 12 nt, Human
guggggcagcac

SEQ ID NO: 2117274 - RNA, 14 nt, Human
guggggcagcacag

SEQ ID NO: 2117275 - RNA, 19 nt, Human
guggggcagcacagagagg

SEQ ID NO: 2117276 - RNA, 23 nt, Human
guggggcagcacagagagggggc

SEQ ID NO: 2117277 - RNA, 22 nt, Human
gugggcuggugacccagucaga

SEQ ID NO: 2117278 - RNA, 14 nt, Human
gugggcugugagug

SEQ ID NO: 2117279 - RNA, 13 nt, Human
gugggcugugagu

SEQ ID NO: 2117280 - RNA, 18 nt, Human
gugggcugagcccuggca

SEQ ID NO: 2117281 - RNA, 22 nt, Human
guggggacguccugccaccugg

SEQ ID NO: 2117282 - RNA, 16 nt, Human
guggggauuucuccca

SEQ ID NO: 2117283 - RNA, 17 nt, Human
guggggauuucucccag

SEQ ID NO: 2117284 - RNA, 18 nt, Human
guggggagacaccucaga

SEQ ID NO: 2117285 - RNA, 19 nt, Human
guggggagacaccucagag

SEQ ID NO: 2117286 - RNA, 20 nt, Human
guggggagacaccucagagc

SEQ ID NO: 2117287 - RNA, 22 nt, Human
guggggagacaccucagagccc

SEQ ID NO: 2117288 - RNA, 22 nt, Human
guggcuuaaaacaacacucaca

SEQ ID NO: 2117289 - RNA, 20 nt, Human
guggcuuacuacauguggga

SEQ ID NO: 2117290 - RNA, 21 nt, Human
guggcuggguccaggggaugg

SEQ ID NO: 2117291 - RNA, 14 nt, Human
guggcugucagcag

SEQ ID NO: 2117292 - RNA, 15 nt, Human
guggcugucagcagg

SEQ ID NO: 2117293 - RNA, 19 nt, Human
guggcugucagcaggaagc

SEQ ID NO: 2117294 - RNA, 18 nt, Human
guggcuggguuuacacgc

SEQ ID NO: 2117295 - RNA, 17 nt, Human
guggcugggggcaggag

SEQ ID NO: 2117296 - RNA, 22 nt, Human
guggcugggggcaggagggccc

SEQ ID NO: 2117297 - RNA, 20 nt, Human
guggcuucccgcucagcccu

SEQ ID NO: 2117298 - RNA, 19 nt, Human
guggcuucccgcucagccc

SEQ ID NO: 2117299 - RNA, 18 nt, Human
guggcuucccgcucagcc

SEQ ID NO: 2117300 - RNA, 17 nt, Human
gugggcaaacaggcagu

SEQ ID NO: 2117301 - RNA, 21 nt, Human
gugggcacgcugugggcaggu

SEQ ID NO: 2117302 - RNA, 17 nt, Human
gugggcaccaagagcca

SEQ ID NO: 2117303 - RNA, 20 nt, Human
gugggcacgcugugggcagg

SEQ ID NO: 2117304 - RNA, 23 nt, Human
gugggcacgcugugggcaggugg

SEQ ID NO: 2117305 - RNA, 19 nt, Human
guggcuggguuggagggug

SEQ ID NO: 2117306 - RNA, 11 nt, Human
guggcuggggg

SEQ ID NO: 2117307 - RNA, 16 nt, Human
guggcugggggcagga

SEQ ID NO: 2117308 - RNA, 20 nt, Human
guggcuccucccggugccca

SEQ ID NO: 2117309 - RNA, 13 nt, Human
guggcuccucccg

SEQ ID NO: 2117310 - RNA, 22 nt, Human
guggcuccccucuauuuagcau

SEQ ID NO: 2117311 - RNA, 23 nt, Human
guggcuccccucuauuuagcaug

SEQ ID NO: 2117312 - RNA, 20 nt, Human
guggcucacgugugugacuc

SEQ ID NO: 2117313 - RNA, 12 nt, Human
guggcuccccuc

SEQ ID NO: 2117314 - RNA, 14 nt, Human
guggcuccccucua

SEQ ID NO: 2117315 - RNA, 15 nt, Human
guggcugccuggagc

SEQ ID NO: 2117316 - RNA, 16 nt, Human
guggcugccuggagcc

SEQ ID NO: 2117317 - RNA, 18 nt, Human
guggcugcggcacccuug

SEQ ID NO: 2117318 - RNA, 17 nt, Human
guggcugcuagcacuug

SEQ ID NO: 2117319 - RNA, 19 nt, Human
guggcugcuagcacuugga

SEQ ID NO: 2117320 - RNA, 14 nt, Human
guggcucacgccug

SEQ ID NO: 2117321 - RNA, 17 nt, Human
guggcuagucagagaga

SEQ ID NO: 2117322 - RNA, 19 nt, Human
guggcuagucagagagagu

SEQ ID NO: 2117323 - RNA, 16 nt, Human
gugcuaauuaauaaag

SEQ ID NO: 2117324 - RNA, 16 nt, Human
guggcuaaugguguaa

SEQ ID NO: 2117325 - RNA, 23 nt, Human
guucuaaagauggaaaaaccacc

SEQ ID NO: 2117326 - RNA, 17 nt, Human
guucuaaagauggaaaa

SEQ ID NO: 2117327 - RNA, 20 nt, Human
guucuaaagauggaaaaacc

SEQ ID NO: 2117328 - RNA, 14 nt, Human
guucuaaagaugga

SEQ ID NO: 2117329 - RNA, 23 nt, Human
guucguucuuguucuguuuuguu

SEQ ID NO: 2117330 - RNA, 23 nt, Human
guuccuugaucuguauauacaau

SEQ ID NO: 2117331 - RNA, 19 nt, Human
guucgagaccaaccugacc

SEQ ID NO: 2117332 - RNA, 17 nt, Human
guucguggaaagggugc

SEQ ID NO: 2117333 - RNA, 16 nt, Human
guucgagaccagccug

SEQ ID NO: 2117334 - RNA, 17 nt, Human
guucgagaccagccugg

SEQ ID NO: 2117335 - RNA, 18 nt, Human
guucgagaccagccuggc

SEQ ID NO: 2117336 - RNA, 19 nt, Human
guucgagaccagccuggcc

SEQ ID NO: 2117337 - RNA, 20 nt, Human
guucgagaccagccuggcca

SEQ ID NO: 2117338 - RNA, 19 nt, Human
guuccuggggugcccucca

SEQ ID NO: 2117339 - RNA, 20 nt, Human
guucugauuagaaaugacca

SEQ ID NO: 2117340 - RNA, 14 nt, Human
guucugcaaauaga

SEQ ID NO: 2117341 - RNA, 15 nt, Human
guucugcaaauagaa

SEQ ID NO: 2117342 - RNA, 18 nt, Human
guucugcaaauagaaaac

SEQ ID NO: 2117343 - RNA, 19 nt, Human
guucugcaaauagaaaaca

SEQ ID NO: 2117344 - RNA, 21 nt, Human
guucugcaaauagaaaacagg

SEQ ID NO: 2117345 - RNA, 13 nt, Human
guucugauuagaa

SEQ ID NO: 2117346 - RNA, 14 nt, Human
guucugauuagaaa

SEQ ID NO: 2117347 - RNA, 16 nt, Human
guucugauuagaaaug

SEQ ID NO: 2117348 - RNA, 18 nt, Human
guucugauuagaaaugac

SEQ ID NO: 2117349 - RNA, 22 nt, Human
guucugagauuauuuuaaucua

SEQ ID NO: 2117350 - RNA, 14 nt, Human
guucugaguguuuu

SEQ ID NO: 2117351 - RNA, 21 nt, Human
guucugacauuaacaguuuuc

SEQ ID NO: 2117352 - RNA, 23 nt, Human
guucugacauuaacaguuuucca

SEQ ID NO: 2117353 - RNA, 15 nt, Human
guucugacauuaaca

SEQ ID NO: 2117354 - RNA, 16 nt, Human
guucugacauuaacag

SEQ ID NO: 2117355 - RNA, 17 nt, Human
guucugacauuaacagu

SEQ ID NO: 2117356 - RNA, 13 nt, Human
guucugaaauauu

SEQ ID NO: 2117357 - RNA, 21 nt, Human
guucugaaauauuuuaccacu

SEQ ID NO: 2117358 - RNA, 15 nt, Human
guucuacaaucuauu

SEQ ID NO: 2117359 - RNA, 23 nt, Human
guucugggacacaguucaauucu

SEQ ID NO: 2117360 - RNA, 16 nt, Human
guucugggacacaguu

SEQ ID NO: 2117361 - RNA, 15 nt, Human
guucugggacacagu

SEQ ID NO: 2117362 - RNA, 14 nt, Human
guucugggacacag

SEQ ID NO: 2117363 - RNA, 12 nt, Human
guucugggacac

SEQ ID NO: 2117364 - RNA, 11 nt, Human
guucugggaca

SEQ ID NO: 2117365 - RNA, 15 nt, Human
guucuggcccucacc

SEQ ID NO: 2117366 - RNA, 21 nt, Human
guucuggcccucaccccugcc

SEQ ID NO: 2117367 - RNA, 23 nt, Human
guucuggcccucaccccugcccu

SEQ ID NO: 2117368 - RNA, 15 nt, Human
guucuuucuuccucu

SEQ ID NO: 2117369 - RNA, 14 nt, Human
guucuuucuuccuc

SEQ ID NO: 2117370 - RNA, 19 nt, Human
guucuuucuuccucugcug

SEQ ID NO: 2117371 - RNA, 18 nt, Human
guucuuucuuccucugcu

SEQ ID NO: 2117372 - RNA, 17 nt, Human
guucuuucuuccucugc

SEQ ID NO: 2117373 - RNA, 16 nt, Human
guucuuucuuccucug

SEQ ID NO: 2117374 - RNA, 13 nt, Human
guucuuuuaaagg

SEQ ID NO: 2117375 - RNA, 17 nt, Human
guugaaaaacagcugag

SEQ ID NO: 2117376 - RNA, 16 nt, Human
guucuuuuguuguaaa

SEQ ID NO: 2117377 - RNA, 14 nt, Human
guugaaaagccaug

SEQ ID NO: 2117378 - RNA, 15 nt, Human
guugaaaagccaugu

SEQ ID NO: 2117379 - RNA, 22 nt, Human
guugaaaagccauguuuaagau

SEQ ID NO: 2117380 - RNA, 23 nt, Human
guugaaaagccauguuuaagauu

SEQ ID NO: 2117381 - RNA, 23 nt, Human
guugauuucagcaccuacagugu

SEQ ID NO: 2117382 - RNA, 15 nt, Human
guugcaaggccgcug

SEQ ID NO: 2117383 - RNA, 16 nt, Human
guugcaaggccgcugu

SEQ ID NO: 2117384 - RNA, 17 nt, Human
guugcaaggccgcuguu

SEQ ID NO: 2117385 - RNA, 23 nt, Human
guugcaaggccgcuguucaccca

SEQ ID NO: 2117386 - RNA, 17 nt, Human
guugcaaguacugcugu

SEQ ID NO: 2117387 - RNA, 15 nt, Human
guugcaggaccucag

SEQ ID NO: 2117388 - RNA, 19 nt, Human
guugcacuuggccucugga

SEQ ID NO: 2117389 - RNA, 15 nt, Human
guugcagugagcuga

SEQ ID NO: 2117390 - RNA, 16 nt, Human
guugcagugagcugag

SEQ ID NO: 2117391 - RNA, 15 nt, Human
guugcaguggagagg

SEQ ID NO: 2117392 - RNA, 14 nt, Human
guugcaucagaaau

SEQ ID NO: 2117393 - RNA, 16 nt, Human
guugcaucagaaaugu

SEQ ID NO: 2117394 - RNA, 13 nt, Human
guugcagugagcu

SEQ ID NO: 2117395 - RNA, 17 nt, Human
guugccaaacagccaca

SEQ ID NO: 2117396 - RNA, 18 nt, Human
guugccaaacagccacac

SEQ ID NO: 2117397 - RNA, 17 nt, Human
guugccaagaacugaaa

SEQ ID NO: 2117398 - RNA, 21 nt, Human
guugccaagaacugaaaacau

SEQ ID NO: 2117399 - RNA, 22 nt, Human
guugccaagaacugaaaacaua

SEQ ID NO: 2117400 - RNA, 15 nt, Human
guugaagaggaaggg

SEQ ID NO: 2117401 - RNA, 15 nt, Human
guugaaagaguccua

SEQ ID NO: 2117402 - RNA, 14 nt, Human
guugaagcucuggu

SEQ ID NO: 2117403 - RNA, 22 nt, Human
guugaagcuaagauuuagagau

SEQ ID NO: 2117404 - RNA, 13 nt, Human
guugaagcucugg

SEQ ID NO: 2117405 - RNA, 16 nt, Human
guugaauggccugccu

SEQ ID NO: 2117406 - RNA, 13 nt, Human
guugaauauuugu

SEQ ID NO: 2117407 - RNA, 14 nt, Human
guuggauuuuuguc

SEQ ID NO: 2117408 - RNA, 14 nt, Human
guuggcaaaaaggc

SEQ ID NO: 2117409 - RNA, 20 nt, Human
guuggauuuuugucuugugu

SEQ ID NO: 2117410 - RNA, 18 nt, Human
guuggcaaaaaggcagga

SEQ ID NO: 2117411 - RNA, 23 nt, Human
guuggccaaagccaaagcuaggc

SEQ ID NO: 2117412 - RNA, 14 nt, Human
guuggccaguguga

SEQ ID NO: 2117413 - RNA, 19 nt, Human
guuggccaggcuggucuca

SEQ ID NO: 2117414 - RNA, 17 nt, Human
guuggccaggcuggucu

SEQ ID NO: 2117415 - RNA, 14 nt, Human
guuggccaggcugg

SEQ ID NO: 2117416 - RNA, 15 nt, Human
guuggccaggcuggu

SEQ ID NO: 2117417 - RNA, 13 nt, Human
guuggccaggcug

SEQ ID NO: 2117418 - RNA, 16 nt, Human
guuggaauuaaaacaa

SEQ ID NO: 2117419 - RNA, 17 nt, Human
guuggaauuaaaacaau

SEQ ID NO: 2117420 - RNA, 19 nt, Human
guuggacagcaaaaccauu

SEQ ID NO: 2117421 - RNA, 23 nt, Human
guuggacagcaaaaccauugcuu

SEQ ID NO: 2117422 - RNA, 17 nt, Human
guuggacuuuucguuaa

SEQ ID NO: 2117423 - RNA, 21 nt, Human
guuggacuuuucguuaacauu

SEQ ID NO: 2117424 - RNA, 23 nt, Human
guuggacuuuucguuaacauuga

SEQ ID NO: 2117425 - RNA, 18 nt, Human
guuggagccacucuguuc

SEQ ID NO: 2117426 - RNA, 19 nt, Human
guuggagccacucuguucc

SEQ ID NO: 2117427 - RNA, 14 nt, Human
guugcccaggcagg

SEQ ID NO: 2117428 - RNA, 12 nt, Human
guugcccaggca

SEQ ID NO: 2117429 - RNA, 17 nt, Human
guugccagagauggagg

SEQ ID NO: 2117430 - RNA, 11 nt, Human
guugccagaga

SEQ ID NO: 2117431 - RNA, 15 nt, Human
guugccagagaugga

SEQ ID NO: 2117432 - RNA, 14 nt, Human
guuauguguguaua

SEQ ID NO: 2117433 - RNA, 20 nt, Human
guuauguguaugugccauuu

SEQ ID NO: 2117434 - RNA, 19 nt, Human
guuauguguguauauguau

SEQ ID NO: 2117435 - RNA, 21 nt, Human
guuauuagggugguauuuagu

SEQ ID NO: 2117436 - RNA, 13 nt, Human
guuauuacauccu

SEQ ID NO: 2117437 - RNA, 15 nt, Human
guuauuacauccuug

SEQ ID NO: 2117438 - RNA, 21 nt, Human
guuauuacauccuuguggcac

SEQ ID NO: 2117439 - RNA, 19 nt, Human
guucaagcgauucuucugc

SEQ ID NO: 2117440 - RNA, 22 nt, Human
guuaugugaaugaucucucuga

SEQ ID NO: 2117441 - RNA, 18 nt, Human
guuauguguaugugccau

SEQ ID NO: 2117442 - RNA, 19 nt, Human
guuauguguaugugccauu

SEQ ID NO: 2117443 - RNA, 23 nt, Human
guuauggaaacuguugccagaga

SEQ ID NO: 2117444 - RNA, 20 nt, Human
guucaagcgauucuucugcu

SEQ ID NO: 2117445 - RNA, 18 nt, Human
guucaaggaaucauuguu

SEQ ID NO: 2117446 - RNA, 14 nt, Human
guucaaggaccaac

SEQ ID NO: 2117447 - RNA, 23 nt, Human
guucaaggaccaacaagggcagu

SEQ ID NO: 2117448 - RNA, 16 nt, Human
guucaauucucauuug

SEQ ID NO: 2117449 - RNA, 23 nt, Human
guucaauucucauuugucacaca

SEQ ID NO: 2117450 - RNA, 20 nt, Human
guuauauuuuacuacugugg

SEQ ID NO: 2117451 - RNA, 13 nt, Human
guuauauaaagag

SEQ ID NO: 2117452 - RNA, 14 nt, Human
guuauauaaagaga

SEQ ID NO: 2117453 - RNA, 16 nt, Human
guuauauaaagagaaa

SEQ ID NO: 2117454 - RNA, 19 nt, Human
guuauauaaagagaaaauu

SEQ ID NO: 2117455 - RNA, 20 nt, Human
guuauauaaagagaaaauug

SEQ ID NO: 2117456 - RNA, 22 nt, Human
guuauauaaagagaaaauugaa

SEQ ID NO: 2117457 - RNA, 23 nt, Human
guuauauaaagagaaaauugaau

SEQ ID NO: 2117458 - RNA, 13 nt, Human
guuauagugaauu

SEQ ID NO: 2117459 - RNA, 15 nt, Human
guuauagugaauuau

SEQ ID NO: 2117460 - RNA, 17 nt, Human
guuauaggucacuccug

SEQ ID NO: 2117461 - RNA, 22 nt, Human
guuauagagggucuaagauuca

SEQ ID NO: 2117462 - RNA, 15 nt, Human
guuaugauaaaaaau

SEQ ID NO: 2117463 - RNA, 16 nt, Human
guuaugauaaaaaauu

SEQ ID NO: 2117464 - RNA, 18 nt, Human
guuaugauaaaaaauuuu

SEQ ID NO: 2117465 - RNA, 22 nt, Human
guuaugauaaaaaauuuuguaa

SEQ ID NO: 2117466 - RNA, 21 nt, Human
guuaucccuuccuuuuagccu

SEQ ID NO: 2117467 - RNA, 15 nt, Human
guuacuauccuggcu

SEQ ID NO: 2117468 - RNA, 16 nt, Human
guuacuauccuggcuu

SEQ ID NO: 2117469 - RNA, 12 nt, Human
guuacucagccc

SEQ ID NO: 2117470 - RNA, 13 nt, Human
guuacucagcccu

SEQ ID NO: 2117471 - RNA, 14 nt, Human
guuacucagcccug

SEQ ID NO: 2117472 - RNA, 15 nt, Human
guuacucagcccugg

SEQ ID NO: 2117473 - RNA, 14 nt, Human
guuacucuccaacc

SEQ ID NO: 2117474 - RNA, 16 nt, Human
guuacucagcccuggg

SEQ ID NO: 2117475 - RNA, 17 nt, Human
guuacucagcccugggc

SEQ ID NO: 2117476 - RNA, 18 nt, Human
guuacucagcccugggcc

SEQ ID NO: 2117477 - RNA, 17 nt, Human
guuacucuccaaccugg

SEQ ID NO: 2117478 - RNA, 18 nt, Human
guuacucuccaaccugga

SEQ ID NO: 2117479 - RNA, 22 nt, Human
guuacucuccaaccuggacaac

SEQ ID NO: 2117480 - RNA, 11 nt, Human
guuacucugaa

SEQ ID NO: 2117481 - RNA, 14 nt, Human
guuacucugaaggg

SEQ ID NO: 2117482 - RNA, 13 nt, Human
guuacuauaugcc

SEQ ID NO: 2117483 - RNA, 23 nt, Human
guuacuaauuggccucuuuaaga

SEQ ID NO: 2117484 - RNA, 23 nt, Human
guuaccuuucuaggucaaggccu

SEQ ID NO: 2117485 - RNA, 23 nt, Human
guuacgcacacguacuuaaauga

SEQ ID NO: 2117486 - RNA, 17 nt, Human
guuauaaaucaauguca

SEQ ID NO: 2117487 - RNA, 18 nt, Human
guuauaaaucaaugucac

SEQ ID NO: 2117488 - RNA, 15 nt, Human
guuauacaugacacu

SEQ ID NO: 2117489 - RNA, 17 nt, Human
guuauacaugacacuga

SEQ ID NO: 2117490 - RNA, 18 nt, Human
guuauacaugacacugaa

SEQ ID NO: 2117491 - RNA, 19 nt, Human
guuauacaugacacugaaa

SEQ ID NO: 2117492 - RNA, 20 nt, Human
guuauacaugacacugaaau

SEQ ID NO: 2117493 - RNA, 23 nt, Human
guuauacaugacacugaaaugcc

SEQ ID NO: 2117494 - RNA, 19 nt, Human
guuauacugucgguuuuuu

SEQ ID NO: 2117495 - RNA, 14 nt, Human
guuaguuuuuacuu

SEQ ID NO: 2117496 - RNA, 16 nt, Human
guuaguuucuuuggga

SEQ ID NO: 2117497 - RNA, 10 nt, Human
guuaccuaau

SEQ ID NO: 2117498 - RNA, 19 nt, Human
guuaccuaauuagagcaga

SEQ ID NO: 2117499 - RNA, 15 nt, Human
guuaccuccuauaaa

SEQ ID NO: 2117500 - RNA, 17 nt, Human
guuaccuccuauaaacu

SEQ ID NO: 2117501 - RNA, 23 nt, Human
guuaccauuuugggguacccacu

SEQ ID NO: 2117502 - RNA, 22 nt, Human
guuacauugcuggucuuguaag

SEQ ID NO: 2117503 - RNA, 23 nt, Human
guuacauugcuggucuuguaaga

SEQ ID NO: 2117504 - RNA, 22 nt, Human
guuacaggcaccgagaauguug

SEQ ID NO: 2117505 - RNA, 18 nt, Human
guuacauaagauaaaugu

SEQ ID NO: 2117506 - RNA, 19 nt, Human
guuacauaagauaaaugug

SEQ ID NO: 2117507 - RNA, 16 nt, Human
guucacccacagggcu

SEQ ID NO: 2117508 - RNA, 11 nt, Human
guucaccagcc

SEQ ID NO: 2117509 - RNA, 12 nt, Human
guucaccccucc

SEQ ID NO: 2117510 - RNA, 14 nt, Human
guucaccccuccac

SEQ ID NO: 2117511 - RNA, 16 nt, Human
guucaccccuccaccc

SEQ ID NO: 2117512 - RNA, 12 nt, Human
guucaccagccu

SEQ ID NO: 2117513 - RNA, 22 nt, Human
guucaccuauuucaaaaauuug

SEQ ID NO: 2117514 - RNA, 15 nt, Human
guucacuaaagcagu

SEQ ID NO: 2117515 - RNA, 24 nt, Human
guucacucuacuuagcaugucccu

SEQ ID NO: 2117516 - RNA, 22 nt, Human
guucaccuugaagaaccucuca

SEQ ID NO: 2117517 - RNA, 19 nt, Human
guucacugcaaccuccgcc

SEQ ID NO: 2117518 - RNA, 16 nt, Human
guucagagacucaggg

SEQ ID NO: 2117519 - RNA, 17 nt, Human
guucagagacucagggc

SEQ ID NO: 2117520 - RNA, 22 nt, Human
guucagagacucagggccccag

SEQ ID NO: 2117521 - RNA, 22 nt, Human
guucauccaauccucacugggu

SEQ ID NO: 2117522 - RNA, 20 nt, Human
guucauccaauccucacugg

SEQ ID NO: 2117523 - RNA, 21 nt, Human
guucauccaauccucacuggg

SEQ ID NO: 2117524 - RNA, 12 nt, Human
guucaucagugu

SEQ ID NO: 2117525 - RNA, 13 nt, Human
guucaucaguguu

SEQ ID NO: 2117526 - RNA, 14 nt, Human
guucaucaguguua

SEQ ID NO: 2117527 - RNA, 16 nt, Human
guucaucaguguuaaa

SEQ ID NO: 2117528 - RNA, 21 nt, Human
guucaucaguguuaaaaaauu

SEQ ID NO: 2117529 - RNA, 16 nt, Human
guucagccccuccucu

SEQ ID NO: 2117530 - RNA, 15 nt, Human
guucauccaauccuc

SEQ ID NO: 2117531 - RNA, 18 nt, Human
guucauccaauccucacu

SEQ ID NO: 2117532 - RNA, 19 nt, Human
guucauccaauccucacug

SEQ ID NO: 2117533 - RNA, 17 nt, Human
guucaucauccuaagcu

SEQ ID NO: 2117534 - RNA, 14 nt, Human
guucagccccuccu

SEQ ID NO: 2117535 - RNA, 15 nt, Human
guucagccccuccuc

SEQ ID NO: 2117536 - RNA, 16 nt, Human
guucagcauucuuagc

SEQ ID NO: 2117537 - RNA, 22 nt, Human
guucagcauucuuagccugugg

SEQ ID NO: 2117538 - RNA, 16 nt, Human
guucagcaccacccua

SEQ ID NO: 2117539 - RNA, 17 nt, Human
guucagcaccacccuag

SEQ ID NO: 2117540 - RNA, 17 nt, Human
guucaucguauaacaca

SEQ ID NO: 2117541 - RNA, 16 nt, Human
guucaugccaccaugg

SEQ ID NO: 2117542 - RNA, 13 nt, Human
guuccucgcccug

SEQ ID NO: 2117543 - RNA, 15 nt, Human
guuccucgcccuggg

SEQ ID NO: 2117544 - RNA, 16 nt, Human
guuccucgcccugggu

SEQ ID NO: 2117545 - RNA, 16 nt, Human
guuccugaugacccag

SEQ ID NO: 2117546 - RNA, 19 nt, Human
guuccugaugacccaggcu

SEQ ID NO: 2117547 - RNA, 20 nt, Human
guuccugaugacccaggcug

SEQ ID NO: 2117548 - RNA, 22 nt, Human
guuccugaugacccaggcugcc

SEQ ID NO: 2117549 - RNA, 15 nt, Human
guuccuggcucagcc

SEQ ID NO: 2117550 - RNA, 16 nt, Human
guuccuggcucagccu

SEQ ID NO: 2117551 - RNA, 14 nt, Human
guuccuuacugcag

SEQ ID NO: 2117552 - RNA, 15 nt, Human
guuccuuacugcaga

SEQ ID NO: 2117553 - RNA, 21 nt, Human
guuccuggcaauaguguguuc

SEQ ID NO: 2117554 - RNA, 13 nt, Human
guuccuggcaaua

SEQ ID NO: 2117555 - RNA, 12 nt, Human
guuccuggcaau

SEQ ID NO: 2117556 - RNA, 12 nt, Human
guuccugcagca

SEQ ID NO: 2117557 - RNA, 17 nt, Human
guuccugcagcagagcc

SEQ ID NO: 2117558 - RNA, 18 nt, Human
guuccugcagcagagccu

SEQ ID NO: 2117559 - RNA, 16 nt, Human
guuccugcuagaaaug

SEQ ID NO: 2117560 - RNA, 17 nt, Human
guuccugcuagaaaugg

SEQ ID NO: 2117561 - RNA, 12 nt, Human
guuccagcucuu

SEQ ID NO: 2117562 - RNA, 14 nt, Human
guuccagcucuuug

SEQ ID NO: 2117563 - RNA, 16 nt, Human
guuccagcucuuugaa

SEQ ID NO: 2117564 - RNA, 22 nt, Human
guuccucauuagcauuuugcua

SEQ ID NO: 2117565 - RNA, 14 nt, Human
guuccuaaguucuu

SEQ ID NO: 2117566 - RNA, 15 nt, Human
guuccaauccuggcu

SEQ ID NO: 2117567 - RNA, 16 nt, Human
guuccaauccuggcuc

SEQ ID NO: 2117568 - RNA, 21 nt, Human
guuccaagacauugucaauaa

SEQ ID NO: 2117569 - RNA, 15 nt, Human
guuccaagacauugu

SEQ ID NO: 2117570 - RNA, 16 nt, Human
guuccaagacauuguc

SEQ ID NO: 2117571 - RNA, 17 nt, Human
guuccaagacauuguca

SEQ ID NO: 2117572 - RNA, 19 nt, Human
guuccaagacauugucaau

SEQ ID NO: 2117573 - RNA, 18 nt, Human
guucauuuguuauucuua

SEQ ID NO: 2117574 - RNA, 20 nt, Human
guucauuucaaauacaucuu

SEQ ID NO: 2117575 - RNA, 16 nt, Human
guucauuugugugcuc

SEQ ID NO: 2117576 - RNA, 17 nt, Human
guucauuugugugcuca

SEQ ID NO: 2117577 - RNA, 18 nt, Human
guucauuugugugcucau

SEQ ID NO: 2117578 - RNA, 13 nt, Human
guuccaagacauu

SEQ ID NO: 2117579 - RNA, 14 nt, Human
guuccaagacauug

SEQ ID NO: 2117580 - RNA, 22 nt, Human
guucauuauuggaauuaaccug

SEQ ID NO: 2117581 - RNA, 15 nt, Human
guucauuauuggaau

SEQ ID NO: 2117582 - RNA, 16 nt, Human
guucauuaaagcauga

SEQ ID NO: 2117583 - RNA, 20 nt, Human
guucauuaaagcaugaaugg

SEQ ID NO: 2117584 - RNA, 14 nt, Human
guucauuguaaugu

SEQ ID NO: 2117585 - RNA, 18 nt, Human
guucauuguaauguuacu

SEQ ID NO: 2117586 - RNA, 19 nt, Human
guucauuguaauguuacug

SEQ ID NO: 2117587 - RNA, 20 nt, Human
guucauuguaauguuacuga

SEQ ID NO: 2117588 - RNA, 21 nt, Human
guucauuguaauguuacugau

SEQ ID NO: 2117589 - RNA, 22 nt, Human
guucauuguaauguuacugauc

SEQ ID NO: 2117590 - RNA, 23 nt, Human
guucauuguaauguuacugauca

SEQ ID NO: 2117591 - RNA, 23 nt, Human
guuccaauccuggcucuguggcu

SEQ ID NO: 2117592 - RNA, 16 nt, Human
guuucuuuaguuuuug

SEQ ID NO: 2117593 - RNA, 13 nt, Human
guuucuuccaaag

SEQ ID NO: 2117594 - RNA, 23 nt, Human
guuucuucauccggcagccugga

SEQ ID NO: 2117595 - RNA, 11 nt, Human
guuucuuccaa

SEQ ID NO: 2117596 - RNA, 14 nt, Human
guuuccucaggcug

SEQ ID NO: 2117597 - RNA, 16 nt, Human
guuuccucaggcugcu

SEQ ID NO: 2117598 - RNA, 17 nt, Human
guuuccccaccagugaa

SEQ ID NO: 2117599 - RNA, 15 nt, Human
guuuccuaaaaguuc

SEQ ID NO: 2117600 - RNA, 16 nt, Human
guuuccuaaaaguuca

SEQ ID NO: 2117601 - RNA, 15 nt, Human
guuuccccaccagug

SEQ ID NO: 2117602 - RNA, 20 nt, Human
guuuccccaccagugaauga

SEQ ID NO: 2117603 - RNA, 20 nt, Human
guuucccauaauuuucuuca

SEQ ID NO: 2117604 - RNA, 21 nt, Human
guuucccauaauuuucuucau

SEQ ID NO: 2117605 - RNA, 18 nt, Human
guuuccucaggcugcugg

SEQ ID NO: 2117606 - RNA, 19 nt, Human
guuuccucaggcugcugga

SEQ ID NO: 2117607 - RNA, 22 nt, Human
guuuccucaggcugcuggagga

SEQ ID NO: 2117608 - RNA, 20 nt, Human
guuuccucauuccugaaaga

SEQ ID NO: 2117609 - RNA, 13 nt, Human
guuugaaaauauu

SEQ ID NO: 2117610 - RNA, 21 nt, Human
guuugaaaauauuaucuuugu

SEQ ID NO: 2117611 - RNA, 23 nt, Human
guuucuuuuauaaaaaaaaugaa

SEQ ID NO: 2117612 - RNA, 17 nt, Human
guuugagaucagccugg

SEQ ID NO: 2117613 - RNA, 18 nt, Human
guuugagaucagccuggg

SEQ ID NO: 2117614 - RNA, 13 nt, Human
guuuguauauugu

SEQ ID NO: 2117615 - RNA, 16 nt, Human
guuuguggccucagaa

SEQ ID NO: 2117616 - RNA, 20 nt, Human
guuuguguucuguuuguuaa

SEQ ID NO: 2117617 - RNA, 22 nt, Human
guuuguguucuguuuguuaaaa

SEQ ID NO: 2117618 - RNA, 13 nt, Human
guuuguggcuggg

SEQ ID NO: 2117619 - RNA, 20 nt, Human
guuuguggcugggggcagga

SEQ ID NO: 2117620 - RNA, 22 nt, Human
guuuguggcugggggcaggagg

SEQ ID NO: 2117621 - RNA, 22 nt, Human
guuuggguauccugcccagugu

SEQ ID NO: 2117622 - RNA, 16 nt, Human
guuuggguauauucau

SEQ ID NO: 2117623 - RNA, 24 nt, Human
guuuucaggaguggguugauuuca

SEQ ID NO: 2117624 - RNA, 21 nt, Human
guuuucagaaccucuucccca

SEQ ID NO: 2117625 - RNA, 14 nt, Human
guuuucagacucag

SEQ ID NO: 2117626 - RNA, 19 nt, Human
guuuucagaaccucuuccc

SEQ ID NO: 2117627 - RNA, 20 nt, Human
guuuucagaaccucuucccc

SEQ ID NO: 2117628 - RNA, 12 nt, Human
guuuucacucuu

SEQ ID NO: 2117629 - RNA, 11 nt, Human
guuuucacucu

SEQ ID NO: 2117630 - RNA, 17 nt, Human
guuuucaaaauaaaaau

SEQ ID NO: 2117631 - RNA, 14 nt, Human
guuuguuuguauuu

SEQ ID NO: 2117632 - RNA, 13 nt, Human
guuuguuaaaacu

SEQ ID NO: 2117633 - RNA, 14 nt, Human
guuuguuaaaacug

SEQ ID NO: 2117634 - RNA, 15 nt, Human
guuuguuaaaacugg

SEQ ID NO: 2117635 - RNA, 17 nt, Human
guuuguuaaaacuggca

SEQ ID NO: 2117636 - RNA, 17 nt, Human
guuuguuuuguuuuuua

SEQ ID NO: 2117637 - RNA, 11 nt, Human
guuuguuuguu

SEQ ID NO: 2117638 - RNA, 12 nt, Human
guuuguuuguuu

SEQ ID NO: 2117639 - RNA, 15 nt, Human
guuuguuuguuuugu

SEQ ID NO: 2117640 - RNA, 16 nt, Human
guuuguuuguuuuguu

SEQ ID NO: 2117641 - RNA, 12 nt, Human
guuuuguaaauu

SEQ ID NO: 2117642 - RNA, 14 nt, Human
guuuuguaaauuuc

SEQ ID NO: 2117643 - RNA, 13 nt, Human
guuuuguaagaaa

SEQ ID NO: 2117644 - RNA, 14 nt, Human
guuuugguuaaguu

SEQ ID NO: 2117645 - RNA, 20 nt, Human
guuuugguuaaguuggcuuc

SEQ ID NO: 2117646 - RNA, 15 nt, Human
guuuuguucuuuaaa

SEQ ID NO: 2117647 - RNA, 15 nt, Human
guuuuguguuuuuuu

SEQ ID NO: 2117648 - RNA, 21 nt, Human
guuuucccugaccucccucua

SEQ ID NO: 2117649 - RNA, 16 nt, Human
guuuuccuaaaugcag

SEQ ID NO: 2117650 - RNA, 17 nt, Human
guuuuccuaaaugcagu

SEQ ID NO: 2117651 - RNA, 16 nt, Human
guuuuccuaaauguau

SEQ ID NO: 2117652 - RNA, 24 nt, Human
guuuuccuaaauguauaccuguaa

SEQ ID NO: 2117653 - RNA, 22 nt, Human
guuuuccuauaauauaauaaau

SEQ ID NO: 2117654 - RNA, 20 nt, Human
guuuuccagguuuaagcugu

SEQ ID NO: 2117655 - RNA, 13 nt, Human
guuuuccaugaaa

SEQ ID NO: 2117656 - RNA, 17 nt, Human
guuuucagacucagacu

SEQ ID NO: 2117657 - RNA, 14 nt, Human
guuuuccaugaaaa

SEQ ID NO: 2117658 - RNA, 15 nt, Human
guuuuccaugaaaac

SEQ ID NO: 2117659 - RNA, 17 nt, Human
guuuuccaugaaaacgu

SEQ ID NO: 2117660 - RNA, 18 nt, Human
guuuuccaugaaaacguu

SEQ ID NO: 2117661 - RNA, 15 nt, Human
guuguuaauaaaagu

SEQ ID NO: 2117662 - RNA, 16 nt, Human
guuguuaaugaaaaug

SEQ ID NO: 2117663 - RNA, 17 nt, Human
guuguuaaugaaaaugu

SEQ ID NO: 2117664 - RNA, 18 nt, Human
guuguuaaugaaaauguc

SEQ ID NO: 2117665 - RNA, 19 nt, Human
guuguuaaugaaaauguca

SEQ ID NO: 2117666 - RNA, 19 nt, Human
guuguggaaagccucugcu

SEQ ID NO: 2117667 - RNA, 21 nt, Human
guuguggagagugcaacagua

SEQ ID NO: 2117668 - RNA, 16 nt, Human
guuguguacucuggcc

SEQ ID NO: 2117669 - RNA, 20 nt, Human
guuguguacucuggccucug

SEQ ID NO: 2117670 - RNA, 14 nt, Human
guuguguaagagaa

SEQ ID NO: 2117671 - RNA, 15 nt, Human
guuguguaagagaau

SEQ ID NO: 2117672 - RNA, 17 nt, Human
guuguguaagagaaugu

SEQ ID NO: 2117673 - RNA, 21 nt, Human
guuguguaagagaauguugaa

SEQ ID NO: 2117674 - RNA, 16 nt, Human
guuguguacguggaga

SEQ ID NO: 2117675 - RNA, 14 nt, Human
guugugguuaaucu

SEQ ID NO: 2117676 - RNA, 19 nt, Human
guugucugaagucacugca

SEQ ID NO: 2117677 - RNA, 22 nt, Human
guugucugaagucacugcacag

SEQ ID NO: 2117678 - RNA, 15 nt, Human
guugugaagauguuu

SEQ ID NO: 2117679 - RNA, 17 nt, Human
guugugaagauguuugc

SEQ ID NO: 2117680 - RNA, 12 nt, Human
guuggcuggggg

SEQ ID NO: 2117681 - RNA, 13 nt, Human
guuggcugggccc

SEQ ID NO: 2117682 - RNA, 14 nt, Human
guuggcugggccca

SEQ ID NO: 2117683 - RNA, 16 nt, Human
guuggcugggcccaga

SEQ ID NO: 2117684 - RNA, 20 nt, Human
guuggcugacuuccacaccu

SEQ ID NO: 2117685 - RNA, 14 nt, Human
guuggccccugccc

SEQ ID NO: 2117686 - RNA, 13 nt, Human
guuggccccugcc

SEQ ID NO: 2117687 - RNA, 13 nt, Human
guuggccugcacu

SEQ ID NO: 2117688 - RNA, 20 nt, Human
guuggccccugcccggcugc

SEQ ID NO: 2117689 - RNA, 19 nt, Human
guuggcugggggccucagu

SEQ ID NO: 2117690 - RNA, 17 nt, Human
guugucaagucucugcu

SEQ ID NO: 2117691 - RNA, 22 nt, Human
guugucaagucucugcuggccc

SEQ ID NO: 2117692 - RNA, 17 nt, Human
guuggcugggcccagaa

SEQ ID NO: 2117693 - RNA, 18 nt, Human
guugucagcaucuucuca

SEQ ID NO: 2117694 - RNA, 12 nt, Human
guugucagcuga

SEQ ID NO: 2117695 - RNA, 14 nt, Human
guugucauugcuuu

SEQ ID NO: 2117696 - RNA, 15 nt, Human
guugucauugcuuua

SEQ ID NO: 2117697 - RNA, 13 nt, Human
guuguuugaaaau

SEQ ID NO: 2117698 - RNA, 23 nt, Human
guuguuugaaaauauuaucuuug

SEQ ID NO: 2117699 - RNA, 13 nt, Human
guuuaccauuugu

SEQ ID NO: 2117700 - RNA, 16 nt, Human
guuuaccauuuguaau

SEQ ID NO: 2117701 - RNA, 17 nt, Human
guuuaccauuuguaaua

SEQ ID NO: 2117702 - RNA, 18 nt, Human
guuuaccauuuguaauaa

SEQ ID NO: 2117703 - RNA, 20 nt, Human
guuuaccauuuguaauaaag

SEQ ID NO: 2117704 - RNA, 21 nt, Human
guuuaccauuuguaauaaagu

SEQ ID NO: 2117705 - RNA, 16 nt, Human
guuuaccugugaaaua

SEQ ID NO: 2117706 - RNA, 13 nt, Human
guuuacuauuuua

SEQ ID NO: 2117707 - RNA, 13 nt, Human
guuguucuuuucc

SEQ ID NO: 2117708 - RNA, 23 nt, Human
guuguucuuuucccccaaagugg

SEQ ID NO: 2117709 - RNA, 24 nt, Human
guuguuguuaaugaaaaugucaga

SEQ ID NO: 2117710 - RNA, 12 nt, Human
guuguuucuucc

SEQ ID NO: 2117711 - RNA, 13 nt, Human
guuguuucuucca

SEQ ID NO: 2117712 - RNA, 16 nt, Human
guuguuauggaaacug

SEQ ID NO: 2117713 - RNA, 13 nt, Human
guuuaguguaaaa

SEQ ID NO: 2117714 - RNA, 15 nt, Human
guuuaguguaaaaau

SEQ ID NO: 2117715 - RNA, 16 nt, Human
guuuaguguaaaaaug

SEQ ID NO: 2117716 - RNA, 17 nt, Human
guuuaguguaaaaauga

SEQ ID NO: 2117717 - RNA, 20 nt, Human
guuuaguguaaaaaugagaa

SEQ ID NO: 2117718 - RNA, 15 nt, Human
guuuauacaguacag

SEQ ID NO: 2117719 - RNA, 18 nt, Human
guuuauacaguuuuaaag

SEQ ID NO: 2117720 - RNA, 19 nt, Human
guuuauacaguuuuaaaga

SEQ ID NO: 2117721 - RNA, 20 nt, Human
guuuauacaguuuuaaagaa

SEQ ID NO: 2117722 - RNA, 14 nt, Human
guuuauauuuucaa

SEQ ID NO: 2117723 - RNA, 17 nt, Human
guuucauaggagacaca

SEQ ID NO: 2117724 - RNA, 16 nt, Human
guuucaguaauaaaac

SEQ ID NO: 2117725 - RNA, 17 nt, Human
guuucaguaauaaaaca

SEQ ID NO: 2117726 - RNA, 18 nt, Human
guuucaguaauaaaacau

SEQ ID NO: 2117727 - RNA, 22 nt, Human
guuucaguaauaaaacaucuuu

SEQ ID NO: 2117728 - RNA, 15 nt, Human
guuucccauaauuuu

SEQ ID NO: 2117729 - RNA, 17 nt, Human
guuuuuaauaaagacag

SEQ ID NO: 2117730 - RNA, 21 nt, Human
guuuuuaaggguuuguggaaa

SEQ ID NO: 2117731 - RNA, 18 nt, Human
guuuuuaauauaaagccu

SEQ ID NO: 2117732 - RNA, 15 nt, Human
guuuuguuucugaaa

SEQ ID NO: 2117733 - RNA, 19 nt, Human
guuuuuaagcuguuuccau

SEQ ID NO: 2117734 - RNA, 15 nt, Human
guuuuuaagcuguuu

SEQ ID NO: 2117735 - RNA, 14 nt, Human
guuuuuaagcuguu

SEQ ID NO: 2117736 - RNA, 13 nt, Human
guuuuuaagcugu

SEQ ID NO: 2117737 - RNA, 16 nt, Human
uaaaaacagcauugcu

SEQ ID NO: 2117738 - RNA, 20 nt, Human
uaaaacaagaaaguuucccc

SEQ ID NO: 2117739 - RNA, 18 nt, Human
uaaaacaagaaaguuucc

SEQ ID NO: 2117740 - RNA, 19 nt, Human
uaaaacaagaaaguuuccc

SEQ ID NO: 2117741 - RNA, 14 nt, Human
uaaaacaauauugu

SEQ ID NO: 2117742 - RNA, 18 nt, Human
uaaaacaauauuguuucu

SEQ ID NO: 2117743 - RNA, 19 nt, Human
uaaaacacuuccauaaucu

SEQ ID NO: 2117744 - RNA, 16 nt, Human
uaaaacaaugucaagg

SEQ ID NO: 2117745 - RNA, 11 nt, Human
uaaaacacuug

SEQ ID NO: 2117746 - RNA, 15 nt, Human
guuuuguguuguuug

SEQ ID NO: 2117747 - RNA, 21 nt, Human
uaaaaauguucuauuuuaauu

SEQ ID NO: 2117748 - RNA, 19 nt, Human
uaaaaauuaaggcaacuga

SEQ ID NO: 2117749 - RNA, 23 nt, Human
uaaaaauuguuucaaaauaaaaa

SEQ ID NO: 2117750 - RNA, 12 nt, Human
uaaaacaaaaaa

SEQ ID NO: 2117751 - RNA, 13 nt, Human
uaaaacaaaaaac

SEQ ID NO: 2117752 - RNA, 15 nt, Human
uaaaacaaaaaacaa

SEQ ID NO: 2117753 - RNA, 17 nt, Human
uaaaacaaaaaacaaua

SEQ ID NO: 2117754 - RNA, 21 nt, Human
uaaaacaaaaaacaauauuua

SEQ ID NO: 2117755 - RNA, 22 nt, Human
uaaaacaaaaaacaauauuuau

SEQ ID NO: 2117756 - RNA, 15 nt, Human
uaaaacaacacucac

SEQ ID NO: 2117757 - RNA, 17 nt, Human
uaaaacaagaaaguuuc

SEQ ID NO: 2117758 - RNA, 23 nt, Human
uaaaagauaacaagaucuuucag

SEQ ID NO: 2117759 - RNA, 12 nt, Human
uaaaacaucuuu

SEQ ID NO: 2117760 - RNA, 21 nt, Human
uaaaagauacauuuguauguu

SEQ ID NO: 2117761 - RNA, 17 nt, Human
uaaaacauuuucacaca

SEQ ID NO: 2117762 - RNA, 15 nt, Human
uaaaacauuuucaca

SEQ ID NO: 2117763 - RNA, 18 nt, Human
uaaaacauuuucacacaa

SEQ ID NO: 2117764 - RNA, 21 nt, Human
uaaaagguaugcaaucaaauc

SEQ ID NO: 2117765 - RNA, 12 nt, Human
uaaaaggagcca

SEQ ID NO: 2117766 - RNA, 11 nt, Human
uaaaagcagca

SEQ ID NO: 2117767 - RNA, 20 nt, Human
uaaaagcagcaucugcuaau

SEQ ID NO: 2117768 - RNA, 21 nt, Human
uaaaagcagcaucugcuaaua

SEQ ID NO: 2117769 - RNA, 21 nt, Human
uaaaaggaaaucucaccccau

SEQ ID NO: 2117770 - RNA, 19 nt, Human
uaaaaggugaccaaugaug

SEQ ID NO: 2117771 - RNA, 12 nt, Human
uaaaaggugacc

SEQ ID NO: 2117772 - RNA, 16 nt, Human
uaaagaaaaguuuugu

SEQ ID NO: 2117773 - RNA, 22 nt, Human
uaaagaaaaguuuuguaaauuu

SEQ ID NO: 2117774 - RNA, 12 nt, Human
uaaagaaaacug

SEQ ID NO: 2117775 - RNA, 12 nt, Human
uaaagaaaauaa

SEQ ID NO: 2117776 - RNA, 13 nt, Human
uaaagaaaauaaa

SEQ ID NO: 2117777 - RNA, 14 nt, Human
uaaagaaaauaaaa

SEQ ID NO: 2117778 - RNA, 16 nt, Human
uaaagaaaauaaaauu

SEQ ID NO: 2117779 - RNA, 11 nt, Human
uaaagccaagg

SEQ ID NO: 2117780 - RNA, 20 nt, Human
uaaagcagagggacuuugua

SEQ ID NO: 2117781 - RNA, 18 nt, Human
uaaagcaggccuuuugau

SEQ ID NO: 2117782 - RNA, 19 nt, Human
uaaagcaggccuuuugaua

SEQ ID NO: 2117783 - RNA, 20 nt, Human
uaaagcaggccuuuugauau

SEQ ID NO: 2117784 - RNA, 14 nt, Human
uaaagcugaaaacu

SEQ ID NO: 2117785 - RNA, 16 nt, Human
uaaagcugccuguagu

SEQ ID NO: 2117786 - RNA, 17 nt, Human
uaaagcugccuguaguu

SEQ ID NO: 2117787 - RNA, 23 nt, Human
uaaagcugccuguaguuaggaaa

SEQ ID NO: 2117788 - RNA, 18 nt, Human
uaaagcugccuguaguua

SEQ ID NO: 2117789 - RNA, 21 nt, Human
uaaagcugccuguaguuagga

SEQ ID NO: 2117790 - RNA, 20 nt, Human
uaaaggccucuuccuugcug

SEQ ID NO: 2117791 - RNA, 13 nt, Human
uaaaguuacauug

SEQ ID NO: 2117792 - RNA, 15 nt, Human
uaaaguuacauugcu

SEQ ID NO: 2117793 - RNA, 16 nt, Human
uaaaguuacuuuguca

SEQ ID NO: 2117794 - RNA, 13 nt, Human
uaaaguguuuuca

SEQ ID NO: 2117795 - RNA, 14 nt, Human
uaaaguguuuucag

SEQ ID NO: 2117796 - RNA, 15 nt, Human
uaaaguguuuucaga

SEQ ID NO: 2117797 - RNA, 16 nt, Human
uaaaguguuuucagag

SEQ ID NO: 2117798 - RNA, 18 nt, Human
uaaaguuaaacauuuuua

SEQ ID NO: 2117799 - RNA, 17 nt, Human
uaaaguguguuucuaug

SEQ ID NO: 2117800 - RNA, 16 nt, Human
uaaacaucacacacac

SEQ ID NO: 2117801 - RNA, 15 nt, Human
uaaacaucacacaca

SEQ ID NO: 2117802 - RNA, 17 nt, Human
uaaacauccuucaagaa

SEQ ID NO: 2117803 - RNA, 15 nt, Human
uaaaaucauguacau

SEQ ID NO: 2117804 - RNA, 18 nt, Human
uaaaaucauguacauuuc

SEQ ID NO: 2117805 - RNA, 19 nt, Human
uaaaaucauguacauuucu

SEQ ID NO: 2117806 - RNA, 13 nt, Human
uaaaaucuuaaac

SEQ ID NO: 2117807 - RNA, 19 nt, Human
uaaaaucuuggcacagaaa

SEQ ID NO: 2117808 - RNA, 16 nt, Human
uaaaaucuugaaaaug

SEQ ID NO: 2117809 - RNA, 20 nt, Human
uaaaaucuuggcacagaaac

SEQ ID NO: 2117810 - RNA, 22 nt, Human
uaaacuugguuuuuaaaaaacu

SEQ ID NO: 2117811 - RNA, 22 nt, Human
uaaacuguguggacugugaugc

SEQ ID NO: 2117812 - RNA, 13 nt, Human
uaaacuguguuua

SEQ ID NO: 2117813 - RNA, 22 nt, Human
uaaacuuagugcggacaaguuu

SEQ ID NO: 2117814 - RNA, 13 nt, Human
uaaacauuaguuc

SEQ ID NO: 2117815 - RNA, 18 nt, Human
uaaacauuaguucuauuu

SEQ ID NO: 2117816 - RNA, 23 nt, Human
uaaacauuaguucuauuucuauc

SEQ ID NO: 2117817 - RNA, 19 nt, Human
uaaacuguacuagucugug

SEQ ID NO: 2117818 - RNA, 20 nt, Human
uaaacuguacuagucugugu

SEQ ID NO: 2117819 - RNA, 17 nt, Human
uaaacuguccucuuuca

SEQ ID NO: 2117820 - RNA, 18 nt, Human
uaaacuguccucuuucag

SEQ ID NO: 2117821 - RNA, 19 nt, Human
uaaacuguccucuuucaga

SEQ ID NO: 2117822 - RNA, 23 nt, Human
uaaacuguccucuuucagaaaac

SEQ ID NO: 2117823 - RNA, 13 nt, Human
uaaacugugugca

SEQ ID NO: 2117824 - RNA, 20 nt, Human
uaaacuguguggacugugau

SEQ ID NO: 2117825 - RNA, 12 nt, Human
uaaacuguguuu

SEQ ID NO: 2117826 - RNA, 18 nt, Human
uaaacauugaaguaauga

SEQ ID NO: 2117827 - RNA, 15 nt, Human
uaaauguagaaagug

SEQ ID NO: 2117828 - RNA, 16 nt, Human
uaaauguagguaugaa

SEQ ID NO: 2117829 - RNA, 16 nt, Human
uaaauguaagaaucau

SEQ ID NO: 2117830 - RNA, 17 nt, Human
uaaauguaaagacaaaa

SEQ ID NO: 2117831 - RNA, 22 nt, Human
uaaaugucucuuuaaugucaca

SEQ ID NO: 2117832 - RNA, 20 nt, Human
uaaaugucuaguuguaacac

SEQ ID NO: 2117833 - RNA, 17 nt, Human
uaaauguaccugaugua

SEQ ID NO: 2117834 - RNA, 13 nt, Human
uaaauguauaccu

SEQ ID NO: 2117835 - RNA, 19 nt, Human
uaaauguaucuuauucaca

SEQ ID NO: 2117836 - RNA, 16 nt, Human
uaaauggguagagaaa

SEQ ID NO: 2117837 - RNA, 15 nt, Human
uaaaggcuaccuuau

SEQ ID NO: 2117838 - RNA, 22 nt, Human
uaaaugggacuggagucccugu

SEQ ID NO: 2117839 - RNA, 17 nt, Human
uaaauggucgcccagga

SEQ ID NO: 2117840 - RNA, 17 nt, Human
uaaaguucugaguguuu

SEQ ID NO: 2117841 - RNA, 17 nt, Human
uaaaugcuuuaugcaaa

SEQ ID NO: 2117842 - RNA, 12 nt, Human
uaaaugcccugc

SEQ ID NO: 2117843 - RNA, 13 nt, Human
uaaaugcccugcu

SEQ ID NO: 2117844 - RNA, 17 nt, Human
uaacacuagucugugug

SEQ ID NO: 2117845 - RNA, 18 nt, Human
uaacacuagucugugugc

SEQ ID NO: 2117846 - RNA, 23 nt, Human
uaacacuagucugugugcugugg

SEQ ID NO: 2117847 - RNA, 16 nt, Human
uaacacuauaaagguu

SEQ ID NO: 2117848 - RNA, 13 nt, Human
uaacacuggcccc

SEQ ID NO: 2117849 - RNA, 15 nt, Human
uaacacuggccccua

SEQ ID NO: 2117850 - RNA, 18 nt, Human
uaacaccaugauuaacca

SEQ ID NO: 2117851 - RNA, 17 nt, Human
uaacacauuugauucug

SEQ ID NO: 2117852 - RNA, 22 nt, Human
uaacacauuaucgggagcagug

SEQ ID NO: 2117853 - RNA, 15 nt, Human
uaaauucuuuuuuaa

SEQ ID NO: 2117854 - RNA, 18 nt, Human
uaaauucuuuuuuaaauu

SEQ ID NO: 2117855 - RNA, 19 nt, Human
uaaauucuuuuuuaaauuu

SEQ ID NO: 2117856 - RNA, 20 nt, Human
uaaauucuuuuuuaaauuuu

SEQ ID NO: 2117857 - RNA, 22 nt, Human
uaaauucuuuuuuaaauuuucu

SEQ ID NO: 2117858 - RNA, 13 nt, Human
uaaauugaaauau

SEQ ID NO: 2117859 - RNA, 20 nt, Human
uaaauugaaauauaaugcaa

SEQ ID NO: 2117860 - RNA, 15 nt, Human
uaaauuuauuucaaa

SEQ ID NO: 2117861 - RNA, 17 nt, Human
uaaauuuauuucaaaaa

SEQ ID NO: 2117862 - RNA, 14 nt, Human
uaaaugucccuaau

SEQ ID NO: 2117863 - RNA, 11 nt, Human
uaaauuauuuu

SEQ ID NO: 2117864 - RNA, 20 nt, Human
uaaauucaaccacuguaaaa

SEQ ID NO: 2117865 - RNA, 16 nt, Human
uaaauuauuuuaaauu

SEQ ID NO: 2117866 - RNA, 23 nt, Human
uaaauucaaccacuguaaaauga

SEQ ID NO: 2117867 - RNA, 17 nt, Human
uaaauucacaauagaaa

SEQ ID NO: 2117868 - RNA, 18 nt, Human
uaaauucagauauauuuu

SEQ ID NO: 2117869 - RNA, 20 nt, Human
uaaauucagauauauuuuuc

SEQ ID NO: 2117870 - RNA, 23 nt, Human
uaaauucagauauauuuuucaca

SEQ ID NO: 2117871 - RNA, 16 nt, Human
uaaauuccacuggacu

SEQ ID NO: 2117872 - RNA, 13 nt, Human
uaaauuccacugg

SEQ ID NO: 2117873 - RNA, 14 nt, Human
uaaauuccacugga

SEQ ID NO: 2117874 - RNA, 17 nt, Human
uaacugacccucccuuc

SEQ ID NO: 2117875 - RNA, 12 nt, Human
uaacugacaaau

SEQ ID NO: 2117876 - RNA, 14 nt, Human
uaacugacaaauca

SEQ ID NO: 2117877 - RNA, 15 nt, Human
uaacugacaaaucaa

SEQ ID NO: 2117878 - RNA, 16 nt, Human
uaacugacaaaucaag

SEQ ID NO: 2117879 - RNA, 17 nt, Human
uaacugacaaaucaagu

SEQ ID NO: 2117880 - RNA, 18 nt, Human
uaacugacaaaucaaguu

SEQ ID NO: 2117881 - RNA, 19 nt, Human
uaacugacaaaucaaguuu

SEQ ID NO: 2117882 - RNA, 20 nt, Human
uaacugacaaaucaaguuuc

SEQ ID NO: 2117883 - RNA, 13 nt, Human
uaacugacaacuu

SEQ ID NO: 2117884 - RNA, 21 nt, Human
uaacucuuugccuuugccacc

SEQ ID NO: 2117885 - RNA, 12 nt, Human
uaacucuuugga

SEQ ID NO: 2117886 - RNA, 13 nt, Human
uaacucuuuggau

SEQ ID NO: 2117887 - RNA, 14 nt, Human
uaacugaaggagaa

SEQ ID NO: 2117888 - RNA, 15 nt, Human
uaacugaaggagaag

SEQ ID NO: 2117889 - RNA, 16 nt, Human
uaacugaaggagaagg

SEQ ID NO: 2117890 - RNA, 14 nt, Human
uaacucugauguaa

SEQ ID NO: 2117891 - RNA, 15 nt, Human
uaacucugauguaaa

SEQ ID NO: 2117892 - RNA, 16 nt, Human
uaacucugauguaaau

SEQ ID NO: 2117893 - RNA, 17 nt, Human
uaacucugauguaaaug

SEQ ID NO: 2117894 - RNA, 19 nt, Human
uaacucugauguaaaugaa

SEQ ID NO: 2117895 - RNA, 22 nt, Human
uaacucuaauucccauuuugca

SEQ ID NO: 2117896 - RNA, 14 nt, Human
uaaccccauucuuu

SEQ ID NO: 2117897 - RNA, 15 nt, Human
uaaccccauucuuug

SEQ ID NO: 2117898 - RNA, 16 nt, Human
uaaccccauucuuugc

SEQ ID NO: 2117899 - RNA, 17 nt, Human
uaaccccauucuuugcu

SEQ ID NO: 2117900 - RNA, 16 nt, Human
uaacuauguugauaaa

SEQ ID NO: 2117901 - RNA, 12 nt, Human
uaaccccuuucc

SEQ ID NO: 2117902 - RNA, 13 nt, Human
uaaccccuuuccu

SEQ ID NO: 2117903 - RNA, 16 nt, Human
uaaccccuuuccugcg

SEQ ID NO: 2117904 - RNA, 19 nt, Human
uaacuauuuuauuuucuaa

SEQ ID NO: 2117905 - RNA, 14 nt, Human
uaacucaauauuuu

SEQ ID NO: 2117906 - RNA, 22 nt, Human
uaacucaauauuuuccaugaaa

SEQ ID NO: 2117907 - RNA, 15 nt, Human
uaacacuguuaagag

SEQ ID NO: 2117908 - RNA, 16 nt, Human
uaacauucgaucucau

SEQ ID NO: 2117909 - RNA, 23 nt, Human
uaacauucgaucucauucaguau

SEQ ID NO: 2117910 - RNA, 15 nt, Human
uaacauugaccaaga

SEQ ID NO: 2117911 - RNA, 16 nt, Human
uaacauugaccaagaa

SEQ ID NO: 2117912 - RNA, 18 nt, Human
uaacauugaccaagaacu

SEQ ID NO: 2117913 - RNA, 19 nt, Human
uaacauugaccaagaacug

SEQ ID NO: 2117914 - RNA, 20 nt, Human
uaacauugaccaagaacugc

SEQ ID NO: 2117915 - RNA, 21 nt, Human
uaacauugaccaagaacugca

SEQ ID NO: 2117916 - RNA, 22 nt, Human
uaacauugaccaagaacugcau

SEQ ID NO: 2117917 - RNA, 23 nt, Human
uaacauugaccaagaacugcaug

SEQ ID NO: 2117918 - RNA, 20 nt, Human
uaacauugggaaaucuuaua

SEQ ID NO: 2117919 - RNA, 22 nt, Human
uaacauucuguaaaaugucugu

SEQ ID NO: 2117920 - RNA, 18 nt, Human
uaacauuucuaacucuga

SEQ ID NO: 2117921 - RNA, 22 nt, Human
uaacauuucuaacucugaugua

SEQ ID NO: 2117922 - RNA, 23 nt, Human
uaacauuucuaacucugauguaa

SEQ ID NO: 2117923 - RNA, 18 nt, Human
uaacauuugagucccuuc

SEQ ID NO: 2117924 - RNA, 15 nt, Human
uaaccacggaaaaga

SEQ ID NO: 2117925 - RNA, 19 nt, Human
uaaccacgucugucuucac

SEQ ID NO: 2117926 - RNA, 13 nt, Human
uaaccacugcuuc

SEQ ID NO: 2117927 - RNA, 19 nt, Human
uaaccacuuaaaaaauguc

SEQ ID NO: 2117928 - RNA, 12 nt, Human
uaaccacugcuu

SEQ ID NO: 2117929 - RNA, 20 nt, Human
uaaccacuuaaaaaaugucc

SEQ ID NO: 2117930 - RNA, 20 nt, Human
uaaccacgucugucuucaca

SEQ ID NO: 2117931 - RNA, 16 nt, Human
uaaccacuucagcuga

SEQ ID NO: 2117932 - RNA, 13 nt, Human
uaaccagagcaag

SEQ ID NO: 2117933 - RNA, 21 nt, Human
uaaccagagcaagcuuuuuua

SEQ ID NO: 2117934 - RNA, 21 nt, Human
uaaccagucugaaguuucauu

SEQ ID NO: 2117935 - RNA, 23 nt, Human
uaaccagucugaaguuucauuua

SEQ ID NO: 2117936 - RNA, 15 nt, Human
uaaccccaaaaugaa

SEQ ID NO: 2117937 - RNA, 19 nt, Human
uaaccccaaaaugaagauu

SEQ ID NO: 2117938 - RNA, 13 nt, Human
uaaccccagcucc

SEQ ID NO: 2117939 - RNA, 19 nt, Human
uaaccccagcucccuagga

SEQ ID NO: 2117940 - RNA, 18 nt, Human
uaacuggagccccaucag

SEQ ID NO: 2117941 - RNA, 11 nt, Human
uaacuguguau

SEQ ID NO: 2117942 - RNA, 13 nt, Human
uaacuguguaugu

SEQ ID NO: 2117943 - RNA, 14 nt, Human
uaacuguguaugua

SEQ ID NO: 2117944 - RNA, 15 nt, Human
uaacuguguauguac

SEQ ID NO: 2117945 - RNA, 18 nt, Human
uaacuguguauguacaua

SEQ ID NO: 2117946 - RNA, 19 nt, Human
uaacuguguauguacauau

SEQ ID NO: 2117947 - RNA, 20 nt, Human
uaacuguguauguacauaua

SEQ ID NO: 2117948 - RNA, 22 nt, Human
uaacuguguauguacauauaua

SEQ ID NO: 2117949 - RNA, 15 nt, Human
uaacugugucauuug

SEQ ID NO: 2117950 - RNA, 22 nt, Human
uaacuggaagcauguaggagaa

SEQ ID NO: 2117951 - RNA, 16 nt, Human
uaagaaaacaucacug

SEQ ID NO: 2117952 - RNA, 20 nt, Human
uaagaaaaaauaacacacau

SEQ ID NO: 2117953 - RNA, 15 nt, Human
uaagaaaaaaauaau

SEQ ID NO: 2117954 - RNA, 22 nt, Human
uaagaaaaaaauaauuuuauga

SEQ ID NO: 2117955 - RNA, 16 nt, Human
uaacuuuugugugaaa

SEQ ID NO: 2117956 - RNA, 15 nt, Human
uaagagcuuuacaaa

SEQ ID NO: 2117957 - RNA, 19 nt, Human
uaagagcuuuacaaaaaga

SEQ ID NO: 2117958 - RNA, 20 nt, Human
uaagagcuuuacaaaaagac

SEQ ID NO: 2117959 - RNA, 15 nt, Human
uaagaggaugaagug

SEQ ID NO: 2117960 - RNA, 19 nt, Human
uaagaaaccaaucaagaua

SEQ ID NO: 2117961 - RNA, 21 nt, Human
uaagaaaccaaucaagauaaa

SEQ ID NO: 2117962 - RNA, 23 nt, Human
uaagaaacacacugaggcaggga

SEQ ID NO: 2117963 - RNA, 14 nt, Human
uaagaaaauacaau

SEQ ID NO: 2117964 - RNA, 17 nt, Human
uaagaaaauacaauaaa

SEQ ID NO: 2117965 - RNA, 18 nt, Human
uaagaaaauacaauaaac

SEQ ID NO: 2117966 - RNA, 19 nt, Human
uaagaaaauacaauaaacu

SEQ ID NO: 2117967 - RNA, 21 nt, Human
uaagaaaagauacgacuuuau

SEQ ID NO: 2117968 - RNA, 20 nt, Human
uaagaaacacacugaggcag

SEQ ID NO: 2117969 - RNA, 21 nt, Human
uaagaaacacacugaggcagg

SEQ ID NO: 2117970 - RNA, 11 nt, Human
uaauguuuccu

SEQ ID NO: 2117971 - RNA, 13 nt, Human
uaauguuugcuau

SEQ ID NO: 2117972 - RNA, 16 nt, Human
uaauguuuuuaaauau

SEQ ID NO: 2117973 - RNA, 12 nt, Human
uaauguuugcua

SEQ ID NO: 2117974 - RNA, 14 nt, Human
uaauuaaaaaauuu

SEQ ID NO: 2117975 - RNA, 17 nt, Human
uaauuaaguaaacuaau

SEQ ID NO: 2117976 - RNA, 21 nt, Human
uaauuaaguaaacuaaugagu

SEQ ID NO: 2117977 - RNA, 14 nt, Human
uaauuaaguacuau

SEQ ID NO: 2117978 - RNA, 17 nt, Human
uaauuaaguacuaugua

SEQ ID NO: 2117979 - RNA, 20 nt, Human
uaauuaaguacuauguauca

SEQ ID NO: 2117980 - RNA, 13 nt, Human
uaauuagcugugc

SEQ ID NO: 2117981 - RNA, 22 nt, Human
uaauuagagcagaugaccccuc

SEQ ID NO: 2117982 - RNA, 21 nt, Human
uaauguuggguagaaagagau

SEQ ID NO: 2117983 - RNA, 23 nt, Human
uaauguuacugaucaugcauugu

SEQ ID NO: 2117984 - RNA, 15 nt, Human
uaauguuacugauca

SEQ ID NO: 2117985 - RNA, 21 nt, Human
uaauguuacugaucaugcauu

SEQ ID NO: 2117986 - RNA, 15 nt, Human
uaauggggcggugag

SEQ ID NO: 2117987 - RNA, 20 nt, Human
uaauggaaaaugauuuuacu

SEQ ID NO: 2117988 - RNA, 16 nt, Human
uaaugcuguugccuca

SEQ ID NO: 2117989 - RNA, 13 nt, Human
uaaugcuggagcg

SEQ ID NO: 2117990 - RNA, 14 nt, Human
uaaugcuguugccu

SEQ ID NO: 2117991 - RNA, 17 nt, Human
uaaugcuguugccucau

SEQ ID NO: 2117992 - RNA, 14 nt, Human
uaaugcuaaaugua

SEQ ID NO: 2117993 - RNA, 21 nt, Human
uaaugcuaaauguaagaauca

SEQ ID NO: 2117994 - RNA, 22 nt, Human
uaaugcuaaauguaagaaucau

SEQ ID NO: 2117995 - RNA, 16 nt, Human
uaauaugcugccaaau

SEQ ID NO: 2117996 - RNA, 10 nt, Human
uaauaugcau

SEQ ID NO: 2117997 - RNA, 18 nt, Human
uaauaugcugccaaauuu

SEQ ID NO: 2117998 - RNA, 12 nt, Human
uaauaugagaau

SEQ ID NO: 2117999 - RNA, 15 nt, Human
uaauaauguuuaaua

SEQ ID NO: 2118000 - RNA, 13 nt, Human
uaauaaugugaau

SEQ ID NO: 2118001 - RNA, 15 nt, Human
uaauaucaauagaag

SEQ ID NO: 2118002 - RNA, 15 nt, Human
uaaucugcuaugcuu

SEQ ID NO: 2118003 - RNA, 18 nt, Human
uaaucugcuaugcuugaa

SEQ ID NO: 2118004 - RNA, 22 nt, Human
uaaucuggacuccucuguccag

SEQ ID NO: 2118005 - RNA, 21 nt, Human
uaaucuggacuccucugucca

SEQ ID NO: 2118006 - RNA, 20 nt, Human
uaaucuggacuccucugucc

SEQ ID NO: 2118007 - RNA, 19 nt, Human
uaaucuggacuccucuguc

SEQ ID NO: 2118008 - RNA, 17 nt, Human
uaauccuagcugugugc

SEQ ID NO: 2118009 - RNA, 17 nt, Human
uaaucuaauucuaagga

SEQ ID NO: 2118010 - RNA, 22 nt, Human
uaaucuacuccuuguaaagacu

SEQ ID NO: 2118011 - RNA, 15 nt, Human
uaaucuggacuccuc

SEQ ID NO: 2118012 - RNA, 16 nt, Human
uaaucuauuggguuca

SEQ ID NO: 2118013 - RNA, 18 nt, Human
uaaucuauuggguucauu

SEQ ID NO: 2118014 - RNA, 18 nt, Human
uaaucuggacuccucugu

SEQ ID NO: 2118015 - RNA, 17 nt, Human
uaaucuggacuccucug

SEQ ID NO: 2118016 - RNA, 20 nt, Human
uaauauuaaggaagacaaug

SEQ ID NO: 2118017 - RNA, 22 nt, Human
uaaucccugggcauugcuuucc

SEQ ID NO: 2118018 - RNA, 19 nt, Human
uaaucccugggcauugcuu

SEQ ID NO: 2118019 - RNA, 20 nt, Human
uaaucccugggcauugcuuu

SEQ ID NO: 2118020 - RNA, 17 nt, Human
uaaucccgauucacccu

SEQ ID NO: 2118021 - RNA, 14 nt, Human
uaaucccugggcau

SEQ ID NO: 2118022 - RNA, 15 nt, Human
uaagccaugggagac

SEQ ID NO: 2118023 - RNA, 15 nt, Human
uaagaggcagggucu

SEQ ID NO: 2118024 - RNA, 12 nt, Human
uaagaggcaggg

SEQ ID NO: 2118025 - RNA, 21 nt, Human
uaagcuaaagaggcugaaaga

SEQ ID NO: 2118026 - RNA, 16 nt, Human
uaagcuaacccccuuc

SEQ ID NO: 2118027 - RNA, 22 nt, Human
uaagcgcuagaggaagcagcca

SEQ ID NO: 2118028 - RNA, 22 nt, Human
uaagcuaacccccuucuacuga

SEQ ID NO: 2118029 - RNA, 14 nt, Human
uaagcccuugaaga

SEQ ID NO: 2118030 - RNA, 13 nt, Human
uaagcuaugugaa

SEQ ID NO: 2118031 - RNA, 15 nt, Human
uaaggauugugauau

SEQ ID NO: 2118032 - RNA, 14 nt, Human
uaagcuauucagua

SEQ ID NO: 2118033 - RNA, 19 nt, Human
uaaggcaacugaacaaaaa

SEQ ID NO: 2118034 - RNA, 20 nt, Human
uaaggcaacugaacaaaaaa

SEQ ID NO: 2118035 - RNA, 17 nt, Human
uaagggaaaagggaaca

SEQ ID NO: 2118036 - RNA, 14 nt, Human
uaaggcuucaauuu

SEQ ID NO: 2118037 - RNA, 23 nt, Human
uaaggcuucaauuuauugcacaa

SEQ ID NO: 2118038 - RNA, 20 nt, Human
uaaggcugaggaaaggccag

SEQ ID NO: 2118039 - RNA, 13 nt, Human
uaaggcugaggaa

SEQ ID NO: 2118040 - RNA, 13 nt, Human
uaaggugccuucu

SEQ ID NO: 2118041 - RNA, 15 nt, Human
uaaggugugcucuga

SEQ ID NO: 2118042 - RNA, 20 nt, Human
uaaggguuaguuuacaauca

SEQ ID NO: 2118043 - RNA, 13 nt, Human
uaaggguuuuaga

SEQ ID NO: 2118044 - RNA, 18 nt, Human
uaaggucauuaccacagg

SEQ ID NO: 2118045 - RNA, 22 nt, Human
uaagggcuggucucugcugaag

SEQ ID NO: 2118046 - RNA, 18 nt, Human
uaauaagcuaaagaggcu

SEQ ID NO: 2118047 - RNA, 19 nt, Human
uaagugugaguaagagcug

SEQ ID NO: 2118048 - RNA, 15 nt, Human
uaauaaauauuuaug

SEQ ID NO: 2118049 - RNA, 16 nt, Human
uaauaaauauuuaugu

SEQ ID NO: 2118050 - RNA, 14 nt, Human
uaauaaaguauaua

SEQ ID NO: 2118051 - RNA, 13 nt, Human
uaauaaaguauuc

SEQ ID NO: 2118052 - RNA, 15 nt, Human
uaauaaaguauucca

SEQ ID NO: 2118053 - RNA, 18 nt, Human
uaauaaaguauuccaccu

SEQ ID NO: 2118054 - RNA, 22 nt, Human
uaauaaaguauuccaccuuaaa

SEQ ID NO: 2118055 - RNA, 10 nt, Human
uaauaaagug

SEQ ID NO: 2118056 - RNA, 16 nt, Human
uaauaaaguguuuuca

SEQ ID NO: 2118057 - RNA, 18 nt, Human
uaauaaaguguuuucaga

SEQ ID NO: 2118058 - RNA, 19 nt, Human
uaauaaaguguuuucagag

SEQ ID NO: 2118059 - RNA, 20 nt, Human
uaauaaaguguuuucagagc

SEQ ID NO: 2118060 - RNA, 15 nt, Human
uaaguguacuaauua

SEQ ID NO: 2118061 - RNA, 11 nt, Human
uaagucucugu

SEQ ID NO: 2118062 - RNA, 12 nt, Human
uaagucucugug

SEQ ID NO: 2118063 - RNA, 23 nt, Human
uaagcuaggauguugcucagaag

SEQ ID NO: 2118064 - RNA, 18 nt, Human
uaagucuaaauauuuccu

SEQ ID NO: 2118065 - RNA, 20 nt, Human
uaaguccuugcaagaaucag

SEQ ID NO: 2118066 - RNA, 23 nt, Human
uaaguccuacuuuacauaugcuu

SEQ ID NO: 2118067 - RNA, 15 nt, Human
uaagucccugccccc

SEQ ID NO: 2118068 - RNA, 17 nt, Human
uaagucccugcccccuc

SEQ ID NO: 2118069 - RNA, 18 nt, Human
uaagucccugcccccucc

SEQ ID NO: 2118070 - RNA, 22 nt, Human
uaagucccugcccccuccccuu

SEQ ID NO: 2118071 - RNA, 23 nt, Human
uaagucccugcccccuccccuuc

SEQ ID NO: 2118072 - RNA, 16 nt, Human
uaagugaaaaggucau

SEQ ID NO: 2118073 - RNA, 15 nt, Human
uaagugagagagaca

SEQ ID NO: 2118074 - RNA, 24 nt, Human
uaagugagagagacaagaagcaaa

SEQ ID NO: 2118075 - RNA, 15 nt, Human
uaagugccuacauua

SEQ ID NO: 2118076 - RNA, 11 nt, Human
uauagaaaugc

SEQ ID NO: 2118077 - RNA, 13 nt, Human
uauagaaguuuag

SEQ ID NO: 2118078 - RNA, 22 nt, Human
uauagaauaaugugggaagaaa

SEQ ID NO: 2118079 - RNA, 15 nt, Human
uauagaauauuuauu

SEQ ID NO: 2118080 - RNA, 21 nt, Human
uauagaauauuuauuaccucu

SEQ ID NO: 2118081 - RNA, 21 nt, Human
uauagaauugcaauuuuaaca

SEQ ID NO: 2118082 - RNA, 17 nt, Human
uauagaauuuuuaaugu

SEQ ID NO: 2118083 - RNA, 18 nt, Human
uauagaauuuuuaauguu

SEQ ID NO: 2118084 - RNA, 16 nt, Human
uauagacaaauaauaa

SEQ ID NO: 2118085 - RNA, 11 nt, Human
uauagacucua

SEQ ID NO: 2118086 - RNA, 16 nt, Human
uauagacccgaggaaa

SEQ ID NO: 2118087 - RNA, 17 nt, Human
uauacuuuuuucuuauu

SEQ ID NO: 2118088 - RNA, 21 nt, Human
uauacuuuuuucuuauuuaac

SEQ ID NO: 2118089 - RNA, 19 nt, Human
uauacuuuuuucuuauuua

SEQ ID NO: 2118090 - RNA, 23 nt, Human
uauaaacuuagugcggacaaguu

SEQ ID NO: 2118091 - RNA, 16 nt, Human
uauaaagguugacaau

SEQ ID NO: 2118092 - RNA, 20 nt, Human
uauaucugggcuggccaguu

SEQ ID NO: 2118093 - RNA, 12 nt, Human
uauauaaagaga

SEQ ID NO: 2118094 - RNA, 14 nt, Human
uauauaaagagaaa

SEQ ID NO: 2118095 - RNA, 15 nt, Human
uauauaaagagaaaa

SEQ ID NO: 2118096 - RNA, 16 nt, Human
uauauaaagagaaaau

SEQ ID NO: 2118097 - RNA, 18 nt, Human
uauauaaagagaaaauug

SEQ ID NO: 2118098 - RNA, 19 nt, Human
uauauaaagagaaaauuga

SEQ ID NO: 2118099 - RNA, 20 nt, Human
uauauaaagagaaaauugaa

SEQ ID NO: 2118100 - RNA, 23 nt, Human
uauauaaagagaaaauugaauuu

SEQ ID NO: 2118101 - RNA, 16 nt, Human
uauaguaccuuugcuc

SEQ ID NO: 2118102 - RNA, 20 nt, Human
uauaguaccuuugcucuugc

SEQ ID NO: 2118103 - RNA, 20 nt, Human
uauagucccagcuacucaga

SEQ ID NO: 2118104 - RNA, 23 nt, Human
uaucaguuugcuagcagaaaucu

SEQ ID NO: 2118105 - RNA, 20 nt, Human
uaucaggugcugccauccag

SEQ ID NO: 2118106 - RNA, 16 nt, Human
uaucaaacugaagcca

SEQ ID NO: 2118107 - RNA, 13 nt, Human
uaucaaacugaag

SEQ ID NO: 2118108 - RNA, 19 nt, Human
uaucaggugcugccaucca

SEQ ID NO: 2118109 - RNA, 18 nt, Human
uaucaaaauaaauugaaa

SEQ ID NO: 2118110 - RNA, 21 nt, Human
uaucaaaauaaauugaaauau

SEQ ID NO: 2118111 - RNA, 15 nt, Human
uaucaaacagcucag

SEQ ID NO: 2118112 - RNA, 18 nt, Human
uaucaaacagcucaggcu

SEQ ID NO: 2118113 - RNA, 15 nt, Human
uaucaugcaaaugcu

SEQ ID NO: 2118114 - RNA, 16 nt, Human
uaucaugcaaaugcug

SEQ ID NO: 2118115 - RNA, 17 nt, Human
uaucaugcaaaugcugu

SEQ ID NO: 2118116 - RNA, 21 nt, Human
uaucauauauauacauacaug

SEQ ID NO: 2118117 - RNA, 18 nt, Human
uaucaugccccuguacuc

SEQ ID NO: 2118118 - RNA, 14 nt, Human
uaucauggaaauau

SEQ ID NO: 2118119 - RNA, 18 nt, Human
uaucauggaaauauuaug

SEQ ID NO: 2118120 - RNA, 23 nt, Human
uaucauggaaauauuaugcaaau

SEQ ID NO: 2118121 - RNA, 18 nt, Human
uauauuuuuaauaaaagu

SEQ ID NO: 2118122 - RNA, 18 nt, Human
uauauuuucaauucaaaa

SEQ ID NO: 2118123 - RNA, 21 nt, Human
uauauuuucaauucaaaaaug

SEQ ID NO: 2118124 - RNA, 22 nt, Human
uauauuuucaauucaaaaaugu

SEQ ID NO: 2118125 - RNA, 17 nt, Human
uauaucuguuuuacugc

SEQ ID NO: 2118126 - RNA, 13 nt, Human
uauaugaacauag

SEQ ID NO: 2118127 - RNA, 15 nt, Human
uauaugaacauagac

SEQ ID NO: 2118128 - RNA, 14 nt, Human
uaguagcauguuga

SEQ ID NO: 2118129 - RNA, 12 nt, Human
uaguagauuuua

SEQ ID NO: 2118130 - RNA, 16 nt, Human
uaggugggccagcccc

SEQ ID NO: 2118131 - RNA, 19 nt, Human
uaggugggccagccccucc

SEQ ID NO: 2118132 - RNA, 20 nt, Human
uaggugggccagccccuccc

SEQ ID NO: 2118133 - RNA, 21 nt, Human
uaggugggccagccccuccca

SEQ ID NO: 2118134 - RNA, 23 nt, Human
uaggugggccagccccucccacc

SEQ ID NO: 2118135 - RNA, 18 nt, Human
uagguuaacuauguacaa

SEQ ID NO: 2118136 - RNA, 19 nt, Human
uagguuaacuauguacaau

SEQ ID NO: 2118137 - RNA, 23 nt, Human
uagguuaacuauguacaauauuu

SEQ ID NO: 2118138 - RNA, 17 nt, Human
uagguguucaggccagu

SEQ ID NO: 2118139 - RNA, 16 nt, Human
uaggugucauuuccau

SEQ ID NO: 2118140 - RNA, 13 nt, Human
uagguguggggga

SEQ ID NO: 2118141 - RNA, 17 nt, Human
uaggugugggggaagca

SEQ ID NO: 2118142 - RNA, 16 nt, Human
uaggugacagagugag

SEQ ID NO: 2118143 - RNA, 11 nt, Human
uaggugacaga

SEQ ID NO: 2118144 - RNA, 11 nt, Human
uagggaaaaac

SEQ ID NO: 2118145 - RNA, 14 nt, Human
uaggcuuuacuuag

SEQ ID NO: 2118146 - RNA, 16 nt, Human
uagguggaucaccuga

SEQ ID NO: 2118147 - RNA, 22 nt, Human
uagcugguuuccucauuccuga

SEQ ID NO: 2118148 - RNA, 18 nt, Human
uagcugguuccugcuaga

SEQ ID NO: 2118149 - RNA, 23 nt, Human
uagcugguuccugcuagaaaugg

SEQ ID NO: 2118150 - RNA, 16 nt, Human
uaggcuggagcccagg

SEQ ID NO: 2118151 - RNA, 19 nt, Human
uaggcuggagcccagggag

SEQ ID NO: 2118152 - RNA, 16 nt, Human
uaggcugggcccagag

SEQ ID NO: 2118153 - RNA, 17 nt, Human
uaggcugggcccagagg

SEQ ID NO: 2118154 - RNA, 18 nt, Human
uaggcugggcccagaggc

SEQ ID NO: 2118155 - RNA, 11 nt, Human
uaggcugggug

SEQ ID NO: 2118156 - RNA, 12 nt, Human
uaggcugggugc

SEQ ID NO: 2118157 - RNA, 17 nt, Human
uaggcugggugcccaca

SEQ ID NO: 2118158 - RNA, 18 nt, Human
uaggcugggugcccacag

SEQ ID NO: 2118159 - RNA, 16 nt, Human
uaguggccagaccaga

SEQ ID NO: 2118160 - RNA, 17 nt, Human
uaguggccagaccagag

SEQ ID NO: 2118161 - RNA, 19 nt, Human
uaguggccagaccagagcu

SEQ ID NO: 2118162 - RNA, 16 nt, Human
uaguauuuauuuaaug

SEQ ID NO: 2118163 - RNA, 20 nt, Human
uaguggcuuaaaacaacacu

SEQ ID NO: 2118164 - RNA, 16 nt, Human
uaguaugguggcuggg

SEQ ID NO: 2118165 - RNA, 18 nt, Human
uaguggggucucccucuc

SEQ ID NO: 2118166 - RNA, 20 nt, Human
uaguggggucucccucuccu

SEQ ID NO: 2118167 - RNA, 21 nt, Human
uaguggggucucccucuccug

SEQ ID NO: 2118168 - RNA, 22 nt, Human
uaguggggucucccucuccugc

SEQ ID NO: 2118169 - RNA, 23 nt, Human
uaguggggucucccucuccugcc

SEQ ID NO: 2118170 - RNA, 14 nt, Human
uauaaacaucacac

SEQ ID NO: 2118171 - RNA, 18 nt, Human
uauaaacaucacacacac

SEQ ID NO: 2118172 - RNA, 17 nt, Human
uauaaacaucacacaca

SEQ ID NO: 2118173 - RNA, 14 nt, Human
uaguuucuuuggga

SEQ ID NO: 2118174 - RNA, 14 nt, Human
uauaaacacuauau

SEQ ID NO: 2118175 - RNA, 13 nt, Human
uagacuagagaaa

SEQ ID NO: 2118176 - RNA, 14 nt, Human
uagacuagagaaac

SEQ ID NO: 2118177 - RNA, 16 nt, Human
uagaccuccagcuguu

SEQ ID NO: 2118178 - RNA, 23 nt, Human
uagaccauuuaucugggauuaug

SEQ ID NO: 2118179 - RNA, 14 nt, Human
uagaccccuggcug

SEQ ID NO: 2118180 - RNA, 15 nt, Human
uagaccccuggcugg

SEQ ID NO: 2118181 - RNA, 14 nt, Human
uagaguccucacuc

SEQ ID NO: 2118182 - RNA, 20 nt, Human
uagaguccucacucccaguc

SEQ ID NO: 2118183 - RNA, 16 nt, Human
uagaggugagggaagc

SEQ ID NO: 2118184 - RNA, 13 nt, Human
uagaguccucacu

SEQ ID NO: 2118185 - RNA, 12 nt, Human
uagagugggagc

SEQ ID NO: 2118186 - RNA, 13 nt, Human
uagagaaggaccc

SEQ ID NO: 2118187 - RNA, 22 nt, Human
uagagaaggacccggaggggcc

SEQ ID NO: 2118188 - RNA, 11 nt, Human
uagagacaggg

SEQ ID NO: 2118189 - RNA, 16 nt, Human
uagaaguggaccagga

SEQ ID NO: 2118190 - RNA, 18 nt, Human
uagaaguggaccaggaca

SEQ ID NO: 2118191 - RNA, 19 nt, Human
uagaaguggaccaggacag

SEQ ID NO: 2118192 - RNA, 20 nt, Human
uagaaguggaccaggacagg

SEQ ID NO: 2118193 - RNA, 16 nt, Human
uagaagugggccagga

SEQ ID NO: 2118194 - RNA, 20 nt, Human
uagaagugggccaggacagg

SEQ ID NO: 2118195 - RNA, 14 nt, Human
uacuuguggacaca

SEQ ID NO: 2118196 - RNA, 22 nt, Human
uacuuguucaaaauauguucuu

SEQ ID NO: 2118197 - RNA, 15 nt, Human
uacuuguuucagagu

SEQ ID NO: 2118198 - RNA, 14 nt, Human
uacuuguuucagag

SEQ ID NO: 2118199 - RNA, 13 nt, Human
uacuuguucaaaa

SEQ ID NO: 2118200 - RNA, 20 nt, Human
uagaauauuuauuaccucug

SEQ ID NO: 2118201 - RNA, 21 nt, Human
uagaaucagccuaggggucag

SEQ ID NO: 2118202 - RNA, 19 nt, Human
uagaauauuuauuaccucu

SEQ ID NO: 2118203 - RNA, 15 nt, Human
uagaauauuuauuac

SEQ ID NO: 2118204 - RNA, 12 nt, Human
uagaauauuuau

SEQ ID NO: 2118205 - RNA, 15 nt, Human
uagaauauaauuauc

SEQ ID NO: 2118206 - RNA, 18 nt, Human
uagaauauaauuaucgga

SEQ ID NO: 2118207 - RNA, 21 nt, Human
uagaauaaugugggaagaaac

SEQ ID NO: 2118208 - RNA, 22 nt, Human
uagaauaaugugggaagaaaca

SEQ ID NO: 2118209 - RNA, 23 nt, Human
uagaauaaugugggaagaaacaa

SEQ ID NO: 2118210 - RNA, 19 nt, Human
uagaagugggccaggacag

SEQ ID NO: 2118211 - RNA, 14 nt, Human
uagaauguuuuccu

SEQ ID NO: 2118212 - RNA, 13 nt, Human
uagaaucugugua

SEQ ID NO: 2118213 - RNA, 19 nt, Human
uagcugggacuacaggcac

SEQ ID NO: 2118214 - RNA, 17 nt, Human
uagcugggacuacaggc

SEQ ID NO: 2118215 - RNA, 15 nt, Human
uagcugggacuacag

SEQ ID NO: 2118216 - RNA, 14 nt, Human
uagcugccaagccc

SEQ ID NO: 2118217 - RNA, 16 nt, Human
uagcugccaagcccca

SEQ ID NO: 2118218 - RNA, 20 nt, Human
uagcugccaagccccauccu

SEQ ID NO: 2118219 - RNA, 21 nt, Human
uagcugccaagccccauccug

SEQ ID NO: 2118220 - RNA, 12 nt, Human
uagcugccaagu

SEQ ID NO: 2118221 - RNA, 12 nt, Human
uagcugggacua

SEQ ID NO: 2118222 - RNA, 12 nt, Human
uagcucaguuua

SEQ ID NO: 2118223 - RNA, 23 nt, Human
uagcugacccagccccuugagaa

SEQ ID NO: 2118224 - RNA, 21 nt, Human
uagcugacccagccccuugag

SEQ ID NO: 2118225 - RNA, 11 nt, Human
uagcugcagaa

SEQ ID NO: 2118226 - RNA, 12 nt, Human
uagcugcagaac

SEQ ID NO: 2118227 - RNA, 11 nt, Human
uagcugagugu

SEQ ID NO: 2118228 - RNA, 21 nt, Human
uagcucaggugucccugcacu

SEQ ID NO: 2118229 - RNA, 20 nt, Human
uagcucaggugucccugcac

SEQ ID NO: 2118230 - RNA, 11 nt, Human
uagcucaguuu

SEQ ID NO: 2118231 - RNA, 18 nt, Human
uagccugugccucuggga

SEQ ID NO: 2118232 - RNA, 20 nt, Human
uagccugugccucugggacu

SEQ ID NO: 2118233 - RNA, 14 nt, Human
uagccuggcuuggg

SEQ ID NO: 2118234 - RNA, 19 nt, Human
uagccggagugacagagua

SEQ ID NO: 2118235 - RNA, 16 nt, Human
uagccuaggugacaga

SEQ ID NO: 2118236 - RNA, 19 nt, Human
uagccgagagccugcuccc

SEQ ID NO: 2118237 - RNA, 19 nt, Human
uagccgggcaugguggcgc

SEQ ID NO: 2118238 - RNA, 17 nt, Human
uagccgagagccugcuc

SEQ ID NO: 2118239 - RNA, 18 nt, Human
uagccgagagccugcucc

SEQ ID NO: 2118240 - RNA, 16 nt, Human
uagccgaccucagccu

SEQ ID NO: 2118241 - RNA, 17 nt, Human
uagccgaccucagccuu

SEQ ID NO: 2118242 - RNA, 14 nt, Human
uagccgagagccug

SEQ ID NO: 2118243 - RNA, 15 nt, Human
uagccgagagccugc

SEQ ID NO: 2118244 - RNA, 19 nt, Human
uagcccccaggcugcugga

SEQ ID NO: 2118245 - RNA, 18 nt, Human
uagcccccaggcugcugg

SEQ ID NO: 2118246 - RNA, 21 nt, Human
uagcaugacaagccccaggca

SEQ ID NO: 2118247 - RNA, 22 nt, Human
uagcaugacaagccccaggcag

SEQ ID NO: 2118248 - RNA, 14 nt, Human
uagcaugcacaaag

SEQ ID NO: 2118249 - RNA, 17 nt, Human
uagcaugcacaaagugu

SEQ ID NO: 2118250 - RNA, 18 nt, Human
uagcaugcacaaagugua

SEQ ID NO: 2118251 - RNA, 19 nt, Human
uagcaugcacaaaguguau

SEQ ID NO: 2118252 - RNA, 16 nt, Human
uagcaugaagacagag

SEQ ID NO: 2118253 - RNA, 16 nt, Human
uagcaugacaagcccc

SEQ ID NO: 2118254 - RNA, 17 nt, Human
uagcaugacaagcccca

SEQ ID NO: 2118255 - RNA, 18 nt, Human
uagcaugacaagccccag

SEQ ID NO: 2118256 - RNA, 20 nt, Human
uagcaugacaagccccaggc

SEQ ID NO: 2118257 - RNA, 11 nt, Human
uagauagaaau

SEQ ID NO: 2118258 - RNA, 12 nt, Human
uagauagaaaua

SEQ ID NO: 2118259 - RNA, 21 nt, Human
uagauagaaauaaauagcuau

SEQ ID NO: 2118260 - RNA, 23 nt, Human
uagauagaaauaaauagcuauau

SEQ ID NO: 2118261 - RNA, 21 nt, Human
uagauuacccccucauuguuu

SEQ ID NO: 2118262 - RNA, 13 nt, Human
uagauuucugauu

SEQ ID NO: 2118263 - RNA, 14 nt, Human
uagauuucugauuu

SEQ ID NO: 2118264 - RNA, 17 nt, Human
uagauuucugauuuuau

SEQ ID NO: 2118265 - RNA, 18 nt, Human
uagauuucugauuuuaug

SEQ ID NO: 2118266 - RNA, 16 nt, Human
uagauuuuaaucaaau

SEQ ID NO: 2118267 - RNA, 13 nt, Human
uagauuuguuuug

SEQ ID NO: 2118268 - RNA, 14 nt, Human
uagauuuguuuugu

SEQ ID NO: 2118269 - RNA, 15 nt, Human
uagauuuguuuugug

SEQ ID NO: 2118270 - RNA, 19 nt, Human
uagauuuguuuuguguugu

SEQ ID NO: 2118271 - RNA, 18 nt, Human
uagauuauauugagacaa

SEQ ID NO: 2118272 - RNA, 21 nt, Human
uagauuauauugagacaaaaa

SEQ ID NO: 2118273 - RNA, 22 nt, Human
uagauuauauugagacaaaaau

SEQ ID NO: 2118274 - RNA, 20 nt, Human
uagauuagaucuuuuaagcc

SEQ ID NO: 2118275 - RNA, 12 nt, Human
uagauucaccug

SEQ ID NO: 2118276 - RNA, 13 nt, Human
uagauucaccugu

SEQ ID NO: 2118277 - RNA, 15 nt, Human
uagauucaccuguaa

SEQ ID NO: 2118278 - RNA, 16 nt, Human
uagauucaccuguaaa

SEQ ID NO: 2118279 - RNA, 17 nt, Human
uagauucaccuguaaaa

SEQ ID NO: 2118280 - RNA, 20 nt, Human
uagauucaccuguaaaacuu

SEQ ID NO: 2118281 - RNA, 21 nt, Human
uagauucaccuguaaaacuuu

SEQ ID NO: 2118282 - RNA, 22 nt, Human
uagauucaccuguaaaacuuua

SEQ ID NO: 2118283 - RNA, 14 nt, Human
uagcagcuaucucu

SEQ ID NO: 2118284 - RNA, 11 nt, Human
uagcagggaaa

SEQ ID NO: 2118285 - RNA, 17 nt, Human
uagauuuuaaucaaauu

SEQ ID NO: 2118286 - RNA, 18 nt, Human
uagauuuuaaucaaauuu

SEQ ID NO: 2118287 - RNA, 22 nt, Human
uagcaggacugaauugucccca

SEQ ID NO: 2118288 - RNA, 17 nt, Human
uaccucugauaccucaa

SEQ ID NO: 2118289 - RNA, 15 nt, Human
uaccucugauaccuc

SEQ ID NO: 2118290 - RNA, 14 nt, Human
uaccucugauaccu

SEQ ID NO: 2118291 - RNA, 23 nt, Human
uaccucucuuauagaauauuuau

SEQ ID NO: 2118292 - RNA, 21 nt, Human
uaccucucuuauagaauauuu

SEQ ID NO: 2118293 - RNA, 17 nt, Human
uaccucucuuauagaau

SEQ ID NO: 2118294 - RNA, 18 nt, Human
uaccucggugccuuccuc

SEQ ID NO: 2118295 - RNA, 11 nt, Human
uaccuccugcc

SEQ ID NO: 2118296 - RNA, 13 nt, Human
uaccuccugccca

SEQ ID NO: 2118297 - RNA, 15 nt, Human
uaccuccugcccagg

SEQ ID NO: 2118298 - RNA, 16 nt, Human
uaccuccugcccagga

SEQ ID NO: 2118299 - RNA, 11 nt, Human
uaccuccuccu

SEQ ID NO: 2118300 - RNA, 14 nt, Human
uaccuuuucucuuc

SEQ ID NO: 2118301 - RNA, 15 nt, Human
uaccuuuucucuuca

SEQ ID NO: 2118302 - RNA, 15 nt, Human
uaccuucagauccua

SEQ ID NO: 2118303 - RNA, 17 nt, Human
uaccuucagauccuacc

SEQ ID NO: 2118304 - RNA, 18 nt, Human
uaccuucagauccuaccc

SEQ ID NO: 2118305 - RNA, 14 nt, Human
uaccuucaaagcug

SEQ ID NO: 2118306 - RNA, 15 nt, Human
uaccuucaaagcuga

SEQ ID NO: 2118307 - RNA, 13 nt, Human
uaccuucaauaaa

SEQ ID NO: 2118308 - RNA, 14 nt, Human
uaccuucaauaaag

SEQ ID NO: 2118309 - RNA, 16 nt, Human
uaccuucaauaaagua

SEQ ID NO: 2118310 - RNA, 17 nt, Human
uaccuucaauaaaguau

SEQ ID NO: 2118311 - RNA, 20 nt, Human
uaccuucaauaaaguaucua

SEQ ID NO: 2118312 - RNA, 14 nt, Human
uacuaaggaaucuu

SEQ ID NO: 2118313 - RNA, 15 nt, Human
uacuaagaaaagaua

SEQ ID NO: 2118314 - RNA, 15 nt, Human
uaccuacauacaauu

SEQ ID NO: 2118315 - RNA, 17 nt, Human
uaccuaauuagagcaga

SEQ ID NO: 2118316 - RNA, 20 nt, Human
uaccuaauuagagcagauga

SEQ ID NO: 2118317 - RNA, 15 nt, Human
uaccuaauuagagca

SEQ ID NO: 2118318 - RNA, 13 nt, Human
uaccuagauuuac

SEQ ID NO: 2118319 - RNA, 20 nt, Human
uaccuaccacagugucugua

SEQ ID NO: 2118320 - RNA, 16 nt, Human
uaccuaccacaguguc

SEQ ID NO: 2118321 - RNA, 17 nt, Human
uaccuaccacagugucu

SEQ ID NO: 2118322 - RNA, 18 nt, Human
uaccuaccacagugucug

SEQ ID NO: 2118323 - RNA, 22 nt, Human
uaccucaacccccauuucuauu

SEQ ID NO: 2118324 - RNA, 17 nt, Human
uaccucaaccuauggua

SEQ ID NO: 2118325 - RNA, 16 nt, Human
uaccucaaccuguaaa

SEQ ID NO: 2118326 - RNA, 17 nt, Human
uaccucaaccuguaaau

SEQ ID NO: 2118327 - RNA, 19 nt, Human
uaccucaaccuguaaauua

SEQ ID NO: 2118328 - RNA, 22 nt, Human
uaccucaaccuguaaauuauuu

SEQ ID NO: 2118329 - RNA, 16 nt, Human
uaccuagauuuacagc

SEQ ID NO: 2118330 - RNA, 11 nt, Human
uaccucagccu

SEQ ID NO: 2118331 - RNA, 15 nt, Human
uaccucacugggguc

SEQ ID NO: 2118332 - RNA, 16 nt, Human
uaccucagccuagacc

SEQ ID NO: 2118333 - RNA, 12 nt, Human
uaccucagccua

SEQ ID NO: 2118334 - RNA, 14 nt, Human
uaccucagccuaga

SEQ ID NO: 2118335 - RNA, 13 nt, Human
uaccucccaccuu

SEQ ID NO: 2118336 - RNA, 16 nt, Human
uaccucccaccuuugg

SEQ ID NO: 2118337 - RNA, 14 nt, Human
uaccucaggcagga

SEQ ID NO: 2118338 - RNA, 15 nt, Human
uaccucaggcaggaa

SEQ ID NO: 2118339 - RNA, 21 nt, Human
uaccgagucucuucuccacug

SEQ ID NO: 2118340 - RNA, 18 nt, Human
uaccgagucucuucucca

SEQ ID NO: 2118341 - RNA, 17 nt, Human
uaccgagucucuucucc

SEQ ID NO: 2118342 - RNA, 13 nt, Human
uacccagcccauc

SEQ ID NO: 2118343 - RNA, 14 nt, Human
uacccagcccaucu

SEQ ID NO: 2118344 - RNA, 15 nt, Human
uacccagcccaucuu

SEQ ID NO: 2118345 - RNA, 16 nt, Human
uacccagcccaucuug

SEQ ID NO: 2118346 - RNA, 22 nt, Human
uacccagcccaucuugccucca

SEQ ID NO: 2118347 - RNA, 22 nt, Human
uaccgagucucuucuccacugg

SEQ ID NO: 2118348 - RNA, 19 nt, Human
uaccuaaaaggaaaucuca

SEQ ID NO: 2118349 - RNA, 22 nt, Human
uaccuaaaaggaaaucucaccc

SEQ ID NO: 2118350 - RNA, 23 nt, Human
uaccuaaaaggaaaucucacccc

SEQ ID NO: 2118351 - RNA, 21 nt, Human
uacccacuucuaaauagcaau

SEQ ID NO: 2118352 - RNA, 18 nt, Human
uacccagaaugucagauu

SEQ ID NO: 2118353 - RNA, 22 nt, Human
uacccagaaugucagauuccuu

SEQ ID NO: 2118354 - RNA, 15 nt, Human
uacccacugcucugg

SEQ ID NO: 2118355 - RNA, 16 nt, Human
uacauggccaguguga

SEQ ID NO: 2118356 - RNA, 13 nt, Human
uacucuaauucua

SEQ ID NO: 2118357 - RNA, 14 nt, Human
uacucuaauucuaa

SEQ ID NO: 2118358 - RNA, 15 nt, Human
uacucuaauucuaac

SEQ ID NO: 2118359 - RNA, 16 nt, Human
uacucuaauucuaacc

SEQ ID NO: 2118360 - RNA, 21 nt, Human
uacucuaauucuaaccagagc

SEQ ID NO: 2118361 - RNA, 16 nt, Human
uacucuacccucuuag

SEQ ID NO: 2118362 - RNA, 22 nt, Human
uacugcagccuuugccuccccg

SEQ ID NO: 2118363 - RNA, 11 nt, Human
uacugccaaag

SEQ ID NO: 2118364 - RNA, 17 nt, Human
uacugcagccuccagag

SEQ ID NO: 2118365 - RNA, 20 nt, Human
uacugcagccuuugccuccc

SEQ ID NO: 2118366 - RNA, 12 nt, Human
uacugcagccuc

SEQ ID NO: 2118367 - RNA, 22 nt, Human
uacugcccaggccugccuguuc

SEQ ID NO: 2118368 - RNA, 21 nt, Human
uacugcccaggccugccuguu

SEQ ID NO: 2118369 - RNA, 20 nt, Human
uacugcccaggccugccugu

SEQ ID NO: 2118370 - RNA, 19 nt, Human
uacugcccaggccugccug

SEQ ID NO: 2118371 - RNA, 21 nt, Human
uacugccucuacaguuaauag

SEQ ID NO: 2118372 - RNA, 22 nt, Human
uacugcccggggcagcugccag

SEQ ID NO: 2118373 - RNA, 19 nt, Human
uacugcccggggcagcugc

SEQ ID NO: 2118374 - RNA, 10 nt, Human
uacuccccuu

SEQ ID NO: 2118375 - RNA, 22 nt, Human
uacucccucaaagcacacguca

SEQ ID NO: 2118376 - RNA, 15 nt, Human
uacuccccuugagcu

SEQ ID NO: 2118377 - RNA, 16 nt, Human
uacuccccuugagcug

SEQ ID NO: 2118378 - RNA, 12 nt, Human
uacuccucccag

SEQ ID NO: 2118379 - RNA, 14 nt, Human
uacuccuaccucag

SEQ ID NO: 2118380 - RNA, 15 nt, Human
uacuccuaccucagc

SEQ ID NO: 2118381 - RNA, 16 nt, Human
uacuccuaccucagcc

SEQ ID NO: 2118382 - RNA, 17 nt, Human
uacuccuaccucagccu

SEQ ID NO: 2118383 - RNA, 14 nt, Human
uacucauucaggga

SEQ ID NO: 2118384 - RNA, 18 nt, Human
uacuacaguucuuuuguu

SEQ ID NO: 2118385 - RNA, 21 nt, Human
uacuacaguuguuuuuugaaa

SEQ ID NO: 2118386 - RNA, 23 nt, Human
uacuacaguuguuuuuugaaaac

SEQ ID NO: 2118387 - RNA, 15 nt, Human
uacuaauuaacauau

SEQ ID NO: 2118388 - RNA, 19 nt, Human
uacuaauuaacauauaaua

SEQ ID NO: 2118389 - RNA, 23 nt, Human
uacuaauuaacauauaauauaug

SEQ ID NO: 2118390 - RNA, 16 nt, Human
uacuacaaaaaaguug

SEQ ID NO: 2118391 - RNA, 16 nt, Human
uacuaaugauguuuuc

SEQ ID NO: 2118392 - RNA, 13 nt, Human
uacuaaugauguu

SEQ ID NO: 2118393 - RNA, 14 nt, Human
uacuaaugauguuu

SEQ ID NO: 2118394 - RNA, 15 nt, Human
uacuaaugauguuuu

SEQ ID NO: 2118395 - RNA, 13 nt, Human
uacuuguggacac

SEQ ID NO: 2118396 - RNA, 15 nt, Human
uacugcuuuuaacuu

SEQ ID NO: 2118397 - RNA, 17 nt, Human
uacuuaaaugaaagcau

SEQ ID NO: 2118398 - RNA, 18 nt, Human
uacuuaaaugaaagcaug

SEQ ID NO: 2118399 - RNA, 13 nt, Human
uacuuaauaaauu

SEQ ID NO: 2118400 - RNA, 22 nt, Human
uacugcuucuaccaacuggaag

SEQ ID NO: 2118401 - RNA, 23 nt, Human
uacugcuucuaccaacuggaagc

SEQ ID NO: 2118402 - RNA, 16 nt, Human
uacuguccuacccacc

SEQ ID NO: 2118403 - RNA, 16 nt, Human
uacuguggaaaaauau

SEQ ID NO: 2118404 - RNA, 19 nt, Human
uacuguggaaaaauauuua

SEQ ID NO: 2118405 - RNA, 20 nt, Human
uacuguggaaaaauauuuaa

SEQ ID NO: 2118406 - RNA, 12 nt, Human
uacugucuuaau

SEQ ID NO: 2118407 - RNA, 13 nt, Human
uacugucuuaauu

SEQ ID NO: 2118408 - RNA, 14 nt, Human
uacugucuuaauua

SEQ ID NO: 2118409 - RNA, 15 nt, Human
uacugucuuaauuaa

SEQ ID NO: 2118410 - RNA, 19 nt, Human
uacugucuuaauuaaguaa

SEQ ID NO: 2118411 - RNA, 20 nt, Human
uacugucuuaauuaaguaaa

SEQ ID NO: 2118412 - RNA, 21 nt, Human
uacugucuucaguaagccgug

SEQ ID NO: 2118413 - RNA, 11 nt, Human
uacugucaaua

SEQ ID NO: 2118414 - RNA, 13 nt, Human
uacugucaauaaa

SEQ ID NO: 2118415 - RNA, 14 nt, Human
uacugucaauaaac

SEQ ID NO: 2118416 - RNA, 15 nt, Human
uacugucaauaaaca

SEQ ID NO: 2118417 - RNA, 16 nt, Human
uacugucaauaaacag

SEQ ID NO: 2118418 - RNA, 22 nt, Human
uacuguguuccuggcaauagug

SEQ ID NO: 2118419 - RNA, 12 nt, Human
uacuguguuccu

SEQ ID NO: 2118420 - RNA, 13 nt, Human
uacuguguuccug

SEQ ID NO: 2118421 - RNA, 14 nt, Human
uacuguguuccugg

SEQ ID NO: 2118422 - RNA, 16 nt, Human
uacuguguuccuggca

SEQ ID NO: 2118423 - RNA, 19 nt, Human
uacuguguuccuggcaaua

SEQ ID NO: 2118424 - RNA, 17 nt, Human
uacacugaauauuuaua

SEQ ID NO: 2118425 - RNA, 18 nt, Human
uacacugaauauuuauau

SEQ ID NO: 2118426 - RNA, 20 nt, Human
uacacugaaguuaacagaga

SEQ ID NO: 2118427 - RNA, 12 nt, Human
uacacucuuaua

SEQ ID NO: 2118428 - RNA, 13 nt, Human
uacacucuuauag

SEQ ID NO: 2118429 - RNA, 21 nt, Human
uacacucucaaagcaaauaau

SEQ ID NO: 2118430 - RNA, 13 nt, Human
uacacucuccugg

SEQ ID NO: 2118431 - RNA, 14 nt, Human
uacacucuccuggg

SEQ ID NO: 2118432 - RNA, 15 nt, Human
uacacucuccugggc

SEQ ID NO: 2118433 - RNA, 17 nt, Human
uacacucuccugggccc

SEQ ID NO: 2118434 - RNA, 18 nt, Human
uacacucuccugggcccc

SEQ ID NO: 2118435 - RNA, 22 nt, Human
uacacucuccugggccccuccc

SEQ ID NO: 2118436 - RNA, 18 nt, Human
uacacauucaauaagcau

SEQ ID NO: 2118437 - RNA, 17 nt, Human
uacacacguuuguuucu

SEQ ID NO: 2118438 - RNA, 14 nt, Human
uacacaucuuccac

SEQ ID NO: 2118439 - RNA, 11 nt, Human
uacacaguugc

SEQ ID NO: 2118440 - RNA, 23 nt, Human
uacacauagcauguaaugguauc

SEQ ID NO: 2118441 - RNA, 16 nt, Human
uacacacacaaagaga

SEQ ID NO: 2118442 - RNA, 17 nt, Human
uacacacacaaagagag

SEQ ID NO: 2118443 - RNA, 19 nt, Human
uacacacacaaagagaguu

SEQ ID NO: 2118444 - RNA, 11 nt, Human
uacacacacac

SEQ ID NO: 2118445 - RNA, 21 nt, Human
uacaauuguaaaacugaggca

SEQ ID NO: 2118446 - RNA, 17 nt, Human
uacaauuguaaaacuga

SEQ ID NO: 2118447 - RNA, 14 nt, Human
uacaauugaacuua

SEQ ID NO: 2118448 - RNA, 20 nt, Human
uacaauugaacuuaaauaaa

SEQ ID NO: 2118449 - RNA, 17 nt, Human
uacaagaaaaaaugaau

SEQ ID NO: 2118450 - RNA, 14 nt, Human
uacaacuucaagug

SEQ ID NO: 2118451 - RNA, 18 nt, Human
uacaacuuaaauaauaaa

SEQ ID NO: 2118452 - RNA, 19 nt, Human
uacaaauugcuugaaagaa

SEQ ID NO: 2118453 - RNA, 16 nt, Human
uacaaauugcuugaaa

SEQ ID NO: 2118454 - RNA, 16 nt, Human
uacaaauuuguuauuu

SEQ ID NO: 2118455 - RNA, 21 nt, Human
uaauucuaaggaauaugagcu

SEQ ID NO: 2118456 - RNA, 16 nt, Human
uaauuagguuaacuau

SEQ ID NO: 2118457 - RNA, 17 nt, Human
uaauuagguuaacuaug

SEQ ID NO: 2118458 - RNA, 22 nt, Human
uaauuagguuaacuauguacaa

SEQ ID NO: 2118459 - RNA, 13 nt, Human
uaauucuaaccag

SEQ ID NO: 2118460 - RNA, 16 nt, Human
uaauucuaaccagagc

SEQ ID NO: 2118461 - RNA, 17 nt, Human
uaauucuaaccagagca

SEQ ID NO: 2118462 - RNA, 19 nt, Human
uaauucuaaccagagcaag

SEQ ID NO: 2118463 - RNA, 22 nt, Human
uaauucuaaccagagcaagcuu

SEQ ID NO: 2118464 - RNA, 23 nt, Human
uaauucuaaccagagcaagcuuu

SEQ ID NO: 2118465 - RNA, 13 nt, Human
uaauucuaaggaa

SEQ ID NO: 2118466 - RNA, 18 nt, Human
uaauuagggguugcuaag

SEQ ID NO: 2118467 - RNA, 17 nt, Human
uaauuagggguugcuaa

SEQ ID NO: 2118468 - RNA, 13 nt, Human
uaauuagguuaac

SEQ ID NO: 2118469 - RNA, 13 nt, Human
uaauuuuuaaagu

SEQ ID NO: 2118470 - RNA, 16 nt, Human
uaauuuuuacagaauu

SEQ ID NO: 2118471 - RNA, 17 nt, Human
uaauuuuuacagaauug

SEQ ID NO: 2118472 - RNA, 12 nt, Human
uacaaacauauu

SEQ ID NO: 2118473 - RNA, 15 nt, Human
uacaaacauauuugu

SEQ ID NO: 2118474 - RNA, 22 nt, Human
uaauuuuuacagaauugcuugu

SEQ ID NO: 2118475 - RNA, 13 nt, Human
uacaaaggaaaaa

SEQ ID NO: 2118476 - RNA, 14 nt, Human
uacaaaggaaaaag

SEQ ID NO: 2118477 - RNA, 18 nt, Human
uacaaaggcuuauuaauu

SEQ ID NO: 2118478 - RNA, 17 nt, Human
uacaaacaugugguuaa

SEQ ID NO: 2118479 - RNA, 11 nt, Human
uacaaacugca

SEQ ID NO: 2118480 - RNA, 12 nt, Human
uacaaacugcaa

SEQ ID NO: 2118481 - RNA, 13 nt, Human
uacaaacugcaau

SEQ ID NO: 2118482 - RNA, 14 nt, Human
uacaaacugcaaua

SEQ ID NO: 2118483 - RNA, 17 nt, Human
uacaaacugcaauagag

SEQ ID NO: 2118484 - RNA, 22 nt, Human
uacaaacugcaauagagacugu

SEQ ID NO: 2118485 - RNA, 14 nt, Human
uacaaaguagaagu

SEQ ID NO: 2118486 - RNA, 18 nt, Human
uacaaaguagaagucuua

SEQ ID NO: 2118487 - RNA, 23 nt, Human
uacaaauacucuuaggaagagaa

SEQ ID NO: 2118488 - RNA, 19 nt, Human
uacaaauacucuuaggaag

SEQ ID NO: 2118489 - RNA, 17 nt, Human
uacaaauacucuuagga

SEQ ID NO: 2118490 - RNA, 12 nt, Human
uacaaauacucu

SEQ ID NO: 2118491 - RNA, 17 nt, Human
uacaaaguguauuuuau

SEQ ID NO: 2118492 - RNA, 20 nt, Human
uacaaaguguauuuuauaaa

SEQ ID NO: 2118493 - RNA, 23 nt, Human
uacaaaguguauuuuauaaaauu

SEQ ID NO: 2118494 - RNA, 15 nt, Human
uacaggagugagcac

SEQ ID NO: 2118495 - RNA, 20 nt, Human
uacaguuguuuuuugaaaac

SEQ ID NO: 2118496 - RNA, 20 nt, Human
uacaguugaaaaacagcuga

SEQ ID NO: 2118497 - RNA, 21 nt, Human
uacaguugggaaaauaugucc

SEQ ID NO: 2118498 - RNA, 17 nt, Human
uacaguugaaaaacagc

SEQ ID NO: 2118499 - RNA, 19 nt, Human
uacaguugaaaaacagcug

SEQ ID NO: 2118500 - RNA, 18 nt, Human
uacagcuaaucagcauuc

SEQ ID NO: 2118501 - RNA, 16 nt, Human
uacagcuaaucagcau

SEQ ID NO: 2118502 - RNA, 16 nt, Human
uacacuuacacuuuau

SEQ ID NO: 2118503 - RNA, 16 nt, Human
uacacuguuagaacac

SEQ ID NO: 2118504 - RNA, 17 nt, Human
uacacuguuagaacacu

SEQ ID NO: 2118505 - RNA, 18 nt, Human
uacacuguuagaacacua

SEQ ID NO: 2118506 - RNA, 19 nt, Human
uacacuguuagaacacuau

SEQ ID NO: 2118507 - RNA, 20 nt, Human
uacacuguuagaacacuauu

SEQ ID NO: 2118508 - RNA, 21 nt, Human
uacacuguuagaacacuauuu

SEQ ID NO: 2118509 - RNA, 23 nt, Human
uacacuguuagaacacuauuuuc

SEQ ID NO: 2118510 - RNA, 13 nt, Human
uacagcugccugc

SEQ ID NO: 2118511 - RNA, 14 nt, Human
uacagcugccugca

SEQ ID NO: 2118512 - RNA, 18 nt, Human
uacaggaagguagaaaua

SEQ ID NO: 2118513 - RNA, 13 nt, Human
uacauaaaggugg

SEQ ID NO: 2118514 - RNA, 19 nt, Human
uacauaacaggguaaauua

SEQ ID NO: 2118515 - RNA, 23 nt, Human
uacauaacaggguaaauuauuca

SEQ ID NO: 2118516 - RNA, 21 nt, Human
uacauaaaggugguaugugug

SEQ ID NO: 2118517 - RNA, 14 nt, Human
uacaguuuuaaaga

SEQ ID NO: 2118518 - RNA, 16 nt, Human
uacaguuuuaaagaau

SEQ ID NO: 2118519 - RNA, 14 nt, Human
uacaguuuuccuaa

SEQ ID NO: 2118520 - RNA, 15 nt, Human
uacaguuuuccuaaa

SEQ ID NO: 2118521 - RNA, 19 nt, Human
uacaguuuuccuaaaugua

SEQ ID NO: 2118522 - RNA, 22 nt, Human
uacaguuuuccuaaauguauac

SEQ ID NO: 2118523 - RNA, 20 nt, Human
uacaucuuucacauuggcua

SEQ ID NO: 2118524 - RNA, 16 nt, Human
uacauaagauaaaugu

SEQ ID NO: 2118525 - RNA, 17 nt, Human
uacauaagauaaaugug

SEQ ID NO: 2118526 - RNA, 22 nt, Human
uacaugcagcccaugcccaccu

SEQ ID NO: 2118527 - RNA, 14 nt, Human
uacaugcagcccau

SEQ ID NO: 2118528 - RNA, 17 nt, Human
uacaugcagcccaugcc

SEQ ID NO: 2118529 - RNA, 21 nt, Human
uacaugcauacacucucaaag

SEQ ID NO: 2118530 - RNA, 20 nt, Human
uacaugcauacacucucaaa

SEQ ID NO: 2118531 - RNA, 14 nt, Human
uacaugcauacacu

SEQ ID NO: 2118532 - RNA, 14 nt, Human
uacaugcauuugag

SEQ ID NO: 2118533 - RNA, 14 nt, Human
uacauggaauaaca

SEQ ID NO: 2118534 - RNA, 18 nt, Human
uacauggaauaacaugua

SEQ ID NO: 2118535 - RNA, 19 nt, Human
uacauggaauaacauguaa

SEQ ID NO: 2118536 - RNA, 22 nt, Human
uacauggaauaacauguaauua

SEQ ID NO: 2118537 - RNA, 23 nt, Human
ugaaucacguaaagcuagaaaug

SEQ ID NO: 2118538 - RNA, 16 nt, Human
ugaaucagacccuacc

SEQ ID NO: 2118539 - RNA, 18 nt, Human
ugaaucagacccuacccc

SEQ ID NO: 2118540 - RNA, 21 nt, Human
ugaaucagacccuaccccacc

SEQ ID NO: 2118541 - RNA, 22 nt, Human
ugaaucagacccuaccccacca

SEQ ID NO: 2118542 - RNA, 19 nt, Human
ugaaucaugguuuuucuua

SEQ ID NO: 2118543 - RNA, 15 nt, Human
ugaauccuaagggcu

SEQ ID NO: 2118544 - RNA, 22 nt, Human
ugaauccuaagggcuggucucu

SEQ ID NO: 2118545 - RNA, 17 nt, Human
ugaaucacguaaagcua

SEQ ID NO: 2118546 - RNA, 19 nt, Human
ugaaggcuuucagggccuc

SEQ ID NO: 2118547 - RNA, 15 nt, Human
ugaaguuucauuuau

SEQ ID NO: 2118548 - RNA, 21 nt, Human
ugaaguuucauuuaugauaca

SEQ ID NO: 2118549 - RNA, 17 nt, Human
ugaaguuuacaaucaaa

SEQ ID NO: 2118550 - RNA, 14 nt, Human
ugaaguuuauacag

SEQ ID NO: 2118551 - RNA, 16 nt, Human
ugaaguuuauacagua

SEQ ID NO: 2118552 - RNA, 19 nt, Human
ugaaguuuauacaguacag

SEQ ID NO: 2118553 - RNA, 20 nt, Human
ugaaguuuauacaguacagu

SEQ ID NO: 2118554 - RNA, 14 nt, Human
ugaaugcauaaaau

SEQ ID NO: 2118555 - RNA, 23 nt, Human
ugaaugaugauccuaggcauuug

SEQ ID NO: 2118556 - RNA, 19 nt, Human
ugaaugauuuccaaagaga

SEQ ID NO: 2118557 - RNA, 19 nt, Human
ugaaugcacacuagccucu

SEQ ID NO: 2118558 - RNA, 16 nt, Human
ugaaucuuggugucua

SEQ ID NO: 2118559 - RNA, 22 nt, Human
ugaaucugcauuuucuggguuc

SEQ ID NO: 2118560 - RNA, 14 nt, Human
ugaaucucaauuug

SEQ ID NO: 2118561 - RNA, 15 nt, Human
ugaaucucaauuuga

SEQ ID NO: 2118562 - RNA, 12 nt, Human
ugaaucuauugg

SEQ ID NO: 2118563 - RNA, 18 nt, Human
ugaacuucagcuagagcu

SEQ ID NO: 2118564 - RNA, 20 nt, Human
ugaagacucauucuucugua

SEQ ID NO: 2118565 - RNA, 19 nt, Human
ugaagacucauucuucugu

SEQ ID NO: 2118566 - RNA, 17 nt, Human
ugaacuuaaauaaaugu

SEQ ID NO: 2118567 - RNA, 22 nt, Human
ugaacuuaaauaaaugucauua

SEQ ID NO: 2118568 - RNA, 23 nt, Human
ugaacuggguacuuguggacaca

SEQ ID NO: 2118569 - RNA, 21 nt, Human
ugaaacaggagagaaagggga

SEQ ID NO: 2118570 - RNA, 20 nt, Human
ugaaacaggagagaaagggg

SEQ ID NO: 2118571 - RNA, 19 nt, Human
ugaaggccgagaagcaaga

SEQ ID NO: 2118572 - RNA, 13 nt, Human
ugaaggaaagauu

SEQ ID NO: 2118573 - RNA, 16 nt, Human
ugaaggaaagauuugu

SEQ ID NO: 2118574 - RNA, 21 nt, Human
ugaaggaaauaaaaaagucuc

SEQ ID NO: 2118575 - RNA, 23 nt, Human
ugaaggaaauaaaaaagucucua

SEQ ID NO: 2118576 - RNA, 16 nt, Human
ugaagagugagagggc

SEQ ID NO: 2118577 - RNA, 17 nt, Human
ugaagagugagagggca

SEQ ID NO: 2118578 - RNA, 18 nt, Human
ugaagagugagagggcau

SEQ ID NO: 2118579 - RNA, 19 nt, Human
ugaagaguggguuucacaa

SEQ ID NO: 2118580 - RNA, 16 nt, Human
ugaagagauccuucug

SEQ ID NO: 2118581 - RNA, 23 nt, Human
ugaagagaccaagacucugaaau

SEQ ID NO: 2118582 - RNA, 20 nt, Human
ugacaagucauuuuaacuuu

SEQ ID NO: 2118583 - RNA, 14 nt, Human
ugacaagucauuuu

SEQ ID NO: 2118584 - RNA, 17 nt, Human
ugacaaggccccagaga

SEQ ID NO: 2118585 - RNA, 18 nt, Human
ugacaaggccccagagac

SEQ ID NO: 2118586 - RNA, 22 nt, Human
ugacaaggccccagagacucag

SEQ ID NO: 2118587 - RNA, 23 nt, Human
ugacaaggauugcuacuguccua

SEQ ID NO: 2118588 - RNA, 13 nt, Human
ugacaaggcccca

SEQ ID NO: 2118589 - RNA, 14 nt, Human
ugacaaggccccag

SEQ ID NO: 2118590 - RNA, 15 nt, Human
ugacaaggccccaga

SEQ ID NO: 2118591 - RNA, 16 nt, Human
ugacaaggccccagag

SEQ ID NO: 2118592 - RNA, 23 nt, Human
ugacaaccaccgcuccccagccc

SEQ ID NO: 2118593 - RNA, 20 nt, Human
ugacaaccaccgcuccccag

SEQ ID NO: 2118594 - RNA, 21 nt, Human
ugacaaccaccgcuccccagc

SEQ ID NO: 2118595 - RNA, 13 nt, Human
ugacagacacagg

SEQ ID NO: 2118596 - RNA, 16 nt, Human
ugacagacacaggccc

SEQ ID NO: 2118597 - RNA, 14 nt, Human
ugacagacacaggc

SEQ ID NO: 2118598 - RNA, 15 nt, Human
ugacacacagcucug

SEQ ID NO: 2118599 - RNA, 14 nt, Human
ugacacacagcucu

SEQ ID NO: 2118600 - RNA, 15 nt, Human
ugaauuguccccagu

SEQ ID NO: 2118601 - RNA, 20 nt, Human
ugaauuaaugacagagccag

SEQ ID NO: 2118602 - RNA, 21 nt, Human
ugaauuaaugacagagccagu

SEQ ID NO: 2118603 - RNA, 11 nt, Human
ugaauuaaauu

SEQ ID NO: 2118604 - RNA, 15 nt, Human
ugaauuaaauuuaau

SEQ ID NO: 2118605 - RNA, 16 nt, Human
ugaauuaaauuaggaa

SEQ ID NO: 2118606 - RNA, 14 nt, Human
ugaaucuugcguuu

SEQ ID NO: 2118607 - RNA, 17 nt, Human
ugaauugugaccaaguu

SEQ ID NO: 2118608 - RNA, 23 nt, Human
ugacaaauguguaucggaugcuu

SEQ ID NO: 2118609 - RNA, 14 nt, Human
ugacaaaucaaguu

SEQ ID NO: 2118610 - RNA, 15 nt, Human
ugacaaaucaaguuu

SEQ ID NO: 2118611 - RNA, 19 nt, Human
ugacaaaucaaguuuccaa

SEQ ID NO: 2118612 - RNA, 20 nt, Human
ugacaaaucaaguuuccaag

SEQ ID NO: 2118613 - RNA, 19 nt, Human
ugacaaccaccgcucccca

SEQ ID NO: 2118614 - RNA, 16 nt, Human
ugacaaccaccgcucc

SEQ ID NO: 2118615 - RNA, 17 nt, Human
ugacauccaagcuuccu

SEQ ID NO: 2118616 - RNA, 17 nt, Human
ugacaucaguggcaugg

SEQ ID NO: 2118617 - RNA, 14 nt, Human
ugacaucagcauca

SEQ ID NO: 2118618 - RNA, 23 nt, Human
ugacaucaguggcauggcuccag

SEQ ID NO: 2118619 - RNA, 13 nt, Human
ugacauccaagcu

SEQ ID NO: 2118620 - RNA, 12 nt, Human
ugacaucucuuu

SEQ ID NO: 2118621 - RNA, 13 nt, Human
ugacaucucuuug

SEQ ID NO: 2118622 - RNA, 14 nt, Human
ugacaucucuuuga

SEQ ID NO: 2118623 - RNA, 15 nt, Human
ugacauauuuuugcu

SEQ ID NO: 2118624 - RNA, 18 nt, Human
ugacagacacaggcccgg

SEQ ID NO: 2118625 - RNA, 17 nt, Human
ugacagacacaggcccg

SEQ ID NO: 2118626 - RNA, 18 nt, Human
ugacagagcaagacucug

SEQ ID NO: 2118627 - RNA, 22 nt, Human
ugacagagcaagugagacccug

SEQ ID NO: 2118628 - RNA, 12 nt, Human
ugacagagccag

SEQ ID NO: 2118629 - RNA, 21 nt, Human
ugacagagcaagacucugucu

SEQ ID NO: 2118630 - RNA, 14 nt, Human
ugacauguggaaag

SEQ ID NO: 2118631 - RNA, 17 nt, Human
ugacauguggaaaguga

SEQ ID NO: 2118632 - RNA, 21 nt, Human
ugacauguggaaagugaauuu

SEQ ID NO: 2118633 - RNA, 22 nt, Human
ugacauguggaaagugaauuug

SEQ ID NO: 2118634 - RNA, 19 nt, Human
ugacaugcgggcugggcag

SEQ ID NO: 2118635 - RNA, 20 nt, Human
ugacaugcgggcugggcagc

SEQ ID NO: 2118636 - RNA, 21 nt, Human
ugacaugcgggcugggcagcu

SEQ ID NO: 2118637 - RNA, 22 nt, Human
ugacaugcgggcugggcagcug

SEQ ID NO: 2118638 - RNA, 16 nt, Human
ugacaucuucaaagcu

SEQ ID NO: 2118639 - RNA, 14 nt, Human
ugacaugaucgcuu

SEQ ID NO: 2118640 - RNA, 15 nt, Human
ugacaugaucgcuuu

SEQ ID NO: 2118641 - RNA, 17 nt, Human
ugacaucuuaguauuug

SEQ ID NO: 2118642 - RNA, 17 nt, Human
ugacaugcgggcugggc

SEQ ID NO: 2118643 - RNA, 18 nt, Human
ugacaugcgggcugggca

SEQ ID NO: 2118644 - RNA, 22 nt, Human
ugaccagccuccaugcugccuc

SEQ ID NO: 2118645 - RNA, 19 nt, Human
ugaccauccacucuacccu

SEQ ID NO: 2118646 - RNA, 22 nt, Human
ugaccauccacucuacccuccc

SEQ ID NO: 2118647 - RNA, 23 nt, Human
ugaccauccacucuacccuccca

SEQ ID NO: 2118648 - RNA, 21 nt, Human
ugaccagccuccaugcugccu

SEQ ID NO: 2118649 - RNA, 22 nt, Human
ugaccagcagaucccagcucac

SEQ ID NO: 2118650 - RNA, 15 nt, Human
ugacaugugucaagc

SEQ ID NO: 2118651 - RNA, 18 nt, Human
ugaccagcacugucucag

SEQ ID NO: 2118652 - RNA, 17 nt, Human
ugaccagcagaucccag

SEQ ID NO: 2118653 - RNA, 18 nt, Human
ugaccagcagaucccagc

SEQ ID NO: 2118654 - RNA, 20 nt, Human
ugaccagcagaucccagcuc

SEQ ID NO: 2118655 - RNA, 21 nt, Human
ugaccagcagaucccagcuca

SEQ ID NO: 2118656 - RNA, 19 nt, Human
ugacucuuggcacagcaug

SEQ ID NO: 2118657 - RNA, 14 nt, Human
ugacucuuggcaca

SEQ ID NO: 2118658 - RNA, 20 nt, Human
ugacucuuguuuucaguuuc

SEQ ID NO: 2118659 - RNA, 15 nt, Human
ugacugccccaacuc

SEQ ID NO: 2118660 - RNA, 16 nt, Human
ugacugccccaacucc

SEQ ID NO: 2118661 - RNA, 17 nt, Human
ugacugccccaacuccu

SEQ ID NO: 2118662 - RNA, 19 nt, Human
ugacugccccaacuccugg

SEQ ID NO: 2118663 - RNA, 20 nt, Human
ugacugccccaacuccugga

SEQ ID NO: 2118664 - RNA, 15 nt, Human
ugacugcugauucuc

SEQ ID NO: 2118665 - RNA, 14 nt, Human
ugacuggaauuuuu

SEQ ID NO: 2118666 - RNA, 19 nt, Human
ugacuggaauuuuuauuau

SEQ ID NO: 2118667 - RNA, 23 nt, Human
ugacuggaauuuuuauuaugcau

SEQ ID NO: 2118668 - RNA, 15 nt, Human
ugacuggcacagucu

SEQ ID NO: 2118669 - RNA, 13 nt, Human
ugacuuucucagc

SEQ ID NO: 2118670 - RNA, 16 nt, Human
ugacuuugcucuuucu

SEQ ID NO: 2118671 - RNA, 21 nt, Human
ugacuggguuucucuguauag

SEQ ID NO: 2118672 - RNA, 13 nt, Human
ugacuuucaggua

SEQ ID NO: 2118673 - RNA, 15 nt, Human
ugacuaaaaaacaaa

SEQ ID NO: 2118674 - RNA, 22 nt, Human
ugacuaaaaaacaaagaagaca

SEQ ID NO: 2118675 - RNA, 14 nt, Human
ugacuaaaaauauu

SEQ ID NO: 2118676 - RNA, 22 nt, Human
ugacuaaaaauauuauaacuua

SEQ ID NO: 2118677 - RNA, 16 nt, Human
ugacuaaagagagaau

SEQ ID NO: 2118678 - RNA, 17 nt, Human
ugacuaaagagagaaug

SEQ ID NO: 2118679 - RNA, 20 nt, Human
ugacuacagacauuaaauaa

SEQ ID NO: 2118680 - RNA, 16 nt, Human
ugagaccucagccaug

SEQ ID NO: 2118681 - RNA, 18 nt, Human
ugagacauuccaaaacga

SEQ ID NO: 2118682 - RNA, 14 nt, Human
ugagaccaaccugg

SEQ ID NO: 2118683 - RNA, 17 nt, Human
ugagaccucagccauga

SEQ ID NO: 2118684 - RNA, 19 nt, Human
ugagaccucagccaugagg

SEQ ID NO: 2118685 - RNA, 14 nt, Human
ugagaggggaacag

SEQ ID NO: 2118686 - RNA, 18 nt, Human
ugagaggggaacagacug

SEQ ID NO: 2118687 - RNA, 17 nt, Human
ugagagggcaugcgcac

SEQ ID NO: 2118688 - RNA, 22 nt, Human
ugagagggcaugcgcacaaggc

SEQ ID NO: 2118689 - RNA, 23 nt, Human
ugagcagacuggugagcagacug

SEQ ID NO: 2118690 - RNA, 22 nt, Human
ugagcagggagauccugguugg

SEQ ID NO: 2118691 - RNA, 15 nt, Human
ugagauagaagaacu

SEQ ID NO: 2118692 - RNA, 16 nt, Human
ugagauagaagaacug

SEQ ID NO: 2118693 - RNA, 19 nt, Human
ugagauagaagaacugcaa

SEQ ID NO: 2118694 - RNA, 21 nt, Human
ugagauagaagaacugcaaag

SEQ ID NO: 2118695 - RNA, 23 nt, Human
ugagauaguagcauacauuuaua

SEQ ID NO: 2118696 - RNA, 19 nt, Human
ugagauaguagcauacauu

SEQ ID NO: 2118697 - RNA, 14 nt, Human
ugagauagaagaug

SEQ ID NO: 2118698 - RNA, 16 nt, Human
ugagauagaagauguu

SEQ ID NO: 2118699 - RNA, 18 nt, Human
ugagauagaagauguuug

SEQ ID NO: 2118700 - RNA, 19 nt, Human
ugagauagaagauguuugc

SEQ ID NO: 2118701 - RNA, 22 nt, Human
ugacuuuucuguccgagcuuug

SEQ ID NO: 2118702 - RNA, 20 nt, Human
ugacuuuuaaggcuaaaacu

SEQ ID NO: 2118703 - RNA, 21 nt, Human
ugagaaaacgaaacugcucua

SEQ ID NO: 2118704 - RNA, 21 nt, Human
ugagaaaacguuuuguuugaa

SEQ ID NO: 2118705 - RNA, 15 nt, Human
ugagaaauaaaguuu

SEQ ID NO: 2118706 - RNA, 23 nt, Human
ugagaaaccuuauuguaccucuc

SEQ ID NO: 2118707 - RNA, 17 nt, Human
ugagcugagaucgugcc

SEQ ID NO: 2118708 - RNA, 14 nt, Human
ugagcugagcaggg

SEQ ID NO: 2118709 - RNA, 19 nt, Human
ugagcugagaucgugccgu

SEQ ID NO: 2118710 - RNA, 13 nt, Human
ugagcugagcagg

SEQ ID NO: 2118711 - RNA, 20 nt, Human
ugagcucagacccccacucu

SEQ ID NO: 2118712 - RNA, 22 nt, Human
ugagcucagacccccacucuca

SEQ ID NO: 2118713 - RNA, 15 nt, Human
ugagcucauguagca

SEQ ID NO: 2118714 - RNA, 12 nt, Human
ugagcuccagac

SEQ ID NO: 2118715 - RNA, 16 nt, Human
ugagcuccagaccccc

SEQ ID NO: 2118716 - RNA, 17 nt, Human
ugagcuccagaccccca

SEQ ID NO: 2118717 - RNA, 13 nt, Human
ugagcuccagacc

SEQ ID NO: 2118718 - RNA, 14 nt, Human
ugagcuccagaccc

SEQ ID NO: 2118719 - RNA, 15 nt, Human
ugagcuccagacccc

SEQ ID NO: 2118720 - RNA, 16 nt, Human
ugagcucagaccccca

SEQ ID NO: 2118721 - RNA, 17 nt, Human
ugagcucagacccccac

SEQ ID NO: 2118722 - RNA, 18 nt, Human
ugagcucagacccccacu

SEQ ID NO: 2118723 - RNA, 19 nt, Human
ugagcucagacccccacuc

SEQ ID NO: 2118724 - RNA, 11 nt, Human
ugagcucagga

SEQ ID NO: 2118725 - RNA, 19 nt, Human
ugagcucaggaguuugaga

SEQ ID NO: 2118726 - RNA, 22 nt, Human
ugagccgagaucacgccacugc

SEQ ID NO: 2118727 - RNA, 23 nt, Human
ugagcagggcucagcggggacag

SEQ ID NO: 2118728 - RNA, 22 nt, Human
ugagcagggcucagcggggaca

SEQ ID NO: 2118729 - RNA, 20 nt, Human
ugagcagggcucagcgggga

SEQ ID NO: 2118730 - RNA, 17 nt, Human
ugagccgcaucuucucc

SEQ ID NO: 2118731 - RNA, 20 nt, Human
ugagccgcaucuucuccauc

SEQ ID NO: 2118732 - RNA, 21 nt, Human
ugagccgcaucuucuccaucu

SEQ ID NO: 2118733 - RNA, 23 nt, Human
ugagccgcaucuucuccaucugg

SEQ ID NO: 2118734 - RNA, 23 nt, Human
ugagccgagaucacgccacugca

SEQ ID NO: 2118735 - RNA, 13 nt, Human
ugaggauuucaag

SEQ ID NO: 2118736 - RNA, 14 nt, Human
ugaggcaagagaau

SEQ ID NO: 2118737 - RNA, 20 nt, Human
ugaggcaauaaaaaucauag

SEQ ID NO: 2118738 - RNA, 20 nt, Human
ugaggcaaccacaggcagca

SEQ ID NO: 2118739 - RNA, 16 nt, Human
ugaggauuucaagccu

SEQ ID NO: 2118740 - RNA, 16 nt, Human
ugaggagugugagaau

SEQ ID NO: 2118741 - RNA, 14 nt, Human
ugaggaguuuccua

SEQ ID NO: 2118742 - RNA, 19 nt, Human
ugaggaguuuccuaaaagu

SEQ ID NO: 2118743 - RNA, 21 nt, Human
ugaggaguuuccuaaaaguuc

SEQ ID NO: 2118744 - RNA, 15 nt, Human
ugaggaucagaaagu

SEQ ID NO: 2118745 - RNA, 16 nt, Human
ugaggaucagaaagua

SEQ ID NO: 2118746 - RNA, 17 nt, Human
ugaggaucagaaaguaa

SEQ ID NO: 2118747 - RNA, 17 nt, Human
ugaggaugucacucaga

SEQ ID NO: 2118748 - RNA, 16 nt, Human
ugaggaugggaaggag

SEQ ID NO: 2118749 - RNA, 20 nt, Human
ugaggaugggaaggagggag

SEQ ID NO: 2118750 - RNA, 18 nt, Human
ugaggaugcagagucagc

SEQ ID NO: 2118751 - RNA, 12 nt, Human
ugaggaugggaa

SEQ ID NO: 2118752 - RNA, 23 nt, Human
ugagcuuaagaauuuugagcagg

SEQ ID NO: 2118753 - RNA, 11 nt, Human
ugagcuguuuu

SEQ ID NO: 2118754 - RNA, 15 nt, Human
ugagcuguguucuug

SEQ ID NO: 2118755 - RNA, 16 nt, Human
ugagcugagcagggag

SEQ ID NO: 2118756 - RNA, 15 nt, Human
ugagcugccauccag

SEQ ID NO: 2118757 - RNA, 20 nt, Human
ugagcugccuguaacuugag

SEQ ID NO: 2118758 - RNA, 15 nt, Human
ugagcuuggccagaa

SEQ ID NO: 2118759 - RNA, 16 nt, Human
ugagcuuggccagaag

SEQ ID NO: 2118760 - RNA, 20 nt, Human
ugagcuuggcagcugaacua

SEQ ID NO: 2118761 - RNA, 13 nt, Human
ugagcuuggccag

SEQ ID NO: 2118762 - RNA, 14 nt, Human
ugagcuuggccaga

SEQ ID NO: 2118763 - RNA, 16 nt, Human
ugagcuucucugugaa

SEQ ID NO: 2118764 - RNA, 19 nt, Human
ugagcuuggcagcugaacu

SEQ ID NO: 2118765 - RNA, 15 nt, Human
ugagcuucucuguga

SEQ ID NO: 2118766 - RNA, 16 nt, Human
ugagcuuagugaaauu

SEQ ID NO: 2118767 - RNA, 15 nt, Human
ugagcuuaucaugcu

SEQ ID NO: 2118768 - RNA, 22 nt, Human
ugagguggucugaauguucuga

SEQ ID NO: 2118769 - RNA, 21 nt, Human
ugagguggucugaauguucug

SEQ ID NO: 2118770 - RNA, 21 nt, Human
ugagguggguuuucuucccau

SEQ ID NO: 2118771 - RNA, 13 nt, Human
ugagguggucuga

SEQ ID NO: 2118772 - RNA, 14 nt, Human
ugagguggucugaa

SEQ ID NO: 2118773 - RNA, 17 nt, Human
ugagguggucugaaugu

SEQ ID NO: 2118774 - RNA, 18 nt, Human
ugagguggucugaauguu

SEQ ID NO: 2118775 - RNA, 19 nt, Human
ugagguggucugaauguuc

SEQ ID NO: 2118776 - RNA, 20 nt, Human
ugagguggucugaauguucu

SEQ ID NO: 2118777 - RNA, 20 nt, Human
ugaggugggcagaucacgag

SEQ ID NO: 2118778 - RNA, 20 nt, Human
ugaggugcagagugcccaga

SEQ ID NO: 2118779 - RNA, 21 nt, Human
ugaggugcagagugcccagaa

SEQ ID NO: 2118780 - RNA, 19 nt, Human
ugaggucagagccugcagu

SEQ ID NO: 2118781 - RNA, 18 nt, Human
ugaggucagagccugcag

SEQ ID NO: 2118782 - RNA, 18 nt, Human
ugaggcugagacugcggg

SEQ ID NO: 2118783 - RNA, 19 nt, Human
ugaggcucuuucugggcca

SEQ ID NO: 2118784 - RNA, 13 nt, Human
ugaggcugagacu

SEQ ID NO: 2118785 - RNA, 17 nt, Human
ugaggugcagagugccc

SEQ ID NO: 2118786 - RNA, 17 nt, Human
ugaggugaaagggagcu

SEQ ID NO: 2118787 - RNA, 18 nt, Human
ugaggugaaagggagcua

SEQ ID NO: 2118788 - RNA, 13 nt, Human
ugaggucccaggc

SEQ ID NO: 2118789 - RNA, 21 nt, Human
ugaggucuuuugacaugugga

SEQ ID NO: 2118790 - RNA, 22 nt, Human
ugaggucuuuugacauguggaa

SEQ ID NO: 2118791 - RNA, 23 nt, Human
ugaggucuuuugacauguggaaa

SEQ ID NO: 2118792 - RNA, 15 nt, Human
ugaggugaaagggag

SEQ ID NO: 2118793 - RNA, 16 nt, Human
ugaggugaaagggagc

SEQ ID NO: 2118794 - RNA, 16 nt, Human
ugaggucaggaguucc

SEQ ID NO: 2118795 - RNA, 18 nt, Human
ugaggucauagcagugcu

SEQ ID NO: 2118796 - RNA, 23 nt, Human
ugaggcggguggaucaccugagg

SEQ ID NO: 2118797 - RNA, 16 nt, Human
ugaggcucuuucuggg

SEQ ID NO: 2118798 - RNA, 17 nt, Human
ugaggcucuuucugggc

SEQ ID NO: 2118799 - RNA, 18 nt, Human
ugaggcucuuucugggcc

SEQ ID NO: 2118800 - RNA, 18 nt, Human
ugaggcagaagaauugaa

SEQ ID NO: 2118801 - RNA, 24 nt, Human
ugaggcagacagcagcucaggcac

SEQ ID NO: 2118802 - RNA, 12 nt, Human
ugaggcaggaga

SEQ ID NO: 2118803 - RNA, 13 nt, Human
ugaggcaggagaa

SEQ ID NO: 2118804 - RNA, 15 nt, Human
ugaggcaggagaauc

SEQ ID NO: 2118805 - RNA, 13 nt, Human
ugaggcagggaag

SEQ ID NO: 2118806 - RNA, 14 nt, Human
ugaggcagggaagu

SEQ ID NO: 2118807 - RNA, 22 nt, Human
ugaggcagggaaguccccaggc

SEQ ID NO: 2118808 - RNA, 15 nt, Human
ugaggcaggggcgga

SEQ ID NO: 2118809 - RNA, 13 nt, Human
ugaggcagaagaa

SEQ ID NO: 2118810 - RNA, 20 nt, Human
ugaggcacaugucagcaagu

SEQ ID NO: 2118811 - RNA, 17 nt, Human
ugaggcacaugucagca

SEQ ID NO: 2118812 - RNA, 16 nt, Human
ugaggcaaugucagga

SEQ ID NO: 2118813 - RNA, 17 nt, Human
ugaggcaaugucaggaa

SEQ ID NO: 2118814 - RNA, 20 nt, Human
ugaggcaaugucaggaacag

SEQ ID NO: 2118815 - RNA, 21 nt, Human
ugaggcaaugucaggaacaga

SEQ ID NO: 2118816 - RNA, 12 nt, Human
ugaggcagacag

SEQ ID NO: 2118817 - RNA, 13 nt, Human
ugaggcagacagc

SEQ ID NO: 2118818 - RNA, 14 nt, Human
ugaggcagacagca

SEQ ID NO: 2118819 - RNA, 15 nt, Human
ugaggcagacagcag

SEQ ID NO: 2118820 - RNA, 16 nt, Human
ugaggcagacagcagc

SEQ ID NO: 2118821 - RNA, 17 nt, Human
ugaggcagacagcagcu

SEQ ID NO: 2118822 - RNA, 20 nt, Human
ugaggcagacagcagcucag

SEQ ID NO: 2118823 - RNA, 23 nt, Human
ugaggcagacagcagcucaggca

SEQ ID NO: 2118824 - RNA, 20 nt, Human
ucugccucacauagcuuaca

SEQ ID NO: 2118825 - RNA, 21 nt, Human
ucugccucaaugugaaucaga

SEQ ID NO: 2118826 - RNA, 15 nt, Human
ucugccuccucuuca

SEQ ID NO: 2118827 - RNA, 18 nt, Human
ucugccucugacacacag

SEQ ID NO: 2118828 - RNA, 15 nt, Human
ucugccucugacaca

SEQ ID NO: 2118829 - RNA, 20 nt, Human
ucugccugaagucacacagu

SEQ ID NO: 2118830 - RNA, 19 nt, Human
ucugccugaagucacacag

SEQ ID NO: 2118831 - RNA, 22 nt, Human
ucugccucugacacacagcucu

SEQ ID NO: 2118832 - RNA, 21 nt, Human
ucugccucugacacacagcuc

SEQ ID NO: 2118833 - RNA, 14 nt, Human
ucugccucugccug

SEQ ID NO: 2118834 - RNA, 16 nt, Human
ucugccucugccugca

SEQ ID NO: 2118835 - RNA, 23 nt, Human
ucugccucugacacacagcucug

SEQ ID NO: 2118836 - RNA, 18 nt, Human
ucugccauauucuguugg

SEQ ID NO: 2118837 - RNA, 23 nt, Human
ucugccauauucuguuggccagu

SEQ ID NO: 2118838 - RNA, 22 nt, Human
ucugccauauucuguuggccag

SEQ ID NO: 2118839 - RNA, 16 nt, Human
ucugccuauugcagcu

SEQ ID NO: 2118840 - RNA, 16 nt, Human
ucugccucaaugugaa

SEQ ID NO: 2118841 - RNA, 18 nt, Human
ucugcccacauuggaccc

SEQ ID NO: 2118842 - RNA, 21 nt, Human
ucugaggaauccagacccggc

SEQ ID NO: 2118843 - RNA, 18 nt, Human
ucugaggaauccagaccc

SEQ ID NO: 2118844 - RNA, 22 nt, Human
ucugaggaauccagacccggcu

SEQ ID NO: 2118845 - RNA, 14 nt, Human
ucugcaaauagaaa

SEQ ID NO: 2118846 - RNA, 16 nt, Human
ucugcaaauagaaaac

SEQ ID NO: 2118847 - RNA, 13 nt, Human
ucugauuucagga

SEQ ID NO: 2118848 - RNA, 20 nt, Human
ucugauuugucccuaugcau

SEQ ID NO: 2118849 - RNA, 17 nt, Human
ucugauuuuauguaaaa

SEQ ID NO: 2118850 - RNA, 21 nt, Human
ucugauuuuauguaaaauuuu

SEQ ID NO: 2118851 - RNA, 22 nt, Human
ucugauuuuauguaaaauuuug

SEQ ID NO: 2118852 - RNA, 22 nt, Human
ucugcaccgccggccagcuggg

SEQ ID NO: 2118853 - RNA, 23 nt, Human
ucugcaccgccggccagcuggga

SEQ ID NO: 2118854 - RNA, 14 nt, Human
ucugcaccuuaucu

SEQ ID NO: 2118855 - RNA, 15 nt, Human
ucugcaccuuaucuu

SEQ ID NO: 2118856 - RNA, 16 nt, Human
ucugcaccuuaucuua

SEQ ID NO: 2118857 - RNA, 20 nt, Human
ucugcaagcacaucugcauu

SEQ ID NO: 2118858 - RNA, 14 nt, Human
ucucauccccaggg

SEQ ID NO: 2118859 - RNA, 22 nt, Human
ucucauccccaggggucccagc

SEQ ID NO: 2118860 - RNA, 15 nt, Human
ucucauccccagggg

SEQ ID NO: 2118861 - RNA, 18 nt, Human
ucugagaggacuuuucuu

SEQ ID NO: 2118862 - RNA, 24 nt, Human
ucugagaucaaaacgguuuuacug

SEQ ID NO: 2118863 - RNA, 15 nt, Human
ucugagccccuggga

SEQ ID NO: 2118864 - RNA, 16 nt, Human
ucugagccccugggac

SEQ ID NO: 2118865 - RNA, 19 nt, Human
ucuggaauuuaaggcccaa

SEQ ID NO: 2118866 - RNA, 18 nt, Human
ucugcugcccuccauccc

SEQ ID NO: 2118867 - RNA, 15 nt, Human
ucuggagaagcagug

SEQ ID NO: 2118868 - RNA, 22 nt, Human
ucuggagaagcagugagccgca

SEQ ID NO: 2118869 - RNA, 16 nt, Human
ucuggagaagcaguga

SEQ ID NO: 2118870 - RNA, 11 nt, Human
ucuggagaagc

SEQ ID NO: 2118871 - RNA, 20 nt, Human
ucuggacugaagccugcagg

SEQ ID NO: 2118872 - RNA, 14 nt, Human
ucuggacuggcuag

SEQ ID NO: 2118873 - RNA, 15 nt, Human
ucuggacuggcuaga

SEQ ID NO: 2118874 - RNA, 13 nt, Human
ucuggacugaagc

SEQ ID NO: 2118875 - RNA, 17 nt, Human
ucuggacugaagccugc

SEQ ID NO: 2118876 - RNA, 19 nt, Human
ucuggacugaagccugcag

SEQ ID NO: 2118877 - RNA, 19 nt, Human
ucuggacugccccagaaaa

SEQ ID NO: 2118878 - RNA, 21 nt, Human
ucuggacugaagccugcagga

SEQ ID NO: 2118879 - RNA, 22 nt, Human
ucuggacuccucuguccaggca

SEQ ID NO: 2118880 - RNA, 18 nt, Human
ucuggacuccucugucca

SEQ ID NO: 2118881 - RNA, 16 nt, Human
ucuggacuccucuguc

SEQ ID NO: 2118882 - RNA, 15 nt, Human
ucuggacuccucugu

SEQ ID NO: 2118883 - RNA, 20 nt, Human
ucugccugcccaggccccug

SEQ ID NO: 2118884 - RNA, 18 nt, Human
ucugccugcccaggcccc

SEQ ID NO: 2118885 - RNA, 17 nt, Human
ucugccugcccaggccc

SEQ ID NO: 2118886 - RNA, 14 nt, Human
ucugcucggccguc

SEQ ID NO: 2118887 - RNA, 15 nt, Human
ucugcucggccgucu

SEQ ID NO: 2118888 - RNA, 18 nt, Human
ucugcucggccgucuuca

SEQ ID NO: 2118889 - RNA, 19 nt, Human
ucugccaugaacuggaggc

SEQ ID NO: 2118890 - RNA, 13 nt, Human
ucugcugaaggaa

SEQ ID NO: 2118891 - RNA, 13 nt, Human
ucugcugcccucc

SEQ ID NO: 2118892 - RNA, 14 nt, Human
ucugcugcccucca

SEQ ID NO: 2118893 - RNA, 15 nt, Human
ucugcugcccuccau

SEQ ID NO: 2118894 - RNA, 17 nt, Human
ucugucgcccagucugg

SEQ ID NO: 2118895 - RNA, 12 nt, Human
ucuguccuggga

SEQ ID NO: 2118896 - RNA, 15 nt, Human
ucugucucauaugau

SEQ ID NO: 2118897 - RNA, 22 nt, Human
ucugucucccuauaaugcugga

SEQ ID NO: 2118898 - RNA, 20 nt, Human
ucuguguauuuaauuguaaa

SEQ ID NO: 2118899 - RNA, 22 nt, Human
ucuguguauuuaauuguaaacu

SEQ ID NO: 2118900 - RNA, 15 nt, Human
ucugugucagccugu

SEQ ID NO: 2118901 - RNA, 14 nt, Human
ucugucuaccaucu

SEQ ID NO: 2118902 - RNA, 16 nt, Human
ucugucuaccaucucc

SEQ ID NO: 2118903 - RNA, 18 nt, Human
ucugucuaccaucucccu

SEQ ID NO: 2118904 - RNA, 21 nt, Human
ucugucucaaaaaauaaaaau

SEQ ID NO: 2118905 - RNA, 15 nt, Human
ucuggucucucuauu

SEQ ID NO: 2118906 - RNA, 16 nt, Human
ucuggugacaccagcc

SEQ ID NO: 2118907 - RNA, 17 nt, Human
ucuggugacaccagccu

SEQ ID NO: 2118908 - RNA, 18 nt, Human
ucuggugacaccagccuu

SEQ ID NO: 2118909 - RNA, 20 nt, Human
ucuguaacgccugcuugucc

SEQ ID NO: 2118910 - RNA, 20 nt, Human
ucuggagagguuauagguca

SEQ ID NO: 2118911 - RNA, 22 nt, Human
ucuggagagguuauaggucacu

SEQ ID NO: 2118912 - RNA, 13 nt, Human
ucuggagccaccu

SEQ ID NO: 2118913 - RNA, 15 nt, Human
ucuggagccaccugu

SEQ ID NO: 2118914 - RNA, 19 nt, Human
ucuggagccaccuguccca

SEQ ID NO: 2118915 - RNA, 20 nt, Human
ucuggagccaccugucccac

SEQ ID NO: 2118916 - RNA, 23 nt, Human
ucuggagccaccugucccaccuc

SEQ ID NO: 2118917 - RNA, 21 nt, Human
ucuggcuggcuaacuggaagc

SEQ ID NO: 2118918 - RNA, 19 nt, Human
ucuggcuucaaauauuaug

SEQ ID NO: 2118919 - RNA, 23 nt, Human
ucuggcuuccagaaaaccccagc

SEQ ID NO: 2118920 - RNA, 23 nt, Human
ucuugcucugcugacagacacag

SEQ ID NO: 2118921 - RNA, 15 nt, Human
ucuugcucugcugac

SEQ ID NO: 2118922 - RNA, 13 nt, Human
ucuuguccuagcu

SEQ ID NO: 2118923 - RNA, 23 nt, Human
ucuugcauggcaaggacugcagg

SEQ ID NO: 2118924 - RNA, 17 nt, Human
ucuugccacugccucuu

SEQ ID NO: 2118925 - RNA, 16 nt, Human
ucuugccacugccucu

SEQ ID NO: 2118926 - RNA, 16 nt, Human
ucuugccaucuauagg

SEQ ID NO: 2118927 - RNA, 14 nt, Human
ucuugcucugcuga

SEQ ID NO: 2118928 - RNA, 17 nt, Human
ucuugcccgcucaggcu

SEQ ID NO: 2118929 - RNA, 12 nt, Human
ucuugcccccca

SEQ ID NO: 2118930 - RNA, 21 nt, Human
ucuugccccccaccccagccu

SEQ ID NO: 2118931 - RNA, 13 nt, Human
ucuucgaggugga

SEQ ID NO: 2118932 - RNA, 19 nt, Human
ucuucggggaacuccugga

SEQ ID NO: 2118933 - RNA, 23 nt, Human
ucuugaaaugaaaguauaacuga

SEQ ID NO: 2118934 - RNA, 14 nt, Human
ucuugaaagcugug

SEQ ID NO: 2118935 - RNA, 12 nt, Human
ucuugaaaugaa

SEQ ID NO: 2118936 - RNA, 13 nt, Human
ucuugaaaugaaa

SEQ ID NO: 2118937 - RNA, 20 nt, Human
ucuuagguuggcaaaaaggc

SEQ ID NO: 2118938 - RNA, 23 nt, Human
ucuuagguuggcaaaaaggcagg

SEQ ID NO: 2118939 - RNA, 15 nt, Human
ucuuagccuguggca

SEQ ID NO: 2118940 - RNA, 17 nt, Human
ucuuagccuguggcagu

SEQ ID NO: 2118941 - RNA, 22 nt, Human
ucuuagccuguggcaguaaaga

SEQ ID NO: 2118942 - RNA, 20 nt, Human
ucugugucagguggggcagc

SEQ ID NO: 2118943 - RNA, 17 nt, Human
ucugugucagguggggc

SEQ ID NO: 2118944 - RNA, 22 nt, Human
ucugugugcaagugugugcaca

SEQ ID NO: 2118945 - RNA, 15 nt, Human
ucuuagauguauaua

SEQ ID NO: 2118946 - RNA, 18 nt, Human
ucuuagcagugauuuuua

SEQ ID NO: 2118947 - RNA, 14 nt, Human
ucuuagauguauau

SEQ ID NO: 2118948 - RNA, 14 nt, Human
ucugugugcugugg

SEQ ID NO: 2118949 - RNA, 19 nt, Human
ucugugugggacuguacac

SEQ ID NO: 2118950 - RNA, 20 nt, Human
ucugugugggacuguacaca

SEQ ID NO: 2118951 - RNA, 21 nt, Human
ucugugugggacuguacacac

SEQ ID NO: 2118952 - RNA, 12 nt, Human
ucuucaguuuua

SEQ ID NO: 2118953 - RNA, 18 nt, Human
ucuucaguuuuaucuuua

SEQ ID NO: 2118954 - RNA, 19 nt, Human
ucuucaguuuuaucuuuaa

SEQ ID NO: 2118955 - RNA, 14 nt, Human
ucuuccaaagcaca

SEQ ID NO: 2118956 - RNA, 18 nt, Human
ucuucaguugguguguuu

SEQ ID NO: 2118957 - RNA, 20 nt, Human
ucuucaguugguguguuuuu

SEQ ID NO: 2118958 - RNA, 22 nt, Human
ucuuauccaacaucaacaucuu

SEQ ID NO: 2118959 - RNA, 18 nt, Human
ucuuagugccugagagua

SEQ ID NO: 2118960 - RNA, 14 nt, Human
ucuuaguagauuuu

SEQ ID NO: 2118961 - RNA, 14 nt, Human
ucuuagugccugag

SEQ ID NO: 2118962 - RNA, 13 nt, Human
ucuuucccucccu

SEQ ID NO: 2118963 - RNA, 23 nt, Human
ucuuucccucccuuccucuuucc

SEQ ID NO: 2118964 - RNA, 12 nt, Human
ucuuucccuccc

SEQ ID NO: 2118965 - RNA, 15 nt, Human
ucuuuccauuucucu

SEQ ID NO: 2118966 - RNA, 16 nt, Human
ucuuuccauuucucuc

SEQ ID NO: 2118967 - RNA, 24 nt, Human
ucuuuccauuucucucuccagucu

SEQ ID NO: 2118968 - RNA, 23 nt, Human
ucuugugacuagugcugaagcuu

SEQ ID NO: 2118969 - RNA, 22 nt, Human
ucuugugacuagugcugaagcu

SEQ ID NO: 2118970 - RNA, 14 nt, Human
ucuuugccuugggc

SEQ ID NO: 2118971 - RNA, 20 nt, Human
ucuuugccuugggcugcucc

SEQ ID NO: 2118972 - RNA, 21 nt, Human
ucuuugccuugggcugcuccu

SEQ ID NO: 2118973 - RNA, 15 nt, Human
ucuuugcuugaacac

SEQ ID NO: 2118974 - RNA, 16 nt, Human
ucuuugcuugaacaca

SEQ ID NO: 2118975 - RNA, 17 nt, Human
ucuuugcuugaacacag

SEQ ID NO: 2118976 - RNA, 19 nt, Human
ucuuugcuugaacacagua

SEQ ID NO: 2118977 - RNA, 21 nt, Human
ucuuugcuugaacacaguauu

SEQ ID NO: 2118978 - RNA, 13 nt, Human
ucuuugcagacag

SEQ ID NO: 2118979 - RNA, 23 nt, Human
ucuuugaccucaaccugugauga

SEQ ID NO: 2118980 - RNA, 17 nt, Human
ucuuugagauagaagaa

SEQ ID NO: 2118981 - RNA, 18 nt, Human
ucuuugagauagaagaac

SEQ ID NO: 2118982 - RNA, 22 nt, Human
ucuuugagauagaagaacugca

SEQ ID NO: 2118983 - RNA, 22 nt, Human
ucuuugacaauuccuagauaaa

SEQ ID NO: 2118984 - RNA, 17 nt, Human
ucuuugcagacaggcaa

SEQ ID NO: 2118985 - RNA, 14 nt, Human
ucuuugcagacagg

SEQ ID NO: 2118986 - RNA, 15 nt, Human
ucuuuuuaauaaaaa

SEQ ID NO: 2118987 - RNA, 14 nt, Human
ucuuuuuaagcuua

SEQ ID NO: 2118988 - RNA, 21 nt, Human
ucuuuuuaagcuuauuuaauu

SEQ ID NO: 2118989 - RNA, 16 nt, Human
ucuuuuccuacuuuuc

SEQ ID NO: 2118990 - RNA, 18 nt, Human
ucuuuucccccaaagugg

SEQ ID NO: 2118991 - RNA, 22 nt, Human
ucuuuuccuguuuuuguuaacu

SEQ ID NO: 2118992 - RNA, 22 nt, Human
ucuuuucgccguggcugcggca

SEQ ID NO: 2118993 - RNA, 12 nt, Human
ucuuuucuacag

SEQ ID NO: 2118994 - RNA, 16 nt, Human
ucuuuucuacagcaaa

SEQ ID NO: 2118995 - RNA, 19 nt, Human
ucuuuucuacagcaaauuu

SEQ ID NO: 2118996 - RNA, 18 nt, Human
ugaaaacagaaaacgguu

SEQ ID NO: 2118997 - RNA, 14 nt, Human
ugaaaacauaaaaa

SEQ ID NO: 2118998 - RNA, 19 nt, Human
ugaaaacaugguagaauug

SEQ ID NO: 2118999 - RNA, 23 nt, Human
ugaaaacaugguagaauuggaga

SEQ ID NO: 2119000 - RNA, 14 nt, Human
ugaaaacauguaau

SEQ ID NO: 2119001 - RNA, 23 nt, Human
ugaaaacccagagaggaaucaga

SEQ ID NO: 2119002 - RNA, 14 nt, Human
ugaaaacccagaga

SEQ ID NO: 2119003 - RNA, 15 nt, Human
ugaaaacccagagag

SEQ ID NO: 2119004 - RNA, 19 nt, Human
ugaaaagaaaaaugagccu

SEQ ID NO: 2119005 - RNA, 16 nt, Human
ugaaaacccagagagg

SEQ ID NO: 2119006 - RNA, 16 nt, Human
ugaaaacguuuuauug

SEQ ID NO: 2119007 - RNA, 17 nt, Human
ugaaaacguuuuauugu

SEQ ID NO: 2119008 - RNA, 18 nt, Human
ugaaaacguuuuauugug

SEQ ID NO: 2119009 - RNA, 15 nt, Human
ugaaaagaaaaauga

SEQ ID NO: 2119010 - RNA, 20 nt, Human
ugaaaauuaggauuucauga

SEQ ID NO: 2119011 - RNA, 13 nt, Human
ugaaaaccucaca

SEQ ID NO: 2119012 - RNA, 20 nt, Human
ugaaaagaaaaaugagccug

SEQ ID NO: 2119013 - RNA, 22 nt, Human
ugaaaagaaaaaugagccuggc

SEQ ID NO: 2119014 - RNA, 18 nt, Human
ugaaaauuccagaaagga

SEQ ID NO: 2119015 - RNA, 20 nt, Human
ugaaaauuccagaaaggaua

SEQ ID NO: 2119016 - RNA, 14 nt, Human
ugaaaauucagugg

SEQ ID NO: 2119017 - RNA, 20 nt, Human
ucagcaccuacaguguacag

SEQ ID NO: 2119018 - RNA, 14 nt, Human
ucagcacccccuuc

SEQ ID NO: 2119019 - RNA, 17 nt, Human
ucagcacccccuucucu

SEQ ID NO: 2119020 - RNA, 23 nt, Human
ucagcacccccuucucugcccau

SEQ ID NO: 2119021 - RNA, 21 nt, Human
ucagcaccuacaguguacagu

SEQ ID NO: 2119022 - RNA, 22 nt, Human
ucagcaccuacaguguacaguc

SEQ ID NO: 2119023 - RNA, 18 nt, Human
ucagcauccuggcacccg

SEQ ID NO: 2119024 - RNA, 17 nt, Human
ucagcauccuggcaccc

SEQ ID NO: 2119025 - RNA, 16 nt, Human
ucagcauccuggcacc

SEQ ID NO: 2119026 - RNA, 15 nt, Human
ucagcauccuggcac

SEQ ID NO: 2119027 - RNA, 21 nt, Human
ucagcaguuguuauuacaucc

SEQ ID NO: 2119028 - RNA, 23 nt, Human
ucagccuagccgaccucagccuu

SEQ ID NO: 2119029 - RNA, 18 nt, Human
ucagccuaggggucaggg

SEQ ID NO: 2119030 - RNA, 13 nt, Human
ucagccucccaaa

SEQ ID NO: 2119031 - RNA, 12 nt, Human
ucagccucccaa

SEQ ID NO: 2119032 - RNA, 14 nt, Human
uaucauuccaaagg

SEQ ID NO: 2119033 - RNA, 12 nt, Human
uaucauucagca

SEQ ID NO: 2119034 - RNA, 14 nt, Human
uaucauucagcaac

SEQ ID NO: 2119035 - RNA, 13 nt, Human
uaucauucagcaa

SEQ ID NO: 2119036 - RNA, 13 nt, Human
ucagauauuuaua

SEQ ID NO: 2119037 - RNA, 21 nt, Human
ucagauauuuauauuuuuauu

SEQ ID NO: 2119038 - RNA, 15 nt, Human
ucagcaccacccuag

SEQ ID NO: 2119039 - RNA, 23 nt, Human
ucagcaccacccuagucccuucc

SEQ ID NO: 2119040 - RNA, 12 nt, Human
ucagcaccaccc

SEQ ID NO: 2119041 - RNA, 13 nt, Human
ucagcaccacccu

SEQ ID NO: 2119042 - RNA, 14 nt, Human
ucagcaccacccua

SEQ ID NO: 2119043 - RNA, 12 nt, Human
ucagauccuacc

SEQ ID NO: 2119044 - RNA, 14 nt, Human
ucagauccuacccc

SEQ ID NO: 2119045 - RNA, 21 nt, Human
ucagaucauuucaaaacucau

SEQ ID NO: 2119046 - RNA, 21 nt, Human
ucagauauuuuuucagaaaua

SEQ ID NO: 2119047 - RNA, 22 nt, Human
ucagauauuuuuucagaaauau

SEQ ID NO: 2119048 - RNA, 23 nt, Human
ucagauauuuuuucagaaauaug

SEQ ID NO: 2119049 - RNA, 13 nt, Human
ucagaucagugcu

SEQ ID NO: 2119050 - RNA, 18 nt, Human
ucagcauccucaguuccu

SEQ ID NO: 2119051 - RNA, 24 nt, Human
ucagcugccucacuuccuacaaga

SEQ ID NO: 2119052 - RNA, 12 nt, Human
ucagcugcuucu

SEQ ID NO: 2119053 - RNA, 15 nt, Human
ucagcugcuacuacu

SEQ ID NO: 2119054 - RNA, 16 nt, Human
ucagcugcccccgcuc

SEQ ID NO: 2119055 - RNA, 21 nt, Human
ucagcugcccccgcucauggg

SEQ ID NO: 2119056 - RNA, 12 nt, Human
ucagcugccuca

SEQ ID NO: 2119057 - RNA, 14 nt, Human
ucagcugccucacu

SEQ ID NO: 2119058 - RNA, 15 nt, Human
ucagcugccucacuu

SEQ ID NO: 2119059 - RNA, 21 nt, Human
ucagcuggcacugucucugcu

SEQ ID NO: 2119060 - RNA, 20 nt, Human
ucagcuguaagaagagacug

SEQ ID NO: 2119061 - RNA, 17 nt, Human
ucaggacccucgcuggc

SEQ ID NO: 2119062 - RNA, 18 nt, Human
ucaggacccucgcuggcc

SEQ ID NO: 2119063 - RNA, 19 nt, Human
ucaggacccucgcuggccc

SEQ ID NO: 2119064 - RNA, 20 nt, Human
ucaggacccucgcuggcccc

SEQ ID NO: 2119065 - RNA, 21 nt, Human
ucaggacccucgcuggccccc

SEQ ID NO: 2119066 - RNA, 22 nt, Human
ucaggacccucgcuggccccca

SEQ ID NO: 2119067 - RNA, 19 nt, Human
ucaggacgagaaugagggu

SEQ ID NO: 2119068 - RNA, 13 nt, Human
ucaggaggcaggg

SEQ ID NO: 2119069 - RNA, 12 nt, Human
ucaggaggcuga

SEQ ID NO: 2119070 - RNA, 13 nt, Human
ucaggaggcugag

SEQ ID NO: 2119071 - RNA, 18 nt, Human
ucaggaggcugaggcaga

SEQ ID NO: 2119072 - RNA, 20 nt, Human
ucaggaggcugaggcagaag

SEQ ID NO: 2119073 - RNA, 22 nt, Human
ucaggaggcugaggcagaagaa

SEQ ID NO: 2119074 - RNA, 15 nt, Human
ucaggaggcugaggg

SEQ ID NO: 2119075 - RNA, 18 nt, Human
ucaggaggcugaggggag

SEQ ID NO: 2119076 - RNA, 13 nt, Human
ucaggaggcugga

SEQ ID NO: 2119077 - RNA, 14 nt, Human
ucaggaggcuggag

SEQ ID NO: 2119078 - RNA, 21 nt, Human
ucaggaggcuggaggaagggg

SEQ ID NO: 2119079 - RNA, 16 nt, Human
ucaggaggaaggcuua

SEQ ID NO: 2119080 - RNA, 23 nt, Human
ucaggaggaaggcuuacacccac

SEQ ID NO: 2119081 - RNA, 20 nt, Human
ucaggagaggggcagaacag

SEQ ID NO: 2119082 - RNA, 15 nt, Human
ucaggagaggggcag

SEQ ID NO: 2119083 - RNA, 17 nt, Human
ucaggagaggggcagaa

SEQ ID NO: 2119084 - RNA, 18 nt, Human
ucaggagaggggcagaac

SEQ ID NO: 2119085 - RNA, 12 nt, Human
ucaggacuccag

SEQ ID NO: 2119086 - RNA, 13 nt, Human
ucaggacuccagc

SEQ ID NO: 2119087 - RNA, 14 nt, Human
ucaggacuccagcc

SEQ ID NO: 2119088 - RNA, 18 nt, Human
ucaggacuccagcccauu

SEQ ID NO: 2119089 - RNA, 14 nt, Human
ucaggacuccucuc

SEQ ID NO: 2119090 - RNA, 15 nt, Human
ucaggacuuggucug

SEQ ID NO: 2119091 - RNA, 22 nt, Human
ucagcuccagcucaccagcccc

SEQ ID NO: 2119092 - RNA, 21 nt, Human
ucagcuccagcucaccagccc

SEQ ID NO: 2119093 - RNA, 18 nt, Human
ucagcuccagcucaccag

SEQ ID NO: 2119094 - RNA, 20 nt, Human
ucagccucccgaauagcugg

SEQ ID NO: 2119095 - RNA, 12 nt, Human
ucagccucccga

SEQ ID NO: 2119096 - RNA, 22 nt, Human
ucagccucccaaagugcuggga

SEQ ID NO: 2119097 - RNA, 22 nt, Human
ucagccucuuaaagcugccugu

SEQ ID NO: 2119098 - RNA, 12 nt, Human
ucagccucuuaa

SEQ ID NO: 2119099 - RNA, 21 nt, Human
ucagccucuuaaagcugccug

SEQ ID NO: 2119100 - RNA, 16 nt, Human
ucagccugcuccagcu

SEQ ID NO: 2119101 - RNA, 20 nt, Human
ucagccugaggcugagacug

SEQ ID NO: 2119102 - RNA, 13 nt, Human
ucagccugaggcu

SEQ ID NO: 2119103 - RNA, 18 nt, Human
ucagccugaggcugagac

SEQ ID NO: 2119104 - RNA, 16 nt, Human
ucaugaaaauccuacc

SEQ ID NO: 2119105 - RNA, 22 nt, Human
ucaugaaaauccuaccaaccuc

SEQ ID NO: 2119106 - RNA, 15 nt, Human
ucauccaauccucac

SEQ ID NO: 2119107 - RNA, 18 nt, Human
ucauccaauccucacugg

SEQ ID NO: 2119108 - RNA, 19 nt, Human
ucauccaauccucacuggg

SEQ ID NO: 2119109 - RNA, 20 nt, Human
ucauccaauccucacugggu

SEQ ID NO: 2119110 - RNA, 22 nt, Human
ucauccaauccucacugggugg

SEQ ID NO: 2119111 - RNA, 12 nt, Human
ucaucaguguua

SEQ ID NO: 2119112 - RNA, 16 nt, Human
ucaucaguguuaaaaa

SEQ ID NO: 2119113 - RNA, 19 nt, Human
ucaucaguguuaaaaaauu

SEQ ID NO: 2119114 - RNA, 13 nt, Human
ucaucauaaaaua

SEQ ID NO: 2119115 - RNA, 14 nt, Human
ucaucauaaaauaa

SEQ ID NO: 2119116 - RNA, 15 nt, Human
ucaucauaaaauaaa

SEQ ID NO: 2119117 - RNA, 19 nt, Human
ucaucauaaaauaaaguau

SEQ ID NO: 2119118 - RNA, 17 nt, Human
ucaucaacccuaaaaag

SEQ ID NO: 2119119 - RNA, 20 nt, Human
ucaguuccugcagcagagcc

SEQ ID NO: 2119120 - RNA, 20 nt, Human
ucaguuccugcccuuggccu

SEQ ID NO: 2119121 - RNA, 17 nt, Human
ucagucccaucagagag

SEQ ID NO: 2119122 - RNA, 18 nt, Human
ucaguccccgugaaggag

SEQ ID NO: 2119123 - RNA, 15 nt, Human
ucaguccauagcaga

SEQ ID NO: 2119124 - RNA, 17 nt, Human
ucagguggggcagcuug

SEQ ID NO: 2119125 - RNA, 21 nt, Human
ucagguggggcagcuugaggg

SEQ ID NO: 2119126 - RNA, 16 nt, Human
ucagguggggcagcuu

SEQ ID NO: 2119127 - RNA, 15 nt, Human
ucagguggggcagcu

SEQ ID NO: 2119128 - RNA, 20 nt, Human
ucaggugcugccauccaggu

SEQ ID NO: 2119129 - RNA, 18 nt, Human
ucaggugcugccauccag

SEQ ID NO: 2119130 - RNA, 14 nt, Human
ucagguggggcagc

SEQ ID NO: 2119131 - RNA, 19 nt, Human
ucaggagucccaaggaaag

SEQ ID NO: 2119132 - RNA, 20 nt, Human
ucaggagucccaaggaaagc

SEQ ID NO: 2119133 - RNA, 19 nt, Human
ucagucugauucccaagcu

SEQ ID NO: 2119134 - RNA, 17 nt, Human
ucagucugauucccaag

SEQ ID NO: 2119135 - RNA, 23 nt, Human
ucagucugauuaaagguggugcc

SEQ ID NO: 2119136 - RNA, 14 nt, Human
ucaguuaagaaaaa

SEQ ID NO: 2119137 - RNA, 15 nt, Human
ucaguuaagaaaaaa

SEQ ID NO: 2119138 - RNA, 16 nt, Human
ucaguuaagaaaaaaa

SEQ ID NO: 2119139 - RNA, 19 nt, Human
ucaguuaagaaaaaaauaa

SEQ ID NO: 2119140 - RNA, 20 nt, Human
ucaguguucccuuuccuacu

SEQ ID NO: 2119141 - RNA, 13 nt, Human
ucaguguuaaaaa

SEQ ID NO: 2119142 - RNA, 15 nt, Human
ucaguguuaaaaaau

SEQ ID NO: 2119143 - RNA, 16 nt, Human
ucaguguuaaaaaauu

SEQ ID NO: 2119144 - RNA, 23 nt, Human
ucaguguuaaaaaauuuuugaaa

SEQ ID NO: 2119145 - RNA, 14 nt, Human
ucaguuacucagcc

SEQ ID NO: 2119146 - RNA, 16 nt, Human
ucaguucccuuggccu

SEQ ID NO: 2119147 - RNA, 17 nt, Human
ucaguucccuuggccuc

SEQ ID NO: 2119148 - RNA, 18 nt, Human
ucaguucccuuggccuca

SEQ ID NO: 2119149 - RNA, 19 nt, Human
ucaguucccuuggccucag

SEQ ID NO: 2119150 - RNA, 20 nt, Human
ucaguucccuuggccucaga

SEQ ID NO: 2119151 - RNA, 22 nt, Human
ucaguucccuuggccucagaau

SEQ ID NO: 2119152 - RNA, 21 nt, Human
uccacccugcucuccgaccag

SEQ ID NO: 2119153 - RNA, 12 nt, Human
uccacccuggaa

SEQ ID NO: 2119154 - RNA, 14 nt, Human
uccacccugcucuc

SEQ ID NO: 2119155 - RNA, 13 nt, Human
uccacccugcucu

SEQ ID NO: 2119156 - RNA, 22 nt, Human
uccacugugccaugugccaggu

SEQ ID NO: 2119157 - RNA, 15 nt, Human
uccacuguuuauuca

SEQ ID NO: 2119158 - RNA, 22 nt, Human
uccacuguuuauucaacaacua

SEQ ID NO: 2119159 - RNA, 23 nt, Human
uccacuuagaaauugcauuuccu

SEQ ID NO: 2119160 - RNA, 21 nt, Human
uccacuuagaaauugcauuuc

SEQ ID NO: 2119161 - RNA, 19 nt, Human
uccagagaguggcuccucc

SEQ ID NO: 2119162 - RNA, 22 nt, Human
uccagagaguggcuccucccgg

SEQ ID NO: 2119163 - RNA, 18 nt, Human
uccacuuucagugaaagc

SEQ ID NO: 2119164 - RNA, 19 nt, Human
uccagcuggguuggaaaac

SEQ ID NO: 2119165 - RNA, 16 nt, Human
uccaggaaaaaggaca

SEQ ID NO: 2119166 - RNA, 17 nt, Human
uccaggaaaaaggacag

SEQ ID NO: 2119167 - RNA, 23 nt, Human
uccaggaaaaaggacaggcagaa

SEQ ID NO: 2119168 - RNA, 17 nt, Human
uccaggaaggggcugga

SEQ ID NO: 2119169 - RNA, 22 nt, Human
uccaggaaugccuccucccugg

SEQ ID NO: 2119170 - RNA, 13 nt, Human
uccagggcccuga

SEQ ID NO: 2119171 - RNA, 22 nt, Human
uccagggccacgugccaggccc

SEQ ID NO: 2119172 - RNA, 23 nt, Human
uccagggccacgugccaggcccg

SEQ ID NO: 2119173 - RNA, 14 nt, Human
uccagggccagaug

SEQ ID NO: 2119174 - RNA, 22 nt, Human
uccagauuuuuuacagcugccu

SEQ ID NO: 2119175 - RNA, 21 nt, Human
uccagaugccuucuccagaca

SEQ ID NO: 2119176 - RNA, 17 nt, Human
uccaagcaaauguuaca

SEQ ID NO: 2119177 - RNA, 18 nt, Human
uccaagcaaauguuacau

SEQ ID NO: 2119178 - RNA, 19 nt, Human
uccaagcaaauguuacaua

SEQ ID NO: 2119179 - RNA, 23 nt, Human
uccaagcgaggucaacagagaag

SEQ ID NO: 2119180 - RNA, 21 nt, Human
uccaagcgaggucaacagaga

SEQ ID NO: 2119181 - RNA, 22 nt, Human
uccaagcgaggucaacagagaa

SEQ ID NO: 2119182 - RNA, 16 nt, Human
uccacaagauucccag

SEQ ID NO: 2119183 - RNA, 17 nt, Human
uccacaagauucccaga

SEQ ID NO: 2119184 - RNA, 18 nt, Human
uccacaagauucccagag

SEQ ID NO: 2119185 - RNA, 18 nt, Human
uccacacccucucccagg

SEQ ID NO: 2119186 - RNA, 19 nt, Human
uccacacccucucccagga

SEQ ID NO: 2119187 - RNA, 20 nt, Human
uccacacccucucccaggac

SEQ ID NO: 2119188 - RNA, 21 nt, Human
uccacacccucucccaggacc

SEQ ID NO: 2119189 - RNA, 19 nt, Human
uccacaagauucccagaga

SEQ ID NO: 2119190 - RNA, 20 nt, Human
uccacaagauucccagagac

SEQ ID NO: 2119191 - RNA, 21 nt, Human
uccacaagauucccagagaca

SEQ ID NO: 2119192 - RNA, 23 nt, Human
uccacaagauucccagagacagg

SEQ ID NO: 2119193 - RNA, 23 nt, Human
uccacacucaccucuaaaacagu

SEQ ID NO: 2119194 - RNA, 14 nt, Human
uccacagccgcagc

SEQ ID NO: 2119195 - RNA, 16 nt, Human
uccacagccgcagccu

SEQ ID NO: 2119196 - RNA, 17 nt, Human
uccacagccgcagccuc

SEQ ID NO: 2119197 - RNA, 23 nt, Human
uccacagcuuccccucucuccuc

SEQ ID NO: 2119198 - RNA, 14 nt, Human
uccacagcuaccuc

SEQ ID NO: 2119199 - RNA, 18 nt, Human
uccacagccgcagccucc

SEQ ID NO: 2119200 - RNA, 12 nt, Human
uccaagagcuga

SEQ ID NO: 2119201 - RNA, 14 nt, Human
ucauguacauuucu

SEQ ID NO: 2119202 - RNA, 21 nt, Human
ucauggcuaagcuuaaaaaaa

SEQ ID NO: 2119203 - RNA, 23 nt, Human
ucauggcuaagcuuaaaaaaaac

SEQ ID NO: 2119204 - RNA, 15 nt, Human
ucauggcucacugca

SEQ ID NO: 2119205 - RNA, 16 nt, Human
ucauggcucacugcag

SEQ ID NO: 2119206 - RNA, 18 nt, Human
ucauggcucacugcagcc

SEQ ID NO: 2119207 - RNA, 19 nt, Human
ucauggcucacugcagccu

SEQ ID NO: 2119208 - RNA, 12 nt, Human
ucauguacauuu

SEQ ID NO: 2119209 - RNA, 19 nt, Human
ucauguagcaaucagauuu

SEQ ID NO: 2119210 - RNA, 16 nt, Human
uccaugucgccucugc

SEQ ID NO: 2119211 - RNA, 14 nt, Human
uccaugauggaaua

SEQ ID NO: 2119212 - RNA, 12 nt, Human
uccaugauggag

SEQ ID NO: 2119213 - RNA, 15 nt, Human
uccaugauggaguca

SEQ ID NO: 2119214 - RNA, 21 nt, Human
uccaugcacccucauacacag

SEQ ID NO: 2119215 - RNA, 18 nt, Human
uccaugucgccucugcau

SEQ ID NO: 2119216 - RNA, 17 nt, Human
uccaugucgccucugca

SEQ ID NO: 2119217 - RNA, 19 nt, Human
uccaugucgccucugcauu

SEQ ID NO: 2119218 - RNA, 14 nt, Human
uccaugugcccagu

SEQ ID NO: 2119219 - RNA, 19 nt, Human
ucccaacacaaggugggca

SEQ ID NO: 2119220 - RNA, 21 nt, Human
ucccaacacaaggugggcagg

SEQ ID NO: 2119221 - RNA, 14 nt, Human
ucccaacuuguaaa

SEQ ID NO: 2119222 - RNA, 17 nt, Human
ucccaagaacagcaggc

SEQ ID NO: 2119223 - RNA, 18 nt, Human
ucccaagaacagcaggcc

SEQ ID NO: 2119224 - RNA, 19 nt, Human
ucccaagaacagcaggccc

SEQ ID NO: 2119225 - RNA, 21 nt, Human
ucccaagaacagcaggcccac

SEQ ID NO: 2119226 - RNA, 22 nt, Human
ucccaagaacagcaggcccacc

SEQ ID NO: 2119227 - RNA, 23 nt, Human
ucccaagaacagcaggcccaccu

SEQ ID NO: 2119228 - RNA, 14 nt, Human
ucccaacugcaagu

SEQ ID NO: 2119229 - RNA, 17 nt, Human
ucccaacuccuauaauu

SEQ ID NO: 2119230 - RNA, 18 nt, Human
ucccaacacuucagacug

SEQ ID NO: 2119231 - RNA, 19 nt, Human
uccaugaguuugcccuggu

SEQ ID NO: 2119232 - RNA, 23 nt, Human
uccaugaguuuuuucucuugggc

SEQ ID NO: 2119233 - RNA, 14 nt, Human
uccauaucuaacca

SEQ ID NO: 2119234 - RNA, 17 nt, Human
uccauaucuaaccagug

SEQ ID NO: 2119235 - RNA, 19 nt, Human
uccauaucuaaccagugau

SEQ ID NO: 2119236 - RNA, 20 nt, Human
uccauauauuagcauuuagu

SEQ ID NO: 2119237 - RNA, 17 nt, Human
uccauauauuagcauuu

SEQ ID NO: 2119238 - RNA, 18 nt, Human
uccauauauuagcauuua

SEQ ID NO: 2119239 - RNA, 16 nt, Human
uccauaguauauuaaa

SEQ ID NO: 2119240 - RNA, 17 nt, Human
uccauaguauauuaaaa

SEQ ID NO: 2119241 - RNA, 20 nt, Human
uccauaguauauuaaaaaug

SEQ ID NO: 2119242 - RNA, 21 nt, Human
uccauaguauauuaaaaaugg

SEQ ID NO: 2119243 - RNA, 22 nt, Human
uccauaguauauuaaaaauggu

SEQ ID NO: 2119244 - RNA, 22 nt, Human
uccauagccuaaucccugggca

SEQ ID NO: 2119245 - RNA, 21 nt, Human
uccauagccuaaucccugggc

SEQ ID NO: 2119246 - RNA, 23 nt, Human
uccauaaucuggacuccucuguc

SEQ ID NO: 2119247 - RNA, 17 nt, Human
uccaggggaugggaggu

SEQ ID NO: 2119248 - RNA, 20 nt, Human
uccagggcccugagcucggu

SEQ ID NO: 2119249 - RNA, 16 nt, Human
uccagggcccugagcu

SEQ ID NO: 2119250 - RNA, 17 nt, Human
uccagggcccugagcuc

SEQ ID NO: 2119251 - RNA, 18 nt, Human
uccauaauuccauaugcu

SEQ ID NO: 2119252 - RNA, 12 nt, Human
uccauaauuaug

SEQ ID NO: 2119253 - RNA, 17 nt, Human
uccauaauuaugacagu

SEQ ID NO: 2119254 - RNA, 19 nt, Human
uccauaauuaugacaguua

SEQ ID NO: 2119255 - RNA, 21 nt, Human
uccauaauuaugacaguuaua

SEQ ID NO: 2119256 - RNA, 20 nt, Human
uccauaauguauaaagaaca

SEQ ID NO: 2119257 - RNA, 12 nt, Human
uccauaauguau

SEQ ID NO: 2119258 - RNA, 14 nt, Human
ucccacucagucca

SEQ ID NO: 2119259 - RNA, 22 nt, Human
ucccacucacaacagcugccug

SEQ ID NO: 2119260 - RNA, 17 nt, Human
ucccacucacaacagcu

SEQ ID NO: 2119261 - RNA, 17 nt, Human
ucccacucaagccaagc

SEQ ID NO: 2119262 - RNA, 20 nt, Human
ucccacggaaaaugccaauc

SEQ ID NO: 2119263 - RNA, 23 nt, Human
ucccacggaaaaugccaaucucu

SEQ ID NO: 2119264 - RNA, 21 nt, Human
ucccaccuuggcugcagggag

SEQ ID NO: 2119265 - RNA, 19 nt, Human
ucccaccuuggcugcaggg

SEQ ID NO: 2119266 - RNA, 18 nt, Human
ucccaccucagccucccg

SEQ ID NO: 2119267 - RNA, 22 nt, Human
ucccaagagaaggggaagcacu

SEQ ID NO: 2119268 - RNA, 16 nt, Human
ucccaccucagccucc

SEQ ID NO: 2119269 - RNA, 16 nt, Human
ucccaugagccucagc

SEQ ID NO: 2119270 - RNA, 15 nt, Human
ucccaugagccucag

SEQ ID NO: 2119271 - RNA, 12 nt, Human
ucccaggggacc

SEQ ID NO: 2119272 - RNA, 17 nt, Human
ucccaggggaccacacc

SEQ ID NO: 2119273 - RNA, 19 nt, Human
ucccagggcuacucacuca

SEQ ID NO: 2119274 - RNA, 21 nt, Human
ucccagggcuacucacucaag

SEQ ID NO: 2119275 - RNA, 22 nt, Human
ucccagggcuacucacucaagu

SEQ ID NO: 2119276 - RNA, 23 nt, Human
ucccagggccagggcccugcaga

SEQ ID NO: 2119277 - RNA, 21 nt, Human
ucccagggccagggcccugca

SEQ ID NO: 2119278 - RNA, 22 nt, Human
ucccagggccagggcccugcag

SEQ ID NO: 2119279 - RNA, 16 nt, Human
ucccagggccagggcc

SEQ ID NO: 2119280 - RNA, 17 nt, Human
ucccagggccagggccc

SEQ ID NO: 2119281 - RNA, 20 nt, Human
ucccagggccagggcccugc

SEQ ID NO: 2119282 - RNA, 17 nt, Human
ucccacuuggaggccuu

SEQ ID NO: 2119283 - RNA, 15 nt, Human
ucccacuugccccug

SEQ ID NO: 2119284 - RNA, 14 nt, Human
ucccacuccuagga

SEQ ID NO: 2119285 - RNA, 18 nt, Human
ucccacucaagccaagca

SEQ ID NO: 2119286 - RNA, 23 nt, Human
ucuaggugcccuuggaggccagc

SEQ ID NO: 2119287 - RNA, 17 nt, Human
ucuagguggaguugaaa

SEQ ID NO: 2119288 - RNA, 19 nt, Human
ucuagguggaguugaaaga

SEQ ID NO: 2119289 - RNA, 12 nt, Human
ucuagggaaaaa

SEQ ID NO: 2119290 - RNA, 20 nt, Human
ucuagguaggggcccacuuc

SEQ ID NO: 2119291 - RNA, 17 nt, Human
ucuagguagugcccuau

SEQ ID NO: 2119292 - RNA, 16 nt, Human
ucuaggucaaggccug

SEQ ID NO: 2119293 - RNA, 20 nt, Human
ucuaggucaaggccuguccc

SEQ ID NO: 2119294 - RNA, 18 nt, Human
ucuaggucaguacccacc

SEQ ID NO: 2119295 - RNA, 20 nt, Human
ucuaggucaguacccaccug

SEQ ID NO: 2119296 - RNA, 21 nt, Human
ucuaggucaguacccaccuga

SEQ ID NO: 2119297 - RNA, 18 nt, Human
ucuaggcaucccagggga

SEQ ID NO: 2119298 - RNA, 18 nt, Human
ucuacucuagggaaaaac

SEQ ID NO: 2119299 - RNA, 22 nt, Human
ucuacuccuaccucagccuaga

SEQ ID NO: 2119300 - RNA, 19 nt, Human
ucuacuccuuguaaagacu

SEQ ID NO: 2119301 - RNA, 18 nt, Human
ucuacucauauauaucua

SEQ ID NO: 2119302 - RNA, 17 nt, Human
ucuacuccuaccucagc

SEQ ID NO: 2119303 - RNA, 19 nt, Human
ucuacuccuaccucagccu

SEQ ID NO: 2119304 - RNA, 14 nt, Human
ucuacucauauaua

SEQ ID NO: 2119305 - RNA, 16 nt, Human
ucuaauuuuuaagcaa

SEQ ID NO: 2119306 - RNA, 20 nt, Human
ucuacuaaaaauacaaaaau

SEQ ID NO: 2119307 - RNA, 15 nt, Human
ucuacuaaaaauaca

SEQ ID NO: 2119308 - RNA, 23 nt, Human
ucuaauuuaucuugucucugggc

SEQ ID NO: 2119309 - RNA, 22 nt, Human
ucuaauuuaucuugucucuggg

SEQ ID NO: 2119310 - RNA, 13 nt, Human
ucuaauugccaug

SEQ ID NO: 2119311 - RNA, 15 nt, Human
ucuaauugccaugua

SEQ ID NO: 2119312 - RNA, 14 nt, Human
ucuaauugccaugu

SEQ ID NO: 2119313 - RNA, 21 nt, Human
ucuaauugaauuuucaagcau

SEQ ID NO: 2119314 - RNA, 20 nt, Human
ucuaauggguauuuaaacaa

SEQ ID NO: 2119315 - RNA, 15 nt, Human
ucuaaugcucacgcu

SEQ ID NO: 2119316 - RNA, 20 nt, Human
ucuaaucugcuaugcuugaa

SEQ ID NO: 2119317 - RNA, 18 nt, Human
ucuaaucaugaaacuccc

SEQ ID NO: 2119318 - RNA, 18 nt, Human
ucguccucccccugccag

SEQ ID NO: 2119319 - RNA, 23 nt, Human
ucguccucccccugccagugccu

SEQ ID NO: 2119320 - RNA, 13 nt, Human
ucguccucccccu

SEQ ID NO: 2119321 - RNA, 14 nt, Human
ucguccucccccug

SEQ ID NO: 2119322 - RNA, 16 nt, Human
ucguccucccccugcc

SEQ ID NO: 2119323 - RNA, 17 nt, Human
ucguccucccccugcca

SEQ ID NO: 2119324 - RNA, 19 nt, Human
ucgucggggggacagcucc

SEQ ID NO: 2119325 - RNA, 23 nt, Human
ucucacucugucgcccagucugg

SEQ ID NO: 2119326 - RNA, 20 nt, Human
ucucacugccaugccagcuu

SEQ ID NO: 2119327 - RNA, 14 nt, Human
ucuaucucacagca

SEQ ID NO: 2119328 - RNA, 18 nt, Human
ucuaucucacagcacacu

SEQ ID NO: 2119329 - RNA, 16 nt, Human
ucuaucuuauauaguu

SEQ ID NO: 2119330 - RNA, 13 nt, Human
ucucaguuucacu

SEQ ID NO: 2119331 - RNA, 15 nt, Human
ucucacuguugccca

SEQ ID NO: 2119332 - RNA, 14 nt, Human
ucucacuguugccc

SEQ ID NO: 2119333 - RNA, 17 nt, Human
ucucacuggaugcaaag

SEQ ID NO: 2119334 - RNA, 13 nt, Human
ucucacugugucc

SEQ ID NO: 2119335 - RNA, 14 nt, Human
ucucacuguguccc

SEQ ID NO: 2119336 - RNA, 21 nt, Human
ucucacugugucccucucucu

SEQ ID NO: 2119337 - RNA, 20 nt, Human
ucucagauauuuauauuuuu

SEQ ID NO: 2119338 - RNA, 23 nt, Human
ucucagauauuuauauuuuuauu

SEQ ID NO: 2119339 - RNA, 14 nt, Human
ucucagauauuuau

SEQ ID NO: 2119340 - RNA, 16 nt, Human
ucucagauauuuauau

SEQ ID NO: 2119341 - RNA, 17 nt, Human
uccuuggggcaggcagu

SEQ ID NO: 2119342 - RNA, 22 nt, Human
uccuuugaucaguauaauuuuu

SEQ ID NO: 2119343 - RNA, 15 nt, Human
uccuuugcaggcuca

SEQ ID NO: 2119344 - RNA, 13 nt, Human
uccuuugggaaag

SEQ ID NO: 2119345 - RNA, 16 nt, Human
uccuugccuccugugu

SEQ ID NO: 2119346 - RNA, 17 nt, Human
uccuugccuccugugua

SEQ ID NO: 2119347 - RNA, 18 nt, Human
uccuugccuccuguguaa

SEQ ID NO: 2119348 - RNA, 17 nt, Human
uccuugcuguccuaggc

SEQ ID NO: 2119349 - RNA, 19 nt, Human
uccuugcuguccuaggcca

SEQ ID NO: 2119350 - RNA, 21 nt, Human
uccuugcuguccuaggccaca

SEQ ID NO: 2119351 - RNA, 14 nt, Human
uccuuacccaucug

SEQ ID NO: 2119352 - RNA, 18 nt, Human
uccuuacccaucugcacc

SEQ ID NO: 2119353 - RNA, 22 nt, Human
uccuuaccgugggcacugaagg

SEQ ID NO: 2119354 - RNA, 14 nt, Human
uccuuaccucuucc

SEQ ID NO: 2119355 - RNA, 21 nt, Human
uccugucccuucucuuaauuu

SEQ ID NO: 2119356 - RNA, 18 nt, Human
uccugucccuucucuuaa

SEQ ID NO: 2119357 - RNA, 14 nt, Human
uccuguccagagag

SEQ ID NO: 2119358 - RNA, 15 nt, Human
uccugaggggcaucu

SEQ ID NO: 2119359 - RNA, 16 nt, Human
uccugaggggcaucug

SEQ ID NO: 2119360 - RNA, 19 nt, Human
uccugaggggcaucugccc

SEQ ID NO: 2119361 - RNA, 18 nt, Human
uccuguccaaccuaaccc

SEQ ID NO: 2119362 - RNA, 20 nt, Human
uccugaggggcaucugcccc

SEQ ID NO: 2119363 - RNA, 20 nt, Human
uccuguccaaccuaaccccu

SEQ ID NO: 2119364 - RNA, 23 nt, Human
uccuuagcuuagaccucagccug

SEQ ID NO: 2119365 - RNA, 15 nt, Human
uccuuagucuucuca

SEQ ID NO: 2119366 - RNA, 16 nt, Human
uccuuagucuucucau

SEQ ID NO: 2119367 - RNA, 17 nt, Human
uccuuagucuucucaua

SEQ ID NO: 2119368 - RNA, 17 nt, Human
uccuuaccucuuccgga

SEQ ID NO: 2119369 - RNA, 17 nt, Human
uccuuaucgaaacucau

SEQ ID NO: 2119370 - RNA, 18 nt, Human
uccuuagucuucucauag

SEQ ID NO: 2119371 - RNA, 22 nt, Human
uccuuagucuucucauagcauu

SEQ ID NO: 2119372 - RNA, 21 nt, Human
uccuuaucacugacacaaaaa

SEQ ID NO: 2119373 - RNA, 23 nt, Human
ucgaugggggagucugaagcaga

SEQ ID NO: 2119374 - RNA, 17 nt, Human
ucgaugggggaugcuuc

SEQ ID NO: 2119375 - RNA, 19 nt, Human
ucgaugggggaugcuucau

SEQ ID NO: 2119376 - RNA, 22 nt, Human
ucgaugggggaugcuucaugug

SEQ ID NO: 2119377 - RNA, 23 nt, Human
ucgaugaagcccaauaaaccucu

SEQ ID NO: 2119378 - RNA, 13 nt, Human
ucgauauuuccau

SEQ ID NO: 2119379 - RNA, 14 nt, Human
ucgauauuuccauc

SEQ ID NO: 2119380 - RNA, 19 nt, Human
ucgauauuuccaucauuaa

SEQ ID NO: 2119381 - RNA, 20 nt, Human
ucgaucucauucaguauuaa

SEQ ID NO: 2119382 - RNA, 19 nt, Human
ucgaugaagcccaauaaac

SEQ ID NO: 2119383 - RNA, 16 nt, Human
uccuuuucuccuaucu

SEQ ID NO: 2119384 - RNA, 19 nt, Human
uccuuuucuccuaucuuca

SEQ ID NO: 2119385 - RNA, 13 nt, Human
uccuuuucuuguu

SEQ ID NO: 2119386 - RNA, 18 nt, Human
uccuuuucuuguuuauca

SEQ ID NO: 2119387 - RNA, 23 nt, Human
uccuuuucuuguuuaucagcagu

SEQ ID NO: 2119388 - RNA, 22 nt, Human
uccuuuucgcaggauucuuccu

SEQ ID NO: 2119389 - RNA, 17 nt, Human
ucgcaggauucuuccuc

SEQ ID NO: 2119390 - RNA, 20 nt, Human
ucgauuauucccuguacaau

SEQ ID NO: 2119391 - RNA, 21 nt, Human
ucgcaggauucuuccucccuc

SEQ ID NO: 2119392 - RNA, 23 nt, Human
ucgcaggauucuuccucccuccc

SEQ ID NO: 2119393 - RNA, 22 nt, Human
ucggaggcuugucagagcuggg

SEQ ID NO: 2119394 - RNA, 23 nt, Human
ucggagccucauccgaggcaggg

SEQ ID NO: 2119395 - RNA, 23 nt, Human
ucggagacagugaucuccauaug

SEQ ID NO: 2119396 - RNA, 22 nt, Human
ucggagccucauccgaggcagg

SEQ ID NO: 2119397 - RNA, 15 nt, Human
ucggagcccugucuc

SEQ ID NO: 2119398 - RNA, 14 nt, Human
ucggagcccugucu

SEQ ID NO: 2119399 - RNA, 23 nt, Human
ucgcccagucuggaaugcagugg

SEQ ID NO: 2119400 - RNA, 19 nt, Human
ucgcccagucuggaaugca

SEQ ID NO: 2119401 - RNA, 14 nt, Human
ucgcccagucugga

SEQ ID NO: 2119402 - RNA, 18 nt, Human
ucgccaccccuccuuccu

SEQ ID NO: 2119403 - RNA, 13 nt, Human
ucgcauuugucaa

SEQ ID NO: 2119404 - RNA, 15 nt, Human
ucgcauuugucaaug

SEQ ID NO: 2119405 - RNA, 16 nt, Human
ucgcccagugcccugg

SEQ ID NO: 2119406 - RNA, 19 nt, Human
ucgcccagugcccuggggc

SEQ ID NO: 2119407 - RNA, 23 nt, Human
ucccuaccgagucucuucuccac

SEQ ID NO: 2119408 - RNA, 22 nt, Human
ucccuaccgagucucuucucca

SEQ ID NO: 2119409 - RNA, 21 nt, Human
ucccuaccgagucucuucucc

SEQ ID NO: 2119410 - RNA, 19 nt, Human
ucccuaccgagucucuucu

SEQ ID NO: 2119411 - RNA, 18 nt, Human
ucccuaccaccuccccag

SEQ ID NO: 2119412 - RNA, 20 nt, Human
ucccuacccccuaagagcca

SEQ ID NO: 2119413 - RNA, 19 nt, Human
ucccuacccccuaagagcc

SEQ ID NO: 2119414 - RNA, 22 nt, Human
ucccaugagccucagcauccug

SEQ ID NO: 2119415 - RNA, 17 nt, Human
ucccaugagccucagca

SEQ ID NO: 2119416 - RNA, 17 nt, Human
ucccuacuuccugugac

SEQ ID NO: 2119417 - RNA, 17 nt, Human
ucccuagaggguuccug

SEQ ID NO: 2119418 - RNA, 18 nt, Human
ucccuagaggguuccugu

SEQ ID NO: 2119419 - RNA, 19 nt, Human
ucccuagaggguuccugua

SEQ ID NO: 2119420 - RNA, 20 nt, Human
ucccuagaggguuccuguag

SEQ ID NO: 2119421 - RNA, 18 nt, Human
ucccucccuuccucuuuc

SEQ ID NO: 2119422 - RNA, 15 nt, Human
ucccucccuuugaaa

SEQ ID NO: 2119423 - RNA, 12 nt, Human
ucccuccucacc

SEQ ID NO: 2119424 - RNA, 20 nt, Human
ucccugcacuugcagacucu

SEQ ID NO: 2119425 - RNA, 16 nt, Human
ucccucuggcccugcc

SEQ ID NO: 2119426 - RNA, 17 nt, Human
ucccucuggcccugccu

SEQ ID NO: 2119427 - RNA, 18 nt, Human
ucccucuggcccugccuu

SEQ ID NO: 2119428 - RNA, 19 nt, Human
ucccucuggcccugccuuc

SEQ ID NO: 2119429 - RNA, 20 nt, Human
ucccucuggcccugccuucu

SEQ ID NO: 2119430 - RNA, 23 nt, Human
ucccucucucuucugcuccaccc

SEQ ID NO: 2119431 - RNA, 13 nt, Human
ucccucugaccug

SEQ ID NO: 2119432 - RNA, 17 nt, Human
ucccucugaccugcagg

SEQ ID NO: 2119433 - RNA, 18 nt, Human
ucccucugaccugcaggc

SEQ ID NO: 2119434 - RNA, 19 nt, Human
ucccucugaccugcaggcc

SEQ ID NO: 2119435 - RNA, 13 nt, Human
ucccucugccggc

SEQ ID NO: 2119436 - RNA, 11 nt, Human
ucccucugccu

SEQ ID NO: 2119437 - RNA, 21 nt, Human
ucccucugccugaaccuucca

SEQ ID NO: 2119438 - RNA, 16 nt, Human
ucccucugccuguccc

SEQ ID NO: 2119439 - RNA, 18 nt, Human
ucccucugccugucccuc

SEQ ID NO: 2119440 - RNA, 20 nt, Human
ucccucugccugucccucuc

SEQ ID NO: 2119441 - RNA, 22 nt, Human
ucccucucaggcaugccugugu

SEQ ID NO: 2119442 - RNA, 23 nt, Human
ucccucucaggcaugccugugug

SEQ ID NO: 2119443 - RNA, 21 nt, Human
ucccucucucuucugcuccac

SEQ ID NO: 2119444 - RNA, 13 nt, Human
ucccuccucaccu

SEQ ID NO: 2119445 - RNA, 19 nt, Human
ucccucucaggcaugccug

SEQ ID NO: 2119446 - RNA, 20 nt, Human
ucccucucaggcaugccugu

SEQ ID NO: 2119447 - RNA, 17 nt, Human
ucccugcccccuccccu

SEQ ID NO: 2119448 - RNA, 15 nt, Human
ucccuggcucucaga

SEQ ID NO: 2119449 - RNA, 16 nt, Human
ucccuggcucucagaa

SEQ ID NO: 2119450 - RNA, 18 nt, Human
ucccuggcucucagaagg

SEQ ID NO: 2119451 - RNA, 19 nt, Human
ucccuggcucucagaaggu

SEQ ID NO: 2119452 - RNA, 20 nt, Human
ucccuggcucucagaaggua

SEQ ID NO: 2119453 - RNA, 18 nt, Human
ucccuggcuuguaacucc

SEQ ID NO: 2119454 - RNA, 19 nt, Human
ucccuggcuuguaacucca

SEQ ID NO: 2119455 - RNA, 21 nt, Human
ucccuggcuuguaacuccacc

SEQ ID NO: 2119456 - RNA, 11 nt, Human
ucccuggcuug

SEQ ID NO: 2119457 - RNA, 19 nt, Human
ucccugggaggaaauuuga

SEQ ID NO: 2119458 - RNA, 22 nt, Human
ucccuggcuuguaacuccacca

SEQ ID NO: 2119459 - RNA, 16 nt, Human
ucccugggcagaaagu

SEQ ID NO: 2119460 - RNA, 12 nt, Human
ucccugggcauu

SEQ ID NO: 2119461 - RNA, 17 nt, Human
ucccugggcauugcuuu

SEQ ID NO: 2119462 - RNA, 18 nt, Human
ucccugccccucccuuca

SEQ ID NO: 2119463 - RNA, 23 nt, Human
ucccugcccagaauucccagcug

SEQ ID NO: 2119464 - RNA, 14 nt, Human
ucccuggcucccau

SEQ ID NO: 2119465 - RNA, 14 nt, Human
ucccugccccuccc

SEQ ID NO: 2119466 - RNA, 15 nt, Human
ucccugccagcaccc

SEQ ID NO: 2119467 - RNA, 18 nt, Human
ucccugccagcaccccca

SEQ ID NO: 2119468 - RNA, 13 nt, Human
ucccugccagcuc

SEQ ID NO: 2119469 - RNA, 16 nt, Human
ucccuucccauaagcu

SEQ ID NO: 2119470 - RNA, 18 nt, Human
ucccugggcauugcuuuc

SEQ ID NO: 2119471 - RNA, 12 nt, Human
uccgagaacuaa

SEQ ID NO: 2119472 - RNA, 12 nt, Human
uccgaggcaggg

SEQ ID NO: 2119473 - RNA, 13 nt, Human
uccgaggcagggu

SEQ ID NO: 2119474 - RNA, 14 nt, Human
uccgaggcaggguc

SEQ ID NO: 2119475 - RNA, 22 nt, Human
uccgcccucaaaaugacagcca

SEQ ID NO: 2119476 - RNA, 21 nt, Human
uccgcuuucuacccagcgagc

SEQ ID NO: 2119477 - RNA, 15 nt, Human
uccggaauccugucc

SEQ ID NO: 2119478 - RNA, 13 nt, Human
ucccuugagaccu

SEQ ID NO: 2119479 - RNA, 16 nt, Human
ucccuugagaccucag

SEQ ID NO: 2119480 - RNA, 17 nt, Human
ucccuugagaccucagc

SEQ ID NO: 2119481 - RNA, 21 nt, Human
uccgaaagggacuuggaagcu

SEQ ID NO: 2119482 - RNA, 17 nt, Human
ucccuucuuuuucuucu

SEQ ID NO: 2119483 - RNA, 16 nt, Human
ucccuucuucugucau

SEQ ID NO: 2119484 - RNA, 19 nt, Human
uccgaacacccucgaagcg

SEQ ID NO: 2119485 - RNA, 22 nt, Human
uccgaaagggacuuggaagcuc

SEQ ID NO: 2119486 - RNA, 12 nt, Human
uccuaucccauc

SEQ ID NO: 2119487 - RNA, 14 nt, Human
uccuaucccauccc

SEQ ID NO: 2119488 - RNA, 15 nt, Human
uccuaucccauccca

SEQ ID NO: 2119489 - RNA, 16 nt, Human
uccuaucccaucccau

SEQ ID NO: 2119490 - RNA, 18 nt, Human
uccuaucccaucccaucc

SEQ ID NO: 2119491 - RNA, 22 nt, Human
uccuaucuucauaucuaucaga

SEQ ID NO: 2119492 - RNA, 18 nt, Human
uccggaauccuguccuca

SEQ ID NO: 2119493 - RNA, 22 nt, Human
uccggaauccuguccucagcuu

SEQ ID NO: 2119494 - RNA, 15 nt, Human
uccggagauguagca

SEQ ID NO: 2119495 - RNA, 21 nt, Human
uccggaggagaagaaggaaau

SEQ ID NO: 2119496 - RNA, 15 nt, Human
uccggaguagcuggg

SEQ ID NO: 2119497 - RNA, 16 nt, Human
uccuaagcuauucagu

SEQ ID NO: 2119498 - RNA, 18 nt, Human
uccuaagcuauucaguaa

SEQ ID NO: 2119499 - RNA, 22 nt, Human
uccuccugagugaucccauuuc

SEQ ID NO: 2119500 - RNA, 23 nt, Human
uccuccugagugaucccauuucu

SEQ ID NO: 2119501 - RNA, 18 nt, Human
uccuccguccagccgcca

SEQ ID NO: 2119502 - RNA, 14 nt, Human
uccuccguccagcc

SEQ ID NO: 2119503 - RNA, 16 nt, Human
uccuccguccagccgc

SEQ ID NO: 2119504 - RNA, 14 nt, Human
uccuauuuuuuuaa

SEQ ID NO: 2119505 - RNA, 22 nt, Human
uccuauuuuuuuaaaaucacua

SEQ ID NO: 2119506 - RNA, 15 nt, Human
uccuauuucuuauag

SEQ ID NO: 2119507 - RNA, 16 nt, Human
uccuauuugcacugua

SEQ ID NO: 2119508 - RNA, 17 nt, Human
uccuccugcccaccugu

SEQ ID NO: 2119509 - RNA, 12 nt, Human
uccuccugccca

SEQ ID NO: 2119510 - RNA, 16 nt, Human
uccuccugcccaccug

SEQ ID NO: 2119511 - RNA, 13 nt, Human
uccucgcaagcug

SEQ ID NO: 2119512 - RNA, 14 nt, Human
uccucgcaagcugg

SEQ ID NO: 2119513 - RNA, 15 nt, Human
uccucgcaagcuggg

SEQ ID NO: 2119514 - RNA, 16 nt, Human
uccucgcaagcugggu

SEQ ID NO: 2119515 - RNA, 23 nt, Human
uccucuggcuggcuaacuggaag

SEQ ID NO: 2119516 - RNA, 9 nt, Human
uccucuggc

SEQ ID NO: 2119517 - RNA, 15 nt, Human
uccugaggaucagaa

SEQ ID NO: 2119518 - RNA, 18 nt, Human
uccugaggaucagaaagu

SEQ ID NO: 2119519 - RNA, 19 nt, Human
uccugaggaucagaaagua

SEQ ID NO: 2119520 - RNA, 13 nt, Human
uccucuguccagg

SEQ ID NO: 2119521 - RNA, 17 nt, Human
uccucuguccaggcacu

SEQ ID NO: 2119522 - RNA, 20 nt, Human
uccucugggcaggaccucag

SEQ ID NO: 2119523 - RNA, 22 nt, Human
uccucuguccaggcacugcugc

SEQ ID NO: 2119524 - RNA, 21 nt, Human
uggaacguuuuuccuguucuu

SEQ ID NO: 2119525 - RNA, 20 nt, Human
uggaacuagguuuuaauaau

SEQ ID NO: 2119526 - RNA, 18 nt, Human
uggaacuagguuuuaaua

SEQ ID NO: 2119527 - RNA, 16 nt, Human
uggaacucauuccugc

SEQ ID NO: 2119528 - RNA, 19 nt, Human
uggaacucauuccugccug

SEQ ID NO: 2119529 - RNA, 21 nt, Human
uggaacucauuccugccuguc

SEQ ID NO: 2119530 - RNA, 16 nt, Human
uggaacucuagggaua

SEQ ID NO: 2119531 - RNA, 14 nt, Human
uggaaguuuugcau

SEQ ID NO: 2119532 - RNA, 14 nt, Human
uggaauaacaugua

SEQ ID NO: 2119533 - RNA, 15 nt, Human
uggaauaacauguaa

SEQ ID NO: 2119534 - RNA, 19 nt, Human
uggaauaacauguaauuaa

SEQ ID NO: 2119535 - RNA, 21 nt, Human
uggaauauaaggaaagcaaua

SEQ ID NO: 2119536 - RNA, 13 nt, Human
uggaauauaaaga

SEQ ID NO: 2119537 - RNA, 14 nt, Human
uggaauauaaggaa

SEQ ID NO: 2119538 - RNA, 18 nt, Human
uggaauauaaggaaagca

SEQ ID NO: 2119539 - RNA, 18 nt, Human
uggacuauuauaauuuaa

SEQ ID NO: 2119540 - RNA, 18 nt, Human
uggaaugacaugugucaa

SEQ ID NO: 2119541 - RNA, 12 nt, Human
uggacagaagaa

SEQ ID NO: 2119542 - RNA, 15 nt, Human
uggacagcaaaacca

SEQ ID NO: 2119543 - RNA, 17 nt, Human
uggacagcaaaaccauu

SEQ ID NO: 2119544 - RNA, 18 nt, Human
uggacagcaaaaccauug

SEQ ID NO: 2119545 - RNA, 20 nt, Human
uggacagcaaaaccauugcu

SEQ ID NO: 2119546 - RNA, 21 nt, Human
uggacagcaaaaccauugcuu

SEQ ID NO: 2119547 - RNA, 22 nt, Human
uggacagcaaaaccauugcuuc

SEQ ID NO: 2119548 - RNA, 19 nt, Human
uggaaagacagcuucucau

SEQ ID NO: 2119549 - RNA, 14 nt, Human
uggaaacuuuucuu

SEQ ID NO: 2119550 - RNA, 21 nt, Human
uggaaacuguugccagagaug

SEQ ID NO: 2119551 - RNA, 14 nt, Human
uggaaacaggacca

SEQ ID NO: 2119552 - RNA, 17 nt, Human
uggaaacuguugccaga

SEQ ID NO: 2119553 - RNA, 13 nt, Human
uggaaacaaagug

SEQ ID NO: 2119554 - RNA, 14 nt, Human
uggaaacaaagugg

SEQ ID NO: 2119555 - RNA, 16 nt, Human
uggaaacaaaguggaa

SEQ ID NO: 2119556 - RNA, 20 nt, Human
uggaaacaaaguggaaggaa

SEQ ID NO: 2119557 - RNA, 21 nt, Human
uggaaacaaaguggaaggaaa

SEQ ID NO: 2119558 - RNA, 22 nt, Human
uggaaacaaaguggaaggaaag

SEQ ID NO: 2119559 - RNA, 23 nt, Human
uggaaacaaaguggaaggaaaga

SEQ ID NO: 2119560 - RNA, 24 nt, Human
uggaaacaaaguggaaggaaagau

SEQ ID NO: 2119561 - RNA, 16 nt, Human
uggaaagcaucaccuc

SEQ ID NO: 2119562 - RNA, 19 nt, Human
uggaaagcaucaccucagg

SEQ ID NO: 2119563 - RNA, 22 nt, Human
uggaaacuuuucuuaaaaaguu

SEQ ID NO: 2119564 - RNA, 23 nt, Human
uggaaagacagcuucucauccug

SEQ ID NO: 2119565 - RNA, 14 nt, Human
uggaacauccuugg

SEQ ID NO: 2119566 - RNA, 21 nt, Human
uggaaccacggagaucuccuu

SEQ ID NO: 2119567 - RNA, 20 nt, Human
uggaaagcaucaccucaggc

SEQ ID NO: 2119568 - RNA, 21 nt, Human
uggaaagcaucaccucaggcc

SEQ ID NO: 2119569 - RNA, 12 nt, Human
uggaaagccucu

SEQ ID NO: 2119570 - RNA, 17 nt, Human
uggaaaaauagccugcc

SEQ ID NO: 2119571 - RNA, 20 nt, Human
uggaaaaauagccugccucu

SEQ ID NO: 2119572 - RNA, 12 nt, Human
uggaaaaauauu

SEQ ID NO: 2119573 - RNA, 13 nt, Human
uggaaaaauccag

SEQ ID NO: 2119574 - RNA, 18 nt, Human
uggaaaaauccagaaaga

SEQ ID NO: 2119575 - RNA, 19 nt, Human
uggaaaaauccagaaagaa

SEQ ID NO: 2119576 - RNA, 18 nt, Human
ugcuuucuuuguuuggcu

SEQ ID NO: 2119577 - RNA, 20 nt, Human
ugcuuugaaacuagacuuga

SEQ ID NO: 2119578 - RNA, 11 nt, Human
ugcuuuacugg

SEQ ID NO: 2119579 - RNA, 15 nt, Human
ugcuuuaauugugaa

SEQ ID NO: 2119580 - RNA, 20 nt, Human
ugcuuuaauugugaauugau

SEQ ID NO: 2119581 - RNA, 19 nt, Human
ugcuuuaauuguuaagaua

SEQ ID NO: 2119582 - RNA, 16 nt, Human
ugcuggacaggucugg

SEQ ID NO: 2119583 - RNA, 19 nt, Human
ugcuggacaggucugggag

SEQ ID NO: 2119584 - RNA, 19 nt, Human
ugcuggacggcauuccugc

SEQ ID NO: 2119585 - RNA, 20 nt, Human
ugcuggacggcauuccugcu

SEQ ID NO: 2119586 - RNA, 19 nt, Human
uggcaggaguuggaagugu

SEQ ID NO: 2119587 - RNA, 19 nt, Human
uggcacgguggcucaggcc

SEQ ID NO: 2119588 - RNA, 20 nt, Human
uggcacgguggcucaggccu

SEQ ID NO: 2119589 - RNA, 13 nt, Human
uggcagcugcuuu

SEQ ID NO: 2119590 - RNA, 21 nt, Human
uggcacccggccccugcuggu

SEQ ID NO: 2119591 - RNA, 20 nt, Human
uggcaccugucgcccagugc

SEQ ID NO: 2119592 - RNA, 12 nt, Human
uggcaccuccua

SEQ ID NO: 2119593 - RNA, 15 nt, Human
uggcaccgccuucuc

SEQ ID NO: 2119594 - RNA, 16 nt, Human
uggcaccgccuucucu

SEQ ID NO: 2119595 - RNA, 13 nt, Human
uggcagugggagc

SEQ ID NO: 2119596 - RNA, 14 nt, Human
uggcaguaaagaga

SEQ ID NO: 2119597 - RNA, 17 nt, Human
uggcaguaaagagaaac

SEQ ID NO: 2119598 - RNA, 19 nt, Human
uggcaguaaagagaaacuu

SEQ ID NO: 2119599 - RNA, 22 nt, Human
uggcaguaaagagaaacuuugu

SEQ ID NO: 2119600 - RNA, 16 nt, Human
uggcagggugggaugg

SEQ ID NO: 2119601 - RNA, 17 nt, Human
uggcagggugggaugga

SEQ ID NO: 2119602 - RNA, 21 nt, Human
uggcagggguggaggagagcc

SEQ ID NO: 2119603 - RNA, 22 nt, Human
uggcagggguggaggagagccu

SEQ ID NO: 2119604 - RNA, 24 nt, Human
uggcagggguggaggagagccugg

SEQ ID NO: 2119605 - RNA, 22 nt, Human
uggcaggaugacccugcgaagg

SEQ ID NO: 2119606 - RNA, 20 nt, Human
uggccacuccagaccccugg

SEQ ID NO: 2119607 - RNA, 17 nt, Human
uggccacuccagacccc

SEQ ID NO: 2119608 - RNA, 14 nt, Human
uggcagcugucuca

SEQ ID NO: 2119609 - RNA, 22 nt, Human
uggcagugcagcaaccagagca

SEQ ID NO: 2119610 - RNA, 21 nt, Human
uggccagaugcaccagcccuu

SEQ ID NO: 2119611 - RNA, 20 nt, Human
uggccagaugcaccagcccu

SEQ ID NO: 2119612 - RNA, 12 nt, Human
uggccagcagcu

SEQ ID NO: 2119613 - RNA, 13 nt, Human
uggccagcagcuu

SEQ ID NO: 2119614 - RNA, 21 nt, Human
uggccagccaacuuuugcaug

SEQ ID NO: 2119615 - RNA, 14 nt, Human
uggccagcagcuug

SEQ ID NO: 2119616 - RNA, 23 nt, Human
uggccaggcagaucugugcccca

SEQ ID NO: 2119617 - RNA, 14 nt, Human
uggccaggauggag

SEQ ID NO: 2119618 - RNA, 12 nt, Human
uggccaggaugg

SEQ ID NO: 2119619 - RNA, 12 nt, Human
uggccaggcaga

SEQ ID NO: 2119620 - RNA, 16 nt, Human
uggccaggcagaucug

SEQ ID NO: 2119621 - RNA, 17 nt, Human
uggccaggcagaucugu

SEQ ID NO: 2119622 - RNA, 19 nt, Human
uggccaggcagaucugugc

SEQ ID NO: 2119623 - RNA, 20 nt, Human
uggccaggcagaucugugcc

SEQ ID NO: 2119624 - RNA, 23 nt, Human
uggccaggagcucuucaggccuc

SEQ ID NO: 2119625 - RNA, 20 nt, Human
uggccaggagcucuucaggc

SEQ ID NO: 2119626 - RNA, 22 nt, Human
uggccaggagcucuucaggccu

SEQ ID NO: 2119627 - RNA, 14 nt, Human
uggccaggagcucu

SEQ ID NO: 2119628 - RNA, 15 nt, Human
uggccaggagcucuu

SEQ ID NO: 2119629 - RNA, 16 nt, Human
uggccaggagcucuuc

SEQ ID NO: 2119630 - RNA, 14 nt, Human
uggacuccucuguc

SEQ ID NO: 2119631 - RNA, 15 nt, Human
uggacuccucugucc

SEQ ID NO: 2119632 - RNA, 17 nt, Human
uggacucuacacuguga

SEQ ID NO: 2119633 - RNA, 21 nt, Human
uggacucuacacugugaacuu

SEQ ID NO: 2119634 - RNA, 15 nt, Human
uggacucuccccucu

SEQ ID NO: 2119635 - RNA, 16 nt, Human
uggacucuccccucuu

SEQ ID NO: 2119636 - RNA, 17 nt, Human
uggacucuccccucuua

SEQ ID NO: 2119637 - RNA, 21 nt, Human
uggacucuccccucuuaugua

SEQ ID NO: 2119638 - RNA, 20 nt, Human
uggagggaaacaccaaacuc

SEQ ID NO: 2119639 - RNA, 14 nt, Human
uggaggagaagaau

SEQ ID NO: 2119640 - RNA, 21 nt, Human
uggaggagaagaauuuucaga

SEQ ID NO: 2119641 - RNA, 14 nt, Human
uggaggagaaggac

SEQ ID NO: 2119642 - RNA, 11 nt, Human
uggaggagagc

SEQ ID NO: 2119643 - RNA, 15 nt, Human
uggaggagagccugg

SEQ ID NO: 2119644 - RNA, 16 nt, Human
uggaggagagccuggu

SEQ ID NO: 2119645 - RNA, 19 nt, Human
uggaggagcucaggacacu

SEQ ID NO: 2119646 - RNA, 21 nt, Human
uggauuuauguuguauagauu

SEQ ID NO: 2119647 - RNA, 22 nt, Human
uggauuuauguuguauagauua

SEQ ID NO: 2119648 - RNA, 14 nt, Human
uggauuucagaaag

SEQ ID NO: 2119649 - RNA, 17 nt, Human
uggauccccagugaaaa

SEQ ID NO: 2119650 - RNA, 19 nt, Human
uggauccccagugaaaacu

SEQ ID NO: 2119651 - RNA, 20 nt, Human
uggauccccagugaaaacua

SEQ ID NO: 2119652 - RNA, 19 nt, Human
uggaucaguccuuugauca

SEQ ID NO: 2119653 - RNA, 16 nt, Human
uggaucaguccuuuga

SEQ ID NO: 2119654 - RNA, 17 nt, Human
uggauuugccugugcca

SEQ ID NO: 2119655 - RNA, 18 nt, Human
uggauuugccugugccac

SEQ ID NO: 2119656 - RNA, 13 nt, Human
ugguauagaaaug

SEQ ID NO: 2119657 - RNA, 22 nt, Human
ugguauagaaaugcugguuuuu

SEQ ID NO: 2119658 - RNA, 14 nt, Human
ugguauagaaaugc

SEQ ID NO: 2119659 - RNA, 16 nt, Human
ugguauagaaaugcug

SEQ ID NO: 2119660 - RNA, 18 nt, Human
ugguaugaucacggcuca

SEQ ID NO: 2119661 - RNA, 16 nt, Human
ugguaucuuaaagugu

SEQ ID NO: 2119662 - RNA, 19 nt, Human
ugguauucaggauuacaug

SEQ ID NO: 2119663 - RNA, 16 nt, Human
uggguaacuagggaag

SEQ ID NO: 2119664 - RNA, 19 nt, Human
ugggguuuaucagaauucu

SEQ ID NO: 2119665 - RNA, 12 nt, Human
uggguaaauuca

SEQ ID NO: 2119666 - RNA, 15 nt, Human
uggguggggugagga

SEQ ID NO: 2119667 - RNA, 20 nt, Human
uggguggggugaggaccacu

SEQ ID NO: 2119668 - RNA, 23 nt, Human
uggguguaacaggucuccucuua

SEQ ID NO: 2119669 - RNA, 18 nt, Human
uggguguguguagccaag

SEQ ID NO: 2119670 - RNA, 22 nt, Human
uggguguaacaggucuccucuu

SEQ ID NO: 2119671 - RNA, 20 nt, Human
uggguguauuaggacuggcu

SEQ ID NO: 2119672 - RNA, 20 nt, Human
uggguguauuuauuuuccuc

SEQ ID NO: 2119673 - RNA, 17 nt, Human
ugggcuucaguggcagc

SEQ ID NO: 2119674 - RNA, 14 nt, Human
ugggcuuguuuucu

SEQ ID NO: 2119675 - RNA, 17 nt, Human
ugggcuuugauuccauc

SEQ ID NO: 2119676 - RNA, 20 nt, Human
ugggcuuugauuccaucucc

SEQ ID NO: 2119677 - RNA, 23 nt, Human
ugggcuuugauuccaucuccuug

SEQ ID NO: 2119678 - RNA, 15 nt, Human
ugggcuucaguggca

SEQ ID NO: 2119679 - RNA, 12 nt, Human
ugggcugugagu

SEQ ID NO: 2119680 - RNA, 15 nt, Human
ugggcugugagugua

SEQ ID NO: 2119681 - RNA, 22 nt, Human
ugggcugugaguguaaguguga

SEQ ID NO: 2119682 - RNA, 17 nt, Human
ugggcuggugucaccug

SEQ ID NO: 2119683 - RNA, 16 nt, Human
ugggcuaguugggcuu

SEQ ID NO: 2119684 - RNA, 16 nt, Human
ugggcuacuuuguccu

SEQ ID NO: 2119685 - RNA, 22 nt, Human
ugggcuaagugauccucccacc

SEQ ID NO: 2119686 - RNA, 16 nt, Human
ugggggcagagggcag

SEQ ID NO: 2119687 - RNA, 15 nt, Human
ugggggaugcuucau

SEQ ID NO: 2119688 - RNA, 17 nt, Human
ugggggcagagggcaga

SEQ ID NO: 2119689 - RNA, 13 nt, Human
ugggggcagaggg

SEQ ID NO: 2119690 - RNA, 19 nt, Human
uggggaacaaggguggcau

SEQ ID NO: 2119691 - RNA, 15 nt, Human
uggggaacaagggug

SEQ ID NO: 2119692 - RNA, 21 nt, Human
ugggggaucacagccucugaa

SEQ ID NO: 2119693 - RNA, 20 nt, Human
ugggggaugacuagaggcag

SEQ ID NO: 2119694 - RNA, 15 nt, Human
uggggauuucuccca

SEQ ID NO: 2119695 - RNA, 20 nt, Human
ugggggaucacagccucuga

SEQ ID NO: 2119696 - RNA, 21 nt, Human
ugggauuacagggaugagcca

SEQ ID NO: 2119697 - RNA, 13 nt, Human
ugggaucugacug

SEQ ID NO: 2119698 - RNA, 14 nt, Human
ugggaucugacugc

SEQ ID NO: 2119699 - RNA, 16 nt, Human
ugggaucugacugcac

SEQ ID NO: 2119700 - RNA, 16 nt, Human
ugggauuacaggugug

SEQ ID NO: 2119701 - RNA, 22 nt, Human
ugggagcugccuguucagcucc

SEQ ID NO: 2119702 - RNA, 21 nt, Human
ugggagcugccuguucagcuc

SEQ ID NO: 2119703 - RNA, 17 nt, Human
ugggagcugccuguuca

SEQ ID NO: 2119704 - RNA, 15 nt, Human
ugggagugagcuggu

SEQ ID NO: 2119705 - RNA, 20 nt, Human
ugggaauguuacauuguuug

SEQ ID NO: 2119706 - RNA, 14 nt, Human
uggcuuuggucucu

SEQ ID NO: 2119707 - RNA, 14 nt, Human
ugggagcugccugu

SEQ ID NO: 2119708 - RNA, 13 nt, Human
ugggagcugccug

SEQ ID NO: 2119709 - RNA, 12 nt, Human
ugggagcugccu

SEQ ID NO: 2119710 - RNA, 16 nt, Human
ugggagaggcagagug

SEQ ID NO: 2119711 - RNA, 15 nt, Human
uggcuuucagagccu

SEQ ID NO: 2119712 - RNA, 17 nt, Human
uggcuuucagagccucc

SEQ ID NO: 2119713 - RNA, 16 nt, Human
uggcuuuccagucaua

SEQ ID NO: 2119714 - RNA, 13 nt, Human
uggcuuuggaagc

SEQ ID NO: 2119715 - RNA, 17 nt, Human
uggcuuugcccaaccuc

SEQ ID NO: 2119716 - RNA, 20 nt, Human
uggcuuugcccaaccucagc

SEQ ID NO: 2119717 - RNA, 22 nt, Human
uggcuuugcccaaccucagcaa

SEQ ID NO: 2119718 - RNA, 23 nt, Human
uggcuuugcccaaccucagcaac

SEQ ID NO: 2119719 - RNA, 20 nt, Human
uggcuugaagccaagucagc

SEQ ID NO: 2119720 - RNA, 15 nt, Human
uggcuucuguuucua

SEQ ID NO: 2119721 - RNA, 16 nt, Human
uggcuucuguuucuag

SEQ ID NO: 2119722 - RNA, 12 nt, Human
uggcuucugaug

SEQ ID NO: 2119723 - RNA, 15 nt, Human
uggcuucugaugaau

SEQ ID NO: 2119724 - RNA, 17 nt, Human
uggcuucugaugaaucu

SEQ ID NO: 2119725 - RNA, 20 nt, Human
uggcuucugaugaaucuugc

SEQ ID NO: 2119726 - RNA, 14 nt, Human
uggcuucuggagcc

SEQ ID NO: 2119727 - RNA, 22 nt, Human
uggcugguaagggccaaguccc

SEQ ID NO: 2119728 - RNA, 22 nt, Human
uggcuggucaacuugagcaugu

SEQ ID NO: 2119729 - RNA, 19 nt, Human
uggcucugaccgaaacagc

SEQ ID NO: 2119730 - RNA, 21 nt, Human
uggcugggggccucagugcca

SEQ ID NO: 2119731 - RNA, 14 nt, Human
uggcuggucaacuu

SEQ ID NO: 2119732 - RNA, 17 nt, Human
uggcucuggaaugacau

SEQ ID NO: 2119733 - RNA, 13 nt, Human
uggcucugagaag

SEQ ID NO: 2119734 - RNA, 15 nt, Human
uggcucugagaaggg

SEQ ID NO: 2119735 - RNA, 18 nt, Human
ugcccaggcuggagugca

SEQ ID NO: 2119736 - RNA, 20 nt, Human
ugcccaggcuggagugcaau

SEQ ID NO: 2119737 - RNA, 13 nt, Human
ugcccaggcugga

SEQ ID NO: 2119738 - RNA, 21 nt, Human
ugcccacccguggagauggga

SEQ ID NO: 2119739 - RNA, 20 nt, Human
ugcccagggcucagccuggu

SEQ ID NO: 2119740 - RNA, 21 nt, Human
ugcccagggcucagccuggug

SEQ ID NO: 2119741 - RNA, 13 nt, Human
ugcccaggcuggc

SEQ ID NO: 2119742 - RNA, 11 nt, Human
ugcccaggcug

SEQ ID NO: 2119743 - RNA, 20 nt, Human
ugccauccagguucagcuug

SEQ ID NO: 2119744 - RNA, 21 nt, Human
ugccauccagguucagcuugu

SEQ ID NO: 2119745 - RNA, 22 nt, Human
ugcccacccucuggagaaggug

SEQ ID NO: 2119746 - RNA, 14 nt, Human
ugcccaccugccca

SEQ ID NO: 2119747 - RNA, 15 nt, Human
ugcccaccugcccau

SEQ ID NO: 2119748 - RNA, 17 nt, Human
ugcccaccugcccauca

SEQ ID NO: 2119749 - RNA, 19 nt, Human
ugcccaccugcccaucaca

SEQ ID NO: 2119750 - RNA, 15 nt, Human
ugccccagggcuccc

SEQ ID NO: 2119751 - RNA, 13 nt, Human
ugccccucccuuc

SEQ ID NO: 2119752 - RNA, 22 nt, Human
ugccccucccccaacccccacc

SEQ ID NO: 2119753 - RNA, 23 nt, Human
ugccccucccccaacccccaccc

SEQ ID NO: 2119754 - RNA, 12 nt, Human
ugccccucccag

SEQ ID NO: 2119755 - RNA, 21 nt, Human
ugccccucccagaacacacuc

SEQ ID NO: 2119756 - RNA, 12 nt, Human
ugccccuccccc

SEQ ID NO: 2119757 - RNA, 17 nt, Human
ugccccucccccaaccc

SEQ ID NO: 2119758 - RNA, 21 nt, Human
ugccccucccccaacccccac

SEQ ID NO: 2119759 - RNA, 14 nt, Human
ugcccaguuaaucu

SEQ ID NO: 2119760 - RNA, 20 nt, Human
ugcccaguuaaucuugcuuu

SEQ ID NO: 2119761 - RNA, 12 nt, Human
ugcccaguguug

SEQ ID NO: 2119762 - RNA, 18 nt, Human
ugcccaguguuguuugua

SEQ ID NO: 2119763 - RNA, 19 nt, Human
ugcccaguguuguuuguaa

SEQ ID NO: 2119764 - RNA, 20 nt, Human
ugcccaguguuguuuguaaa

SEQ ID NO: 2119765 - RNA, 21 nt, Human
ugcccaguguuguuuguaaau

SEQ ID NO: 2119766 - RNA, 22 nt, Human
ugcccaguguuguuuguaaaua

SEQ ID NO: 2119767 - RNA, 23 nt, Human
ugcccagggcucagccugguggg

SEQ ID NO: 2119768 - RNA, 23 nt, Human
ugcccaguuaaucuugcuuucuu

SEQ ID NO: 2119769 - RNA, 22 nt, Human
ugcccaguuaaucuugcuuucu

SEQ ID NO: 2119770 - RNA, 20 nt, Human
ugcccaucacaggguugggc

SEQ ID NO: 2119771 - RNA, 23 nt, Human
ugcccaucacaggguugggccca

SEQ ID NO: 2119772 - RNA, 16 nt, Human
ugcccauccugucugu

SEQ ID NO: 2119773 - RNA, 18 nt, Human
ugcauauccugagccauc

SEQ ID NO: 2119774 - RNA, 16 nt, Human
ugcauauccugagcca

SEQ ID NO: 2119775 - RNA, 17 nt, Human
ugcauauccugagccau

SEQ ID NO: 2119776 - RNA, 15 nt, Human
ugcauauguaugacu

SEQ ID NO: 2119777 - RNA, 12 nt, Human
ugcauauguaug

SEQ ID NO: 2119778 - RNA, 22 nt, Human
ugccaccaggagaaccacuaca

SEQ ID NO: 2119779 - RNA, 14 nt, Human
ugccaccaggagaa

SEQ ID NO: 2119780 - RNA, 17 nt, Human
ugccaccaggagaacca

SEQ ID NO: 2119781 - RNA, 12 nt, Human
ugccaccaggag

SEQ ID NO: 2119782 - RNA, 13 nt, Human
ugccaccaggaga

SEQ ID NO: 2119783 - RNA, 22 nt, Human
ugccacuacggaauaguuggcu

SEQ ID NO: 2119784 - RNA, 19 nt, Human
ugccacccuggggagaaag

SEQ ID NO: 2119785 - RNA, 12 nt, Human
ugccacccacca

SEQ ID NO: 2119786 - RNA, 17 nt, Human
ugccacccaccagggcg

SEQ ID NO: 2119787 - RNA, 18 nt, Human
ugccaccauggccagcca

SEQ ID NO: 2119788 - RNA, 22 nt, Human
ugccagguuuuuggucugaccc

SEQ ID NO: 2119789 - RNA, 19 nt, Human
ugccagguuuuuggucuga

SEQ ID NO: 2119790 - RNA, 18 nt, Human
ugccagguuuuuggucug

SEQ ID NO: 2119791 - RNA, 10 nt, Human
ugccaggcau

SEQ ID NO: 2119792 - RNA, 16 nt, Human
ugccacuaggcugggu

SEQ ID NO: 2119793 - RNA, 18 nt, Human
ugccacuaggcugggugc

SEQ ID NO: 2119794 - RNA, 21 nt, Human
ugccacuaggcugggugccca

SEQ ID NO: 2119795 - RNA, 22 nt, Human
ugccacuaggcugggugcccac

SEQ ID NO: 2119796 - RNA, 23 nt, Human
ugccacuaggcugggugcccaca

SEQ ID NO: 2119797 - RNA, 13 nt, Human
ugcauauccugag

SEQ ID NO: 2119798 - RNA, 17 nt, Human
ugcauauauacauauau

SEQ ID NO: 2119799 - RNA, 17 nt, Human
ugcaguggcucacgccu

SEQ ID NO: 2119800 - RNA, 22 nt, Human
ugcagugguaugaucacggcuc

SEQ ID NO: 2119801 - RNA, 16 nt, Human
ugcagugcuuccaagg

SEQ ID NO: 2119802 - RNA, 19 nt, Human
ugcaggccccgcuugucca

SEQ ID NO: 2119803 - RNA, 13 nt, Human
ugcagugagcuga

SEQ ID NO: 2119804 - RNA, 22 nt, Human
ugcagugauuaaggucucucuu

SEQ ID NO: 2119805 - RNA, 10 nt, Human
ugcaggcccc

SEQ ID NO: 2119806 - RNA, 20 nt, Human
ugcaggccaagagcagaggc

SEQ ID NO: 2119807 - RNA, 21 nt, Human
ugcaggccaagagcagaggca

SEQ ID NO: 2119808 - RNA, 23 nt, Human
ugcagcaugaccugugaccagca

SEQ ID NO: 2119809 - RNA, 22 nt, Human
ugcagcaguucaccuauuucaa

SEQ ID NO: 2119810 - RNA, 15 nt, Human
ugcagcauaugagga

SEQ ID NO: 2119811 - RNA, 17 nt, Human
ugcagcauaugaggaug

SEQ ID NO: 2119812 - RNA, 20 nt, Human
ugcagcauaugaggaugcag

SEQ ID NO: 2119813 - RNA, 13 nt, Human
ugcagcaugaccu

SEQ ID NO: 2119814 - RNA, 17 nt, Human
ugcagcaugaccuguga

SEQ ID NO: 2119815 - RNA, 19 nt, Human
ugcagcaugaccugugacc

SEQ ID NO: 2119816 - RNA, 22 nt, Human
ugcagcaugaccugugaccagc

SEQ ID NO: 2119817 - RNA, 18 nt, Human
ugcagcagugagucucuu

SEQ ID NO: 2119818 - RNA, 22 nt, Human
ugcagcagugagucucuucaga

SEQ ID NO: 2119819 - RNA, 12 nt, Human
ugcagcagcuug

SEQ ID NO: 2119820 - RNA, 16 nt, Human
ugcagcagcuugcugc

SEQ ID NO: 2119821 - RNA, 19 nt, Human
ugcagcagcuugcugcacc

SEQ ID NO: 2119822 - RNA, 20 nt, Human
ugcagcagcuugcugcaccc

SEQ ID NO: 2119823 - RNA, 15 nt, Human
ugcaccgggccacag

SEQ ID NO: 2119824 - RNA, 14 nt, Human
ugcaccgggccaca

SEQ ID NO: 2119825 - RNA, 22 nt, Human
ugcaccgggccacagagaaagu

SEQ ID NO: 2119826 - RNA, 17 nt, Human
ugcaccgggccacagag

SEQ ID NO: 2119827 - RNA, 17 nt, Human
ugcacgcccauguguga

SEQ ID NO: 2119828 - RNA, 19 nt, Human
ugcacgcccaugugugagu

SEQ ID NO: 2119829 - RNA, 22 nt, Human
ugcacgcccaugugugagugug

SEQ ID NO: 2119830 - RNA, 19 nt, Human
ugcacgcacacugucugcc

SEQ ID NO: 2119831 - RNA, 15 nt, Human
ugcacgcccaugugu

SEQ ID NO: 2119832 - RNA, 21 nt, Human
ugcagagcaggaaacaugacu

SEQ ID NO: 2119833 - RNA, 13 nt, Human
ugcagaggggaaa

SEQ ID NO: 2119834 - RNA, 13 nt, Human
ugcagcagagccu

SEQ ID NO: 2119835 - RNA, 20 nt, Human
ugcagcagcaacacaauguu

SEQ ID NO: 2119836 - RNA, 22 nt, Human
ugcagcagcaacacaauguuau

SEQ ID NO: 2119837 - RNA, 15 nt, Human
ugcacuguaugcugg

SEQ ID NO: 2119838 - RNA, 16 nt, Human
ugcacuguaugcugga

SEQ ID NO: 2119839 - RNA, 21 nt, Human
ugcacuggaguccagucucuu

SEQ ID NO: 2119840 - RNA, 15 nt, Human
ugcacuggaguccag

SEQ ID NO: 2119841 - RNA, 18 nt, Human
ugcacuggaguccagucu

SEQ ID NO: 2119842 - RNA, 19 nt, Human
ugcacuggaguccagucuc

SEQ ID NO: 2119843 - RNA, 20 nt, Human
ugcacuggaguccagucucu

SEQ ID NO: 2119844 - RNA, 15 nt, Human
ugccugugagccagu

SEQ ID NO: 2119845 - RNA, 16 nt, Human
ugccugugagccaguc

SEQ ID NO: 2119846 - RNA, 14 nt, Human
ugccugugaggcag

SEQ ID NO: 2119847 - RNA, 16 nt, Human
ugccugugaggcaggg

SEQ ID NO: 2119848 - RNA, 19 nt, Human
ugccuucguuaacugugua

SEQ ID NO: 2119849 - RNA, 20 nt, Human
ugccuucguuaacuguguau

SEQ ID NO: 2119850 - RNA, 22 nt, Human
ugccuucguuaacuguguaugu

SEQ ID NO: 2119851 - RNA, 17 nt, Human
ugccugugaggcagggg

SEQ ID NO: 2119852 - RNA, 21 nt, Human
ugccuucuucggggaacuccu

SEQ ID NO: 2119853 - RNA, 22 nt, Human
ugccuucuucggggaacuccug

SEQ ID NO: 2119854 - RNA, 23 nt, Human
ugccuucuucggggaacuccugg

SEQ ID NO: 2119855 - RNA, 21 nt, Human
ugcgaucuggguucacugcaa

SEQ ID NO: 2119856 - RNA, 20 nt, Human
ugcgaucuggguucacugca

SEQ ID NO: 2119857 - RNA, 19 nt, Human
ugcgaucuggguucacugc

SEQ ID NO: 2119858 - RNA, 15 nt, Human
ugcgaucuggguuca

SEQ ID NO: 2119859 - RNA, 15 nt, Human
ugccuugaagccacu

SEQ ID NO: 2119860 - RNA, 13 nt, Human
ugcgagugugugc

SEQ ID NO: 2119861 - RNA, 17 nt, Human
ugcgagugugugcaugu

SEQ ID NO: 2119862 - RNA, 14 nt, Human
ugccuugaagccac

SEQ ID NO: 2119863 - RNA, 14 nt, Human
ugcgaucuggguuc

SEQ ID NO: 2119864 - RNA, 22 nt, Human
ugcgagugugugcaugugugug

SEQ ID NO: 2119865 - RNA, 19 nt, Human
ugcgagugugugcaugugu

SEQ ID NO: 2119866 - RNA, 21 nt, Human
ugcgagugugugcaugugugu

SEQ ID NO: 2119867 - RNA, 15 nt, Human
ugcgaucauggcuca

SEQ ID NO: 2119868 - RNA, 21 nt, Human
ugcgaucauggcucacugcag

SEQ ID NO: 2119869 - RNA, 23 nt, Human
ugcgaucauggcucacugcagcc

SEQ ID NO: 2119870 - RNA, 22 nt, Human
ugcgugaaacacaccaggcugu

SEQ ID NO: 2119871 - RNA, 23 nt, Human
ugcgucuuagcagugauuuuuau

SEQ ID NO: 2119872 - RNA, 14 nt, Human
ugcgugaaacacac

SEQ ID NO: 2119873 - RNA, 22 nt, Human
ugcgccuacaggagugagcacu

SEQ ID NO: 2119874 - RNA, 16 nt, Human
ugcgccuacaggagug

SEQ ID NO: 2119875 - RNA, 14 nt, Human
ugcgccuacaggag

SEQ ID NO: 2119876 - RNA, 21 nt, Human
ugcuaaauuuucaguagggcu

SEQ ID NO: 2119877 - RNA, 18 nt, Human
ugcuaaauguaagaauca

SEQ ID NO: 2119878 - RNA, 24 nt, Human
ugcuaaauguaagaaucauuguaa

SEQ ID NO: 2119879 - RNA, 15 nt, Human
ugcuaaauuuucagu

SEQ ID NO: 2119880 - RNA, 15 nt, Human
ugcuaaaugugaaug

SEQ ID NO: 2119881 - RNA, 12 nt, Human
ugcuaaaucucc

SEQ ID NO: 2119882 - RNA, 16 nt, Human
ugcuaaaucuccuauu

SEQ ID NO: 2119883 - RNA, 17 nt, Human
ugcuaaaucuccuauuu

SEQ ID NO: 2119884 - RNA, 20 nt, Human
ugcuaaauggucgcccagga

SEQ ID NO: 2119885 - RNA, 21 nt, Human
ugcuaaauggucgcccaggag

SEQ ID NO: 2119886 - RNA, 22 nt, Human
ugcuaaauggucgcccaggaga

SEQ ID NO: 2119887 - RNA, 15 nt, Human
ugccuguaguuagga

SEQ ID NO: 2119888 - RNA, 22 nt, Human
ugccugucuccuuugcaggcuc

SEQ ID NO: 2119889 - RNA, 23 nt, Human
ugccugucuccuuugcaggcuca

SEQ ID NO: 2119890 - RNA, 13 nt, Human
ugccuguaguuag

SEQ ID NO: 2119891 - RNA, 15 nt, Human
ugccuguaaacauag

SEQ ID NO: 2119892 - RNA, 15 nt, Human
ugccuguaacuugag

SEQ ID NO: 2119893 - RNA, 16 nt, Human
ugccugguggcagcug

SEQ ID NO: 2119894 - RNA, 15 nt, Human
ugccugguggcagcu

SEQ ID NO: 2119895 - RNA, 14 nt, Human
ugccugguggcagc

SEQ ID NO: 2119896 - RNA, 19 nt, Human
ugccugagggcgaggggag

SEQ ID NO: 2119897 - RNA, 18 nt, Human
ugccugagcaccucccag

SEQ ID NO: 2119898 - RNA, 19 nt, Human
ugccugagcaccucccagc

SEQ ID NO: 2119899 - RNA, 20 nt, Human
ugccugagcaccucccagcc

SEQ ID NO: 2119900 - RNA, 22 nt, Human
ugccugagcaccucccagcccc

SEQ ID NO: 2119901 - RNA, 18 nt, Human
ugccugggaaccuuccug

SEQ ID NO: 2119902 - RNA, 21 nt, Human
ugccugggaaccuuccugucu

SEQ ID NO: 2119903 - RNA, 14 nt, Human
ugccugggaaugua

SEQ ID NO: 2119904 - RNA, 15 nt, Human
ugccugggaauguau

SEQ ID NO: 2119905 - RNA, 16 nt, Human
ugccugggaauguauu

SEQ ID NO: 2119906 - RNA, 22 nt, Human
ugccugggcucccuugugcgug

SEQ ID NO: 2119907 - RNA, 18 nt, Human
ugccuggucuccugcccc

SEQ ID NO: 2119908 - RNA, 20 nt, Human
ugccuggucuccugccccca

SEQ ID NO: 2119909 - RNA, 21 nt, Human
ugccuggucuccugcccccac

SEQ ID NO: 2119910 - RNA, 19 nt, Human
ugccucgaacuggcugcaa

SEQ ID NO: 2119911 - RNA, 18 nt, Human
ugccucgaacuggcugca

SEQ ID NO: 2119912 - RNA, 20 nt, Human
ugccucgaacuggcugcaaa

SEQ ID NO: 2119913 - RNA, 14 nt, Human
ugccccuucuacac

SEQ ID NO: 2119914 - RNA, 15 nt, Human
ugccccuucuacacu

SEQ ID NO: 2119915 - RNA, 16 nt, Human
ugccccuucuacacuc

SEQ ID NO: 2119916 - RNA, 18 nt, Human
ugccccuucuacacucuc

SEQ ID NO: 2119917 - RNA, 20 nt, Human
ugccccuucuacacucuccu

SEQ ID NO: 2119918 - RNA, 22 nt, Human
ugccccuucuacacucuccugg

SEQ ID NO: 2119919 - RNA, 23 nt, Human
ugccccuucuacacucuccuggg

SEQ ID NO: 2119920 - RNA, 14 nt, Human
ugccccuggcucug

SEQ ID NO: 2119921 - RNA, 16 nt, Human
ugccugaaccuuccau

SEQ ID NO: 2119922 - RNA, 13 nt, Human
ugccugaagaaca

SEQ ID NO: 2119923 - RNA, 18 nt, Human
ugccucuuuccuguuguu

SEQ ID NO: 2119924 - RNA, 14 nt, Human
ugccucuuuccugu

SEQ ID NO: 2119925 - RNA, 18 nt, Human
ugccucucccuggcccuc

SEQ ID NO: 2119926 - RNA, 20 nt, Human
ugcugaacaaaaaauaaaaa

SEQ ID NO: 2119927 - RNA, 13 nt, Human
ugcugaagcuuau

SEQ ID NO: 2119928 - RNA, 18 nt, Human
ugcugaagcuuauuaaug

SEQ ID NO: 2119929 - RNA, 19 nt, Human
ugcugaagcuuauuaaugc

SEQ ID NO: 2119930 - RNA, 23 nt, Human
ugcugaaggaauaaauugcuccu

SEQ ID NO: 2119931 - RNA, 20 nt, Human
ugcugaagcuuauuaaugcu

SEQ ID NO: 2119932 - RNA, 21 nt, Human
ugcugaagcuuauuaaugcua

SEQ ID NO: 2119933 - RNA, 22 nt, Human
ugcugaagcuuauuaaugcuaa

SEQ ID NO: 2119934 - RNA, 23 nt, Human
ugcugaagcuuauuaaugcuaag

SEQ ID NO: 2119935 - RNA, 23 nt, Human
ugcugacagacacaggcccggcu

SEQ ID NO: 2119936 - RNA, 22 nt, Human
ugcugacagacacaggcccggc

SEQ ID NO: 2119937 - RNA, 15 nt, Human
ugcugacagcugacc

SEQ ID NO: 2119938 - RNA, 21 nt, Human
ugcugcuaaucuucagggcac

SEQ ID NO: 2119939 - RNA, 22 nt, Human
ugcugcuaaucuucagggcacu

SEQ ID NO: 2119940 - RNA, 17 nt, Human
ugcugcuaaucuucagg

SEQ ID NO: 2119941 - RNA, 14 nt, Human
ugcugcgucuccca

SEQ ID NO: 2119942 - RNA, 15 nt, Human
ugcugcgucucccau

SEQ ID NO: 2119943 - RNA, 15 nt, Human
ugcugcgcccuuccc

SEQ ID NO: 2119944 - RNA, 17 nt, Human
ugcugcuuuuccuuggg

SEQ ID NO: 2119945 - RNA, 20 nt, Human
ugcugcuuuuccuuggggca

SEQ ID NO: 2119946 - RNA, 19 nt, Human
ugcugcuauccugccaaaa

SEQ ID NO: 2119947 - RNA, 14 nt, Human
ugcuccucucccca

SEQ ID NO: 2119948 - RNA, 16 nt, Human
ugcucaguagucagac

SEQ ID NO: 2119949 - RNA, 18 nt, Human
ugcucagguacagagaag

SEQ ID NO: 2119950 - RNA, 22 nt, Human
ugcucagguacagagaaggaau

SEQ ID NO: 2119951 - RNA, 16 nt, Human
ugcucagggucaauuu

SEQ ID NO: 2119952 - RNA, 20 nt, Human
ugcucagggucaauuucuuu

SEQ ID NO: 2119953 - RNA, 20 nt, Human
ugcucagcaaggggcucugc

SEQ ID NO: 2119954 - RNA, 14 nt, Human
ugcucagggcugac

SEQ ID NO: 2119955 - RNA, 19 nt, Human
ugcucaggggcguguggcu

SEQ ID NO: 2119956 - RNA, 16 nt, Human
ugcucacauaucuguc

SEQ ID NO: 2119957 - RNA, 15 nt, Human
ugcucacauaucugu

SEQ ID NO: 2119958 - RNA, 19 nt, Human
ugcucacacuccacauccc

SEQ ID NO: 2119959 - RNA, 13 nt, Human
ugcucacagcugu

SEQ ID NO: 2119960 - RNA, 14 nt, Human
ugcucacagcugua

SEQ ID NO: 2119961 - RNA, 18 nt, Human
ugcuccucuccccagcaa

SEQ ID NO: 2119962 - RNA, 17 nt, Human
ugcuccucuccccagca

SEQ ID NO: 2119963 - RNA, 23 nt, Human
ugcucgauuauucccuguacaau

SEQ ID NO: 2119964 - RNA, 23 nt, Human
ugcucuaucucacagcacacuca

SEQ ID NO: 2119965 - RNA, 21 nt, Human
ugcucuccucuugccacugcc

SEQ ID NO: 2119966 - RNA, 18 nt, Human
ugcucuccucuugccacu

SEQ ID NO: 2119967 - RNA, 14 nt, Human
ugcucuccucuugc

SEQ ID NO: 2119968 - RNA, 14 nt, Human
ugcucuccccugcc

SEQ ID NO: 2119969 - RNA, 16 nt, Human
ugcucuccucuugcca

SEQ ID NO: 2119970 - RNA, 12 nt, Human
ugcucuccccug

SEQ ID NO: 2119971 - RNA, 13 nt, Human
ugcucuccccugc

SEQ ID NO: 2119972 - RNA, 22 nt, Human
ugcucuccucuugccacugccu

SEQ ID NO: 2119973 - RNA, 12 nt, Human
ugcucuccuuuc

SEQ ID NO: 2119974 - RNA, 15 nt, Human
ugcucuccccugccc

SEQ ID NO: 2119975 - RNA, 15 nt, Human
ugcugaaacaggaga

SEQ ID NO: 2119976 - RNA, 17 nt, Human
ugcugaaacaggagaga

SEQ ID NO: 2119977 - RNA, 22 nt, Human
ugcugaaagagaaaagaggggu

SEQ ID NO: 2119978 - RNA, 15 nt, Human
ugcugaacaaaaaau

SEQ ID NO: 2119979 - RNA, 18 nt, Human
ugcugaacaaaaaauaaa

SEQ ID NO: 2119980 - RNA, 21 nt, Human
uguacagucuuguauuaaguu

SEQ ID NO: 2119981 - RNA, 13 nt, Human
uguacacacuuua

SEQ ID NO: 2119982 - RNA, 14 nt, Human
uguacacacuuuau

SEQ ID NO: 2119983 - RNA, 19 nt, Human
uguacacacuuuauuuacu

SEQ ID NO: 2119984 - RNA, 17 nt, Human
uguacaguguguaaagu

SEQ ID NO: 2119985 - RNA, 19 nt, Human
uguacaguguguaaagugu

SEQ ID NO: 2119986 - RNA, 15 nt, Human
uguacaguugggaaa

SEQ ID NO: 2119987 - RNA, 16 nt, Human
uguaauguuacugauc

SEQ ID NO: 2119988 - RNA, 17 nt, Human
uguaauguuacugauca

SEQ ID NO: 2119989 - RNA, 19 nt, Human
uguaauguuacugaucaug

SEQ ID NO: 2119990 - RNA, 22 nt, Human
uguaauguuacugaucaugcau

SEQ ID NO: 2119991 - RNA, 17 nt, Human
uguaauuaaguacuaug

SEQ ID NO: 2119992 - RNA, 17 nt, Human
uguacaauauuuaaaau

SEQ ID NO: 2119993 - RNA, 14 nt, Human
uguacaauauuuaa

SEQ ID NO: 2119994 - RNA, 15 nt, Human
uguacaauauuuaaa

SEQ ID NO: 2119995 - RNA, 15 nt, Human
uguacaauauuuuaa

SEQ ID NO: 2119996 - RNA, 18 nt, Human
uguacaauauuuuaagca

SEQ ID NO: 2119997 - RNA, 19 nt, Human
uguacaauauuuuaagcau

SEQ ID NO: 2119998 - RNA, 20 nt, Human
uguacaauauuuuaagcauu

SEQ ID NO: 2119999 - RNA, 21 nt, Human
uguacaauauuuuaagcauua

SEQ ID NO: 2120000 - RNA, 22 nt, Human
uguacaauugaacuuaaauaaa

SEQ ID NO: 2120001 - RNA, 23 nt, Human
uguacaauugaacuuaaauaaau

SEQ ID NO: 2120002 - RNA, 20 nt, Human
uguaaucccagcuacucagg

SEQ ID NO: 2120003 - RNA, 21 nt, Human
uguaaucccagcuacucagga

SEQ ID NO: 2120004 - RNA, 20 nt, Human
uguaaucccagcuacucggg

SEQ ID NO: 2120005 - RNA, 23 nt, Human
uguaaucccagcuacucaggagg

SEQ ID NO: 2120006 - RNA, 22 nt, Human
uguaaucccagcuacuugggag

SEQ ID NO: 2120007 - RNA, 23 nt, Human
uguaaugucaccaccuucccagc

SEQ ID NO: 2120008 - RNA, 14 nt, Human
uguaauguuacuga

SEQ ID NO: 2120009 - RNA, 13 nt, Human
uguaauguuacug

SEQ ID NO: 2120010 - RNA, 16 nt, Human
uguaaucguuaugugu

SEQ ID NO: 2120011 - RNA, 18 nt, Human
uguaaucguuaugugugu

SEQ ID NO: 2120012 - RNA, 19 nt, Human
uguaaucguuaugugugua

SEQ ID NO: 2120013 - RNA, 21 nt, Human
uguaaucguuauguguguaua

SEQ ID NO: 2120014 - RNA, 20 nt, Human
uguaauaaaaaguauauguu

SEQ ID NO: 2120015 - RNA, 20 nt, Human
uguaauaaacucauuucuag

SEQ ID NO: 2120016 - RNA, 13 nt, Human
uguaauaaaguau

SEQ ID NO: 2120017 - RNA, 15 nt, Human
uguaauaaaguauau

SEQ ID NO: 2120018 - RNA, 16 nt, Human
uguaauaaaguauaua

SEQ ID NO: 2120019 - RNA, 19 nt, Human
uguaauaaaguauauaauu

SEQ ID NO: 2120020 - RNA, 13 nt, Human
uguaauaaagugu

SEQ ID NO: 2120021 - RNA, 14 nt, Human
uguaauaaaguguu

SEQ ID NO: 2120022 - RNA, 16 nt, Human
uguaauaaaguguuuu

SEQ ID NO: 2120023 - RNA, 17 nt, Human
uguaauaaaguguuuuc

SEQ ID NO: 2120024 - RNA, 18 nt, Human
uguaauaaaguguuuuca

SEQ ID NO: 2120025 - RNA, 19 nt, Human
uguaauaaaguguuuucag

SEQ ID NO: 2120026 - RNA, 20 nt, Human
uguaauaaaguguuuucaga

SEQ ID NO: 2120027 - RNA, 22 nt, Human
uggucaagauuuugaaugcuuc

SEQ ID NO: 2120028 - RNA, 22 nt, Human
uggucaauccgaaguaugaggg

SEQ ID NO: 2120029 - RNA, 14 nt, Human
uggucacagagaac

SEQ ID NO: 2120030 - RNA, 22 nt, Human
uguagccucgccgucugugaau

SEQ ID NO: 2120031 - RNA, 17 nt, Human
uguagccccaagaaggc

SEQ ID NO: 2120032 - RNA, 21 nt, Human
uguagccccaagaaggcuggg

SEQ ID NO: 2120033 - RNA, 22 nt, Human
uguagccccaagaaggcugggg

SEQ ID NO: 2120034 - RNA, 16 nt, Human
uguagccuugcccgga

SEQ ID NO: 2120035 - RNA, 17 nt, Human
uguagccuugcccggau

SEQ ID NO: 2120036 - RNA, 14 nt, Human
uguagcugguuucc

SEQ ID NO: 2120037 - RNA, 15 nt, Human
uguaguuaggaaaua

SEQ ID NO: 2120038 - RNA, 23 nt, Human
uguaguuaggaaauaaaaccuuu

SEQ ID NO: 2120039 - RNA, 12 nt, Human
uguaguuaggaa

SEQ ID NO: 2120040 - RNA, 13 nt, Human
uguaguuaggaaa

SEQ ID NO: 2120041 - RNA, 14 nt, Human
uguaguuaggaaau

SEQ ID NO: 2120042 - RNA, 15 nt, Human
uguacgucugacagg

SEQ ID NO: 2120043 - RNA, 21 nt, Human
uguaccgggcuggccugugcc

SEQ ID NO: 2120044 - RNA, 19 nt, Human
uguacugcauaugaaagga

SEQ ID NO: 2120045 - RNA, 12 nt, Human
uguacuggagag

SEQ ID NO: 2120046 - RNA, 19 nt, Human
uguacuggagagcaacaca

SEQ ID NO: 2120047 - RNA, 16 nt, Human
uguacuguaaagaauu

SEQ ID NO: 2120048 - RNA, 12 nt, Human
uguacuguaguu

SEQ ID NO: 2120049 - RNA, 16 nt, Human
uguacuguaguuuuuc

SEQ ID NO: 2120050 - RNA, 22 nt, Human
uguagauauugugaaguacaua

SEQ ID NO: 2120051 - RNA, 19 nt, Human
uguagauauugugaaguac

SEQ ID NO: 2120052 - RNA, 21 nt, Human
uguagauauugugaaguacau

SEQ ID NO: 2120053 - RNA, 10 nt, Human
uguagccaag

SEQ ID NO: 2120054 - RNA, 13 nt, Human
uguauaaaaauag

SEQ ID NO: 2120055 - RNA, 19 nt, Human
uguaguuuuucuucaacau

SEQ ID NO: 2120056 - RNA, 15 nt, Human
uguauuguucccagu

SEQ ID NO: 2120057 - RNA, 19 nt, Human
uguauuguucccagugaca

SEQ ID NO: 2120058 - RNA, 12 nt, Human
uguauuguuccc

SEQ ID NO: 2120059 - RNA, 13 nt, Human
uguauuguuccca

SEQ ID NO: 2120060 - RNA, 14 nt, Human
uguauuguucccag

SEQ ID NO: 2120061 - RNA, 17 nt, Human
ugucacacacuuuggcu

SEQ ID NO: 2120062 - RNA, 12 nt, Human
ugucacaggcag

SEQ ID NO: 2120063 - RNA, 21 nt, Human
ugucaccaccuucccagcucu

SEQ ID NO: 2120064 - RNA, 23 nt, Human
ugucaccaccuucccagcucucc

SEQ ID NO: 2120065 - RNA, 18 nt, Human
ugucaccggauccugggu

SEQ ID NO: 2120066 - RNA, 19 nt, Human
ugucaccggauccugggug

SEQ ID NO: 2120067 - RNA, 16 nt, Human
ugucaccaccuuccca

SEQ ID NO: 2120068 - RNA, 18 nt, Human
ugucaccaccuucccagc

SEQ ID NO: 2120069 - RNA, 19 nt, Human
ugucaccaccuucccagcu

SEQ ID NO: 2120070 - RNA, 13 nt, Human
uguauuuaaauau

SEQ ID NO: 2120071 - RNA, 19 nt, Human
uguauuuuauaaaauuaaa

SEQ ID NO: 2120072 - RNA, 22 nt, Human
uguauuuuauaaaauuaaagaa

SEQ ID NO: 2120073 - RNA, 13 nt, Human
uguauuuuaugua

SEQ ID NO: 2120074 - RNA, 14 nt, Human
uguauuuuauguau

SEQ ID NO: 2120075 - RNA, 16 nt, Human
uguauuuuauguaugu

SEQ ID NO: 2120076 - RNA, 18 nt, Human
uguauuuuauguauguuu

SEQ ID NO: 2120077 - RNA, 19 nt, Human
uguauuuuauguauguuua

SEQ ID NO: 2120078 - RNA, 18 nt, Human
uguauuuauuuuccuccc

SEQ ID NO: 2120079 - RNA, 19 nt, Human
uguauuuauuuuccucccc

SEQ ID NO: 2120080 - RNA, 20 nt, Human
uguauuuauuuuccucccca

SEQ ID NO: 2120081 - RNA, 15 nt, Human
uguauuuccagugca

SEQ ID NO: 2120082 - RNA, 11 nt, Human
uguauuuuauu

SEQ ID NO: 2120083 - RNA, 21 nt, Human
uguauuuuauuuuuuucucuc

SEQ ID NO: 2120084 - RNA, 23 nt, Human
ugucaucuuucuucuauuuuauu

SEQ ID NO: 2120085 - RNA, 13 nt, Human
ugucauuaaaaua

SEQ ID NO: 2120086 - RNA, 18 nt, Human
ugucauuaaaauaaauaa

SEQ ID NO: 2120087 - RNA, 13 nt, Human
ugucaccugaaga

SEQ ID NO: 2120088 - RNA, 16 nt, Human
ugucaccgugagcagc

SEQ ID NO: 2120089 - RNA, 22 nt, Human
ugucaccgugagcagcuuugga

SEQ ID NO: 2120090 - RNA, 23 nt, Human
ugucaccgugagcagcuuuggaa

SEQ ID NO: 2120091 - RNA, 16 nt, Human
ugucccaacuuguaaa

SEQ ID NO: 2120092 - RNA, 16 nt, Human
ugucauuugagcaggg

SEQ ID NO: 2120093 - RNA, 19 nt, Human
ugucauuugagcagggcuc

SEQ ID NO: 2120094 - RNA, 17 nt, Human
uguccagggcccugagc

SEQ ID NO: 2120095 - RNA, 19 nt, Human
uguccagggcccugagcuc

SEQ ID NO: 2120096 - RNA, 12 nt, Human
ugucccaccuca

SEQ ID NO: 2120097 - RNA, 12 nt, Human
ugucccacagcu

SEQ ID NO: 2120098 - RNA, 13 nt, Human
ugucccacagcuu

SEQ ID NO: 2120099 - RNA, 14 nt, Human
ugucccacagcuug

SEQ ID NO: 2120100 - RNA, 17 nt, Human
ugucccacagcuugggg

SEQ ID NO: 2120101 - RNA, 20 nt, Human
ugucccacagcuuggggcca

SEQ ID NO: 2120102 - RNA, 13 nt, Human
ugucccaccagcu

SEQ ID NO: 2120103 - RNA, 13 nt, Human
uguccccagccca

SEQ ID NO: 2120104 - RNA, 14 nt, Human
uguccccagcccac

SEQ ID NO: 2120105 - RNA, 15 nt, Human
uguccccagcccacu

SEQ ID NO: 2120106 - RNA, 16 nt, Human
uguccccagcccacug

SEQ ID NO: 2120107 - RNA, 19 nt, Human
uguccccaguuugcagaaa

SEQ ID NO: 2120108 - RNA, 20 nt, Human
uguccuacccacccuccuuu

SEQ ID NO: 2120109 - RNA, 14 nt, Human
ugucccccugagau

SEQ ID NO: 2120110 - RNA, 20 nt, Human
ugucccccugagaucagagu

SEQ ID NO: 2120111 - RNA, 21 nt, Human
ugucccccugagaucagaguc

SEQ ID NO: 2120112 - RNA, 23 nt, Human
ugucccccugagaucagaguccu

SEQ ID NO: 2120113 - RNA, 17 nt, Human
uguccuacucuguguca

SEQ ID NO: 2120114 - RNA, 12 nt, Human
uguccuacucug

SEQ ID NO: 2120115 - RNA, 17 nt, Human
ugucuguagcuccucaa

SEQ ID NO: 2120116 - RNA, 23 nt, Human
ugucuguagcuccucaacucacc

SEQ ID NO: 2120117 - RNA, 13 nt, Human
ugucuuucuuugg

SEQ ID NO: 2120118 - RNA, 14 nt, Human
ugucuuucuuuggu

SEQ ID NO: 2120119 - RNA, 15 nt, Human
ugucuuucuuuggug

SEQ ID NO: 2120120 - RNA, 20 nt, Human
ugucuuucuuuggugccuuu

SEQ ID NO: 2120121 - RNA, 22 nt, Human
ugucuuucuuuggugccuuucc

SEQ ID NO: 2120122 - RNA, 20 nt, Human
ugucuuuuucuggacugaag

SEQ ID NO: 2120123 - RNA, 23 nt, Human
ugugaaaagaaaaaugagccugg

SEQ ID NO: 2120124 - RNA, 17 nt, Human
ugucuuuuucuggacug

SEQ ID NO: 2120125 - RNA, 23 nt, Human
ugucuuuuucuggacugaagccu

SEQ ID NO: 2120126 - RNA, 19 nt, Human
ugucuggacauucagaaca

SEQ ID NO: 2120127 - RNA, 14 nt, Human
ugucuggagaauaa

SEQ ID NO: 2120128 - RNA, 22 nt, Human
ugucuggaggggagcucugucu

SEQ ID NO: 2120129 - RNA, 16 nt, Human
ugucugaagucacugc

SEQ ID NO: 2120130 - RNA, 18 nt, Human
ugucugaagucacugcac

SEQ ID NO: 2120131 - RNA, 17 nt, Human
ugucugaagucacugca

SEQ ID NO: 2120132 - RNA, 19 nt, Human
ugucugaagucacugcaca

SEQ ID NO: 2120133 - RNA, 16 nt, Human
uguccucuuucagaaa

SEQ ID NO: 2120134 - RNA, 17 nt, Human
uguccucuuucagaaaa

SEQ ID NO: 2120135 - RNA, 19 nt, Human
uguccucuuucagaaaaca

SEQ ID NO: 2120136 - RNA, 21 nt, Human
uguccucuuucagaaaacaga

SEQ ID NO: 2120137 - RNA, 23 nt, Human
uguccucuuucagaaaacagaaa

SEQ ID NO: 2120138 - RNA, 21 nt, Human
uguccuccucggaucaccgag

SEQ ID NO: 2120139 - RNA, 11 nt, Human
uguccuccucg

SEQ ID NO: 2120140 - RNA, 10 nt, Human
uguccuccuc

SEQ ID NO: 2120141 - RNA, 14 nt, Human
uguccucagcuucu

SEQ ID NO: 2120142 - RNA, 20 nt, Human
ugugaucaggcuauguaugg

SEQ ID NO: 2120143 - RNA, 19 nt, Human
ugugcacacacaccacaca

SEQ ID NO: 2120144 - RNA, 22 nt, Human
ugugcacacacaccacacauac

SEQ ID NO: 2120145 - RNA, 14 nt, Human
ugugauauuaacag

SEQ ID NO: 2120146 - RNA, 16 nt, Human
ugugaguuuaaagcaa

SEQ ID NO: 2120147 - RNA, 22 nt, Human
ugugaguguguguuugugcuga

SEQ ID NO: 2120148 - RNA, 16 nt, Human
ugugaguguaagugug

SEQ ID NO: 2120149 - RNA, 20 nt, Human
ugugaguguaagugugagua

SEQ ID NO: 2120150 - RNA, 20 nt, Human
ugugaguguguccaagugug

SEQ ID NO: 2120151 - RNA, 23 nt, Human
ugugaguguguccaagugugugu

SEQ ID NO: 2120152 - RNA, 14 nt, Human
ugugagugugugca

SEQ ID NO: 2120153 - RNA, 19 nt, Human
ugugaguguguguuugugc

SEQ ID NO: 2120154 - RNA, 21 nt, Human
ugugagucaccaagcccaguu

SEQ ID NO: 2120155 - RNA, 19 nt, Human
ugugagucaccaagcccag

SEQ ID NO: 2120156 - RNA, 17 nt, Human
ugugagucaccaagccc

SEQ ID NO: 2120157 - RNA, 15 nt, Human
ugugagucaccaagc

SEQ ID NO: 2120158 - RNA, 23 nt, Human
ugugaggcccaugguugagaaau

SEQ ID NO: 2120159 - RNA, 12 nt, Human
ugugaggcaggg

SEQ ID NO: 2120160 - RNA, 13 nt, Human
ugugaccaaguua

SEQ ID NO: 2120161 - RNA, 13 nt, Human
ugugaggcagggg

SEQ ID NO: 2120162 - RNA, 18 nt, Human
ugugaggcaggggcggag

SEQ ID NO: 2120163 - RNA, 14 nt, Human
ugugaggagcugcu

SEQ ID NO: 2120164 - RNA, 17 nt, Human
ugugaggagcugcuggc

SEQ ID NO: 2120165 - RNA, 18 nt, Human
ugugaggagcugcuggcu

SEQ ID NO: 2120166 - RNA, 20 nt, Human
ugugaggagcugcuggcuug

SEQ ID NO: 2120167 - RNA, 13 nt, Human
ugugaggagcugc

SEQ ID NO: 2120168 - RNA, 14 nt, Human
ugugaagggaagga

SEQ ID NO: 2120169 - RNA, 19 nt, Human
ugugaauugaaauguucgu

SEQ ID NO: 2120170 - RNA, 16 nt, Human
ugugaauugauaauaa

SEQ ID NO: 2120171 - RNA, 17 nt, Human
ugugaauugauaauaaa

SEQ ID NO: 2120172 - RNA, 12 nt, Human
uguguagggcgg

SEQ ID NO: 2120173 - RNA, 16 nt, Human
uguguagggcgggagg

SEQ ID NO: 2120174 - RNA, 13 nt, Human
uguguacacaugg

SEQ ID NO: 2120175 - RNA, 21 nt, Human
uguguacagaauucugcuacc

SEQ ID NO: 2120176 - RNA, 23 nt, Human
uguguacagaauucugcuaccuc

SEQ ID NO: 2120177 - RNA, 19 nt, Human
uguguacaguguguaaagu

SEQ ID NO: 2120178 - RNA, 16 nt, Human
ugugggcaggaaguga

SEQ ID NO: 2120179 - RNA, 19 nt, Human
ugugggccucaaggacuug

SEQ ID NO: 2120180 - RNA, 21 nt, Human
ugugggccucaaggacuugaa

SEQ ID NO: 2120181 - RNA, 22 nt, Human
ugugggcuaguugggcuuccuc

SEQ ID NO: 2120182 - RNA, 23 nt, Human
uguguaaucauuucuugggcccu

SEQ ID NO: 2120183 - RNA, 21 nt, Human
uguguaaucauuucuugggcc

SEQ ID NO: 2120184 - RNA, 22 nt, Human
uguguaaucauuucuugggccc

SEQ ID NO: 2120185 - RNA, 20 nt, Human
uguggccuuccauuuauaug

SEQ ID NO: 2120186 - RNA, 13 nt, Human
uguggccucagaa

SEQ ID NO: 2120187 - RNA, 22 nt, Human
uguggcucacgugagagugucu

SEQ ID NO: 2120188 - RNA, 16 nt, Human
uguggcucacgugugu

SEQ ID NO: 2120189 - RNA, 10 nt, Human
uguggcucac

SEQ ID NO: 2120190 - RNA, 13 nt, Human
uguggcggugccu

SEQ ID NO: 2120191 - RNA, 13 nt, Human
ugugggagcagcg

SEQ ID NO: 2120192 - RNA, 13 nt, Human
uguggcuccccuc

SEQ ID NO: 2120193 - RNA, 14 nt, Human
uguggcuccccucu

SEQ ID NO: 2120194 - RNA, 21 nt, Human
ugugggacuguacacacuuua

SEQ ID NO: 2120195 - RNA, 19 nt, Human
uguggacacagcucuucuc

SEQ ID NO: 2120196 - RNA, 10 nt, Human
uguggccuca

SEQ ID NO: 2120197 - RNA, 11 nt, Human
uguggccucag

SEQ ID NO: 2120198 - RNA, 18 nt, Human
uguggacacagcucuucu

SEQ ID NO: 2120199 - RNA, 14 nt, Human
uguggaagggacua

SEQ ID NO: 2120200 - RNA, 15 nt, Human
uguggaagggacuag

SEQ ID NO: 2120201 - RNA, 18 nt, Human
uguggaagggacuaggag

SEQ ID NO: 2120202 - RNA, 14 nt, Human
ugugcuaugaauuu

SEQ ID NO: 2120203 - RNA, 15 nt, Human
ugugcuaugaauuuu

SEQ ID NO: 2120204 - RNA, 19 nt, Human
ugugcgccuacaggaguga

SEQ ID NO: 2120205 - RNA, 14 nt, Human
ugugcgccuacagg

SEQ ID NO: 2120206 - RNA, 17 nt, Human
ugugcuuugcauuccua

SEQ ID NO: 2120207 - RNA, 14 nt, Human
ugugcacguacaca

SEQ ID NO: 2120208 - RNA, 17 nt, Human
ugugcacuuauuuauga

SEQ ID NO: 2120209 - RNA, 18 nt, Human
ugugcagacucaauaaaa

SEQ ID NO: 2120210 - RNA, 19 nt, Human
ugugcagacucaauaaaau

SEQ ID NO: 2120211 - RNA, 22 nt, Human
ugugcagacucaauaaaaucau

SEQ ID NO: 2120212 - RNA, 15 nt, Human
ugugcaugugugugc

SEQ ID NO: 2120213 - RNA, 15 nt, Human
uuaaauguagaaagu

SEQ ID NO: 2120214 - RNA, 11 nt, Human
uuaagauuuaa

SEQ ID NO: 2120215 - RNA, 13 nt, Human
uuaagauuuaauu

SEQ ID NO: 2120216 - RNA, 15 nt, Human
uuaagauuuaauuug

SEQ ID NO: 2120217 - RNA, 19 nt, Human
uuaagauuuaauuugccaa

SEQ ID NO: 2120218 - RNA, 17 nt, Human
uuaagaugugucuucaa

SEQ ID NO: 2120219 - RNA, 21 nt, Human
uuaagaugugucuucaauuug

SEQ ID NO: 2120220 - RNA, 19 nt, Human
uuaagauuccuuuucuugu

SEQ ID NO: 2120221 - RNA, 14 nt, Human
uuaagauaugaugu

SEQ ID NO: 2120222 - RNA, 14 nt, Human
uuaagauggauucu

SEQ ID NO: 2120223 - RNA, 17 nt, Human
uuaagauggauucucag

SEQ ID NO: 2120224 - RNA, 18 nt, Human
uuaagauggauucucaga

SEQ ID NO: 2120225 - RNA, 21 nt, Human
uuaagauggauucucagauau

SEQ ID NO: 2120226 - RNA, 22 nt, Human
uuaagauggauucucagauauu

SEQ ID NO: 2120227 - RNA, 23 nt, Human
uuaagauggauucucagauauuu

SEQ ID NO: 2120228 - RNA, 18 nt, Human
uuaacuuuaucacauuau

SEQ ID NO: 2120229 - RNA, 23 nt, Human
uuaacuuuaucacauuauuugca

SEQ ID NO: 2120230 - RNA, 19 nt, Human
uuaauagaauauaauuauc

SEQ ID NO: 2120231 - RNA, 24 nt, Human
uuaauaaucagcaagaauuugauc

SEQ ID NO: 2120232 - RNA, 17 nt, Human
uuaauaaguuucacuga

SEQ ID NO: 2120233 - RNA, 20 nt, Human
uuaauaacccuugaaaguca

SEQ ID NO: 2120234 - RNA, 15 nt, Human
uuaauaaguuucacu

SEQ ID NO: 2120235 - RNA, 19 nt, Human
uuaauaacauaacaaauaa

SEQ ID NO: 2120236 - RNA, 12 nt, Human
uuaagcauuguu

SEQ ID NO: 2120237 - RNA, 14 nt, Human
uuaagcauuguuug

SEQ ID NO: 2120238 - RNA, 19 nt, Human
uuaagcauuguuugcuuau

SEQ ID NO: 2120239 - RNA, 22 nt, Human
uuaagcauuguuugcuuauugu

SEQ ID NO: 2120240 - RNA, 23 nt, Human
uuaagcauuguuugcuuauuguu

SEQ ID NO: 2120241 - RNA, 14 nt, Human
uuaagcaucacaaa

SEQ ID NO: 2120242 - RNA, 15 nt, Human
uuaagcaucacaaau

SEQ ID NO: 2120243 - RNA, 18 nt, Human
uuaagcaucacaaaugau

SEQ ID NO: 2120244 - RNA, 14 nt, Human
uuaagcauuacucu

SEQ ID NO: 2120245 - RNA, 19 nt, Human
uuaagcauuacucuuguaa

SEQ ID NO: 2120246 - RNA, 20 nt, Human
uuaagcauuacucuuguaag

SEQ ID NO: 2120247 - RNA, 21 nt, Human
uuaagcauuacucuuguaaga

SEQ ID NO: 2120248 - RNA, 22 nt, Human
uuaagcauuacucuuguaagau

SEQ ID NO: 2120249 - RNA, 23 nt, Human
uuaagcauuacucuuguaagauu

SEQ ID NO: 2120250 - RNA, 20 nt, Human
uuaagcauuggguggguaaa

SEQ ID NO: 2120251 - RNA, 17 nt, Human
uuacacauuuuucagau

SEQ ID NO: 2120252 - RNA, 23 nt, Human
uuacacauuuuucagauauaaaa

SEQ ID NO: 2120253 - RNA, 23 nt, Human
uuacacguggaggaaugcucccc

SEQ ID NO: 2120254 - RNA, 13 nt, Human
uuacacuguuaga

SEQ ID NO: 2120255 - RNA, 17 nt, Human
uuacacuguuagaacac

SEQ ID NO: 2120256 - RNA, 19 nt, Human
uuacacuguuagaacacua

SEQ ID NO: 2120257 - RNA, 20 nt, Human
uuacacuguuagaacacuau

SEQ ID NO: 2120258 - RNA, 22 nt, Human
uuacaccucguuagggaagaga

SEQ ID NO: 2120259 - RNA, 14 nt, Human
uuacacuuuugaga

SEQ ID NO: 2120260 - RNA, 13 nt, Human
uuacacuuuaugc

SEQ ID NO: 2120261 - RNA, 20 nt, Human
uuacacuuuaugcacaaaau

SEQ ID NO: 2120262 - RNA, 23 nt, Human
uuacagaauugcuuguuugcuuc

SEQ ID NO: 2120263 - RNA, 18 nt, Human
uuacauuccuugauaaug

SEQ ID NO: 2120264 - RNA, 21 nt, Human
uuacauuccuugauaauguug

SEQ ID NO: 2120265 - RNA, 22 nt, Human
uuacauuccuugauaauguugu

SEQ ID NO: 2120266 - RNA, 17 nt, Human
uuacauuguuugucugu

SEQ ID NO: 2120267 - RNA, 19 nt, Human
uuacauugcuggucuugua

SEQ ID NO: 2120268 - RNA, 20 nt, Human
uuacauugcuggucuuguaa

SEQ ID NO: 2120269 - RNA, 21 nt, Human
uuacauugcuggucuuguaag

SEQ ID NO: 2120270 - RNA, 22 nt, Human
uuacauugcuggucuuguaaga

SEQ ID NO: 2120271 - RNA, 15 nt, Human
uuacacauuuuucag

SEQ ID NO: 2120272 - RNA, 17 nt, Human
uuacacaucuucaacag

SEQ ID NO: 2120273 - RNA, 17 nt, Human
uuacaagaaaaaaugaa

SEQ ID NO: 2120274 - RNA, 13 nt, Human
uuaauuagguuaa

SEQ ID NO: 2120275 - RNA, 17 nt, Human
uuaauuagguuaacuau

SEQ ID NO: 2120276 - RNA, 18 nt, Human
uuaauuagguuaacuaug

SEQ ID NO: 2120277 - RNA, 19 nt, Human
uuaauuagggguugcuaag

SEQ ID NO: 2120278 - RNA, 20 nt, Human
uuaauuagggguugcuaaga

SEQ ID NO: 2120279 - RNA, 14 nt, Human
uuacaaauuggagc

SEQ ID NO: 2120280 - RNA, 19 nt, Human
uuaaugacagagccagugg

SEQ ID NO: 2120281 - RNA, 13 nt, Human
uuaauuaaaugca

SEQ ID NO: 2120282 - RNA, 14 nt, Human
uuaauuaaguaaac

SEQ ID NO: 2120283 - RNA, 16 nt, Human
uuaauuaaguaaacua

SEQ ID NO: 2120284 - RNA, 21 nt, Human
uuaauuaaguaaacuaaugag

SEQ ID NO: 2120285 - RNA, 18 nt, Human
uuaaagaaaaguuuugua

SEQ ID NO: 2120286 - RNA, 22 nt, Human
uuaaagcacuuacagauaggcc

SEQ ID NO: 2120287 - RNA, 21 nt, Human
uuaaagcagagggacuuugua

SEQ ID NO: 2120288 - RNA, 23 nt, Human
uuaaagaaaauaaaauuaagaau

SEQ ID NO: 2120289 - RNA, 14 nt, Human
uuaaagcagucacu

SEQ ID NO: 2120290 - RNA, 22 nt, Human
uuaaagcagagggacuuuguau

SEQ ID NO: 2120291 - RNA, 15 nt, Human
uuaaagcauuuacuu

SEQ ID NO: 2120292 - RNA, 17 nt, Human
uuaaagcauuuacuuug

SEQ ID NO: 2120293 - RNA, 20 nt, Human
uuaaagcauuuacuuugaau

SEQ ID NO: 2120294 - RNA, 14 nt, Human
uuaaauauuuacau

SEQ ID NO: 2120295 - RNA, 17 nt, Human
uuaaauauuuacauaug

SEQ ID NO: 2120296 - RNA, 18 nt, Human
uuaaauauuuacauauga

SEQ ID NO: 2120297 - RNA, 21 nt, Human
uuaaauauguuagcaaagagu

SEQ ID NO: 2120298 - RNA, 16 nt, Human
uuaaauaucaaucauu

SEQ ID NO: 2120299 - RNA, 17 nt, Human
uuaaauaucaaucauuu

SEQ ID NO: 2120300 - RNA, 18 nt, Human
uuaaauaucaaucauuuu

SEQ ID NO: 2120301 - RNA, 20 nt, Human
uuaaaucccauucauaacuu

SEQ ID NO: 2120302 - RNA, 12 nt, Human
uuaaauccuguu

SEQ ID NO: 2120303 - RNA, 14 nt, Human
uuaaauccuguuga

SEQ ID NO: 2120304 - RNA, 16 nt, Human
uuaaauccuguugaaa

SEQ ID NO: 2120305 - RNA, 18 nt, Human
uuaaauccuguugaaaag

SEQ ID NO: 2120306 - RNA, 15 nt, Human
uuaaaugaaagcaug

SEQ ID NO: 2120307 - RNA, 12 nt, Human
uuaaaugagaag

SEQ ID NO: 2120308 - RNA, 23 nt, Human
uuaaaugagaaggaauuugaguu

SEQ ID NO: 2120309 - RNA, 15 nt, Human
uuaaaauaacuagug

SEQ ID NO: 2120310 - RNA, 14 nt, Human
uuaaaacuuuaauc

SEQ ID NO: 2120311 - RNA, 23 nt, Human
uuaaaacuuaaccgcaucagaag

SEQ ID NO: 2120312 - RNA, 12 nt, Human
uuaaaacuccug

SEQ ID NO: 2120313 - RNA, 14 nt, Human
uuaaaacccaagug

SEQ ID NO: 2120314 - RNA, 13 nt, Human
uguuucugaaaau

SEQ ID NO: 2120315 - RNA, 14 nt, Human
uguuucugaaaauu

SEQ ID NO: 2120316 - RNA, 21 nt, Human
uguuucugaaaauuccagaaa

SEQ ID NO: 2120317 - RNA, 14 nt, Human
uguuucccauaauu

SEQ ID NO: 2120318 - RNA, 22 nt, Human
uguuucccauaauuuucuucau

SEQ ID NO: 2120319 - RNA, 12 nt, Human
uguuuacugaaa

SEQ ID NO: 2120320 - RNA, 16 nt, Human
uguuuuaagaggcagg

SEQ ID NO: 2120321 - RNA, 22 nt, Human
uguuuuaaauuuauuucaaaaa

SEQ ID NO: 2120322 - RNA, 18 nt, Human
uguuuuaaauauagaauu

SEQ ID NO: 2120323 - RNA, 19 nt, Human
uguuuuaaauauagaauuu

SEQ ID NO: 2120324 - RNA, 17 nt, Human
uguuuguuaaaacuggc

SEQ ID NO: 2120325 - RNA, 21 nt, Human
uguuuguuaaaacuggcaucu

SEQ ID NO: 2120326 - RNA, 12 nt, Human
uguuuguuaugg

SEQ ID NO: 2120327 - RNA, 14 nt, Human
uguuugugugagag

SEQ ID NO: 2120328 - RNA, 15 nt, Human
uguuuguggccucag

SEQ ID NO: 2120329 - RNA, 13 nt, Human
uguuuguggccuc

SEQ ID NO: 2120330 - RNA, 14 nt, Human
uguuuguggccuca

SEQ ID NO: 2120331 - RNA, 12 nt, Human
uguuuguggccu

SEQ ID NO: 2120332 - RNA, 17 nt, Human
uguuuuaagaggcaggg

SEQ ID NO: 2120333 - RNA, 14 nt, Human
uguuuuuaagcugu

SEQ ID NO: 2120334 - RNA, 12 nt, Human
uguuuuuaacuc

SEQ ID NO: 2120335 - RNA, 17 nt, Human
uguuuuuaaaaaucaua

SEQ ID NO: 2120336 - RNA, 20 nt, Human
uguuuuuaaaaaucauaaac

SEQ ID NO: 2120337 - RNA, 14 nt, Human
uguuuuugggaugu

SEQ ID NO: 2120338 - RNA, 17 nt, Human
uguuuuugggaugucuu

SEQ ID NO: 2120339 - RNA, 18 nt, Human
uguuuuugggaugucuua

SEQ ID NO: 2120340 - RNA, 13 nt, Human
uguuuuugaaaua

SEQ ID NO: 2120341 - RNA, 22 nt, Human
uguuuuuaagcuguuuccauag

SEQ ID NO: 2120342 - RNA, 20 nt, Human
uguuuuuaagcuguuuccau

SEQ ID NO: 2120343 - RNA, 17 nt, Human
uguuuuuaagcuguuuc

SEQ ID NO: 2120344 - RNA, 15 nt, Human
uguuuuuaagcuguu

SEQ ID NO: 2120345 - RNA, 22 nt, Human
ugugugucuaggcaggaccugu

SEQ ID NO: 2120346 - RNA, 22 nt, Human
ugugugcugugguuccuggggu

SEQ ID NO: 2120347 - RNA, 14 nt, Human
uguguggucagugg

SEQ ID NO: 2120348 - RNA, 17 nt, Human
uguguggcuuucagagc

SEQ ID NO: 2120349 - RNA, 15 nt, Human
uguguuuuuaauaaa

SEQ ID NO: 2120350 - RNA, 19 nt, Human
uguguuuugcuaaaggaaa

SEQ ID NO: 2120351 - RNA, 19 nt, Human
uguguuuuguuuugauuua

SEQ ID NO: 2120352 - RNA, 20 nt, Human
uguguuuuuaauaaagacag

SEQ ID NO: 2120353 - RNA, 20 nt, Human
uguguuucuaugugacaauu

SEQ ID NO: 2120354 - RNA, 11 nt, Human
uguguuuccuu

SEQ ID NO: 2120355 - RNA, 19 nt, Human
ugugugcacguacacacac

SEQ ID NO: 2120356 - RNA, 20 nt, Human
uguguggcuuucagagccuc

SEQ ID NO: 2120357 - RNA, 14 nt, Human
ugugugggacugua

SEQ ID NO: 2120358 - RNA, 15 nt, Human
ugugugggacuguac

SEQ ID NO: 2120359 - RNA, 16 nt, Human
ugugugggacuguaca

SEQ ID NO: 2120360 - RNA, 17 nt, Human
ugugugggacuguacac

SEQ ID NO: 2120361 - RNA, 18 nt, Human
ugugugggacuguacaca

SEQ ID NO: 2120362 - RNA, 16 nt, Human
uguguggacugugaug

SEQ ID NO: 2120363 - RNA, 17 nt, Human
ugugugcucauguaugu

SEQ ID NO: 2120364 - RNA, 22 nt, Human
ugugugcucauguaugugcgaa

SEQ ID NO: 2120365 - RNA, 17 nt, Human
uguguggacucaagucc

SEQ ID NO: 2120366 - RNA, 19 nt, Human
uguguggacugugaugcca

SEQ ID NO: 2120367 - RNA, 19 nt, Human
uguguaugugcgugugugc

SEQ ID NO: 2120368 - RNA, 23 nt, Human
ugugugaagaucacguuccuucc

SEQ ID NO: 2120369 - RNA, 14 nt, Human
uguguaugugcgug

SEQ ID NO: 2120370 - RNA, 20 nt, Human
ugugugaaauaccagugugg

SEQ ID NO: 2120371 - RNA, 15 nt, Human
uguguauguacauau

SEQ ID NO: 2120372 - RNA, 16 nt, Human
uguguauguacauaua

SEQ ID NO: 2120373 - RNA, 19 nt, Human
uguuaaaaucucucucugu

SEQ ID NO: 2120374 - RNA, 14 nt, Human
uguuaaaauaacua

SEQ ID NO: 2120375 - RNA, 20 nt, Human
uguuaccuaauuagagcaga

SEQ ID NO: 2120376 - RNA, 18 nt, Human
uguuaaaaaauuuuugaa

SEQ ID NO: 2120377 - RNA, 19 nt, Human
uguuaaaaaauuuuugaaa

SEQ ID NO: 2120378 - RNA, 22 nt, Human
uguguuuuuuuuucguuuguuu

SEQ ID NO: 2120379 - RNA, 19 nt, Human
uguuaaaacuggcaucuga

SEQ ID NO: 2120380 - RNA, 12 nt, Human
uguuaaaauaac

SEQ ID NO: 2120381 - RNA, 13 nt, Human
uguguuuuugaaa

SEQ ID NO: 2120382 - RNA, 18 nt, Human
uguguuuuugggaugucu

SEQ ID NO: 2120383 - RNA, 19 nt, Human
uguguuuuugggaugucuu

SEQ ID NO: 2120384 - RNA, 20 nt, Human
uguguuuuugggaugucuua

SEQ ID NO: 2120385 - RNA, 16 nt, Human
uguuaggaaaauuuca

SEQ ID NO: 2120386 - RNA, 14 nt, Human
uguuagcuguuauu

SEQ ID NO: 2120387 - RNA, 17 nt, Human
uguuagccccauaauuu

SEQ ID NO: 2120388 - RNA, 17 nt, Human
uguuacugguguccagc

SEQ ID NO: 2120389 - RNA, 21 nt, Human
uguuagcaugcuggugagcca

SEQ ID NO: 2120390 - RNA, 14 nt, Human
uguuacugaucaug

SEQ ID NO: 2120391 - RNA, 15 nt, Human
uguuacugaccagca

SEQ ID NO: 2120392 - RNA, 13 nt, Human
uguuacugaucau

SEQ ID NO: 2120393 - RNA, 20 nt, Human
uguuacugaucaugcauugu

SEQ ID NO: 2120394 - RNA, 22 nt, Human
uguuaguacuauaucuguuuua

SEQ ID NO: 2120395 - RNA, 14 nt, Human
uguuaguagaaauu

SEQ ID NO: 2120396 - RNA, 20 nt, Human
uguuaguagaaauuuuacaa

SEQ ID NO: 2120397 - RNA, 14 nt, Human
uguuaggcugggcc

SEQ ID NO: 2120398 - RNA, 16 nt, Human
uguuaggcugggccca

SEQ ID NO: 2120399 - RNA, 18 nt, Human
uguuaggcugggcccaga

SEQ ID NO: 2120400 - RNA, 22 nt, Human
uguucagcuccagcucaccagc

SEQ ID NO: 2120401 - RNA, 21 nt, Human
uguucagcuccagcucaccag

SEQ ID NO: 2120402 - RNA, 20 nt, Human
uguucagcuccagcucacca

SEQ ID NO: 2120403 - RNA, 21 nt, Human
uguucuuuucccccaaagugg

SEQ ID NO: 2120404 - RNA, 19 nt, Human
uguugaaaagccauguuua

SEQ ID NO: 2120405 - RNA, 22 nt, Human
uguugaaugcccacaggcaaau

SEQ ID NO: 2120406 - RNA, 14 nt, Human
uguugacaugugcu

SEQ ID NO: 2120407 - RNA, 17 nt, Human
uguugacauccaagcuu

SEQ ID NO: 2120408 - RNA, 19 nt, Human
uguugacauccaagcuucc

SEQ ID NO: 2120409 - RNA, 13 nt, Human
uguucuuugggga

SEQ ID NO: 2120410 - RNA, 20 nt, Human
uguucuuuggaaauacacag

SEQ ID NO: 2120411 - RNA, 13 nt, Human
uguucuggcccuc

SEQ ID NO: 2120412 - RNA, 15 nt, Human
uguucuggcccucac

SEQ ID NO: 2120413 - RNA, 23 nt, Human
uguugaaaaaaaaguuucagaga

SEQ ID NO: 2120414 - RNA, 15 nt, Human
uguucucucuucucc

SEQ ID NO: 2120415 - RNA, 16 nt, Human
uguucucucuucucca

SEQ ID NO: 2120416 - RNA, 14 nt, Human
uguucagcauucuu

SEQ ID NO: 2120417 - RNA, 19 nt, Human
uguucaucauccuaagcua

SEQ ID NO: 2120418 - RNA, 12 nt, Human
uguugaucccaa

SEQ ID NO: 2120419 - RNA, 16 nt, Human
uguugaucccaagaca

SEQ ID NO: 2120420 - RNA, 20 nt, Human
uguugauugcaggaauaagg

SEQ ID NO: 2120421 - RNA, 11 nt, Human
uguugauuauu

SEQ ID NO: 2120422 - RNA, 16 nt, Human
uguugauuauuagcca

SEQ ID NO: 2120423 - RNA, 18 nt, Human
uguuggcacaugccugua

SEQ ID NO: 2120424 - RNA, 16 nt, Human
uguuggccaggcuggu

SEQ ID NO: 2120425 - RNA, 15 nt, Human
uguuggccaggcugg

SEQ ID NO: 2120426 - RNA, 15 nt, Human
uguuggccaaagcca

SEQ ID NO: 2120427 - RNA, 19 nt, Human
uguuggcugggggccucag

SEQ ID NO: 2120428 - RNA, 14 nt, Human
uguuggcuagccuc

SEQ ID NO: 2120429 - RNA, 17 nt, Human
uguuggcugggggccuc

SEQ ID NO: 2120430 - RNA, 15 nt, Human
uguuggcuaaugaag

SEQ ID NO: 2120431 - RNA, 16 nt, Human
uguuuaauauugagaa

SEQ ID NO: 2120432 - RNA, 20 nt, Human
uguuuaauauugagaaagaa

SEQ ID NO: 2120433 - RNA, 21 nt, Human
uguuuaaguguuguaaauauu

SEQ ID NO: 2120434 - RNA, 13 nt, Human
uguuuaagauuua

SEQ ID NO: 2120435 - RNA, 14 nt, Human
uguuuaagauuuaa

SEQ ID NO: 2120436 - RNA, 18 nt, Human
uguuuaagauuuaauuug

SEQ ID NO: 2120437 - RNA, 20 nt, Human
uguuuaagauuuaauuugcc

SEQ ID NO: 2120438 - RNA, 21 nt, Human
uguuuaagauuuaauuugcca

SEQ ID NO: 2120439 - RNA, 22 nt, Human
uguuuaagauuuaauuugccaa

SEQ ID NO: 2120440 - RNA, 23 nt, Human
uguuuaagauuuaauuugccaaa

SEQ ID NO: 2120441 - RNA, 16 nt, Human
aaaacagaaaaaaaac

SEQ ID NO: 2120442 - RNA, 21 nt, Human
aaaacagaaaaaaaacacaca

SEQ ID NO: 2120443 - RNA, 21 nt, Human
aaaacacuauuuuuuuuucuu

SEQ ID NO: 2120444 - RNA, 11 nt, Human
aaaagaaaaag

SEQ ID NO: 2120445 - RNA, 20 nt, Human
aaaacuuuuuauauuuuaua

SEQ ID NO: 2120446 - RNA, 17 nt, Human
aaaacuuuuuauauuuu

SEQ ID NO: 2120447 - RNA, 13 nt, Human
aaaacuuuuauaa

SEQ ID NO: 2120448 - RNA, 15 nt, Human
aaaacuuuuauaaau

SEQ ID NO: 2120449 - RNA, 17 nt, Human
aaaacuuuuauaaauua

SEQ ID NO: 2120450 - RNA, 18 nt, Human
aaaacuuuuauaaauuaa

SEQ ID NO: 2120451 - RNA, 21 nt, Human
aaaacuuuuauaaauuaaaua

SEQ ID NO: 2120452 - RNA, 22 nt, Human
aaaacuuuuauaaauuaaauau

SEQ ID NO: 2120453 - RNA, 15 nt, Human
aaaacagacucaggu

SEQ ID NO: 2120454 - RNA, 16 nt, Human
aaaacagcauugcuuu

SEQ ID NO: 2120455 - RNA, 20 nt, Human
aaaacagcauugcuuucuga

SEQ ID NO: 2120456 - RNA, 18 nt, Human
aaaacagccucacagaag

SEQ ID NO: 2120457 - RNA, 19 nt, Human
aaaacaggaaaaaaacuuu

SEQ ID NO: 2120458 - RNA, 16 nt, Human
aaaagaauacagaaag

SEQ ID NO: 2120459 - RNA, 19 nt, Human
aaaagaaucccuguucauu

SEQ ID NO: 2120460 - RNA, 21 nt, Human
aaaagaaucugcauuuagcac

SEQ ID NO: 2120461 - RNA, 18 nt, Human
aaaagacacuugauacuu

SEQ ID NO: 2120462 - RNA, 20 nt, Human
aaaagacacacuuguccaca

SEQ ID NO: 2120463 - RNA, 15 nt, Human
aaaagaaugucagaa

SEQ ID NO: 2120464 - RNA, 21 nt, Human
aaaagaaugucagaaaaacaa

SEQ ID NO: 2120465 - RNA, 15 nt, Human
aaaagaaaugcacaa

SEQ ID NO: 2120466 - RNA, 20 nt, Human
aaaagaaauucccuggacca

SEQ ID NO: 2120467 - RNA, 20 nt, Human
aaaagauacgacuuuauuuu

SEQ ID NO: 2120468 - RNA, 14 nt, Human
aaaagauacauuug

SEQ ID NO: 2120469 - RNA, 16 nt, Human
aaaagauacauuugua

SEQ ID NO: 2120470 - RNA, 18 nt, Human
aaaagauacauuuguaug

SEQ ID NO: 2120471 - RNA, 13 nt, Human
aaaagaucgcagu

SEQ ID NO: 2120472 - RNA, 16 nt, Human
aaaagacucaguguuc

SEQ ID NO: 2120473 - RNA, 15 nt, Human
aaaagaggggcuggg

SEQ ID NO: 2120474 - RNA, 13 nt, Human
aaaaucagccugc

SEQ ID NO: 2120475 - RNA, 17 nt, Human
aaaaucagccugcucca

SEQ ID NO: 2120476 - RNA, 21 nt, Human
aaaaucagccugcuccagcug

SEQ ID NO: 2120477 - RNA, 15 nt, Human
aaaaguuuaaaaugu

SEQ ID NO: 2120478 - RNA, 20 nt, Human
aaaaguuuaaaauguauaag

SEQ ID NO: 2120479 - RNA, 21 nt, Human
aaaagugaucaauaaaaugug

SEQ ID NO: 2120480 - RNA, 13 nt, Human
aaaagucucuauu

SEQ ID NO: 2120481 - RNA, 15 nt, Human
aaaagucucuauuua

SEQ ID NO: 2120482 - RNA, 19 nt, Human
aaaagucucuauuuaaauu

SEQ ID NO: 2120483 - RNA, 20 nt, Human
aaaagucucuauuuaaauuc

SEQ ID NO: 2120484 - RNA, 21 nt, Human
aaaagucucuauuuaaauucu

SEQ ID NO: 2120485 - RNA, 23 nt, Human
aaaagucucuauuuaaauucuuu

SEQ ID NO: 2120486 - RNA, 12 nt, Human
aaaagucugauu

SEQ ID NO: 2120487 - RNA, 22 nt, Human
aaaagucugauugguuuuaauu

SEQ ID NO: 2120488 - RNA, 14 nt, Human
aaaagucugcauua

SEQ ID NO: 2120489 - RNA, 17 nt, Human
aaaagucugcauuacau

SEQ ID NO: 2120490 - RNA, 18 nt, Human
aaaagucugcauuacauu

SEQ ID NO: 2120491 - RNA, 23 nt, Human
aaaagucuucaagggcugcuuca

SEQ ID NO: 2120492 - RNA, 15 nt, Human
aaaagucaaaaggug

SEQ ID NO: 2120493 - RNA, 19 nt, Human
aaaagucagacugcuggga

SEQ ID NO: 2120494 - RNA, 15 nt, Human
aaagcccaaaguggu

SEQ ID NO: 2120495 - RNA, 16 nt, Human
aaagccucugcugcca

SEQ ID NO: 2120496 - RNA, 16 nt, Human
aaagccaucauguaaa

SEQ ID NO: 2120497 - RNA, 17 nt, Human
aaagccaucauguaaau

SEQ ID NO: 2120498 - RNA, 20 nt, Human
aaagccaucauguaaauuac

SEQ ID NO: 2120499 - RNA, 13 nt, Human
aaagccauguuua

SEQ ID NO: 2120500 - RNA, 14 nt, Human
aaagccauguuuaa

SEQ ID NO: 2120501 - RNA, 16 nt, Human
aaagccauguuuaaga

SEQ ID NO: 2120502 - RNA, 17 nt, Human
aaagccauguuuaagau

SEQ ID NO: 2120503 - RNA, 18 nt, Human
aaagccauguuuaagauu

SEQ ID NO: 2120504 - RNA, 19 nt, Human
aaagccauguuuaagauuu

SEQ ID NO: 2120505 - RNA, 22 nt, Human
aaagcauucaauuuauucaaga

SEQ ID NO: 2120506 - RNA, 13 nt, Human
aaagcaugucuca

SEQ ID NO: 2120507 - RNA, 18 nt, Human
aaagaaaaaauaauugau

SEQ ID NO: 2120508 - RNA, 19 nt, Human
aaaccaggguuuaucuuuu

SEQ ID NO: 2120509 - RNA, 15 nt, Human
aaaccgccaaggcug

SEQ ID NO: 2120510 - RNA, 16 nt, Human
aaaccgccaaggcugg

SEQ ID NO: 2120511 - RNA, 12 nt, Human
aaacccagagag

SEQ ID NO: 2120512 - RNA, 11 nt, Human
aaacccagaga

SEQ ID NO: 2120513 - RNA, 12 nt, Human
aaacucuuaaaa

SEQ ID NO: 2120514 - RNA, 23 nt, Human
aaacucuuaaaacccaagugccu

SEQ ID NO: 2120515 - RNA, 12 nt, Human
aaacugcaauag

SEQ ID NO: 2120516 - RNA, 16 nt, Human
aaacugcaauagagac

SEQ ID NO: 2120517 - RNA, 17 nt, Human
aaacugcaauagagacu

SEQ ID NO: 2120518 - RNA, 18 nt, Human
aaacugcaauagagacug

SEQ ID NO: 2120519 - RNA, 21 nt, Human
aaacugcaauagagacuguag

SEQ ID NO: 2120520 - RNA, 22 nt, Human
aaacugcaauagagacuguaga

SEQ ID NO: 2120521 - RNA, 12 nt, Human
aaaccagggagc

SEQ ID NO: 2120522 - RNA, 19 nt, Human
aaaccaguauacaagauaa

SEQ ID NO: 2120523 - RNA, 12 nt, Human
aaaccauugcuu

SEQ ID NO: 2120524 - RNA, 13 nt, Human
aaaccauugcuuc

SEQ ID NO: 2120525 - RNA, 14 nt, Human
aaaccauugcuuca

SEQ ID NO: 2120526 - RNA, 15 nt, Human
aaaccauugcuucac

SEQ ID NO: 2120527 - RNA, 16 nt, Human
aaaccauugcuucacu

SEQ ID NO: 2120528 - RNA, 17 nt, Human
aaaccauugcuucacua

SEQ ID NO: 2120529 - RNA, 19 nt, Human
aaaccaguguagccuugcc

SEQ ID NO: 2120530 - RNA, 22 nt, Human
aaaugcugguuuuucaguuuuc

SEQ ID NO: 2120531 - RNA, 21 nt, Human
aaaugcugcgcccuuccccag

SEQ ID NO: 2120532 - RNA, 20 nt, Human
aaaugcugcgcccuucccca

SEQ ID NO: 2120533 - RNA, 22 nt, Human
aaauggagguccuucugcugga

SEQ ID NO: 2120534 - RNA, 13 nt, Human
aaauggauacugg

SEQ ID NO: 2120535 - RNA, 18 nt, Human
aaaugcuuuaugcaaacc

SEQ ID NO: 2120536 - RNA, 22 nt, Human
aaaucucagaauuccuuuucua

SEQ ID NO: 2120537 - RNA, 15 nt, Human
aaaucucagcaauga

SEQ ID NO: 2120538 - RNA, 17 nt, Human
aaaucucaccccauccc

SEQ ID NO: 2120539 - RNA, 15 nt, Human
aaauauuuacauaug

SEQ ID NO: 2120540 - RNA, 17 nt, Human
aaauauuuacauaugaa

SEQ ID NO: 2120541 - RNA, 19 nt, Human
aaauauuuacauaugaaau

SEQ ID NO: 2120542 - RNA, 21 nt, Human
aaauauuuacauaugaaauuu

SEQ ID NO: 2120543 - RNA, 15 nt, Human
aaauauuuauguaaa

SEQ ID NO: 2120544 - RNA, 12 nt, Human
aaauauuuccuu

SEQ ID NO: 2120545 - RNA, 14 nt, Human
aaauauuuccuuaa

SEQ ID NO: 2120546 - RNA, 12 nt, Human
aaauauuuaaga

SEQ ID NO: 2120547 - RNA, 15 nt, Human
aaauagcaacaugcu

SEQ ID NO: 2120548 - RNA, 18 nt, Human
aaauagcaacaugcuuca

SEQ ID NO: 2120549 - RNA, 19 nt, Human
aaauagaguauaugcacuu

SEQ ID NO: 2120550 - RNA, 17 nt, Human
aaauagaguauaugcac

SEQ ID NO: 2120551 - RNA, 19 nt, Human
aaaggauguaaacagugcc

SEQ ID NO: 2120552 - RNA, 20 nt, Human
aaaggauguaaacagugccu

SEQ ID NO: 2120553 - RNA, 21 nt, Human
aaaggauguaaacagugccug

SEQ ID NO: 2120554 - RNA, 18 nt, Human
aaaggauucauguggaau

SEQ ID NO: 2120555 - RNA, 14 nt, Human
aaaggauuucuaga

SEQ ID NO: 2120556 - RNA, 14 nt, Human
aaauucuguuucuu

SEQ ID NO: 2120557 - RNA, 15 nt, Human
aaauucuguuucuug

SEQ ID NO: 2120558 - RNA, 21 nt, Human
aaauguuuuucugccagggag

SEQ ID NO: 2120559 - RNA, 23 nt, Human
aaauguuuuucugccagggagcu

SEQ ID NO: 2120560 - RNA, 19 nt, Human
aaauguuuuguaagaaacc

SEQ ID NO: 2120561 - RNA, 16 nt, Human
aaauguuuuucugcca

SEQ ID NO: 2120562 - RNA, 16 nt, Human
aaauguuuuaaggcuu

SEQ ID NO: 2120563 - RNA, 23 nt, Human
aaauguuuuaaggcuucaauuua

SEQ ID NO: 2120564 - RNA, 19 nt, Human
aacauggagaaacccuguc

SEQ ID NO: 2120565 - RNA, 20 nt, Human
aacaggcucaauauuccuga

SEQ ID NO: 2120566 - RNA, 21 nt, Human
aacaggcucaauauuccugaa

SEQ ID NO: 2120567 - RNA, 13 nt, Human
aacagccgagugg

SEQ ID NO: 2120568 - RNA, 22 nt, Human
aacagccgaguggauagaugcc

SEQ ID NO: 2120569 - RNA, 23 nt, Human
aacagccgaguggauagaugccc

SEQ ID NO: 2120570 - RNA, 20 nt, Human
aacagccgcuccugucugcc

SEQ ID NO: 2120571 - RNA, 21 nt, Human
aacagccgcuccugucugcca

SEQ ID NO: 2120572 - RNA, 22 nt, Human
aacagccgucagccaaauguaa

SEQ ID NO: 2120573 - RNA, 13 nt, Human
aacagccucacag

SEQ ID NO: 2120574 - RNA, 14 nt, Human
aacagccucacaga

SEQ ID NO: 2120575 - RNA, 11 nt, Human
aacaggcagau

SEQ ID NO: 2120576 - RNA, 20 nt, Human
aacagcauugcuuucugaaa

SEQ ID NO: 2120577 - RNA, 17 nt, Human
aacagcauugcuuucug

SEQ ID NO: 2120578 - RNA, 13 nt, Human
aaccguccucuuu

SEQ ID NO: 2120579 - RNA, 15 nt, Human
aaccguccucuuuuu

SEQ ID NO: 2120580 - RNA, 17 nt, Human
aacccugcaaaggacug

SEQ ID NO: 2120581 - RNA, 21 nt, Human
aacccuccuaucaccuccccu

SEQ ID NO: 2120582 - RNA, 15 nt, Human
aacccucguuucuga

SEQ ID NO: 2120583 - RNA, 15 nt, Human
aaccgucaauaggca

SEQ ID NO: 2120584 - RNA, 23 nt, Human
aaccggggagcccccgccccgcc

SEQ ID NO: 2120585 - RNA, 16 nt, Human
aacccucccucagccc

SEQ ID NO: 2120586 - RNA, 17 nt, Human
aacccucccucagcccc

SEQ ID NO: 2120587 - RNA, 18 nt, Human
aacccucccucagccccu

SEQ ID NO: 2120588 - RNA, 19 nt, Human
aacccucccucagccccuc

SEQ ID NO: 2120589 - RNA, 20 nt, Human
aacccucccucagccccucu

SEQ ID NO: 2120590 - RNA, 21 nt, Human
aacccucccucagccccucuu

SEQ ID NO: 2120591 - RNA, 23 nt, Human
aacccucccucagccccucuugc

SEQ ID NO: 2120592 - RNA, 19 nt, Human
aacccuccuaucaccuccc

SEQ ID NO: 2120593 - RNA, 12 nt, Human
aacccucagagc

SEQ ID NO: 2120594 - RNA, 19 nt, Human
aacccucagagccaccccu

SEQ ID NO: 2120595 - RNA, 13 nt, Human
aacccucccucag

SEQ ID NO: 2120596 - RNA, 14 nt, Human
aacccucccucagc

SEQ ID NO: 2120597 - RNA, 15 nt, Human
aacccucccucagcc

SEQ ID NO: 2120598 - RNA, 20 nt, Human
aacauggagaaacccugucu

SEQ ID NO: 2120599 - RNA, 23 nt, Human
aacaugggguuggcugggcccag

SEQ ID NO: 2120600 - RNA, 22 nt, Human
aacaugguaaacgcugucccua

SEQ ID NO: 2120601 - RNA, 22 nt, Human
aaccuaaauuugguucuaggcc

SEQ ID NO: 2120602 - RNA, 18 nt, Human
aacaucuuuccaguccuu

SEQ ID NO: 2120603 - RNA, 22 nt, Human
aaccuaaauaaacacauagauu

SEQ ID NO: 2120604 - RNA, 11 nt, Human
aauaaagacag

SEQ ID NO: 2120605 - RNA, 12 nt, Human
aauaaagacagg

SEQ ID NO: 2120606 - RNA, 19 nt, Human
aauaauguuaacauggaca

SEQ ID NO: 2120607 - RNA, 15 nt, Human
aauaaugugaaucau

SEQ ID NO: 2120608 - RNA, 16 nt, Human
aauaaugugggaagaa

SEQ ID NO: 2120609 - RNA, 21 nt, Human
aauaaugugggaagaaacaaa

SEQ ID NO: 2120610 - RNA, 12 nt, Human
aagugcugggau

SEQ ID NO: 2120611 - RNA, 20 nt, Human
aaguggaccaggacaggacc

SEQ ID NO: 2120612 - RNA, 17 nt, Human
aaguggcaugugcugug

SEQ ID NO: 2120613 - RNA, 18 nt, Human
aaguggcaugugcuguga

SEQ ID NO: 2120614 - RNA, 20 nt, Human
aaguggaccuugagaccaca

SEQ ID NO: 2120615 - RNA, 14 nt, Human
aaguggcugcugac

SEQ ID NO: 2120616 - RNA, 20 nt, Human
aaguugaaagaguccuauuu

SEQ ID NO: 2120617 - RNA, 17 nt, Human
aaguugaaauuaaccau

SEQ ID NO: 2120618 - RNA, 12 nt, Human
aaguggcugcug

SEQ ID NO: 2120619 - RNA, 17 nt, Human
aaguugaagcuaagauu

SEQ ID NO: 2120620 - RNA, 18 nt, Human
aaguugaagcuaagauuu

SEQ ID NO: 2120621 - RNA, 21 nt, Human
aaguugaauggccugccuuga

SEQ ID NO: 2120622 - RNA, 13 nt, Human
aaguuuaaaaugu

SEQ ID NO: 2120623 - RNA, 14 nt, Human
aaguuuaaaaugua

SEQ ID NO: 2120624 - RNA, 15 nt, Human
aaguuuaaaauguau

SEQ ID NO: 2120625 - RNA, 17 nt, Human
aaguuuaaaauguauaa

SEQ ID NO: 2120626 - RNA, 16 nt, Human
aaguugggagccugaa

SEQ ID NO: 2120627 - RNA, 16 nt, Human
aaguugggcaauauaa

SEQ ID NO: 2120628 - RNA, 17 nt, Human
aaguugggcaauauaac

SEQ ID NO: 2120629 - RNA, 19 nt, Human
aaguugggcaauauaacca

SEQ ID NO: 2120630 - RNA, 20 nt, Human
aaguugggcaauauaaccaa

SEQ ID NO: 2120631 - RNA, 11 nt, Human
aaguuggcuuc

SEQ ID NO: 2120632 - RNA, 16 nt, Human
aaguuggcuucuguuu

SEQ ID NO: 2120633 - RNA, 17 nt, Human
aaguuggcuucuguuuc

SEQ ID NO: 2120634 - RNA, 19 nt, Human
aaguuggcuucuguuucua

SEQ ID NO: 2120635 - RNA, 21 nt, Human
aaguuggcuucuguuucuagu

SEQ ID NO: 2120636 - RNA, 13 nt, Human
aaguuggacuggg

SEQ ID NO: 2120637 - RNA, 21 nt, Human
aauaaacagcuucaugccuuu

SEQ ID NO: 2120638 - RNA, 22 nt, Human
aauaaacagcuucaugccuuug

SEQ ID NO: 2120639 - RNA, 13 nt, Human
aauaaacauccuu

SEQ ID NO: 2120640 - RNA, 23 nt, Human
aauaaacauccuucaagaacucu

SEQ ID NO: 2120641 - RNA, 21 nt, Human
aauaaacacauagauucaccu

SEQ ID NO: 2120642 - RNA, 22 nt, Human
aauaaacacauagauucaccug

SEQ ID NO: 2120643 - RNA, 22 nt, Human
aaucaauccagcgguucucaaa

SEQ ID NO: 2120644 - RNA, 17 nt, Human
aaucacgaggucaggag

SEQ ID NO: 2120645 - RNA, 22 nt, Human
aaucaaugcuauaacuauguug

SEQ ID NO: 2120646 - RNA, 17 nt, Human
aaucaaugucacuuaaa

SEQ ID NO: 2120647 - RNA, 10 nt, Human
aaucaaaacu

SEQ ID NO: 2120648 - RNA, 18 nt, Human
aaucaaaacucuccuaca

SEQ ID NO: 2120649 - RNA, 13 nt, Human
aaucaaaauaugu

SEQ ID NO: 2120650 - RNA, 23 nt, Human
aaucaaguuggcuucuaaucaaa

SEQ ID NO: 2120651 - RNA, 19 nt, Human
aaucaaguuuccaagcaaa

SEQ ID NO: 2120652 - RNA, 20 nt, Human
aaucaaguuuccaagcaaau

SEQ ID NO: 2120653 - RNA, 12 nt, Human
aauauguauuuu

SEQ ID NO: 2120654 - RNA, 13 nt, Human
aauauguauuuua

SEQ ID NO: 2120655 - RNA, 18 nt, Human
aauauguauuuuauguau

SEQ ID NO: 2120656 - RNA, 20 nt, Human
aauauguauuuuauguaugu

SEQ ID NO: 2120657 - RNA, 21 nt, Human
aauauguauuuuauguauguu

SEQ ID NO: 2120658 - RNA, 17 nt, Human
aauauguccauaucuaa

SEQ ID NO: 2120659 - RNA, 19 nt, Human
aauauguccauaucuaacc

SEQ ID NO: 2120660 - RNA, 11 nt, Human
aauauguauuu

SEQ ID NO: 2120661 - RNA, 21 nt, Human
aauauguuaaccucaguguca

SEQ ID NO: 2120662 - RNA, 16 nt, Human
aauauguuagcaaaga

SEQ ID NO: 2120663 - RNA, 22 nt, Human
aauauguuaaccucagugucau

SEQ ID NO: 2120664 - RNA, 20 nt, Human
aauauguucuuuaaaaauau

SEQ ID NO: 2120665 - RNA, 22 nt, Human
aauauguugaugaaaaauagca

SEQ ID NO: 2120666 - RNA, 13 nt, Human
aauauuaagaaag

SEQ ID NO: 2120667 - RNA, 15 nt, Human
aaugaauaauaauua

SEQ ID NO: 2120668 - RNA, 16 nt, Human
aaugaauaauuuccca

SEQ ID NO: 2120669 - RNA, 21 nt, Human
aaugaauaauaauuauccaga

SEQ ID NO: 2120670 - RNA, 22 nt, Human
aaugaaagcauguggcauguuc

SEQ ID NO: 2120671 - RNA, 17 nt, Human
aaugaaagcaugucuca

SEQ ID NO: 2120672 - RNA, 15 nt, Human
aaugaaagcaugugg

SEQ ID NO: 2120673 - RNA, 22 nt, Human
aaugaagauuauuuuuuaugag

SEQ ID NO: 2120674 - RNA, 21 nt, Human
aaugaaagacuguacaaagua

SEQ ID NO: 2120675 - RNA, 18 nt, Human
aaugaaagacuguacaaa

SEQ ID NO: 2120676 - RNA, 20 nt, Human
aaugaaagacuguacaaagu

SEQ ID NO: 2120677 - RNA, 22 nt, Human
aaucucaccccaucccacaccc

SEQ ID NO: 2120678 - RNA, 22 nt, Human
aaucucagagguagggcugcca

SEQ ID NO: 2120679 - RNA, 23 nt, Human
aaucucagagguagggcugccac

SEQ ID NO: 2120680 - RNA, 22 nt, Human
aaucucagcaaugauuacucuu

SEQ ID NO: 2120681 - RNA, 13 nt, Human
aaucucaccccau

SEQ ID NO: 2120682 - RNA, 14 nt, Human
aaucucaauuugag

SEQ ID NO: 2120683 - RNA, 12 nt, Human
aaucugaaugua

SEQ ID NO: 2120684 - RNA, 13 nt, Human
aaucugaauguaa

SEQ ID NO: 2120685 - RNA, 14 nt, Human
aaucugaauguaau

SEQ ID NO: 2120686 - RNA, 15 nt, Human
aaucugaauguaauu

SEQ ID NO: 2120687 - RNA, 16 nt, Human
aaucugaauguaauuu

SEQ ID NO: 2120688 - RNA, 18 nt, Human
aaucugaauguaauuugu

SEQ ID NO: 2120689 - RNA, 17 nt, Human
aaucugaggccuccucu

SEQ ID NO: 2120690 - RNA, 16 nt, Human
aaucugaucguucuuu

SEQ ID NO: 2120691 - RNA, 19 nt, Human
aaucugaucguucuuucua

SEQ ID NO: 2120692 - RNA, 21 nt, Human
aaucugaucguucuuucuagc

SEQ ID NO: 2120693 - RNA, 13 nt, Human
aagcuagaaauga

SEQ ID NO: 2120694 - RNA, 15 nt, Human
aagcgugagccacug

SEQ ID NO: 2120695 - RNA, 23 nt, Human
aagcgugaaggccgagaagcaag

SEQ ID NO: 2120696 - RNA, 16 nt, Human
aagcgugagccacugc

SEQ ID NO: 2120697 - RNA, 18 nt, Human
aagcgaggucaacagaga

SEQ ID NO: 2120698 - RNA, 20 nt, Human
aagcgaugaauuuggagacu

SEQ ID NO: 2120699 - RNA, 21 nt, Human
aagcgaugaauuuggagacuc

SEQ ID NO: 2120700 - RNA, 13 nt, Human
aagcggggggagg

SEQ ID NO: 2120701 - RNA, 14 nt, Human
aagcggggggaggg

SEQ ID NO: 2120702 - RNA, 14 nt, Human
aagcggcuggcagc

SEQ ID NO: 2120703 - RNA, 15 nt, Human
aagccuuuccauaag

SEQ ID NO: 2120704 - RNA, 14 nt, Human
aagccuuuccauaa

SEQ ID NO: 2120705 - RNA, 12 nt, Human
aagccagucuua

SEQ ID NO: 2120706 - RNA, 14 nt, Human
aagccagucuuaac

SEQ ID NO: 2120707 - RNA, 22 nt, Human
aagccagggauggggccacagc

SEQ ID NO: 2120708 - RNA, 23 nt, Human
aagccagggauggggccacagcc

SEQ ID NO: 2120709 - RNA, 21 nt, Human
aagauaaucuuagcugccaag

SEQ ID NO: 2120710 - RNA, 19 nt, Human
aagauaauauuaaggaaga

SEQ ID NO: 2120711 - RNA, 21 nt, Human
aagauaauauuaaggaagaca

SEQ ID NO: 2120712 - RNA, 14 nt, Human
aagauaaaugugcu

SEQ ID NO: 2120713 - RNA, 21 nt, Human
aagaguuugagaccugaauag

SEQ ID NO: 2120714 - RNA, 19 nt, Human
aagauaacaagaucuuuca

SEQ ID NO: 2120715 - RNA, 20 nt, Human
aagauaacaagaucuuucag

SEQ ID NO: 2120716 - RNA, 21 nt, Human
aagauaacaagaucuuucagg

SEQ ID NO: 2120717 - RNA, 22 nt, Human
aagauaacaagaucuuucagga

SEQ ID NO: 2120718 - RNA, 15 nt, Human
aaggagaaggaagga

SEQ ID NO: 2120719 - RNA, 19 nt, Human
aaggagaaacagagacagg

SEQ ID NO: 2120720 - RNA, 20 nt, Human
aaggcaacugaacaaaaaaa

SEQ ID NO: 2120721 - RNA, 21 nt, Human
aaggcaacugaacaaaaaaau

SEQ ID NO: 2120722 - RNA, 13 nt, Human
aagcugcacccuc

SEQ ID NO: 2120723 - RNA, 19 nt, Human
aagcugcacccucaggcag

SEQ ID NO: 2120724 - RNA, 12 nt, Human
aaggacuugaaa

SEQ ID NO: 2120725 - RNA, 17 nt, Human
aaggacuugaaagcauc

SEQ ID NO: 2120726 - RNA, 19 nt, Human
aaggacuugaaagcaucca

SEQ ID NO: 2120727 - RNA, 22 nt, Human
aaggacuugaaagcauccaugu

SEQ ID NO: 2120728 - RNA, 16 nt, Human
aagcugauuacuguca

SEQ ID NO: 2120729 - RNA, 17 nt, Human
aagcugauuacugucaa

SEQ ID NO: 2120730 - RNA, 19 nt, Human
aagcugauuacugucaaua

SEQ ID NO: 2120731 - RNA, 22 nt, Human
aagcugauuacugucaauaaac

SEQ ID NO: 2120732 - RNA, 23 nt, Human
aagcugauuacugucaauaaaca

SEQ ID NO: 2120733 - RNA, 12 nt, Human
aagacagagucu

SEQ ID NO: 2120734 - RNA, 15 nt, Human
aagacagagcuggga

SEQ ID NO: 2120735 - RNA, 16 nt, Human
aagacagagcugggau

SEQ ID NO: 2120736 - RNA, 13 nt, Human
aagacagaagccu

SEQ ID NO: 2120737 - RNA, 12 nt, Human
aagacagaagcc

SEQ ID NO: 2120738 - RNA, 22 nt, Human
aagacagagccccacccucaga

SEQ ID NO: 2120739 - RNA, 15 nt, Human
aagacaugaauauga

SEQ ID NO: 2120740 - RNA, 13 nt, Human
aagacaugaacca

SEQ ID NO: 2120741 - RNA, 18 nt, Human
aagacaugaaugcacacu

SEQ ID NO: 2120742 - RNA, 23 nt, Human
aagacauacuccuuccaucaaau

SEQ ID NO: 2120743 - RNA, 16 nt, Human
aagacagaugccccag

SEQ ID NO: 2120744 - RNA, 17 nt, Human
aagacagaugccccaga

SEQ ID NO: 2120745 - RNA, 20 nt, Human
aagacagaugccccagagcu

SEQ ID NO: 2120746 - RNA, 22 nt, Human
aagacagaugccccagagcugu

SEQ ID NO: 2120747 - RNA, 17 nt, Human
aagaccaccucaaauuu

SEQ ID NO: 2120748 - RNA, 19 nt, Human
aagaccaccucaaauuuaa

SEQ ID NO: 2120749 - RNA, 17 nt, Human
aagacauugucaauaaa

SEQ ID NO: 2120750 - RNA, 18 nt, Human
aagaccaaaaugacaaug

SEQ ID NO: 2120751 - RNA, 19 nt, Human
aagaccaaaaugacaauga

SEQ ID NO: 2120752 - RNA, 13 nt, Human
aagagaaaaaaua

SEQ ID NO: 2120753 - RNA, 17 nt, Human
aagagaaaauguaaaua

SEQ ID NO: 2120754 - RNA, 13 nt, Human
aagagaaaauuga

SEQ ID NO: 2120755 - RNA, 15 nt, Human
aagagaaaauugaau

SEQ ID NO: 2120756 - RNA, 17 nt, Human
aagagaaaauugaauuu

SEQ ID NO: 2120757 - RNA, 18 nt, Human
aagagaaaauugaauuua

SEQ ID NO: 2120758 - RNA, 21 nt, Human
aagagaaaauugaauuuaaca

SEQ ID NO: 2120759 - RNA, 12 nt, Human
aagagaaacagg

SEQ ID NO: 2120760 - RNA, 21 nt, Human
aagagaaacaggguguuguca

SEQ ID NO: 2120761 - RNA, 12 nt, Human
aagagaaacuuu

SEQ ID NO: 2120762 - RNA, 14 nt, Human
aagagaaacuuugu

SEQ ID NO: 2120763 - RNA, 18 nt, Human
aagagaaacuuugugcua

SEQ ID NO: 2120764 - RNA, 20 nt, Human
aagagaaacuuugugcuaca

SEQ ID NO: 2120765 - RNA, 22 nt, Human
aagagaaaaaaaguuugccaga

SEQ ID NO: 2120766 - RNA, 13 nt, Human
aagagaugaagag

SEQ ID NO: 2120767 - RNA, 14 nt, Human
aagagauacagagg

SEQ ID NO: 2120768 - RNA, 21 nt, Human
aagagauauguagaaggcaca

SEQ ID NO: 2120769 - RNA, 19 nt, Human
aagagaguuaaucaacuga

SEQ ID NO: 2120770 - RNA, 22 nt, Human
aagagaguuaaucaacugaaag

SEQ ID NO: 2120771 - RNA, 13 nt, Human
aagaagaaaacac

SEQ ID NO: 2120772 - RNA, 12 nt, Human
aagaagacauga

SEQ ID NO: 2120773 - RNA, 16 nt, Human
aagaagacaugaacca

SEQ ID NO: 2120774 - RNA, 15 nt, Human
aagacaacauuaaaa

SEQ ID NO: 2120775 - RNA, 21 nt, Human
aagacaacauuaaaacaauau

SEQ ID NO: 2120776 - RNA, 19 nt, Human
aagacaaugugaaaagaaa

SEQ ID NO: 2120777 - RNA, 20 nt, Human
aagacaaugugaaaagaaaa

SEQ ID NO: 2120778 - RNA, 23 nt, Human
aagacaauggcuuacuccaggag

SEQ ID NO: 2120779 - RNA, 22 nt, Human
aagacacugaaauauacacaca

SEQ ID NO: 2120780 - RNA, 21 nt, Human
aagacacugaaauauacacac

SEQ ID NO: 2120781 - RNA, 14 nt, Human
aagacacugaaaua

SEQ ID NO: 2120782 - RNA, 18 nt, Human
aagacaccguucauucag

SEQ ID NO: 2120783 - RNA, 16 nt, Human
aacgcagcccugcuuu

SEQ ID NO: 2120784 - RNA, 12 nt, Human
aacgcagcccug

SEQ ID NO: 2120785 - RNA, 23 nt, Human
aacgcauggaguguguauuguuc

SEQ ID NO: 2120786 - RNA, 21 nt, Human
aacgcauggaguguguauugu

SEQ ID NO: 2120787 - RNA, 22 nt, Human
aacgcauggaguguguauuguu

SEQ ID NO: 2120788 - RNA, 18 nt, Human
aacgcauggaguguguau

SEQ ID NO: 2120789 - RNA, 13 nt, Human
aacgcauggagug

SEQ ID NO: 2120790 - RNA, 21 nt, Human
aagaacuagagguuuuaugau

SEQ ID NO: 2120791 - RNA, 11 nt, Human
aagaacugcau

SEQ ID NO: 2120792 - RNA, 13 nt, Human
aagaacugcaugg

SEQ ID NO: 2120793 - RNA, 18 nt, Human
aagaacugcauggaccua

SEQ ID NO: 2120794 - RNA, 23 nt, Human
aagaacugcauggaccuaacauu

SEQ ID NO: 2120795 - RNA, 14 nt, Human
aagaacugaaaaca

SEQ ID NO: 2120796 - RNA, 16 nt, Human
aagaacugaaaacaua

SEQ ID NO: 2120797 - RNA, 18 nt, Human
aagaacugaaaacauaaa

SEQ ID NO: 2120798 - RNA, 19 nt, Human
aagaacugaaaacauaaaa

SEQ ID NO: 2120799 - RNA, 23 nt, Human
aagaguaguugauguugcauuuu

SEQ ID NO: 2120800 - RNA, 22 nt, Human
aagaguaguugauguugcauuu

SEQ ID NO: 2120801 - RNA, 19 nt, Human
aagaguaguugauguugca

SEQ ID NO: 2120802 - RNA, 23 nt, Human
aagaguguccuaggaguauccuc

SEQ ID NO: 2120803 - RNA, 15 nt, Human
aagaguuaagaaugu

SEQ ID NO: 2120804 - RNA, 14 nt, Human
aagaguuggcuggu

SEQ ID NO: 2120805 - RNA, 23 nt, Human
aagaguucuuaaggauugugaua

SEQ ID NO: 2120806 - RNA, 18 nt, Human
aagaguuguguuguucuu

SEQ ID NO: 2120807 - RNA, 19 nt, Human
aagaguuguguuguucuuu

SEQ ID NO: 2120808 - RNA, 22 nt, Human
aagaguuguguuguucuuuucc

SEQ ID NO: 2120809 - RNA, 20 nt, Human
acugauguaugaggaauuuc

SEQ ID NO: 2120810 - RNA, 17 nt, Human
acugaucaugcauuguu

SEQ ID NO: 2120811 - RNA, 23 nt, Human
acugaugggcaacccccagccug

SEQ ID NO: 2120812 - RNA, 16 nt, Human
acugauguuaggcugg

SEQ ID NO: 2120813 - RNA, 18 nt, Human
acugauguuaggcugggc

SEQ ID NO: 2120814 - RNA, 19 nt, Human
acugauguuaggcugggcc

SEQ ID NO: 2120815 - RNA, 21 nt, Human
acugauguuaggcugggccca

SEQ ID NO: 2120816 - RNA, 22 nt, Human
acugauguuaggcugggcccag

SEQ ID NO: 2120817 - RNA, 23 nt, Human
acugauguuaggcugggcccaga

SEQ ID NO: 2120818 - RNA, 15 nt, Human
acugaucaugcauug

SEQ ID NO: 2120819 - RNA, 16 nt, Human
acugaucaugcauugu

SEQ ID NO: 2120820 - RNA, 18 nt, Human
acugaucaugcauuguug

SEQ ID NO: 2120821 - RNA, 16 nt, Human
acugauuuggagauau

SEQ ID NO: 2120822 - RNA, 22 nt, Human
acugaauuaaugacagagccag

SEQ ID NO: 2120823 - RNA, 13 nt, Human
acucuacccuccc

SEQ ID NO: 2120824 - RNA, 15 nt, Human
acucuacccucccac

SEQ ID NO: 2120825 - RNA, 16 nt, Human
acucuacccucccacc

SEQ ID NO: 2120826 - RNA, 18 nt, Human
acucuacccucccacccc

SEQ ID NO: 2120827 - RNA, 19 nt, Human
acucuacccucccaccccc

SEQ ID NO: 2120828 - RNA, 16 nt, Human
acugaaugcucugugc

SEQ ID NO: 2120829 - RNA, 17 nt, Human
acugaaugaacaaccuc

SEQ ID NO: 2120830 - RNA, 22 nt, Human
acugaaugcuucugacuucaua

SEQ ID NO: 2120831 - RNA, 18 nt, Human
acugacauuguuggccaa

SEQ ID NO: 2120832 - RNA, 17 nt, Human
acugacauuguuggcca

SEQ ID NO: 2120833 - RNA, 14 nt, Human
acugacagaggggg

SEQ ID NO: 2120834 - RNA, 18 nt, Human
acugacagccucccaccc

SEQ ID NO: 2120835 - RNA, 23 nt, Human
acugacacaaaaaguagauuaag

SEQ ID NO: 2120836 - RNA, 13 nt, Human
acugacacacacg

SEQ ID NO: 2120837 - RNA, 13 nt, Human
acugacacaugcu

SEQ ID NO: 2120838 - RNA, 17 nt, Human
acugaauuguccccagu

SEQ ID NO: 2120839 - RNA, 13 nt, Human
acugacaaaucaa

SEQ ID NO: 2120840 - RNA, 16 nt, Human
acugacaaaucaaguu

SEQ ID NO: 2120841 - RNA, 17 nt, Human
acugacaaaucaaguuu

SEQ ID NO: 2120842 - RNA, 19 nt, Human
acugacaaaucaaguuucc

SEQ ID NO: 2120843 - RNA, 21 nt, Human
acucuaauucuaaccagagca

SEQ ID NO: 2120844 - RNA, 16 nt, Human
acucuacacugugaac

SEQ ID NO: 2120845 - RNA, 15 nt, Human
acucuacagaggcca

SEQ ID NO: 2120846 - RNA, 17 nt, Human
acucccuggcucucaga

SEQ ID NO: 2120847 - RNA, 18 nt, Human
acucccuggcucucagaa

SEQ ID NO: 2120848 - RNA, 15 nt, Human
acucccuucccauaa

SEQ ID NO: 2120849 - RNA, 15 nt, Human
acucccuccucaccu

SEQ ID NO: 2120850 - RNA, 16 nt, Human
acucccuccucaccuc

SEQ ID NO: 2120851 - RNA, 19 nt, Human
acucccuccucaccucugg

SEQ ID NO: 2120852 - RNA, 20 nt, Human
acucccuccucaccucugga

SEQ ID NO: 2120853 - RNA, 22 nt, Human
acucccuccucaccucuggacu

SEQ ID NO: 2120854 - RNA, 15 nt, Human
acucccaagcuggac

SEQ ID NO: 2120855 - RNA, 13 nt, Human
acucccaaagagc

SEQ ID NO: 2120856 - RNA, 15 nt, Human
acucccaaagagcug

SEQ ID NO: 2120857 - RNA, 16 nt, Human
acucccaaagagcugc

SEQ ID NO: 2120858 - RNA, 18 nt, Human
acucccaaagagcugccu

SEQ ID NO: 2120859 - RNA, 19 nt, Human
acucccaaagagcugccua

SEQ ID NO: 2120860 - RNA, 13 nt, Human
acucccaagaaca

SEQ ID NO: 2120861 - RNA, 14 nt, Human
acucccaagaacag

SEQ ID NO: 2120862 - RNA, 17 nt, Human
acucccaagaacagcag

SEQ ID NO: 2120863 - RNA, 19 nt, Human
acucccaagaacagcaggc

SEQ ID NO: 2120864 - RNA, 22 nt, Human
acucccaagaacagcaggccca

SEQ ID NO: 2120865 - RNA, 20 nt, Human
acuccauguuggcuagccuc

SEQ ID NO: 2120866 - RNA, 14 nt, Human
acuccauguuggcu

SEQ ID NO: 2120867 - RNA, 22 nt, Human
acucccaguccaaauguccucc

SEQ ID NO: 2120868 - RNA, 15 nt, Human
acuccggugugccug

SEQ ID NO: 2120869 - RNA, 16 nt, Human
acuccggugugccugc

SEQ ID NO: 2120870 - RNA, 15 nt, Human
acuccgucucaagga

SEQ ID NO: 2120871 - RNA, 21 nt, Human
acuccggugugccugcagccc

SEQ ID NO: 2120872 - RNA, 19 nt, Human
acuccggugugccugcagc

SEQ ID NO: 2120873 - RNA, 20 nt, Human
acuccggugugccugcagcc

SEQ ID NO: 2120874 - RNA, 16 nt, Human
acuccgucucaaggaa

SEQ ID NO: 2120875 - RNA, 12 nt, Human
acugguggcccg

SEQ ID NO: 2120876 - RNA, 14 nt, Human
acuggugagcagac

SEQ ID NO: 2120877 - RNA, 16 nt, Human
acuggugagcagacug

SEQ ID NO: 2120878 - RNA, 21 nt, Human
acuggaggggacgcugguaga

SEQ ID NO: 2120879 - RNA, 22 nt, Human
acuggaggggacgcugguagag

SEQ ID NO: 2120880 - RNA, 12 nt, Human
acuggaguccag

SEQ ID NO: 2120881 - RNA, 17 nt, Human
acuggaguccagucucu

SEQ ID NO: 2120882 - RNA, 13 nt, Human
acuggaggccagg

SEQ ID NO: 2120883 - RNA, 18 nt, Human
acuggaggaccacacuca

SEQ ID NO: 2120884 - RNA, 11 nt, Human
acuggagcccc

SEQ ID NO: 2120885 - RNA, 14 nt, Human
acugccaugccagc

SEQ ID NO: 2120886 - RNA, 18 nt, Human
acugccauggaggcacac

SEQ ID NO: 2120887 - RNA, 21 nt, Human
acugccauggaggcacacagc

SEQ ID NO: 2120888 - RNA, 19 nt, Human
acugcccaggccugccugu

SEQ ID NO: 2120889 - RNA, 15 nt, Human
acugccuaagcccuc

SEQ ID NO: 2120890 - RNA, 14 nt, Human
acugccuaagcccu

SEQ ID NO: 2120891 - RNA, 19 nt, Human
acugccgaccgaggcugga

SEQ ID NO: 2120892 - RNA, 13 nt, Human
acugcccugucua

SEQ ID NO: 2120893 - RNA, 18 nt, Human
acugccgaccgaggcugg

SEQ ID NO: 2120894 - RNA, 22 nt, Human
acugccgaccgaggcuggagcu

SEQ ID NO: 2120895 - RNA, 23 nt, Human
acugccgaccgaggcuggagcug

SEQ ID NO: 2120896 - RNA, 18 nt, Human
acugugccaugugccagg

SEQ ID NO: 2120897 - RNA, 17 nt, Human
acugugccaugugccag

SEQ ID NO: 2120898 - RNA, 16 nt, Human
acugugaagagaacca

SEQ ID NO: 2120899 - RNA, 16 nt, Human
acuguaaaaugaaauu

SEQ ID NO: 2120900 - RNA, 12 nt, Human
acuguuucucug

SEQ ID NO: 2120901 - RNA, 14 nt, Human
acuguuuccacauu

SEQ ID NO: 2120902 - RNA, 14 nt, Human
acuguuuuuuccug

SEQ ID NO: 2120903 - RNA, 20 nt, Human
acuguuuuuuaaacuaggaa

SEQ ID NO: 2120904 - RNA, 23 nt, Human
acuguuuuucagggagguggcug

SEQ ID NO: 2120905 - RNA, 17 nt, Human
acuguuuuuuccugagc

SEQ ID NO: 2120906 - RNA, 18 nt, Human
acuguuuuuuccugagcu

SEQ ID NO: 2120907 - RNA, 19 nt, Human
acuguuuuuuccugagcuu

SEQ ID NO: 2120908 - RNA, 13 nt, Human
acuuaaaaaaaug

SEQ ID NO: 2120909 - RNA, 14 nt, Human
acuuaaaaaaauga

SEQ ID NO: 2120910 - RNA, 15 nt, Human
acuuaaaaaaaugac

SEQ ID NO: 2120911 - RNA, 16 nt, Human
acuuaaaaaaaugaca

SEQ ID NO: 2120912 - RNA, 17 nt, Human
acuuaaaaaaaugacag

SEQ ID NO: 2120913 - RNA, 22 nt, Human
acuuaaaaaaaugacagauguu

SEQ ID NO: 2120914 - RNA, 13 nt, Human
acuuaaaaaacuu

SEQ ID NO: 2120915 - RNA, 23 nt, Human
acuuaaaaaacuuguaaaugcug

SEQ ID NO: 2120916 - RNA, 14 nt, Human
acuuaaaaaauguc

SEQ ID NO: 2120917 - RNA, 13 nt, Human
acuucagacugaa

SEQ ID NO: 2120918 - RNA, 19 nt, Human
acuucagacugaacaugua

SEQ ID NO: 2120919 - RNA, 15 nt, Human
acuucagagagcugg

SEQ ID NO: 2120920 - RNA, 16 nt, Human
acuucagagagcuggu

SEQ ID NO: 2120921 - RNA, 17 nt, Human
acuucagagagcuggua

SEQ ID NO: 2120922 - RNA, 18 nt, Human
acuucagagagcugguag

SEQ ID NO: 2120923 - RNA, 20 nt, Human
acuucagagagcugguaguu

SEQ ID NO: 2120924 - RNA, 23 nt, Human
acuuggggggcugaggugggagg

SEQ ID NO: 2120925 - RNA, 17 nt, Human
accuguggccaaguucu

SEQ ID NO: 2120926 - RNA, 14 nt, Human
accuguaacuuuuu

SEQ ID NO: 2120927 - RNA, 19 nt, Human
accugugaugaggggagga

SEQ ID NO: 2120928 - RNA, 18 nt, Human
accugugaguuuaaagca

SEQ ID NO: 2120929 - RNA, 19 nt, Human
accugugaguuuaaagcaa

SEQ ID NO: 2120930 - RNA, 20 nt, Human
accuguaaucccagcuacuu

SEQ ID NO: 2120931 - RNA, 19 nt, Human
accuguaaucccagcuacu

SEQ ID NO: 2120932 - RNA, 19 nt, Human
accuguaaucccagcacuu

SEQ ID NO: 2120933 - RNA, 16 nt, Human
accuguaaucccagca

SEQ ID NO: 2120934 - RNA, 15 nt, Human
accuguaaucccagc

SEQ ID NO: 2120935 - RNA, 14 nt, Human
accuguaaucccag

SEQ ID NO: 2120936 - RNA, 20 nt, Human
accuguaacuuuuguaaaua

SEQ ID NO: 2120937 - RNA, 19 nt, Human
accugcccccuucucccac

SEQ ID NO: 2120938 - RNA, 20 nt, Human
accugcccccuucucccaca

SEQ ID NO: 2120939 - RNA, 22 nt, Human
accugcccccuucucccacacu

SEQ ID NO: 2120940 - RNA, 23 nt, Human
accugcccccuucucccacacug

SEQ ID NO: 2120941 - RNA, 16 nt, Human
accugccccgcccagc

SEQ ID NO: 2120942 - RNA, 17 nt, Human
accugccccgcccagcu

SEQ ID NO: 2120943 - RNA, 11 nt, Human
accuguaaaac

SEQ ID NO: 2120944 - RNA, 14 nt, Human
accuguaaaacuuu

SEQ ID NO: 2120945 - RNA, 15 nt, Human
accuguaaaacuuua

SEQ ID NO: 2120946 - RNA, 16 nt, Human
accuguaaaacuuuau

SEQ ID NO: 2120947 - RNA, 17 nt, Human
accuguaaaacuuuauu

SEQ ID NO: 2120948 - RNA, 20 nt, Human
accuguaaaacuuuauuuua

SEQ ID NO: 2120949 - RNA, 21 nt, Human
accuguaaaacuuuauuuuau

SEQ ID NO: 2120950 - RNA, 22 nt, Human
accuguaaaacuuuauuuuaua

SEQ ID NO: 2120951 - RNA, 12 nt, Human
accuguaaauua

SEQ ID NO: 2120952 - RNA, 18 nt, Human
accuguaaauuauuuuaa

SEQ ID NO: 2120953 - RNA, 19 nt, Human
accuguaaauuauuuuaaa

SEQ ID NO: 2120954 - RNA, 15 nt, Human
accuguaacuuuugu

SEQ ID NO: 2120955 - RNA, 23 nt, Human
accugccccgcccagcugcaccu

SEQ ID NO: 2120956 - RNA, 17 nt, Human
accuguaacuuuuguaa

SEQ ID NO: 2120957 - RNA, 23 nt, Human
accucugccugaagucacacagu

SEQ ID NO: 2120958 - RNA, 20 nt, Human
accucugccugaagucacac

SEQ ID NO: 2120959 - RNA, 12 nt, Human
accucugccuga

SEQ ID NO: 2120960 - RNA, 22 nt, Human
accucuguauuugaaucagccu

SEQ ID NO: 2120961 - RNA, 21 nt, Human
accucuguauuugaaucagcc

SEQ ID NO: 2120962 - RNA, 12 nt, Human
acgcacacacac

SEQ ID NO: 2120963 - RNA, 12 nt, Human
acgcacacagcu

SEQ ID NO: 2120964 - RNA, 13 nt, Human
acgcacacagcuu

SEQ ID NO: 2120965 - RNA, 22 nt, Human
acgcacacguacuuaaaugaaa

SEQ ID NO: 2120966 - RNA, 21 nt, Human
acgcacacacacacacaggag

SEQ ID NO: 2120967 - RNA, 14 nt, Human
acgcacacugucug

SEQ ID NO: 2120968 - RNA, 18 nt, Human
acgcacacacacacacag

SEQ ID NO: 2120969 - RNA, 19 nt, Human
acgcacacacacacacagg

SEQ ID NO: 2120970 - RNA, 20 nt, Human
acgcacacacacacacagga

SEQ ID NO: 2120971 - RNA, 19 nt, Human
acggaauaguuggcuagga

SEQ ID NO: 2120972 - RNA, 17 nt, Human
acggacacucaaaagcu

SEQ ID NO: 2120973 - RNA, 23 nt, Human
acgcagcccugcuuugggcugcc

SEQ ID NO: 2120974 - RNA, 22 nt, Human
acgcagcccugcuuugggcugc

SEQ ID NO: 2120975 - RNA, 12 nt, Human
acgcagcccugc

SEQ ID NO: 2120976 - RNA, 13 nt, Human
acgcaccucccau

SEQ ID NO: 2120977 - RNA, 15 nt, Human
acgcaccucccaucc

SEQ ID NO: 2120978 - RNA, 19 nt, Human
acgcaccucccauccuaau

SEQ ID NO: 2120979 - RNA, 18 nt, Human
acgcuugacaggacagca

SEQ ID NO: 2120980 - RNA, 21 nt, Human
acgcuugacaggacagcaugg

SEQ ID NO: 2120981 - RNA, 15 nt, Human
acgcugugggcaggu

SEQ ID NO: 2120982 - RNA, 14 nt, Human
acgcugugggcagg

SEQ ID NO: 2120983 - RNA, 14 nt, Human
acguggagagcugg

SEQ ID NO: 2120984 - RNA, 17 nt, Human
acguggacguuuuuaau

SEQ ID NO: 2120985 - RNA, 15 nt, Human
acguggagagcuggu

SEQ ID NO: 2120986 - RNA, 16 nt, Human
acguggagagcuggug

SEQ ID NO: 2120987 - RNA, 18 nt, Human
acguggagagcuggugcc

SEQ ID NO: 2120988 - RNA, 19 nt, Human
acguggagagcuggugccc

SEQ ID NO: 2120989 - RNA, 13 nt, Human
acgugccaggccc

SEQ ID NO: 2120990 - RNA, 14 nt, Human
acgugccaggcccg

SEQ ID NO: 2120991 - RNA, 18 nt, Human
acgugccaggcccggggc

SEQ ID NO: 2120992 - RNA, 19 nt, Human
acgugccaggcccggggcu

SEQ ID NO: 2120993 - RNA, 21 nt, Human
acgugccaggcccggggcugg

SEQ ID NO: 2120994 - RNA, 18 nt, Human
acuaauggggcggugaga

SEQ ID NO: 2120995 - RNA, 15 nt, Human
acuaauuaacauaua

SEQ ID NO: 2120996 - RNA, 16 nt, Human
acuaauuaacauauaa

SEQ ID NO: 2120997 - RNA, 18 nt, Human
acuaauuaacauauaaua

SEQ ID NO: 2120998 - RNA, 21 nt, Human
accucaggugauccacccacc

SEQ ID NO: 2120999 - RNA, 20 nt, Human
accucaggugauccacccac

SEQ ID NO: 2121000 - RNA, 12 nt, Human
accucaggcagg

SEQ ID NO: 2121001 - RNA, 15 nt, Human
accucaggcaggaag

SEQ ID NO: 2121002 - RNA, 13 nt, Human
accucaggccagg

SEQ ID NO: 2121003 - RNA, 20 nt, Human
accucaggccaggugcagug

SEQ ID NO: 2121004 - RNA, 21 nt, Human
accucaggccaggugcagugg

SEQ ID NO: 2121005 - RNA, 15 nt, Human
accucagccuccugu

SEQ ID NO: 2121006 - RNA, 11 nt, Human
accucagccug

SEQ ID NO: 2121007 - RNA, 12 nt, Human
accucagccugu

SEQ ID NO: 2121008 - RNA, 16 nt, Human
accucagccugugcug

SEQ ID NO: 2121009 - RNA, 17 nt, Human
accucagccugugcugc

SEQ ID NO: 2121010 - RNA, 18 nt, Human
accucagccugugcugcc

SEQ ID NO: 2121011 - RNA, 19 nt, Human
accucagccugugcugccc

SEQ ID NO: 2121012 - RNA, 20 nt, Human
accucagccuuccccuugcc

SEQ ID NO: 2121013 - RNA, 14 nt, Human
accucagccuugga

SEQ ID NO: 2121014 - RNA, 16 nt, Human
accgggcacucagaag

SEQ ID NO: 2121015 - RNA, 20 nt, Human
accgggccacagagaaagua

SEQ ID NO: 2121016 - RNA, 14 nt, Human
accgggcacucaga

SEQ ID NO: 2121017 - RNA, 12 nt, Human
accgggcacuca

SEQ ID NO: 2121018 - RNA, 11 nt, Human
accucagccuc

SEQ ID NO: 2121019 - RNA, 12 nt, Human
accucagccucc

SEQ ID NO: 2121020 - RNA, 22 nt, Human
accggggagcccccgccccgcc

SEQ ID NO: 2121021 - RNA, 21 nt, Human
accgggcugggagcucugcag

SEQ ID NO: 2121022 - RNA, 23 nt, Human
accgggcugggagcucugcagag

SEQ ID NO: 2121023 - RNA, 11 nt, Human
accuccacagc

SEQ ID NO: 2121024 - RNA, 12 nt, Human
accuccacagcu

SEQ ID NO: 2121025 - RNA, 13 nt, Human
accuccacagcuu

SEQ ID NO: 2121026 - RNA, 19 nt, Human
accuccaaaagcccugagu

SEQ ID NO: 2121027 - RNA, 14 nt, Human
accuccacagcuuc

SEQ ID NO: 2121028 - RNA, 22 nt, Human
acccuagucccuuccccucccu

SEQ ID NO: 2121029 - RNA, 13 nt, Human
acccuauugcugc

SEQ ID NO: 2121030 - RNA, 17 nt, Human
acccuauauguaguaua

SEQ ID NO: 2121031 - RNA, 11 nt, Human
acccucagagc

SEQ ID NO: 2121032 - RNA, 14 nt, Human
acccuauugcugcu

SEQ ID NO: 2121033 - RNA, 19 nt, Human
acccuauugcugcuugagg

SEQ ID NO: 2121034 - RNA, 22 nt, Human
acccuaaggucauuaccacagg

SEQ ID NO: 2121035 - RNA, 14 nt, Human
acccuaccccacca

SEQ ID NO: 2121036 - RNA, 15 nt, Human
acccuaccccaccac

SEQ ID NO: 2121037 - RNA, 19 nt, Human
acccuaaaaagcagagcuu

SEQ ID NO: 2121038 - RNA, 14 nt, Human
acccguuuuaugau

SEQ ID NO: 2121039 - RNA, 21 nt, Human
acccguuuuaugauuuacuca

SEQ ID NO: 2121040 - RNA, 22 nt, Human
acccguuuuaugauuuacucau

SEQ ID NO: 2121041 - RNA, 15 nt, Human
acccuaaaucugagg

SEQ ID NO: 2121042 - RNA, 16 nt, Human
acccuaaaucugagga

SEQ ID NO: 2121043 - RNA, 23 nt, Human
acccuggcacuauaauguaagcu

SEQ ID NO: 2121044 - RNA, 13 nt, Human
acccuggagccca

SEQ ID NO: 2121045 - RNA, 15 nt, Human
acccucaucugucug

SEQ ID NO: 2121046 - RNA, 16 nt, Human
acccucaucugucugg

SEQ ID NO: 2121047 - RNA, 16 nt, Human
acccuggaucaguccu

SEQ ID NO: 2121048 - RNA, 18 nt, Human
acccucauacacagaaac

SEQ ID NO: 2121049 - RNA, 18 nt, Human
acccucagagccaccccu

SEQ ID NO: 2121050 - RNA, 20 nt, Human
acccucagaugcacaugagc

SEQ ID NO: 2121051 - RNA, 13 nt, Human
acccucaggcagg

SEQ ID NO: 2121052 - RNA, 14 nt, Human
acccucaggcaggu

SEQ ID NO: 2121053 - RNA, 19 nt, Human
acccucaggcauaggccug

SEQ ID NO: 2121054 - RNA, 20 nt, Human
acccucaggcauaggccugg

SEQ ID NO: 2121055 - RNA, 22 nt, Human
acccucaggcauaggccugggu

SEQ ID NO: 2121056 - RNA, 23 nt, Human
acccucaggcauaggccugggug

SEQ ID NO: 2121057 - RNA, 15 nt, Human
acccucaggcaggug

SEQ ID NO: 2121058 - RNA, 16 nt, Human
acccucaggcaggugg

SEQ ID NO: 2121059 - RNA, 16 nt, Human
acccuggggagaaagu

SEQ ID NO: 2121060 - RNA, 21 nt, Human
acccugucucuuaaagaaaaa

SEQ ID NO: 2121061 - RNA, 11 nt, Human
acccugucucu

SEQ ID NO: 2121062 - RNA, 19 nt, Human
acccuguccaaacugccua

SEQ ID NO: 2121063 - RNA, 20 nt, Human
acccuggugaggaagcucca

SEQ ID NO: 2121064 - RNA, 18 nt, Human
acaguggaaccagcccag

SEQ ID NO: 2121065 - RNA, 18 nt, Human
acaguggaauauaaggaa

SEQ ID NO: 2121066 - RNA, 17 nt, Human
acaguggauugcauuuc

SEQ ID NO: 2121067 - RNA, 14 nt, Human
acagugcuucagcc

SEQ ID NO: 2121068 - RNA, 15 nt, Human
acagugcuucagccu

SEQ ID NO: 2121069 - RNA, 17 nt, Human
acagugcuucagccuga

SEQ ID NO: 2121070 - RNA, 18 nt, Human
acagugcuucagccugag

SEQ ID NO: 2121071 - RNA, 20 nt, Human
acagugcuucagccugaggc

SEQ ID NO: 2121072 - RNA, 21 nt, Human
acagugcuucagccugaggcu

SEQ ID NO: 2121073 - RNA, 22 nt, Human
acagugcuucagccugaggcug

SEQ ID NO: 2121074 - RNA, 20 nt, Human
acagugcugaccagacagcc

SEQ ID NO: 2121075 - RNA, 24 nt, Human
acagugaugcugugcuaugaauuu

SEQ ID NO: 2121076 - RNA, 15 nt, Human
acagugccauugucu

SEQ ID NO: 2121077 - RNA, 16 nt, Human
acagugccauugucuu

SEQ ID NO: 2121078 - RNA, 17 nt, Human
acagugccauugucuuu

SEQ ID NO: 2121079 - RNA, 18 nt, Human
acagugccauugucuuua

SEQ ID NO: 2121080 - RNA, 11 nt, Human
acagugccugc

SEQ ID NO: 2121081 - RNA, 22 nt, Human
acagugaucuccauauguuaca

SEQ ID NO: 2121082 - RNA, 13 nt, Human
acagugccugcug

SEQ ID NO: 2121083 - RNA, 14 nt, Human
acagugccugcuga

SEQ ID NO: 2121084 - RNA, 14 nt, Human
acagugccugggaa

SEQ ID NO: 2121085 - RNA, 18 nt, Human
acagugccugggaaugua

SEQ ID NO: 2121086 - RNA, 20 nt, Human
acagugccugggaauguauu

SEQ ID NO: 2121087 - RNA, 21 nt, Human
acagugccugggaauguauua

SEQ ID NO: 2121088 - RNA, 14 nt, Human
acagugaucuccau

SEQ ID NO: 2121089 - RNA, 12 nt, Human
acaggcagaaag

SEQ ID NO: 2121090 - RNA, 13 nt, Human
acaggcagaaaga

SEQ ID NO: 2121091 - RNA, 14 nt, Human
acaggcagaaagag

SEQ ID NO: 2121092 - RNA, 15 nt, Human
acaggcagaaagagu

SEQ ID NO: 2121093 - RNA, 23 nt, Human
acaggcacccaccaucaugucug

SEQ ID NO: 2121094 - RNA, 14 nt, Human
acaggcaccgagaa

SEQ ID NO: 2121095 - RNA, 17 nt, Human
acaggcaccgagaaugu

SEQ ID NO: 2121096 - RNA, 20 nt, Human
acaggcaccgagaauguugu

SEQ ID NO: 2121097 - RNA, 21 nt, Human
acaggcaccgagaauguugua

SEQ ID NO: 2121098 - RNA, 18 nt, Human
acagugcaucucagccca

SEQ ID NO: 2121099 - RNA, 17 nt, Human
acagugcaucucagccc

SEQ ID NO: 2121100 - RNA, 15 nt, Human
acagugcaucucagc

SEQ ID NO: 2121101 - RNA, 15 nt, Human
acagugaucuccaua

SEQ ID NO: 2121102 - RNA, 18 nt, Human
acagugaucuccauaugu

SEQ ID NO: 2121103 - RNA, 19 nt, Human
acagugaucuccauauguu

SEQ ID NO: 2121104 - RNA, 21 nt, Human
acagugaucuccauauguuac

SEQ ID NO: 2121105 - RNA, 13 nt, Human
acagugcaucuca

SEQ ID NO: 2121106 - RNA, 15 nt, Human
acagugggagccagg

SEQ ID NO: 2121107 - RNA, 14 nt, Human
acagugggagccag

SEQ ID NO: 2121108 - RNA, 13 nt, Human
acagugggagcca

SEQ ID NO: 2121109 - RNA, 17 nt, Human
acagugggagccagggc

SEQ ID NO: 2121110 - RNA, 16 nt, Human
acagugggagccaggg

SEQ ID NO: 2121111 - RNA, 17 nt, Human
acaggcaaugcuggcug

SEQ ID NO: 2121112 - RNA, 14 nt, Human
acaggcacccacca

SEQ ID NO: 2121113 - RNA, 16 nt, Human
acaggcaaugcuggcu

SEQ ID NO: 2121114 - RNA, 15 nt, Human
acaggcaaugcuggc

SEQ ID NO: 2121115 - RNA, 15 nt, Human
acaggauuagacagu

SEQ ID NO: 2121116 - RNA, 20 nt, Human
acagcucuucuccaggcugu

SEQ ID NO: 2121117 - RNA, 19 nt, Human
acagcucuucuccaggcug

SEQ ID NO: 2121118 - RNA, 19 nt, Human
acauguuuuucuucucccu

SEQ ID NO: 2121119 - RNA, 20 nt, Human
acaugcagcccaugcccacc

SEQ ID NO: 2121120 - RNA, 18 nt, Human
acaugcagcccaugccca

SEQ ID NO: 2121121 - RNA, 15 nt, Human
acaugcagcccaugc

SEQ ID NO: 2121122 - RNA, 17 nt, Human
acaugcagcccaugccc

SEQ ID NO: 2121123 - RNA, 21 nt, Human
acaugccugccccaaacaaau

SEQ ID NO: 2121124 - RNA, 15 nt, Human
acaugccugccccaa

SEQ ID NO: 2121125 - RNA, 22 nt, Human
acaugccugccccaaacaaaua

SEQ ID NO: 2121126 - RNA, 14 nt, Human
acaugcgggcuggg

SEQ ID NO: 2121127 - RNA, 16 nt, Human
acaugcgggcugggca

SEQ ID NO: 2121128 - RNA, 17 nt, Human
acaugcgggcugggcag

SEQ ID NO: 2121129 - RNA, 19 nt, Human
acaugcgggcugggcagcu

SEQ ID NO: 2121130 - RNA, 21 nt, Human
acaugcgggcugggcagcugu

SEQ ID NO: 2121131 - RNA, 22 nt, Human
acaugcgggcugggcagcuguu

SEQ ID NO: 2121132 - RNA, 15 nt, Human
acauguggugggaca

SEQ ID NO: 2121133 - RNA, 23 nt, Human
acauguggugggacagggaccca

SEQ ID NO: 2121134 - RNA, 13 nt, Human
acaugugucaagc

SEQ ID NO: 2121135 - RNA, 19 nt, Human
acaugugucaagcugcuug

SEQ ID NO: 2121136 - RNA, 20 nt, Human
acaugugucaagcugcuugg

SEQ ID NO: 2121137 - RNA, 16 nt, Human
acaugugugcgugugc

SEQ ID NO: 2121138 - RNA, 18 nt, Human
acauguggaaagugaauu

SEQ ID NO: 2121139 - RNA, 19 nt, Human
acauguggaaagugaauuu

SEQ ID NO: 2121140 - RNA, 13 nt, Human
acaugcacgugug

SEQ ID NO: 2121141 - RNA, 15 nt, Human
acaucccugccagcu

SEQ ID NO: 2121142 - RNA, 23 nt, Human
acaucccuacaaaaaauuagaaa

SEQ ID NO: 2121143 - RNA, 16 nt, Human
acaucccugccagcuc

SEQ ID NO: 2121144 - RNA, 17 nt, Human
acaucccugccagcucu

SEQ ID NO: 2121145 - RNA, 14 nt, Human
acauccccacccuu

SEQ ID NO: 2121146 - RNA, 16 nt, Human
acauccccgcuggcug

SEQ ID NO: 2121147 - RNA, 17 nt, Human
acauccccgcuggcugg

SEQ ID NO: 2121148 - RNA, 19 nt, Human
acauccccgcuggcugggg

SEQ ID NO: 2121149 - RNA, 16 nt, Human
acaucccauugcccug

SEQ ID NO: 2121150 - RNA, 17 nt, Human
acaucccauugcccugg

SEQ ID NO: 2121151 - RNA, 18 nt, Human
acaucccauugcccuggu

SEQ ID NO: 2121152 - RNA, 13 nt, Human
acauccaagcuuc

SEQ ID NO: 2121153 - RNA, 16 nt, Human
acauacaauuccaaac

SEQ ID NO: 2121154 - RNA, 20 nt, Human
acauacaggaagguagaaau

SEQ ID NO: 2121155 - RNA, 15 nt, Human
acauaagauaaaugu

SEQ ID NO: 2121156 - RNA, 13 nt, Human
acauaacagaaug

SEQ ID NO: 2121157 - RNA, 15 nt, Human
acauaacagaaugca

SEQ ID NO: 2121158 - RNA, 18 nt, Human
acauaacagaaugcacca

SEQ ID NO: 2121159 - RNA, 16 nt, Human
acauaacaggguaaau

SEQ ID NO: 2121160 - RNA, 20 nt, Human
acauaacaggguaaauuauu

SEQ ID NO: 2121161 - RNA, 22 nt, Human
acauaacaggguaaauuauuca

SEQ ID NO: 2121162 - RNA, 14 nt, Human
acauaacaaaauca

SEQ ID NO: 2121163 - RNA, 17 nt, Human
acauaacaaaaucacuu

SEQ ID NO: 2121164 - RNA, 22 nt, Human
acauaacaaaaucacuuccaua

SEQ ID NO: 2121165 - RNA, 14 nt, Human
acauaacaaauaac

SEQ ID NO: 2121166 - RNA, 16 nt, Human
acauaaccacugcuuc

SEQ ID NO: 2121167 - RNA, 16 nt, Human
acauuugagucccuuc

SEQ ID NO: 2121168 - RNA, 19 nt, Human
acauuugagucccuuccag

SEQ ID NO: 2121169 - RNA, 16 nt, Human
accacgcuggaccuug

SEQ ID NO: 2121170 - RNA, 14 nt, Human
accacgcuggaccu

SEQ ID NO: 2121171 - RNA, 18 nt, Human
accacgcuggaccuugaa

SEQ ID NO: 2121172 - RNA, 20 nt, Human
accaccccagcugcuccccu

SEQ ID NO: 2121173 - RNA, 22 nt, Human
accaccccagcugcuccccucc

SEQ ID NO: 2121174 - RNA, 14 nt, Human
accacguccagcug

SEQ ID NO: 2121175 - RNA, 17 nt, Human
accacgucugucuucac

SEQ ID NO: 2121176 - RNA, 18 nt, Human
accacgcuugacaggaca

SEQ ID NO: 2121177 - RNA, 20 nt, Human
accacgcuugacaggacagc

SEQ ID NO: 2121178 - RNA, 14 nt, Human
accacggaaaagag

SEQ ID NO: 2121179 - RNA, 18 nt, Human
accacggaaaagagcgca

SEQ ID NO: 2121180 - RNA, 18 nt, Human
accaagccguggcuuccc

SEQ ID NO: 2121181 - RNA, 17 nt, Human
accaagccguggcuucc

SEQ ID NO: 2121182 - RNA, 16 nt, Human
accaagccguggcuuc

SEQ ID NO: 2121183 - RNA, 15 nt, Human
accaagccguggcuu

SEQ ID NO: 2121184 - RNA, 14 nt, Human
accaagccguggcu

SEQ ID NO: 2121185 - RNA, 19 nt, Human
accaaccugaagacaccgu

SEQ ID NO: 2121186 - RNA, 13 nt, Human
accaaccugacca

SEQ ID NO: 2121187 - RNA, 13 nt, Human
accaccaggucuc

SEQ ID NO: 2121188 - RNA, 14 nt, Human
accaccaggucucc

SEQ ID NO: 2121189 - RNA, 17 nt, Human
accaccaggucucccgg

SEQ ID NO: 2121190 - RNA, 16 nt, Human
accaacccuucccuga

SEQ ID NO: 2121191 - RNA, 19 nt, Human
accaccccagcugcucccc

SEQ ID NO: 2121192 - RNA, 18 nt, Human
accacgucugucuucaca

SEQ ID NO: 2121193 - RNA, 22 nt, Human
aauuggauacgacaacuugcac

SEQ ID NO: 2121194 - RNA, 14 nt, Human
aauucuuaaaauau

SEQ ID NO: 2121195 - RNA, 14 nt, Human
aauucuguuuuucu

SEQ ID NO: 2121196 - RNA, 18 nt, Human
aauucuguuuuucuaggc

SEQ ID NO: 2121197 - RNA, 13 nt, Human
aauuggcauuaaa

SEQ ID NO: 2121198 - RNA, 16 nt, Human
aauuggcauuaaaacu

SEQ ID NO: 2121199 - RNA, 17 nt, Human
aauuggcauuaaaacuu

SEQ ID NO: 2121200 - RNA, 16 nt, Human
aauucuguuucuugag

SEQ ID NO: 2121201 - RNA, 16 nt, Human
aauucuguucauuugu

SEQ ID NO: 2121202 - RNA, 17 nt, Human
aauucuguucauuuguu

SEQ ID NO: 2121203 - RNA, 18 nt, Human
aauucuguucauuuguua

SEQ ID NO: 2121204 - RNA, 22 nt, Human
aauucuguucauuuguuauucu

SEQ ID NO: 2121205 - RNA, 12 nt, Human
aauucuguuucu

SEQ ID NO: 2121206 - RNA, 13 nt, Human
aauucuguuucuu

SEQ ID NO: 2121207 - RNA, 19 nt, Human
aauucugcuaccucacugg

SEQ ID NO: 2121208 - RNA, 15 nt, Human
aauucugcuaccuca

SEQ ID NO: 2121209 - RNA, 16 nt, Human
aauucugcuaccucac

SEQ ID NO: 2121210 - RNA, 22 nt, Human
aauucuagcuuugagcuuaaga

SEQ ID NO: 2121211 - RNA, 15 nt, Human
aauucuacauuguca

SEQ ID NO: 2121212 - RNA, 14 nt, Human
aauucuacuuugag

SEQ ID NO: 2121213 - RNA, 14 nt, Human
aauucuaacuuuuu

SEQ ID NO: 2121214 - RNA, 22 nt, Human
aauucuaaccagagcaagcuuu

SEQ ID NO: 2121215 - RNA, 15 nt, Human
aauucuaaucuaaca

SEQ ID NO: 2121216 - RNA, 22 nt, Human
aauucuaaucuaacaauggaag

SEQ ID NO: 2121217 - RNA, 18 nt, Human
aauucuaaauaaaauaua

SEQ ID NO: 2121218 - RNA, 20 nt, Human
aauucuaaauaaaauauaau

SEQ ID NO: 2121219 - RNA, 22 nt, Human
aauucuaaauaaaauauaauug

SEQ ID NO: 2121220 - RNA, 19 nt, Human
aauucucagaaucucaaau

SEQ ID NO: 2121221 - RNA, 23 nt, Human
aauucuaggcaucccaggggacc

SEQ ID NO: 2121222 - RNA, 21 nt, Human
aauucucauuugucacacacu

SEQ ID NO: 2121223 - RNA, 15 nt, Human
aauucucuuauccaa

SEQ ID NO: 2121224 - RNA, 19 nt, Human
aauuaugaguuauuuuuau

SEQ ID NO: 2121225 - RNA, 12 nt, Human
aauuaucuauuu

SEQ ID NO: 2121226 - RNA, 13 nt, Human
aauuaucuauuug

SEQ ID NO: 2121227 - RNA, 14 nt, Human
aauuaucuauuugu

SEQ ID NO: 2121228 - RNA, 16 nt, Human
aauuaucuauuuguau

SEQ ID NO: 2121229 - RNA, 19 nt, Human
aauuaucuauuuguauaua

SEQ ID NO: 2121230 - RNA, 23 nt, Human
aauuaucuauuuguauauauaca

SEQ ID NO: 2121231 - RNA, 20 nt, Human
aauuaucgggaacaguguuu

SEQ ID NO: 2121232 - RNA, 23 nt, Human
aauuaucgggaacaguguuuccc

SEQ ID NO: 2121233 - RNA, 19 nt, Human
aauuaucaagcuaauaaaa

SEQ ID NO: 2121234 - RNA, 15 nt, Human
aauuaucccuuuucu

SEQ ID NO: 2121235 - RNA, 16 nt, Human
aauuaucccuuuucuu

SEQ ID NO: 2121236 - RNA, 21 nt, Human
aauuaucccuuuucuugacua

SEQ ID NO: 2121237 - RNA, 15 nt, Human
aauuauccagaguuu

SEQ ID NO: 2121238 - RNA, 15 nt, Human
aauuaucggaagcag

SEQ ID NO: 2121239 - RNA, 17 nt, Human
aauuaucggaagcagug

SEQ ID NO: 2121240 - RNA, 20 nt, Human
aauuaucggaagcagugccu

SEQ ID NO: 2121241 - RNA, 21 nt, Human
aauuaucggaagcagugccuu

SEQ ID NO: 2121242 - RNA, 17 nt, Human
aauuaucgggaacagug

SEQ ID NO: 2121243 - RNA, 19 nt, Human
aauuaucgggaacaguguu

SEQ ID NO: 2121244 - RNA, 13 nt, Human
aauuaugacaguu

SEQ ID NO: 2121245 - RNA, 12 nt, Human
aauuaugacagu

SEQ ID NO: 2121246 - RNA, 15 nt, Human
aauuaugacaguuau

SEQ ID NO: 2121247 - RNA, 11 nt, Human
aauuccugggc

SEQ ID NO: 2121248 - RNA, 18 nt, Human
aauucgcugcaaccuguu

SEQ ID NO: 2121249 - RNA, 19 nt, Human
aauuccuuuucuaacucuc

SEQ ID NO: 2121250 - RNA, 13 nt, Human
aauuccuuagcuu

SEQ ID NO: 2121251 - RNA, 23 nt, Human
aauuccuuagcuuagaccucagc

SEQ ID NO: 2121252 - RNA, 21 nt, Human
aauuccuuggcaugccuucca

SEQ ID NO: 2121253 - RNA, 20 nt, Human
aauuauacuggagaagucuu

SEQ ID NO: 2121254 - RNA, 22 nt, Human
aauuauaucaguccucuuucaa

SEQ ID NO: 2121255 - RNA, 15 nt, Human
aauuaucaagcuaau

SEQ ID NO: 2121256 - RNA, 16 nt, Human
aauuaucaagcuaaua

SEQ ID NO: 2121257 - RNA, 21 nt, Human
aauuuccacucaggucuguuu

SEQ ID NO: 2121258 - RNA, 15 nt, Human
aauuucauuuauuuu

SEQ ID NO: 2121259 - RNA, 21 nt, Human
aauuuccacaaaaucugucca

SEQ ID NO: 2121260 - RNA, 15 nt, Human
aauuuccaguaccuu

SEQ ID NO: 2121261 - RNA, 17 nt, Human
aauuuccaguaccuuug

SEQ ID NO: 2121262 - RNA, 20 nt, Human
aauuuccaguaccuuuguca

SEQ ID NO: 2121263 - RNA, 24 nt, Human
aauuuccagugagcuuaucaugcu

SEQ ID NO: 2121264 - RNA, 19 nt, Human
aauuucccaauuaggaagu

SEQ ID NO: 2121265 - RNA, 18 nt, Human
aauuguaggggugugugu

SEQ ID NO: 2121266 - RNA, 19 nt, Human
acacgccuuguucuuggcc

SEQ ID NO: 2121267 - RNA, 20 nt, Human
acacguggaggaaugcuccc

SEQ ID NO: 2121268 - RNA, 21 nt, Human
acacguggaggaaugcucccc

SEQ ID NO: 2121269 - RNA, 22 nt, Human
acacguggaggaaugcuccccc

SEQ ID NO: 2121270 - RNA, 24 nt, Human
acacguggaggaaugcucccccau

SEQ ID NO: 2121271 - RNA, 23 nt, Human
acacguacuuaaaugaaagcaug

SEQ ID NO: 2121272 - RNA, 14 nt, Human
acacguccacccca

SEQ ID NO: 2121273 - RNA, 17 nt, Human
acacgucugacccucuc

SEQ ID NO: 2121274 - RNA, 19 nt, Human
acacgucugacccucucca

SEQ ID NO: 2121275 - RNA, 17 nt, Human
acacguggaggaaugcu

SEQ ID NO: 2121276 - RNA, 13 nt, Human
acaccagagccca

SEQ ID NO: 2121277 - RNA, 23 nt, Human
acaccagagcccaccuuggcuca

SEQ ID NO: 2121278 - RNA, 18 nt, Human
acaccagagcccaccuug

SEQ ID NO: 2121279 - RNA, 18 nt, Human
acacagcucuucuccagg

SEQ ID NO: 2121280 - RNA, 16 nt, Human
acacagcucuucucca

SEQ ID NO: 2121281 - RNA, 14 nt, Human
acacagcucuucuc

SEQ ID NO: 2121282 - RNA, 14 nt, Human
acacagcaugugua

SEQ ID NO: 2121283 - RNA, 15 nt, Human
acacagcauguguau

SEQ ID NO: 2121284 - RNA, 19 nt, Human
acacacuuuuuaagaaaua

SEQ ID NO: 2121285 - RNA, 14 nt, Human
acacacuuuuuaag

SEQ ID NO: 2121286 - RNA, 14 nt, Human
acaaggugggcagg

SEQ ID NO: 2121287 - RNA, 15 nt, Human
acaaggugggcaggg

SEQ ID NO: 2121288 - RNA, 22 nt, Human
acaagguucuucccuuuuacau

SEQ ID NO: 2121289 - RNA, 13 nt, Human
acaagguucuucc

SEQ ID NO: 2121290 - RNA, 18 nt, Human
acaaggguggcaucccag

SEQ ID NO: 2121291 - RNA, 22 nt, Human
acaagguagcccuggccagagg

SEQ ID NO: 2121292 - RNA, 14 nt, Human
acaagguaguuuuu

SEQ ID NO: 2121293 - RNA, 19 nt, Human
acaagggucuagggagaga

SEQ ID NO: 2121294 - RNA, 20 nt, Human
acaagggucuagggagagac

SEQ ID NO: 2121295 - RNA, 16 nt, Human
acaagguaguuuuuac

SEQ ID NO: 2121296 - RNA, 16 nt, Human
acaagggcaguggagg

SEQ ID NO: 2121297 - RNA, 21 nt, Human
acaagggcaguggaggugcug

SEQ ID NO: 2121298 - RNA, 17 nt, Human
acaagggucuagggaga

SEQ ID NO: 2121299 - RNA, 18 nt, Human
acaagggucuagggagag

SEQ ID NO: 2121300 - RNA, 15 nt, Human
acaaguuaaauaaau

SEQ ID NO: 2121301 - RNA, 11 nt, Human
acaacccaucu

SEQ ID NO: 2121302 - RNA, 14 nt, Human
acaacuuaaaaagu

SEQ ID NO: 2121303 - RNA, 15 nt, Human
acaacuuaaaaaguc

SEQ ID NO: 2121304 - RNA, 16 nt, Human
acaacuuaaaaagucu

SEQ ID NO: 2121305 - RNA, 14 nt, Human
acaacuuaaauaau

SEQ ID NO: 2121306 - RNA, 15 nt, Human
acaacuuaaauaaua

SEQ ID NO: 2121307 - RNA, 10 nt, Human
acaaacugca

SEQ ID NO: 2121308 - RNA, 11 nt, Human
acaaacugcaa

SEQ ID NO: 2121309 - RNA, 13 nt, Human
acaaacugcaaua

SEQ ID NO: 2121310 - RNA, 14 nt, Human
acaaacugcaauag

SEQ ID NO: 2121311 - RNA, 16 nt, Human
acaaacugcaauagag

SEQ ID NO: 2121312 - RNA, 19 nt, Human
acaaacugcaauagagacu

SEQ ID NO: 2121313 - RNA, 20 nt, Human
acaaacugcaauagagacug

SEQ ID NO: 2121314 - RNA, 15 nt, Human
acaaccaccgcuccc

SEQ ID NO: 2121315 - RNA, 19 nt, Human
acaaccaccgcuccccagc

SEQ ID NO: 2121316 - RNA, 20 nt, Human
acaaccaccgcuccccagcc

SEQ ID NO: 2121317 - RNA, 17 nt, Human
acaaccacucauucaaa

SEQ ID NO: 2121318 - RNA, 22 nt, Human
acaacauguauaauauuuuuaa

SEQ ID NO: 2121319 - RNA, 15 nt, Human
acaaacuguguaacu

SEQ ID NO: 2121320 - RNA, 16 nt, Human
acaaacuguguaacug

SEQ ID NO: 2121321 - RNA, 16 nt, Human
acaacauuaaaacaau

SEQ ID NO: 2121322 - RNA, 21 nt, Human
acaaacaaccccccaucacaa

SEQ ID NO: 2121323 - RNA, 13 nt, Human
acaaacaaacaag

SEQ ID NO: 2121324 - RNA, 14 nt, Human
acaaacaaacaagc

SEQ ID NO: 2121325 - RNA, 18 nt, Human
acaaacaagcuaggugcu

SEQ ID NO: 2121326 - RNA, 18 nt, Human
acaaacaauuaacugagc

SEQ ID NO: 2121327 - RNA, 19 nt, Human
acaaacauauuuguuaaau

SEQ ID NO: 2121328 - RNA, 22 nt, Human
acaaacauauuuguuaaauauu

SEQ ID NO: 2121329 - RNA, 19 nt, Human
acaaacaugugguuaaugc

SEQ ID NO: 2121330 - RNA, 19 nt, Human
agugauucuccugccucag

SEQ ID NO: 2121331 - RNA, 18 nt, Human
agugauucuccugccuca

SEQ ID NO: 2121332 - RNA, 20 nt, Human
agugauucuccugccucagc

SEQ ID NO: 2121333 - RNA, 18 nt, Human
agugcgauguuucaggag

SEQ ID NO: 2121334 - RNA, 16 nt, Human
agugccuuccauaauu

SEQ ID NO: 2121335 - RNA, 13 nt, Human
agugccuuccaua

SEQ ID NO: 2121336 - RNA, 15 nt, Human
agugccuuccauaau

SEQ ID NO: 2121337 - RNA, 16 nt, Human
agugauguaccaugaa

SEQ ID NO: 2121338 - RNA, 13 nt, Human
agugauggucaga

SEQ ID NO: 2121339 - RNA, 18 nt, Human
agugauuaaggucucucu

SEQ ID NO: 2121340 - RNA, 19 nt, Human
agugauuaaggucucucuu

SEQ ID NO: 2121341 - RNA, 21 nt, Human
agugauuaaggucucucuuug

SEQ ID NO: 2121342 - RNA, 22 nt, Human
agugauuaaggucucucuuugg

SEQ ID NO: 2121343 - RNA, 23 nt, Human
agugauuaaggucucucuuugga

SEQ ID NO: 2121344 - RNA, 23 nt, Human
agugauccucccaccucagccuc

SEQ ID NO: 2121345 - RNA, 22 nt, Human
agugauccucccaccucagccu

SEQ ID NO: 2121346 - RNA, 20 nt, Human
agugauccucccaccucagc

SEQ ID NO: 2121347 - RNA, 19 nt, Human
agugauccucccaccucag

SEQ ID NO: 2121348 - RNA, 14 nt, Human
agugacagaggcag

SEQ ID NO: 2121349 - RNA, 23 nt, Human
agugaaucuaaaagcuuuugcuu

SEQ ID NO: 2121350 - RNA, 19 nt, Human
agugacagaggcagcccca

SEQ ID NO: 2121351 - RNA, 16 nt, Human
agugacagaggcagcc

SEQ ID NO: 2121352 - RNA, 19 nt, Human
agugacagaguucacuaua

SEQ ID NO: 2121353 - RNA, 13 nt, Human
agugacagaguaa

SEQ ID NO: 2121354 - RNA, 15 nt, Human
agugacagaguucac

SEQ ID NO: 2121355 - RNA, 22 nt, Human
agucauuugcgcacaacuuaaa

SEQ ID NO: 2121356 - RNA, 21 nt, Human
agucauuuuaacuuuaucaca

SEQ ID NO: 2121357 - RNA, 19 nt, Human
agucauuuuaacuuuauca

SEQ ID NO: 2121358 - RNA, 15 nt, Human
aguccucguagccau

SEQ ID NO: 2121359 - RNA, 17 nt, Human
aguccucguagccaucu

SEQ ID NO: 2121360 - RNA, 21 nt, Human
aguccucguagccaucucucu

SEQ ID NO: 2121361 - RNA, 14 nt, Human
aguccucuuuucug

SEQ ID NO: 2121362 - RNA, 20 nt, Human
agucugguuucuagacuugu

SEQ ID NO: 2121363 - RNA, 15 nt, Human
agucugguuucuaga

SEQ ID NO: 2121364 - RNA, 17 nt, Human
agucugucucaaaagaa

SEQ ID NO: 2121365 - RNA, 18 nt, Human
agucuggcccuuccuuuu

SEQ ID NO: 2121366 - RNA, 17 nt, Human
agucuggaucugggacc

SEQ ID NO: 2121367 - RNA, 13 nt, Human
agucuggaggggc

SEQ ID NO: 2121368 - RNA, 15 nt, Human
agucuggaucuggga

SEQ ID NO: 2121369 - RNA, 22 nt, Human
agucuggaggggcauggccagc

SEQ ID NO: 2121370 - RNA, 16 nt, Human
agucgaggacagggag

SEQ ID NO: 2121371 - RNA, 18 nt, Human
aguccuugcaagaaucag

SEQ ID NO: 2121372 - RNA, 20 nt, Human
agucugauucccaagcucug

SEQ ID NO: 2121373 - RNA, 22 nt, Human
agucugauucccaagcucugcu

SEQ ID NO: 2121374 - RNA, 21 nt, Human
agucugauucccaagcucugc

SEQ ID NO: 2121375 - RNA, 15 nt, Human
aguaucaggccugcc

SEQ ID NO: 2121376 - RNA, 18 nt, Human
aguauauuuucuuuuccu

SEQ ID NO: 2121377 - RNA, 19 nt, Human
aguauauuuucuuuuccuc

SEQ ID NO: 2121378 - RNA, 13 nt, Human
aguaaagaaauga

SEQ ID NO: 2121379 - RNA, 15 nt, Human
aguaaagaaaugaca

SEQ ID NO: 2121380 - RNA, 12 nt, Human
aguaaagaaauu

SEQ ID NO: 2121381 - RNA, 16 nt, Human
aguaaacuaaugaguu

SEQ ID NO: 2121382 - RNA, 19 nt, Human
aguaaacuaaugaguuucu

SEQ ID NO: 2121383 - RNA, 14 nt, Human
aguaaacuauuuau

SEQ ID NO: 2121384 - RNA, 16 nt, Human
aguaaacuauuuaucu

SEQ ID NO: 2121385 - RNA, 14 nt, Human
aguaaacugcccug

SEQ ID NO: 2121386 - RNA, 13 nt, Human
aguaaagagaaac

SEQ ID NO: 2121387 - RNA, 14 nt, Human
aguaaagagaaacu

SEQ ID NO: 2121388 - RNA, 15 nt, Human
aguaaagagaaacuu

SEQ ID NO: 2121389 - RNA, 18 nt, Human
aguaaagagaaacuuugu

SEQ ID NO: 2121390 - RNA, 22 nt, Human
aguaaagagaaacuuugugcua

SEQ ID NO: 2121391 - RNA, 13 nt, Human
aguaaagaaauuu

SEQ ID NO: 2121392 - RNA, 20 nt, Human
aguaaagaaauuuaaaagac

SEQ ID NO: 2121393 - RNA, 18 nt, Human
aguaaagugauaauuucu

SEQ ID NO: 2121394 - RNA, 19 nt, Human
aguaaagugauaauuucug

SEQ ID NO: 2121395 - RNA, 15 nt, Human
aguaaaguguaacau

SEQ ID NO: 2121396 - RNA, 21 nt, Human
aguaaaguguaacauaugcaa

SEQ ID NO: 2121397 - RNA, 22 nt, Human
aguaaaguguaacauaugcaaa

SEQ ID NO: 2121398 - RNA, 14 nt, Human
aguaaauauuucag

SEQ ID NO: 2121399 - RNA, 19 nt, Human
aguaacugccaucaagaug

SEQ ID NO: 2121400 - RNA, 14 nt, Human
aguaacugacaacu

SEQ ID NO: 2121401 - RNA, 15 nt, Human
aguaacuugguuaua

SEQ ID NO: 2121402 - RNA, 17 nt, Human
aguaacuugguuauaca

SEQ ID NO: 2121403 - RNA, 18 nt, Human
aguaacuugguuauacau

SEQ ID NO: 2121404 - RNA, 19 nt, Human
aguaacuugguuauacaug

SEQ ID NO: 2121405 - RNA, 20 nt, Human
aguaacuugguuauacauga

SEQ ID NO: 2121406 - RNA, 22 nt, Human
aguaacuugguuauacaugaca

SEQ ID NO: 2121407 - RNA, 15 nt, Human
aguaacuugucuuaa

SEQ ID NO: 2121408 - RNA, 20 nt, Human
aguaacuugucuuaaauaaa

SEQ ID NO: 2121409 - RNA, 23 nt, Human
aguaacuugucuuaaauaaaaga

SEQ ID NO: 2121410 - RNA, 17 nt, Human
aguaacuuacuuaggug

SEQ ID NO: 2121411 - RNA, 22 nt, Human
aguacuucuccacccugcucuc

SEQ ID NO: 2121412 - RNA, 21 nt, Human
aguacuucuccacccugcucu

SEQ ID NO: 2121413 - RNA, 19 nt, Human
aguacuucuccacccugcu

SEQ ID NO: 2121414 - RNA, 20 nt, Human
aguacuucuccacccugcuc

SEQ ID NO: 2121415 - RNA, 16 nt, Human
aguauauuuauauaau

SEQ ID NO: 2121416 - RNA, 17 nt, Human
aguauauuuauauaauu

SEQ ID NO: 2121417 - RNA, 18 nt, Human
aguauauuuauauaauua

SEQ ID NO: 2121418 - RNA, 19 nt, Human
aguauauuuauauaauuau

SEQ ID NO: 2121419 - RNA, 20 nt, Human
aguauauuuauauaauuaug

SEQ ID NO: 2121420 - RNA, 11 nt, Human
aguauauuuau

SEQ ID NO: 2121421 - RNA, 14 nt, Human
aguauauuuauagu

SEQ ID NO: 2121422 - RNA, 18 nt, Human
aguauauuuauagucaca

SEQ ID NO: 2121423 - RNA, 13 nt, Human
aguauauuuucuu

SEQ ID NO: 2121424 - RNA, 14 nt, Human
aguauauuaaaaau

SEQ ID NO: 2121425 - RNA, 15 nt, Human
aguauauuaaaaaug

SEQ ID NO: 2121426 - RNA, 16 nt, Human
aguauauuaaaaaugg

SEQ ID NO: 2121427 - RNA, 17 nt, Human
aguauauuaaaaauggu

SEQ ID NO: 2121428 - RNA, 19 nt, Human
aguauauuaaaaaugguaa

SEQ ID NO: 2121429 - RNA, 22 nt, Human
aguauauuaaaaaugguaaaau

SEQ ID NO: 2121430 - RNA, 13 nt, Human
aguaccuuugcuc

SEQ ID NO: 2121431 - RNA, 14 nt, Human
aguaccuuugcucu

SEQ ID NO: 2121432 - RNA, 16 nt, Human
aguaccuuugcucuug

SEQ ID NO: 2121433 - RNA, 17 nt, Human
aguaccuuugcucuugc

SEQ ID NO: 2121434 - RNA, 18 nt, Human
aguaccuuugcucuugca

SEQ ID NO: 2121435 - RNA, 21 nt, Human
aguaccuuugcucuugcagag

SEQ ID NO: 2121436 - RNA, 13 nt, Human
aguaccuuuguca

SEQ ID NO: 2121437 - RNA, 16 nt, Human
aguaccuucagauccu

SEQ ID NO: 2121438 - RNA, 20 nt, Human
aguaccuucagauccuaccc

SEQ ID NO: 2121439 - RNA, 14 nt, Human
aguaccuuugucac

SEQ ID NO: 2121440 - RNA, 15 nt, Human
aguaccuuugucaca

SEQ ID NO: 2121441 - RNA, 15 nt, Human
aguacuggcauggua

SEQ ID NO: 2121442 - RNA, 20 nt, Human
aguacuccugcaaaauuuua

SEQ ID NO: 2121443 - RNA, 21 nt, Human
aguacuccugcaaaauuuuau

SEQ ID NO: 2121444 - RNA, 15 nt, Human
aguacuccuuaagaa

SEQ ID NO: 2121445 - RNA, 17 nt, Human
aguacuccuuaagaaca

SEQ ID NO: 2121446 - RNA, 18 nt, Human
aguacuccuuaagaacac

SEQ ID NO: 2121447 - RNA, 19 nt, Human
aguacuccuuaagaacaca

SEQ ID NO: 2121448 - RNA, 18 nt, Human
aguacgugcuaacaggcu

SEQ ID NO: 2121449 - RNA, 16 nt, Human
aguacuccugcaaaau

SEQ ID NO: 2121450 - RNA, 18 nt, Human
aguacuccugcaaaauuu

SEQ ID NO: 2121451 - RNA, 19 nt, Human
aguacuccugcaaaauuuu

SEQ ID NO: 2121452 - RNA, 22 nt, Human
aggggccaaauauauucucuuu

SEQ ID NO: 2121453 - RNA, 23 nt, Human
aggggccaaauauauucucuuug

SEQ ID NO: 2121454 - RNA, 13 nt, Human
aguuacacauuuu

SEQ ID NO: 2121455 - RNA, 20 nt, Human
aguuacaaauugcuugaaag

SEQ ID NO: 2121456 - RNA, 16 nt, Human
aguuacacauuuuuca

SEQ ID NO: 2121457 - RNA, 19 nt, Human
aguuacacauuuuucagau

SEQ ID NO: 2121458 - RNA, 14 nt, Human
aguucauacccugu

SEQ ID NO: 2121459 - RNA, 16 nt, Human
aguucauccaauccuc

SEQ ID NO: 2121460 - RNA, 18 nt, Human
aguucauccaauccucac

SEQ ID NO: 2121461 - RNA, 20 nt, Human
aguucauccaauccucacug

SEQ ID NO: 2121462 - RNA, 22 nt, Human
aguucauccaauccucacuggg

SEQ ID NO: 2121463 - RNA, 20 nt, Human
aguucauagggucucuucag

SEQ ID NO: 2121464 - RNA, 17 nt, Human
aguugaaaaacagcuga

SEQ ID NO: 2121465 - RNA, 18 nt, Human
aguugaaaaacagcugag

SEQ ID NO: 2121466 - RNA, 19 nt, Human
aguuaacagacaacacguu

SEQ ID NO: 2121467 - RNA, 12 nt, Human
aguuaacagaga

SEQ ID NO: 2121468 - RNA, 23 nt, Human
aguuaaauagaguauaugcacuu

SEQ ID NO: 2121469 - RNA, 20 nt, Human
aguguuuuaagauaaauuau

SEQ ID NO: 2121470 - RNA, 12 nt, Human
aguguuuucaga

SEQ ID NO: 2121471 - RNA, 13 nt, Human
aguguuuucagag

SEQ ID NO: 2121472 - RNA, 14 nt, Human
aguguuuucagagc

SEQ ID NO: 2121473 - RNA, 15 nt, Human
aguggcauggcucca

SEQ ID NO: 2121474 - RNA, 18 nt, Human
aguggcauggcuccaguc

SEQ ID NO: 2121475 - RNA, 16 nt, Human
aguggcaugugcugug

SEQ ID NO: 2121476 - RNA, 16 nt, Human
aguggcccccacagaa

SEQ ID NO: 2121477 - RNA, 21 nt, Human
aguguuuggguauauucauuu

SEQ ID NO: 2121478 - RNA, 11 nt, Human
aguggccagac

SEQ ID NO: 2121479 - RNA, 14 nt, Human
aguggccagaccag

SEQ ID NO: 2121480 - RNA, 17 nt, Human
aguggccagaccagagc

SEQ ID NO: 2121481 - RNA, 19 nt, Human
aguggccagaccagagcuc

SEQ ID NO: 2121482 - RNA, 21 nt, Human
aguggccagaccagagcucug

SEQ ID NO: 2121483 - RNA, 22 nt, Human
aguggccagaccagagcucugg

SEQ ID NO: 2121484 - RNA, 23 nt, Human
aguggccagaccagagcucugga

SEQ ID NO: 2121485 - RNA, 13 nt, Human
aguuguuauuaca

SEQ ID NO: 2121486 - RNA, 19 nt, Human
aguuguuauuacauccuug

SEQ ID NO: 2121487 - RNA, 14 nt, Human
aguugaaucuauug

SEQ ID NO: 2121488 - RNA, 16 nt, Human
aguugaagcuaagauu

SEQ ID NO: 2121489 - RNA, 14 nt, Human
aguuugaggcugca

SEQ ID NO: 2121490 - RNA, 17 nt, Human
aguuugaggcugcagcg

SEQ ID NO: 2121491 - RNA, 13 nt, Human
aguuugccagaag

SEQ ID NO: 2121492 - RNA, 12 nt, Human
aguuugcccugg

SEQ ID NO: 2121493 - RNA, 21 nt, Human
aguuugcccugguuucacugg

SEQ ID NO: 2121494 - RNA, 22 nt, Human
aguuugcagaaaagcaccugcc

SEQ ID NO: 2121495 - RNA, 23 nt, Human
aguuugcagaaaagcaccugccg

SEQ ID NO: 2121496 - RNA, 11 nt, Human
aguuugcaguu

SEQ ID NO: 2121497 - RNA, 14 nt, Human
aguuugcagaaaag

SEQ ID NO: 2121498 - RNA, 20 nt, Human
aguuugcagaaaagcaccug

SEQ ID NO: 2121499 - RNA, 21 nt, Human
aguuugcagaaaagcaccugc

SEQ ID NO: 2121500 - RNA, 18 nt, Human
auaaaacaggucaauaca

SEQ ID NO: 2121501 - RNA, 16 nt, Human
auaaaacaggucaaua

SEQ ID NO: 2121502 - RNA, 12 nt, Human
auaaaaauggau

SEQ ID NO: 2121503 - RNA, 22 nt, Human
auaaaaaagcuggugggugaaa

SEQ ID NO: 2121504 - RNA, 14 nt, Human
auaaaaaagucucu

SEQ ID NO: 2121505 - RNA, 15 nt, Human
auaaaaaagucucua

SEQ ID NO: 2121506 - RNA, 16 nt, Human
auaaaaaagucucuau

SEQ ID NO: 2121507 - RNA, 18 nt, Human
auaaaaaagucucuauuu

SEQ ID NO: 2121508 - RNA, 14 nt, Human
auaaaaaauaauaa

SEQ ID NO: 2121509 - RNA, 20 nt, Human
auaaaaaauaauaauacaag

SEQ ID NO: 2121510 - RNA, 23 nt, Human
aguuugcuagcagaaaucuagaa

SEQ ID NO: 2121511 - RNA, 15 nt, Human
auaaaaaaaaugaaa

SEQ ID NO: 2121512 - RNA, 18 nt, Human
auaaaaaaaaugaaaugu

SEQ ID NO: 2121513 - RNA, 20 nt, Human
auaaaaaaaaugaaauguuu

SEQ ID NO: 2121514 - RNA, 13 nt, Human
auaaaaaauuuug

SEQ ID NO: 2121515 - RNA, 15 nt, Human
auaaaaaauuuugua

SEQ ID NO: 2121516 - RNA, 18 nt, Human
auaaaaaauuuuguaauu

SEQ ID NO: 2121517 - RNA, 19 nt, Human
auaaaaaauuuuguaauuu

SEQ ID NO: 2121518 - RNA, 21 nt, Human
auaaaaaauuuuguaauuuuc

SEQ ID NO: 2121519 - RNA, 17 nt, Human
auaaaaaccaagaagau

SEQ ID NO: 2121520 - RNA, 17 nt, Human
auaaugugggaagaaac

SEQ ID NO: 2121521 - RNA, 19 nt, Human
auaaugugggaagaaacaa

SEQ ID NO: 2121522 - RNA, 21 nt, Human
auaaugugggaagaaacaaac

SEQ ID NO: 2121523 - RNA, 13 nt, Human
auaaguacugugu

SEQ ID NO: 2121524 - RNA, 16 nt, Human
auaaguacuguguaca

SEQ ID NO: 2121525 - RNA, 18 nt, Human
auaaguacuguguacaga

SEQ ID NO: 2121526 - RNA, 18 nt, Human
auaauguugugguuuguu

SEQ ID NO: 2121527 - RNA, 15 nt, Human
auacaauucuacauu

SEQ ID NO: 2121528 - RNA, 12 nt, Human
auaauguuaaca

SEQ ID NO: 2121529 - RNA, 13 nt, Human
auaagcuuccagg

SEQ ID NO: 2121530 - RNA, 23 nt, Human
auaagcuuccaggcugcauagaa

SEQ ID NO: 2121531 - RNA, 17 nt, Human
auaagcuaaagaggcug

SEQ ID NO: 2121532 - RNA, 13 nt, Human
auaagcuaaagag

SEQ ID NO: 2121533 - RNA, 16 nt, Human
auaagcuaaagaggcu

SEQ ID NO: 2121534 - RNA, 14 nt, Human
auaaaagauacauu

SEQ ID NO: 2121535 - RNA, 15 nt, Human
auaaaagauacauuu

SEQ ID NO: 2121536 - RNA, 18 nt, Human
auaaaagauacauuugua

SEQ ID NO: 2121537 - RNA, 16 nt, Human
auaaaacaucuuucca

SEQ ID NO: 2121538 - RNA, 13 nt, Human
auaaagagaaaau

SEQ ID NO: 2121539 - RNA, 16 nt, Human
auaaagagaaaauuga

SEQ ID NO: 2121540 - RNA, 17 nt, Human
auaaagagaaaauugaa

SEQ ID NO: 2121541 - RNA, 18 nt, Human
auaaagagaaaauugaau

SEQ ID NO: 2121542 - RNA, 20 nt, Human
auaaagagaaaauugaauuu

SEQ ID NO: 2121543 - RNA, 21 nt, Human
auaaagagaaaauugaauuua

SEQ ID NO: 2121544 - RNA, 16 nt, Human
auaaagaccuauaaau

SEQ ID NO: 2121545 - RNA, 21 nt, Human
auacugucgguuuuuuuuaaa

SEQ ID NO: 2121546 - RNA, 19 nt, Human
auacuuuuuucuuauuuaa

SEQ ID NO: 2121547 - RNA, 16 nt, Human
auagcaacacucuaua

SEQ ID NO: 2121548 - RNA, 21 nt, Human
auagaaaacaggaaaaaaacu

SEQ ID NO: 2121549 - RNA, 22 nt, Human
auagaaaacaggaaaaaaacuu

SEQ ID NO: 2121550 - RNA, 23 nt, Human
auagaaaacaggaaaaaaacuuu

SEQ ID NO: 2121551 - RNA, 18 nt, Human
auacaccgggccuggaga

SEQ ID NO: 2121552 - RNA, 14 nt, Human
auacaccgggccug

SEQ ID NO: 2121553 - RNA, 19 nt, Human
auacaccagagauaauaug

SEQ ID NO: 2121554 - RNA, 22 nt, Human
auacacuauuugugagcaaagg

SEQ ID NO: 2121555 - RNA, 21 nt, Human
auacacuaugaagauguuuca

SEQ ID NO: 2121556 - RNA, 17 nt, Human
auacacgagguaugagg

SEQ ID NO: 2121557 - RNA, 21 nt, Human
auacacugaaguuaacagaga

SEQ ID NO: 2121558 - RNA, 16 nt, Human
auauuuuuuucuaaga

SEQ ID NO: 2121559 - RNA, 14 nt, Human
auauuuuuuuaagu

SEQ ID NO: 2121560 - RNA, 17 nt, Human
auauuuuuuuaagucuu

SEQ ID NO: 2121561 - RNA, 24 nt, Human
aucaaaagguuaauaaaguaauua

SEQ ID NO: 2121562 - RNA, 22 nt, Human
aucaaacccggcgguccccucc

SEQ ID NO: 2121563 - RNA, 20 nt, Human
aucaaaagguuaauaaagua

SEQ ID NO: 2121564 - RNA, 17 nt, Human
aucaaacugaagccaga

SEQ ID NO: 2121565 - RNA, 19 nt, Human
aucaaagagguuuuaaaaa

SEQ ID NO: 2121566 - RNA, 14 nt, Human
aucaaacugaagcc

SEQ ID NO: 2121567 - RNA, 15 nt, Human
aucaaacugaagcca

SEQ ID NO: 2121568 - RNA, 16 nt, Human
aucaaacugaagccag

SEQ ID NO: 2121569 - RNA, 19 nt, Human
auagcaagacacaucccua

SEQ ID NO: 2121570 - RNA, 15 nt, Human
auagcaacaugcuuc

SEQ ID NO: 2121571 - RNA, 17 nt, Human
auagcaagauugcuuaa

SEQ ID NO: 2121572 - RNA, 13 nt, Human
auagcaagugaau

SEQ ID NO: 2121573 - RNA, 19 nt, Human
auagcaagugaauuuuucu

SEQ ID NO: 2121574 - RNA, 22 nt, Human
auagcaagugaauuuuucucua

SEQ ID NO: 2121575 - RNA, 22 nt, Human
auagcaauccauguuaguuuuu

SEQ ID NO: 2121576 - RNA, 15 nt, Human
aucauccuaagcuau

SEQ ID NO: 2121577 - RNA, 15 nt, Human
aucauggaaauauua

SEQ ID NO: 2121578 - RNA, 19 nt, Human
aucauggaaauauuaugca

SEQ ID NO: 2121579 - RNA, 22 nt, Human
aucaugcauuguugaggugguc

SEQ ID NO: 2121580 - RNA, 12 nt, Human
aucaugcauugu

SEQ ID NO: 2121581 - RNA, 13 nt, Human
aucaugcauuguu

SEQ ID NO: 2121582 - RNA, 14 nt, Human
aucaugcauuguug

SEQ ID NO: 2121583 - RNA, 21 nt, Human
aucaugcauuguugagguggu

SEQ ID NO: 2121584 - RNA, 22 nt, Human
aucaugcaucuuacugaaggua

SEQ ID NO: 2121585 - RNA, 19 nt, Human
aucaugcaaaugcuguauu

SEQ ID NO: 2121586 - RNA, 15 nt, Human
aucaugagauugaug

SEQ ID NO: 2121587 - RNA, 17 nt, Human
aucaugagauugaugca

SEQ ID NO: 2121588 - RNA, 20 nt, Human
aucaugacacucguauaagc

SEQ ID NO: 2121589 - RNA, 21 nt, Human
auccacugugccaugugccag

SEQ ID NO: 2121590 - RNA, 22 nt, Human
auccacucuacccucccacccc

SEQ ID NO: 2121591 - RNA, 23 nt, Human
auccacucuacccucccaccccc

SEQ ID NO: 2121592 - RNA, 19 nt, Human
auccagccggaggccagag

SEQ ID NO: 2121593 - RNA, 20 nt, Human
auccagauacacccaaagua

SEQ ID NO: 2121594 - RNA, 18 nt, Human
auccuuuuucuuuauaaa

SEQ ID NO: 2121595 - RNA, 17 nt, Human
auccuuccucacaccag

SEQ ID NO: 2121596 - RNA, 12 nt, Human
auccuucuaauc

SEQ ID NO: 2121597 - RNA, 13 nt, Human
auccuucuaaucu

SEQ ID NO: 2121598 - RNA, 19 nt, Human
auccuucuaaucugcuaug

SEQ ID NO: 2121599 - RNA, 18 nt, Human
auccagggaugccaucug

SEQ ID NO: 2121600 - RNA, 14 nt, Human
auggcuucuaacaa

SEQ ID NO: 2121601 - RNA, 18 nt, Human
auggcuugccacagcucu

SEQ ID NO: 2121602 - RNA, 18 nt, Human
augggaaacuuccaagac

SEQ ID NO: 2121603 - RNA, 18 nt, Human
auggaguguguauuguuc

SEQ ID NO: 2121604 - RNA, 21 nt, Human
auggaguguguauuguuccca

SEQ ID NO: 2121605 - RNA, 20 nt, Human
augggaaaugccuaagaaga

SEQ ID NO: 2121606 - RNA, 14 nt, Human
augggaagacauga

SEQ ID NO: 2121607 - RNA, 22 nt, Human
augcuuucugaacucgcuucuc

SEQ ID NO: 2121608 - RNA, 13 nt, Human
auggagagagggg

SEQ ID NO: 2121609 - RNA, 14 nt, Human
auggagagagggga

SEQ ID NO: 2121610 - RNA, 15 nt, Human
auggagagaggggaa

SEQ ID NO: 2121611 - RNA, 17 nt, Human
auggagagaggggaaua

SEQ ID NO: 2121612 - RNA, 18 nt, Human
augcucugcauguuacau

SEQ ID NO: 2121613 - RNA, 19 nt, Human
augcucugcauguuacaua

SEQ ID NO: 2121614 - RNA, 23 nt, Human
augcucugugcgaggguuacuau

SEQ ID NO: 2121615 - RNA, 12 nt, Human
augcauaacuga

SEQ ID NO: 2121616 - RNA, 19 nt, Human
augcauaacugacaaauca

SEQ ID NO: 2121617 - RNA, 20 nt, Human
augcauaacugacaaaucaa

SEQ ID NO: 2121618 - RNA, 22 nt, Human
augcauaacugacaaaucaagu

SEQ ID NO: 2121619 - RNA, 17 nt, Human
augcauacacucucaaa

SEQ ID NO: 2121620 - RNA, 14 nt, Human
augcauacauacac

SEQ ID NO: 2121621 - RNA, 17 nt, Human
augcauacauacacaua

SEQ ID NO: 2121622 - RNA, 23 nt, Human
augcauacauacacauauauaca

SEQ ID NO: 2121623 - RNA, 23 nt, Human
augcauccauuccucagggacag

SEQ ID NO: 2121624 - RNA, 14 nt, Human
augcauccauuccu

SEQ ID NO: 2121625 - RNA, 17 nt, Human
augcauccauuccucag

SEQ ID NO: 2121626 - RNA, 18 nt, Human
augcauccauuccucagg

SEQ ID NO: 2121627 - RNA, 22 nt, Human
augcauccauuccucagggaca

SEQ ID NO: 2121628 - RNA, 15 nt, Human
augcaucaauccugu

SEQ ID NO: 2121629 - RNA, 16 nt, Human
augcaucaauccugug

SEQ ID NO: 2121630 - RNA, 22 nt, Human
augcaucucacuggaugcaaag

SEQ ID NO: 2121631 - RNA, 21 nt, Human
augcauggcagcaggccuguu

SEQ ID NO: 2121632 - RNA, 21 nt, Human
augccugguggcagcugcggu

SEQ ID NO: 2121633 - RNA, 16 nt, Human
augccuguccagccug

SEQ ID NO: 2121634 - RNA, 18 nt, Human
augccugguggcagcugc

SEQ ID NO: 2121635 - RNA, 19 nt, Human
augccugguggcagcugcg

SEQ ID NO: 2121636 - RNA, 14 nt, Human
augccugguggcag

SEQ ID NO: 2121637 - RNA, 13 nt, Human
augccugguggca

SEQ ID NO: 2121638 - RNA, 12 nt, Human
augccugguggc

SEQ ID NO: 2121639 - RNA, 11 nt, Human
augccuggugg

SEQ ID NO: 2121640 - RNA, 22 nt, Human
augaauaauuucccaauuagga

SEQ ID NO: 2121641 - RNA, 21 nt, Human
augaauacagggcaugcauuu

SEQ ID NO: 2121642 - RNA, 17 nt, Human
augaauaaagacaccua

SEQ ID NO: 2121643 - RNA, 21 nt, Human
augaaguaacuugucuuaaau

SEQ ID NO: 2121644 - RNA, 15 nt, Human
augaauaauuuccca

SEQ ID NO: 2121645 - RNA, 15 nt, Human
augaagcuaccucaa

SEQ ID NO: 2121646 - RNA, 14 nt, Human
augaaagaaaggcc

SEQ ID NO: 2121647 - RNA, 17 nt, Human
augaagccacagcccag

SEQ ID NO: 2121648 - RNA, 23 nt, Human
augaagccacagcccaggccucc

SEQ ID NO: 2121649 - RNA, 23 nt, Human
augaagcauuuacuuuguguuca

SEQ ID NO: 2121650 - RNA, 14 nt, Human
augaagcuaccuca

SEQ ID NO: 2121651 - RNA, 12 nt, Human
augaagcccaag

SEQ ID NO: 2121652 - RNA, 15 nt, Human
augaagcccaaguga

SEQ ID NO: 2121653 - RNA, 17 nt, Human
augaagcccaagugaaa

SEQ ID NO: 2121654 - RNA, 16 nt, Human
augaagcccaauaaac

SEQ ID NO: 2121655 - RNA, 12 nt, Human
augaaagacugu

SEQ ID NO: 2121656 - RNA, 19 nt, Human
augagccucagcauccugg

SEQ ID NO: 2121657 - RNA, 21 nt, Human
augagccucagcauccuggca

SEQ ID NO: 2121658 - RNA, 11 nt, Human
augagccuggc

SEQ ID NO: 2121659 - RNA, 12 nt, Human
augagccuggca

SEQ ID NO: 2121660 - RNA, 17 nt, Human
augaccuucuaggaagc

SEQ ID NO: 2121661 - RNA, 18 nt, Human
augaccuucuaggaagcu

SEQ ID NO: 2121662 - RNA, 18 nt, Human
augagcuuuauguaauaa

SEQ ID NO: 2121663 - RNA, 20 nt, Human
augagcuuuauguaauaaug

SEQ ID NO: 2121664 - RNA, 22 nt, Human
augagcuuuauguaauaaugug

SEQ ID NO: 2121665 - RNA, 18 nt, Human
augaggccucaguggacu

SEQ ID NO: 2121666 - RNA, 15 nt, Human
agauauaaaagacug

SEQ ID NO: 2121667 - RNA, 21 nt, Human
agauaggcucugcacagaugg

SEQ ID NO: 2121668 - RNA, 22 nt, Human
agauaggcucugcacagaugga

SEQ ID NO: 2121669 - RNA, 23 nt, Human
agauaguuuugccagaacaguuu

SEQ ID NO: 2121670 - RNA, 12 nt, Human
agauaggccugu

SEQ ID NO: 2121671 - RNA, 18 nt, Human
agauaggccuucuuguga

SEQ ID NO: 2121672 - RNA, 13 nt, Human
agauaggcucugc

SEQ ID NO: 2121673 - RNA, 14 nt, Human
agauaggcucugca

SEQ ID NO: 2121674 - RNA, 16 nt, Human
agauaggcucugcaca

SEQ ID NO: 2121675 - RNA, 17 nt, Human
agauagaagaaaaaaga

SEQ ID NO: 2121676 - RNA, 21 nt, Human
agauagaagaaaaaagaaugu

SEQ ID NO: 2121677 - RNA, 13 nt, Human
agauagaagaacu

SEQ ID NO: 2121678 - RNA, 14 nt, Human
agauagaagaacug

SEQ ID NO: 2121679 - RNA, 15 nt, Human
agauagaagaacugc

SEQ ID NO: 2121680 - RNA, 16 nt, Human
agauagaagaacugca

SEQ ID NO: 2121681 - RNA, 17 nt, Human
agauagaagauguuugc

SEQ ID NO: 2121682 - RNA, 18 nt, Human
agaguggucuuucuggag

SEQ ID NO: 2121683 - RNA, 22 nt, Human
agagggucuggagaagcaguga

SEQ ID NO: 2121684 - RNA, 14 nt, Human
agagggugcugccc

SEQ ID NO: 2121685 - RNA, 23 nt, Human
agagggugcugccccaugaagcc

SEQ ID NO: 2121686 - RNA, 13 nt, Human
agaguggccuggc

SEQ ID NO: 2121687 - RNA, 14 nt, Human
agaguggccuggcc

SEQ ID NO: 2121688 - RNA, 15 nt, Human
agaguggccuggcca

SEQ ID NO: 2121689 - RNA, 16 nt, Human
agaguggccuggccag

SEQ ID NO: 2121690 - RNA, 18 nt, Human
agagggucuggagaagca

SEQ ID NO: 2121691 - RNA, 20 nt, Human
agagggucugaggaauccag

SEQ ID NO: 2121692 - RNA, 14 nt, Human
agaguggcuccucc

SEQ ID NO: 2121693 - RNA, 13 nt, Human
agaguggcuccuc

SEQ ID NO: 2121694 - RNA, 12 nt, Human
agaguggcuccu

SEQ ID NO: 2121695 - RNA, 17 nt, Human
agaguggccuggccagg

SEQ ID NO: 2121696 - RNA, 19 nt, Human
agaguggccuggccaggag

SEQ ID NO: 2121697 - RNA, 15 nt, Human
agaguggcuccuccc

SEQ ID NO: 2121698 - RNA, 22 nt, Human
agaguggccuggccaggagcuc

SEQ ID NO: 2121699 - RNA, 16 nt, Human
agaguggguuucacaa

SEQ ID NO: 2121700 - RNA, 17 nt, Human
agauaucuugaaaugaa

SEQ ID NO: 2121701 - RNA, 14 nt, Human
agauaucuuuuuau

SEQ ID NO: 2121702 - RNA, 17 nt, Human
agauaucuuuuuauuga

SEQ ID NO: 2121703 - RNA, 18 nt, Human
agauaucuuuuuauugau

SEQ ID NO: 2121704 - RNA, 22 nt, Human
agauaucuuuuuauugaugugc

SEQ ID NO: 2121705 - RNA, 24 nt, Human
agauaucuuuuuauugaugugcaa

SEQ ID NO: 2121706 - RNA, 15 nt, Human
agauaugaguuguuu

SEQ ID NO: 2121707 - RNA, 16 nt, Human
agauaugauauguaaa

SEQ ID NO: 2121708 - RNA, 17 nt, Human
agauaugauauguaaac

SEQ ID NO: 2121709 - RNA, 23 nt, Human
agaucucugcuuuggaaaucaca

SEQ ID NO: 2121710 - RNA, 18 nt, Human
agaucucugcuuuggaaa

SEQ ID NO: 2121711 - RNA, 14 nt, Human
agaucugcaccgcc

SEQ ID NO: 2121712 - RNA, 15 nt, Human
agaucugcaccgccg

SEQ ID NO: 2121713 - RNA, 19 nt, Human
agauucuacauauucuuua

SEQ ID NO: 2121714 - RNA, 20 nt, Human
agauggcugugccucugccu

SEQ ID NO: 2121715 - RNA, 19 nt, Human
agauggcugugccucugcc

SEQ ID NO: 2121716 - RNA, 18 nt, Human
agauggcugugccucugc

SEQ ID NO: 2121717 - RNA, 17 nt, Human
agauggcugugccucug

SEQ ID NO: 2121718 - RNA, 22 nt, Human
agauggcugugccucugccugu

SEQ ID NO: 2121719 - RNA, 21 nt, Human
agauggcugugccucugccug

SEQ ID NO: 2121720 - RNA, 19 nt, Human
agcaaauaaacuaggaaau

SEQ ID NO: 2121721 - RNA, 19 nt, Human
agcaaauucuguuuuucua

SEQ ID NO: 2121722 - RNA, 16 nt, Human
agcaaaucagaaacuu

SEQ ID NO: 2121723 - RNA, 20 nt, Human
agcaaaucagaaacuuguga

SEQ ID NO: 2121724 - RNA, 14 nt, Human
agcaaauuuauaau

SEQ ID NO: 2121725 - RNA, 15 nt, Human
agcaaauuuauaauu

SEQ ID NO: 2121726 - RNA, 16 nt, Human
agcaaauuuauaauuu

SEQ ID NO: 2121727 - RNA, 18 nt, Human
agcaaauuuauaauuuua

SEQ ID NO: 2121728 - RNA, 19 nt, Human
agcaaauuuauaauuuuaa

SEQ ID NO: 2121729 - RNA, 20 nt, Human
agcaaauuuauaauuuuaag

SEQ ID NO: 2121730 - RNA, 21 nt, Human
agauugcgccauugcacucca

SEQ ID NO: 2121731 - RNA, 19 nt, Human
agauugcaacaggcugggc

SEQ ID NO: 2121732 - RNA, 17 nt, Human
agauugcaacaggcugg

SEQ ID NO: 2121733 - RNA, 16 nt, Human
agauugcaccacugca

SEQ ID NO: 2121734 - RNA, 16 nt, Human
agauugcaacaggcug

SEQ ID NO: 2121735 - RNA, 18 nt, Human
agauugaguaagauuuac

SEQ ID NO: 2121736 - RNA, 22 nt, Human
agauugaguaagauuuacccag

SEQ ID NO: 2121737 - RNA, 14 nt, Human
agcaucucaugagu

SEQ ID NO: 2121738 - RNA, 13 nt, Human
agcaucuaaacuu

SEQ ID NO: 2121739 - RNA, 14 nt, Human
agcaucuaaacuuu

SEQ ID NO: 2121740 - RNA, 16 nt, Human
agcaucuaaacuuuaa

SEQ ID NO: 2121741 - RNA, 17 nt, Human
agcaucuaaacuuuaau

SEQ ID NO: 2121742 - RNA, 22 nt, Human
agcaucuaaacuuuaauaugua

SEQ ID NO: 2121743 - RNA, 13 nt, Human
agcaucggaggga

SEQ ID NO: 2121744 - RNA, 22 nt, Human
agccaaggugggcugagcccug

SEQ ID NO: 2121745 - RNA, 23 nt, Human
agccaaggugggcugagcccugg

SEQ ID NO: 2121746 - RNA, 13 nt, Human
agcccaccuuggc

SEQ ID NO: 2121747 - RNA, 23 nt, Human
agcccaccccucaacaccucugc

SEQ ID NO: 2121748 - RNA, 13 nt, Human
agcccaaagaagg

SEQ ID NO: 2121749 - RNA, 14 nt, Human
agcccaaagaagga

SEQ ID NO: 2121750 - RNA, 18 nt, Human
agcaucuucacuucuaaa

SEQ ID NO: 2121751 - RNA, 21 nt, Human
agccaacgacaaagccaaacu

SEQ ID NO: 2121752 - RNA, 15 nt, Human
agccaacuuuugcau

SEQ ID NO: 2121753 - RNA, 13 nt, Human
agcaucugcuaau

SEQ ID NO: 2121754 - RNA, 19 nt, Human
agcaucucuugaggccagg

SEQ ID NO: 2121755 - RNA, 22 nt, Human
agcaucucuugaggccaggagu

SEQ ID NO: 2121756 - RNA, 23 nt, Human
agcaucuccugaggaucagaaag

SEQ ID NO: 2121757 - RNA, 17 nt, Human
agcaucucuugaggcca

SEQ ID NO: 2121758 - RNA, 17 nt, Human
agccaaggguauccaag

SEQ ID NO: 2121759 - RNA, 18 nt, Human
agccaaggguucagagac

SEQ ID NO: 2121760 - RNA, 15 nt, Human
agccaagggccucuu

SEQ ID NO: 2121761 - RNA, 22 nt, Human
agccaaggguucagagacucag

SEQ ID NO: 2121762 - RNA, 19 nt, Human
agccaaggugggcugagcc

SEQ ID NO: 2121763 - RNA, 20 nt, Human
agccaaggugggcugagccc

SEQ ID NO: 2121764 - RNA, 16 nt, Human
agcagccuggacccug

SEQ ID NO: 2121765 - RNA, 16 nt, Human
agcacugagcaaagca

SEQ ID NO: 2121766 - RNA, 13 nt, Human
agcacucacaugc

SEQ ID NO: 2121767 - RNA, 14 nt, Human
agcacucacaugcu

SEQ ID NO: 2121768 - RNA, 21 nt, Human
agcacucacaugcuggacagg

SEQ ID NO: 2121769 - RNA, 19 nt, Human
agcacuccucccugaugua

SEQ ID NO: 2121770 - RNA, 20 nt, Human
agcacuccucccugauguac

SEQ ID NO: 2121771 - RNA, 11 nt, Human
agcagcuacca

SEQ ID NO: 2121772 - RNA, 17 nt, Human
agcagcuaucucucagu

SEQ ID NO: 2121773 - RNA, 19 nt, Human
agcagcuaucucucaguga

SEQ ID NO: 2121774 - RNA, 15 nt, Human
agcagcucaaaggca

SEQ ID NO: 2121775 - RNA, 16 nt, Human
agcagcucaaaggcac

SEQ ID NO: 2121776 - RNA, 19 nt, Human
agcagcucaaaggcacagu

SEQ ID NO: 2121777 - RNA, 12 nt, Human
agcagcucaggc

SEQ ID NO: 2121778 - RNA, 13 nt, Human
agcagcucaggca

SEQ ID NO: 2121779 - RNA, 14 nt, Human
agcagcucaggcac

SEQ ID NO: 2121780 - RNA, 20 nt, Human
agcagccuggacccugugga

SEQ ID NO: 2121781 - RNA, 13 nt, Human
agcagccuguggc

SEQ ID NO: 2121782 - RNA, 14 nt, Human
agcagccuguggca

SEQ ID NO: 2121783 - RNA, 19 nt, Human
agcaguggacaccaggagu

SEQ ID NO: 2121784 - RNA, 12 nt, Human
agcaguggacac

SEQ ID NO: 2121785 - RNA, 15 nt, Human
agcaguggacaccag

SEQ ID NO: 2121786 - RNA, 20 nt, Human
agcagcucaaaggcacagug

SEQ ID NO: 2121787 - RNA, 21 nt, Human
agcagcucaggcacacuucuu

SEQ ID NO: 2121788 - RNA, 23 nt, Human
agcagugccuuccauaauuauga

SEQ ID NO: 2121789 - RNA, 20 nt, Human
agcaauuuauacaauaucau

SEQ ID NO: 2121790 - RNA, 20 nt, Human
agcaauuccaugcuauaaaa

SEQ ID NO: 2121791 - RNA, 23 nt, Human
agcaauuccaugcuauaaaaacu

SEQ ID NO: 2121792 - RNA, 17 nt, Human
agcaauugcugcaucuu

SEQ ID NO: 2121793 - RNA, 18 nt, Human
agcaauugcugcaucuua

SEQ ID NO: 2121794 - RNA, 20 nt, Human
agcaauugcugcaucuuagu

SEQ ID NO: 2121795 - RNA, 16 nt, Human
agcaauugugugguca

SEQ ID NO: 2121796 - RNA, 23 nt, Human
agcaauuguguggucaguggcuc

SEQ ID NO: 2121797 - RNA, 19 nt, Human
agcacagagagggggccac

SEQ ID NO: 2121798 - RNA, 20 nt, Human
agcacagagagggggccacc

SEQ ID NO: 2121799 - RNA, 21 nt, Human
agcacagagagggggccaccu

SEQ ID NO: 2121800 - RNA, 23 nt, Human
agcacagagagggggccaccucc

SEQ ID NO: 2121801 - RNA, 16 nt, Human
agcacaaaagccucuc

SEQ ID NO: 2121802 - RNA, 12 nt, Human
agcacagagagg

SEQ ID NO: 2121803 - RNA, 21 nt, Human
agcaauuucgccguugaagag

SEQ ID NO: 2121804 - RNA, 22 nt, Human
agcaauuucgccguugaagagg

SEQ ID NO: 2121805 - RNA, 18 nt, Human
agaagaugaaugagcaaa

SEQ ID NO: 2121806 - RNA, 12 nt, Human
agaagaugaaaa

SEQ ID NO: 2121807 - RNA, 22 nt, Human
agaagaugaaaauggaaguggc

SEQ ID NO: 2121808 - RNA, 19 nt, Human
agaagauggcacuuauaac

SEQ ID NO: 2121809 - RNA, 16 nt, Human
agaagaugacuuccca

SEQ ID NO: 2121810 - RNA, 16 nt, Human
agaaggggaagcacuc

SEQ ID NO: 2121811 - RNA, 17 nt, Human
agaagucaacagugaaa

SEQ ID NO: 2121812 - RNA, 17 nt, Human
agaagucaaaguaaaac

SEQ ID NO: 2121813 - RNA, 15 nt, Human
agaaggggaagcacu

SEQ ID NO: 2121814 - RNA, 19 nt, Human
agaagggccaguccugccu

SEQ ID NO: 2121815 - RNA, 20 nt, Human
agaagggccaguccugccug

SEQ ID NO: 2121816 - RNA, 20 nt, Human
agaagucaugaagcccaagu

SEQ ID NO: 2121817 - RNA, 14 nt, Human
agaagucacacagu

SEQ ID NO: 2121818 - RNA, 15 nt, Human
agaagucuuagacuu

SEQ ID NO: 2121819 - RNA, 17 nt, Human
agaagucuuagauguau

SEQ ID NO: 2121820 - RNA, 19 nt, Human
agaagucuuagauguauau

SEQ ID NO: 2121821 - RNA, 18 nt, Human
agaaccaguuucaggugu

SEQ ID NO: 2121822 - RNA, 22 nt, Human
agaaccaucccuauuuuguauu

SEQ ID NO: 2121823 - RNA, 20 nt, Human
agaaccaggcaacuugggaa

SEQ ID NO: 2121824 - RNA, 13 nt, Human
agaaccacuauga

SEQ ID NO: 2121825 - RNA, 17 nt, Human
agaaccaggcaacuugg

SEQ ID NO: 2121826 - RNA, 17 nt, Human
agaacaccaagacuuga

SEQ ID NO: 2121827 - RNA, 22 nt, Human
agaagagaauauuagcuuuacu

SEQ ID NO: 2121828 - RNA, 13 nt, Human
agaaucugaaugu

SEQ ID NO: 2121829 - RNA, 18 nt, Human
agaaucugaauguaauuu

SEQ ID NO: 2121830 - RNA, 17 nt, Human
agaaucucaaauaacua

SEQ ID NO: 2121831 - RNA, 21 nt, Human
agaaucgaugggggaugcuuc

SEQ ID NO: 2121832 - RNA, 22 nt, Human
agaaucgaugggggaugcuuca

SEQ ID NO: 2121833 - RNA, 23 nt, Human
agaaucgaugggggaugcuucau

SEQ ID NO: 2121834 - RNA, 16 nt, Human
agaaugaaagggccca

SEQ ID NO: 2121835 - RNA, 13 nt, Human
agaaugaggagga

SEQ ID NO: 2121836 - RNA, 16 nt, Human
agaaugaggaggaagg

SEQ ID NO: 2121837 - RNA, 12 nt, Human
agaaucuuuccu

SEQ ID NO: 2121838 - RNA, 19 nt, Human
agaaucuuuccuuccucuc

SEQ ID NO: 2121839 - RNA, 14 nt, Human
agaaugaugcacau

SEQ ID NO: 2121840 - RNA, 19 nt, Human
agaaugaugcacauuucau

SEQ ID NO: 2121841 - RNA, 14 nt, Human
agaaugagugaauc

SEQ ID NO: 2121842 - RNA, 16 nt, Human
agaaugccauucucuu

SEQ ID NO: 2121843 - RNA, 18 nt, Human
agaaugcucuuuacuuca

SEQ ID NO: 2121844 - RNA, 17 nt, Human
agaaugaggaggaagga

SEQ ID NO: 2121845 - RNA, 16 nt, Human
agaaugagggccaaga

SEQ ID NO: 2121846 - RNA, 18 nt, Human
agaacagaucuccaaagc

SEQ ID NO: 2121847 - RNA, 19 nt, Human
agaacagaucuccaaagcu

SEQ ID NO: 2121848 - RNA, 20 nt, Human
agaacagaucuccaaagcuu

SEQ ID NO: 2121849 - RNA, 13 nt, Human
agaacagcaggcc

SEQ ID NO: 2121850 - RNA, 17 nt, Human
agaacagcaggcccacc

SEQ ID NO: 2121851 - RNA, 18 nt, Human
agaacagcaggcccaccu

SEQ ID NO: 2121852 - RNA, 19 nt, Human
agaacagcaggcccaccua

SEQ ID NO: 2121853 - RNA, 23 nt, Human
agaacagcaggguagucugguuu

SEQ ID NO: 2121854 - RNA, 13 nt, Human
agaacagcagagg

SEQ ID NO: 2121855 - RNA, 18 nt, Human
agaacagccgcuccuguc

SEQ ID NO: 2121856 - RNA, 19 nt, Human
agaacagccgcuccugucu

SEQ ID NO: 2121857 - RNA, 20 nt, Human
agaacagccgcuccugucug

SEQ ID NO: 2121858 - RNA, 18 nt, Human
agaacagcagagguucuu

SEQ ID NO: 2121859 - RNA, 22 nt, Human
agaacagccgcuccugucugcc

SEQ ID NO: 2121860 - RNA, 23 nt, Human
agaacagccgcuccugucugcca

SEQ ID NO: 2121861 - RNA, 11 nt, Human
agaacauagaa

SEQ ID NO: 2121862 - RNA, 17 nt, Human
agaacaguuuguacaga

SEQ ID NO: 2121863 - RNA, 17 nt, Human
agaacaguuaagcagcc

SEQ ID NO: 2121864 - RNA, 20 nt, Human
agaacaguuaagcagccgcc

SEQ ID NO: 2121865 - RNA, 21 nt, Human
agaacaguuaagcagccgcca

SEQ ID NO: 2121866 - RNA, 15 nt, Human
agaacaguuuguaca

SEQ ID NO: 2121867 - RNA, 14 nt, Human
agaacagugauuuu

SEQ ID NO: 2121868 - RNA, 18 nt, Human
agaacaucccugccagcu

SEQ ID NO: 2121869 - RNA, 19 nt, Human
agaacaucccugccagcuc

SEQ ID NO: 2121870 - RNA, 15 nt, Human
agaacauccaaggag

SEQ ID NO: 2121871 - RNA, 18 nt, Human
agaacauccaaggagaaa

SEQ ID NO: 2121872 - RNA, 16 nt, Human
agaacaucccugccag

SEQ ID NO: 2121873 - RNA, 17 nt, Human
agaacaucccugccagc

SEQ ID NO: 2121874 - RNA, 16 nt, Human
agaacauguugguauu

SEQ ID NO: 2121875 - RNA, 19 nt, Human
agaacauguugguauuuau

SEQ ID NO: 2121876 - RNA, 20 nt, Human
agaacauguugguauuuauc

SEQ ID NO: 2121877 - RNA, 21 nt, Human
agaacauguugguauuuaucu

SEQ ID NO: 2121878 - RNA, 22 nt, Human
agaacauguugguauuuaucua

SEQ ID NO: 2121879 - RNA, 18 nt, Human
agaacauugauugcugug

SEQ ID NO: 2121880 - RNA, 19 nt, Human
agaacauugauugcugugu

SEQ ID NO: 2121881 - RNA, 14 nt, Human
agaacacuauuuuc

SEQ ID NO: 2121882 - RNA, 16 nt, Human
agaacacuauuuucag

SEQ ID NO: 2121883 - RNA, 17 nt, Human
agaacacuauuuucaga

SEQ ID NO: 2121884 - RNA, 18 nt, Human
agaacacuauuuucagaa

SEQ ID NO: 2121885 - RNA, 19 nt, Human
agaacacuauuuucagaau

SEQ ID NO: 2121886 - RNA, 20 nt, Human
agaacacuauuuucagaauc

SEQ ID NO: 2121887 - RNA, 21 nt, Human
agaacacuauuuucagaaucu

SEQ ID NO: 2121888 - RNA, 22 nt, Human
agaacacuauuuucagaaucug

SEQ ID NO: 2121889 - RNA, 23 nt, Human
agaacacuauuuucagaaucuga

SEQ ID NO: 2121890 - RNA, 10 nt, Human
agaacagaaa

SEQ ID NO: 2121891 - RNA, 11 nt, Human
agaacagaaaa

SEQ ID NO: 2121892 - RNA, 12 nt, Human
agaacagaaaac

SEQ ID NO: 2121893 - RNA, 13 nt, Human
agaacagaaaaca

SEQ ID NO: 2121894 - RNA, 14 nt, Human
agaacagaaaacaa

SEQ ID NO: 2121895 - RNA, 15 nt, Human
agaacagaaaacaac

SEQ ID NO: 2121896 - RNA, 20 nt, Human
agaacagaaaacaacaaaaa

SEQ ID NO: 2121897 - RNA, 21 nt, Human
agaacagaaaacaacaaaaaa

SEQ ID NO: 2121898 - RNA, 22 nt, Human
agaacagaaaacaacaaaaaau

SEQ ID NO: 2121899 - RNA, 16 nt, Human
agaacagacuggccug

SEQ ID NO: 2121900 - RNA, 20 nt, Human
agaacagacuggccugagga

SEQ ID NO: 2121901 - RNA, 20 nt, Human
agaacacagcaauuccucag

SEQ ID NO: 2121902 - RNA, 17 nt, Human
agaacaagguaguuuuu

SEQ ID NO: 2121903 - RNA, 19 nt, Human
agaacaagguaguuuuuac

SEQ ID NO: 2121904 - RNA, 16 nt, Human
agaacacaaggucauu

SEQ ID NO: 2121905 - RNA, 15 nt, Human
agaacacaaagcggg

SEQ ID NO: 2121906 - RNA, 22 nt, Human
agaacacaaagcggggggaggg

SEQ ID NO: 2121907 - RNA, 21 nt, Human
agacugaccaauauuguacag

SEQ ID NO: 2121908 - RNA, 16 nt, Human
agagaaaauguaaaua

SEQ ID NO: 2121909 - RNA, 17 nt, Human
agagaaaauguaaauaa

SEQ ID NO: 2121910 - RNA, 13 nt, Human
agagaaaauugaa

SEQ ID NO: 2121911 - RNA, 14 nt, Human
agagaaaauugaau

SEQ ID NO: 2121912 - RNA, 16 nt, Human
agagaaaauugaauuu

SEQ ID NO: 2121913 - RNA, 21 nt, Human
agagaaaauugaauuuaacaa

SEQ ID NO: 2121914 - RNA, 12 nt, Human
agacugaccaau

SEQ ID NO: 2121915 - RNA, 16 nt, Human
agacugaacuguguga

SEQ ID NO: 2121916 - RNA, 15 nt, Human
agacucuuugcauau

SEQ ID NO: 2121917 - RNA, 15 nt, Human
agacugaacagccaa

SEQ ID NO: 2121918 - RNA, 17 nt, Human
agacugaacauguacac

SEQ ID NO: 2121919 - RNA, 17 nt, Human
agagaaaccguccucuu

SEQ ID NO: 2121920 - RNA, 20 nt, Human
agagaaaccguccucuuuuu

SEQ ID NO: 2121921 - RNA, 21 nt, Human
agagaaaccguccucuuuuuc

SEQ ID NO: 2121922 - RNA, 23 nt, Human
agagaaaccguccucuuuuucca

SEQ ID NO: 2121923 - RNA, 21 nt, Human
agagaaacucuauggguauca

SEQ ID NO: 2121924 - RNA, 19 nt, Human
agagaaacuuugugcuaca

SEQ ID NO: 2121925 - RNA, 14 nt, Human
agagaagugccccu

SEQ ID NO: 2121926 - RNA, 15 nt, Human
agagaagugccccug

SEQ ID NO: 2121927 - RNA, 17 nt, Human
agagaagugccccugcu

SEQ ID NO: 2121928 - RNA, 18 nt, Human
agagaagugccccugcug

SEQ ID NO: 2121929 - RNA, 22 nt, Human
agagaauauuagcuuuacuguu

SEQ ID NO: 2121930 - RNA, 22 nt, Human
agagaaccucacgcaccuccca

SEQ ID NO: 2121931 - RNA, 23 nt, Human
agagaaccucacgcaccucccau

SEQ ID NO: 2121932 - RNA, 20 nt, Human
agagaaccucacgcaccucc

SEQ ID NO: 2121933 - RNA, 14 nt, Human
agagagauguuuug

SEQ ID NO: 2121934 - RNA, 13 nt, Human
agagaggagucag

SEQ ID NO: 2121935 - RNA, 20 nt, Human
agagaggagucagagagaau

SEQ ID NO: 2121936 - RNA, 13 nt, Human
agagccugcuccc

SEQ ID NO: 2121937 - RNA, 15 nt, Human
agagccugcuccccc

SEQ ID NO: 2121938 - RNA, 16 nt, Human
agagccugcuccccca

SEQ ID NO: 2121939 - RNA, 18 nt, Human
agagccugcucccccacc

SEQ ID NO: 2121940 - RNA, 15 nt, Human
agagccugcugcaug

SEQ ID NO: 2121941 - RNA, 19 nt, Human
agagccugcucccccaccc

SEQ ID NO: 2121942 - RNA, 20 nt, Human
agagccugcucccccacccc

SEQ ID NO: 2121943 - RNA, 12 nt, Human
agagccugcugc

SEQ ID NO: 2121944 - RNA, 21 nt, Human
agagcccagcagggccucaaa

SEQ ID NO: 2121945 - RNA, 14 nt, Human
agagcccagccauu

SEQ ID NO: 2121946 - RNA, 16 nt, Human
agacucuuuggacacu

SEQ ID NO: 2121947 - RNA, 14 nt, Human
agaauuuuuaaugu

SEQ ID NO: 2121948 - RNA, 19 nt, Human
agacaaaaaacuauaugua

SEQ ID NO: 2121949 - RNA, 16 nt, Human
agacaaaaacagccuc

SEQ ID NO: 2121950 - RNA, 15 nt, Human
agaauuuugagcagg

SEQ ID NO: 2121951 - RNA, 20 nt, Human
agaauuuucagaccccagcg

SEQ ID NO: 2121952 - RNA, 21 nt, Human
agaauuuucagaccccagcgg

SEQ ID NO: 2121953 - RNA, 17 nt, Human
agacaaaaacagccuca

SEQ ID NO: 2121954 - RNA, 14 nt, Human
agacaaaaauacuc

SEQ ID NO: 2121955 - RNA, 17 nt, Human
agacaaaaauacucuaa

SEQ ID NO: 2121956 - RNA, 22 nt, Human
agacaaaaauacucuaauucua

SEQ ID NO: 2121957 - RNA, 23 nt, Human
agacaaaaauacucuaauucuaa

SEQ ID NO: 2121958 - RNA, 12 nt, Human
agacaaaaauua

SEQ ID NO: 2121959 - RNA, 14 nt, Human
agacaaaaauuauc

SEQ ID NO: 2121960 - RNA, 21 nt, Human
agacaaaaauuaucuauuugu

SEQ ID NO: 2121961 - RNA, 22 nt, Human
agacaaaaacagccucacagaa

SEQ ID NO: 2121962 - RNA, 16 nt, Human
agacaagguagcccug

SEQ ID NO: 2121963 - RNA, 23 nt, Human
agacaagugacuguaucugugua

SEQ ID NO: 2121964 - RNA, 20 nt, Human
agacaagugacuguaucugu

SEQ ID NO: 2121965 - RNA, 22 nt, Human
agacaagugacuguaucugugu

SEQ ID NO: 2121966 - RNA, 20 nt, Human
agacaaugugaaaagaaaaa

SEQ ID NO: 2121967 - RNA, 16 nt, Human
agacaaugcagaugcc

SEQ ID NO: 2121968 - RNA, 17 nt, Human
agacaaugcagaugcca

SEQ ID NO: 2121969 - RNA, 22 nt, Human
agacaaugcagaugccagagca

SEQ ID NO: 2121970 - RNA, 21 nt, Human
agaccauccuggccaacauga

SEQ ID NO: 2121971 - RNA, 17 nt, Human
agacuauauuguacaca

SEQ ID NO: 2121972 - RNA, 12 nt, Human
agacuagagaaa

SEQ ID NO: 2121973 - RNA, 13 nt, Human
agacuagagaaac

SEQ ID NO: 2121974 - RNA, 14 nt, Human
agacuagagaaacc

SEQ ID NO: 2121975 - RNA, 15 nt, Human
agacuagagaaaccg

SEQ ID NO: 2121976 - RNA, 16 nt, Human
agacuagauugccuuu

SEQ ID NO: 2121977 - RNA, 19 nt, Human
agacuagauugccuuuguu

SEQ ID NO: 2121978 - RNA, 22 nt, Human
agacuaguuuuuauuccuugug

SEQ ID NO: 2121979 - RNA, 22 nt, Human
aggcaugugccacccacccaac

SEQ ID NO: 2121980 - RNA, 20 nt, Human
aggcaugagggaucacaggg

SEQ ID NO: 2121981 - RNA, 22 nt, Human
aggcaugagggaucacagggcc

SEQ ID NO: 2121982 - RNA, 13 nt, Human
aggcaugccugug

SEQ ID NO: 2121983 - RNA, 14 nt, Human
aggcaugccugugu

SEQ ID NO: 2121984 - RNA, 12 nt, Human
aggcauguucuc

SEQ ID NO: 2121985 - RNA, 14 nt, Human
aggcaucugcaccc

SEQ ID NO: 2121986 - RNA, 15 nt, Human
aggcaugagggauca

SEQ ID NO: 2121987 - RNA, 23 nt, Human
aggcaugagggaucacagggccc

SEQ ID NO: 2121988 - RNA, 19 nt, Human
aggcaucugugggcauggu

SEQ ID NO: 2121989 - RNA, 22 nt, Human
aggcauguucucugaggacacu

SEQ ID NO: 2121990 - RNA, 20 nt, Human
aggcauguucucugaggaca

SEQ ID NO: 2121991 - RNA, 15 nt, Human
aggcaugccugugug

SEQ ID NO: 2121992 - RNA, 16 nt, Human
aggcaugccuguguga

SEQ ID NO: 2121993 - RNA, 12 nt, Human
aggcauucaagu

SEQ ID NO: 2121994 - RNA, 13 nt, Human
aggcauucucuga

SEQ ID NO: 2121995 - RNA, 11 nt, Human
aggccaggcuc

SEQ ID NO: 2121996 - RNA, 12 nt, Human
aggccaggcucc

SEQ ID NO: 2121997 - RNA, 17 nt, Human
aggccaggcuccuuccu

SEQ ID NO: 2121998 - RNA, 22 nt, Human
aggccaggcuccuuccugucuu

SEQ ID NO: 2121999 - RNA, 17 nt, Human
aggccaugggccuccug

SEQ ID NO: 2122000 - RNA, 16 nt, Human
aggccaugggccuccu

SEQ ID NO: 2122001 - RNA, 14 nt, Human
aggccaugggccuc

SEQ ID NO: 2122002 - RNA, 13 nt, Human
aggcagauacagg

SEQ ID NO: 2122003 - RNA, 21 nt, Human
aggcagaagaauugaacccag

SEQ ID NO: 2122004 - RNA, 13 nt, Human
aggcagaaagagu

SEQ ID NO: 2122005 - RNA, 15 nt, Human
aggcagaagaauuga

SEQ ID NO: 2122006 - RNA, 16 nt, Human
aggcagaaagcagagg

SEQ ID NO: 2122007 - RNA, 17 nt, Human
aggcagaaagcagaggc

SEQ ID NO: 2122008 - RNA, 18 nt, Human
aggcagaaagcagaggcu

SEQ ID NO: 2122009 - RNA, 19 nt, Human
aggcagaaagcagaggcug

SEQ ID NO: 2122010 - RNA, 21 nt, Human
aggcagaaagcagaggcuggc

SEQ ID NO: 2122011 - RNA, 23 nt, Human
aggcagaaagcagaggcuggccu

SEQ ID NO: 2122012 - RNA, 14 nt, Human
aggcagaacccugg

SEQ ID NO: 2122013 - RNA, 22 nt, Human
aggcagaacccuggugaggaag

SEQ ID NO: 2122014 - RNA, 17 nt, Human
aggcagagugccccacc

SEQ ID NO: 2122015 - RNA, 19 nt, Human
aggcagagugccccaccug

SEQ ID NO: 2122016 - RNA, 20 nt, Human
aggcagagugccccaccugc

SEQ ID NO: 2122017 - RNA, 21 nt, Human
aggcagagugccccaccugcc

SEQ ID NO: 2122018 - RNA, 22 nt, Human
aggcagagugccccaccugcca

SEQ ID NO: 2122019 - RNA, 24 nt, Human
aggcagagugccccaccugccacu

SEQ ID NO: 2122020 - RNA, 17 nt, Human
aggaguucgaggcugca

SEQ ID NO: 2122021 - RNA, 22 nt, Human
aggaguucgagaccagccuggc

SEQ ID NO: 2122022 - RNA, 16 nt, Human
aggaguucgaggcugc

SEQ ID NO: 2122023 - RNA, 14 nt, Human
aggaguugcuguuu

SEQ ID NO: 2122024 - RNA, 21 nt, Human
aggaguugcuguuuguuugac

SEQ ID NO: 2122025 - RNA, 19 nt, Human
aggaguuuaagaccagccu

SEQ ID NO: 2122026 - RNA, 21 nt, Human
aggaguuuaagaccagccugg

SEQ ID NO: 2122027 - RNA, 20 nt, Human
aggaguuuccuaaaaguuca

SEQ ID NO: 2122028 - RNA, 12 nt, Human
aggauggagggg

SEQ ID NO: 2122029 - RNA, 19 nt, Human
aggauggaggggugguccu

SEQ ID NO: 2122030 - RNA, 23 nt, Human
aggaguucagggucauagcaugc

SEQ ID NO: 2122031 - RNA, 19 nt, Human
aggaguuccuaaccagccu

SEQ ID NO: 2122032 - RNA, 20 nt, Human
aggaguuccuugaucuguau

SEQ ID NO: 2122033 - RNA, 16 nt, Human
aggaguucgagaccag

SEQ ID NO: 2122034 - RNA, 21 nt, Human
aggaguucgagaccagccugg

SEQ ID NO: 2122035 - RNA, 14 nt, Human
aggagugagcacua

SEQ ID NO: 2122036 - RNA, 18 nt, Human
aggagguuuaggucaaga

SEQ ID NO: 2122037 - RNA, 12 nt, Human
aggagugagcac

SEQ ID NO: 2122038 - RNA, 20 nt, Human
aggagguggaggcugcagug

SEQ ID NO: 2122039 - RNA, 20 nt, Human
aggagguggagguugcagug

SEQ ID NO: 2122040 - RNA, 14 nt, Human
aggagguggcagcc

SEQ ID NO: 2122041 - RNA, 17 nt, Human
aggagguggcagcccug

SEQ ID NO: 2122042 - RNA, 18 nt, Human
aggagguggcagcccugu

SEQ ID NO: 2122043 - RNA, 20 nt, Human
aggagguggcagcccuguag

SEQ ID NO: 2122044 - RNA, 21 nt, Human
aggagguggcagcccuguagg

SEQ ID NO: 2122045 - RNA, 23 nt, Human
aggagguggcagcccuguaggga

SEQ ID NO: 2122046 - RNA, 16 nt, Human
aggagagcccuucauu

SEQ ID NO: 2122047 - RNA, 14 nt, Human
aggagacccacagg

SEQ ID NO: 2122048 - RNA, 17 nt, Human
aggagaccaaggcggga

SEQ ID NO: 2122049 - RNA, 21 nt, Human
aggagaccuggcacuggaugc

SEQ ID NO: 2122050 - RNA, 11 nt, Human
aggagacucac

SEQ ID NO: 2122051 - RNA, 13 nt, Human
aggagacucaccu

SEQ ID NO: 2122052 - RNA, 14 nt, Human
aggagacucaccuc

SEQ ID NO: 2122053 - RNA, 15 nt, Human
aggagacucaccucu

SEQ ID NO: 2122054 - RNA, 16 nt, Human
aggagacucaccucug

SEQ ID NO: 2122055 - RNA, 17 nt, Human
aggagacucaccucugc

SEQ ID NO: 2122056 - RNA, 18 nt, Human
aggagacucaccucugcc

SEQ ID NO: 2122057 - RNA, 19 nt, Human
aggagacucaccucugccu

SEQ ID NO: 2122058 - RNA, 21 nt, Human
aggagacucaccucugccuca

SEQ ID NO: 2122059 - RNA, 14 nt, Human
aggagaccaaggcg

SEQ ID NO: 2122060 - RNA, 18 nt, Human
aggaggguuagggagggg

SEQ ID NO: 2122061 - RNA, 20 nt, Human
aggagggcccuaccugauug

SEQ ID NO: 2122062 - RNA, 17 nt, Human
aggagggcgugacucac

SEQ ID NO: 2122063 - RNA, 22 nt, Human
aggagggcgugacucacccaag

SEQ ID NO: 2122064 - RNA, 19 nt, Human
aggagggaugcugccugag

SEQ ID NO: 2122065 - RNA, 15 nt, Human
aggagggagggggcu

SEQ ID NO: 2122066 - RNA, 16 nt, Human
aggagagccagcccuc

SEQ ID NO: 2122067 - RNA, 23 nt, Human
aggagggagguauucgugcagca

SEQ ID NO: 2122068 - RNA, 14 nt, Human
aggagagccagccc

SEQ ID NO: 2122069 - RNA, 15 nt, Human
aggagagccagcccu

SEQ ID NO: 2122070 - RNA, 12 nt, Human
aggagagccugc

SEQ ID NO: 2122071 - RNA, 13 nt, Human
aggagagccugcu

SEQ ID NO: 2122072 - RNA, 14 nt, Human
aggagagccugcug

SEQ ID NO: 2122073 - RNA, 15 nt, Human
aggagagccugcugc

SEQ ID NO: 2122074 - RNA, 16 nt, Human
aggagagccugcugca

SEQ ID NO: 2122075 - RNA, 18 nt, Human
aggagagccugcugcaug

SEQ ID NO: 2122076 - RNA, 20 nt, Human
aggagagccugcugcauggg

SEQ ID NO: 2122077 - RNA, 17 nt, Human
aggaugggaaggaggga

SEQ ID NO: 2122078 - RNA, 12 nt, Human
aggaugggaagg

SEQ ID NO: 2122079 - RNA, 18 nt, Human
aggauggcuuugaaugcg

SEQ ID NO: 2122080 - RNA, 22 nt, Human
aggaugggucugguuugcagag

SEQ ID NO: 2122081 - RNA, 19 nt, Human
aggaugucacucagaugga

SEQ ID NO: 2122082 - RNA, 20 nt, Human
aggauguggaaaccuccuuc

SEQ ID NO: 2122083 - RNA, 23 nt, Human
aggcuguaucccaugagccucag

SEQ ID NO: 2122084 - RNA, 14 nt, Human
aggcugaggcagaa

SEQ ID NO: 2122085 - RNA, 21 nt, Human
aggcugcagucagucaugaug

SEQ ID NO: 2122086 - RNA, 13 nt, Human
aggcugcauagaa

SEQ ID NO: 2122087 - RNA, 15 nt, Human
aggcugcauagaagg

SEQ ID NO: 2122088 - RNA, 16 nt, Human
aggcugcauagaagga

SEQ ID NO: 2122089 - RNA, 17 nt, Human
aggcugcauagaaggag

SEQ ID NO: 2122090 - RNA, 19 nt, Human
aggcugcauagaaggagga

SEQ ID NO: 2122091 - RNA, 23 nt, Human
aggcugcauagaaggaggagagg

SEQ ID NO: 2122092 - RNA, 17 nt, Human
aggcugcagugagccga

SEQ ID NO: 2122093 - RNA, 19 nt, Human
aggcugcagugagccgaga

SEQ ID NO: 2122094 - RNA, 17 nt, Human
aggcugccaaggccaga

SEQ ID NO: 2122095 - RNA, 24 nt, Human
aggcuguaucccaugagccucagc

SEQ ID NO: 2122096 - RNA, 13 nt, Human
agggacauauuca

SEQ ID NO: 2122097 - RNA, 14 nt, Human
agggacauguggaa

SEQ ID NO: 2122098 - RNA, 15 nt, Human
agggacauauucauu

SEQ ID NO: 2122099 - RNA, 23 nt, Human
agggacauauucauuuggaaaua

SEQ ID NO: 2122100 - RNA, 16 nt, Human
agggaccaacugggcc

SEQ ID NO: 2122101 - RNA, 17 nt, Human
agggaccaacugggccc

SEQ ID NO: 2122102 - RNA, 19 nt, Human
agggaccaacugggcccaa

SEQ ID NO: 2122103 - RNA, 14 nt, Human
agggaccaaggacc

SEQ ID NO: 2122104 - RNA, 18 nt, Human
agggaccaaggaccccuc

SEQ ID NO: 2122105 - RNA, 21 nt, Human
agggaccaaggaccccucacc

SEQ ID NO: 2122106 - RNA, 19 nt, Human
agggaccaaggaccccuca

SEQ ID NO: 2122107 - RNA, 16 nt, Human
aggcuguuuuugggug

SEQ ID NO: 2122108 - RNA, 17 nt, Human
aggcuguuuuugggugc

SEQ ID NO: 2122109 - RNA, 14 nt, Human
aggcuuacacccac

SEQ ID NO: 2122110 - RNA, 14 nt, Human
aggcugaggaaagg

SEQ ID NO: 2122111 - RNA, 13 nt, Human
aggcucuucuccu

SEQ ID NO: 2122112 - RNA, 11 nt, Human
aggcugaggac

SEQ ID NO: 2122113 - RNA, 15 nt, Human
aggcugaggaaaggc

SEQ ID NO: 2122114 - RNA, 18 nt, Human
aggcugaggaaaggccag

SEQ ID NO: 2122115 - RNA, 19 nt, Human
aggcugaggaaaggccagc

SEQ ID NO: 2122116 - RNA, 20 nt, Human
aggcugaggaaaggccagcu

SEQ ID NO: 2122117 - RNA, 13 nt, Human
aggcugaggacuu

SEQ ID NO: 2122118 - RNA, 18 nt, Human
aggcugaggcaagagaau

SEQ ID NO: 2122119 - RNA, 22 nt, Human
aggcugaggaaaggccagcugg

SEQ ID NO: 2122120 - RNA, 11 nt, Human
aggcugaggca

SEQ ID NO: 2122121 - RNA, 13 nt, Human
aggccaggggcuu

SEQ ID NO: 2122122 - RNA, 16 nt, Human
aggccaggggcuuuug

SEQ ID NO: 2122123 - RNA, 17 nt, Human
agggcgugacucaccca

SEQ ID NO: 2122124 - RNA, 19 nt, Human
agggcgugacucacccaag

SEQ ID NO: 2122125 - RNA, 13 nt, Human
agggcuaagagcu

SEQ ID NO: 2122126 - RNA, 19 nt, Human
agggcuacccucccccagg

SEQ ID NO: 2122127 - RNA, 14 nt, Human
agggcuaagagcua

SEQ ID NO: 2122128 - RNA, 21 nt, Human
agggcuaagagcuagcgcugc

SEQ ID NO: 2122129 - RNA, 22 nt, Human
agggcuaagagcuagcgcugcc

SEQ ID NO: 2122130 - RNA, 23 nt, Human
agggcuaagagcuagcgcugccg

SEQ ID NO: 2122131 - RNA, 18 nt, Human
aggggcauggccagcagc

SEQ ID NO: 2122132 - RNA, 21 nt, Human
aggggcaucugccccuccccc

SEQ ID NO: 2122133 - RNA, 22 nt, Human
aggggcaucugccccuccccca

SEQ ID NO: 2122134 - RNA, 17 nt, Human
aggggcaucugccccuc

SEQ ID NO: 2122135 - RNA, 19 nt, Human
aggggcaucugccccuccc

SEQ ID NO: 2122136 - RNA, 20 nt, Human
aggggcaucugccccucccc

SEQ ID NO: 2122137 - RNA, 19 nt, Human
agggauucaggcugcuugg

SEQ ID NO: 2122138 - RNA, 16 nt, Human
agggauucaggcugcu

SEQ ID NO: 2122139 - RNA, 18 nt, Human
agggauucaggcugcuug

SEQ ID NO: 2122140 - RNA, 18 nt, Human
agggauucacaucugcau

SEQ ID NO: 2122141 - RNA, 17 nt, Human
agggauggggccacagc

SEQ ID NO: 2122142 - RNA, 14 nt, Human
agggauucaggcug

SEQ ID NO: 2122143 - RNA, 15 nt, Human
agggauucaggcugc

SEQ ID NO: 2122144 - RNA, 19 nt, Human
agggaugaggugcugggag

SEQ ID NO: 2122145 - RNA, 23 nt, Human
agggaugaggugcugggagggau

SEQ ID NO: 2122146 - RNA, 18 nt, Human
agggaugccaucuguggg

SEQ ID NO: 2122147 - RNA, 15 nt, Human
agggauggaaaagga

SEQ ID NO: 2122148 - RNA, 22 nt, Human
agggauggaaaaggaagacuag

SEQ ID NO: 2122149 - RNA, 16 nt, Human
agggaugcugccugag

SEQ ID NO: 2122150 - RNA, 17 nt, Human
agggaugcugccugagu

SEQ ID NO: 2122151 - RNA, 18 nt, Human
agggaugcugccugaguc

SEQ ID NO: 2122152 - RNA, 19 nt, Human
agggaugcugccugaguca

SEQ ID NO: 2122153 - RNA, 16 nt, Human
agggaugaggugcugg

SEQ ID NO: 2122154 - RNA, 17 nt, Human
agggaugaggugcuggg

SEQ ID NO: 2122155 - RNA, 19 nt, Human
aggaaaaccaagccguggc

SEQ ID NO: 2122156 - RNA, 14 nt, Human
aggaaaaaaaugac

SEQ ID NO: 2122157 - RNA, 15 nt, Human
aggaaaaaaaugacu

SEQ ID NO: 2122158 - RNA, 18 nt, Human
agcuuuuuuacacaaaug

SEQ ID NO: 2122159 - RNA, 20 nt, Human
agcuuuuuuauuuuuuauac

SEQ ID NO: 2122160 - RNA, 22 nt, Human
agcuuuuuuauuuuuuauacag

SEQ ID NO: 2122161 - RNA, 13 nt, Human
aggaaaaaaacuu

SEQ ID NO: 2122162 - RNA, 14 nt, Human
aggaaaaaaacuuu

SEQ ID NO: 2122163 - RNA, 15 nt, Human
aggaaaaaaacuuuu

SEQ ID NO: 2122164 - RNA, 16 nt, Human
aggaaaaaaacuuuua

SEQ ID NO: 2122165 - RNA, 17 nt, Human
aggaaaaaaacuuuuau

SEQ ID NO: 2122166 - RNA, 21 nt, Human
aggaaaaaaacuuuuauaaau

SEQ ID NO: 2122167 - RNA, 17 nt, Human
agcuuuuugucuuuucu

SEQ ID NO: 2122168 - RNA, 19 nt, Human
agcuuuguuucaaccaagu

SEQ ID NO: 2122169 - RNA, 22 nt, Human
agcuuuguuuguugucagcuga

SEQ ID NO: 2122170 - RNA, 21 nt, Human
agcuuuguuuguugucagcug

SEQ ID NO: 2122171 - RNA, 15 nt, Human
aggaacacucugaau

SEQ ID NO: 2122172 - RNA, 13 nt, Human
aggaacagaagga

SEQ ID NO: 2122173 - RNA, 14 nt, Human
aggaacagaaggau

SEQ ID NO: 2122174 - RNA, 21 nt, Human
aggaacagaaggaugaaugag

SEQ ID NO: 2122175 - RNA, 21 nt, Human
aggaacagcuaugggagcccc

SEQ ID NO: 2122176 - RNA, 16 nt, Human
aggaacauaugaaaau

SEQ ID NO: 2122177 - RNA, 23 nt, Human
aggaacacccgacuccucaaaag

SEQ ID NO: 2122178 - RNA, 19 nt, Human
aggaacauaugaaaauaca

SEQ ID NO: 2122179 - RNA, 14 nt, Human
aggaagaaaaauca

SEQ ID NO: 2122180 - RNA, 16 nt, Human
aggaagaaaaaucagu

SEQ ID NO: 2122181 - RNA, 23 nt, Human
aggaaaaccaagccguggcuucc

SEQ ID NO: 2122182 - RNA, 22 nt, Human
aggaaaaccaagccguggcuuc

SEQ ID NO: 2122183 - RNA, 21 nt, Human
aggaaaaccaagccguggcuu

SEQ ID NO: 2122184 - RNA, 20 nt, Human
aggaaaaccaagccguggcu

SEQ ID NO: 2122185 - RNA, 14 nt, Human
aggaagguagaaau

SEQ ID NO: 2122186 - RNA, 16 nt, Human
agcugguuccugcuag

SEQ ID NO: 2122187 - RNA, 19 nt, Human
agcugguuccugcuagaaa

SEQ ID NO: 2122188 - RNA, 22 nt, Human
agcugguuccugcuagaaaugg

SEQ ID NO: 2122189 - RNA, 15 nt, Human
agcuggucccacuca

SEQ ID NO: 2122190 - RNA, 22 nt, Human
agcugguaguuaguagcauguu

SEQ ID NO: 2122191 - RNA, 19 nt, Human
agcugguaguuaguagcau

SEQ ID NO: 2122192 - RNA, 21 nt, Human
agcugguaguuaguagcaugu

SEQ ID NO: 2122193 - RNA, 14 nt, Human
agcuggguuggaaa

SEQ ID NO: 2122194 - RNA, 16 nt, Human
agcuggguuggaaaac

SEQ ID NO: 2122195 - RNA, 20 nt, Human
agcuggguuggaaaacagua

SEQ ID NO: 2122196 - RNA, 15 nt, Human
agcugguaguuagua

SEQ ID NO: 2122197 - RNA, 18 nt, Human
agcuggugucugauuguu

SEQ ID NO: 2122198 - RNA, 21 nt, Human
agcuggugguaucugaguuga

SEQ ID NO: 2122199 - RNA, 15 nt, Human
agcuggugggaagcg

SEQ ID NO: 2122200 - RNA, 13 nt, Human
agcuggugggaag

SEQ ID NO: 2122201 - RNA, 20 nt, Human
agcuggugggugaaagaaau

SEQ ID NO: 2122202 - RNA, 21 nt, Human
agcuggugggugaaagaaauc

SEQ ID NO: 2122203 - RNA, 23 nt, Human
agcuggugggugaaagaaaucau

SEQ ID NO: 2122204 - RNA, 22 nt, Human
agcugccuugagccuuaaaacc

SEQ ID NO: 2122205 - RNA, 15 nt, Human
agcugacuuuucugu

SEQ ID NO: 2122206 - RNA, 21 nt, Human
agcugacuuuucuguccgagc

SEQ ID NO: 2122207 - RNA, 15 nt, Human
agcugacgaggcugg

SEQ ID NO: 2122208 - RNA, 16 nt, Human
agcugacgaggcuggg

SEQ ID NO: 2122209 - RNA, 17 nt, Human
agcugacgaggcugggc

SEQ ID NO: 2122210 - RNA, 18 nt, Human
agcugacgaggcugggcc

SEQ ID NO: 2122211 - RNA, 19 nt, Human
agcugacgaggcugggcca

SEQ ID NO: 2122212 - RNA, 20 nt, Human
agcugacgaggcugggccaa

SEQ ID NO: 2122213 - RNA, 12 nt, Human
agcuccucuggg

SEQ ID NO: 2122214 - RNA, 14 nt, Human
agcuccucugggca

SEQ ID NO: 2122215 - RNA, 15 nt, Human
agcuccucugggcag

SEQ ID NO: 2122216 - RNA, 23 nt, Human
agcucaccagccccagugcccac

SEQ ID NO: 2122217 - RNA, 22 nt, Human
agcucaccagccccagugccca

SEQ ID NO: 2122218 - RNA, 21 nt, Human
agcucacaguuccucgcccug

SEQ ID NO: 2122219 - RNA, 23 nt, Human
agcucacaguuccucgcccuggg

SEQ ID NO: 2122220 - RNA, 18 nt, Human
agccuggcacagggcagu

SEQ ID NO: 2122221 - RNA, 17 nt, Human
agccuggcacagggcag

SEQ ID NO: 2122222 - RNA, 11 nt, Human
agccuggaggc

SEQ ID NO: 2122223 - RNA, 23 nt, Human
agccuggaggccgggugcucagg

SEQ ID NO: 2122224 - RNA, 20 nt, Human
agccuggcacagggcagugg

SEQ ID NO: 2122225 - RNA, 14 nt, Human
agccuggccaacau

SEQ ID NO: 2122226 - RNA, 14 nt, Human
agccugcuuuuuaa

SEQ ID NO: 2122227 - RNA, 14 nt, Human
agccuggacccugu

SEQ ID NO: 2122228 - RNA, 11 nt, Human
agccugcugca

SEQ ID NO: 2122229 - RNA, 12 nt, Human
agccugcuggau

SEQ ID NO: 2122230 - RNA, 12 nt, Human
agccugcugcau

SEQ ID NO: 2122231 - RNA, 15 nt, Human
agccugggcaacaga

SEQ ID NO: 2122232 - RNA, 17 nt, Human
agccugggcaacagagc

SEQ ID NO: 2122233 - RNA, 18 nt, Human
agccugggcaacagagca

SEQ ID NO: 2122234 - RNA, 20 nt, Human
agccugggaggucaaggcug

SEQ ID NO: 2122235 - RNA, 18 nt, Human
agccugggcaaugugaua

SEQ ID NO: 2122236 - RNA, 20 nt, Human
agccugggcaacagagcaag

SEQ ID NO: 2122237 - RNA, 17 nt, Human
agccugggcagcauagc

SEQ ID NO: 2122238 - RNA, 20 nt, Human
agccugggcagcauagcaag

SEQ ID NO: 2122239 - RNA, 15 nt, Human
agccugggcagccag

SEQ ID NO: 2122240 - RNA, 15 nt, Human
agccuuugccucccc

SEQ ID NO: 2122241 - RNA, 16 nt, Human
agccuuugccuccccg

SEQ ID NO: 2122242 - RNA, 18 nt, Human
agcgaaccaauauuugua

SEQ ID NO: 2122243 - RNA, 12 nt, Human
agcgaaacuccg

SEQ ID NO: 2122244 - RNA, 14 nt, Human
agccuuuccauaag

SEQ ID NO: 2122245 - RNA, 22 nt, Human
agccuuuccauaaggaauguag

SEQ ID NO: 2122246 - RNA, 16 nt, Human
agccuuucucccaggc

SEQ ID NO: 2122247 - RNA, 23 nt, Human
agccuuuccauaaggaauguagc

SEQ ID NO: 2122248 - RNA, 17 nt, Human
agccugggcagccaggc

SEQ ID NO: 2122249 - RNA, 18 nt, Human
agccugggcagccaggcu

SEQ ID NO: 2122250 - RNA, 13 nt, Human
agcuaaagaggcu

SEQ ID NO: 2122251 - RNA, 15 nt, Human
agcuaaagaggcuga

SEQ ID NO: 2122252 - RNA, 21 nt, Human
agcuaaagaggcugaaagagg

SEQ ID NO: 2122253 - RNA, 16 nt, Human
agcuaaagcccaaccu

SEQ ID NO: 2122254 - RNA, 16 nt, Human
agcuaacacuggcccc

SEQ ID NO: 2122255 - RNA, 17 nt, Human
agcuaacacuggccccu

SEQ ID NO: 2122256 - RNA, 18 nt, Human
agcuaacacuggccccua

SEQ ID NO: 2122257 - RNA, 19 nt, Human
agcuaacacuggccccuag

SEQ ID NO: 2122258 - RNA, 23 nt, Human
agcuaacccccuucuacugagcc

SEQ ID NO: 2122259 - RNA, 15 nt, Human
agcgauucuucugcu

SEQ ID NO: 2122260 - RNA, 19 nt, Human
agcgauucuucugcuucag

SEQ ID NO: 2122261 - RNA, 17 nt, Human
agcgauucuucugcuuc

SEQ ID NO: 2122262 - RNA, 20 nt, Human
agcucacaguuccucgcccu

SEQ ID NO: 2122263 - RNA, 16 nt, Human
agcucacacaugagau

SEQ ID NO: 2122264 - RNA, 21 nt, Human
agcucaccagccccagugccc

SEQ ID NO: 2122265 - RNA, 15 nt, Human
agcucaccagcccca

SEQ ID NO: 2122266 - RNA, 14 nt, Human
agcucaccagcccc

SEQ ID NO: 2122267 - RNA, 13 nt, Human
agcucaccagccc

SEQ ID NO: 2122268 - RNA, 15 nt, Human
agcuaaugggacacu

SEQ ID NO: 2122269 - RNA, 14 nt, Human
agcuaaugggacac

SEQ ID NO: 2122270 - RNA, 13 nt, Human
agcuaaugggaca

SEQ ID NO: 2122271 - RNA, 19 nt, Human
agcuaagugaaaaggucau

SEQ ID NO: 2122272 - RNA, 16 nt, Human
agcuaauggaaaauga

SEQ ID NO: 2122273 - RNA, 17 nt, Human
agcuaauggaaaaugau

SEQ ID NO: 2122274 - RNA, 16 nt, Human
agcuaaggacauuucc

SEQ ID NO: 2122275 - RNA, 19 nt, Human
agcuaaggacauuucccag

SEQ ID NO: 2122276 - RNA, 21 nt, Human
cucucuguaauaaacucauuu

SEQ ID NO: 2122277 - RNA, 16 nt, Human
cucucuguaauaaacu

SEQ ID NO: 2122278 - RNA, 23 nt, Human
cucucuuauagaauauuuauuac

SEQ ID NO: 2122279 - RNA, 14 nt, Human
cucucuuccuaucc

SEQ ID NO: 2122280 - RNA, 15 nt, Human
cucucuuccuauccc

SEQ ID NO: 2122281 - RNA, 16 nt, Human
cucucuuccuauccca

SEQ ID NO: 2122282 - RNA, 19 nt, Human
cucucuuccuaucccaucc

SEQ ID NO: 2122283 - RNA, 20 nt, Human
cucucuuccuaucccauccc

SEQ ID NO: 2122284 - RNA, 21 nt, Human
cucucuuccuaucccauccca

SEQ ID NO: 2122285 - RNA, 12 nt, Human
cucucuucugcu

SEQ ID NO: 2122286 - RNA, 14 nt, Human
cucucuucugcucc

SEQ ID NO: 2122287 - RNA, 15 nt, Human
cucucuucugcucca

SEQ ID NO: 2122288 - RNA, 16 nt, Human
cucucuucugcuccac

SEQ ID NO: 2122289 - RNA, 21 nt, Human
cucucuuauagaauauuuauu

SEQ ID NO: 2122290 - RNA, 19 nt, Human
cucucuuauagaauauuua

SEQ ID NO: 2122291 - RNA, 18 nt, Human
cucucuuauagaauauuu

SEQ ID NO: 2122292 - RNA, 15 nt, Human
cucucuuacccuucu

SEQ ID NO: 2122293 - RNA, 18 nt, Human
cucucuuacccuucugug

SEQ ID NO: 2122294 - RNA, 19 nt, Human
cucucuuacccuucugugc

SEQ ID NO: 2122295 - RNA, 22 nt, Human
cucucuuacccuucugugccca

SEQ ID NO: 2122296 - RNA, 23 nt, Human
cucucuuacccuucugugcccag

SEQ ID NO: 2122297 - RNA, 20 nt, Human
cucuauggguaucaaacagc

SEQ ID NO: 2122298 - RNA, 21 nt, Human
cucuauggguaucaaacagcu

SEQ ID NO: 2122299 - RNA, 19 nt, Human
cucuaugguaaagauauua

SEQ ID NO: 2122300 - RNA, 20 nt, Human
cucuaugguaaagauauuau

SEQ ID NO: 2122301 - RNA, 21 nt, Human
cucuaugccagcucaguccca

SEQ ID NO: 2122302 - RNA, 13 nt, Human
cucucccuccccu

SEQ ID NO: 2122303 - RNA, 17 nt, Human
cucucccuccccugcca

SEQ ID NO: 2122304 - RNA, 12 nt, Human
cucucccucugg

SEQ ID NO: 2122305 - RNA, 13 nt, Human
cucucccucuggc

SEQ ID NO: 2122306 - RNA, 18 nt, Human
cucucccucuggcccugc

SEQ ID NO: 2122307 - RNA, 19 nt, Human
cucucccucuggcccugcc

SEQ ID NO: 2122308 - RNA, 21 nt, Human
cucucccucuggcccugccuu

SEQ ID NO: 2122309 - RNA, 22 nt, Human
cucucccucuggcccugccuuc

SEQ ID NO: 2122310 - RNA, 16 nt, Human
cucgguguggagaagc

SEQ ID NO: 2122311 - RNA, 12 nt, Human
cucgugcuuuaa

SEQ ID NO: 2122312 - RNA, 15 nt, Human
cucgugcuuuaagug

SEQ ID NO: 2122313 - RNA, 17 nt, Human
cucuaugccagcucagu

SEQ ID NO: 2122314 - RNA, 16 nt, Human
cucguccucccccugc

SEQ ID NO: 2122315 - RNA, 17 nt, Human
cucguccucccccugcc

SEQ ID NO: 2122316 - RNA, 18 nt, Human
cucguccucccccugcca

SEQ ID NO: 2122317 - RNA, 20 nt, Human
cucguccucccccugccagu

SEQ ID NO: 2122318 - RNA, 22 nt, Human
cucguccucccccugccagugc

SEQ ID NO: 2122319 - RNA, 24 nt, Human
cucguccucccccugccagugccu

SEQ ID NO: 2122320 - RNA, 20 nt, Human
cucgucggggggacagcucc

SEQ ID NO: 2122321 - RNA, 17 nt, Human
cucgguguggagaagcg

SEQ ID NO: 2122322 - RNA, 23 nt, Human
cucgguguggagaagcggcuggc

SEQ ID NO: 2122323 - RNA, 22 nt, Human
cuccugguauggguuucuccca

SEQ ID NO: 2122324 - RNA, 17 nt, Human
cuccuuuggccauucca

SEQ ID NO: 2122325 - RNA, 20 nt, Human
cuccuuucacaaccuucugu

SEQ ID NO: 2122326 - RNA, 15 nt, Human
cuccuuuacccucau

SEQ ID NO: 2122327 - RNA, 17 nt, Human
cuccuuuacccucaucu

SEQ ID NO: 2122328 - RNA, 18 nt, Human
cuccuuuacccucaucug

SEQ ID NO: 2122329 - RNA, 20 nt, Human
cucugcacaagcugcacccu

SEQ ID NO: 2122330 - RNA, 21 nt, Human
cucugcacaagcugcacccuc

SEQ ID NO: 2122331 - RNA, 10 nt, Human
cucugcacag

SEQ ID NO: 2122332 - RNA, 14 nt, Human
cucugcacagaugg

SEQ ID NO: 2122333 - RNA, 15 nt, Human
cucugcacagaugga

SEQ ID NO: 2122334 - RNA, 21 nt, Human
cucugcuccucuccccagcaa

SEQ ID NO: 2122335 - RNA, 16 nt, Human
cucugcagccagccca

SEQ ID NO: 2122336 - RNA, 17 nt, Human
cucugcagccagcccag

SEQ ID NO: 2122337 - RNA, 18 nt, Human
cucugcagccagcccagc

SEQ ID NO: 2122338 - RNA, 19 nt, Human
cucugcagccagcccagcc

SEQ ID NO: 2122339 - RNA, 23 nt, Human
cucugcugacagacacaggcccg

SEQ ID NO: 2122340 - RNA, 13 nt, Human
cucugcugccaug

SEQ ID NO: 2122341 - RNA, 15 nt, Human
cucugcugccauggc

SEQ ID NO: 2122342 - RNA, 20 nt, Human
cucugcugacagacacaggc

SEQ ID NO: 2122343 - RNA, 22 nt, Human
cucugcugacagacacaggccc

SEQ ID NO: 2122344 - RNA, 21 nt, Human
cucugcugacagacacaggcc

SEQ ID NO: 2122345 - RNA, 15 nt, Human
cucugcuggccgggc

SEQ ID NO: 2122346 - RNA, 20 nt, Human
cucugcuggccgggcacagc

SEQ ID NO: 2122347 - RNA, 21 nt, Human
cucugcuggccgggcacagcu

SEQ ID NO: 2122348 - RNA, 22 nt, Human
cucugcuggccgggcacagcug

SEQ ID NO: 2122349 - RNA, 21 nt, Human
cucuuauagaauauuuauuac

SEQ ID NO: 2122350 - RNA, 20 nt, Human
cucuuauagaauauuuauua

SEQ ID NO: 2122351 - RNA, 18 nt, Human
cucuuauagaauauuuau

SEQ ID NO: 2122352 - RNA, 17 nt, Human
cucuuauagaauauuua

SEQ ID NO: 2122353 - RNA, 16 nt, Human
cucuuauagaauauuu

SEQ ID NO: 2122354 - RNA, 19 nt, Human
cucuuaggaagagaaacca

SEQ ID NO: 2122355 - RNA, 14 nt, Human
cucugcuggcccag

SEQ ID NO: 2122356 - RNA, 18 nt, Human
cucugcuggcccagccaa

SEQ ID NO: 2122357 - RNA, 23 nt, Human
cuccgcuuucuacccagcgagcc

SEQ ID NO: 2122358 - RNA, 22 nt, Human
cuccggaggcugaggcaggaga

SEQ ID NO: 2122359 - RNA, 23 nt, Human
cuccggaggcugaggcaggagaa

SEQ ID NO: 2122360 - RNA, 21 nt, Human
cuccuagacugacccugauca

SEQ ID NO: 2122361 - RNA, 11 nt, Human
cuccucugcca

SEQ ID NO: 2122362 - RNA, 12 nt, Human
cuccucugccac

SEQ ID NO: 2122363 - RNA, 14 nt, Human
cuccucugccaccu

SEQ ID NO: 2122364 - RNA, 15 nt, Human
cuccucugccaccuc

SEQ ID NO: 2122365 - RNA, 16 nt, Human
cuccucugccaccucc

SEQ ID NO: 2122366 - RNA, 17 nt, Human
cuccucugccaccuccc

SEQ ID NO: 2122367 - RNA, 12 nt, Human
cuccuagacuga

SEQ ID NO: 2122368 - RNA, 14 nt, Human
cuccuaccucugcu

SEQ ID NO: 2122369 - RNA, 13 nt, Human
cuccuaccuggua

SEQ ID NO: 2122370 - RNA, 16 nt, Human
cuccuaccucagccua

SEQ ID NO: 2122371 - RNA, 18 nt, Human
cuccuaccucagccuaga

SEQ ID NO: 2122372 - RNA, 12 nt, Human
cuccuaccucag

SEQ ID NO: 2122373 - RNA, 13 nt, Human
cuccuaccucagc

SEQ ID NO: 2122374 - RNA, 14 nt, Human
cuccuaccucagcc

SEQ ID NO: 2122375 - RNA, 15 nt, Human
cuccuaccucagccu

SEQ ID NO: 2122376 - RNA, 16 nt, Human
cuccucuugccacugc

SEQ ID NO: 2122377 - RNA, 15 nt, Human
cuccucuugccacug

SEQ ID NO: 2122378 - RNA, 12 nt, Human
cuccucuugcca

SEQ ID NO: 2122379 - RNA, 23 nt, Human
cuccucuucuuuuuuuucauuau

SEQ ID NO: 2122380 - RNA, 18 nt, Human
cuccucuugccacugccu

SEQ ID NO: 2122381 - RNA, 19 nt, Human
cuccuggcccacugcaucg

SEQ ID NO: 2122382 - RNA, 19 nt, Human
cuccuggccucaagugauu

SEQ ID NO: 2122383 - RNA, 18 nt, Human
cuccugggcuaagugauc

SEQ ID NO: 2122384 - RNA, 15 nt, Human
cuccucuguccaggc

SEQ ID NO: 2122385 - RNA, 15 nt, Human
cuccucuguccaggg

SEQ ID NO: 2122386 - RNA, 16 nt, Human
cuccucuguccagggc

SEQ ID NO: 2122387 - RNA, 12 nt, Human
cuccucugucca

SEQ ID NO: 2122388 - RNA, 15 nt, Human
cuccucugggcagga

SEQ ID NO: 2122389 - RNA, 23 nt, Human
cuccucugggcaggaccucagag

SEQ ID NO: 2122390 - RNA, 14 nt, Human
cuccucuguccagg

SEQ ID NO: 2122391 - RNA, 17 nt, Human
cuccucuguccagggcc

SEQ ID NO: 2122392 - RNA, 18 nt, Human
cuccucuguccagggccc

SEQ ID NO: 2122393 - RNA, 13 nt, Human
cuccucugucccu

SEQ ID NO: 2122394 - RNA, 12 nt, Human
cuccucugggca

SEQ ID NO: 2122395 - RNA, 13 nt, Human
cuccucugggcag

SEQ ID NO: 2122396 - RNA, 14 nt, Human
cuccuguccaaccu

SEQ ID NO: 2122397 - RNA, 17 nt, Human
cuccuguacuuuuucca

SEQ ID NO: 2122398 - RNA, 14 nt, Human
cuccugggcucaag

SEQ ID NO: 2122399 - RNA, 15 nt, Human
cuccugggcucaagc

SEQ ID NO: 2122400 - RNA, 13 nt, Human
cuccugggcucag

SEQ ID NO: 2122401 - RNA, 15 nt, Human
cuccuggucuugaga

SEQ ID NO: 2122402 - RNA, 23 nt, Human
cuccuggucuugagaugucuucu

SEQ ID NO: 2122403 - RNA, 17 nt, Human
cuccuuucacaaccuuc

SEQ ID NO: 2122404 - RNA, 16 nt, Human
cuccuuucacaaccuu

SEQ ID NO: 2122405 - RNA, 15 nt, Human
cuccuuucaccacau

SEQ ID NO: 2122406 - RNA, 13 nt, Human
cuccuuucacaac

SEQ ID NO: 2122407 - RNA, 13 nt, Human
cuccugucugcca

SEQ ID NO: 2122408 - RNA, 16 nt, Human
cuccuuguaaagacug

SEQ ID NO: 2122409 - RNA, 16 nt, Human
cuccugucugccagcc

SEQ ID NO: 2122410 - RNA, 14 nt, Human
cuccugucugccag

SEQ ID NO: 2122411 - RNA, 15 nt, Human
cuccugucugccagc

SEQ ID NO: 2122412 - RNA, 13 nt, Human
cucccccuccuuc

SEQ ID NO: 2122413 - RNA, 14 nt, Human
cucccccuccuucc

SEQ ID NO: 2122414 - RNA, 15 nt, Human
cucccccuccuuccc

SEQ ID NO: 2122415 - RNA, 17 nt, Human
cucccccuccuucccag

SEQ ID NO: 2122416 - RNA, 20 nt, Human
cucccccuccuucccagcug

SEQ ID NO: 2122417 - RNA, 14 nt, Human
cuccccggcucgag

SEQ ID NO: 2122418 - RNA, 20 nt, Human
cuccccuaaccucuuuucug

SEQ ID NO: 2122419 - RNA, 15 nt, Human
cuccccuaaugccug

SEQ ID NO: 2122420 - RNA, 16 nt, Human
cuccccuaaugccugc

SEQ ID NO: 2122421 - RNA, 17 nt, Human
cuccccuauccacccag

SEQ ID NO: 2122422 - RNA, 18 nt, Human
cuccccuauccacccagc

SEQ ID NO: 2122423 - RNA, 19 nt, Human
cuccccuauccacccagcc

SEQ ID NO: 2122424 - RNA, 21 nt, Human
cuccccuauccacccagccca

SEQ ID NO: 2122425 - RNA, 23 nt, Human
cuccccuauccacccagcccauu

SEQ ID NO: 2122426 - RNA, 13 nt, Human
cuccccucaagga

SEQ ID NO: 2122427 - RNA, 19 nt, Human
cucccuccuuccuucuugc

SEQ ID NO: 2122428 - RNA, 20 nt, Human
cucccuccuuccuucuugcu

SEQ ID NO: 2122429 - RNA, 18 nt, Human
cucccucgaacccacacu

SEQ ID NO: 2122430 - RNA, 20 nt, Human
cucccucgaacccacacugc

SEQ ID NO: 2122431 - RNA, 21 nt, Human
cucccucgaacccacacugca

SEQ ID NO: 2122432 - RNA, 22 nt, Human
cucccucgaacccacacugcaa

SEQ ID NO: 2122433 - RNA, 20 nt, Human
cucccugaaguaagcaaaga

SEQ ID NO: 2122434 - RNA, 19 nt, Human
cucccugaaccaucccuga

SEQ ID NO: 2122435 - RNA, 21 nt, Human
cucccugaaaauguuuuucug

SEQ ID NO: 2122436 - RNA, 23 nt, Human
cucccugaaaauguuuuucugcc

SEQ ID NO: 2122437 - RNA, 12 nt, Human
cucccucuccug

SEQ ID NO: 2122438 - RNA, 20 nt, Human
cucccucuuucccucccuuc

SEQ ID NO: 2122439 - RNA, 20 nt, Human
cuccaggcuguaucccauga

SEQ ID NO: 2122440 - RNA, 23 nt, Human
cuccaggcuccuuuagcgcccag

SEQ ID NO: 2122441 - RNA, 15 nt, Human
cuccaggcuccuuua

SEQ ID NO: 2122442 - RNA, 16 nt, Human
cuccaguacuggagcu

SEQ ID NO: 2122443 - RNA, 21 nt, Human
cuccaguacuggagcuucucu

SEQ ID NO: 2122444 - RNA, 21 nt, Human
cucccacaggcccuuccucuc

SEQ ID NO: 2122445 - RNA, 20 nt, Human
cucccacaggcccuuccucu

SEQ ID NO: 2122446 - RNA, 16 nt, Human
cucccacaggcccuuc

SEQ ID NO: 2122447 - RNA, 14 nt, Human
cucccacaggcccu

SEQ ID NO: 2122448 - RNA, 15 nt, Human
cucccacaggcccuu

SEQ ID NO: 2122449 - RNA, 24 nt, Human
cucccagaacacacuccaucagcu

SEQ ID NO: 2122450 - RNA, 16 nt, Human
cucccagcucugagga

SEQ ID NO: 2122451 - RNA, 16 nt, Human
cucccagaacacacuc

SEQ ID NO: 2122452 - RNA, 12 nt, Human
cucauguagcaa

SEQ ID NO: 2122453 - RNA, 12 nt, Human
cucaugggcccc

SEQ ID NO: 2122454 - RNA, 15 nt, Human
cucaugggccccucu

SEQ ID NO: 2122455 - RNA, 16 nt, Human
cucaugggccccucug

SEQ ID NO: 2122456 - RNA, 17 nt, Human
cucaugggccccucuga

SEQ ID NO: 2122457 - RNA, 20 nt, Human
cucaugggccccucugacuc

SEQ ID NO: 2122458 - RNA, 17 nt, Human
cucaugguccccauggc

SEQ ID NO: 2122459 - RNA, 20 nt, Human
cucaugguccccauggcaug

SEQ ID NO: 2122460 - RNA, 23 nt, Human
cucauggugaggcuuaacaaugu

SEQ ID NO: 2122461 - RNA, 15 nt, Human
cucaugguggguuca

SEQ ID NO: 2122462 - RNA, 20 nt, Human
cucaaugugaaucagacccu

SEQ ID NO: 2122463 - RNA, 21 nt, Human
cucaaugugaaucagacccua

SEQ ID NO: 2122464 - RNA, 19 nt, Human
cucaauucauauuuaugaa

SEQ ID NO: 2122465 - RNA, 22 nt, Human
cucaauauuuuccaugaaaaug

SEQ ID NO: 2122466 - RNA, 15 nt, Human
cucaaucaagaaaau

SEQ ID NO: 2122467 - RNA, 18 nt, Human
cucaaucccagcuacuca

SEQ ID NO: 2122468 - RNA, 14 nt, Human
cucaauccucuaag

SEQ ID NO: 2122469 - RNA, 21 nt, Human
cucaagugauucuccugccuc

SEQ ID NO: 2122470 - RNA, 11 nt, Human
cuauguuugcu

SEQ ID NO: 2122471 - RNA, 14 nt, Human
cucaaguugaaaga

SEQ ID NO: 2122472 - RNA, 20 nt, Human
cucaaguuucuucaaucuga

SEQ ID NO: 2122473 - RNA, 13 nt, Human
cucaauaaaauca

SEQ ID NO: 2122474 - RNA, 18 nt, Human
cucaauauuuuccaugaa

SEQ ID NO: 2122475 - RNA, 19 nt, Human
cucaauauuuuccaugaaa

SEQ ID NO: 2122476 - RNA, 22 nt, Human
cucaauaaaaucauguacauuu

SEQ ID NO: 2122477 - RNA, 23 nt, Human
cucaauaaaaucauguacauuuc

SEQ ID NO: 2122478 - RNA, 22 nt, Human
cucaagugucucaguccaccug

SEQ ID NO: 2122479 - RNA, 14 nt, Human
cucaaguucaagga

SEQ ID NO: 2122480 - RNA, 15 nt, Human
cucaaguucaaggac

SEQ ID NO: 2122481 - RNA, 17 nt, Human
cucaaguucaaggacca

SEQ ID NO: 2122482 - RNA, 18 nt, Human
cucaaguucaaggaccaa

SEQ ID NO: 2122483 - RNA, 19 nt, Human
cucaaguucaaggaccaac

SEQ ID NO: 2122484 - RNA, 12 nt, Human
cuaugugacaau

SEQ ID NO: 2122485 - RNA, 22 nt, Human
cuauguugcccaggcaggucuu

SEQ ID NO: 2122486 - RNA, 21 nt, Human
cuauguugcccaggcaggucu

SEQ ID NO: 2122487 - RNA, 19 nt, Human
cuauguugcccaggcaggu

SEQ ID NO: 2122488 - RNA, 18 nt, Human
cuauguugcccaggcagg

SEQ ID NO: 2122489 - RNA, 14 nt, Human
cuaucucacagcac

SEQ ID NO: 2122490 - RNA, 18 nt, Human
cuaucucacagcacacuc

SEQ ID NO: 2122491 - RNA, 20 nt, Human
cuaucucacagcacacucag

SEQ ID NO: 2122492 - RNA, 13 nt, Human
cuaugucccuugc

SEQ ID NO: 2122493 - RNA, 16 nt, Human
cuaugucccuugcugu

SEQ ID NO: 2122494 - RNA, 12 nt, Human
cuauccuggcuu

SEQ ID NO: 2122495 - RNA, 13 nt, Human
cuauccuggcuuu

SEQ ID NO: 2122496 - RNA, 14 nt, Human
cuauccuggcuuug

SEQ ID NO: 2122497 - RNA, 18 nt, Human
cuauccuggcuuugccca

SEQ ID NO: 2122498 - RNA, 19 nt, Human
cuauccuggcuuugcccaa

SEQ ID NO: 2122499 - RNA, 21 nt, Human
cuauccuggcuuugcccaacc

SEQ ID NO: 2122500 - RNA, 22 nt, Human
cuauccuggcuuugcccaaccu

SEQ ID NO: 2122501 - RNA, 20 nt, Human
cuauccggacagagcacguu

SEQ ID NO: 2122502 - RNA, 13 nt, Human
cuauccuacccca

SEQ ID NO: 2122503 - RNA, 14 nt, Human
cuaucaccuccccu

SEQ ID NO: 2122504 - RNA, 15 nt, Human
cuaucaccuccccuc

SEQ ID NO: 2122505 - RNA, 18 nt, Human
cuaucagaguauccacug

SEQ ID NO: 2122506 - RNA, 16 nt, Human
cuaucaccuccccucc

SEQ ID NO: 2122507 - RNA, 17 nt, Human
cuaucaccuccccuccu

SEQ ID NO: 2122508 - RNA, 19 nt, Human
cuaucaccuccccuccuug

SEQ ID NO: 2122509 - RNA, 20 nt, Human
cuacaaaaccugauguuaaa

SEQ ID NO: 2122510 - RNA, 21 nt, Human
cuacaaaaccugauguuaaaa

SEQ ID NO: 2122511 - RNA, 17 nt, Human
cuacaaaauuugaaauu

SEQ ID NO: 2122512 - RNA, 18 nt, Human
cuacaaaauuugaaauuu

SEQ ID NO: 2122513 - RNA, 23 nt, Human
cucagaagacacugaugggcaac

SEQ ID NO: 2122514 - RNA, 11 nt, Human
cucagaagccu

SEQ ID NO: 2122515 - RNA, 13 nt, Human
cucagaagccuga

SEQ ID NO: 2122516 - RNA, 14 nt, Human
cucagaagccugag

SEQ ID NO: 2122517 - RNA, 15 nt, Human
cucagaagccugagg

SEQ ID NO: 2122518 - RNA, 18 nt, Human
cucagaagccugaggcug

SEQ ID NO: 2122519 - RNA, 16 nt, Human
cucagaagccugaggc

SEQ ID NO: 2122520 - RNA, 17 nt, Human
cucagaagccugaggcu

SEQ ID NO: 2122521 - RNA, 13 nt, Human
cucagacccccac

SEQ ID NO: 2122522 - RNA, 23 nt, Human
cucagacccccacucucauuccc

SEQ ID NO: 2122523 - RNA, 17 nt, Human
cucagacucauacagaa

SEQ ID NO: 2122524 - RNA, 14 nt, Human
cucagacuccauuu

SEQ ID NO: 2122525 - RNA, 14 nt, Human
cucagacccccacu

SEQ ID NO: 2122526 - RNA, 15 nt, Human
cucagacccccacuc

SEQ ID NO: 2122527 - RNA, 16 nt, Human
cucagacccccacucu

SEQ ID NO: 2122528 - RNA, 22 nt, Human
cucagacccccacucucauucc

SEQ ID NO: 2122529 - RNA, 13 nt, Human
cucagacugcuca

SEQ ID NO: 2122530 - RNA, 14 nt, Human
cucagacugcucaa

SEQ ID NO: 2122531 - RNA, 13 nt, Human
cucagcccugagg

SEQ ID NO: 2122532 - RNA, 14 nt, Human
cucagcccugaggu

SEQ ID NO: 2122533 - RNA, 15 nt, Human
cucagcccugaggug

SEQ ID NO: 2122534 - RNA, 11 nt, Human
cucagcccugg

SEQ ID NO: 2122535 - RNA, 12 nt, Human
cucagcccuggg

SEQ ID NO: 2122536 - RNA, 13 nt, Human
cucagcccugggc

SEQ ID NO: 2122537 - RNA, 14 nt, Human
cucagcccugggcc

SEQ ID NO: 2122538 - RNA, 22 nt, Human
cucagccucccgaauagcuggg

SEQ ID NO: 2122539 - RNA, 22 nt, Human
cucagccuccuguguagcuggg

SEQ ID NO: 2122540 - RNA, 15 nt, Human
cucagcccugggccc

SEQ ID NO: 2122541 - RNA, 19 nt, Human
cucagcccugggccccacc

SEQ ID NO: 2122542 - RNA, 21 nt, Human
cucagcccugggccccaccac

SEQ ID NO: 2122543 - RNA, 21 nt, Human
cucagccucccgaauagcugg

SEQ ID NO: 2122544 - RNA, 19 nt, Human
cucagccucccgaauagcu

SEQ ID NO: 2122545 - RNA, 22 nt, Human
cucagaagacacugaugggcaa

SEQ ID NO: 2122546 - RNA, 20 nt, Human
cucagaagacacugaugggc

SEQ ID NO: 2122547 - RNA, 17 nt, Human
cucagaagacacugaug

SEQ ID NO: 2122548 - RNA, 15 nt, Human
cucagaagacacuga

SEQ ID NO: 2122549 - RNA, 15 nt, Human
cucagaacacauucu

SEQ ID NO: 2122550 - RNA, 17 nt, Human
cucagaacacauucuuu

SEQ ID NO: 2122551 - RNA, 13 nt, Human
cucagaagacacu

SEQ ID NO: 2122552 - RNA, 18 nt, Human
cucacgccuguaauccca

SEQ ID NO: 2122553 - RNA, 19 nt, Human
cucacgccuguaaucccag

SEQ ID NO: 2122554 - RNA, 20 nt, Human
cucacgccuguaaucccagc

SEQ ID NO: 2122555 - RNA, 21 nt, Human
cucacgccuguaaucccagca

SEQ ID NO: 2122556 - RNA, 23 nt, Human
cucacgccuguaaucccagcacu

SEQ ID NO: 2122557 - RNA, 22 nt, Human
cucacgccuguaaucccagcag

SEQ ID NO: 2122558 - RNA, 20 nt, Human
cucacgcucccaacacaagg

SEQ ID NO: 2122559 - RNA, 23 nt, Human
cucacgccuguaaucccagcagu

SEQ ID NO: 2122560 - RNA, 19 nt, Human
cucacgggcaguagcugug

SEQ ID NO: 2122561 - RNA, 13 nt, Human
cucacguguguga

SEQ ID NO: 2122562 - RNA, 16 nt, Human
cucacgugagaguguc

SEQ ID NO: 2122563 - RNA, 15 nt, Human
cucacgcaccuccca

SEQ ID NO: 2122564 - RNA, 16 nt, Human
cucacgcaccucccau

SEQ ID NO: 2122565 - RNA, 19 nt, Human
cucacgcaccucccauccu

SEQ ID NO: 2122566 - RNA, 20 nt, Human
cucacgccuaugaucccagc

SEQ ID NO: 2122567 - RNA, 17 nt, Human
cucaccuuucccaucuu

SEQ ID NO: 2122568 - RNA, 23 nt, Human
cucaggccuauaaccccagcucc

SEQ ID NO: 2122569 - RNA, 19 nt, Human
cucaggccaacaagccaac

SEQ ID NO: 2122570 - RNA, 13 nt, Human
cucaggccaccug

SEQ ID NO: 2122571 - RNA, 23 nt, Human
cucagccuccuguguagcuggga

SEQ ID NO: 2122572 - RNA, 17 nt, Human
cucagccucugaauaug

SEQ ID NO: 2122573 - RNA, 19 nt, Human
cucagggacagagacaccu

SEQ ID NO: 2122574 - RNA, 20 nt, Human
cucagggacagagacaccug

SEQ ID NO: 2122575 - RNA, 20 nt, Human
cucaggcuguuuuugggugc

SEQ ID NO: 2122576 - RNA, 17 nt, Human
cucaggcuuccuuggca

SEQ ID NO: 2122577 - RNA, 14 nt, Human
cucagggaagccca

SEQ ID NO: 2122578 - RNA, 15 nt, Human
cucagggaagcccag

SEQ ID NO: 2122579 - RNA, 16 nt, Human
cucagggaagcccagc

SEQ ID NO: 2122580 - RNA, 17 nt, Human
cucagggaagcccagcu

SEQ ID NO: 2122581 - RNA, 18 nt, Human
cucagggaagcccagcuc

SEQ ID NO: 2122582 - RNA, 19 nt, Human
cucagggaagcccagcucc

SEQ ID NO: 2122583 - RNA, 20 nt, Human
cucagggaagcccagcucca

SEQ ID NO: 2122584 - RNA, 21 nt, Human
cucagggaagcccagcuccag

SEQ ID NO: 2122585 - RNA, 23 nt, Human
cucagggaagcccagcuccaggg

SEQ ID NO: 2122586 - RNA, 14 nt, Human
cucagggacagaga

SEQ ID NO: 2122587 - RNA, 20 nt, Human
cucaggcgauccaccugucu

SEQ ID NO: 2122588 - RNA, 13 nt, Human
cucaggcucugcc

SEQ ID NO: 2122589 - RNA, 21 nt, Human
cucaggcgauccaccugucuc

SEQ ID NO: 2122590 - RNA, 17 nt, Human
cucaggcugaccacuuu

SEQ ID NO: 2122591 - RNA, 14 nt, Human
cucaggcucugccc

SEQ ID NO: 2122592 - RNA, 15 nt, Human
cucaggcucugcccu

SEQ ID NO: 2122593 - RNA, 16 nt, Human
cucaggcucugcccug

SEQ ID NO: 2122594 - RNA, 17 nt, Human
cucaggcucugcccugc

SEQ ID NO: 2122595 - RNA, 19 nt, Human
cucaggcucugcccugccc

SEQ ID NO: 2122596 - RNA, 22 nt, Human
cucaggcucugcccugcccuag

SEQ ID NO: 2122597 - RNA, 11 nt, Human
cucaggcugcu

SEQ ID NO: 2122598 - RNA, 12 nt, Human
cucaggcugcug

SEQ ID NO: 2122599 - RNA, 13 nt, Human
cucaggcugcugg

SEQ ID NO: 2122600 - RNA, 14 nt, Human
cucaggcugcugga

SEQ ID NO: 2122601 - RNA, 15 nt, Human
cucaggcugcuggag

SEQ ID NO: 2122602 - RNA, 16 nt, Human
cucaggcugcuggagg

SEQ ID NO: 2122603 - RNA, 17 nt, Human
cucaggcugcuggagga

SEQ ID NO: 2122604 - RNA, 17 nt, Human
cucaguccauagcagag

SEQ ID NO: 2122605 - RNA, 15 nt, Human
cucaguccauagcag

SEQ ID NO: 2122606 - RNA, 14 nt, Human
cucagguugucuga

SEQ ID NO: 2122607 - RNA, 19 nt, Human
cucagguuguaguaaagaa

SEQ ID NO: 2122608 - RNA, 22 nt, Human
cucagguuguaguaaagaaauu

SEQ ID NO: 2122609 - RNA, 16 nt, Human
cucaguccaccugagc

SEQ ID NO: 2122610 - RNA, 17 nt, Human
cucaguccaccugagcu

SEQ ID NO: 2122611 - RNA, 18 nt, Human
cucaguccaccugagcug

SEQ ID NO: 2122612 - RNA, 20 nt, Human
cucagucuggcccuuccuuu

SEQ ID NO: 2122613 - RNA, 22 nt, Human
cucagucuggcccuuccuuuuc

SEQ ID NO: 2122614 - RNA, 13 nt, Human
cucagucuucccu

SEQ ID NO: 2122615 - RNA, 20 nt, Human
cucagucuucccuagggcug

SEQ ID NO: 2122616 - RNA, 22 nt, Human
cucagucuucccuagggcuggg

SEQ ID NO: 2122617 - RNA, 23 nt, Human
cucagucuucccuagggcugggu

SEQ ID NO: 2122618 - RNA, 22 nt, Human
cucaugaggggcccgagcagaa

SEQ ID NO: 2122619 - RNA, 19 nt, Human
cucaugaucuugugacaua

SEQ ID NO: 2122620 - RNA, 20 nt, Human
cucaugaucuugugacauau

SEQ ID NO: 2122621 - RNA, 18 nt, Human
cucaugcauagucccagc

SEQ ID NO: 2122622 - RNA, 19 nt, Human
cucaugcauagucccagcu

SEQ ID NO: 2122623 - RNA, 20 nt, Human
cucaugcauagucccagcua

SEQ ID NO: 2122624 - RNA, 22 nt, Human
cucagguugucugaagucacug

SEQ ID NO: 2122625 - RNA, 23 nt, Human
cucaggugucccugcacuugcag

SEQ ID NO: 2122626 - RNA, 17 nt, Human
cguaaagcuagaaauga

SEQ ID NO: 2122627 - RNA, 16 nt, Human
cguaaagcuagaaaug

SEQ ID NO: 2122628 - RNA, 20 nt, Human
cguaaauacacaacacacac

SEQ ID NO: 2122629 - RNA, 15 nt, Human
cguaaccacggaaaa

SEQ ID NO: 2122630 - RNA, 20 nt, Human
cgguggcucacgccuguaau

SEQ ID NO: 2122631 - RNA, 20 nt, Human
cgguggcucaggccuauaac

SEQ ID NO: 2122632 - RNA, 16 nt, Human
cgggcuggccugugcc

SEQ ID NO: 2122633 - RNA, 17 nt, Human
cgggcuggccugugccu

SEQ ID NO: 2122634 - RNA, 15 nt, Human
cgggcuuuuccccgg

SEQ ID NO: 2122635 - RNA, 14 nt, Human
cggggaacuccugg

SEQ ID NO: 2122636 - RNA, 15 nt, Human
cggggaacuccugga

SEQ ID NO: 2122637 - RNA, 13 nt, Human
cgguggcuaaagg

SEQ ID NO: 2122638 - RNA, 22 nt, Human
cgguggcuaaaggucccaaggc

SEQ ID NO: 2122639 - RNA, 16 nt, Human
cggggaacuccuggaa

SEQ ID NO: 2122640 - RNA, 15 nt, Human
cguacugcagccucc

SEQ ID NO: 2122641 - RNA, 22 nt, Human
cguacuuagcagcuaucucuca

SEQ ID NO: 2122642 - RNA, 14 nt, Human
cguacugcagccuc

SEQ ID NO: 2122643 - RNA, 17 nt, Human
cguacauucaauguuua

SEQ ID NO: 2122644 - RNA, 21 nt, Human
cggcuacucagcagcccuccu

SEQ ID NO: 2122645 - RNA, 12 nt, Human
cggcuacucagc

SEQ ID NO: 2122646 - RNA, 13 nt, Human
cggcuacucagca

SEQ ID NO: 2122647 - RNA, 14 nt, Human
cggcuacucagcag

SEQ ID NO: 2122648 - RNA, 16 nt, Human
cggcuacucagcagcc

SEQ ID NO: 2122649 - RNA, 18 nt, Human
cggcuacucagcagcccu

SEQ ID NO: 2122650 - RNA, 19 nt, Human
cggcuacucagcagcccuc

SEQ ID NO: 2122651 - RNA, 20 nt, Human
cggcuacucagcagcccucc

SEQ ID NO: 2122652 - RNA, 14 nt, Human
cgggcucagcucug

SEQ ID NO: 2122653 - RNA, 15 nt, Human
cgggcucagcucugg

SEQ ID NO: 2122654 - RNA, 14 nt, Human
cgggcucucugcug

SEQ ID NO: 2122655 - RNA, 15 nt, Human
cgggcucucugcugu

SEQ ID NO: 2122656 - RNA, 20 nt, Human
cgggccuggagaacuagaga

SEQ ID NO: 2122657 - RNA, 16 nt, Human
cgggccuggagaacua

SEQ ID NO: 2122658 - RNA, 19 nt, Human
cgggcucagcaaaagaugc

SEQ ID NO: 2122659 - RNA, 20 nt, Human
cgggcugggagcucugcaga

SEQ ID NO: 2122660 - RNA, 16 nt, Human
cgggcugggagcucug

SEQ ID NO: 2122661 - RNA, 14 nt, Human
cgggcugggcagcu

SEQ ID NO: 2122662 - RNA, 15 nt, Human
cgggcugggcagcug

SEQ ID NO: 2122663 - RNA, 16 nt, Human
cgggcugggcagcugu

SEQ ID NO: 2122664 - RNA, 17 nt, Human
cgggcugggcagcuguu

SEQ ID NO: 2122665 - RNA, 15 nt, Human
cggaggggccuggca

SEQ ID NO: 2122666 - RNA, 23 nt, Human
cggagucccaccuuggcugcagg

SEQ ID NO: 2122667 - RNA, 22 nt, Human
cggagucccaccuuggcugcag

SEQ ID NO: 2122668 - RNA, 21 nt, Human
cggagucccaccuuggcugca

SEQ ID NO: 2122669 - RNA, 17 nt, Human
cggagggauuccccuaa

SEQ ID NO: 2122670 - RNA, 19 nt, Human
cggagggaauugaggucug

SEQ ID NO: 2122671 - RNA, 19 nt, Human
cggaggcuugucagagcug

SEQ ID NO: 2122672 - RNA, 20 nt, Human
cggaggcuugucagagcugg

SEQ ID NO: 2122673 - RNA, 21 nt, Human
cggaggcuugucagagcuggg

SEQ ID NO: 2122674 - RNA, 23 nt, Human
cggaggcuugucagagcugggag

SEQ ID NO: 2122675 - RNA, 18 nt, Human
cggaggcuugucagagcu

SEQ ID NO: 2122676 - RNA, 17 nt, Human
cggagacggagucccac

SEQ ID NO: 2122677 - RNA, 20 nt, Human
cggagacggagucccaccuu

SEQ ID NO: 2122678 - RNA, 21 nt, Human
cggagacgugaugaagggagg

SEQ ID NO: 2122679 - RNA, 13 nt, Human
cggagagaaaaaa

SEQ ID NO: 2122680 - RNA, 14 nt, Human
cggagagaaaaaag

SEQ ID NO: 2122681 - RNA, 16 nt, Human
cggagagaaaaaagaa

SEQ ID NO: 2122682 - RNA, 23 nt, Human
cggagagcgccugccccucccag

SEQ ID NO: 2122683 - RNA, 20 nt, Human
cggaggcugaggcaggagaa

SEQ ID NO: 2122684 - RNA, 19 nt, Human
cgcucuguugcccaggcug

SEQ ID NO: 2122685 - RNA, 22 nt, Human
cgcucuguugcccaggcuggag

SEQ ID NO: 2122686 - RNA, 21 nt, Human
cgcucuuggcagguacucagc

SEQ ID NO: 2122687 - RNA, 23 nt, Human
cgcugacaaccaccgcuccccag

SEQ ID NO: 2122688 - RNA, 13 nt, Human
cgcucuuuuccua

SEQ ID NO: 2122689 - RNA, 15 nt, Human
cgccugccccuccca

SEQ ID NO: 2122690 - RNA, 16 nt, Human
cgccugccccucccag

SEQ ID NO: 2122691 - RNA, 17 nt, Human
cgccaccccuccuuccu

SEQ ID NO: 2122692 - RNA, 19 nt, Human
cgccacauccccgcuggcu

SEQ ID NO: 2122693 - RNA, 23 nt, Human
cgccacauccccgcuggcugggg

SEQ ID NO: 2122694 - RNA, 21 nt, Human
cgccacuacacuccagccuga

SEQ ID NO: 2122695 - RNA, 18 nt, Human
cgcuggagugcagugagc

SEQ ID NO: 2122696 - RNA, 17 nt, Human
cgcuggagugcagugag

SEQ ID NO: 2122697 - RNA, 20 nt, Human
cgcugccgcaccccagagug

SEQ ID NO: 2122698 - RNA, 21 nt, Human
cgcugccgcaccccagagugu

SEQ ID NO: 2122699 - RNA, 17 nt, Human
cgcugccuaaguggcug

SEQ ID NO: 2122700 - RNA, 20 nt, Human
cgcugccuaaguggcugcug

SEQ ID NO: 2122701 - RNA, 13 nt, Human
cgcugccgcaccc

SEQ ID NO: 2122702 - RNA, 18 nt, Human
cgcugccgcaccccagag

SEQ ID NO: 2122703 - RNA, 10 nt, Human
cgcuggcccc

SEQ ID NO: 2122704 - RNA, 12 nt, Human
cgcuggccccca

SEQ ID NO: 2122705 - RNA, 13 nt, Human
cgcuggcccccac

SEQ ID NO: 2122706 - RNA, 16 nt, Human
cgcuggcccccacugg

SEQ ID NO: 2122707 - RNA, 17 nt, Human
cgcuggcccccacuggc

SEQ ID NO: 2122708 - RNA, 18 nt, Human
cgcuggcccccacuggcu

SEQ ID NO: 2122709 - RNA, 19 nt, Human
cgcuggcccccacuggcug

SEQ ID NO: 2122710 - RNA, 20 nt, Human
cgcuggcccccacuggcugu

SEQ ID NO: 2122711 - RNA, 21 nt, Human
cgcuggcccccacuggcugug

SEQ ID NO: 2122712 - RNA, 16 nt, Human
cgagucucuucuccac

SEQ ID NO: 2122713 - RNA, 16 nt, Human
cgaggguccuggcucc

SEQ ID NO: 2122714 - RNA, 23 nt, Human
cgaggguccuggcuccugagggg

SEQ ID NO: 2122715 - RNA, 18 nt, Human
cgagucucuucuccacug

SEQ ID NO: 2122716 - RNA, 17 nt, Human
cgagucucuucuccacu

SEQ ID NO: 2122717 - RNA, 14 nt, Human
cgaggguccuggcu

SEQ ID NO: 2122718 - RNA, 15 nt, Human
cgaggguccuggcuc

SEQ ID NO: 2122719 - RNA, 18 nt, Human
cgaggggaggguggcagg

SEQ ID NO: 2122720 - RNA, 19 nt, Human
cgaggggaggguggcaggu

SEQ ID NO: 2122721 - RNA, 21 nt, Human
cgagucucuucuccacuggau

SEQ ID NO: 2122722 - RNA, 20 nt, Human
cgagucucuucuccacugga

SEQ ID NO: 2122723 - RNA, 19 nt, Human
cgcagugcuucucuacaga

SEQ ID NO: 2122724 - RNA, 12 nt, Human
ccuuuuccaugc

SEQ ID NO: 2122725 - RNA, 20 nt, Human
ccuuuucgcaggauucuucc

SEQ ID NO: 2122726 - RNA, 12 nt, Human
ccuuucccuuua

SEQ ID NO: 2122727 - RNA, 11 nt, Human
ccuuuccuguu

SEQ ID NO: 2122728 - RNA, 15 nt, Human
ccuuuccuguucagc

SEQ ID NO: 2122729 - RNA, 18 nt, Human
ccuuuccuguucagcauu

SEQ ID NO: 2122730 - RNA, 20 nt, Human
ccuuuccuguucagcauucu

SEQ ID NO: 2122731 - RNA, 16 nt, Human
ccuuuccuuccauccc

SEQ ID NO: 2122732 - RNA, 18 nt, Human
ccuuuccuuccaucccua

SEQ ID NO: 2122733 - RNA, 12 nt, Human
ccuuuccuuccu

SEQ ID NO: 2122734 - RNA, 21 nt, Human
ccuuuccuuccuucccuggcu

SEQ ID NO: 2122735 - RNA, 13 nt, Human
ccuuuccuuccuu

SEQ ID NO: 2122736 - RNA, 22 nt, Human
cuaagaaagcccuuaggaagaa

SEQ ID NO: 2122737 - RNA, 16 nt, Human
cuaacuuuccuucauu

SEQ ID NO: 2122738 - RNA, 22 nt, Human
cuaacuuggagccccagugcca

SEQ ID NO: 2122739 - RNA, 17 nt, Human
cuaacuuggagccccag

SEQ ID NO: 2122740 - RNA, 20 nt, Human
cuaacuuggagccccagugc

SEQ ID NO: 2122741 - RNA, 21 nt, Human
cuaacuuggagccccagugcc

SEQ ID NO: 2122742 - RNA, 17 nt, Human
cuaaaguagacuucauu

SEQ ID NO: 2122743 - RNA, 20 nt, Human
cuaaaggucccaaggcaagg

SEQ ID NO: 2122744 - RNA, 17 nt, Human
cuaaagcccaaccuccu

SEQ ID NO: 2122745 - RNA, 20 nt, Human
cuaacgacuucagggcaggg

SEQ ID NO: 2122746 - RNA, 15 nt, Human
cuaacguaaauacac

SEQ ID NO: 2122747 - RNA, 19 nt, Human
cgugagugaaccaucauua

SEQ ID NO: 2122748 - RNA, 14 nt, Human
cguuagggaagaga

SEQ ID NO: 2122749 - RNA, 16 nt, Human
cguuagggaagagaaa

SEQ ID NO: 2122750 - RNA, 17 nt, Human
cguuagggaagagaaac

SEQ ID NO: 2122751 - RNA, 15 nt, Human
cguucaccccuccac

SEQ ID NO: 2122752 - RNA, 22 nt, Human
cguuauguguguauauguaugu

SEQ ID NO: 2122753 - RNA, 13 nt, Human
cuaaagcaggccu

SEQ ID NO: 2122754 - RNA, 11 nt, Human
cuaaagcagug

SEQ ID NO: 2122755 - RNA, 20 nt, Human
cguucaccccuccacccuug

SEQ ID NO: 2122756 - RNA, 18 nt, Human
cuaaagcaguggacacca

SEQ ID NO: 2122757 - RNA, 15 nt, Human
cgugacaacacuugu

SEQ ID NO: 2122758 - RNA, 14 nt, Human
cgugacaacacuug

SEQ ID NO: 2122759 - RNA, 20 nt, Human
cgugagccacugcaccgggc

SEQ ID NO: 2122760 - RNA, 15 nt, Human
cgugagccacugcac

SEQ ID NO: 2122761 - RNA, 14 nt, Human
cgugagccacugca

SEQ ID NO: 2122762 - RNA, 19 nt, Human
cgugaggaugucacucaga

SEQ ID NO: 2122763 - RNA, 22 nt, Human
cgugagccacugcaccgggcca

SEQ ID NO: 2122764 - RNA, 15 nt, Human
cuaauuugauguuua

SEQ ID NO: 2122765 - RNA, 16 nt, Human
cuaauuugauguuuac

SEQ ID NO: 2122766 - RNA, 13 nt, Human
cuaauaaaauauc

SEQ ID NO: 2122767 - RNA, 14 nt, Human
cuaauaaaauauca

SEQ ID NO: 2122768 - RNA, 13 nt, Human
cuaauaaaagcau

SEQ ID NO: 2122769 - RNA, 15 nt, Human
cuaauaaaauaucau

SEQ ID NO: 2122770 - RNA, 16 nt, Human
cuaauaaaauaucauu

SEQ ID NO: 2122771 - RNA, 17 nt, Human
cuaauaaaauaucauuc

SEQ ID NO: 2122772 - RNA, 18 nt, Human
cuaauaaaauaucauuca

SEQ ID NO: 2122773 - RNA, 19 nt, Human
cuaauaaaauaucauucag

SEQ ID NO: 2122774 - RNA, 20 nt, Human
cuaauaaaauaucauucagc

SEQ ID NO: 2122775 - RNA, 21 nt, Human
cuaauaaaauaucauucagca

SEQ ID NO: 2122776 - RNA, 22 nt, Human
cuaauaaaauaucauucagcaa

SEQ ID NO: 2122777 - RNA, 23 nt, Human
cuaauaaaauaucauucagcaac

SEQ ID NO: 2122778 - RNA, 19 nt, Human
cuacaaaaagcauaaaaau

SEQ ID NO: 2122779 - RNA, 12 nt, Human
cuaauuuuuaag

SEQ ID NO: 2122780 - RNA, 13 nt, Human
cuaaguuucaguu

SEQ ID NO: 2122781 - RNA, 15 nt, Human
cuaaguucuuagaua

SEQ ID NO: 2122782 - RNA, 17 nt, Human
cuaaguucuuagauauc

SEQ ID NO: 2122783 - RNA, 18 nt, Human
cuaaguucuuagauaucu

SEQ ID NO: 2122784 - RNA, 20 nt, Human
cuaaguucuuagauaucuuu

SEQ ID NO: 2122785 - RNA, 12 nt, Human
cuaagucucugu

SEQ ID NO: 2122786 - RNA, 13 nt, Human
cuaagucucugug

SEQ ID NO: 2122787 - RNA, 14 nt, Human
cuaagucucuguga

SEQ ID NO: 2122788 - RNA, 15 nt, Human
cuaagucccugcccc

SEQ ID NO: 2122789 - RNA, 16 nt, Human
cuaagucccugccccc

SEQ ID NO: 2122790 - RNA, 17 nt, Human
cuaagucccugcccccu

SEQ ID NO: 2122791 - RNA, 18 nt, Human
cuaagucccugcccccuc

SEQ ID NO: 2122792 - RNA, 10 nt, Human
cuaauaaaac

SEQ ID NO: 2122793 - RNA, 19 nt, Human
cuaaguuucaguugauuuu

SEQ ID NO: 2122794 - RNA, 14 nt, Human
ccuuagucuucuca

SEQ ID NO: 2122795 - RNA, 13 nt, Human
ccuuagucuucuc

SEQ ID NO: 2122796 - RNA, 23 nt, Human
ccuuagcuuagaccucagccugu

SEQ ID NO: 2122797 - RNA, 13 nt, Human
ccuuaggcaggga

SEQ ID NO: 2122798 - RNA, 15 nt, Human
ccuuaggcagggaag

SEQ ID NO: 2122799 - RNA, 19 nt, Human
ccuuagcuuagaccucagc

SEQ ID NO: 2122800 - RNA, 20 nt, Human
ccuuagcuuagaccucagcc

SEQ ID NO: 2122801 - RNA, 21 nt, Human
ccuuagcuuagaccucagccu

SEQ ID NO: 2122802 - RNA, 22 nt, Human
ccuuagcuuagaccucagccug

SEQ ID NO: 2122803 - RNA, 16 nt, Human
ccuuaggcagggaagu

SEQ ID NO: 2122804 - RNA, 16 nt, Human
ccuuaucgaaacucau

SEQ ID NO: 2122805 - RNA, 13 nt, Human
ccuuaucugugcg

SEQ ID NO: 2122806 - RNA, 20 nt, Human
ccuuaucugugcgugaaaca

SEQ ID NO: 2122807 - RNA, 21 nt, Human
ccuuaucugugcgugaaacac

SEQ ID NO: 2122808 - RNA, 12 nt, Human
ccuucccagcuc

SEQ ID NO: 2122809 - RNA, 13 nt, Human
ccuucccagcucu

SEQ ID NO: 2122810 - RNA, 14 nt, Human
ccuucccagcucuc

SEQ ID NO: 2122811 - RNA, 17 nt, Human
ccuucccagcucucccu

SEQ ID NO: 2122812 - RNA, 18 nt, Human
ccuucccagcucucccuc

SEQ ID NO: 2122813 - RNA, 15 nt, Human
ccuucccaugcccug

SEQ ID NO: 2122814 - RNA, 22 nt, Human
ccuucccagcucucccucuggc

SEQ ID NO: 2122815 - RNA, 19 nt, Human
ccuucccagcucucccucu

SEQ ID NO: 2122816 - RNA, 21 nt, Human
ccuucccagcucucccucugg

SEQ ID NO: 2122817 - RNA, 13 nt, Human
ccuucccagcugc

SEQ ID NO: 2122818 - RNA, 16 nt, Human
ccuucccagcugcccc

SEQ ID NO: 2122819 - RNA, 18 nt, Human
ccuucccagcugccccuc

SEQ ID NO: 2122820 - RNA, 22 nt, Human
ccuucccagcugccccucccug

SEQ ID NO: 2122821 - RNA, 19 nt, Human
ccuguucagcuccagcuca

SEQ ID NO: 2122822 - RNA, 16 nt, Human
ccuguucagcuccagc

SEQ ID NO: 2122823 - RNA, 15 nt, Human
ccuguucagcuccag

SEQ ID NO: 2122824 - RNA, 14 nt, Human
ccuguucagcucca

SEQ ID NO: 2122825 - RNA, 21 nt, Human
ccuguucagcuccagcucacc

SEQ ID NO: 2122826 - RNA, 20 nt, Human
ccuguucagcuccagcucac

SEQ ID NO: 2122827 - RNA, 23 nt, Human
ccuguucagcuccagcucaccag

SEQ ID NO: 2122828 - RNA, 12 nt, Human
ccuguucagcau

SEQ ID NO: 2122829 - RNA, 15 nt, Human
ccuguucagcauucu

SEQ ID NO: 2122830 - RNA, 19 nt, Human
ccuguucugggugcagcug

SEQ ID NO: 2122831 - RNA, 12 nt, Human
ccuguugaaaag

SEQ ID NO: 2122832 - RNA, 22 nt, Human
ccuguugaaaagccauguuuaa

SEQ ID NO: 2122833 - RNA, 12 nt, Human
ccuguucccauu

SEQ ID NO: 2122834 - RNA, 16 nt, Human
ccuguucauuguaagc

SEQ ID NO: 2122835 - RNA, 22 nt, Human
ccuguugcccuuucuguaccau

SEQ ID NO: 2122836 - RNA, 20 nt, Human
ccuuagcagggaaacagcua

SEQ ID NO: 2122837 - RNA, 19 nt, Human
ccuuagcagggaaacagcu

SEQ ID NO: 2122838 - RNA, 16 nt, Human
ccuuagcaaauucugu

SEQ ID NO: 2122839 - RNA, 12 nt, Human
ccuguugcuuuu

SEQ ID NO: 2122840 - RNA, 17 nt, Human
ccuuagcaacagccgag

SEQ ID NO: 2122841 - RNA, 18 nt, Human
ccuuagccaguuguauau

SEQ ID NO: 2122842 - RNA, 14 nt, Human
ccuuagccucccug

SEQ ID NO: 2122843 - RNA, 15 nt, Human
ccuuagccucccuga

SEQ ID NO: 2122844 - RNA, 16 nt, Human
ccuuagccucccugaa

SEQ ID NO: 2122845 - RNA, 17 nt, Human
ccuuagcuuagaccuca

SEQ ID NO: 2122846 - RNA, 18 nt, Human
ccuuagcuuagaccucag

SEQ ID NO: 2122847 - RNA, 11 nt, Human
ccuuagcugcc

SEQ ID NO: 2122848 - RNA, 13 nt, Human
ccuuagcugccaa

SEQ ID NO: 2122849 - RNA, 15 nt, Human
ccuuagcugccaagc

SEQ ID NO: 2122850 - RNA, 20 nt, Human
ccuuagcugccaagccccau

SEQ ID NO: 2122851 - RNA, 21 nt, Human
ccuguucacucuacuuagcau

SEQ ID NO: 2122852 - RNA, 18 nt, Human
ccuguuagcuguuauuuc

SEQ ID NO: 2122853 - RNA, 13 nt, Human
ccuguucagcucc

SEQ ID NO: 2122854 - RNA, 21 nt, Human
ccuguuaccuaauuagagcag

SEQ ID NO: 2122855 - RNA, 22 nt, Human
ccuguuaccuaauuagagcaga

SEQ ID NO: 2122856 - RNA, 23 nt, Human
ccuguuaccuaauuagagcagau

SEQ ID NO: 2122857 - RNA, 13 nt, Human
ccugcuggaucuc

SEQ ID NO: 2122858 - RNA, 15 nt, Human
ccugcuggaucuccc

SEQ ID NO: 2122859 - RNA, 16 nt, Human
ccugcuggaucuccca

SEQ ID NO: 2122860 - RNA, 17 nt, Human
ccugcuggaucucccag

SEQ ID NO: 2122861 - RNA, 21 nt, Human
ccugcuggaucucccagggcu

SEQ ID NO: 2122862 - RNA, 22 nt, Human
ccugcuggaucucccagggcua

SEQ ID NO: 2122863 - RNA, 12 nt, Human
ccugcuggcccc

SEQ ID NO: 2122864 - RNA, 13 nt, Human
ccugcuggccccu

SEQ ID NO: 2122865 - RNA, 11 nt, Human
ccugcuggccc

SEQ ID NO: 2122866 - RNA, 22 nt, Human
ccugcugccgccucccagccug

SEQ ID NO: 2122867 - RNA, 21 nt, Human
ccuucuguccuacucuguguc

SEQ ID NO: 2122868 - RNA, 20 nt, Human
ccuucuguccuacucugugu

SEQ ID NO: 2122869 - RNA, 14 nt, Human
ccuucucuuaauuu

SEQ ID NO: 2122870 - RNA, 22 nt, Human
ccuucuguccuacucuguguca

SEQ ID NO: 2122871 - RNA, 16 nt, Human
ccuucucugaaggaca

SEQ ID NO: 2122872 - RNA, 14 nt, Human
ccuucucugaagga

SEQ ID NO: 2122873 - RNA, 13 nt, Human
ccuucucugccca

SEQ ID NO: 2122874 - RNA, 14 nt, Human
ccuucucugcccau

SEQ ID NO: 2122875 - RNA, 18 nt, Human
ccuucucugcccauuccc

SEQ ID NO: 2122876 - RNA, 19 nt, Human
ccuucucugcccauucccc

SEQ ID NO: 2122877 - RNA, 22 nt, Human
ccuucucugcccauuccccagc

SEQ ID NO: 2122878 - RNA, 13 nt, Human
ccuucucugcucc

SEQ ID NO: 2122879 - RNA, 14 nt, Human
ccuucucugcucca

SEQ ID NO: 2122880 - RNA, 16 nt, Human
ccuucucugcuccacc

SEQ ID NO: 2122881 - RNA, 17 nt, Human
ccuucucugcuccacca

SEQ ID NO: 2122882 - RNA, 20 nt, Human
ccuucucugcuccaccacau

SEQ ID NO: 2122883 - RNA, 22 nt, Human
ccuucucugcuccaccacaucc

SEQ ID NO: 2122884 - RNA, 20 nt, Human
ccuuccucuccacugccuuc

SEQ ID NO: 2122885 - RNA, 15 nt, Human
ccuuccucuccacug

SEQ ID NO: 2122886 - RNA, 14 nt, Human
ccuuccucuccacu

SEQ ID NO: 2122887 - RNA, 22 nt, Human
ccuuccucucauccuuuucucc

SEQ ID NO: 2122888 - RNA, 17 nt, Human
ccuuccucuccacugcc

SEQ ID NO: 2122889 - RNA, 16 nt, Human
ccuuccucuccacugc

SEQ ID NO: 2122890 - RNA, 16 nt, Human
ccuucccuugagcccu

SEQ ID NO: 2122891 - RNA, 12 nt, Human
ccuucccucucc

SEQ ID NO: 2122892 - RNA, 11 nt, Human
ccuucccuggc

SEQ ID NO: 2122893 - RNA, 12 nt, Human
ccuucccugcaa

SEQ ID NO: 2122894 - RNA, 20 nt, Human
ccuucccccucccagggcca

SEQ ID NO: 2122895 - RNA, 16 nt, Human
ccuucccccucccagg

SEQ ID NO: 2122896 - RNA, 17 nt, Human
ccuucccccucccaggg

SEQ ID NO: 2122897 - RNA, 19 nt, Human
ccuucccccuccaauccca

SEQ ID NO: 2122898 - RNA, 20 nt, Human
ccuuccccacugccugccca

SEQ ID NO: 2122899 - RNA, 12 nt, Human
ccuuccccacug

SEQ ID NO: 2122900 - RNA, 13 nt, Human
ccuuccccagccu

SEQ ID NO: 2122901 - RNA, 22 nt, Human
ccuuccccacugccugcccacc

SEQ ID NO: 2122902 - RNA, 15 nt, Human
ccuuccccagccucu

SEQ ID NO: 2122903 - RNA, 16 nt, Human
ccuuccccuccuucuc

SEQ ID NO: 2122904 - RNA, 19 nt, Human
ccuuccccucccuggcucc

SEQ ID NO: 2122905 - RNA, 22 nt, Human
ccuuccccucccuggcucccau

SEQ ID NO: 2122906 - RNA, 15 nt, Human
ccuuccccucccugg

SEQ ID NO: 2122907 - RNA, 17 nt, Human
ccuuccccucccuggcu

SEQ ID NO: 2122908 - RNA, 18 nt, Human
ccuuccccucccuggcuc

SEQ ID NO: 2122909 - RNA, 18 nt, Human
ccuuccccuugcccaggg

SEQ ID NO: 2122910 - RNA, 20 nt, Human
ccuuccccuugcccagggcu

SEQ ID NO: 2122911 - RNA, 22 nt, Human
ccuuccccuugcccagggcuca

SEQ ID NO: 2122912 - RNA, 13 nt, Human
ccuuuauuuuaga

SEQ ID NO: 2122913 - RNA, 14 nt, Human
ccuuuauuaaaauc

SEQ ID NO: 2122914 - RNA, 16 nt, Human
ccuuuauuaaaaucuu

SEQ ID NO: 2122915 - RNA, 15 nt, Human
ccuuucaaauuucac

SEQ ID NO: 2122916 - RNA, 16 nt, Human
ccuuucaaauuucaca

SEQ ID NO: 2122917 - RNA, 20 nt, Human
ccuuucccuccacuccuucc

SEQ ID NO: 2122918 - RNA, 12 nt, Human
ccuuucccucca

SEQ ID NO: 2122919 - RNA, 20 nt, Human
ccuugcucuccccugcccug

SEQ ID NO: 2122920 - RNA, 18 nt, Human
ccuugcucgcuguaaaau

SEQ ID NO: 2122921 - RNA, 11 nt, Human
ccuugcuaccu

SEQ ID NO: 2122922 - RNA, 12 nt, Human
ccuugcuaccuc

SEQ ID NO: 2122923 - RNA, 14 nt, Human
ccuugcuaccucaa

SEQ ID NO: 2122924 - RNA, 17 nt, Human
ccuugcuaccucaaggg

SEQ ID NO: 2122925 - RNA, 16 nt, Human
ccuugccuccugugua

SEQ ID NO: 2122926 - RNA, 21 nt, Human
ccuugcgcuuuugcuggucac

SEQ ID NO: 2122927 - RNA, 13 nt, Human
ccuugccagacau

SEQ ID NO: 2122928 - RNA, 19 nt, Human
ccuugcacacuccccugca

SEQ ID NO: 2122929 - RNA, 22 nt, Human
ccuugcacacuccccugcacug

SEQ ID NO: 2122930 - RNA, 15 nt, Human
ccuugcaagaaucag

SEQ ID NO: 2122931 - RNA, 12 nt, Human
ccuugcaccugc

SEQ ID NO: 2122932 - RNA, 13 nt, Human
ccuugcaccugca

SEQ ID NO: 2122933 - RNA, 14 nt, Human
ccuugcaccugcau

SEQ ID NO: 2122934 - RNA, 16 nt, Human
ccuugcaccugcaucc

SEQ ID NO: 2122935 - RNA, 15 nt, Human
ccuugcagcuaguuu

SEQ ID NO: 2122936 - RNA, 17 nt, Human
ccuugcaguucagcacc

SEQ ID NO: 2122937 - RNA, 19 nt, Human
ccuugcaguucagcaccac

SEQ ID NO: 2122938 - RNA, 20 nt, Human
ccuugcaguucagcaccacc

SEQ ID NO: 2122939 - RNA, 22 nt, Human
ccuugcaguucagcaccacccu

SEQ ID NO: 2122940 - RNA, 23 nt, Human
ccuugcaguucagcaccacccua

SEQ ID NO: 2122941 - RNA, 16 nt, Human
ccucgagguuucucaa

SEQ ID NO: 2122942 - RNA, 19 nt, Human
ccucgaagcgcgccacucg

SEQ ID NO: 2122943 - RNA, 18 nt, Human
ccucgaagcgcgccacuc

SEQ ID NO: 2122944 - RNA, 15 nt, Human
ccucgaacuggcugc

SEQ ID NO: 2122945 - RNA, 16 nt, Human
ccucgaacuggcugca

SEQ ID NO: 2122946 - RNA, 15 nt, Human
ccuccuuucuggcuu

SEQ ID NO: 2122947 - RNA, 23 nt, Human
ccuccgccauucucaagcccugc

SEQ ID NO: 2122948 - RNA, 14 nt, Human
ccuccgccaggcga

SEQ ID NO: 2122949 - RNA, 16 nt, Human
ccuccgccaggcgaga

SEQ ID NO: 2122950 - RNA, 16 nt, Human
ccuccguauuucagac

SEQ ID NO: 2122951 - RNA, 15 nt, Human
ccuccguauuucaga

SEQ ID NO: 2122952 - RNA, 16 nt, Human
ccucccuguccuccuc

SEQ ID NO: 2122953 - RNA, 15 nt, Human
ccucccuguccuccu

SEQ ID NO: 2122954 - RNA, 21 nt, Human
ccucccuguugaagcucuggu

SEQ ID NO: 2122955 - RNA, 14 nt, Human
ccucccuguccacc

SEQ ID NO: 2122956 - RNA, 15 nt, Human
ccucccuguccaccc

SEQ ID NO: 2122957 - RNA, 12 nt, Human
ccucccuguccu

SEQ ID NO: 2122958 - RNA, 11 nt, Human
ccucccugucc

SEQ ID NO: 2122959 - RNA, 14 nt, Human
ccucccuguccucc

SEQ ID NO: 2122960 - RNA, 14 nt, Human
ccucccuggccugu

SEQ ID NO: 2122961 - RNA, 20 nt, Human
ccucccuggagccuccacug

SEQ ID NO: 2122962 - RNA, 15 nt, Human
ccucccuggccuguu

SEQ ID NO: 2122963 - RNA, 12 nt, Human
ccucccuggcuc

SEQ ID NO: 2122964 - RNA, 13 nt, Human
ccucccuggcucc

SEQ ID NO: 2122965 - RNA, 14 nt, Human
ccucccuggcuccc

SEQ ID NO: 2122966 - RNA, 15 nt, Human
ccucccuggcuccca

SEQ ID NO: 2122967 - RNA, 16 nt, Human
ccucccuggcucccau

SEQ ID NO: 2122968 - RNA, 18 nt, Human
ccucccuggcucccauga

SEQ ID NO: 2122969 - RNA, 20 nt, Human
ccucccuggcucccaugacc

SEQ ID NO: 2122970 - RNA, 20 nt, Human
ccucugccugaagucacaca

SEQ ID NO: 2122971 - RNA, 11 nt, Human
ccucugccuga

SEQ ID NO: 2122972 - RNA, 23 nt, Human
ccucugccucugacacacagcuc

SEQ ID NO: 2122973 - RNA, 21 nt, Human
ccucugccucugacacacagc

SEQ ID NO: 2122974 - RNA, 20 nt, Human
ccucugccucugacacacag

SEQ ID NO: 2122975 - RNA, 12 nt, Human
ccucugccggcu

SEQ ID NO: 2122976 - RNA, 11 nt, Human
ccucugccuca

SEQ ID NO: 2122977 - RNA, 12 nt, Human
ccucugccucaa

SEQ ID NO: 2122978 - RNA, 13 nt, Human
ccucugccucaau

SEQ ID NO: 2122979 - RNA, 13 nt, Human
ccucucuaaccuc

SEQ ID NO: 2122980 - RNA, 16 nt, Human
ccucucuaaccuccuu

SEQ ID NO: 2122981 - RNA, 17 nt, Human
ccucucuaaccuccuuu

SEQ ID NO: 2122982 - RNA, 19 nt, Human
ccucucuaaccuccuuuac

SEQ ID NO: 2122983 - RNA, 20 nt, Human
ccucucuaaccuccuuuacc

SEQ ID NO: 2122984 - RNA, 21 nt, Human
ccucucggaaggcuggcuggg

SEQ ID NO: 2122985 - RNA, 19 nt, Human
ccucucgguggccagcagg

SEQ ID NO: 2122986 - RNA, 15 nt, Human
ccucggcuccuggac

SEQ ID NO: 2122987 - RNA, 19 nt, Human
ccucggcuccuggacucau

SEQ ID NO: 2122988 - RNA, 17 nt, Human
ccucucggaaggcuggc

SEQ ID NO: 2122989 - RNA, 19 nt, Human
ccucgggcgagucacugcc

SEQ ID NO: 2122990 - RNA, 15 nt, Human
ccucagccuccugag

SEQ ID NO: 2122991 - RNA, 23 nt, Human
ccuaggacauguucccuucuccu

SEQ ID NO: 2122992 - RNA, 16 nt, Human
ccuaggaauucccagc

SEQ ID NO: 2122993 - RNA, 17 nt, Human
ccuaggaauucccagcc

SEQ ID NO: 2122994 - RNA, 11 nt, Human
ccuagcugugu

SEQ ID NO: 2122995 - RNA, 21 nt, Human
ccuagcuugggaggcuucccc

SEQ ID NO: 2122996 - RNA, 13 nt, Human
ccuagcugugugc

SEQ ID NO: 2122997 - RNA, 17 nt, Human
ccuagcugugugcaguc

SEQ ID NO: 2122998 - RNA, 20 nt, Human
ccuagcuugggaggcuuccc

SEQ ID NO: 2122999 - RNA, 18 nt, Human
ccuaaugagaagucaaca

SEQ ID NO: 2123000 - RNA, 11 nt, Human
ccucaggcagg

SEQ ID NO: 2123001 - RNA, 13 nt, Human
ccucaggcaggaa

SEQ ID NO: 2123002 - RNA, 14 nt, Human
ccucaugccaaccc

SEQ ID NO: 2123003 - RNA, 11 nt, Human
ccucccaccuu

SEQ ID NO: 2123004 - RNA, 13 nt, Human
ccucccaccuuug

SEQ ID NO: 2123005 - RNA, 17 nt, Human
ccucccagaacacacuc

SEQ ID NO: 2123006 - RNA, 18 nt, Human
ccucccagaacacacucc

SEQ ID NO: 2123007 - RNA, 12 nt, Human
ccuccccagcag

SEQ ID NO: 2123008 - RNA, 16 nt, Human
ccuccccagcaggugg

SEQ ID NO: 2123009 - RNA, 17 nt, Human
ccuccccagcagguggg

SEQ ID NO: 2123010 - RNA, 20 nt, Human
ccuccccagcagguggggag

SEQ ID NO: 2123011 - RNA, 22 nt, Human
ccuccccaggggagagggucug

SEQ ID NO: 2123012 - RNA, 13 nt, Human
ccuccccaggccg

SEQ ID NO: 2123013 - RNA, 12 nt, Human
ccuccccagggg

SEQ ID NO: 2123014 - RNA, 14 nt, Human
ccuccccaggggag

SEQ ID NO: 2123015 - RNA, 10 nt, Human
ccugacucaa

SEQ ID NO: 2123016 - RNA, 16 nt, Human
ccugacucaggcauca

SEQ ID NO: 2123017 - RNA, 19 nt, Human
ccugacggcgcccccagug

SEQ ID NO: 2123018 - RNA, 20 nt, Human
ccugacggcgcccccagugu

SEQ ID NO: 2123019 - RNA, 21 nt, Human
ccugacggcgcccccagugug

SEQ ID NO: 2123020 - RNA, 16 nt, Human
ccugaccugucucacc

SEQ ID NO: 2123021 - RNA, 18 nt, Human
ccugaggggcaucugccc

SEQ ID NO: 2123022 - RNA, 19 nt, Human
ccugaggggcaucugcccc

SEQ ID NO: 2123023 - RNA, 20 nt, Human
ccugaggggcaucugccccu

SEQ ID NO: 2123024 - RNA, 22 nt, Human
ccugaggggcaucugccccucc

SEQ ID NO: 2123025 - RNA, 23 nt, Human
ccugaggggcaucugccccuccc

SEQ ID NO: 2123026 - RNA, 19 nt, Human
ccugagugaucccauuucu

SEQ ID NO: 2123027 - RNA, 12 nt, Human
ccugcagagaug

SEQ ID NO: 2123028 - RNA, 19 nt, Human
ccucugccugucuccccca

SEQ ID NO: 2123029 - RNA, 22 nt, Human
ccucugccugucccucucaggc

SEQ ID NO: 2123030 - RNA, 20 nt, Human
ccucugccugugcacggcca

SEQ ID NO: 2123031 - RNA, 15 nt, Human
ccucugccugucucc

SEQ ID NO: 2123032 - RNA, 14 nt, Human
ccucugccucaaug

SEQ ID NO: 2123033 - RNA, 19 nt, Human
ccucugccugaaccuucca

SEQ ID NO: 2123034 - RNA, 21 nt, Human
ccucugccugaaccuuccauc

SEQ ID NO: 2123035 - RNA, 19 nt, Human
ccucugccugucccucuca

SEQ ID NO: 2123036 - RNA, 21 nt, Human
ccucugccugaagucacacag

SEQ ID NO: 2123037 - RNA, 15 nt, Human
ccucuucuucuucag

SEQ ID NO: 2123038 - RNA, 12 nt, Human
ccucuucuuacu

SEQ ID NO: 2123039 - RNA, 14 nt, Human
ccucuucuuacuug

SEQ ID NO: 2123040 - RNA, 17 nt, Human
ccucuucuuacuugaug

SEQ ID NO: 2123041 - RNA, 16 nt, Human
ccucuucuucuucaga

SEQ ID NO: 2123042 - RNA, 17 nt, Human
ccucuucuucuucagaa

SEQ ID NO: 2123043 - RNA, 14 nt, Human
ccugcugccgccuc

SEQ ID NO: 2123044 - RNA, 15 nt, Human
ccugcugccgccucc

SEQ ID NO: 2123045 - RNA, 18 nt, Human
ccugcugccgccucccag

SEQ ID NO: 2123046 - RNA, 21 nt, Human
ccugcugccgccucccagccu

SEQ ID NO: 2123047 - RNA, 10 nt, Human
ccugcugcau

SEQ ID NO: 2123048 - RNA, 21 nt, Human
ccugccucuuaaauaaaccuu

SEQ ID NO: 2123049 - RNA, 14 nt, Human
ccugccucuuaaau

SEQ ID NO: 2123050 - RNA, 15 nt, Human
ccugccucuucucua

SEQ ID NO: 2123051 - RNA, 13 nt, Human
cccugaaccaucc

SEQ ID NO: 2123052 - RNA, 18 nt, Human
cccugaaccaucccugau

SEQ ID NO: 2123053 - RNA, 17 nt, Human
cccucgggcgagucacu

SEQ ID NO: 2123054 - RNA, 15 nt, Human
cccucggucuucggc

SEQ ID NO: 2123055 - RNA, 18 nt, Human
cccugaaagcccugagcu

SEQ ID NO: 2123056 - RNA, 22 nt, Human
cccucgaagcgcgccacucgcu

SEQ ID NO: 2123057 - RNA, 13 nt, Human
cccucgcuggccc

SEQ ID NO: 2123058 - RNA, 14 nt, Human
cccucgcuggcccc

SEQ ID NO: 2123059 - RNA, 15 nt, Human
cccucgcuggccccc

SEQ ID NO: 2123060 - RNA, 17 nt, Human
cccucgcuggcccccac

SEQ ID NO: 2123061 - RNA, 18 nt, Human
cccucgcuggcccccacu

SEQ ID NO: 2123062 - RNA, 19 nt, Human
cccucgcuggcccccacug

SEQ ID NO: 2123063 - RNA, 20 nt, Human
cccucgcuggcccccacugg

SEQ ID NO: 2123064 - RNA, 21 nt, Human
cccucgcuggcccccacuggc

SEQ ID NO: 2123065 - RNA, 23 nt, Human
cccucgcuggcccccacuggcug

SEQ ID NO: 2123066 - RNA, 22 nt, Human
cccuccgccuucacuccggugu

SEQ ID NO: 2123067 - RNA, 13 nt, Human
cccuccgccuuca

SEQ ID NO: 2123068 - RNA, 21 nt, Human
cccuccgccuucacuccggug

SEQ ID NO: 2123069 - RNA, 18 nt, Human
cccuccguggcaucaccu

SEQ ID NO: 2123070 - RNA, 23 nt, Human
cccuccguggcaucaccuuaggc

SEQ ID NO: 2123071 - RNA, 20 nt, Human
cccuccuaucaccuccccuc

SEQ ID NO: 2123072 - RNA, 21 nt, Human
cccuccuaucaccuccccucc

SEQ ID NO: 2123073 - RNA, 15 nt, Human
cccucgaagcgcgcc

SEQ ID NO: 2123074 - RNA, 19 nt, Human
cccucgaagcgcgccacuc

SEQ ID NO: 2123075 - RNA, 21 nt, Human
cccucgaagcgcgccacucgc

SEQ ID NO: 2123076 - RNA, 12 nt, Human
cccugagcucgg

SEQ ID NO: 2123077 - RNA, 18 nt, Human
cccugagaucagaguccu

SEQ ID NO: 2123078 - RNA, 16 nt, Human
cccugagcuuucugcu

SEQ ID NO: 2123079 - RNA, 22 nt, Human
cccugagcucgguggacccagg

SEQ ID NO: 2123080 - RNA, 17 nt, Human
cccugagacaaauggag

SEQ ID NO: 2123081 - RNA, 16 nt, Human
cccugagacaaaugga

SEQ ID NO: 2123082 - RNA, 23 nt, Human
cccugagacaaauggaggccugu

SEQ ID NO: 2123083 - RNA, 20 nt, Human
cccugagacaaauggaggcc

SEQ ID NO: 2123084 - RNA, 18 nt, Human
cccugacucucugugacc

SEQ ID NO: 2123085 - RNA, 13 nt, Human
cccugacucucug

SEQ ID NO: 2123086 - RNA, 17 nt, Human
cccugacucucugugac

SEQ ID NO: 2123087 - RNA, 17 nt, Human
cccugaccucccucuaa

SEQ ID NO: 2123088 - RNA, 15 nt, Human
cccugaccucacugu

SEQ ID NO: 2123089 - RNA, 12 nt, Human
cccugacccugc

SEQ ID NO: 2123090 - RNA, 15 nt, Human
cccugacccugcaga

SEQ ID NO: 2123091 - RNA, 17 nt, Human
cccugccccucccuuca

SEQ ID NO: 2123092 - RNA, 15 nt, Human
cccugccccgucacc

SEQ ID NO: 2123093 - RNA, 23 nt, Human
cccugccccucccuucaaccauu

SEQ ID NO: 2123094 - RNA, 21 nt, Human
cccugccccgucaccaucuca

SEQ ID NO: 2123095 - RNA, 12 nt, Human
cccugccccugc

SEQ ID NO: 2123096 - RNA, 19 nt, Human
cccugccccucccuucaac

SEQ ID NO: 2123097 - RNA, 18 nt, Human
cccugccccucccuucaa

SEQ ID NO: 2123098 - RNA, 17 nt, Human
cccugcccggcugcgga

SEQ ID NO: 2123099 - RNA, 14 nt, Human
cccugcccggcugc

SEQ ID NO: 2123100 - RNA, 14 nt, Human
cccugcccuagcuc

SEQ ID NO: 2123101 - RNA, 16 nt, Human
cccugcccuagcucca

SEQ ID NO: 2123102 - RNA, 17 nt, Human
cccugcccuagcuccac

SEQ ID NO: 2123103 - RNA, 23 nt, Human
cccugcccccuccccuucacacc

SEQ ID NO: 2123104 - RNA, 16 nt, Human
cccugccccucaugcc

SEQ ID NO: 2123105 - RNA, 13 nt, Human
cccugccccugcc

SEQ ID NO: 2123106 - RNA, 17 nt, Human
cccugccccugccccgu

SEQ ID NO: 2123107 - RNA, 18 nt, Human
cccugccccugccccguc

SEQ ID NO: 2123108 - RNA, 19 nt, Human
cccugccccugccccguca

SEQ ID NO: 2123109 - RNA, 18 nt, Human
cccugccccuucuacacu

SEQ ID NO: 2123110 - RNA, 23 nt, Human
cccugccccuucuacacucuccu

SEQ ID NO: 2123111 - RNA, 20 nt, Human
cccuggcucccacaggcccu

SEQ ID NO: 2123112 - RNA, 13 nt, Human
cccuggcucccau

SEQ ID NO: 2123113 - RNA, 14 nt, Human
cccuggcucccaug

SEQ ID NO: 2123114 - RNA, 15 nt, Human
cccuggcucccauga

SEQ ID NO: 2123115 - RNA, 23 nt, Human
cccuggcucccaugaccauacug

SEQ ID NO: 2123116 - RNA, 19 nt, Human
cccuggcucucagaaggua

SEQ ID NO: 2123117 - RNA, 12 nt, Human
cccugcccuggu

SEQ ID NO: 2123118 - RNA, 13 nt, Human
cccugcccugcug

SEQ ID NO: 2123119 - RNA, 11 nt, Human
cccugcccugc

SEQ ID NO: 2123120 - RNA, 18 nt, Human
cccugcccugguccaggg

SEQ ID NO: 2123121 - RNA, 14 nt, Human
cccugcccuggucc

SEQ ID NO: 2123122 - RNA, 15 nt, Human
cccugcccuggucca

SEQ ID NO: 2123123 - RNA, 13 nt, Human
cccugcccuggga

SEQ ID NO: 2123124 - RNA, 23 nt, Human
cccuggaucaguccuuugaucag

SEQ ID NO: 2123125 - RNA, 19 nt, Human
cccuggauccaucaggcca

SEQ ID NO: 2123126 - RNA, 22 nt, Human
cccuggaugaaguuaucuggcu

SEQ ID NO: 2123127 - RNA, 22 nt, Human
ccuaaucccugggcauugcuuu

SEQ ID NO: 2123128 - RNA, 21 nt, Human
ccuaaucccugggcauugcuu

SEQ ID NO: 2123129 - RNA, 20 nt, Human
ccuagccugugccucuggga

SEQ ID NO: 2123130 - RNA, 20 nt, Human
ccuagccgaccucagccuuc

SEQ ID NO: 2123131 - RNA, 18 nt, Human
ccuagccgaccucagccu

SEQ ID NO: 2123132 - RNA, 19 nt, Human
ccuagccgaccucagccuu

SEQ ID NO: 2123133 - RNA, 14 nt, Human
ccuagccgaccuca

SEQ ID NO: 2123134 - RNA, 15 nt, Human
ccuagccgaccucag

SEQ ID NO: 2123135 - RNA, 16 nt, Human
ccuagccgaccucagc

SEQ ID NO: 2123136 - RNA, 17 nt, Human
ccuagccgaccucagcc

SEQ ID NO: 2123137 - RNA, 17 nt, Human
ccuagcacuuugggagg

SEQ ID NO: 2123138 - RNA, 14 nt, Human
ccggcuccaggcuc

SEQ ID NO: 2123139 - RNA, 13 nt, Human
ccggcuccaggcu

SEQ ID NO: 2123140 - RNA, 12 nt, Human
ccggcuccaggc

SEQ ID NO: 2123141 - RNA, 15 nt, Human
ccggcuccaggcucc

SEQ ID NO: 2123142 - RNA, 15 nt, Human
ccggccccugcuggu

SEQ ID NO: 2123143 - RNA, 13 nt, Human
ccggcccuggggc

SEQ ID NO: 2123144 - RNA, 12 nt, Human
ccggcccugggg

SEQ ID NO: 2123145 - RNA, 18 nt, Human
ccggcaggguccuagaaa

SEQ ID NO: 2123146 - RNA, 17 nt, Human
ccggcaguucugggugc

SEQ ID NO: 2123147 - RNA, 22 nt, Human
ccggcaguucugggugcucccu

SEQ ID NO: 2123148 - RNA, 21 nt, Human
cccuuccucuccacugccuuc

SEQ ID NO: 2123149 - RNA, 14 nt, Human
cccuguccuccucg

SEQ ID NO: 2123150 - RNA, 15 nt, Human
cccuguccuccucgg

SEQ ID NO: 2123151 - RNA, 16 nt, Human
cccuguccuccucgga

SEQ ID NO: 2123152 - RNA, 17 nt, Human
ccgcccagcugcaccug

SEQ ID NO: 2123153 - RNA, 22 nt, Human
ccgcccagcugcaccugccagc

SEQ ID NO: 2123154 - RNA, 17 nt, Human
cccuuccuguccgcccu

SEQ ID NO: 2123155 - RNA, 15 nt, Human
cccuuccucuuucca

SEQ ID NO: 2123156 - RNA, 15 nt, Human
ccgaaaaucauauaa

SEQ ID NO: 2123157 - RNA, 19 nt, Human
ccgaaagggacuuggaagc

SEQ ID NO: 2123158 - RNA, 17 nt, Human
ccgaccagacaccuuga

SEQ ID NO: 2123159 - RNA, 13 nt, Human
ccgaccagacacc

SEQ ID NO: 2123160 - RNA, 15 nt, Human
ccgaccaccugccca

SEQ ID NO: 2123161 - RNA, 18 nt, Human
ccgaccagacaccuugac

SEQ ID NO: 2123162 - RNA, 17 nt, Human
ccgaauagcugggacua

SEQ ID NO: 2123163 - RNA, 16 nt, Human
ccgaauagcugggacu

SEQ ID NO: 2123164 - RNA, 19 nt, Human
ccgaaggaaaagggcuuuc

SEQ ID NO: 2123165 - RNA, 23 nt, Human
ccagagggguggguuccucuucc

SEQ ID NO: 2123166 - RNA, 13 nt, Human
ccagagagggugg

SEQ ID NO: 2123167 - RNA, 16 nt, Human
ccagagaggaaucaga

SEQ ID NO: 2123168 - RNA, 21 nt, Human
ccagagagccuggugcugcug

SEQ ID NO: 2123169 - RNA, 22 nt, Human
ccagagagccuggugcugcugc

SEQ ID NO: 2123170 - RNA, 21 nt, Human
ccagagagagaagugccccug

SEQ ID NO: 2123171 - RNA, 22 nt, Human
ccagagagagaagugccccugc

SEQ ID NO: 2123172 - RNA, 23 nt, Human
ccagagagagaagugccccugcu

SEQ ID NO: 2123173 - RNA, 14 nt, Human
ccagaucugcaccg

SEQ ID NO: 2123174 - RNA, 13 nt, Human
ccagaucuggucc

SEQ ID NO: 2123175 - RNA, 14 nt, Human
ccagauaagaaugc

SEQ ID NO: 2123176 - RNA, 21 nt, Human
ccagauacacccaaaguauca

SEQ ID NO: 2123177 - RNA, 21 nt, Human
ccagauacuucccauuuugga

SEQ ID NO: 2123178 - RNA, 19 nt, Human
ccagauauucaagucaccu

SEQ ID NO: 2123179 - RNA, 14 nt, Human
ccagaugcaccagc

SEQ ID NO: 2123180 - RNA, 13 nt, Human
ccagaugcaccag

SEQ ID NO: 2123181 - RNA, 19 nt, Human
ccagaucuggucccuugca

SEQ ID NO: 2123182 - RNA, 18 nt, Human
ccagaugcacaucccugg

SEQ ID NO: 2123183 - RNA, 21 nt, Human
ccagaugagcagaagcucucg

SEQ ID NO: 2123184 - RNA, 14 nt, Human
ccagagacaagacu

SEQ ID NO: 2123185 - RNA, 13 nt, Human
ccagagacaggaa

SEQ ID NO: 2123186 - RNA, 14 nt, Human
ccagagacaggaaa

SEQ ID NO: 2123187 - RNA, 15 nt, Human
ccagagacaggaaaa

SEQ ID NO: 2123188 - RNA, 12 nt, Human
ccagagacagga

SEQ ID NO: 2123189 - RNA, 14 nt, Human
ccagagagagaagu

SEQ ID NO: 2123190 - RNA, 18 nt, Human
ccagagagagaagugccc

SEQ ID NO: 2123191 - RNA, 19 nt, Human
ccagagagagaagugcccc

SEQ ID NO: 2123192 - RNA, 20 nt, Human
ccagagagagaagugccccu

SEQ ID NO: 2123193 - RNA, 15 nt, Human
ccagagacucagagg

SEQ ID NO: 2123194 - RNA, 23 nt, Human
ccagagacaggaaaauccucugg

SEQ ID NO: 2123195 - RNA, 23 nt, Human
ccagagaagcaucggagggaauu

SEQ ID NO: 2123196 - RNA, 14 nt, Human
ccagacuugcugaa

SEQ ID NO: 2123197 - RNA, 15 nt, Human
ccagacggcacccac

SEQ ID NO: 2123198 - RNA, 16 nt, Human
ccagacgguucaccag

SEQ ID NO: 2123199 - RNA, 16 nt, Human
ccagacggcacccacc

SEQ ID NO: 2123200 - RNA, 17 nt, Human
ccagacgguucaccagc

SEQ ID NO: 2123201 - RNA, 18 nt, Human
ccagacgguucaccagcc

SEQ ID NO: 2123202 - RNA, 19 nt, Human
ccagacgguucaccagccu

SEQ ID NO: 2123203 - RNA, 16 nt, Human
ccagacuacuugggag

SEQ ID NO: 2123204 - RNA, 20 nt, Human
ccagacgguucaccagccuc

SEQ ID NO: 2123205 - RNA, 18 nt, Human
ccagacgcacgugggucu

SEQ ID NO: 2123206 - RNA, 23 nt, Human
ccagacgcacgugggucuucagg

SEQ ID NO: 2123207 - RNA, 14 nt, Human
ccagaccuuuuauc

SEQ ID NO: 2123208 - RNA, 13 nt, Human
ccagaccugagcu

SEQ ID NO: 2123209 - RNA, 15 nt, Human
ccagaccugagcucc

SEQ ID NO: 2123210 - RNA, 16 nt, Human
ccagacccggcugcgu

SEQ ID NO: 2123211 - RNA, 17 nt, Human
ccagacccggcugcgug

SEQ ID NO: 2123212 - RNA, 21 nt, Human
ccacuuugguacauggccagu

SEQ ID NO: 2123213 - RNA, 14 nt, Human
ccacugaagcuggg

SEQ ID NO: 2123214 - RNA, 15 nt, Human
ccacugaagcuggga

SEQ ID NO: 2123215 - RNA, 16 nt, Human
ccacugaagcugggau

SEQ ID NO: 2123216 - RNA, 18 nt, Human
ccacugaagauagaagaa

SEQ ID NO: 2123217 - RNA, 19 nt, Human
ccacugaagauagaagaaa

SEQ ID NO: 2123218 - RNA, 15 nt, Human
ccacugacagccucc

SEQ ID NO: 2123219 - RNA, 16 nt, Human
ccacugacagccuccc

SEQ ID NO: 2123220 - RNA, 17 nt, Human
ccacugacagccuccca

SEQ ID NO: 2123221 - RNA, 19 nt, Human
ccacugacagccucccacc

SEQ ID NO: 2123222 - RNA, 19 nt, Human
ccacugagagaucugcugu

SEQ ID NO: 2123223 - RNA, 15 nt, Human
ccacugauggaaaca

SEQ ID NO: 2123224 - RNA, 21 nt, Human
ccacugauggaaacaaagugg

SEQ ID NO: 2123225 - RNA, 19 nt, Human
ccacugcaccgggccacag

SEQ ID NO: 2123226 - RNA, 17 nt, Human
ccacugcaccgggccac

SEQ ID NO: 2123227 - RNA, 14 nt, Human
ccacugcaccgggc

SEQ ID NO: 2123228 - RNA, 13 nt, Human
ccacugcaccggg

SEQ ID NO: 2123229 - RNA, 20 nt, Human
ccacugcacuauagccuagg

SEQ ID NO: 2123230 - RNA, 19 nt, Human
ccacugcacuauagccuag

SEQ ID NO: 2123231 - RNA, 23 nt, Human
ccacuucauucuugaaagcugug

SEQ ID NO: 2123232 - RNA, 21 nt, Human
ccacuucauucuugaaagcug

SEQ ID NO: 2123233 - RNA, 11 nt, Human
ccacugcacuc

SEQ ID NO: 2123234 - RNA, 14 nt, Human
ccacugcacuccag

SEQ ID NO: 2123235 - RNA, 17 nt, Human
ccacugcacuccagccu

SEQ ID NO: 2123236 - RNA, 21 nt, Human
ccacuuggaggccuuucaucc

SEQ ID NO: 2123237 - RNA, 23 nt, Human
ccacuugacacuauucacuaaaa

SEQ ID NO: 2123238 - RNA, 19 nt, Human
ccacuucuuguuccccacu

SEQ ID NO: 2123239 - RNA, 20 nt, Human
ccacuucuuguuccccacug

SEQ ID NO: 2123240 - RNA, 16 nt, Human
ccacuucuuuuauaac

SEQ ID NO: 2123241 - RNA, 22 nt, Human
ccaguauucuagguagugcccu

SEQ ID NO: 2123242 - RNA, 14 nt, Human
ccaguccugccugg

SEQ ID NO: 2123243 - RNA, 15 nt, Human
ccaguccugccuggc

SEQ ID NO: 2123244 - RNA, 16 nt, Human
ccaguccugccuggcc

SEQ ID NO: 2123245 - RNA, 17 nt, Human
ccaguccugccuggcca

SEQ ID NO: 2123246 - RNA, 12 nt, Human
ccaguccugcuc

SEQ ID NO: 2123247 - RNA, 13 nt, Human
ccaguccugcucu

SEQ ID NO: 2123248 - RNA, 14 nt, Human
ccaguccugcucuc

SEQ ID NO: 2123249 - RNA, 15 nt, Human
ccaguccugcucucu

SEQ ID NO: 2123250 - RNA, 18 nt, Human
ccaguccugccuggccag

SEQ ID NO: 2123251 - RNA, 19 nt, Human
ccaguccugccuggccagg

SEQ ID NO: 2123252 - RNA, 21 nt, Human
ccaguccugccuggccaggca

SEQ ID NO: 2123253 - RNA, 22 nt, Human
ccaguccugccuggccaggcag

SEQ ID NO: 2123254 - RNA, 17 nt, Human
ccaggcugcauagaagg

SEQ ID NO: 2123255 - RNA, 18 nt, Human
ccaggcugcauagaagga

SEQ ID NO: 2123256 - RNA, 21 nt, Human
ccaggcugcauagaaggagga

SEQ ID NO: 2123257 - RNA, 13 nt, Human
ccaggcugccaag

SEQ ID NO: 2123258 - RNA, 16 nt, Human
ccaggggaugggaggu

SEQ ID NO: 2123259 - RNA, 23 nt, Human
ccaggcagaucugugccccaugc

SEQ ID NO: 2123260 - RNA, 21 nt, Human
ccaggcagaucugugccccau

SEQ ID NO: 2123261 - RNA, 14 nt, Human
ccaggcaggcugug

SEQ ID NO: 2123262 - RNA, 21 nt, Human
ccaggaguuuaagaccagccu

SEQ ID NO: 2123263 - RNA, 23 nt, Human
ccaggaguuuaagaccagccugg

SEQ ID NO: 2123264 - RNA, 17 nt, Human
ccaggaguuugagacca

SEQ ID NO: 2123265 - RNA, 18 nt, Human
ccaggaguuugagaccag

SEQ ID NO: 2123266 - RNA, 17 nt, Human
ccaggaguuugaggcug

SEQ ID NO: 2123267 - RNA, 20 nt, Human
ccaggaguuugaggcugcag

SEQ ID NO: 2123268 - RNA, 21 nt, Human
ccaggaguuugaggcugcagc

SEQ ID NO: 2123269 - RNA, 22 nt, Human
ccaggaguuugaggcugcagcg

SEQ ID NO: 2123270 - RNA, 14 nt, Human
ccagcuugcucuuc

SEQ ID NO: 2123271 - RNA, 16 nt, Human
ccagcuugcucuucag

SEQ ID NO: 2123272 - RNA, 23 nt, Human
ccagcuugcucuucagugggaga

SEQ ID NO: 2123273 - RNA, 21 nt, Human
ccagcggcuggugcagggccu

SEQ ID NO: 2123274 - RNA, 22 nt, Human
ccagcggcuggugcagggccuc

SEQ ID NO: 2123275 - RNA, 22 nt, Human
ccagcgccuaguggggucuccc

SEQ ID NO: 2123276 - RNA, 13 nt, Human
ccagcggcugagu

SEQ ID NO: 2123277 - RNA, 16 nt, Human
ccagcuuguuauuuau

SEQ ID NO: 2123278 - RNA, 15 nt, Human
ccagcuuguuauuua

SEQ ID NO: 2123279 - RNA, 17 nt, Human
ccagcuuguuauuuaua

SEQ ID NO: 2123280 - RNA, 21 nt, Human
ccagcgagcccugguggcagu

SEQ ID NO: 2123281 - RNA, 13 nt, Human
ccagcagccugga

SEQ ID NO: 2123282 - RNA, 11 nt, Human
ccagcagccug

SEQ ID NO: 2123283 - RNA, 12 nt, Human
ccagcagccugg

SEQ ID NO: 2123284 - RNA, 18 nt, Human
cccagggccacucugccu

SEQ ID NO: 2123285 - RNA, 15 nt, Human
cccagggccagggcc

SEQ ID NO: 2123286 - RNA, 17 nt, Human
cccagggccagggcccu

SEQ ID NO: 2123287 - RNA, 18 nt, Human
cccagggccagggcccug

SEQ ID NO: 2123288 - RNA, 23 nt, Human
cccagggccacucugccucugcc

SEQ ID NO: 2123289 - RNA, 20 nt, Human
cccagggccagggcccugca

SEQ ID NO: 2123290 - RNA, 20 nt, Human
cccauccagucucccaacuu

SEQ ID NO: 2123291 - RNA, 13 nt, Human
cccaucccacacc

SEQ ID NO: 2123292 - RNA, 15 nt, Human
cccaucccacacccu

SEQ ID NO: 2123293 - RNA, 12 nt, Human
cccaucccaucc

SEQ ID NO: 2123294 - RNA, 13 nt, Human
cccaucccauccc

SEQ ID NO: 2123295 - RNA, 14 nt, Human
cccaucccauccca

SEQ ID NO: 2123296 - RNA, 15 nt, Human
cccaucccaucccau

SEQ ID NO: 2123297 - RNA, 16 nt, Human
cccaucccaucccauc

SEQ ID NO: 2123298 - RNA, 18 nt, Human
cccaucccaucccauccc

SEQ ID NO: 2123299 - RNA, 20 nt, Human
cccaggcuggcgugcagugg

SEQ ID NO: 2123300 - RNA, 19 nt, Human
cccaggcuggcgugcagug

SEQ ID NO: 2123301 - RNA, 21 nt, Human
cccagggauuuguccuugggg

SEQ ID NO: 2123302 - RNA, 21 nt, Human
cccagggagcggaaagcagcu

SEQ ID NO: 2123303 - RNA, 22 nt, Human
cccagggagcggaaagcagcuc

SEQ ID NO: 2123304 - RNA, 15 nt, Human
cccagcugucugugu

SEQ ID NO: 2123305 - RNA, 16 nt, Human
cccagcugucuguguc

SEQ ID NO: 2123306 - RNA, 23 nt, Human
cccagcugucugugucagccugu

SEQ ID NO: 2123307 - RNA, 18 nt, Human
cccaggcuggcgugcagu

SEQ ID NO: 2123308 - RNA, 22 nt, Human
cccagcccauucucucuccugu

SEQ ID NO: 2123309 - RNA, 16 nt, Human
cccagcuggugggaag

SEQ ID NO: 2123310 - RNA, 19 nt, Human
cccagcuggugggaagcgu

SEQ ID NO: 2123311 - RNA, 22 nt, Human
cccagcuggugggaagcgucug

SEQ ID NO: 2123312 - RNA, 16 nt, Human
cccagcaguuugggag

SEQ ID NO: 2123313 - RNA, 19 nt, Human
cccagcagguggggagggg

SEQ ID NO: 2123314 - RNA, 21 nt, Human
cccagcauccuuuucugcaga

SEQ ID NO: 2123315 - RNA, 17 nt, Human
cccagccaaacccuguc

SEQ ID NO: 2123316 - RNA, 19 nt, Human
cccagcccacuucugccau

SEQ ID NO: 2123317 - RNA, 12 nt, Human
cccagccacccc

SEQ ID NO: 2123318 - RNA, 17 nt, Human
cccagcccacuucugcc

SEQ ID NO: 2123319 - RNA, 17 nt, Human
cccagcccagcccagcu

SEQ ID NO: 2123320 - RNA, 12 nt, Human
cccagcccagcu

SEQ ID NO: 2123321 - RNA, 13 nt, Human
cccagcccagcug

SEQ ID NO: 2123322 - RNA, 15 nt, Human
cccagcccagcugcu

SEQ ID NO: 2123323 - RNA, 16 nt, Human
cccagcccagcugcuc

SEQ ID NO: 2123324 - RNA, 18 nt, Human
cccagcccagcugcucug

SEQ ID NO: 2123325 - RNA, 20 nt, Human
cccagcccagcugcucugcc

SEQ ID NO: 2123326 - RNA, 22 nt, Human
cccagcccagcugcucugccca

SEQ ID NO: 2123327 - RNA, 16 nt, Human
cccagcccagcuggug

SEQ ID NO: 2123328 - RNA, 21 nt, Human
cccagcccaggguucccccag

SEQ ID NO: 2123329 - RNA, 21 nt, Human
cccagcccauucucucuccug

SEQ ID NO: 2123330 - RNA, 18 nt, Human
cccagcccagcugguggg

SEQ ID NO: 2123331 - RNA, 13 nt, Human
cccagcccaucuu

SEQ ID NO: 2123332 - RNA, 16 nt, Human
cccagcccaucuugcc

SEQ ID NO: 2123333 - RNA, 21 nt, Human
cccagcccaucuugccuccau

SEQ ID NO: 2123334 - RNA, 23 nt, Human
cccauucugccugcccaggcccc

SEQ ID NO: 2123335 - RNA, 23 nt, Human
ccccaaaaccacagcccugucag

SEQ ID NO: 2123336 - RNA, 20 nt, Human
ccccaaaaccacagcccugu

SEQ ID NO: 2123337 - RNA, 22 nt, Human
ccccaaaaccacagcccuguca

SEQ ID NO: 2123338 - RNA, 12 nt, Human
ccccagcaggug

SEQ ID NO: 2123339 - RNA, 11 nt, Human
ccccagcaggu

SEQ ID NO: 2123340 - RNA, 15 nt, Human
ccccaaaaccacagc

SEQ ID NO: 2123341 - RNA, 16 nt, Human
ccccaaaaccacagcc

SEQ ID NO: 2123342 - RNA, 19 nt, Human
ccccaaaaccacagcccug

SEQ ID NO: 2123343 - RNA, 20 nt, Human
ccccaaaaaccucacccgag

SEQ ID NO: 2123344 - RNA, 11 nt, Human
cccauucuuug

SEQ ID NO: 2123345 - RNA, 20 nt, Human
cccauucuuugcuugaacac

SEQ ID NO: 2123346 - RNA, 21 nt, Human
cccauucuuugcuugaacaca

SEQ ID NO: 2123347 - RNA, 14 nt, Human
cccauugcccuggu

SEQ ID NO: 2123348 - RNA, 21 nt, Human
ccccauucugccugcccaggc

SEQ ID NO: 2123349 - RNA, 11 nt, Human
ccccagcccac

SEQ ID NO: 2123350 - RNA, 13 nt, Human
ccccgccccgccc

SEQ ID NO: 2123351 - RNA, 16 nt, Human
ccccgcucaugggccc

SEQ ID NO: 2123352 - RNA, 23 nt, Human
ccccgcucaugggccccucugac

SEQ ID NO: 2123353 - RNA, 13 nt, Human
ccccgccccacau

SEQ ID NO: 2123354 - RNA, 16 nt, Human
ccccgccccacauucc

SEQ ID NO: 2123355 - RNA, 17 nt, Human
ccccgccccacauuccg

SEQ ID NO: 2123356 - RNA, 20 nt, Human
ccccgccccacauuccgaca

SEQ ID NO: 2123357 - RNA, 16 nt, Human
ccccgccccgccccac

SEQ ID NO: 2123358 - RNA, 17 nt, Human
ccccgcauuccaggcuc

SEQ ID NO: 2123359 - RNA, 17 nt, Human
ccccgcccagcugcacc

SEQ ID NO: 2123360 - RNA, 23 nt, Human
ccccgcccagcugcaccugccag

SEQ ID NO: 2123361 - RNA, 13 nt, Human
cccccuucuccca

SEQ ID NO: 2123362 - RNA, 14 nt, Human
cccccuucucccac

SEQ ID NO: 2123363 - RNA, 15 nt, Human
cccccuucucccaca

SEQ ID NO: 2123364 - RNA, 17 nt, Human
cccccuucucccacacu

SEQ ID NO: 2123365 - RNA, 21 nt, Human
cccccuucucugcccauuccc

SEQ ID NO: 2123366 - RNA, 15 nt, Human
cccccuucucugcuc

SEQ ID NO: 2123367 - RNA, 16 nt, Human
cccccuucucugcucc

SEQ ID NO: 2123368 - RNA, 17 nt, Human
cccccuucucugcucca

SEQ ID NO: 2123369 - RNA, 22 nt, Human
cccccuucucugcuccaccaca

SEQ ID NO: 2123370 - RNA, 15 nt, Human
cccccuucagugccc

SEQ ID NO: 2123371 - RNA, 23 nt, Human
cccccuucagugcccaccaacau

SEQ ID NO: 2123372 - RNA, 14 nt, Human
cccccuucagugcc

SEQ ID NO: 2123373 - RNA, 21 nt, Human
ccccauucuuugcuugaacac

SEQ ID NO: 2123374 - RNA, 22 nt, Human
ccccauucuuugcuugaacaca

SEQ ID NO: 2123375 - RNA, 21 nt, Human
cccaagaauagaugcugacug

SEQ ID NO: 2123376 - RNA, 20 nt, Human
cccaagaauagaugcugacu

SEQ ID NO: 2123377 - RNA, 17 nt, Human
cccaagcucugcuccuc

SEQ ID NO: 2123378 - RNA, 11 nt, Human
cccaagcugga

SEQ ID NO: 2123379 - RNA, 19 nt, Human
cccaagcuggagugcagug

SEQ ID NO: 2123380 - RNA, 22 nt, Human
cccaagcuggagugcaguggug

SEQ ID NO: 2123381 - RNA, 17 nt, Human
cccacccccuccccagg

SEQ ID NO: 2123382 - RNA, 19 nt, Human
cccacccccuccccagggg

SEQ ID NO: 2123383 - RNA, 19 nt, Human
cccacccccuucagugccc

SEQ ID NO: 2123384 - RNA, 23 nt, Human
cccacccccuucagugcccacca

SEQ ID NO: 2123385 - RNA, 16 nt, Human
cccacccccuucucug

SEQ ID NO: 2123386 - RNA, 19 nt, Human
cccacccccuucucugcuc

SEQ ID NO: 2123387 - RNA, 22 nt, Human
cccacccccuucucugcuccac

SEQ ID NO: 2123388 - RNA, 18 nt, Human
cccaccaucaugucuggc

SEQ ID NO: 2123389 - RNA, 14 nt, Human
cccaaggaaagccc

SEQ ID NO: 2123390 - RNA, 19 nt, Human
cccaaggaaagccccagca

SEQ ID NO: 2123391 - RNA, 18 nt, Human
cccaccaugucugcccca

SEQ ID NO: 2123392 - RNA, 15 nt, Human
ccauugucucagagc

SEQ ID NO: 2123393 - RNA, 12 nt, Human
ccauugucuuua

SEQ ID NO: 2123394 - RNA, 14 nt, Human
ccauugucuuuaua

SEQ ID NO: 2123395 - RNA, 18 nt, Human
ccauugucuuuauaugaa

SEQ ID NO: 2123396 - RNA, 20 nt, Human
ccauugucuuuauaugaaca

SEQ ID NO: 2123397 - RNA, 22 nt, Human
ccauugucuuuauaugaacaua

SEQ ID NO: 2123398 - RNA, 23 nt, Human
ccauugucuuuauaugaacauag

SEQ ID NO: 2123399 - RNA, 23 nt, Human
cccaaccugcucuccucuugcca

SEQ ID NO: 2123400 - RNA, 15 nt, Human
cccaacgaaaagcac

SEQ ID NO: 2123401 - RNA, 16 nt, Human
cccaacgaaaagcaca

SEQ ID NO: 2123402 - RNA, 19 nt, Human
cccaacgaaaagcacaucc

SEQ ID NO: 2123403 - RNA, 14 nt, Human
cccaagaacagcag

SEQ ID NO: 2123404 - RNA, 22 nt, Human
cccaagaacagcaggcccaccu

SEQ ID NO: 2123405 - RNA, 23 nt, Human
cccaagaacagcaggcccaccua

SEQ ID NO: 2123406 - RNA, 14 nt, Human
cccaagaaggcugg

SEQ ID NO: 2123407 - RNA, 15 nt, Human
cccaagaaggcuggg

SEQ ID NO: 2123408 - RNA, 16 nt, Human
cccaagaaggcugggg

SEQ ID NO: 2123409 - RNA, 12 nt, Human
cccaacuguuau

SEQ ID NO: 2123410 - RNA, 21 nt, Human
cccaacugcaagucacaaagg

SEQ ID NO: 2123411 - RNA, 21 nt, Human
cccaaccugcucuccucuugc

SEQ ID NO: 2123412 - RNA, 14 nt, Human
cccaaccugcucuc

SEQ ID NO: 2123413 - RNA, 13 nt, Human
cccaaccugcucu

SEQ ID NO: 2123414 - RNA, 12 nt, Human
ccauugugugag

SEQ ID NO: 2123415 - RNA, 22 nt, Human
cccaaggaaagccccagcacua

SEQ ID NO: 2123416 - RNA, 13 nt, Human
ccaugagccucag

SEQ ID NO: 2123417 - RNA, 18 nt, Human
ccaugacuugagaaacaa

SEQ ID NO: 2123418 - RNA, 15 nt, Human
ccaugacugcauuuu

SEQ ID NO: 2123419 - RNA, 17 nt, Human
ccaugacugcauuuuac

SEQ ID NO: 2123420 - RNA, 16 nt, Human
ccaugucucucagaau

SEQ ID NO: 2123421 - RNA, 17 nt, Human
ccaugucugccccauca

SEQ ID NO: 2123422 - RNA, 13 nt, Human
ccaugggggcagg

SEQ ID NO: 2123423 - RNA, 14 nt, Human
ccaugggggcaggg

SEQ ID NO: 2123424 - RNA, 17 nt, Human
ccaugggccuccugugu

SEQ ID NO: 2123425 - RNA, 20 nt, Human
caauuggauacgacaacuug

SEQ ID NO: 2123426 - RNA, 18 nt, Human
caaugcugcgucucccau

SEQ ID NO: 2123427 - RNA, 12 nt, Human
caaugcuggcug

SEQ ID NO: 2123428 - RNA, 19 nt, Human
caauuguaaaacugaggca

SEQ ID NO: 2123429 - RNA, 22 nt, Human
caauugggauggcgcuaggcau

SEQ ID NO: 2123430 - RNA, 15 nt, Human
caauggcagccuugg

SEQ ID NO: 2123431 - RNA, 14 nt, Human
caauggcagccuug

SEQ ID NO: 2123432 - RNA, 13 nt, Human
caauggcagccuu

SEQ ID NO: 2123433 - RNA, 15 nt, Human
caaugcgaaugguag

SEQ ID NO: 2123434 - RNA, 19 nt, Human
caaugcgaaugguagucua

SEQ ID NO: 2123435 - RNA, 16 nt, Human
caaucagauuuuccug

SEQ ID NO: 2123436 - RNA, 15 nt, Human
caaucaacucuaaua

SEQ ID NO: 2123437 - RNA, 12 nt, Human
caaucaagauaa

SEQ ID NO: 2123438 - RNA, 16 nt, Human
caaucaagauaaagga

SEQ ID NO: 2123439 - RNA, 17 nt, Human
caaucaagauaaaggac

SEQ ID NO: 2123440 - RNA, 14 nt, Human
caaucaaaucugcu

SEQ ID NO: 2123441 - RNA, 18 nt, Human
caaucaaaggaaaauagu

SEQ ID NO: 2123442 - RNA, 17 nt, Human
caauauuguacaguuuu

SEQ ID NO: 2123443 - RNA, 18 nt, Human
caauauuguacaguuuuu

SEQ ID NO: 2123444 - RNA, 14 nt, Human
caauauuguuucua

SEQ ID NO: 2123445 - RNA, 15 nt, Human
caauauuuaaggaga

SEQ ID NO: 2123446 - RNA, 16 nt, Human
caauauuuaaggagau

SEQ ID NO: 2123447 - RNA, 19 nt, Human
caauauuuaaggagaugua

SEQ ID NO: 2123448 - RNA, 22 nt, Human
caauauuuaaggagauguaaga

SEQ ID NO: 2123449 - RNA, 13 nt, Human
caauauuuauuau

SEQ ID NO: 2123450 - RNA, 14 nt, Human
caauauuuauuauu

SEQ ID NO: 2123451 - RNA, 12 nt, Human
caauauuuauua

SEQ ID NO: 2123452 - RNA, 11 nt, Human
caauauuuucc

SEQ ID NO: 2123453 - RNA, 13 nt, Human
caauauuuuccau

SEQ ID NO: 2123454 - RNA, 15 nt, Human
caauauuuuccauga

SEQ ID NO: 2123455 - RNA, 13 nt, Human
caauauuuguaga

SEQ ID NO: 2123456 - RNA, 14 nt, Human
caauauuuguagaa

SEQ ID NO: 2123457 - RNA, 15 nt, Human
caauauuuguagaag

SEQ ID NO: 2123458 - RNA, 11 nt, Human
caauauuuuaa

SEQ ID NO: 2123459 - RNA, 13 nt, Human
caauauuuuaagc

SEQ ID NO: 2123460 - RNA, 14 nt, Human
caauauuuuaagca

SEQ ID NO: 2123461 - RNA, 16 nt, Human
caauauuuuaagcauu

SEQ ID NO: 2123462 - RNA, 17 nt, Human
caauauuuuaagcauua

SEQ ID NO: 2123463 - RNA, 23 nt, Human
caauauuuuaagcauuacucuug

SEQ ID NO: 2123464 - RNA, 16 nt, Human
caauauuuuccaugaa

SEQ ID NO: 2123465 - RNA, 19 nt, Human
caauauuuuccaugaaaau

SEQ ID NO: 2123466 - RNA, 20 nt, Human
caauauuuuccaugaaaaug

SEQ ID NO: 2123467 - RNA, 22 nt, Human
caauauuuuccaugaaaaugca

SEQ ID NO: 2123468 - RNA, 15 nt, Human
caauauuguacaguu

SEQ ID NO: 2123469 - RNA, 16 nt, Human
caauauuguacaguuu

SEQ ID NO: 2123470 - RNA, 18 nt, Human
caauugugagccaccacg

SEQ ID NO: 2123471 - RNA, 21 nt, Human
caauugugagccaccacgucc

SEQ ID NO: 2123472 - RNA, 14 nt, Human
caauuuauucaaga

SEQ ID NO: 2123473 - RNA, 17 nt, Human
caauuuauucaagaaaa

SEQ ID NO: 2123474 - RNA, 16 nt, Human
caauuuauugcacaaa

SEQ ID NO: 2123475 - RNA, 22 nt, Human
caauuuauugcacaaaauauaa

SEQ ID NO: 2123476 - RNA, 13 nt, Human
caauuuauuuuau

SEQ ID NO: 2123477 - RNA, 14 nt, Human
caauuuauuuuauu

SEQ ID NO: 2123478 - RNA, 19 nt, Human
caauuuauuuuauuuuagc

SEQ ID NO: 2123479 - RNA, 16 nt, Human
caagcucugcuccucu

SEQ ID NO: 2123480 - RNA, 15 nt, Human
caagcucugcuccuc

SEQ ID NO: 2123481 - RNA, 17 nt, Human
caagcuccaucuccacu

SEQ ID NO: 2123482 - RNA, 21 nt, Human
caagcuccaucuccacuccag

SEQ ID NO: 2123483 - RNA, 20 nt, Human
caaggauugcuacuguccua

SEQ ID NO: 2123484 - RNA, 19 nt, Human
caaggauugcuacuguccu

SEQ ID NO: 2123485 - RNA, 17 nt, Human
caaggccagaguggccu

SEQ ID NO: 2123486 - RNA, 19 nt, Human
caaggccagcaagguggag

SEQ ID NO: 2123487 - RNA, 21 nt, Human
caaggccagcaagguggagug

SEQ ID NO: 2123488 - RNA, 22 nt, Human
caaggccagcaagguggagugg

SEQ ID NO: 2123489 - RNA, 23 nt, Human
caaggccagcaagguggagugga

SEQ ID NO: 2123490 - RNA, 21 nt, Human
caaggccagaguggccuggcc

SEQ ID NO: 2123491 - RNA, 22 nt, Human
caaggccagaguggccuggcca

SEQ ID NO: 2123492 - RNA, 18 nt, Human
caaggccagaguggccug

SEQ ID NO: 2123493 - RNA, 19 nt, Human
caaggccagaguggccugg

SEQ ID NO: 2123494 - RNA, 20 nt, Human
caaggccagaguggccuggc

SEQ ID NO: 2123495 - RNA, 18 nt, Human
caaguaagaagacaugaa

SEQ ID NO: 2123496 - RNA, 14 nt, Human
caaguaagaagaca

SEQ ID NO: 2123497 - RNA, 16 nt, Human
caaguaagaagacaug

SEQ ID NO: 2123498 - RNA, 13 nt, Human
caaguaagaagac

SEQ ID NO: 2123499 - RNA, 22 nt, Human
caaguaagaagacaugaaccaa

SEQ ID NO: 2123500 - RNA, 12 nt, Human
caaggccccaga

SEQ ID NO: 2123501 - RNA, 14 nt, Human
caaggccccagaga

SEQ ID NO: 2123502 - RNA, 15 nt, Human
caaggccccagagac

SEQ ID NO: 2123503 - RNA, 16 nt, Human
caaggccccagagacu

SEQ ID NO: 2123504 - RNA, 17 nt, Human
caaggccccagagacuc

SEQ ID NO: 2123505 - RNA, 21 nt, Human
caaggccccagagacucagag

SEQ ID NO: 2123506 - RNA, 21 nt, Human
caaguuccucuagugcccucc

SEQ ID NO: 2123507 - RNA, 12 nt, Human
caaguucaagga

SEQ ID NO: 2123508 - RNA, 14 nt, Human
caaguucaaggacc

SEQ ID NO: 2123509 - RNA, 14 nt, Human
caaguauucugccu

SEQ ID NO: 2123510 - RNA, 15 nt, Human
caaguauucugccuu

SEQ ID NO: 2123511 - RNA, 18 nt, Human
caaguauucugccuuugc

SEQ ID NO: 2123512 - RNA, 23 nt, Human
caaguauucugccuuugcagaaa

SEQ ID NO: 2123513 - RNA, 15 nt, Human
caaguuauuaauuuc

SEQ ID NO: 2123514 - RNA, 21 nt, Human
caaguuauuaauuucuucaca

SEQ ID NO: 2123515 - RNA, 19 nt, Human
caaguuauugacaaacucu

SEQ ID NO: 2123516 - RNA, 23 nt, Human
caaguaaauagcaacaugcuuca

SEQ ID NO: 2123517 - RNA, 13 nt, Human
caagcaagaaaca

SEQ ID NO: 2123518 - RNA, 19 nt, Human
caagcaaaggugaagagac

SEQ ID NO: 2123519 - RNA, 14 nt, Human
caagcaaauguuac

SEQ ID NO: 2123520 - RNA, 15 nt, Human
caagcaaauguuaca

SEQ ID NO: 2123521 - RNA, 18 nt, Human
caagcaagaaacacuggg

SEQ ID NO: 2123522 - RNA, 14 nt, Human
caagcaauccuccu

SEQ ID NO: 2123523 - RNA, 15 nt, Human
caagcaauccuccug

SEQ ID NO: 2123524 - RNA, 17 nt, Human
caagcaauccuccugag

SEQ ID NO: 2123525 - RNA, 19 nt, Human
caagauccugucuuuaagg

SEQ ID NO: 2123526 - RNA, 11 nt, Human
caagaccaaaa

SEQ ID NO: 2123527 - RNA, 18 nt, Human
caagaccaaaaugacaau

SEQ ID NO: 2123528 - RNA, 15 nt, Human
caagaucuuucagga

SEQ ID NO: 2123529 - RNA, 19 nt, Human
caagaugagagaacuggag

SEQ ID NO: 2123530 - RNA, 22 nt, Human
caagauccugucuuuaaggaaa

SEQ ID NO: 2123531 - RNA, 12 nt, Human
caagaucuuuca

SEQ ID NO: 2123532 - RNA, 13 nt, Human
caagaucuuucag

SEQ ID NO: 2123533 - RNA, 14 nt, Human
caagaucuuucagg

SEQ ID NO: 2123534 - RNA, 18 nt, Human
caagaugccaucuguguc

SEQ ID NO: 2123535 - RNA, 22 nt, Human
caagauuuugaaugcuuccuga

SEQ ID NO: 2123536 - RNA, 16 nt, Human
caagcaaaaggagaga

SEQ ID NO: 2123537 - RNA, 13 nt, Human
caagcaccuccug

SEQ ID NO: 2123538 - RNA, 17 nt, Human
caagcacaucugcauuu

SEQ ID NO: 2123539 - RNA, 20 nt, Human
caagcacaucugcauuuuca

SEQ ID NO: 2123540 - RNA, 17 nt, Human
caagcacagugccugca

SEQ ID NO: 2123541 - RNA, 16 nt, Human
caagcaccagggaaga

SEQ ID NO: 2123542 - RNA, 18 nt, Human
caagcaccuagccucgcu

SEQ ID NO: 2123543 - RNA, 14 nt, Human
caagcaccuccugc

SEQ ID NO: 2123544 - RNA, 16 nt, Human
caaccccuucgcuccu

SEQ ID NO: 2123545 - RNA, 14 nt, Human
caaccccuucgcuc

SEQ ID NO: 2123546 - RNA, 17 nt, Human
caaccccuucgcuccug

SEQ ID NO: 2123547 - RNA, 21 nt, Human
caaccccuguggagcccgcac

SEQ ID NO: 2123548 - RNA, 17 nt, Human
caacuaggcuucagcau

SEQ ID NO: 2123549 - RNA, 22 nt, Human
caaccccuguggagcccgcacc

SEQ ID NO: 2123550 - RNA, 18 nt, Human
caacuauauuaucaugca

SEQ ID NO: 2123551 - RNA, 19 nt, Human
caacuauauuaucaugcaa

SEQ ID NO: 2123552 - RNA, 14 nt, Human
caacccccagccug

SEQ ID NO: 2123553 - RNA, 17 nt, Human
caacccccaccccacac

SEQ ID NO: 2123554 - RNA, 18 nt, Human
caacccccaccccacacu

SEQ ID NO: 2123555 - RNA, 23 nt, Human
caacccccaccccacacuuguuc

SEQ ID NO: 2123556 - RNA, 11 nt, Human
caacccccacc

SEQ ID NO: 2123557 - RNA, 12 nt, Human
caacccccaccc

SEQ ID NO: 2123558 - RNA, 13 nt, Human
caacccccacccc

SEQ ID NO: 2123559 - RNA, 14 nt, Human
caacccccacccca

SEQ ID NO: 2123560 - RNA, 17 nt, Human
caacuccaguacuggag

SEQ ID NO: 2123561 - RNA, 19 nt, Human
caacuccaguacuggagcu

SEQ ID NO: 2123562 - RNA, 20 nt, Human
caacuccaguacuggagcuu

SEQ ID NO: 2123563 - RNA, 22 nt, Human
caacuccaguacuggagcuucu

SEQ ID NO: 2123564 - RNA, 11 nt, Human
caagacauugu

SEQ ID NO: 2123565 - RNA, 13 nt, Human
caagacauuguca

SEQ ID NO: 2123566 - RNA, 14 nt, Human
caagacauugucaa

SEQ ID NO: 2123567 - RNA, 17 nt, Human
caagacauugucaauaa

SEQ ID NO: 2123568 - RNA, 18 nt, Human
caagacauugucaauaaa

SEQ ID NO: 2123569 - RNA, 18 nt, Human
caagaaucagugcaaaga

SEQ ID NO: 2123570 - RNA, 19 nt, Human
caagaaucagugcaaagau

SEQ ID NO: 2123571 - RNA, 18 nt, Human
caagaauagaugcugacu

SEQ ID NO: 2123572 - RNA, 16 nt, Human
cacggaagagccuugc

SEQ ID NO: 2123573 - RNA, 22 nt, Human
cacggaagagccuugcggaagg

SEQ ID NO: 2123574 - RNA, 17 nt, Human
cacgcuuucuagcuguu

SEQ ID NO: 2123575 - RNA, 20 nt, Human
cacggaaaaugccaaucucu

SEQ ID NO: 2123576 - RNA, 16 nt, Human
cacuccagaccccugg

SEQ ID NO: 2123577 - RNA, 14 nt, Human
cacuccagaccccu

SEQ ID NO: 2123578 - RNA, 10 nt, Human
cacuccacca

SEQ ID NO: 2123579 - RNA, 11 nt, Human
cacuccaccac

SEQ ID NO: 2123580 - RNA, 19 nt, Human
cacuccaccacccaaaagu

SEQ ID NO: 2123581 - RNA, 15 nt, Human
cacuagaacucucca

SEQ ID NO: 2123582 - RNA, 17 nt, Human
cacuagaacucuccauc

SEQ ID NO: 2123583 - RNA, 21 nt, Human
cacuacugcuaccacaacuau

SEQ ID NO: 2123584 - RNA, 15 nt, Human
cacgcuggagugcag

SEQ ID NO: 2123585 - RNA, 20 nt, Human
cacgcuggagugcagugagc

SEQ ID NO: 2123586 - RNA, 18 nt, Human
cacgcuggagugcaguga

SEQ ID NO: 2123587 - RNA, 17 nt, Human
cacgcuggagugcagug

SEQ ID NO: 2123588 - RNA, 16 nt, Human
cacgcuggagugcagu

SEQ ID NO: 2123589 - RNA, 13 nt, Human
cacgcugucucca

SEQ ID NO: 2123590 - RNA, 14 nt, Human
cacgcugucuccag

SEQ ID NO: 2123591 - RNA, 15 nt, Human
cacgcugucuccaga

SEQ ID NO: 2123592 - RNA, 16 nt, Human
cacgcugucuccagac

SEQ ID NO: 2123593 - RNA, 17 nt, Human
cacgcugucuccagacc

SEQ ID NO: 2123594 - RNA, 21 nt, Human
cacgcuggagugcagugagcc

SEQ ID NO: 2123595 - RNA, 19 nt, Human
cacgcuugacaggacagca

SEQ ID NO: 2123596 - RNA, 22 nt, Human
cacgcuugacaggacagcaugg

SEQ ID NO: 2123597 - RNA, 14 nt, Human
cacgcuuucuagcu

SEQ ID NO: 2123598 - RNA, 18 nt, Human
cacgcugucuccagaccc

SEQ ID NO: 2123599 - RNA, 19 nt, Human
cacgcugucuccagacccc

SEQ ID NO: 2123600 - RNA, 20 nt, Human
cacgcugucuccagaccccc

SEQ ID NO: 2123601 - RNA, 23 nt, Human
cacgcugucuccagacccccacc

SEQ ID NO: 2123602 - RNA, 16 nt, Human
cacgcugugggcaggu

SEQ ID NO: 2123603 - RNA, 18 nt, Human
cacgcugugggcaggugg

SEQ ID NO: 2123604 - RNA, 22 nt, Human
cacgcugugggcaggugggagc

SEQ ID NO: 2123605 - RNA, 19 nt, Human
cacugaaguuaacagagac

SEQ ID NO: 2123606 - RNA, 22 nt, Human
cacugaaguuaacagagacaga

SEQ ID NO: 2123607 - RNA, 20 nt, Human
cacugaaggcuuucagggcc

SEQ ID NO: 2123608 - RNA, 21 nt, Human
cacugaaggcuuucagggccu

SEQ ID NO: 2123609 - RNA, 22 nt, Human
cacugaaggcuuucagggccuc

SEQ ID NO: 2123610 - RNA, 17 nt, Human
cacugaagcuuuuuagu

SEQ ID NO: 2123611 - RNA, 17 nt, Human
cacugaagcugggauuc

SEQ ID NO: 2123612 - RNA, 14 nt, Human
cacugaagauagaa

SEQ ID NO: 2123613 - RNA, 16 nt, Human
cacugaagauagaaga

SEQ ID NO: 2123614 - RNA, 17 nt, Human
cacugaagauagaagaa

SEQ ID NO: 2123615 - RNA, 13 nt, Human
cacugaagcuggg

SEQ ID NO: 2123616 - RNA, 17 nt, Human
cacuccagaccccuggc

SEQ ID NO: 2123617 - RNA, 14 nt, Human
cacuccaccaccca

SEQ ID NO: 2123618 - RNA, 15 nt, Human
cacuccaccacccaa

SEQ ID NO: 2123619 - RNA, 18 nt, Human
cacuccaccacccaaaag

SEQ ID NO: 2123620 - RNA, 12 nt, Human
cacccugcucuc

SEQ ID NO: 2123621 - RNA, 11 nt, Human
cacccuggaau

SEQ ID NO: 2123622 - RNA, 21 nt, Human
cacccuggaggauuucaucuc

SEQ ID NO: 2123623 - RNA, 17 nt, Human
cacccugauuucuugcu

SEQ ID NO: 2123624 - RNA, 16 nt, Human
cacccucgaagcgcgc

SEQ ID NO: 2123625 - RNA, 24 nt, Human
cacccucgaagcgcgccacucgcu

SEQ ID NO: 2123626 - RNA, 19 nt, Human
cacccucgaagcgcgccac

SEQ ID NO: 2123627 - RNA, 23 nt, Human
cacccucgaagcgcgccacucgc

SEQ ID NO: 2123628 - RNA, 12 nt, Human
cacccuccuuuc

SEQ ID NO: 2123629 - RNA, 22 nt, Human
caccugccagccuggcuucugg

SEQ ID NO: 2123630 - RNA, 14 nt, Human
caccuauaauacca

SEQ ID NO: 2123631 - RNA, 20 nt, Human
caccuauaauaccagcuacu

SEQ ID NO: 2123632 - RNA, 16 nt, Human
caccuauagucccagc

SEQ ID NO: 2123633 - RNA, 18 nt, Human
caccugccacuaggcugg

SEQ ID NO: 2123634 - RNA, 21 nt, Human
caccugccacuaggcugggug

SEQ ID NO: 2123635 - RNA, 23 nt, Human
caccugccacuaggcugggugcc

SEQ ID NO: 2123636 - RNA, 13 nt, Human
caccugccagccu

SEQ ID NO: 2123637 - RNA, 14 nt, Human
caccugccagccug

SEQ ID NO: 2123638 - RNA, 15 nt, Human
caccugccagccugg

SEQ ID NO: 2123639 - RNA, 16 nt, Human
caccugccagccuggc

SEQ ID NO: 2123640 - RNA, 17 nt, Human
caccugccagccuggcu

SEQ ID NO: 2123641 - RNA, 20 nt, Human
caccugccagccuggcuucu

SEQ ID NO: 2123642 - RNA, 17 nt, Human
cacccuggggagaaagu

SEQ ID NO: 2123643 - RNA, 20 nt, Human
cacccuguccaaacugccua

SEQ ID NO: 2123644 - RNA, 23 nt, Human
cacccuguccaaacugccuaagc

SEQ ID NO: 2123645 - RNA, 14 nt, Human
caccuauaaaacag

SEQ ID NO: 2123646 - RNA, 16 nt, Human
caccuauaaaacaggu

SEQ ID NO: 2123647 - RNA, 19 nt, Human
caccuauaaaacaggucaa

SEQ ID NO: 2123648 - RNA, 22 nt, Human
cacaucuugcucugcugacaga

SEQ ID NO: 2123649 - RNA, 21 nt, Human
cacaucuugcucugcugacag

SEQ ID NO: 2123650 - RNA, 20 nt, Human
cacaucuugcucugcugaca

SEQ ID NO: 2123651 - RNA, 15 nt, Human
cacaucuugcucugc

SEQ ID NO: 2123652 - RNA, 22 nt, Human
cacaucuucccuagaggguucc

SEQ ID NO: 2123653 - RNA, 23 nt, Human
cacauccauuucaucuauuucug

SEQ ID NO: 2123654 - RNA, 21 nt, Human
cacauccauuucaucuauuuc

SEQ ID NO: 2123655 - RNA, 18 nt, Human
cacauccaggcaauggcc

SEQ ID NO: 2123656 - RNA, 21 nt, Human
cacauccaggcaauggccuaa

SEQ ID NO: 2123657 - RNA, 14 nt, Human
cacaucuugcucug

SEQ ID NO: 2123658 - RNA, 13 nt, Human
cacaucuugcucu

SEQ ID NO: 2123659 - RNA, 14 nt, Human
cacccauccuagag

SEQ ID NO: 2123660 - RNA, 15 nt, Human
cacccaugaagacag

SEQ ID NO: 2123661 - RNA, 14 nt, Human
cacccaugaagaca

SEQ ID NO: 2123662 - RNA, 14 nt, Human
cacccagacagcuc

SEQ ID NO: 2123663 - RNA, 16 nt, Human
cacccagacagcuccc

SEQ ID NO: 2123664 - RNA, 22 nt, Human
cacccagacagcucccucugcc

SEQ ID NO: 2123665 - RNA, 23 nt, Human
caccaggcacgaacccaccugcu

SEQ ID NO: 2123666 - RNA, 24 nt, Human
caccaggcacgaacccaccugcug

SEQ ID NO: 2123667 - RNA, 19 nt, Human
caccaggcacgaacccacc

SEQ ID NO: 2123668 - RNA, 20 nt, Human
caccaggcacgaacccaccu

SEQ ID NO: 2123669 - RNA, 21 nt, Human
caccaggcacgaacccaccug

SEQ ID NO: 2123670 - RNA, 22 nt, Human
caccaggcacgaacccaccugc

SEQ ID NO: 2123671 - RNA, 23 nt, Human
caccaggaauguuaaagucagug

SEQ ID NO: 2123672 - RNA, 12 nt, Human
cacccagcccac

SEQ ID NO: 2123673 - RNA, 18 nt, Human
cacccagcaacuccaacu

SEQ ID NO: 2123674 - RNA, 11 nt, Human
cacccagccca

SEQ ID NO: 2123675 - RNA, 10 nt, Human
cacccagccc

SEQ ID NO: 2123676 - RNA, 22 nt, Human
caccagccccagugcccacagg

SEQ ID NO: 2123677 - RNA, 21 nt, Human
caccagccccagugcccacag

SEQ ID NO: 2123678 - RNA, 18 nt, Human
caccagccccagugccca

SEQ ID NO: 2123679 - RNA, 19 nt, Human
caccagcccuuagcaggga

SEQ ID NO: 2123680 - RNA, 12 nt, Human
caccaggaaugu

SEQ ID NO: 2123681 - RNA, 17 nt, Human
caccaggaauguuaaag

SEQ ID NO: 2123682 - RNA, 21 nt, Human
caccaggaauguuaaagucag

SEQ ID NO: 2123683 - RNA, 16 nt, Human
caccaggagaaccacu

SEQ ID NO: 2123684 - RNA, 17 nt, Human
caccaggagaaccacua

SEQ ID NO: 2123685 - RNA, 19 nt, Human
caccaggagaaccacuaca

SEQ ID NO: 2123686 - RNA, 14 nt, Human
caccaggagacaga

SEQ ID NO: 2123687 - RNA, 17 nt, Human
caccaggagucccuggu

SEQ ID NO: 2123688 - RNA, 17 nt, Human
caccagccccagugccc

SEQ ID NO: 2123689 - RNA, 18 nt, Human
cacauuuauucugcucac

SEQ ID NO: 2123690 - RNA, 17 nt, Human
cacauuuauucugcuca

SEQ ID NO: 2123691 - RNA, 12 nt, Human
cacaucuuucac

SEQ ID NO: 2123692 - RNA, 18 nt, Human
cacaucuuucacacuucc

SEQ ID NO: 2123693 - RNA, 19 nt, Human
cacaucuuucacacuucca

SEQ ID NO: 2123694 - RNA, 21 nt, Human
cacaucuuucacacuuccacc

SEQ ID NO: 2123695 - RNA, 23 nt, Human
cacaucuugcucugcugacagac

SEQ ID NO: 2123696 - RNA, 15 nt, Human
auuuauauaaauuuu

SEQ ID NO: 2123697 - RNA, 14 nt, Human
auuuauauauuuau

SEQ ID NO: 2123698 - RNA, 14 nt, Human
auuuauauaauuau

SEQ ID NO: 2123699 - RNA, 15 nt, Human
auuuauauaauuaug

SEQ ID NO: 2123700 - RNA, 16 nt, Human
auuuauauaauuaugu

SEQ ID NO: 2123701 - RNA, 18 nt, Human
auuuauauaauuauguua

SEQ ID NO: 2123702 - RNA, 20 nt, Human
auuuauauaauuauguuauu

SEQ ID NO: 2123703 - RNA, 22 nt, Human
auuuauauaauuauguuauuga

SEQ ID NO: 2123704 - RNA, 15 nt, Human
auuuaauucauguuu

SEQ ID NO: 2123705 - RNA, 17 nt, Human
auuuaauucauguuucu

SEQ ID NO: 2123706 - RNA, 13 nt, Human
auuuaauuguaaa

SEQ ID NO: 2123707 - RNA, 14 nt, Human
auuuaauuguaaac

SEQ ID NO: 2123708 - RNA, 15 nt, Human
auuuaauuguaaacu

SEQ ID NO: 2123709 - RNA, 16 nt, Human
auuuaauuguaaacug

SEQ ID NO: 2123710 - RNA, 17 nt, Human
auuuaauuguaaacugu

SEQ ID NO: 2123711 - RNA, 18 nt, Human
auuuaauuguaaacugua

SEQ ID NO: 2123712 - RNA, 12 nt, Human
auuuaagcauug

SEQ ID NO: 2123713 - RNA, 13 nt, Human
auuuaagcauugu

SEQ ID NO: 2123714 - RNA, 14 nt, Human
auuuaagcauuguu

SEQ ID NO: 2123715 - RNA, 15 nt, Human
auuuaagcauuguuu

SEQ ID NO: 2123716 - RNA, 11 nt, Human
auuuaagcauu

SEQ ID NO: 2123717 - RNA, 15 nt, Human
auuuaagauaguuuu

SEQ ID NO: 2123718 - RNA, 15 nt, Human
auuuaaguauucaag

SEQ ID NO: 2123719 - RNA, 18 nt, Human
auuuaaguauucaagaaa

SEQ ID NO: 2123720 - RNA, 18 nt, Human
auuuaagcuuaugucaga

SEQ ID NO: 2123721 - RNA, 19 nt, Human
auuuaaggagauguaagag

SEQ ID NO: 2123722 - RNA, 22 nt, Human
auuuaaggagauguaagagcuu

SEQ ID NO: 2123723 - RNA, 21 nt, Human
auuucacauuaauauuugcug

SEQ ID NO: 2123724 - RNA, 22 nt, Human
auuucacauuaauauuugcuga

SEQ ID NO: 2123725 - RNA, 20 nt, Human
auuucacgucgucuucugua

SEQ ID NO: 2123726 - RNA, 14 nt, Human
auuucacuauuuuu

SEQ ID NO: 2123727 - RNA, 22 nt, Human
auuucacuauuuuuauuuauau

SEQ ID NO: 2123728 - RNA, 19 nt, Human
auuucaggauacucuguca

SEQ ID NO: 2123729 - RNA, 22 nt, Human
auuucaggauacucugucagau

SEQ ID NO: 2123730 - RNA, 23 nt, Human
auuucacaguguguuugugauug

SEQ ID NO: 2123731 - RNA, 13 nt, Human
auuucacauuaau

SEQ ID NO: 2123732 - RNA, 17 nt, Human
auuucaauuuguucagu

SEQ ID NO: 2123733 - RNA, 21 nt, Human
auuucaauuuccaagagcuga

SEQ ID NO: 2123734 - RNA, 16 nt, Human
auuuaucuauuguaag

SEQ ID NO: 2123735 - RNA, 17 nt, Human
auuuaucuauuguaaga

SEQ ID NO: 2123736 - RNA, 18 nt, Human
auuuaucuauuguaagau

SEQ ID NO: 2123737 - RNA, 20 nt, Human
auuuaucuauuguaagauaa

SEQ ID NO: 2123738 - RNA, 23 nt, Human
auuuaucuauuguaagauaaaaa

SEQ ID NO: 2123739 - RNA, 19 nt, Human
auuuauauauuuauaacuc

SEQ ID NO: 2123740 - RNA, 15 nt, Human
auuuauauauuuaua

SEQ ID NO: 2123741 - RNA, 16 nt, Human
auuuauauauuuauaa

SEQ ID NO: 2123742 - RNA, 17 nt, Human
auuuauauauuuauaac

SEQ ID NO: 2123743 - RNA, 18 nt, Human
auuuauauauuuauaacu

SEQ ID NO: 2123744 - RNA, 23 nt, Human
auuuaucagugacagaguucacu

SEQ ID NO: 2123745 - RNA, 17 nt, Human
auuuaagaaaauacaau

SEQ ID NO: 2123746 - RNA, 20 nt, Human
auuuaagaaaauacaauaaa

SEQ ID NO: 2123747 - RNA, 21 nt, Human
auuuaagaaaauacaauaaac

SEQ ID NO: 2123748 - RNA, 23 nt, Human
auuucugagaagguccuuaauga

SEQ ID NO: 2123749 - RNA, 13 nt, Human
auuucuuaaacaa

SEQ ID NO: 2123750 - RNA, 21 nt, Human
auuucuuaaacaaauguauga

SEQ ID NO: 2123751 - RNA, 13 nt, Human
auuucucucucca

SEQ ID NO: 2123752 - RNA, 18 nt, Human
auuucucucuccagucuu

SEQ ID NO: 2123753 - RNA, 22 nt, Human
auuucucucuccagucuuccac

SEQ ID NO: 2123754 - RNA, 17 nt, Human
auuucucuacagauguc

SEQ ID NO: 2123755 - RNA, 14 nt, Human
auuucagucuuuuc

SEQ ID NO: 2123756 - RNA, 19 nt, Human
auuucagucuuuuccuguu

SEQ ID NO: 2123757 - RNA, 14 nt, Human
auuucaggauucuc

SEQ ID NO: 2123758 - RNA, 19 nt, Human
auuucaggggucgucacca

SEQ ID NO: 2123759 - RNA, 22 nt, Human
auuucaggggucgucaccaccu

SEQ ID NO: 2123760 - RNA, 20 nt, Human
auuucagguuuuguaaagau

SEQ ID NO: 2123761 - RNA, 21 nt, Human
auuucagguuuuguaaagaug

SEQ ID NO: 2123762 - RNA, 20 nt, Human
auuucugaaaugaccucaag

SEQ ID NO: 2123763 - RNA, 11 nt, Human
auuucugagaa

SEQ ID NO: 2123764 - RNA, 17 nt, Human
auuucugagaagguccu

SEQ ID NO: 2123765 - RNA, 15 nt, Human
auuucugauauagaa

SEQ ID NO: 2123766 - RNA, 17 nt, Human
auuucugauauagaauu

SEQ ID NO: 2123767 - RNA, 18 nt, Human
auuucugauauagaauug

SEQ ID NO: 2123768 - RNA, 11 nt, Human
auuucugauuu

SEQ ID NO: 2123769 - RNA, 13 nt, Human
auuucugauuuua

SEQ ID NO: 2123770 - RNA, 16 nt, Human
auuucugauuuuaugu

SEQ ID NO: 2123771 - RNA, 17 nt, Human
auuucugauuuuaugua

SEQ ID NO: 2123772 - RNA, 19 nt, Human
auuucugauuuuauguaaa

SEQ ID NO: 2123773 - RNA, 15 nt, Human
auuuuuuuuguuuca

SEQ ID NO: 2123774 - RNA, 15 nt, Human
auuuuuuuucuuuua

SEQ ID NO: 2123775 - RNA, 15 nt, Human
auuuuuuuuuagaac

SEQ ID NO: 2123776 - RNA, 21 nt, Human
auuuuuuuuuagaacagaaaa

SEQ ID NO: 2123777 - RNA, 23 nt, Human
auuuuuuuuuagaacagaaaaca

SEQ ID NO: 2123778 - RNA, 15 nt, Human
caaaagcaaaugaga

SEQ ID NO: 2123779 - RNA, 14 nt, Human
caaaagcacccuug

SEQ ID NO: 2123780 - RNA, 20 nt, Human
caaaagguuaauaaaguaau

SEQ ID NO: 2123781 - RNA, 19 nt, Human
caaaagguucacuaaagca

SEQ ID NO: 2123782 - RNA, 13 nt, Human
caaaaggugccug

SEQ ID NO: 2123783 - RNA, 15 nt, Human
caaaaggugccugug

SEQ ID NO: 2123784 - RNA, 18 nt, Human
caaaaggugccugugagg

SEQ ID NO: 2123785 - RNA, 22 nt, Human
caaaaggugccugugaggcagg

SEQ ID NO: 2123786 - RNA, 18 nt, Human
caaacauccuaucaacaa

SEQ ID NO: 2123787 - RNA, 23 nt, Human
caaaaggugccugugaggcaggg

SEQ ID NO: 2123788 - RNA, 21 nt, Human
caaacaucuggaaaauaaaag

SEQ ID NO: 2123789 - RNA, 12 nt, Human
caaacaugaagu

SEQ ID NO: 2123790 - RNA, 14 nt, Human
caaacaugaagugu

SEQ ID NO: 2123791 - RNA, 21 nt, Human
caaacaugaaguguguuuccu

SEQ ID NO: 2123792 - RNA, 20 nt, Human
caaaaggguuuaaacugauu

SEQ ID NO: 2123793 - RNA, 22 nt, Human
caaaaggguuuaaacugauuca

SEQ ID NO: 2123794 - RNA, 18 nt, Human
auuuuuauuacccuucuu

SEQ ID NO: 2123795 - RNA, 14 nt, Human
auuuuuauuaugca

SEQ ID NO: 2123796 - RNA, 15 nt, Human
auuuuuauuaugcau

SEQ ID NO: 2123797 - RNA, 17 nt, Human
auuuuuauuaugcauaa

SEQ ID NO: 2123798 - RNA, 19 nt, Human
auuuuuauuaugcauaacu

SEQ ID NO: 2123799 - RNA, 20 nt, Human
auuuuuauuaugcauaacug

SEQ ID NO: 2123800 - RNA, 22 nt, Human
auuuuuauuaugcauaacugac

SEQ ID NO: 2123801 - RNA, 16 nt, Human
auuuuuauuaaauuau

SEQ ID NO: 2123802 - RNA, 14 nt, Human
auuuuuauuuauau

SEQ ID NO: 2123803 - RNA, 14 nt, Human
auuuuuauuucaaa

SEQ ID NO: 2123804 - RNA, 20 nt, Human
auuuuuuucuaccuugaggu

SEQ ID NO: 2123805 - RNA, 13 nt, Human
auuuuuuucuacc

SEQ ID NO: 2123806 - RNA, 22 nt, Human
auuuuguuuuugucuuaaaaag

SEQ ID NO: 2123807 - RNA, 15 nt, Human
auuuuuauggaauuu

SEQ ID NO: 2123808 - RNA, 12 nt, Human
auuuuuauggaa

SEQ ID NO: 2123809 - RNA, 14 nt, Human
auuuuuauggaauu

SEQ ID NO: 2123810 - RNA, 12 nt, Human
auuuuuauccaa

SEQ ID NO: 2123811 - RNA, 18 nt, Human
auuuuuauccaaucuugu

SEQ ID NO: 2123812 - RNA, 18 nt, Human
caaacaugugguuaaugc

SEQ ID NO: 2123813 - RNA, 13 nt, Human
auuuuuuucucuc

SEQ ID NO: 2123814 - RNA, 20 nt, Human
caaacaugggguuggcuggg

SEQ ID NO: 2123815 - RNA, 13 nt, Human
caaaccagaagca

SEQ ID NO: 2123816 - RNA, 22 nt, Human
caaacaugaaguguguuuccuu

SEQ ID NO: 2123817 - RNA, 23 nt, Human
caaacaugggguuggcugggccc

SEQ ID NO: 2123818 - RNA, 16 nt, Human
auuuugaaaacuacau

SEQ ID NO: 2123819 - RNA, 18 nt, Human
auuuugaaaacuacauuu

SEQ ID NO: 2123820 - RNA, 19 nt, Human
auuuugaaaacuacauuuu

SEQ ID NO: 2123821 - RNA, 22 nt, Human
auuuugaaaacuacauuuuaac

SEQ ID NO: 2123822 - RNA, 13 nt, Human
auuuuauaaaauu

SEQ ID NO: 2123823 - RNA, 17 nt, Human
auuuuauaaaauuaaag

SEQ ID NO: 2123824 - RNA, 18 nt, Human
auuuuauaaaauuaaaga

SEQ ID NO: 2123825 - RNA, 19 nt, Human
auuuuauaaaauuaaagaa

SEQ ID NO: 2123826 - RNA, 20 nt, Human
auuuuauaaaauuaaagaaa

SEQ ID NO: 2123827 - RNA, 21 nt, Human
auuuuauaaaauuaaagaaaa

SEQ ID NO: 2123828 - RNA, 22 nt, Human
auuuuauaaaauuaaagaaaau

SEQ ID NO: 2123829 - RNA, 15 nt, Human
auuuucugaaacuaa

SEQ ID NO: 2123830 - RNA, 16 nt, Human
auuuucugaaacuaau

SEQ ID NO: 2123831 - RNA, 19 nt, Human
auuuucugaaacuaaugaa

SEQ ID NO: 2123832 - RNA, 20 nt, Human
auuuucugaaacuaaugaaa

SEQ ID NO: 2123833 - RNA, 21 nt, Human
auuuucugaaacuaaugaaag

SEQ ID NO: 2123834 - RNA, 22 nt, Human
auuuucugaaacuaaugaaagc

SEQ ID NO: 2123835 - RNA, 18 nt, Human
auuuucugguagauagaa

SEQ ID NO: 2123836 - RNA, 17 nt, Human
auuuucugguagauaga

SEQ ID NO: 2123837 - RNA, 20 nt, Human
auuuucugguagauagaaau

SEQ ID NO: 2123838 - RNA, 21 nt, Human
auuuucugguagauagaaaua

SEQ ID NO: 2123839 - RNA, 20 nt, Human
auuuucuggguucugggugg

SEQ ID NO: 2123840 - RNA, 22 nt, Human
auuuucuuuuuauuuuuuaauu

SEQ ID NO: 2123841 - RNA, 17 nt, Human
auuuuaguauauuuaua

SEQ ID NO: 2123842 - RNA, 22 nt, Human
auuuuaguauauuuauauaauu

SEQ ID NO: 2123843 - RNA, 23 nt, Human
auuuuaguauauuuauauaauua

SEQ ID NO: 2123844 - RNA, 12 nt, Human
auuuguuaaugg

SEQ ID NO: 2123845 - RNA, 15 nt, Human
auuuguuauucuuaa

SEQ ID NO: 2123846 - RNA, 16 nt, Human
auuuguuauucuuaag

SEQ ID NO: 2123847 - RNA, 17 nt, Human
auuuguuauucuuaaga

SEQ ID NO: 2123848 - RNA, 14 nt, Human
auuuguuauaauga

SEQ ID NO: 2123849 - RNA, 15 nt, Human
auuuguuaaauauuu

SEQ ID NO: 2123850 - RNA, 16 nt, Human
auuuguuaaauauuua

SEQ ID NO: 2123851 - RNA, 17 nt, Human
auuuguuaaauauuuac

SEQ ID NO: 2123852 - RNA, 18 nt, Human
auuuguuaaauauuuaca

SEQ ID NO: 2123853 - RNA, 19 nt, Human
auuugcagagacaggaccu

SEQ ID NO: 2123854 - RNA, 22 nt, Human
auuugcagagacaggaccugac

SEQ ID NO: 2123855 - RNA, 16 nt, Human
auuugcacccuccgcc

SEQ ID NO: 2123856 - RNA, 15 nt, Human
auuugcagagacagg

SEQ ID NO: 2123857 - RNA, 15 nt, Human
auuugugugugugca

SEQ ID NO: 2123858 - RNA, 20 nt, Human
auuugugugugugcaagugu

SEQ ID NO: 2123859 - RNA, 12 nt, Human
auuugugugugu

SEQ ID NO: 2123860 - RNA, 14 nt, Human
auuugugugugugc

SEQ ID NO: 2123861 - RNA, 14 nt, Human
auuaauuucuucac

SEQ ID NO: 2123862 - RNA, 23 nt, Human
auuaaugcuaagggcaggcccaa

SEQ ID NO: 2123863 - RNA, 14 nt, Human
auuaaugcuaaggg

SEQ ID NO: 2123864 - RNA, 15 nt, Human
auuaaugcuaagggc

SEQ ID NO: 2123865 - RNA, 18 nt, Human
auuacacaaauacuuauu

SEQ ID NO: 2123866 - RNA, 22 nt, Human
auuacaagcgugagccacugca

SEQ ID NO: 2123867 - RNA, 15 nt, Human
auuacagagaggaga

SEQ ID NO: 2123868 - RNA, 17 nt, Human
auuacagagaggagaaa

SEQ ID NO: 2123869 - RNA, 18 nt, Human
auuacagagaggagaaac

SEQ ID NO: 2123870 - RNA, 12 nt, Human
auuacagagagg

SEQ ID NO: 2123871 - RNA, 20 nt, Human
auuaaauuuuuuaaaaagca

SEQ ID NO: 2123872 - RNA, 13 nt, Human
auuaaauuuuucc

SEQ ID NO: 2123873 - RNA, 14 nt, Human
auuaaauuuuuccu

SEQ ID NO: 2123874 - RNA, 16 nt, Human
auuaaauuuuuccuua

SEQ ID NO: 2123875 - RNA, 14 nt, Human
auuaacaaauuaug

SEQ ID NO: 2123876 - RNA, 23 nt, Human
auuaacaguuuuccaugaaaacg

SEQ ID NO: 2123877 - RNA, 14 nt, Human
auuaacauauaaua

SEQ ID NO: 2123878 - RNA, 17 nt, Human
auuaacauauaauauau

SEQ ID NO: 2123879 - RNA, 18 nt, Human
auuaacauauaauauaug

SEQ ID NO: 2123880 - RNA, 20 nt, Human
auuaacauauaauauauguu

SEQ ID NO: 2123881 - RNA, 12 nt, Human
auuaacaguuuu

SEQ ID NO: 2123882 - RNA, 14 nt, Human
auuaacaguuuucc

SEQ ID NO: 2123883 - RNA, 16 nt, Human
auuaacaguuuuccau

SEQ ID NO: 2123884 - RNA, 18 nt, Human
auuaacaguuuuccauga

SEQ ID NO: 2123885 - RNA, 19 nt, Human
auuaacaguuuuccaugaa

SEQ ID NO: 2123886 - RNA, 21 nt, Human
auuaacaguuuuccaugaaaa

SEQ ID NO: 2123887 - RNA, 22 nt, Human
auuaacaguuuuccaugaaaac

SEQ ID NO: 2123888 - RNA, 20 nt, Human
auuaacaaauuauguuacau

SEQ ID NO: 2123889 - RNA, 11 nt, Human
auuaacacugc

SEQ ID NO: 2123890 - RNA, 12 nt, Human
auucauguuucu

SEQ ID NO: 2123891 - RNA, 13 nt, Human
auucauguuucuu

SEQ ID NO: 2123892 - RNA, 15 nt, Human
auucauguuucuuaa

SEQ ID NO: 2123893 - RNA, 19 nt, Human
auucauucuggucucucua

SEQ ID NO: 2123894 - RNA, 22 nt, Human
auucauucuggucucucuauua

SEQ ID NO: 2123895 - RNA, 14 nt, Human
auucauauuuacuu

SEQ ID NO: 2123896 - RNA, 16 nt, Human
auucaagguaaaauuc

SEQ ID NO: 2123897 - RNA, 17 nt, Human
auucaagguaaaauucu

SEQ ID NO: 2123898 - RNA, 18 nt, Human
auucaagguaaaauucua

SEQ ID NO: 2123899 - RNA, 19 nt, Human
auucaagguaaaauucuaa

SEQ ID NO: 2123900 - RNA, 20 nt, Human
auucaagguaaaauucuaaa

SEQ ID NO: 2123901 - RNA, 21 nt, Human
auucaagguaaaauucuaaau

SEQ ID NO: 2123902 - RNA, 16 nt, Human
auucaaguguacagug

SEQ ID NO: 2123903 - RNA, 15 nt, Human
auuagagucagccuu

SEQ ID NO: 2123904 - RNA, 21 nt, Human
auucgugcagcauaugaggau

SEQ ID NO: 2123905 - RNA, 23 nt, Human
auucguggugaucaauuaaaugu

SEQ ID NO: 2123906 - RNA, 16 nt, Human
auucucuccucagacu

SEQ ID NO: 2123907 - RNA, 18 nt, Human
auucucuccucagacugc

SEQ ID NO: 2123908 - RNA, 19 nt, Human
auucucuccucagacugcu

SEQ ID NO: 2123909 - RNA, 22 nt, Human
auucucuccucagacugcucaa

SEQ ID NO: 2123910 - RNA, 12 nt, Human
auucucuuaucc

SEQ ID NO: 2123911 - RNA, 14 nt, Human
auucucuuauccaa

SEQ ID NO: 2123912 - RNA, 16 nt, Human
auucauuguauaaaaa

SEQ ID NO: 2123913 - RNA, 20 nt, Human
auucauugugguuauuuuua

SEQ ID NO: 2123914 - RNA, 21 nt, Human
auucauugugguuauuuuuau

SEQ ID NO: 2123915 - RNA, 22 nt, Human
auucauugugguuauuuuuaua

SEQ ID NO: 2123916 - RNA, 19 nt, Human
auucauuguauaaaaauag

SEQ ID NO: 2123917 - RNA, 22 nt, Human
auucauuucaaagggagagaga

SEQ ID NO: 2123918 - RNA, 14 nt, Human
auuccuuucccuuu

SEQ ID NO: 2123919 - RNA, 15 nt, Human
auuccuuucccuuua

SEQ ID NO: 2123920 - RNA, 17 nt, Human
auuccuuucccuuuagc

SEQ ID NO: 2123921 - RNA, 18 nt, Human
auuccuuuccugaucacu

SEQ ID NO: 2123922 - RNA, 11 nt, Human
auucauuucaa

SEQ ID NO: 2123923 - RNA, 15 nt, Human
auuccuuuucuuguu

SEQ ID NO: 2123924 - RNA, 19 nt, Human
auuccuuuucuuguuuauc

SEQ ID NO: 2123925 - RNA, 20 nt, Human
auuccuuuucuuguuuauca

SEQ ID NO: 2123926 - RNA, 18 nt, Human
auuccuuuuguguacagu

SEQ ID NO: 2123927 - RNA, 21 nt, Human
auucgcccaaagccagacagc

SEQ ID NO: 2123928 - RNA, 20 nt, Human
auucgcccaaagccagacag

SEQ ID NO: 2123929 - RNA, 14 nt, Human
auucgagcuauauu

SEQ ID NO: 2123930 - RNA, 15 nt, Human
auucgagcuauauuu

SEQ ID NO: 2123931 - RNA, 20 nt, Human
auucgagcuauauuuaagua

SEQ ID NO: 2123932 - RNA, 19 nt, Human
auucgaucucauucaguau

SEQ ID NO: 2123933 - RNA, 19 nt, Human
auucgcccaaagccagaca

SEQ ID NO: 2123934 - RNA, 17 nt, Human
auucuuuaaauuucauc

SEQ ID NO: 2123935 - RNA, 17 nt, Human
auucucuuggcuggcuu

SEQ ID NO: 2123936 - RNA, 20 nt, Human
auucucuuggcuggcuuccu

SEQ ID NO: 2123937 - RNA, 15 nt, Human
auucucuuauccaac

SEQ ID NO: 2123938 - RNA, 19 nt, Human
auucuuucaauaacgaagu

SEQ ID NO: 2123939 - RNA, 19 nt, Human
auucuuucaagugaaucua

SEQ ID NO: 2123940 - RNA, 16 nt, Human
auucuuuccauuauga

SEQ ID NO: 2123941 - RNA, 17 nt, Human
auucuuuccauuaugau

SEQ ID NO: 2123942 - RNA, 21 nt, Human
auucuuuccauuaugauucuu

SEQ ID NO: 2123943 - RNA, 22 nt, Human
auucuuuccauuaugauucuuu

SEQ ID NO: 2123944 - RNA, 21 nt, Human
auugagcuggaccucaccaag

SEQ ID NO: 2123945 - RNA, 22 nt, Human
cagauauaaaagacugaccaau

SEQ ID NO: 2123946 - RNA, 17 nt, Human
cagauaggccuucuugu

SEQ ID NO: 2123947 - RNA, 18 nt, Human
cagauaggccuucuugug

SEQ ID NO: 2123948 - RNA, 19 nt, Human
cagauaggccuucuuguga

SEQ ID NO: 2123949 - RNA, 19 nt, Human
cagauagauauaugcucug

SEQ ID NO: 2123950 - RNA, 19 nt, Human
cagaggggcuuucuggaga

SEQ ID NO: 2123951 - RNA, 19 nt, Human
cagauacuuggggggcuga

SEQ ID NO: 2123952 - RNA, 15 nt, Human
cagaucccagcucac

SEQ ID NO: 2123953 - RNA, 12 nt, Human
cagaucccagcu

SEQ ID NO: 2123954 - RNA, 14 nt, Human
cagaucccagcuca

SEQ ID NO: 2123955 - RNA, 22 nt, Human
cagaucccagaaggaccuccug

SEQ ID NO: 2123956 - RNA, 19 nt, Human
cagauauauuuuucacagu

SEQ ID NO: 2123957 - RNA, 18 nt, Human
cagauaugauauguaaac

SEQ ID NO: 2123958 - RNA, 13 nt, Human
cagauauauuuuu

SEQ ID NO: 2123959 - RNA, 14 nt, Human
cagauauauuuuuc

SEQ ID NO: 2123960 - RNA, 15 nt, Human
cagauauauuuuuca

SEQ ID NO: 2123961 - RNA, 15 nt, Human
cagauaugauaugua

SEQ ID NO: 2123962 - RNA, 16 nt, Human
cagauauauuuuucac

SEQ ID NO: 2123963 - RNA, 18 nt, Human
cagauauauuuuucacag

SEQ ID NO: 2123964 - RNA, 18 nt, Human
cagaggggcuuucuggag

SEQ ID NO: 2123965 - RNA, 23 nt, Human
cagagaggguggugaccucugcc

SEQ ID NO: 2123966 - RNA, 19 nt, Human
cagagaggucaagcccagg

SEQ ID NO: 2123967 - RNA, 21 nt, Human
cagagaggucaagcccaggag

SEQ ID NO: 2123968 - RNA, 15 nt, Human
cagagcucuggagcc

SEQ ID NO: 2123969 - RNA, 19 nt, Human
cagagcucuggagccaccu

SEQ ID NO: 2123970 - RNA, 21 nt, Human
cagagcucuggagccaccugu

SEQ ID NO: 2123971 - RNA, 23 nt, Human
cagagcuccuccuugucuuggca

SEQ ID NO: 2123972 - RNA, 11 nt, Human
cagagagaaac

SEQ ID NO: 2123973 - RNA, 22 nt, Human
cagagaggguggugaccucugc

SEQ ID NO: 2123974 - RNA, 20 nt, Human
cagagaggguggugaccucu

SEQ ID NO: 2123975 - RNA, 17 nt, Human
cagagaggguggugacc

SEQ ID NO: 2123976 - RNA, 20 nt, Human
cagagagggggccaccuccc

SEQ ID NO: 2123977 - RNA, 22 nt, Human
cagagagggggccaccucccca

SEQ ID NO: 2123978 - RNA, 16 nt, Human
cagagagaauggcuuu

SEQ ID NO: 2123979 - RNA, 11 nt, Human
cagagagacag

SEQ ID NO: 2123980 - RNA, 15 nt, Human
cagagagacagacuu

SEQ ID NO: 2123981 - RNA, 17 nt, Human
cagagagacagacuuga

SEQ ID NO: 2123982 - RNA, 18 nt, Human
cagagagacagacuugag

SEQ ID NO: 2123983 - RNA, 22 nt, Human
cagagagacagacuugagaacu

SEQ ID NO: 2123984 - RNA, 22 nt, Human
cagagagagaagugccccugcu

SEQ ID NO: 2123985 - RNA, 23 nt, Human
cagagagagaagugccccugcug

SEQ ID NO: 2123986 - RNA, 19 nt, Human
cagagagagaagugccccu

SEQ ID NO: 2123987 - RNA, 20 nt, Human
cagagagagaagugccccug

SEQ ID NO: 2123988 - RNA, 21 nt, Human
cagagagagaagugccccugc

SEQ ID NO: 2123989 - RNA, 12 nt, Human
cagagagggugg

SEQ ID NO: 2123990 - RNA, 15 nt, Human
cagagagggggccac

SEQ ID NO: 2123991 - RNA, 20 nt, Human
cagcacuaaagcaguggaca

SEQ ID NO: 2123992 - RNA, 10 nt, Human
cagcacuaac

SEQ ID NO: 2123993 - RNA, 14 nt, Human
cagcacuaaagcag

SEQ ID NO: 2123994 - RNA, 17 nt, Human
cagcacuaaagcagugg

SEQ ID NO: 2123995 - RNA, 19 nt, Human
cagcacuaaagcaguggac

SEQ ID NO: 2123996 - RNA, 20 nt, Human
cagccagcccagcccagcug

SEQ ID NO: 2123997 - RNA, 17 nt, Human
cagccagcccagcccag

SEQ ID NO: 2123998 - RNA, 19 nt, Human
cagccagcccagcccagcu

SEQ ID NO: 2123999 - RNA, 13 nt, Human
cagccagcccagc

SEQ ID NO: 2124000 - RNA, 14 nt, Human
cagccagcccagcc

SEQ ID NO: 2124001 - RNA, 15 nt, Human
cagccagcccagccc

SEQ ID NO: 2124002 - RNA, 16 nt, Human
cagccagcccagccca

SEQ ID NO: 2124003 - RNA, 11 nt, Human
cagccagccca

SEQ ID NO: 2124004 - RNA, 12 nt, Human
cagccagcccag

SEQ ID NO: 2124005 - RNA, 22 nt, Human
cagccaggcugccaaggccaga

SEQ ID NO: 2124006 - RNA, 13 nt, Human
cagccaggcugcc

SEQ ID NO: 2124007 - RNA, 16 nt, Human
cagccaggcugccaag

SEQ ID NO: 2124008 - RNA, 19 nt, Human
cagccaggcucaggccaug

SEQ ID NO: 2124009 - RNA, 12 nt, Human
cagccaggcugc

SEQ ID NO: 2124010 - RNA, 18 nt, Human
cagauugcaacaggcugg

SEQ ID NO: 2124011 - RNA, 20 nt, Human
cagauugcaacaggcugggc

SEQ ID NO: 2124012 - RNA, 19 nt, Human
cagauugcaacaggcuggg

SEQ ID NO: 2124013 - RNA, 14 nt, Human
cagauugucagcuc

SEQ ID NO: 2124014 - RNA, 22 nt, Human
cagauuuagugaaagcuagaga

SEQ ID NO: 2124015 - RNA, 17 nt, Human
cagauuuagugaaagcu

SEQ ID NO: 2124016 - RNA, 20 nt, Human
cagauuuagugaaagcuaga

SEQ ID NO: 2124017 - RNA, 22 nt, Human
cagcaccacccuagucccuucc

SEQ ID NO: 2124018 - RNA, 19 nt, Human
cagauuugaacucuucaau

SEQ ID NO: 2124019 - RNA, 21 nt, Human
cagauuucagucuuuuccugu

SEQ ID NO: 2124020 - RNA, 18 nt, Human
cagcacccagcaacucca

SEQ ID NO: 2124021 - RNA, 14 nt, Human
cagcacccccacgc

SEQ ID NO: 2124022 - RNA, 22 nt, Human
cagcacccccuucucugcccau

SEQ ID NO: 2124023 - RNA, 17 nt, Human
cagacucuacagaggcc

SEQ ID NO: 2124024 - RNA, 21 nt, Human
cagacuccugugcaacuuucc

SEQ ID NO: 2124025 - RNA, 23 nt, Human
cagacaggcaagcaccuccugcc

SEQ ID NO: 2124026 - RNA, 22 nt, Human
cagacaggcaagcaccuccugc

SEQ ID NO: 2124027 - RNA, 21 nt, Human
cagacucuacagaggccaugg

SEQ ID NO: 2124028 - RNA, 20 nt, Human
cagacucuacagaggccaug

SEQ ID NO: 2124029 - RNA, 19 nt, Human
cagacucuacagaggccau

SEQ ID NO: 2124030 - RNA, 18 nt, Human
cagacucuacagaggcca

SEQ ID NO: 2124031 - RNA, 23 nt, Human
cagacucuacagaggccaugggc

SEQ ID NO: 2124032 - RNA, 20 nt, Human
cagacugacaaauguguauc

SEQ ID NO: 2124033 - RNA, 13 nt, Human
cagacuggaagca

SEQ ID NO: 2124034 - RNA, 20 nt, Human
cagacugcugggacuggcca

SEQ ID NO: 2124035 - RNA, 23 nt, Human
cagacugcugggacuggccaggu

SEQ ID NO: 2124036 - RNA, 13 nt, Human
cagacugcuggga

SEQ ID NO: 2124037 - RNA, 15 nt, Human
cagacugcugggacu

SEQ ID NO: 2124038 - RNA, 16 nt, Human
cagacugcugggacug

SEQ ID NO: 2124039 - RNA, 18 nt, Human
cagacuggaagcacagcu

SEQ ID NO: 2124040 - RNA, 17 nt, Human
cagacuggaagcacagc

SEQ ID NO: 2124041 - RNA, 16 nt, Human
cagacuggaagcacag

SEQ ID NO: 2124042 - RNA, 14 nt, Human
cagacuggaagcac

SEQ ID NO: 2124043 - RNA, 21 nt, Human
cagacuggaagcacagcuuca

SEQ ID NO: 2124044 - RNA, 20 nt, Human
cagacuggaagcacagcuuc

SEQ ID NO: 2124045 - RNA, 19 nt, Human
cagacuggauaguccgucu

SEQ ID NO: 2124046 - RNA, 11 nt, Human
cagacuggagg

SEQ ID NO: 2124047 - RNA, 16 nt, Human
cagacuggccugagga

SEQ ID NO: 2124048 - RNA, 21 nt, Human
cagacuggccugaggagcagc

SEQ ID NO: 2124049 - RNA, 16 nt, Human
cagacuggcuggcugc

SEQ ID NO: 2124050 - RNA, 12 nt, Human
cagacuggaggg

SEQ ID NO: 2124051 - RNA, 15 nt, Human
cagacuggugagcag

SEQ ID NO: 2124052 - RNA, 17 nt, Human
cagacuggugagcagac

SEQ ID NO: 2124053 - RNA, 21 nt, Human
cagacaggcaagcaccuccug

SEQ ID NO: 2124054 - RNA, 20 nt, Human
cagacaggcaagcaccuccu

SEQ ID NO: 2124055 - RNA, 18 nt, Human
cagacaggcaagcaccuc

SEQ ID NO: 2124056 - RNA, 13 nt, Human
cagacaggcaagc

SEQ ID NO: 2124057 - RNA, 13 nt, Human
cagacaggagaaa

SEQ ID NO: 2124058 - RNA, 21 nt, Human
cagacaggagaaaugcaucca

SEQ ID NO: 2124059 - RNA, 23 nt, Human
cagacaggaaagggaaggcccca

SEQ ID NO: 2124060 - RNA, 11 nt, Human
cagacaggcaa

SEQ ID NO: 2124061 - RNA, 11 nt, Human
cagacagcucc

SEQ ID NO: 2124062 - RNA, 12 nt, Human
cagacagcuccc

SEQ ID NO: 2124063 - RNA, 17 nt, Human
cagacagcucccucugc

SEQ ID NO: 2124064 - RNA, 19 nt, Human
cagacagcucccucugccu

SEQ ID NO: 2124065 - RNA, 15 nt, Human
cagacaggaaaggga

SEQ ID NO: 2124066 - RNA, 20 nt, Human
cagacaggaaagggaaggcc

SEQ ID NO: 2124067 - RNA, 17 nt, Human
cagacagcagcucaggc

SEQ ID NO: 2124068 - RNA, 18 nt, Human
cagacagcagcucaggca

SEQ ID NO: 2124069 - RNA, 19 nt, Human
cagacagcagcucaggcac

SEQ ID NO: 2124070 - RNA, 16 nt, Human
cagacagacacacaca

SEQ ID NO: 2124071 - RNA, 21 nt, Human
cagacagauggaaaagggaga

SEQ ID NO: 2124072 - RNA, 21 nt, Human
cagacagcaacggggaggcca

SEQ ID NO: 2124073 - RNA, 13 nt, Human
cagacagcagcuc

SEQ ID NO: 2124074 - RNA, 15 nt, Human
cagacagcagcucag

SEQ ID NO: 2124075 - RNA, 16 nt, Human
cagacagcagcucagg

SEQ ID NO: 2124076 - RNA, 15 nt, Human
cagacagacacacac

SEQ ID NO: 2124077 - RNA, 14 nt, Human
cagacagacacaca

SEQ ID NO: 2124078 - RNA, 23 nt, Human
cagacagaagucacucaauuguu

SEQ ID NO: 2124079 - RNA, 14 nt, Human
cagacugcuuuaaa

SEQ ID NO: 2124080 - RNA, 14 nt, Human
cagacuucacacug

SEQ ID NO: 2124081 - RNA, 23 nt, Human
cagacugguugaguucagguagc

SEQ ID NO: 2124082 - RNA, 20 nt, Human
cagacuggugagcagacugg

SEQ ID NO: 2124083 - RNA, 16 nt, Human
caggaccacaaaaaug

SEQ ID NO: 2124084 - RNA, 12 nt, Human
caggaccacaaa

SEQ ID NO: 2124085 - RNA, 16 nt, Human
caggaccucaggugag

SEQ ID NO: 2124086 - RNA, 23 nt, Human
caggaccucaggugagaagcaga

SEQ ID NO: 2124087 - RNA, 20 nt, Human
caggacccaccaugucugcc

SEQ ID NO: 2124088 - RNA, 21 nt, Human
caggacccaucacgccugugc

SEQ ID NO: 2124089 - RNA, 23 nt, Human
caggaggauugcuugagcccagg

SEQ ID NO: 2124090 - RNA, 19 nt, Human
caggaggaucacuugaguc

SEQ ID NO: 2124091 - RNA, 21 nt, Human
caggaggacugccccgugcag

SEQ ID NO: 2124092 - RNA, 23 nt, Human
caggaggacugccccgugcagac

SEQ ID NO: 2124093 - RNA, 23 nt, Human
caggaggagacuagauuuaugaa

SEQ ID NO: 2124094 - RNA, 22 nt, Human
caggaggauugcuugagcccag

SEQ ID NO: 2124095 - RNA, 19 nt, Human
caggaggacugccccgugc

SEQ ID NO: 2124096 - RNA, 17 nt, Human
caggcaaugcuggcugu

SEQ ID NO: 2124097 - RNA, 16 nt, Human
caggcaaugcuggcug

SEQ ID NO: 2124098 - RNA, 15 nt, Human
caggcaaugcuggcu

SEQ ID NO: 2124099 - RNA, 14 nt, Human
caggcaaugcuggc

SEQ ID NO: 2124100 - RNA, 12 nt, Human
caggaggcugag

SEQ ID NO: 2124101 - RNA, 13 nt, Human
caggaggcugagg

SEQ ID NO: 2124102 - RNA, 15 nt, Human
caggaggcugaggca

SEQ ID NO: 2124103 - RNA, 16 nt, Human
caggaggcugaggcag

SEQ ID NO: 2124104 - RNA, 17 nt, Human
caggaggcugaggcaga

SEQ ID NO: 2124105 - RNA, 18 nt, Human
caggaggcugaggcagaa

SEQ ID NO: 2124106 - RNA, 20 nt, Human
caggaggcugaggcagaaga

SEQ ID NO: 2124107 - RNA, 21 nt, Human
caggaggcugaggcagaagaa

SEQ ID NO: 2124108 - RNA, 17 nt, Human
caggaggcugaggcagg

SEQ ID NO: 2124109 - RNA, 18 nt, Human
caggaggcugaggcagga

SEQ ID NO: 2124110 - RNA, 19 nt, Human
caggaggcugaggcaggag

SEQ ID NO: 2124111 - RNA, 20 nt, Human
caggaggcugaggcaggagg

SEQ ID NO: 2124112 - RNA, 21 nt, Human
caggaggcugaggcaggagga

SEQ ID NO: 2124113 - RNA, 15 nt, Human
caggaggcugagggg

SEQ ID NO: 2124114 - RNA, 14 nt, Human
caggaggcugaggu

SEQ ID NO: 2124115 - RNA, 13 nt, Human
caggaggcuggag

SEQ ID NO: 2124116 - RNA, 15 nt, Human
caggaggcuggagga

SEQ ID NO: 2124117 - RNA, 18 nt, Human
caggaggcuggaggaagg

SEQ ID NO: 2124118 - RNA, 21 nt, Human
caggaggcuuggaaagcauca

SEQ ID NO: 2124119 - RNA, 13 nt, Human
caggcaccgagaa

SEQ ID NO: 2124120 - RNA, 16 nt, Human
caggcaccgagaaugu

SEQ ID NO: 2124121 - RNA, 17 nt, Human
caggcaccgagaauguu

SEQ ID NO: 2124122 - RNA, 16 nt, Human
caggcacgaacccacc

SEQ ID NO: 2124123 - RNA, 17 nt, Human
caggcacgaacccaccu

SEQ ID NO: 2124124 - RNA, 19 nt, Human
caggcacgaacccaccugc

SEQ ID NO: 2124125 - RNA, 22 nt, Human
caggcacgaacccaccugcuga

SEQ ID NO: 2124126 - RNA, 20 nt, Human
caggcacgaacccaccugcu

SEQ ID NO: 2124127 - RNA, 21 nt, Human
caggcacgaacccaccugcug

SEQ ID NO: 2124128 - RNA, 12 nt, Human
caggccagcugu

SEQ ID NO: 2124129 - RNA, 13 nt, Human
caggccagcugug

SEQ ID NO: 2124130 - RNA, 17 nt, Human
cagggagaggccaugau

SEQ ID NO: 2124131 - RNA, 16 nt, Human
cagggagaggccauga

SEQ ID NO: 2124132 - RNA, 17 nt, Human
cagggcuaagagcuagc

SEQ ID NO: 2124133 - RNA, 15 nt, Human
cagggcuacccuccc

SEQ ID NO: 2124134 - RNA, 17 nt, Human
cagggcuacccuccccc

SEQ ID NO: 2124135 - RNA, 12 nt, Human
cagggcucagcc

SEQ ID NO: 2124136 - RNA, 13 nt, Human
cagggcucagccu

SEQ ID NO: 2124137 - RNA, 14 nt, Human
cagggcucagccug

SEQ ID NO: 2124138 - RNA, 17 nt, Human
caggggaaaaucagccu

SEQ ID NO: 2124139 - RNA, 19 nt, Human
caggccggugugggcugug

SEQ ID NO: 2124140 - RNA, 22 nt, Human
caggccggugugggcugugucg

SEQ ID NO: 2124141 - RNA, 15 nt, Human
caggccguggcugcc

SEQ ID NO: 2124142 - RNA, 17 nt, Human
caggccguggcugccca

SEQ ID NO: 2124143 - RNA, 19 nt, Human
caggccguggcugcccaca

SEQ ID NO: 2124144 - RNA, 19 nt, Human
caggccugggucugugucu

SEQ ID NO: 2124145 - RNA, 20 nt, Human
caggccugggucugugucuc

SEQ ID NO: 2124146 - RNA, 16 nt, Human
caggccugggucugug

SEQ ID NO: 2124147 - RNA, 18 nt, Human
caggccugggucuguguc

SEQ ID NO: 2124148 - RNA, 19 nt, Human
caggcgauccaccugucuc

SEQ ID NO: 2124149 - RNA, 16 nt, Human
caggcgauccaccugu

SEQ ID NO: 2124150 - RNA, 14 nt, Human
caggccuguugcuu

SEQ ID NO: 2124151 - RNA, 16 nt, Human
caggccuguugcuuuu

SEQ ID NO: 2124152 - RNA, 22 nt, Human
cagcugucccugucaccaagcu

SEQ ID NO: 2124153 - RNA, 18 nt, Human
cagcugucccugucacca

SEQ ID NO: 2124154 - RNA, 17 nt, Human
cagcugccucacuuccu

SEQ ID NO: 2124155 - RNA, 12 nt, Human
cagcugucccug

SEQ ID NO: 2124156 - RNA, 13 nt, Human
cagcugucccugu

SEQ ID NO: 2124157 - RNA, 14 nt, Human
cagcugucccuguc

SEQ ID NO: 2124158 - RNA, 15 nt, Human
cagcugucccuguca

SEQ ID NO: 2124159 - RNA, 16 nt, Human
cagcugucccugucac

SEQ ID NO: 2124160 - RNA, 17 nt, Human
cagcugucccugucacc

SEQ ID NO: 2124161 - RNA, 22 nt, Human
cagcugagaaaaugagugacua

SEQ ID NO: 2124162 - RNA, 21 nt, Human
cagcugacuuuucuguccgag

SEQ ID NO: 2124163 - RNA, 14 nt, Human
cagcugccucacuu

SEQ ID NO: 2124164 - RNA, 17 nt, Human
cagccugcuccagcugu

SEQ ID NO: 2124165 - RNA, 19 nt, Human
cagccugcuccagcuguuc

SEQ ID NO: 2124166 - RNA, 15 nt, Human
cagccugcuccagcu

SEQ ID NO: 2124167 - RNA, 16 nt, Human
cagccugcuccagcug

SEQ ID NO: 2124168 - RNA, 18 nt, Human
cagcuaaagcccaaccuc

SEQ ID NO: 2124169 - RNA, 22 nt, Human
cagcuaaagcccaaccuccuga

SEQ ID NO: 2124170 - RNA, 19 nt, Human
cagcgcuggguccacccca

SEQ ID NO: 2124171 - RNA, 11 nt, Human
caguuuuccuu

SEQ ID NO: 2124172 - RNA, 17 nt, Human
caguuuuccaugaaaac

SEQ ID NO: 2124173 - RNA, 18 nt, Human
caguuuuccaugaaaacg

SEQ ID NO: 2124174 - RNA, 13 nt, Human
caguuuuccauug

SEQ ID NO: 2124175 - RNA, 12 nt, Human
caguuuuccaug

SEQ ID NO: 2124176 - RNA, 13 nt, Human
caguuuuccauga

SEQ ID NO: 2124177 - RNA, 14 nt, Human
caguuuuccaugaa

SEQ ID NO: 2124178 - RNA, 15 nt, Human
caguuuuccaugaaa

SEQ ID NO: 2124179 - RNA, 16 nt, Human
caguuuuccaugaaaa

SEQ ID NO: 2124180 - RNA, 19 nt, Human
caguuuuccaugaaaacgu

SEQ ID NO: 2124181 - RNA, 13 nt, Human
caguuuuccuucu

SEQ ID NO: 2124182 - RNA, 15 nt, Human
cauaauguauaaaga

SEQ ID NO: 2124183 - RNA, 14 nt, Human
cauaauuaugacag

SEQ ID NO: 2124184 - RNA, 19 nt, Human
cauaauuaugacaguuaua

SEQ ID NO: 2124185 - RNA, 15 nt, Human
cauaauuaugacagu

SEQ ID NO: 2124186 - RNA, 17 nt, Human
cauaauuaugacaguua

SEQ ID NO: 2124187 - RNA, 23 nt, Human
cauacaggaagguagaaauaucu

SEQ ID NO: 2124188 - RNA, 17 nt, Human
cauauguauuccugauc

SEQ ID NO: 2124189 - RNA, 14 nt, Human
cauauguaaaauaa

SEQ ID NO: 2124190 - RNA, 17 nt, Human
cauaugugaauauggac

SEQ ID NO: 2124191 - RNA, 15 nt, Human
cauauguuacacuaa

SEQ ID NO: 2124192 - RNA, 20 nt, Human
cauauuaggaaaauaugggu

SEQ ID NO: 2124193 - RNA, 14 nt, Human
cauauuaggaaaau

SEQ ID NO: 2124194 - RNA, 13 nt, Human
cauauuaugucuu

SEQ ID NO: 2124195 - RNA, 13 nt, Human
cauauguaaaaua

SEQ ID NO: 2124196 - RNA, 23 nt, Human
cauagcagagaaugaaagggccc

SEQ ID NO: 2124197 - RNA, 17 nt, Human
cauagcagauuuuaauu

SEQ ID NO: 2124198 - RNA, 16 nt, Human
cauagcagauuuuaau

SEQ ID NO: 2124199 - RNA, 18 nt, Human
cauagcagauuuuaauuu

SEQ ID NO: 2124200 - RNA, 18 nt, Human
caguuucaauucagugcu

SEQ ID NO: 2124201 - RNA, 23 nt, Human
caguuucacuuucacauagaugu

SEQ ID NO: 2124202 - RNA, 15 nt, Human
caguuucagguguuu

SEQ ID NO: 2124203 - RNA, 22 nt, Human
caguuucagguguuuaguugca

SEQ ID NO: 2124204 - RNA, 15 nt, Human
caguuugagacagga

SEQ ID NO: 2124205 - RNA, 16 nt, Human
caguuugagacaggag

SEQ ID NO: 2124206 - RNA, 18 nt, Human
caguuugagacaggagac

SEQ ID NO: 2124207 - RNA, 16 nt, Human
caguuuuaacuagaau

SEQ ID NO: 2124208 - RNA, 12 nt, Human
caguuuuaaaga

SEQ ID NO: 2124209 - RNA, 11 nt, Human
caucuggccuu

SEQ ID NO: 2124210 - RNA, 14 nt, Human
caucuggccuuaca

SEQ ID NO: 2124211 - RNA, 15 nt, Human
caucuggccuuacac

SEQ ID NO: 2124212 - RNA, 20 nt, Human
caucuggccuuacaccucgu

SEQ ID NO: 2124213 - RNA, 12 nt, Human
caucuguagaua

SEQ ID NO: 2124214 - RNA, 12 nt, Human
caucuaaacuuu

SEQ ID NO: 2124215 - RNA, 14 nt, Human
caucuaaacuuuaa

SEQ ID NO: 2124216 - RNA, 15 nt, Human
caucuaaacuuuaau

SEQ ID NO: 2124217 - RNA, 17 nt, Human
caucuaaacuuuaauau

SEQ ID NO: 2124218 - RNA, 20 nt, Human
caucuaaacuuuaauaugua

SEQ ID NO: 2124219 - RNA, 22 nt, Human
caucuaaacuuuaauauguauu

SEQ ID NO: 2124220 - RNA, 23 nt, Human
caucuaaacuuuaauauguauuu

SEQ ID NO: 2124221 - RNA, 12 nt, Human
cauccugcaggc

SEQ ID NO: 2124222 - RNA, 13 nt, Human
caucagcuagcaa

SEQ ID NO: 2124223 - RNA, 17 nt, Human
caucagcuagcaaaaga

SEQ ID NO: 2124224 - RNA, 16 nt, Human
caucagcuauucaguu

SEQ ID NO: 2124225 - RNA, 14 nt, Human
caucagcuccagcu

SEQ ID NO: 2124226 - RNA, 22 nt, Human
cauccauuuauuuggcaucugu

SEQ ID NO: 2124227 - RNA, 19 nt, Human
cauccauuucaucuauuuc

SEQ ID NO: 2124228 - RNA, 16 nt, Human
cauccauuccucaggg

SEQ ID NO: 2124229 - RNA, 17 nt, Human
cauccauuccucaggga

SEQ ID NO: 2124230 - RNA, 18 nt, Human
cauccauuccucagggac

SEQ ID NO: 2124231 - RNA, 19 nt, Human
cauccauuccucagggaca

SEQ ID NO: 2124232 - RNA, 18 nt, Human
caucagaagccuauugua

SEQ ID NO: 2124233 - RNA, 20 nt, Human
caucagaagccuauuguaaa

SEQ ID NO: 2124234 - RNA, 11 nt, Human
caucagaagga

SEQ ID NO: 2124235 - RNA, 14 nt, Human
caucagaaggagaa

SEQ ID NO: 2124236 - RNA, 11 nt, Human
caucagaaaug

SEQ ID NO: 2124237 - RNA, 12 nt, Human
caucagaaaugu

SEQ ID NO: 2124238 - RNA, 20 nt, Human
cauccauuucaucuauuucu

SEQ ID NO: 2124239 - RNA, 23 nt, Human
cauccauuucaucuauuucugag

SEQ ID NO: 2124240 - RNA, 14 nt, Human
caucccacacccug

SEQ ID NO: 2124241 - RNA, 23 nt, Human
caucccacucacaacagcugccu

SEQ ID NO: 2124242 - RNA, 17 nt, Human
caguucagcaccacccu

SEQ ID NO: 2124243 - RNA, 17 nt, Human
caguucaggagucccaa

SEQ ID NO: 2124244 - RNA, 20 nt, Human
caguucaggagucccaagga

SEQ ID NO: 2124245 - RNA, 23 nt, Human
caguucaggagucccaaggaaag

SEQ ID NO: 2124246 - RNA, 23 nt, Human
caguucaguaauaaacuguguuu

SEQ ID NO: 2124247 - RNA, 13 nt, Human
caguucagcacca

SEQ ID NO: 2124248 - RNA, 16 nt, Human
caguucagcaccaccc

SEQ ID NO: 2124249 - RNA, 18 nt, Human
caguuaugugaaugaucu

SEQ ID NO: 2124250 - RNA, 20 nt, Human
caguuaugugaaugaucucu

SEQ ID NO: 2124251 - RNA, 22 nt, Human
caguucaccuauuucaaaaauu

SEQ ID NO: 2124252 - RNA, 23 nt, Human
caguucaccuauuucaaaaauuu

SEQ ID NO: 2124253 - RNA, 14 nt, Human
caguucacuugcag

SEQ ID NO: 2124254 - RNA, 19 nt, Human
caguggugcgaucuggguu

SEQ ID NO: 2124255 - RNA, 21 nt, Human
caguggugcgaucauggcuca

SEQ ID NO: 2124256 - RNA, 21 nt, Human
cagugguaugaucacggcuca

SEQ ID NO: 2124257 - RNA, 15 nt, Human
caguuagagaugccu

SEQ ID NO: 2124258 - RNA, 17 nt, Human
caguuagagaugccucc

SEQ ID NO: 2124259 - RNA, 18 nt, Human
caguuagagaugccuccc

SEQ ID NO: 2124260 - RNA, 19 nt, Human
caguuaggguugaguuacu

SEQ ID NO: 2124261 - RNA, 19 nt, Human
caguuacucagcccugggc

SEQ ID NO: 2124262 - RNA, 15 nt, Human
caguuacucugaagg

SEQ ID NO: 2124263 - RNA, 16 nt, Human
caguuacucugaaggg

SEQ ID NO: 2124264 - RNA, 13 nt, Human
caguuacucagcc

SEQ ID NO: 2124265 - RNA, 14 nt, Human
caguuacucagccc

SEQ ID NO: 2124266 - RNA, 15 nt, Human
caguuacucagcccu

SEQ ID NO: 2124267 - RNA, 16 nt, Human
caguuacucagcccug

SEQ ID NO: 2124268 - RNA, 17 nt, Human
caguuacucagcccugg

SEQ ID NO: 2124269 - RNA, 18 nt, Human
caguuacucagcccuggg

SEQ ID NO: 2124270 - RNA, 13 nt, Human
caguuacucugaa

SEQ ID NO: 2124271 - RNA, 23 nt, Human
cagucugauucccaagcucugcu

SEQ ID NO: 2124272 - RNA, 13 nt, Human
cagugauuuuuau

SEQ ID NO: 2124273 - RNA, 14 nt, Human
cagugauuuuuauc

SEQ ID NO: 2124274 - RNA, 15 nt, Human
cagugauuuuuaucc

SEQ ID NO: 2124275 - RNA, 16 nt, Human
cagugauuuuuaucca

SEQ ID NO: 2124276 - RNA, 17 nt, Human
cagugauuuuuauccaa

SEQ ID NO: 2124277 - RNA, 18 nt, Human
cagugauuuuuuuuuaga

SEQ ID NO: 2124278 - RNA, 18 nt, Human
cagugauucgagcuauau

SEQ ID NO: 2124279 - RNA, 19 nt, Human
cagugauucgagcuauauu

SEQ ID NO: 2124280 - RNA, 20 nt, Human
cagugauucgagcuauauuu

SEQ ID NO: 2124281 - RNA, 12 nt, Human
cagucugcugcc

SEQ ID NO: 2124282 - RNA, 13 nt, Human
cagucugcugccc

SEQ ID NO: 2124283 - RNA, 22 nt, Human
cagucucucuuacccuucugug

SEQ ID NO: 2124284 - RNA, 22 nt, Human
cagugcccacaggaucagucug

SEQ ID NO: 2124285 - RNA, 18 nt, Human
cagugcccacaggaucag

SEQ ID NO: 2124286 - RNA, 16 nt, Human
cagugcccaccaacau

SEQ ID NO: 2124287 - RNA, 21 nt, Human
cagugcccacaggaucagucu

SEQ ID NO: 2124288 - RNA, 15 nt, Human
cagugcaacacugaa

SEQ ID NO: 2124289 - RNA, 18 nt, Human
cagugggagcugccuguu

SEQ ID NO: 2124290 - RNA, 17 nt, Human
cagugggagcugccugu

SEQ ID NO: 2124291 - RNA, 21 nt, Human
cagugcccaccaacaucccau

SEQ ID NO: 2124292 - RNA, 16 nt, Human
cagugggagcugccug

SEQ ID NO: 2124293 - RNA, 13 nt, Human
caguggggcuggg

SEQ ID NO: 2124294 - RNA, 14 nt, Human
caguggggcugggg

SEQ ID NO: 2124295 - RNA, 20 nt, Human
cagugguaugaucacggcuc

SEQ ID NO: 2124296 - RNA, 13 nt, Human
cagugggugcccc

SEQ ID NO: 2124297 - RNA, 21 nt, Human
cagucuacccaccucagccuc

SEQ ID NO: 2124298 - RNA, 23 nt, Human
cagucuacccaccucagccuccu

SEQ ID NO: 2124299 - RNA, 22 nt, Human
cagucugauucccaagcucugc

SEQ ID NO: 2124300 - RNA, 21 nt, Human
cagucugauucccaagcucug

SEQ ID NO: 2124301 - RNA, 15 nt, Human
cagucucggguggcu

SEQ ID NO: 2124302 - RNA, 22 nt, Human
cagucucggguggcuagucaga

SEQ ID NO: 2124303 - RNA, 13 nt, Human
cagucuaguuccu

SEQ ID NO: 2124304 - RNA, 14 nt, Human
cagucuaguuccug

SEQ ID NO: 2124305 - RNA, 22 nt, Human
caugaaugguauggaacucucu

SEQ ID NO: 2124306 - RNA, 16 nt, Human
caugaaugcacacuag

SEQ ID NO: 2124307 - RNA, 13 nt, Human
caugaauguauca

SEQ ID NO: 2124308 - RNA, 21 nt, Human
caugaauuuuuuucaucuucu

SEQ ID NO: 2124309 - RNA, 16 nt, Human
caugacaacuucuaau

SEQ ID NO: 2124310 - RNA, 14 nt, Human
caugacaagcccca

SEQ ID NO: 2124311 - RNA, 15 nt, Human
caugacaagccccag

SEQ ID NO: 2124312 - RNA, 18 nt, Human
caugauggagcgcaccug

SEQ ID NO: 2124313 - RNA, 19 nt, Human
caugauggagcgcaccugc

SEQ ID NO: 2124314 - RNA, 12 nt, Human
caugauggaguc

SEQ ID NO: 2124315 - RNA, 19 nt, Human
caugauggagucagguuug

SEQ ID NO: 2124316 - RNA, 23 nt, Human
caugauggagucagguuuggggu

SEQ ID NO: 2124317 - RNA, 18 nt, Human
caugacaagccccaggca

SEQ ID NO: 2124318 - RNA, 16 nt, Human
caugacaagccccagg

SEQ ID NO: 2124319 - RNA, 17 nt, Human
caugacaagccccaggc

SEQ ID NO: 2124320 - RNA, 19 nt, Human
caugacaagccccaggcag

SEQ ID NO: 2124321 - RNA, 14 nt, Human
caugcaaaugcugu

SEQ ID NO: 2124322 - RNA, 16 nt, Human
caugcaaaugcuguau

SEQ ID NO: 2124323 - RNA, 22 nt, Human
caugcaaaugcuguauucuucu

SEQ ID NO: 2124324 - RNA, 14 nt, Human
caugcaaggggaaa

SEQ ID NO: 2124325 - RNA, 20 nt, Human
caugggaaaugucaacaagu

SEQ ID NO: 2124326 - RNA, 18 nt, Human
cauggcuugccacagcuc

SEQ ID NO: 2124327 - RNA, 15 nt, Human
cauggcuugccacag

SEQ ID NO: 2124328 - RNA, 19 nt, Human
cauggcuugccacagcucu

SEQ ID NO: 2124329 - RNA, 19 nt, Human
caugcaaggggaaaaucuc

SEQ ID NO: 2124330 - RNA, 20 nt, Human
caugcaaggggaaaaucuca

SEQ ID NO: 2124331 - RNA, 15 nt, Human
cauggccagguggcc

SEQ ID NO: 2124332 - RNA, 20 nt, Human
caugcuccuggcccacugca

SEQ ID NO: 2124333 - RNA, 17 nt, Human
caugcuccuggcccacu

SEQ ID NO: 2124334 - RNA, 14 nt, Human
caugcuccuggccc

SEQ ID NO: 2124335 - RNA, 16 nt, Human
caugcuccuggcccac

SEQ ID NO: 2124336 - RNA, 19 nt, Human
cauuaucacuuuaaagccc

SEQ ID NO: 2124337 - RNA, 19 nt, Human
cauguuggccaggcugguc

SEQ ID NO: 2124338 - RNA, 17 nt, Human
cauguuggccaggcugg

SEQ ID NO: 2124339 - RNA, 18 nt, Human
cauguuggccaggcuggu

SEQ ID NO: 2124340 - RNA, 17 nt, Human
cauguuaccuccuauaa

SEQ ID NO: 2124341 - RNA, 16 nt, Human
cauguuaauccuagcu

SEQ ID NO: 2124342 - RNA, 17 nt, Human
cauguuaauccuagcug

SEQ ID NO: 2124343 - RNA, 22 nt, Human
cauguuaauccuagcugugugc

SEQ ID NO: 2124344 - RNA, 21 nt, Human
cauguuacauaagauaaaugu

SEQ ID NO: 2124345 - RNA, 16 nt, Human
cauguuacauaagaua

SEQ ID NO: 2124346 - RNA, 17 nt, Human
cauguuacauaagauaa

SEQ ID NO: 2124347 - RNA, 20 nt, Human
cauuaucgccuuuugacagc

SEQ ID NO: 2124348 - RNA, 22 nt, Human
cauuaucgccuuuugacagcug

SEQ ID NO: 2124349 - RNA, 16 nt, Human
cauuaucgggagcagu

SEQ ID NO: 2124350 - RNA, 17 nt, Human
cauuaucgggagcagug

SEQ ID NO: 2124351 - RNA, 18 nt, Human
cauuaucgggagcagugu

SEQ ID NO: 2124352 - RNA, 20 nt, Human
cauuaucgggagcagugucu

SEQ ID NO: 2124353 - RNA, 21 nt, Human
cauuaucgggagcagugucuu

SEQ ID NO: 2124354 - RNA, 23 nt, Human
cauuaucgggagcagugucuucc

SEQ ID NO: 2124355 - RNA, 12 nt, Human
cauucucucucc

SEQ ID NO: 2124356 - RNA, 16 nt, Human
cauucucucuccugua

SEQ ID NO: 2124357 - RNA, 15 nt, Human
cauucucucuccugu

SEQ ID NO: 2124358 - RNA, 16 nt, Human
cauucucucuccuguc

SEQ ID NO: 2124359 - RNA, 18 nt, Human
cauucucucuccugucca

SEQ ID NO: 2124360 - RNA, 20 nt, Human
cauucucucuccuguccaac

SEQ ID NO: 2124361 - RNA, 12 nt, Human
cauucucugaag

SEQ ID NO: 2124362 - RNA, 13 nt, Human
cauucucugaaga

SEQ ID NO: 2124363 - RNA, 19 nt, Human
cauuaucuaacugugcuca

SEQ ID NO: 2124364 - RNA, 15 nt, Human
ccaagcucugcuccu

SEQ ID NO: 2124365 - RNA, 14 nt, Human
ccaagcucugcucc

SEQ ID NO: 2124366 - RNA, 16 nt, Human
ccaagcucugcuccuc

SEQ ID NO: 2124367 - RNA, 16 nt, Human
ccaaaucauaguggcu

SEQ ID NO: 2124368 - RNA, 23 nt, Human
ccaaaucagcugcuacuacuccu

SEQ ID NO: 2124369 - RNA, 15 nt, Human
ccaaaucagcugcua

SEQ ID NO: 2124370 - RNA, 15 nt, Human
ccaaaucaaaauaug

SEQ ID NO: 2124371 - RNA, 21 nt, Human
ccaauggagacugucucaaga

SEQ ID NO: 2124372 - RNA, 21 nt, Human
ccaauucaacccuuugcccca

SEQ ID NO: 2124373 - RNA, 11 nt, Human
ccaauucuuac

SEQ ID NO: 2124374 - RNA, 20 nt, Human
ccaauggaguagaccccugg

SEQ ID NO: 2124375 - RNA, 23 nt, Human
ccaauggaguagaccccuggcug

SEQ ID NO: 2124376 - RNA, 14 nt, Human
ccaaggaccccuca

SEQ ID NO: 2124377 - RNA, 15 nt, Human
ccaaggaccccucac

SEQ ID NO: 2124378 - RNA, 16 nt, Human
ccaaggaccccucacc

SEQ ID NO: 2124379 - RNA, 11 nt, Human
ccaacuccagu

SEQ ID NO: 2124380 - RNA, 20 nt, Human
ccaacuccaguacuggagcu

SEQ ID NO: 2124381 - RNA, 21 nt, Human
ccaacuccaguacuggagcuu

SEQ ID NO: 2124382 - RNA, 22 nt, Human
ccaaggaccccucaccuugcaa

SEQ ID NO: 2124383 - RNA, 18 nt, Human
ccaaggaccccucaccuu

SEQ ID NO: 2124384 - RNA, 11 nt, Human
ccaaggacugc

SEQ ID NO: 2124385 - RNA, 13 nt, Human
ccaaggacugccg

SEQ ID NO: 2124386 - RNA, 15 nt, Human
ccaaggacugccgac

SEQ ID NO: 2124387 - RNA, 14 nt, Human
ccaaggagaaacag

SEQ ID NO: 2124388 - RNA, 15 nt, Human
ccaaggagaaacaga

SEQ ID NO: 2124389 - RNA, 18 nt, Human
ccaaggagaaacagagac

SEQ ID NO: 2124390 - RNA, 21 nt, Human
ccaaggagaaacagagacagg

SEQ ID NO: 2124391 - RNA, 19 nt, Human
ccaaggagaaacagagaca

SEQ ID NO: 2124392 - RNA, 18 nt, Human
ccaaugccccacuggcag

SEQ ID NO: 2124393 - RNA, 13 nt, Human
ccaaggaggaaaa

SEQ ID NO: 2124394 - RNA, 21 nt, Human
ccaaggaggaaaaacagacaa

SEQ ID NO: 2124395 - RNA, 14 nt, Human
ccaaggagaugaag

SEQ ID NO: 2124396 - RNA, 15 nt, Human
ccaaggagcugagaa

SEQ ID NO: 2124397 - RNA, 17 nt, Human
ccaaggagcugagaaua

SEQ ID NO: 2124398 - RNA, 20 nt, Human
ccaaggagcugagaauagaa

SEQ ID NO: 2124399 - RNA, 22 nt, Human
ccaaggagcugagaauagaagg

SEQ ID NO: 2124400 - RNA, 23 nt, Human
ccaaggagaugaagcaaacacau

SEQ ID NO: 2124401 - RNA, 14 nt, Human
ccaaagugcuggga

SEQ ID NO: 2124402 - RNA, 20 nt, Human
cauuuggucaagauuuugaa

SEQ ID NO: 2124403 - RNA, 17 nt, Human
cauuugggugguaagag

SEQ ID NO: 2124404 - RNA, 23 nt, Human
cauuugggugguaagagaauguu

SEQ ID NO: 2124405 - RNA, 12 nt, Human
cauuuguaauaa

SEQ ID NO: 2124406 - RNA, 13 nt, Human
cauuuguaauaaa

SEQ ID NO: 2124407 - RNA, 14 nt, Human
cauuuguaauaaag

SEQ ID NO: 2124408 - RNA, 16 nt, Human
cauuuguaauaaagua

SEQ ID NO: 2124409 - RNA, 17 nt, Human
cauuuguaauaaaguau

SEQ ID NO: 2124410 - RNA, 18 nt, Human
cauuuguaauaaaguaua

SEQ ID NO: 2124411 - RNA, 20 nt, Human
cauuuggcuuuccagucaua

SEQ ID NO: 2124412 - RNA, 17 nt, Human
cauuugggguagcuaga

SEQ ID NO: 2124413 - RNA, 22 nt, Human
cauuugggguagcuagaggaac

SEQ ID NO: 2124414 - RNA, 15 nt, Human
cauuuggguaaauca

SEQ ID NO: 2124415 - RNA, 16 nt, Human
cauuuggguaaaucau

SEQ ID NO: 2124416 - RNA, 15 nt, Human
cauuuguuauucuua

SEQ ID NO: 2124417 - RNA, 19 nt, Human
cauuuguuauucuuaagac

SEQ ID NO: 2124418 - RNA, 21 nt, Human
cauuuuuuuucagcagacuau

SEQ ID NO: 2124419 - RNA, 13 nt, Human
ccaaaaaaauaag

SEQ ID NO: 2124420 - RNA, 18 nt, Human
ccaaaaaaauaaggugua

SEQ ID NO: 2124421 - RNA, 17 nt, Human
cauuuuuuuuuuuaauu

SEQ ID NO: 2124422 - RNA, 20 nt, Human
cauuuuuuuuuuuaauuuug

SEQ ID NO: 2124423 - RNA, 22 nt, Human
cauuuuuuuuuuuaauuuugua

SEQ ID NO: 2124424 - RNA, 22 nt, Human
ccaaaagucaaaaggugccugu

SEQ ID NO: 2124425 - RNA, 18 nt, Human
ccaaaaguaucgggggcu

SEQ ID NO: 2124426 - RNA, 21 nt, Human
ccaaaagucaaaaggugccug

SEQ ID NO: 2124427 - RNA, 20 nt, Human
cauuuaguucuuuguuauuu

SEQ ID NO: 2124428 - RNA, 17 nt, Human
cauugguucccuuugcu

SEQ ID NO: 2124429 - RNA, 18 nt, Human
cauugguucccuuugcuc

SEQ ID NO: 2124430 - RNA, 22 nt, Human
cauugguucccuuugcuccacc

SEQ ID NO: 2124431 - RNA, 14 nt, Human
cauuuaguucuuug

SEQ ID NO: 2124432 - RNA, 20 nt, Human
cauuuaguccaaugucuuuu

SEQ ID NO: 2124433 - RNA, 18 nt, Human
cauuggguggguaaauuc

SEQ ID NO: 2124434 - RNA, 19 nt, Human
cauuggguggguaaauuca

SEQ ID NO: 2124435 - RNA, 18 nt, Human
cauuggacccacaugagg

SEQ ID NO: 2124436 - RNA, 19 nt, Human
gcccuagagcacacuguag

SEQ ID NO: 2124437 - RNA, 13 nt, Human
gcccuagagcaca

SEQ ID NO: 2124438 - RNA, 17 nt, Human
gcccuagagcacacugu

SEQ ID NO: 2124439 - RNA, 15 nt, Human
gccccugcccggcug

SEQ ID NO: 2124440 - RNA, 20 nt, Human
gcccgugacauccccacccu

SEQ ID NO: 2124441 - RNA, 23 nt, Human
gcccccagugugcacgaguggga

SEQ ID NO: 2124442 - RNA, 13 nt, Human
gcccguguggccc

SEQ ID NO: 2124443 - RNA, 15 nt, Human
gcccguguggccccu

SEQ ID NO: 2124444 - RNA, 16 nt, Human
gcccguguggccccuu

SEQ ID NO: 2124445 - RNA, 17 nt, Human
gcccguguggccccuuc

SEQ ID NO: 2124446 - RNA, 18 nt, Human
gcccguguggccccuuca

SEQ ID NO: 2124447 - RNA, 20 nt, Human
gcccaugugugagugugugc

SEQ ID NO: 2124448 - RNA, 13 nt, Human
gcccaugugugag

SEQ ID NO: 2124449 - RNA, 14 nt, Human
gcccaugugugagu

SEQ ID NO: 2124450 - RNA, 15 nt, Human
gcccaugugugagug

SEQ ID NO: 2124451 - RNA, 15 nt, Human
gccccaaaaccacag

SEQ ID NO: 2124452 - RNA, 16 nt, Human
gccccaaaaccacagc

SEQ ID NO: 2124453 - RNA, 19 nt, Human
gccccaaaaccacagcccu

SEQ ID NO: 2124454 - RNA, 20 nt, Human
gccccaaaaccacagcccug

SEQ ID NO: 2124455 - RNA, 21 nt, Human
gccccaaaaccacagcccugu

SEQ ID NO: 2124456 - RNA, 22 nt, Human
gccccaaaaccacagcccuguc

SEQ ID NO: 2124457 - RNA, 23 nt, Human
gccccaaaaccacagcccuguca

SEQ ID NO: 2124458 - RNA, 16 nt, Human
gcccccaggcugcugg

SEQ ID NO: 2124459 - RNA, 17 nt, Human
gcccccaggcugcugga

SEQ ID NO: 2124460 - RNA, 14 nt, Human
gccccugccccguc

SEQ ID NO: 2124461 - RNA, 15 nt, Human
gccccugccccguca

SEQ ID NO: 2124462 - RNA, 16 nt, Human
gccccugccccgucac

SEQ ID NO: 2124463 - RNA, 20 nt, Human
gccccugccccgucaccauc

SEQ ID NO: 2124464 - RNA, 22 nt, Human
gccccugccccgucaccaucuc

SEQ ID NO: 2124465 - RNA, 14 nt, Human
gccccugccccuca

SEQ ID NO: 2124466 - RNA, 19 nt, Human
gccccugccccucaugcca

SEQ ID NO: 2124467 - RNA, 14 nt, Human
gccccugcccggcu

SEQ ID NO: 2124468 - RNA, 13 nt, Human
gccccugcccggc

SEQ ID NO: 2124469 - RNA, 21 nt, Human
gcccaugguugagaaaugaau

SEQ ID NO: 2124470 - RNA, 18 nt, Human
gcccacguucucucugcc

SEQ ID NO: 2124471 - RNA, 21 nt, Human
gcccacguucucucugccugu

SEQ ID NO: 2124472 - RNA, 23 nt, Human
gcccacguucucucugccuguga

SEQ ID NO: 2124473 - RNA, 18 nt, Human
gcccacuauggucaucuu

SEQ ID NO: 2124474 - RNA, 21 nt, Human
gcccugcugccgccucccagc

SEQ ID NO: 2124475 - RNA, 22 nt, Human
gcccugcugccgccucccagcc

SEQ ID NO: 2124476 - RNA, 23 nt, Human
gcccugcugccgccucccagccu

SEQ ID NO: 2124477 - RNA, 21 nt, Human
gcccuguucugggugcagcug

SEQ ID NO: 2124478 - RNA, 16 nt, Human
gccgccaugcuccugg

SEQ ID NO: 2124479 - RNA, 20 nt, Human
gccgccaggaccgccaaaga

SEQ ID NO: 2124480 - RNA, 16 nt, Human
gccgccauugccacca

SEQ ID NO: 2124481 - RNA, 17 nt, Human
gccgccauugccaccag

SEQ ID NO: 2124482 - RNA, 18 nt, Human
gccgccauugccaccagg

SEQ ID NO: 2124483 - RNA, 21 nt, Human
gccgccauugccaccaggaga

SEQ ID NO: 2124484 - RNA, 12 nt, Human
gccgccucccag

SEQ ID NO: 2124485 - RNA, 13 nt, Human
gccgccucccagc

SEQ ID NO: 2124486 - RNA, 14 nt, Human
gccgccucccagcc

SEQ ID NO: 2124487 - RNA, 15 nt, Human
gccgccucccagccu

SEQ ID NO: 2124488 - RNA, 16 nt, Human
gccgccucccagccug

SEQ ID NO: 2124489 - RNA, 17 nt, Human
gccgccucccagccugg

SEQ ID NO: 2124490 - RNA, 15 nt, Human
gccgccaugcuccug

SEQ ID NO: 2124491 - RNA, 16 nt, Human
gccgcauucccugagu

SEQ ID NO: 2124492 - RNA, 18 nt, Human
gccgcauucccugaguca

SEQ ID NO: 2124493 - RNA, 19 nt, Human
gccgccugcgggcugcccc

SEQ ID NO: 2124494 - RNA, 23 nt, Human
gccgcuccugucugccagccagc

SEQ ID NO: 2124495 - RNA, 19 nt, Human
gccgccucccagccugggg

SEQ ID NO: 2124496 - RNA, 15 nt, Human
gccgcuguucaccca

SEQ ID NO: 2124497 - RNA, 16 nt, Human
gccgcuguucacccac

SEQ ID NO: 2124498 - RNA, 17 nt, Human
gccgcuguucacccaca

SEQ ID NO: 2124499 - RNA, 23 nt, Human
gccuggcuucuggagcccuuggg

SEQ ID NO: 2124500 - RNA, 18 nt, Human
gccuggcuucuggagccc

SEQ ID NO: 2124501 - RNA, 22 nt, Human
gccuggcuucuggagcccuugg

SEQ ID NO: 2124502 - RNA, 14 nt, Human
gccuggcuucugga

SEQ ID NO: 2124503 - RNA, 15 nt, Human
gccuggcuucuggag

SEQ ID NO: 2124504 - RNA, 16 nt, Human
gccuggcuucuggagc

SEQ ID NO: 2124505 - RNA, 17 nt, Human
gccuggcuucuggagcc

SEQ ID NO: 2124506 - RNA, 21 nt, Human
gccugggaggucaaggcugca

SEQ ID NO: 2124507 - RNA, 23 nt, Human
gccugggaauguauuauucugca

SEQ ID NO: 2124508 - RNA, 21 nt, Human
gccugggaaccuuccugucuu

SEQ ID NO: 2124509 - RNA, 15 nt, Human
gccugggaauguauu

SEQ ID NO: 2124510 - RNA, 22 nt, Human
gccugggaggucaaggcugcag

SEQ ID NO: 2124511 - RNA, 21 nt, Human
gccugugugacaucaguggca

SEQ ID NO: 2124512 - RNA, 17 nt, Human
gccugccuguucccauu

SEQ ID NO: 2124513 - RNA, 16 nt, Human
gccugccucuucucua

SEQ ID NO: 2124514 - RNA, 15 nt, Human
gccugccuucguuaa

SEQ ID NO: 2124515 - RNA, 16 nt, Human
gccugccuugaagcca

SEQ ID NO: 2124516 - RNA, 23 nt, Human
gccugccuugaagccacugaagc

SEQ ID NO: 2124517 - RNA, 18 nt, Human
gccuacuagggaccuggg

SEQ ID NO: 2124518 - RNA, 19 nt, Human
gccuacuagggaccugggg

SEQ ID NO: 2124519 - RNA, 20 nt, Human
gccuacuagggaccugggga

SEQ ID NO: 2124520 - RNA, 22 nt, Human
gccuacuagggaccuggggaag

SEQ ID NO: 2124521 - RNA, 12 nt, Human
gccuacucacga

SEQ ID NO: 2124522 - RNA, 22 nt, Human
gccuaccggcaauuuccggcca

SEQ ID NO: 2124523 - RNA, 14 nt, Human
gccuacauuaucua

SEQ ID NO: 2124524 - RNA, 15 nt, Human
gccggccagcuggga

SEQ ID NO: 2124525 - RNA, 12 nt, Human
gccggcccuggg

SEQ ID NO: 2124526 - RNA, 20 nt, Human
gccggcccuggggcuaggcu

SEQ ID NO: 2124527 - RNA, 13 nt, Human
gccggcccugggg

SEQ ID NO: 2124528 - RNA, 14 nt, Human
gccggcccuggggc

SEQ ID NO: 2124529 - RNA, 13 nt, Human
gccuccuccagcc

SEQ ID NO: 2124530 - RNA, 16 nt, Human
gccuccucuaacaggg

SEQ ID NO: 2124531 - RNA, 18 nt, Human
gccuccuguguagcuggg

SEQ ID NO: 2124532 - RNA, 13 nt, Human
gccuccuguguaa

SEQ ID NO: 2124533 - RNA, 13 nt, Human
gccuccugugugu

SEQ ID NO: 2124534 - RNA, 12 nt, Human
gccucugcuggc

SEQ ID NO: 2124535 - RNA, 15 nt, Human
gccucugcugccaug

SEQ ID NO: 2124536 - RNA, 17 nt, Human
gccucuggaggccucug

SEQ ID NO: 2124537 - RNA, 19 nt, Human
gccucuggaggccucuggg

SEQ ID NO: 2124538 - RNA, 20 nt, Human
gccucuggaggccucugggc

SEQ ID NO: 2124539 - RNA, 21 nt, Human
gccucuggaggccucugggcc

SEQ ID NO: 2124540 - RNA, 17 nt, Human
gccucuggauuguggga

SEQ ID NO: 2124541 - RNA, 12 nt, Human
gccucuggcuag

SEQ ID NO: 2124542 - RNA, 22 nt, Human
gccucuggcuagaggccagccc

SEQ ID NO: 2124543 - RNA, 23 nt, Human
gccucuggcuagaggccagcccc

SEQ ID NO: 2124544 - RNA, 12 nt, Human
gccucugggacu

SEQ ID NO: 2124545 - RNA, 13 nt, Human
gccucuggcuaga

SEQ ID NO: 2124546 - RNA, 18 nt, Human
gccucuggcuagaggcca

SEQ ID NO: 2124547 - RNA, 19 nt, Human
gccucuggcuagaggccag

SEQ ID NO: 2124548 - RNA, 21 nt, Human
gccucuggcuagaggccagcc

SEQ ID NO: 2124549 - RNA, 20 nt, Human
gccugcccaggccccugcca

SEQ ID NO: 2124550 - RNA, 19 nt, Human
gccugcccaggccccugcc

SEQ ID NO: 2124551 - RNA, 17 nt, Human
gccugccuagcacucac

SEQ ID NO: 2124552 - RNA, 21 nt, Human
gccugccuagcacucacaugc

SEQ ID NO: 2124553 - RNA, 22 nt, Human
gccugccuagcacucacaugcu

SEQ ID NO: 2124554 - RNA, 18 nt, Human
gccugcccaggccccugc

SEQ ID NO: 2124555 - RNA, 17 nt, Human
gccugcccaggccccug

SEQ ID NO: 2124556 - RNA, 20 nt, Human
gccucuugcggucccuucuu

SEQ ID NO: 2124557 - RNA, 12 nt, Human
gccucuuccucc

SEQ ID NO: 2124558 - RNA, 22 nt, Human
gccucuuccucccucauuccac

SEQ ID NO: 2124559 - RNA, 18 nt, Human
gccucuuaaagcugccug

SEQ ID NO: 2124560 - RNA, 16 nt, Human
gccucuucuucuucag

SEQ ID NO: 2124561 - RNA, 20 nt, Human
gccucuucuucuucagaaga

SEQ ID NO: 2124562 - RNA, 21 nt, Human
gccucuucuucuucagaagac

SEQ ID NO: 2124563 - RNA, 15 nt, Human
gccucuucuucuuca

SEQ ID NO: 2124564 - RNA, 19 nt, Human
gccucuuaaagcugccugu

SEQ ID NO: 2124565 - RNA, 17 nt, Human
gccucuucuagagccgu

SEQ ID NO: 2124566 - RNA, 12 nt, Human
gccucuucucua

SEQ ID NO: 2124567 - RNA, 23 nt, Human
gccucuucucuacucuagggaaa

SEQ ID NO: 2124568 - RNA, 14 nt, Human
gccaggccuggguc

SEQ ID NO: 2124569 - RNA, 21 nt, Human
gccaggccugggucugugucu

SEQ ID NO: 2124570 - RNA, 13 nt, Human
gccaggccagagg

SEQ ID NO: 2124571 - RNA, 12 nt, Human
gccaggccagag

SEQ ID NO: 2124572 - RNA, 19 nt, Human
gccaggaguuugagaccag

SEQ ID NO: 2124573 - RNA, 21 nt, Human
gccagcacccccacgcccuca

SEQ ID NO: 2124574 - RNA, 12 nt, Human
gccagccagcag

SEQ ID NO: 2124575 - RNA, 13 nt, Human
gccagccagcagc

SEQ ID NO: 2124576 - RNA, 14 nt, Human
gccagccagcagcc

SEQ ID NO: 2124577 - RNA, 20 nt, Human
gccaggagcucuucaggccu

SEQ ID NO: 2124578 - RNA, 23 nt, Human
gccaggagcugggcagaaggcca

SEQ ID NO: 2124579 - RNA, 22 nt, Human
gccaggagcugggcagaaggcc

SEQ ID NO: 2124580 - RNA, 13 nt, Human
gccaggagcuggg

SEQ ID NO: 2124581 - RNA, 22 nt, Human
gccaggagcucuucaggccucc

SEQ ID NO: 2124582 - RNA, 16 nt, Human
gccagcagccagcucu

SEQ ID NO: 2124583 - RNA, 17 nt, Human
gccagcagccagcucuc

SEQ ID NO: 2124584 - RNA, 18 nt, Human
gccagcagccagcucuca

SEQ ID NO: 2124585 - RNA, 19 nt, Human
gccagcagccagcucucag

SEQ ID NO: 2124586 - RNA, 20 nt, Human
gccagcagccagcucucagc

SEQ ID NO: 2124587 - RNA, 21 nt, Human
gccagcagccagcucucagcc

SEQ ID NO: 2124588 - RNA, 22 nt, Human
gccagcagccagcucucagcca

SEQ ID NO: 2124589 - RNA, 23 nt, Human
gccagcagccagcucucagccaa

SEQ ID NO: 2124590 - RNA, 12 nt, Human
gccagcagccag

SEQ ID NO: 2124591 - RNA, 13 nt, Human
gccagcagccagc

SEQ ID NO: 2124592 - RNA, 15 nt, Human
gccagcagccagcuc

SEQ ID NO: 2124593 - RNA, 21 nt, Human
gccagaaguuugucaagucaa

SEQ ID NO: 2124594 - RNA, 14 nt, Human
gccagacauguggu

SEQ ID NO: 2124595 - RNA, 13 nt, Human
gccagaccagagc

SEQ ID NO: 2124596 - RNA, 14 nt, Human
gccagaccagagcu

SEQ ID NO: 2124597 - RNA, 15 nt, Human
gccagaccagagcuc

SEQ ID NO: 2124598 - RNA, 17 nt, Human
gccagaccagagcucug

SEQ ID NO: 2124599 - RNA, 19 nt, Human
gccagaccagagcucugga

SEQ ID NO: 2124600 - RNA, 14 nt, Human
gccagaaccccgag

SEQ ID NO: 2124601 - RNA, 15 nt, Human
gccagaaccccgagc

SEQ ID NO: 2124602 - RNA, 20 nt, Human
gccagaaccccgagcccuac

SEQ ID NO: 2124603 - RNA, 21 nt, Human
gccagaagcugagcaccaggg

SEQ ID NO: 2124604 - RNA, 18 nt, Human
gccagaagggggccauga

SEQ ID NO: 2124605 - RNA, 12 nt, Human
gccagaagcuga

SEQ ID NO: 2124606 - RNA, 22 nt, Human
gccagacggcacccacccagca

SEQ ID NO: 2124607 - RNA, 23 nt, Human
gccagacggcacccacccagcac

SEQ ID NO: 2124608 - RNA, 15 nt, Human
gccagcaagguggag

SEQ ID NO: 2124609 - RNA, 18 nt, Human
gccagcaagguggagugg

SEQ ID NO: 2124610 - RNA, 20 nt, Human
gccauauucuguuggccagu

SEQ ID NO: 2124611 - RNA, 19 nt, Human
gccauauucuguuggccag

SEQ ID NO: 2124612 - RNA, 14 nt, Human
gccauguuggccag

SEQ ID NO: 2124613 - RNA, 15 nt, Human
gccaugugaagaggg

SEQ ID NO: 2124614 - RNA, 17 nt, Human
gccaugugaagagggag

SEQ ID NO: 2124615 - RNA, 18 nt, Human
gccauguuggccaggcug

SEQ ID NO: 2124616 - RNA, 17 nt, Human
gccauguuggccaggcu

SEQ ID NO: 2124617 - RNA, 16 nt, Human
gccauguuggccaggc

SEQ ID NO: 2124618 - RNA, 15 nt, Human
gccauguuggccagg

SEQ ID NO: 2124619 - RNA, 24 nt, Human
gccauguuggccaggcuggucuca

SEQ ID NO: 2124620 - RNA, 22 nt, Human
gccauguuggccaggcuggucu

SEQ ID NO: 2124621 - RNA, 20 nt, Human
gccauguuggccaggcuggu

SEQ ID NO: 2124622 - RNA, 19 nt, Human
gccauguuggccaggcugg

SEQ ID NO: 2124623 - RNA, 18 nt, Human
gccauucucaagcccugc

SEQ ID NO: 2124624 - RNA, 16 nt, Human
gccauucucaagcccu

SEQ ID NO: 2124625 - RNA, 14 nt, Human
gccauuccaacagc

SEQ ID NO: 2124626 - RNA, 14 nt, Human
gccauguuuaagau

SEQ ID NO: 2124627 - RNA, 15 nt, Human
gccauguuuaagauu

SEQ ID NO: 2124628 - RNA, 16 nt, Human
gccauguuuaagauuu

SEQ ID NO: 2124629 - RNA, 17 nt, Human
gccauguuuaagauuua

SEQ ID NO: 2124630 - RNA, 21 nt, Human
gccauguuuaagauuuaauuu

SEQ ID NO: 2124631 - RNA, 17 nt, Human
gcccacgcuggagugca

SEQ ID NO: 2124632 - RNA, 16 nt, Human
gcccacgcuggagugc

SEQ ID NO: 2124633 - RNA, 15 nt, Human
gcccacgcuggagug

SEQ ID NO: 2124634 - RNA, 18 nt, Human
gcccaccuuggcucaagu

SEQ ID NO: 2124635 - RNA, 18 nt, Human
gcacuuggagacuuguau

SEQ ID NO: 2124636 - RNA, 13 nt, Human
gcacuuggagcca

SEQ ID NO: 2124637 - RNA, 16 nt, Human
gcacuuggagccaagg

SEQ ID NO: 2124638 - RNA, 14 nt, Human
gcacuuggccucug

SEQ ID NO: 2124639 - RNA, 22 nt, Human
gcacuuggagccaaggguucag

SEQ ID NO: 2124640 - RNA, 16 nt, Human
gccaccacguccagcu

SEQ ID NO: 2124641 - RNA, 14 nt, Human
gccaccacguccag

SEQ ID NO: 2124642 - RNA, 15 nt, Human
gccaccacguccagc

SEQ ID NO: 2124643 - RNA, 16 nt, Human
gccaccaugcccagcu

SEQ ID NO: 2124644 - RNA, 22 nt, Human
gccaccaugcccagcucagagg

SEQ ID NO: 2124645 - RNA, 14 nt, Human
gccaccauggccag

SEQ ID NO: 2124646 - RNA, 16 nt, Human
gccaccauggccagcc

SEQ ID NO: 2124647 - RNA, 17 nt, Human
gccaccauggccagcca

SEQ ID NO: 2124648 - RNA, 18 nt, Human
gccaccauggccagccaa

SEQ ID NO: 2124649 - RNA, 16 nt, Human
gccaccaggucaucuc

SEQ ID NO: 2124650 - RNA, 22 nt, Human
gccaccauauucagugcugugg

SEQ ID NO: 2124651 - RNA, 23 nt, Human
gccaccauauucagugcuguggc

SEQ ID NO: 2124652 - RNA, 16 nt, Human
gccaccaacuggcccu

SEQ ID NO: 2124653 - RNA, 18 nt, Human
gccaccaacuggcccucu

SEQ ID NO: 2124654 - RNA, 19 nt, Human
gccaccaacuggcccucuu

SEQ ID NO: 2124655 - RNA, 18 nt, Human
gccaccccgggcucucug

SEQ ID NO: 2124656 - RNA, 19 nt, Human
gccaccccgggcucucugc

SEQ ID NO: 2124657 - RNA, 15 nt, Human
gccacccucccagcu

SEQ ID NO: 2124658 - RNA, 16 nt, Human
gccacccucccagcuc

SEQ ID NO: 2124659 - RNA, 18 nt, Human
gccacccucccagcucug

SEQ ID NO: 2124660 - RNA, 15 nt, Human
gccaccccuccuucc

SEQ ID NO: 2124661 - RNA, 21 nt, Human
gccaccccgggcucucugcug

SEQ ID NO: 2124662 - RNA, 16 nt, Human
gccaccccuccuuccu

SEQ ID NO: 2124663 - RNA, 23 nt, Human
gccacugcaccgggccacagaga

SEQ ID NO: 2124664 - RNA, 19 nt, Human
gccacccuggggagaaagu

SEQ ID NO: 2124665 - RNA, 13 nt, Human
gccacccugggga

SEQ ID NO: 2124666 - RNA, 12 nt, Human
gccacugcacuc

SEQ ID NO: 2124667 - RNA, 19 nt, Human
gccacugcacuccaaucug

SEQ ID NO: 2124668 - RNA, 18 nt, Human
gccacugcacuccagccu

SEQ ID NO: 2124669 - RNA, 21 nt, Human
gccacugcacuauagccuagg

SEQ ID NO: 2124670 - RNA, 19 nt, Human
gccacugcauaccaaccug

SEQ ID NO: 2124671 - RNA, 16 nt, Human
gccacugcccgagcug

SEQ ID NO: 2124672 - RNA, 17 nt, Human
gccacugcccgagcugg

SEQ ID NO: 2124673 - RNA, 18 nt, Human
gccacugcccgagcuggu

SEQ ID NO: 2124674 - RNA, 19 nt, Human
gccacugcacuccagccug

SEQ ID NO: 2124675 - RNA, 20 nt, Human
gccacugcacuccagccugg

SEQ ID NO: 2124676 - RNA, 21 nt, Human
gccacugcacuccagccuggg

SEQ ID NO: 2124677 - RNA, 22 nt, Human
gccacugcacuccagccugggc

SEQ ID NO: 2124678 - RNA, 21 nt, Human
gccacuugaugacccccaacc

SEQ ID NO: 2124679 - RNA, 22 nt, Human
gccacuuaccuucaauaaagua

SEQ ID NO: 2124680 - RNA, 23 nt, Human
gccacuuaccuucaauaaaguau

SEQ ID NO: 2124681 - RNA, 14 nt, Human
gccacuuaccuuca

SEQ ID NO: 2124682 - RNA, 19 nt, Human
gccacuuaccuucaauaaa

SEQ ID NO: 2124683 - RNA, 21 nt, Human
gccacuuaccuucaauaaagu

SEQ ID NO: 2124684 - RNA, 12 nt, Human
gccagaaauaaa

SEQ ID NO: 2124685 - RNA, 16 nt, Human
gccagaacaguuugua

SEQ ID NO: 2124686 - RNA, 18 nt, Human
gccagaacaguuuguaca

SEQ ID NO: 2124687 - RNA, 21 nt, Human
gccacuuugguacauggccag

SEQ ID NO: 2124688 - RNA, 22 nt, Human
gccacuuugguacauggccagu

SEQ ID NO: 2124689 - RNA, 23 nt, Human
gccacuuugguacauggccagug

SEQ ID NO: 2124690 - RNA, 23 nt, Human
gccacuuuugacuagggauucag

SEQ ID NO: 2124691 - RNA, 17 nt, Human
gccacugccucuuccuc

SEQ ID NO: 2124692 - RNA, 16 nt, Human
gccacugccucuuccu

SEQ ID NO: 2124693 - RNA, 13 nt, Human
gccacugccucuu

SEQ ID NO: 2124694 - RNA, 12 nt, Human
gccacugccucu

SEQ ID NO: 2124695 - RNA, 19 nt, Human
gccacugcccgagcuggug

SEQ ID NO: 2124696 - RNA, 21 nt, Human
gccacugcccgagcuggugca

SEQ ID NO: 2124697 - RNA, 18 nt, Human
gccacugugaagagaacc

SEQ ID NO: 2124698 - RNA, 19 nt, Human
gccacugugaagagaacca

SEQ ID NO: 2124699 - RNA, 12 nt, Human
gcucaccugggg

SEQ ID NO: 2124700 - RNA, 13 nt, Human
gcucaccuggggu

SEQ ID NO: 2124701 - RNA, 22 nt, Human
gcucaccuggggugugggaggc

SEQ ID NO: 2124702 - RNA, 22 nt, Human
gcuauguauggaauacaguguu

SEQ ID NO: 2124703 - RNA, 18 nt, Human
gcuauggggagaaaagac

SEQ ID NO: 2124704 - RNA, 19 nt, Human
gcuaugggagccccagggu

SEQ ID NO: 2124705 - RNA, 21 nt, Human
gcuaugggagccccagggucu

SEQ ID NO: 2124706 - RNA, 18 nt, Human
gcuaggauguugcucaga

SEQ ID NO: 2124707 - RNA, 15 nt, Human
gcuaggccuggccag

SEQ ID NO: 2124708 - RNA, 14 nt, Human
gcuaggccuggcca

SEQ ID NO: 2124709 - RNA, 18 nt, Human
gcuaggcauacaaguagg

SEQ ID NO: 2124710 - RNA, 18 nt, Human
gcuaugggagccccaggg

SEQ ID NO: 2124711 - RNA, 19 nt, Human
gccuguucagcuccagcuc

SEQ ID NO: 2124712 - RNA, 22 nt, Human
gccugugugacaucaguggcau

SEQ ID NO: 2124713 - RNA, 20 nt, Human
gccuguucagcuccagcuca

SEQ ID NO: 2124714 - RNA, 21 nt, Human
gccuguuagcaugcuggugag

SEQ ID NO: 2124715 - RNA, 20 nt, Human
gcucaggggcguguggcuca

SEQ ID NO: 2124716 - RNA, 17 nt, Human
gcucagguacagagaag

SEQ ID NO: 2124717 - RNA, 19 nt, Human
gcucagguacagagaagga

SEQ ID NO: 2124718 - RNA, 20 nt, Human
gcucagguacagagaaggaa

SEQ ID NO: 2124719 - RNA, 21 nt, Human
gcucagguacagagaaggaau

SEQ ID NO: 2124720 - RNA, 23 nt, Human
gcucagguacagagaaggaaugu

SEQ ID NO: 2124721 - RNA, 13 nt, Human
gcucacgugugug

SEQ ID NO: 2124722 - RNA, 15 nt, Human
gcucacgugugugac

SEQ ID NO: 2124723 - RNA, 17 nt, Human
gcucacgugugugacuc

SEQ ID NO: 2124724 - RNA, 21 nt, Human
gcucacgccuaugaucccagc

SEQ ID NO: 2124725 - RNA, 22 nt, Human
gcucacgccuaugaucccagca

SEQ ID NO: 2124726 - RNA, 22 nt, Human
gcucacgugagagugucuucac

SEQ ID NO: 2124727 - RNA, 14 nt, Human
gcucacgucacacu

SEQ ID NO: 2124728 - RNA, 15 nt, Human
gcucacgucacacuu

SEQ ID NO: 2124729 - RNA, 21 nt, Human
gcucacgccuguaaucccagc

SEQ ID NO: 2124730 - RNA, 22 nt, Human
gcucacgccuguaaucccagca

SEQ ID NO: 2124731 - RNA, 12 nt, Human
gcucuaauugaa

SEQ ID NO: 2124732 - RNA, 22 nt, Human
gcucuacagcuaaucagcauuc

SEQ ID NO: 2124733 - RNA, 20 nt, Human
gcucuacagcuaaucagcau

SEQ ID NO: 2124734 - RNA, 13 nt, Human
gcuccccagccca

SEQ ID NO: 2124735 - RNA, 14 nt, Human
gcuccccagcccag

SEQ ID NO: 2124736 - RNA, 15 nt, Human
gcuccccagcccagg

SEQ ID NO: 2124737 - RNA, 16 nt, Human
gcuccccagcccaggg

SEQ ID NO: 2124738 - RNA, 15 nt, Human
gcuccccucccuccu

SEQ ID NO: 2124739 - RNA, 11 nt, Human
gcuccucuggg

SEQ ID NO: 2124740 - RNA, 19 nt, Human
gcuccucugggcaggaccu

SEQ ID NO: 2124741 - RNA, 12 nt, Human
gcuccucugggc

SEQ ID NO: 2124742 - RNA, 13 nt, Human
gcuccucugggca

SEQ ID NO: 2124743 - RNA, 14 nt, Human
gcuccucugggcag

SEQ ID NO: 2124744 - RNA, 16 nt, Human
gcuccucugggcagga

SEQ ID NO: 2124745 - RNA, 21 nt, Human
gcucugaccgaaacagcgcug

SEQ ID NO: 2124746 - RNA, 21 nt, Human
gcucugagcaaauguggcucc

SEQ ID NO: 2124747 - RNA, 20 nt, Human
gcucugagcaaauguggcuc

SEQ ID NO: 2124748 - RNA, 11 nt, Human
gcucugcacag

SEQ ID NO: 2124749 - RNA, 12 nt, Human
gcucugcacaga

SEQ ID NO: 2124750 - RNA, 13 nt, Human
gcucugcacagau

SEQ ID NO: 2124751 - RNA, 14 nt, Human
gcucugcacagaug

SEQ ID NO: 2124752 - RNA, 18 nt, Human
gcucugcacagauggauu

SEQ ID NO: 2124753 - RNA, 15 nt, Human
gcucugcacagaugg

SEQ ID NO: 2124754 - RNA, 15 nt, Human
gcucuggccuccaag

SEQ ID NO: 2124755 - RNA, 17 nt, Human
gcucuggccuccaaguc

SEQ ID NO: 2124756 - RNA, 14 nt, Human
gcucuggcucacag

SEQ ID NO: 2124757 - RNA, 15 nt, Human
gcucuggcucacaga

SEQ ID NO: 2124758 - RNA, 18 nt, Human
gcucuggcucacagacug

SEQ ID NO: 2124759 - RNA, 22 nt, Human
gcucuggcucacagacuggaga

SEQ ID NO: 2124760 - RNA, 21 nt, Human
gcucuggcucuccccaauauc

SEQ ID NO: 2124761 - RNA, 14 nt, Human
gcucuguccuggga

SEQ ID NO: 2124762 - RNA, 15 nt, Human
gcucuguccugggag

SEQ ID NO: 2124763 - RNA, 16 nt, Human
gcucuguccugggagu

SEQ ID NO: 2124764 - RNA, 21 nt, Human
gcucugggauagcugacccag

SEQ ID NO: 2124765 - RNA, 17 nt, Human
gcucuguguugccaugu

SEQ ID NO: 2124766 - RNA, 12 nt, Human
gcucuucaggcc

SEQ ID NO: 2124767 - RNA, 15 nt, Human
gcucuucaggccucc

SEQ ID NO: 2124768 - RNA, 18 nt, Human
gcucuucaggccucccuc

SEQ ID NO: 2124769 - RNA, 12 nt, Human
gcugaaauacug

SEQ ID NO: 2124770 - RNA, 19 nt, Human
gcucuucagugggagaaaa

SEQ ID NO: 2124771 - RNA, 20 nt, Human
gcugaaauacugaggggucu

SEQ ID NO: 2124772 - RNA, 22 nt, Human
gcugaagcuuauuaaugcuaag

SEQ ID NO: 2124773 - RNA, 21 nt, Human
gcugaagcuuauuaaugcuaa

SEQ ID NO: 2124774 - RNA, 19 nt, Human
gcugaagccgccaggaccg

SEQ ID NO: 2124775 - RNA, 17 nt, Human
gcugaaugguuuucaaa

SEQ ID NO: 2124776 - RNA, 22 nt, Human
gcugaauacagaggcaacugca

SEQ ID NO: 2124777 - RNA, 15 nt, Human
gcugacagacacagg

SEQ ID NO: 2124778 - RNA, 14 nt, Human
gcugacagacacag

SEQ ID NO: 2124779 - RNA, 16 nt, Human
gcugacagacacaggc

SEQ ID NO: 2124780 - RNA, 20 nt, Human
gcuuccauuugugugugugc

SEQ ID NO: 2124781 - RNA, 14 nt, Human
gcuuccccucucuc

SEQ ID NO: 2124782 - RNA, 16 nt, Human
gcuuccccucucuccu

SEQ ID NO: 2124783 - RNA, 16 nt, Human
gcuucccccauagcca

SEQ ID NO: 2124784 - RNA, 18 nt, Human
gcuucccccauagccacc

SEQ ID NO: 2124785 - RNA, 14 nt, Human
gcuucccccauagc

SEQ ID NO: 2124786 - RNA, 15 nt, Human
gcuucccccauagcc

SEQ ID NO: 2124787 - RNA, 17 nt, Human
gcuucccucugccuguc

SEQ ID NO: 2124788 - RNA, 19 nt, Human
gcuucccucugccuguccc

SEQ ID NO: 2124789 - RNA, 20 nt, Human
gcuucccucugccugucccu

SEQ ID NO: 2124790 - RNA, 23 nt, Human
gcuucccucugccugucccucuc

SEQ ID NO: 2124791 - RNA, 18 nt, Human
gcuucccgcucagcccuc

SEQ ID NO: 2124792 - RNA, 17 nt, Human
gcuucccgcucagcccu

SEQ ID NO: 2124793 - RNA, 16 nt, Human
gcuucccgcucagccc

SEQ ID NO: 2124794 - RNA, 15 nt, Human
gcuucccgcucagcc

SEQ ID NO: 2124795 - RNA, 12 nt, Human
gcuucccucugc

SEQ ID NO: 2124796 - RNA, 13 nt, Human
gcuucccucugcc

SEQ ID NO: 2124797 - RNA, 15 nt, Human
gcuucccucugccug

SEQ ID NO: 2124798 - RNA, 23 nt, Human
gcuucccgcucagcccucccugc

SEQ ID NO: 2124799 - RNA, 18 nt, Human
gcuuccccucucuccucc

SEQ ID NO: 2124800 - RNA, 22 nt, Human
gcuuccuuggcaucacagggca

SEQ ID NO: 2124801 - RNA, 22 nt, Human
gcuuccuuuguuuuuuuuuccu

SEQ ID NO: 2124802 - RNA, 23 nt, Human
gcuuccuuuguuuuuuuuuccug

SEQ ID NO: 2124803 - RNA, 19 nt, Human
gcuucgaggcccagcgacc

SEQ ID NO: 2124804 - RNA, 21 nt, Human
gcuucgaggcccagcgaccuc

SEQ ID NO: 2124805 - RNA, 23 nt, Human
gcuucuuuuaguuguaucucuuu

SEQ ID NO: 2124806 - RNA, 16 nt, Human
gcuuggggcuuccuaa

SEQ ID NO: 2124807 - RNA, 24 nt, Human
gcuugggggaugacuagaggcagg

SEQ ID NO: 2124808 - RNA, 19 nt, Human
gcuuggguguaacaggucu

SEQ ID NO: 2124809 - RNA, 21 nt, Human
gcuuggguguaacaggucucc

SEQ ID NO: 2124810 - RNA, 14 nt, Human
gcuucagccaggag

SEQ ID NO: 2124811 - RNA, 17 nt, Human
gcuucagcauauuuaua

SEQ ID NO: 2124812 - RNA, 19 nt, Human
gcuucagcauauuuauagc

SEQ ID NO: 2124813 - RNA, 20 nt, Human
gcuucacggaagagccuugc

SEQ ID NO: 2124814 - RNA, 20 nt, Human
gcuucaauuuauugcacaaa

SEQ ID NO: 2124815 - RNA, 18 nt, Human
gcuucaagucugugccug

SEQ ID NO: 2124816 - RNA, 22 nt, Human
gcuucaagucugugccuggagc

SEQ ID NO: 2124817 - RNA, 23 nt, Human
gcuucaagucugugccuggagcu

SEQ ID NO: 2124818 - RNA, 20 nt, Human
gcugugaacaagugaacaca

SEQ ID NO: 2124819 - RNA, 22 nt, Human
gcugugaccauuuauaauguua

SEQ ID NO: 2124820 - RNA, 19 nt, Human
gcugugacccucaauucau

SEQ ID NO: 2124821 - RNA, 21 nt, Human
gcugugcucuggacaggcaug

SEQ ID NO: 2124822 - RNA, 14 nt, Human
gcuguggcaggcca

SEQ ID NO: 2124823 - RNA, 23 nt, Human
gcuguggcaggccagcugugguu

SEQ ID NO: 2124824 - RNA, 15 nt, Human
gcuuaaaacuuuuca

SEQ ID NO: 2124825 - RNA, 16 nt, Human
gcuuaaaacuuuucaa

SEQ ID NO: 2124826 - RNA, 18 nt, Human
gcuguugucauugcuuua

SEQ ID NO: 2124827 - RNA, 22 nt, Human
gcuguugucauugcuuuacugg

SEQ ID NO: 2124828 - RNA, 22 nt, Human
gcuguuggcugggggccucagu

SEQ ID NO: 2124829 - RNA, 21 nt, Human
gcuguuggcugggggccucag

SEQ ID NO: 2124830 - RNA, 20 nt, Human
gcuggguguauuaggacugg

SEQ ID NO: 2124831 - RNA, 22 nt, Human
gcuggguguauuaggacuggcu

SEQ ID NO: 2124832 - RNA, 21 nt, Human
gcuggguuggaggguguccca

SEQ ID NO: 2124833 - RNA, 14 nt, Human
gcuggguuggaggg

SEQ ID NO: 2124834 - RNA, 14 nt, Human
gcugguuuuucagu

SEQ ID NO: 2124835 - RNA, 15 nt, Human
gcugguuuuucaguu

SEQ ID NO: 2124836 - RNA, 15 nt, Human
gcuguaaauaaaugc

SEQ ID NO: 2124837 - RNA, 14 nt, Human
gcuguaaauaaaug

SEQ ID NO: 2124838 - RNA, 14 nt, Human
gcuguaaaaucuug

SEQ ID NO: 2124839 - RNA, 16 nt, Human
gcuguaagaagagacu

SEQ ID NO: 2124840 - RNA, 24 nt, Human
gcuguaagaagagacugggaagau

SEQ ID NO: 2124841 - RNA, 23 nt, Human
gcuguaucccaugagccucagca

SEQ ID NO: 2124842 - RNA, 20 nt, Human
gcuguaucccaugagccuca

SEQ ID NO: 2124843 - RNA, 16 nt, Human
gcuguaucuuguuuuu

SEQ ID NO: 2124844 - RNA, 18 nt, Human
gcuguaucuuguuuuucc

SEQ ID NO: 2124845 - RNA, 14 nt, Human
gcuguaucuuguuu

SEQ ID NO: 2124846 - RNA, 18 nt, Human
gcugagggugagugggug

SEQ ID NO: 2124847 - RNA, 22 nt, Human
gcugaggggaggaucacuggag

SEQ ID NO: 2124848 - RNA, 11 nt, Human
gcugaggggca

SEQ ID NO: 2124849 - RNA, 23 nt, Human
gcugaggggcaacgaagaaaaaa

SEQ ID NO: 2124850 - RNA, 15 nt, Human
gcugagggaccagcc

SEQ ID NO: 2124851 - RNA, 16 nt, Human
gcugagggaccagcca

SEQ ID NO: 2124852 - RNA, 12 nt, Human
gcugaggaaagg

SEQ ID NO: 2124853 - RNA, 15 nt, Human
gcugaggaaaggcca

SEQ ID NO: 2124854 - RNA, 16 nt, Human
gcugaggaaaggccag

SEQ ID NO: 2124855 - RNA, 17 nt, Human
gcugaggaaaggccagc

SEQ ID NO: 2124856 - RNA, 21 nt, Human
gcugaggaaaggccagcuggc

SEQ ID NO: 2124857 - RNA, 22 nt, Human
gcugaggaaaggccagcuggca

SEQ ID NO: 2124858 - RNA, 23 nt, Human
gcugaggaaaggccagcuggcag

SEQ ID NO: 2124859 - RNA, 17 nt, Human
gcugcaccugccagccu

SEQ ID NO: 2124860 - RNA, 18 nt, Human
gcugcaccugccagccug

SEQ ID NO: 2124861 - RNA, 19 nt, Human
gcugcaccugccagccugg

SEQ ID NO: 2124862 - RNA, 20 nt, Human
gcugcaccugccagccuggc

SEQ ID NO: 2124863 - RNA, 23 nt, Human
gcugccauccagguucagcuugu

SEQ ID NO: 2124864 - RNA, 23 nt, Human
gcugccauggcgugucccucucg

SEQ ID NO: 2124865 - RNA, 22 nt, Human
gcugccauggcgugucccucuc

SEQ ID NO: 2124866 - RNA, 21 nt, Human
gcugccauccagguucagcuu

SEQ ID NO: 2124867 - RNA, 12 nt, Human
gcugccagagaa

SEQ ID NO: 2124868 - RNA, 21 nt, Human
gcugcaccugccagccuggcu

SEQ ID NO: 2124869 - RNA, 22 nt, Human
gcugcaccugccagccuggcuu

SEQ ID NO: 2124870 - RNA, 12 nt, Human
gcugcugcugcu

SEQ ID NO: 2124871 - RNA, 20 nt, Human
gcugcugcuaaucuucaggg

SEQ ID NO: 2124872 - RNA, 23 nt, Human
gcugcugccuuuagucgcugagg

SEQ ID NO: 2124873 - RNA, 13 nt, Human
gcugcucugccca

SEQ ID NO: 2124874 - RNA, 14 nt, Human
gcugcucugcccag

SEQ ID NO: 2124875 - RNA, 15 nt, Human
gcugcucugcccaga

SEQ ID NO: 2124876 - RNA, 16 nt, Human
gcugcucugcccagag

SEQ ID NO: 2124877 - RNA, 17 nt, Human
gcugcucugcccagagc

SEQ ID NO: 2124878 - RNA, 18 nt, Human
gcugcucugcccagagcu

SEQ ID NO: 2124879 - RNA, 19 nt, Human
gcugcucugcccagagcug

SEQ ID NO: 2124880 - RNA, 20 nt, Human
gcugcucugcccagagcugg

SEQ ID NO: 2124881 - RNA, 21 nt, Human
gcugcucugcccagagcuggg

SEQ ID NO: 2124882 - RNA, 17 nt, Human
gcugcuccuuagcugcc

SEQ ID NO: 2124883 - RNA, 18 nt, Human
gcugcuccuuagcugcca

SEQ ID NO: 2124884 - RNA, 19 nt, Human
gcugcuccuuagcugccaa

SEQ ID NO: 2124885 - RNA, 20 nt, Human
gcugcuccuuagcugccaag

SEQ ID NO: 2124886 - RNA, 23 nt, Human
gcugcuccuuagcugccaagccc

SEQ ID NO: 2124887 - RNA, 13 nt, Human
gcugcuccucaug

SEQ ID NO: 2124888 - RNA, 11 nt, Human
gcugcuccucc

SEQ ID NO: 2124889 - RNA, 12 nt, Human
gcugcuccucca

SEQ ID NO: 2124890 - RNA, 14 nt, Human
gcugcuccuccagg

SEQ ID NO: 2124891 - RNA, 15 nt, Human
gcugcuccuccaggg

SEQ ID NO: 2124892 - RNA, 18 nt, Human
gcugcuccuccagggcca

SEQ ID NO: 2124893 - RNA, 23 nt, Human
gcugcuccuccagggccacgugc

SEQ ID NO: 2124894 - RNA, 22 nt, Human
gcugccuggcccccagcugugg

SEQ ID NO: 2124895 - RNA, 21 nt, Human
gcugccuggcccccagcugug

SEQ ID NO: 2124896 - RNA, 20 nt, Human
gcugccuggaagagcagccc

SEQ ID NO: 2124897 - RNA, 13 nt, Human
gcugccuggagcc

SEQ ID NO: 2124898 - RNA, 14 nt, Human
gcugccuggagccc

SEQ ID NO: 2124899 - RNA, 16 nt, Human
gcugccuggagcccca

SEQ ID NO: 2124900 - RNA, 17 nt, Human
gcugccuggagccccac

SEQ ID NO: 2124901 - RNA, 22 nt, Human
gcugccuggagccccacugccc

SEQ ID NO: 2124902 - RNA, 19 nt, Human
gcugccuggcccccagcug

SEQ ID NO: 2124903 - RNA, 18 nt, Human
gcugccuaaguggcugcu

SEQ ID NO: 2124904 - RNA, 13 nt, Human
gcugccaugugaa

SEQ ID NO: 2124905 - RNA, 21 nt, Human
gcugccaugugaagagggaga

SEQ ID NO: 2124906 - RNA, 17 nt, Human
gcugccaugugaagagg

SEQ ID NO: 2124907 - RNA, 17 nt, Human
gcugcccacacacccca

SEQ ID NO: 2124908 - RNA, 19 nt, Human
gcugccccaugaagccaca

SEQ ID NO: 2124909 - RNA, 20 nt, Human
gcugccccaugaagccacag

SEQ ID NO: 2124910 - RNA, 21 nt, Human
gcugccccaugaagccacagc

SEQ ID NO: 2124911 - RNA, 23 nt, Human
gcugccccaugaagccacagccc

SEQ ID NO: 2124912 - RNA, 17 nt, Human
gcugccuaaguggcugc

SEQ ID NO: 2124913 - RNA, 15 nt, Human
gcugccuaagaggca

SEQ ID NO: 2124914 - RNA, 16 nt, Human
gcugccuaaguggcug

SEQ ID NO: 2124915 - RNA, 15 nt, Human
gcugccgcaccccag

SEQ ID NO: 2124916 - RNA, 18 nt, Human
gcugccgcaccccagagu

SEQ ID NO: 2124917 - RNA, 22 nt, Human
gcugccgcaccccagagugugg

SEQ ID NO: 2124918 - RNA, 13 nt, Human
gcugccgccuccc

SEQ ID NO: 2124919 - RNA, 15 nt, Human
gcugccgccucccag

SEQ ID NO: 2124920 - RNA, 16 nt, Human
gcugccgccucccagc

SEQ ID NO: 2124921 - RNA, 18 nt, Human
gcugccgccucccagccu

SEQ ID NO: 2124922 - RNA, 19 nt, Human
gcugccgccucccagccug

SEQ ID NO: 2124923 - RNA, 20 nt, Human
gcugccgccucccagccugg

SEQ ID NO: 2124924 - RNA, 12 nt, Human
gcuggagugcag

SEQ ID NO: 2124925 - RNA, 12 nt, Human
gcuggacuggcu

SEQ ID NO: 2124926 - RNA, 13 nt, Human
gcuggacuggcug

SEQ ID NO: 2124927 - RNA, 14 nt, Human
gcuggacuggcugu

SEQ ID NO: 2124928 - RNA, 12 nt, Human
gcuggagcuggc

SEQ ID NO: 2124929 - RNA, 22 nt, Human
gcuggagcuggcgucugucuuc

SEQ ID NO: 2124930 - RNA, 17 nt, Human
gcuggacuccagaucug

SEQ ID NO: 2124931 - RNA, 18 nt, Human
gcuggacuccagaucugc

SEQ ID NO: 2124932 - RNA, 20 nt, Human
gcuggacuccagaucugcac

SEQ ID NO: 2124933 - RNA, 21 nt, Human
gcuggacuccagaucugcacc

SEQ ID NO: 2124934 - RNA, 22 nt, Human
gcuggacuccagaucugcaccg

SEQ ID NO: 2124935 - RNA, 23 nt, Human
gcuggacuccagaucugcaccgc

SEQ ID NO: 2124936 - RNA, 16 nt, Human
gcuggacggcauuccu

SEQ ID NO: 2124937 - RNA, 17 nt, Human
gcugggauuacagggau

SEQ ID NO: 2124938 - RNA, 18 nt, Human
gcugggauuacaggugug

SEQ ID NO: 2124939 - RNA, 19 nt, Human
gcugggauuacagguguga

SEQ ID NO: 2124940 - RNA, 19 nt, Human
gcugggcaacaugccugcu

SEQ ID NO: 2124941 - RNA, 19 nt, Human
gcugggcagaaggccaaga

SEQ ID NO: 2124942 - RNA, 13 nt, Human
gcugggcagaagg

SEQ ID NO: 2124943 - RNA, 16 nt, Human
gcugggauuacaggug

SEQ ID NO: 2124944 - RNA, 15 nt, Human
gcuggagugcaguga

SEQ ID NO: 2124945 - RNA, 14 nt, Human
gcuggagugcagug

SEQ ID NO: 2124946 - RNA, 13 nt, Human
gcugggugcccac

SEQ ID NO: 2124947 - RNA, 15 nt, Human
gcugggugcccacag

SEQ ID NO: 2124948 - RNA, 16 nt, Human
gcugggugcccacagc

SEQ ID NO: 2124949 - RNA, 17 nt, Human
gcugggugcccacagcc

SEQ ID NO: 2124950 - RNA, 14 nt, Human
gcugggcagcuguu

SEQ ID NO: 2124951 - RNA, 12 nt, Human
gcugggcagcug

SEQ ID NO: 2124952 - RNA, 13 nt, Human
gcugggcagcugu

SEQ ID NO: 2124953 - RNA, 22 nt, Human
gcuuggguguaacaggucuccu

SEQ ID NO: 2124954 - RNA, 23 nt, Human
gcuuggguguaacaggucuccuc

SEQ ID NO: 2124955 - RNA, 13 nt, Human
ggaccccugcccu

SEQ ID NO: 2124956 - RNA, 13 nt, Human
ggaccccucaccu

SEQ ID NO: 2124957 - RNA, 17 nt, Human
ggaccgguacagaaagg

SEQ ID NO: 2124958 - RNA, 21 nt, Human
ggacccggaggggccuggcag

SEQ ID NO: 2124959 - RNA, 20 nt, Human
ggacccggaggggccuggca

SEQ ID NO: 2124960 - RNA, 12 nt, Human
ggagagccuggu

SEQ ID NO: 2124961 - RNA, 15 nt, Human
ggagagcuagcagca

SEQ ID NO: 2124962 - RNA, 18 nt, Human
ggagagcgccugccccuc

SEQ ID NO: 2124963 - RNA, 20 nt, Human
ggagagcgccugccccuccc

SEQ ID NO: 2124964 - RNA, 22 nt, Human
ggagagcgccugccccucccag

SEQ ID NO: 2124965 - RNA, 14 nt, Human
ggagagagacucca

SEQ ID NO: 2124966 - RNA, 11 nt, Human
ggagagccagc

SEQ ID NO: 2124967 - RNA, 12 nt, Human
ggagagccagcc

SEQ ID NO: 2124968 - RNA, 14 nt, Human
ggagagccagcccu

SEQ ID NO: 2124969 - RNA, 15 nt, Human
ggagagccagcccuc

SEQ ID NO: 2124970 - RNA, 21 nt, Human
ggagagaggggaauaauagaa

SEQ ID NO: 2124971 - RNA, 12 nt, Human
ggagagagggga

SEQ ID NO: 2124972 - RNA, 14 nt, Human
ggagagaggggaau

SEQ ID NO: 2124973 - RNA, 23 nt, Human
ggagagccagcccucccuguccu

SEQ ID NO: 2124974 - RNA, 18 nt, Human
ggagagccagcccucccu

SEQ ID NO: 2124975 - RNA, 21 nt, Human
ggagagccagcccucccuguc

SEQ ID NO: 2124976 - RNA, 11 nt, Human
ggagagcccag

SEQ ID NO: 2124977 - RNA, 12 nt, Human
ggagagcccagc

SEQ ID NO: 2124978 - RNA, 16 nt, Human
ggagagcgccugcccc

SEQ ID NO: 2124979 - RNA, 18 nt, Human
ggacuuuucguuaacauu

SEQ ID NO: 2124980 - RNA, 22 nt, Human
ggacuuuucguuaacauugacc

SEQ ID NO: 2124981 - RNA, 13 nt, Human
ggagaaaacacuu

SEQ ID NO: 2124982 - RNA, 17 nt, Human
ggacuuggaagcuccgc

SEQ ID NO: 2124983 - RNA, 15 nt, Human
ggacuuggcgcgccc

SEQ ID NO: 2124984 - RNA, 15 nt, Human
ggacuuggaagcucc

SEQ ID NO: 2124985 - RNA, 16 nt, Human
ggagacugucucaaga

SEQ ID NO: 2124986 - RNA, 22 nt, Human
ggagacugcugagucaacccaa

SEQ ID NO: 2124987 - RNA, 13 nt, Human
ggagaacuagaga

SEQ ID NO: 2124988 - RNA, 11 nt, Human
ggagaaacaca

SEQ ID NO: 2124989 - RNA, 13 nt, Human
ggagaaacagaga

SEQ ID NO: 2124990 - RNA, 14 nt, Human
ggagaaacagagac

SEQ ID NO: 2124991 - RNA, 20 nt, Human
ggagaaaugcauccauuccu

SEQ ID NO: 2124992 - RNA, 23 nt, Human
ggagaaaugcauccauuccucag

SEQ ID NO: 2124993 - RNA, 15 nt, Human
ggagaaccucaggcu

SEQ ID NO: 2124994 - RNA, 22 nt, Human
ggacucaaugcacugacauugu

SEQ ID NO: 2124995 - RNA, 13 nt, Human
ggacucagcccug

SEQ ID NO: 2124996 - RNA, 15 nt, Human
ggacucacuggcagc

SEQ ID NO: 2124997 - RNA, 16 nt, Human
ggacucacuggcagcc

SEQ ID NO: 2124998 - RNA, 19 nt, Human
ggacucacuggcagcccca

SEQ ID NO: 2124999 - RNA, 23 nt, Human
ggacucacuggcagccccagcac

SEQ ID NO: 2125000 - RNA, 20 nt, Human
ggacuacaggugugagucac

SEQ ID NO: 2125001 - RNA, 13 nt, Human
ggaccucaccaag

SEQ ID NO: 2125002 - RNA, 19 nt, Human
ggaccucagaguccaggcc

SEQ ID NO: 2125003 - RNA, 22 nt, Human
ggaccuaacauucgaucucauu

SEQ ID NO: 2125004 - RNA, 21 nt, Human
ggaccucagaguccaggcccc

SEQ ID NO: 2125005 - RNA, 13 nt, Human
ggacuacugaagc

SEQ ID NO: 2125006 - RNA, 14 nt, Human
ggacucagcccuga

SEQ ID NO: 2125007 - RNA, 15 nt, Human
ggacucagcccugag

SEQ ID NO: 2125008 - RNA, 16 nt, Human
ggacucagcccugagg

SEQ ID NO: 2125009 - RNA, 17 nt, Human
ggacucagcccugaggu

SEQ ID NO: 2125010 - RNA, 23 nt, Human
ggacuguugacauccaagcuucc

SEQ ID NO: 2125011 - RNA, 20 nt, Human
ggacuguuuuuuccugagcu

SEQ ID NO: 2125012 - RNA, 21 nt, Human
ggacuguuuuuuccugagcuu

SEQ ID NO: 2125013 - RNA, 23 nt, Human
ggacuguuuuuuccugagcuugg

SEQ ID NO: 2125014 - RNA, 12 nt, Human
ggagcagagaag

SEQ ID NO: 2125015 - RNA, 14 nt, Human
ggagcagagaaggc

SEQ ID NO: 2125016 - RNA, 16 nt, Human
ggagcagagaaggcca

SEQ ID NO: 2125017 - RNA, 13 nt, Human
ggagccagggcug

SEQ ID NO: 2125018 - RNA, 12 nt, Human
ggagcagugucu

SEQ ID NO: 2125019 - RNA, 18 nt, Human
ggagcagggacagaucau

SEQ ID NO: 2125020 - RNA, 21 nt, Human
ggagguugcagugagcugaga

SEQ ID NO: 2125021 - RNA, 17 nt, Human
ggagguugcagggagcc

SEQ ID NO: 2125022 - RNA, 20 nt, Human
ggagguugcagugagcugag

SEQ ID NO: 2125023 - RNA, 12 nt, Human
ggagguugcagg

SEQ ID NO: 2125024 - RNA, 14 nt, Human
ggagguugcaggga

SEQ ID NO: 2125025 - RNA, 18 nt, Human
ggaggucgaggcaggagg

SEQ ID NO: 2125026 - RNA, 13 nt, Human
ggaggcugaggcg

SEQ ID NO: 2125027 - RNA, 19 nt, Human
ggaggcugaggcaggagga

SEQ ID NO: 2125028 - RNA, 16 nt, Human
ggagguucucucggag

SEQ ID NO: 2125029 - RNA, 17 nt, Human
ggagguuaaggcugagg

SEQ ID NO: 2125030 - RNA, 19 nt, Human
ggagguuaaggcugaggaa

SEQ ID NO: 2125031 - RNA, 21 nt, Human
ggagguuaaggcugaggaaag

SEQ ID NO: 2125032 - RNA, 15 nt, Human
ggaggucgaggcagg

SEQ ID NO: 2125033 - RNA, 16 nt, Human
ggaggucgaggcagga

SEQ ID NO: 2125034 - RNA, 12 nt, Human
ggaggcugaggc

SEQ ID NO: 2125035 - RNA, 14 nt, Human
ggaggcugaggcag

SEQ ID NO: 2125036 - RNA, 15 nt, Human
ggaggcugaggcaga

SEQ ID NO: 2125037 - RNA, 16 nt, Human
ggaggcugaggcagaa

SEQ ID NO: 2125038 - RNA, 18 nt, Human
ggaggcugaggcagaaga

SEQ ID NO: 2125039 - RNA, 15 nt, Human
ggaggcugaggcagg

SEQ ID NO: 2125040 - RNA, 17 nt, Human
ggaggcugaggcaggag

SEQ ID NO: 2125041 - RNA, 19 nt, Human
ggaggcugaggugggcaga

SEQ ID NO: 2125042 - RNA, 20 nt, Human
ggagcuuucaaagaaggaau

SEQ ID NO: 2125043 - RNA, 17 nt, Human
ggagcuucucuuuaacu

SEQ ID NO: 2125044 - RNA, 23 nt, Human
ggagcugcuggcuugcagugcgc

SEQ ID NO: 2125045 - RNA, 13 nt, Human
ggagcugcuggcu

SEQ ID NO: 2125046 - RNA, 15 nt, Human
ggagcugcuggcuug

SEQ ID NO: 2125047 - RNA, 12 nt, Human
ggagcugagaau

SEQ ID NO: 2125048 - RNA, 20 nt, Human
ggagcugagaauagaaggaa

SEQ ID NO: 2125049 - RNA, 22 nt, Human
ggagcugccuguucagcuccag

SEQ ID NO: 2125050 - RNA, 18 nt, Human
ggagcucuucaggccucc

SEQ ID NO: 2125051 - RNA, 20 nt, Human
ggagcucuucaggccucccu

SEQ ID NO: 2125052 - RNA, 16 nt, Human
ggagcugaguggggga

SEQ ID NO: 2125053 - RNA, 11 nt, Human
ggagcuccugg

SEQ ID NO: 2125054 - RNA, 12 nt, Human
ggagcuccuggg

SEQ ID NO: 2125055 - RNA, 14 nt, Human
ggagcuccugggaa

SEQ ID NO: 2125056 - RNA, 17 nt, Human
ggagcucuucaggccuc

SEQ ID NO: 2125057 - RNA, 14 nt, Human
ggagccccacugcc

SEQ ID NO: 2125058 - RNA, 15 nt, Human
ggagccccacugccc

SEQ ID NO: 2125059 - RNA, 14 nt, Human
ggagccccagugcc

SEQ ID NO: 2125060 - RNA, 14 nt, Human
ggagccccaggguc

SEQ ID NO: 2125061 - RNA, 20 nt, Human
ggagccccagggucuucccu

SEQ ID NO: 2125062 - RNA, 12 nt, Human
ggagccccaggg

SEQ ID NO: 2125063 - RNA, 13 nt, Human
ggagccccagggu

SEQ ID NO: 2125064 - RNA, 18 nt, Human
ggaggccaaggugggagg

SEQ ID NO: 2125065 - RNA, 12 nt, Human
ggaggaagagaa

SEQ ID NO: 2125066 - RNA, 23 nt, Human
ggaggaaauuugaauggguccau

SEQ ID NO: 2125067 - RNA, 18 nt, Human
ggaggaacacugcacucu

SEQ ID NO: 2125068 - RNA, 20 nt, Human
ggaggaaccgaaaggccaaa

SEQ ID NO: 2125069 - RNA, 22 nt, Human
ggaggaaaaccaagccguggcu

SEQ ID NO: 2125070 - RNA, 21 nt, Human
ggaggaaaaccaagccguggc

SEQ ID NO: 2125071 - RNA, 20 nt, Human
ggaggaaaaccaagccgugg

SEQ ID NO: 2125072 - RNA, 14 nt, Human
ggaggcaucugcac

SEQ ID NO: 2125073 - RNA, 19 nt, Human
ggaggaagcagguugaggg

SEQ ID NO: 2125074 - RNA, 16 nt, Human
ggcaggcuggcuggcc

SEQ ID NO: 2125075 - RNA, 10 nt, Human
ggcaggcagu

SEQ ID NO: 2125076 - RNA, 15 nt, Human
ggcaggccagcugug

SEQ ID NO: 2125077 - RNA, 10 nt, Human
ggcagaaaga

SEQ ID NO: 2125078 - RNA, 22 nt, Human
ggcagaaagcaaaugugaccug

SEQ ID NO: 2125079 - RNA, 17 nt, Human
ggcagaaagcagaggcu

SEQ ID NO: 2125080 - RNA, 18 nt, Human
ggcagaaagcagaggcug

SEQ ID NO: 2125081 - RNA, 19 nt, Human
ggcagaaagcagaggcugg

SEQ ID NO: 2125082 - RNA, 19 nt, Human
ggcagaauaaucuuugggu

SEQ ID NO: 2125083 - RNA, 16 nt, Human
ggcagaaggccaagag

SEQ ID NO: 2125084 - RNA, 14 nt, Human
ggcagagaaucaua

SEQ ID NO: 2125085 - RNA, 14 nt, Human
ggcagaacugagcu

SEQ ID NO: 2125086 - RNA, 15 nt, Human
ggcagaacugagcuc

SEQ ID NO: 2125087 - RNA, 21 nt, Human
ggcagaacugagcuccucugg

SEQ ID NO: 2125088 - RNA, 17 nt, Human
ggcagaagaauugaacc

SEQ ID NO: 2125089 - RNA, 22 nt, Human
ggcagaagaauugaacccagga

SEQ ID NO: 2125090 - RNA, 23 nt, Human
ggcagaagaauugaacccaggag

SEQ ID NO: 2125091 - RNA, 14 nt, Human
ggcagaaaguggcc

SEQ ID NO: 2125092 - RNA, 16 nt, Human
ggcagaaaguggccau

SEQ ID NO: 2125093 - RNA, 14 nt, Human
ggcagaacagccgc

SEQ ID NO: 2125094 - RNA, 18 nt, Human
ggcagaacagccgcuccu

SEQ ID NO: 2125095 - RNA, 20 nt, Human
ggcagaacagccgcuccugu

SEQ ID NO: 2125096 - RNA, 14 nt, Human
ggcagaacccuggu

SEQ ID NO: 2125097 - RNA, 15 nt, Human
ggcagaacccuggug

SEQ ID NO: 2125098 - RNA, 13 nt, Human
ggcagaacugagc

SEQ ID NO: 2125099 - RNA, 13 nt, Human
ggcaggagcucag

SEQ ID NO: 2125100 - RNA, 14 nt, Human
ggcaggagcucaga

SEQ ID NO: 2125101 - RNA, 15 nt, Human
ggcaggagcucagau

SEQ ID NO: 2125102 - RNA, 22 nt, Human
ggcagccgugccuucagcucua

SEQ ID NO: 2125103 - RNA, 19 nt, Human
ggcagccuacuagggaccu

SEQ ID NO: 2125104 - RNA, 21 nt, Human
ggcagccuacuagggaccugg

SEQ ID NO: 2125105 - RNA, 22 nt, Human
ggcagccuacuagggaccuggg

SEQ ID NO: 2125106 - RNA, 19 nt, Human
ggcaggacaacgaggaagc

SEQ ID NO: 2125107 - RNA, 18 nt, Human
ggcaggacaacgaggaag

SEQ ID NO: 2125108 - RNA, 15 nt, Human
ggcaggaccucagag

SEQ ID NO: 2125109 - RNA, 21 nt, Human
ggcaggaccucagaguccagg

SEQ ID NO: 2125110 - RNA, 20 nt, Human
ggcaggacaacgaggaagcc

SEQ ID NO: 2125111 - RNA, 21 nt, Human
ggcaggacaacgaggaagccc

SEQ ID NO: 2125112 - RNA, 12 nt, Human
ggcagccaggcu

SEQ ID NO: 2125113 - RNA, 19 nt, Human
ggcagccaggcugccaagg

SEQ ID NO: 2125114 - RNA, 13 nt, Human
ggcagccaggcug

SEQ ID NO: 2125115 - RNA, 15 nt, Human
ggcagccaggcugcc

SEQ ID NO: 2125116 - RNA, 18 nt, Human
ggcagccgugccuucagc

SEQ ID NO: 2125117 - RNA, 21 nt, Human
ggcagccgugccuucagcucu

SEQ ID NO: 2125118 - RNA, 19 nt, Human
ggcagccgugccuucagcu

SEQ ID NO: 2125119 - RNA, 22 nt, Human
ggaugaaugaggucccaggcag

SEQ ID NO: 2125120 - RNA, 14 nt, Human
ggaugaaugagguc

SEQ ID NO: 2125121 - RNA, 18 nt, Human
ggaugaaugaggucccag

SEQ ID NO: 2125122 - RNA, 21 nt, Human
ggaugaauuccaaauucugcu

SEQ ID NO: 2125123 - RNA, 15 nt, Human
ggaugacaugucccu

SEQ ID NO: 2125124 - RNA, 16 nt, Human
ggaugacaugucccua

SEQ ID NO: 2125125 - RNA, 20 nt, Human
ggaugacaugucccuacacc

SEQ ID NO: 2125126 - RNA, 22 nt, Human
ggaugagaaagguugaagcacc

SEQ ID NO: 2125127 - RNA, 12 nt, Human
ggaugagaaagg

SEQ ID NO: 2125128 - RNA, 19 nt, Human
ggaugacuagaggcaggga

SEQ ID NO: 2125129 - RNA, 18 nt, Human
ggaugacuagaggcaggg

SEQ ID NO: 2125130 - RNA, 15 nt, Human
ggauguucuggcccu

SEQ ID NO: 2125131 - RNA, 16 nt, Human
ggauguaaacagugcc

SEQ ID NO: 2125132 - RNA, 17 nt, Human
ggauguaaacagugccu

SEQ ID NO: 2125133 - RNA, 18 nt, Human
ggauguaaacagugccug

SEQ ID NO: 2125134 - RNA, 19 nt, Human
ggauguaaacagugccugc

SEQ ID NO: 2125135 - RNA, 21 nt, Human
ggauguaaacagugccugcug

SEQ ID NO: 2125136 - RNA, 20 nt, Human
ggauguaaacagugccugcu

SEQ ID NO: 2125137 - RNA, 20 nt, Human
ggcaacacagcgagacuccg

SEQ ID NO: 2125138 - RNA, 12 nt, Human
ggcaacagagca

SEQ ID NO: 2125139 - RNA, 21 nt, Human
ggcaacacagcgagacuccgu

SEQ ID NO: 2125140 - RNA, 17 nt, Human
ggcaaacuucagacuga

SEQ ID NO: 2125141 - RNA, 16 nt, Human
ggcaaagacagaagcc

SEQ ID NO: 2125142 - RNA, 23 nt, Human
ggcaaacaggcaguuggccagag

SEQ ID NO: 2125143 - RNA, 13 nt, Human
ggcaaacaggcag

SEQ ID NO: 2125144 - RNA, 23 nt, Human
ggauguuucugucacaucagcuc

SEQ ID NO: 2125145 - RNA, 14 nt, Human
ggauguugcucaga

SEQ ID NO: 2125146 - RNA, 19 nt, Human
ggauuuggguuggaaguga

SEQ ID NO: 2125147 - RNA, 12 nt, Human
ggauuuucagcc

SEQ ID NO: 2125148 - RNA, 21 nt, Human
ggauuuugauccaagcugguc

SEQ ID NO: 2125149 - RNA, 21 nt, Human
ggcaaccacaggcagcauuua

SEQ ID NO: 2125150 - RNA, 19 nt, Human
ggcaacagagcaagauccu

SEQ ID NO: 2125151 - RNA, 22 nt, Human
ggcaacaugccugcuuuagaau

SEQ ID NO: 2125152 - RNA, 20 nt, Human
ggcaaccacaggcagcauuu

SEQ ID NO: 2125153 - RNA, 19 nt, Human
ggccagguggccacuccag

SEQ ID NO: 2125154 - RNA, 17 nt, Human
ggccagguuucugccca

SEQ ID NO: 2125155 - RNA, 14 nt, Human
ggccaggugcacag

SEQ ID NO: 2125156 - RNA, 14 nt, Human
ggccaggugcagug

SEQ ID NO: 2125157 - RNA, 12 nt, Human
ggcauucucuga

SEQ ID NO: 2125158 - RNA, 15 nt, Human
ggcauuccugcuuau

SEQ ID NO: 2125159 - RNA, 23 nt, Human
ggcauugauggggaaggaggcug

SEQ ID NO: 2125160 - RNA, 15 nt, Human
ggccaaagccaaagc

SEQ ID NO: 2125161 - RNA, 21 nt, Human
ggccaaaggagggucaggaag

SEQ ID NO: 2125162 - RNA, 22 nt, Human
ggccaaaggagggucaggaagg

SEQ ID NO: 2125163 - RNA, 21 nt, Human
ggccaaauauauucucuuugg

SEQ ID NO: 2125164 - RNA, 22 nt, Human
ggccaaauauauucucuuuggu

SEQ ID NO: 2125165 - RNA, 16 nt, Human
ggcauugauggggaag

SEQ ID NO: 2125166 - RNA, 12 nt, Human
ggcauugcuuuc

SEQ ID NO: 2125167 - RNA, 13 nt, Human
ggcauugcuuucc

SEQ ID NO: 2125168 - RNA, 20 nt, Human
ggcauugguucccuuugcuc

SEQ ID NO: 2125169 - RNA, 20 nt, Human
ggccagaugcaccagcccuu

SEQ ID NO: 2125170 - RNA, 19 nt, Human
ggccagaugcaccagcccu

SEQ ID NO: 2125171 - RNA, 17 nt, Human
ggccagaugcaccagcc

SEQ ID NO: 2125172 - RNA, 20 nt, Human
ggccagaguggccuggccag

SEQ ID NO: 2125173 - RNA, 18 nt, Human
ggccagaguggccuggcc

SEQ ID NO: 2125174 - RNA, 19 nt, Human
ggccagaguggccuggcca

SEQ ID NO: 2125175 - RNA, 17 nt, Human
ggccaaccccaaagaag

SEQ ID NO: 2125176 - RNA, 18 nt, Human
ggccagcaagguggagug

SEQ ID NO: 2125177 - RNA, 22 nt, Human
ggccagcaagguggaguggaug

SEQ ID NO: 2125178 - RNA, 23 nt, Human
ggccagcaagguggaguggaugc

SEQ ID NO: 2125179 - RNA, 12 nt, Human
ggccagccccuc

SEQ ID NO: 2125180 - RNA, 14 nt, Human
ggccagccccuccc

SEQ ID NO: 2125181 - RNA, 15 nt, Human
ggccagccccuccca

SEQ ID NO: 2125182 - RNA, 16 nt, Human
ggccagccccucccac

SEQ ID NO: 2125183 - RNA, 23 nt, Human
ggccagccccucccaccacagca

SEQ ID NO: 2125184 - RNA, 18 nt, Human
ggccagccccucccacca

SEQ ID NO: 2125185 - RNA, 21 nt, Human
ggccagccccucccaccacag

SEQ ID NO: 2125186 - RNA, 23 nt, Human
ggccagagggagugacagaggca

SEQ ID NO: 2125187 - RNA, 16 nt, Human
ggccaagugcaggcug

SEQ ID NO: 2125188 - RNA, 18 nt, Human
ggccaagugcaggcuggc

SEQ ID NO: 2125189 - RNA, 14 nt, Human
ggccagaguggccu

SEQ ID NO: 2125190 - RNA, 15 nt, Human
ggccagaguggccug

SEQ ID NO: 2125191 - RNA, 16 nt, Human
ggccagaguggccugg

SEQ ID NO: 2125192 - RNA, 14 nt, Human
ggccaagucccacc

SEQ ID NO: 2125193 - RNA, 16 nt, Human
ggccaagucccaccgg

SEQ ID NO: 2125194 - RNA, 20 nt, Human
ggccaagugcaggcuggcac

SEQ ID NO: 2125195 - RNA, 13 nt, Human
ggccaagguggga

SEQ ID NO: 2125196 - RNA, 13 nt, Human
ggccaacauggua

SEQ ID NO: 2125197 - RNA, 15 nt, Human
ggccaacaccaggga

SEQ ID NO: 2125198 - RNA, 18 nt, Human
ggccaacaccagggaugg

SEQ ID NO: 2125199 - RNA, 13 nt, Human
ggccaaaguguua

SEQ ID NO: 2125200 - RNA, 13 nt, Human
ggccaaauucccu

SEQ ID NO: 2125201 - RNA, 15 nt, Human
ggcccaggcaggcca

SEQ ID NO: 2125202 - RNA, 20 nt, Human
ggcccagggagaggccauga

SEQ ID NO: 2125203 - RNA, 16 nt, Human
ggcccagcgaccucgg

SEQ ID NO: 2125204 - RNA, 17 nt, Human
ggcccgacagccuggca

SEQ ID NO: 2125205 - RNA, 16 nt, Human
ggcccgacagccuggc

SEQ ID NO: 2125206 - RNA, 15 nt, Human
ggcccgacagccugg

SEQ ID NO: 2125207 - RNA, 19 nt, Human
ggcccgccuggcagaacug

SEQ ID NO: 2125208 - RNA, 23 nt, Human
ggcccgccuggcagaacugagcu

SEQ ID NO: 2125209 - RNA, 15 nt, Human
ggcccgccuggcaga

SEQ ID NO: 2125210 - RNA, 13 nt, Human
ggccccaggaagc

SEQ ID NO: 2125211 - RNA, 14 nt, Human
ggccccaggaagcc

SEQ ID NO: 2125212 - RNA, 15 nt, Human
ggccccaggaagccg

SEQ ID NO: 2125213 - RNA, 17 nt, Human
ggccccagggcuacccu

SEQ ID NO: 2125214 - RNA, 18 nt, Human
ggccccagggcuacccuc

SEQ ID NO: 2125215 - RNA, 15 nt, Human
ggccccaccaccuag

SEQ ID NO: 2125216 - RNA, 14 nt, Human
ggccccaccaccua

SEQ ID NO: 2125217 - RNA, 16 nt, Human
ggccccaaaaccacag

SEQ ID NO: 2125218 - RNA, 20 nt, Human
ggccccaaaaccacagcccu

SEQ ID NO: 2125219 - RNA, 21 nt, Human
ggccccaaaaccacagcccug

SEQ ID NO: 2125220 - RNA, 15 nt, Human
ggccucccucucucu

SEQ ID NO: 2125221 - RNA, 23 nt, Human
ggccucccucucucuucugcucc

SEQ ID NO: 2125222 - RNA, 13 nt, Human
ggccucccaaagu

SEQ ID NO: 2125223 - RNA, 17 nt, Human
ggccuccauuccuggag

SEQ ID NO: 2125224 - RNA, 21 nt, Human
ggccuccauuccuggagcccg

SEQ ID NO: 2125225 - RNA, 22 nt, Human
ggccuccauuccuggagcccga

SEQ ID NO: 2125226 - RNA, 23 nt, Human
ggccuccauuccuggagcccgag

SEQ ID NO: 2125227 - RNA, 14 nt, Human
ggcccuuccuuuuc

SEQ ID NO: 2125228 - RNA, 23 nt, Human
ggcccuuccucuccacugccuuc

SEQ ID NO: 2125229 - RNA, 22 nt, Human
ggcccuuccucuccacugccuu

SEQ ID NO: 2125230 - RNA, 19 nt, Human
ggcccuuccucuccacugc

SEQ ID NO: 2125231 - RNA, 18 nt, Human
ggcccuuccucuccacug

SEQ ID NO: 2125232 - RNA, 12 nt, Human
aaaaaaaacaaa

SEQ ID NO: 2125233 - RNA, 13 nt, Human
aaaaaaaaaguuc

SEQ ID NO: 2125234 - RNA, 13 nt, Human
aaaaaaguugaag

SEQ ID NO: 2125235 - RNA, 12 nt, Human
aaaaaauaacac

SEQ ID NO: 2125236 - RNA, 21 nt, Human
aaaaaagcuggugggugaaag

SEQ ID NO: 2125237 - RNA, 11 nt, Human
aaaaaagucuc

SEQ ID NO: 2125238 - RNA, 17 nt, Human
aaaaaagucucuauuua

SEQ ID NO: 2125239 - RNA, 13 nt, Human
aaaaaaacacaaa

SEQ ID NO: 2125240 - RNA, 12 nt, Human
aaaaaagaaugu

SEQ ID NO: 2125241 - RNA, 14 nt, Human
aaaaaagaauguca

SEQ ID NO: 2125242 - RNA, 13 nt, Human
aaaaaaaauccuu

SEQ ID NO: 2125243 - RNA, 20 nt, Human
aaaaagucagacugcuggga

SEQ ID NO: 2125244 - RNA, 22 nt, Human
aaaaagucuacgcucuccuuuc

SEQ ID NO: 2125245 - RNA, 15 nt, Human
aaaaagucucuauuu

SEQ ID NO: 2125246 - RNA, 17 nt, Human
aaaaagucucuauuuaa

SEQ ID NO: 2125247 - RNA, 18 nt, Human
aaaaagucucuauuuaaa

SEQ ID NO: 2125248 - RNA, 21 nt, Human
aaaaagucucuauuuaaauuc

SEQ ID NO: 2125249 - RNA, 22 nt, Human
aaaaagucucuauuuaaauucu

SEQ ID NO: 2125250 - RNA, 23 nt, Human
aaaaagucucuauuuaaauucuu

SEQ ID NO: 2125251 - RNA, 14 nt, Human
aaaaagucugcauu

SEQ ID NO: 2125252 - RNA, 21 nt, Human
aaaaaguaaguaccacucagg

SEQ ID NO: 2125253 - RNA, 21 nt, Human
aaaaagggauccguacauuca

SEQ ID NO: 2125254 - RNA, 22 nt, Human
aaaaagggcagggcaucuccug

SEQ ID NO: 2125255 - RNA, 13 nt, Human
aaaaagcuggugg

SEQ ID NO: 2125256 - RNA, 22 nt, Human
aaaaagcuggugggugaaagaa

SEQ ID NO: 2125257 - RNA, 14 nt, Human
aaaaagcuuuuaug

SEQ ID NO: 2125258 - RNA, 13 nt, Human
aaaaagcuucccc

SEQ ID NO: 2125259 - RNA, 23 nt, Human
gggaaaaucagccugcuccagcu

SEQ ID NO: 2125260 - RNA, 16 nt, Human
gggaaaauguuuugua

SEQ ID NO: 2125261 - RNA, 21 nt, Human
gggaaaauguuuuguaagaaa

SEQ ID NO: 2125262 - RNA, 23 nt, Human
gggaaaagggaacaggaaaagaa

SEQ ID NO: 2125263 - RNA, 13 nt, Human
gggaaaaucagcc

SEQ ID NO: 2125264 - RNA, 17 nt, Human
ggcuuccauuugugugu

SEQ ID NO: 2125265 - RNA, 18 nt, Human
ggcuuccauuugugugug

SEQ ID NO: 2125266 - RNA, 22 nt, Human
ggcuuccauuugugugugugca

SEQ ID NO: 2125267 - RNA, 18 nt, Human
ggcuucaggggagucccg

SEQ ID NO: 2125268 - RNA, 16 nt, Human
ggcuucaguggcagcu

SEQ ID NO: 2125269 - RNA, 21 nt, Human
ggcuuccagaaaaccccagca

SEQ ID NO: 2125270 - RNA, 23 nt, Human
ggcuguaucccaugagccucagc

SEQ ID NO: 2125271 - RNA, 22 nt, Human
ggcuguaucccaugagccucag

SEQ ID NO: 2125272 - RNA, 20 nt, Human
ggcuguaucccaugagccuc

SEQ ID NO: 2125273 - RNA, 15 nt, Human
ggcuucaguggcagc

SEQ ID NO: 2125274 - RNA, 20 nt, Human
ggcuucagcauauuuauagc

SEQ ID NO: 2125275 - RNA, 15 nt, Human
ggcuggugggcacca

SEQ ID NO: 2125276 - RNA, 15 nt, Human
ggcugucagcaggaa

SEQ ID NO: 2125277 - RNA, 16 nt, Human
ggcugucagcaggaag

SEQ ID NO: 2125278 - RNA, 17 nt, Human
ggcugucagcaggaagc

SEQ ID NO: 2125279 - RNA, 18 nt, Human
ggcugucagcaggaagca

SEQ ID NO: 2125280 - RNA, 18 nt, Human
ggcugucaguaugacauu

SEQ ID NO: 2125281 - RNA, 16 nt, Human
ggcuggugucaccuga

SEQ ID NO: 2125282 - RNA, 19 nt, Human
ggcuguaucccaugagccu

SEQ ID NO: 2125283 - RNA, 13 nt, Human
ggcuggugcaggg

SEQ ID NO: 2125284 - RNA, 14 nt, Human
ggcuggugcagggc

SEQ ID NO: 2125285 - RNA, 22 nt, Human
aaaaaguaucauggaaauauua

SEQ ID NO: 2125286 - RNA, 13 nt, Human
aaaaaguugaagg

SEQ ID NO: 2125287 - RNA, 20 nt, Human
aaaaaguuaaaaaaaauaau

SEQ ID NO: 2125288 - RNA, 13 nt, Human
ggcuggcugggca

SEQ ID NO: 2125289 - RNA, 14 nt, Human
ggcuggcugcagug

SEQ ID NO: 2125290 - RNA, 15 nt, Human
ggcuggcugcaguga

SEQ ID NO: 2125291 - RNA, 20 nt, Human
ggcuggcggcuacucagcag

SEQ ID NO: 2125292 - RNA, 17 nt, Human
ggcuggcuaacuggaag

SEQ ID NO: 2125293 - RNA, 20 nt, Human
ggcugcccacacaccccaau

SEQ ID NO: 2125294 - RNA, 18 nt, Human
ggcugcccacuaugguca

SEQ ID NO: 2125295 - RNA, 18 nt, Human
ggcugccaugugaagagg

SEQ ID NO: 2125296 - RNA, 17 nt, Human
ggcugcccacacacccc

SEQ ID NO: 2125297 - RNA, 19 nt, Human
ggcugcccacacaccccaa

SEQ ID NO: 2125298 - RNA, 19 nt, Human
ggcuggcaccgccuucucu

SEQ ID NO: 2125299 - RNA, 21 nt, Human
ggcuggauuuugaauuuucuu

SEQ ID NO: 2125300 - RNA, 18 nt, Human
ggcuggaugugguggcau

SEQ ID NO: 2125301 - RNA, 19 nt, Human
ggcuggaugugguggcaua

SEQ ID NO: 2125302 - RNA, 15 nt, Human
ggcuggauguggugg

SEQ ID NO: 2125303 - RNA, 20 nt, Human
ggcuggcgugcaguggugcg

SEQ ID NO: 2125304 - RNA, 16 nt, Human
ggcuggcgugcagugg

SEQ ID NO: 2125305 - RNA, 14 nt, Human
ggcuggcgugcagu

SEQ ID NO: 2125306 - RNA, 17 nt, Human
ggcuccucccggugccc

SEQ ID NO: 2125307 - RNA, 14 nt, Human
ggcuccucccuccc

SEQ ID NO: 2125308 - RNA, 16 nt, Human
ggcuccucccucccuc

SEQ ID NO: 2125309 - RNA, 21 nt, Human
ggcuccucucuaaccuccuuu

SEQ ID NO: 2125310 - RNA, 12 nt, Human
ggcuccugaggg

SEQ ID NO: 2125311 - RNA, 24 nt, Human
ggcuccgucaguaucaggccugcc

SEQ ID NO: 2125312 - RNA, 13 nt, Human
ggcucccuuccuc

SEQ ID NO: 2125313 - RNA, 16 nt, Human
ggcucccuuccuccca

SEQ ID NO: 2125314 - RNA, 15 nt, Human
ggcuccgaacacccu

SEQ ID NO: 2125315 - RNA, 15 nt, Human
ggcuccgcugugugg

SEQ ID NO: 2125316 - RNA, 18 nt, Human
ggcuccgucaguaucagg

SEQ ID NO: 2125317 - RNA, 22 nt, Human
ggcuccgucaguaucaggccug

SEQ ID NO: 2125318 - RNA, 13 nt, Human
ggcugcauagaag

SEQ ID NO: 2125319 - RNA, 16 nt, Human
ggcugcauagaaggag

SEQ ID NO: 2125320 - RNA, 19 nt, Human
ggcugcauagaaggaggag

SEQ ID NO: 2125321 - RNA, 13 nt, Human
ggcugccaccaag

SEQ ID NO: 2125322 - RNA, 15 nt, Human
ggcugaacggggaga

SEQ ID NO: 2125323 - RNA, 17 nt, Human
ggcugaacggggagaaa

SEQ ID NO: 2125324 - RNA, 20 nt, Human
ggcugaacggggagaaaagg

SEQ ID NO: 2125325 - RNA, 22 nt, Human
ggcugcagugacgugcaccugu

SEQ ID NO: 2125326 - RNA, 17 nt, Human
ggcugcagggaguccga

SEQ ID NO: 2125327 - RNA, 21 nt, Human
ggcucgagcaguccugccuca

SEQ ID NO: 2125328 - RNA, 20 nt, Human
ggcugaaagaggccaaugcc

SEQ ID NO: 2125329 - RNA, 18 nt, Human
aaaagggaacugaacauu

SEQ ID NO: 2125330 - RNA, 15 nt, Human
aaaagggaacaggaa

SEQ ID NO: 2125331 - RNA, 14 nt, Human
aaaagggacaugaa

SEQ ID NO: 2125332 - RNA, 19 nt, Human
gggcaggaaggagagccug

SEQ ID NO: 2125333 - RNA, 21 nt, Human
gggcaggaaggagagccugcu

SEQ ID NO: 2125334 - RNA, 19 nt, Human
gggcagcuguuagagucca

SEQ ID NO: 2125335 - RNA, 16 nt, Human
gggcaggaaggagagc

SEQ ID NO: 2125336 - RNA, 18 nt, Human
gggcaggaaggagagccu

SEQ ID NO: 2125337 - RNA, 18 nt, Human
gggcaggagggcccuacc

SEQ ID NO: 2125338 - RNA, 18 nt, Human
gggcaaacaccugcugau

SEQ ID NO: 2125339 - RNA, 20 nt, Human
aaaaggcgguacuaguucag

SEQ ID NO: 2125340 - RNA, 16 nt, Human
gggcagcacagagagg

SEQ ID NO: 2125341 - RNA, 20 nt, Human
gggcagcauagcaagacaca

SEQ ID NO: 2125342 - RNA, 13 nt, Human
gggcagccaggcu

SEQ ID NO: 2125343 - RNA, 17 nt, Human
gggcagccaaacccaug

SEQ ID NO: 2125344 - RNA, 14 nt, Human
gggcagccaggcug

SEQ ID NO: 2125345 - RNA, 16 nt, Human
gggcagccaggcugcc

SEQ ID NO: 2125346 - RNA, 15 nt, Human
gggauuucucccagc

SEQ ID NO: 2125347 - RNA, 13 nt, Human
gggagggggaggg

SEQ ID NO: 2125348 - RNA, 19 nt, Human
gggauuuguccuuggggac

SEQ ID NO: 2125349 - RNA, 21 nt, Human
gggauuuucagcccucagaau

SEQ ID NO: 2125350 - RNA, 14 nt, Human
gggcaaacaggcag

SEQ ID NO: 2125351 - RNA, 17 nt, Human
gggauuucucccagcuc

SEQ ID NO: 2125352 - RNA, 15 nt, Human
gggcaaacaggcagu

SEQ ID NO: 2125353 - RNA, 13 nt, Human
gggcagagccggg

SEQ ID NO: 2125354 - RNA, 14 nt, Human
gggcagagccggga

SEQ ID NO: 2125355 - RNA, 17 nt, Human
gggcagagccgggaagc

SEQ ID NO: 2125356 - RNA, 15 nt, Human
gggagggcccacuuc

SEQ ID NO: 2125357 - RNA, 23 nt, Human
gggaggggcggcaggagggaggu

SEQ ID NO: 2125358 - RNA, 17 nt, Human
gggauugaaggaugcug

SEQ ID NO: 2125359 - RNA, 14 nt, Human
gggauucaggcugc

SEQ ID NO: 2125360 - RNA, 15 nt, Human
gggauucaggcugcu

SEQ ID NO: 2125361 - RNA, 16 nt, Human
gggauucaggcugcuu

SEQ ID NO: 2125362 - RNA, 12 nt, Human
aaaauaaauuga

SEQ ID NO: 2125363 - RNA, 21 nt, Human
aaaauagcaacacucuauauu

SEQ ID NO: 2125364 - RNA, 22 nt, Human
aaaauagcaacacucuauauuu

SEQ ID NO: 2125365 - RNA, 13 nt, Human
aaaauacucuaau

SEQ ID NO: 2125366 - RNA, 14 nt, Human
aaaauacucuaauu

SEQ ID NO: 2125367 - RNA, 15 nt, Human
aaaauacucuaauuc

SEQ ID NO: 2125368 - RNA, 16 nt, Human
aaaauacucuaauucu

SEQ ID NO: 2125369 - RNA, 17 nt, Human
aaaauacucuaauucua

SEQ ID NO: 2125370 - RNA, 18 nt, Human
aaaauacucuaauucuaa

SEQ ID NO: 2125371 - RNA, 20 nt, Human
aaaauacucuaauucuaacc

SEQ ID NO: 2125372 - RNA, 23 nt, Human
aaaauacucuaauucuaaccaga

SEQ ID NO: 2125373 - RNA, 13 nt, Human
aaaauacaaacaa

SEQ ID NO: 2125374 - RNA, 12 nt, Human
aaaauaaauuau

SEQ ID NO: 2125375 - RNA, 14 nt, Human
aaaauaacacacau

SEQ ID NO: 2125376 - RNA, 16 nt, Human
aaaauaaaguuacauu

SEQ ID NO: 2125377 - RNA, 12 nt, Human
aaaauaaauaaa

SEQ ID NO: 2125378 - RNA, 14 nt, Human
aaaauaaauaaaua

SEQ ID NO: 2125379 - RNA, 15 nt, Human
aaaaguacaauuuac

SEQ ID NO: 2125380 - RNA, 23 nt, Human
aaaaguaaguaccacucaggcca

SEQ ID NO: 2125381 - RNA, 22 nt, Human
aaaaguaaguaccacucaggcc

SEQ ID NO: 2125382 - RNA, 12 nt, Human
aaaauauaauug

SEQ ID NO: 2125383 - RNA, 15 nt, Human
aaaauauaauuguuu

SEQ ID NO: 2125384 - RNA, 19 nt, Human
aaaauauaauuguuuuuua

SEQ ID NO: 2125385 - RNA, 22 nt, Human
aaaauauaauuguuuuuuaucu

SEQ ID NO: 2125386 - RNA, 24 nt, Human
aaaauauaauuuuuuagagagcug

SEQ ID NO: 2125387 - RNA, 20 nt, Human
aaaauauggguugcauuugg

SEQ ID NO: 2125388 - RNA, 21 nt, Human
aaaauauauauguugauuucu

SEQ ID NO: 2125389 - RNA, 15 nt, Human
aaaauaggagagaga

SEQ ID NO: 2125390 - RNA, 18 nt, Human
aaaauauaaagcaucuaa

SEQ ID NO: 2125391 - RNA, 12 nt, Human
aaaauagccugc

SEQ ID NO: 2125392 - RNA, 23 nt, Human
aaaauagcaaccuuuuuaucucc

SEQ ID NO: 2125393 - RNA, 10 nt, Human
aaaauagcca

SEQ ID NO: 2125394 - RNA, 18 nt, Human
aaaauagguauacagugg

SEQ ID NO: 2125395 - RNA, 13 nt, Human
gggagagacccuu

SEQ ID NO: 2125396 - RNA, 12 nt, Human
gggagagagaga

SEQ ID NO: 2125397 - RNA, 12 nt, Human
gggagagccagc

SEQ ID NO: 2125398 - RNA, 13 nt, Human
gggacuguacaca

SEQ ID NO: 2125399 - RNA, 21 nt, Human
gggacugucuuucagauacau

SEQ ID NO: 2125400 - RNA, 13 nt, Human
gggacugggaggg

SEQ ID NO: 2125401 - RNA, 14 nt, Human
gggacugggagggc

SEQ ID NO: 2125402 - RNA, 15 nt, Human
gggacugggagggcc

SEQ ID NO: 2125403 - RNA, 17 nt, Human
gggacugggagggccca

SEQ ID NO: 2125404 - RNA, 13 nt, Human
gggaggccaagga

SEQ ID NO: 2125405 - RNA, 14 nt, Human
gggagagccagcuc

SEQ ID NO: 2125406 - RNA, 15 nt, Human
gggagagccagcucc

SEQ ID NO: 2125407 - RNA, 12 nt, Human
gggagagcccag

SEQ ID NO: 2125408 - RNA, 13 nt, Human
gggaggcagccgg

SEQ ID NO: 2125409 - RNA, 20 nt, Human
gggaggcagagguugcagug

SEQ ID NO: 2125410 - RNA, 14 nt, Human
aaaagcugggcagg

SEQ ID NO: 2125411 - RNA, 22 nt, Human
aaaacuugauguguuaucucuu

SEQ ID NO: 2125412 - RNA, 17 nt, Human
aaaacuuguaaaugcug

SEQ ID NO: 2125413 - RNA, 12 nt, Human
aaaacuuuauuu

SEQ ID NO: 2125414 - RNA, 13 nt, Human
aaaacuuuauuuu

SEQ ID NO: 2125415 - RNA, 15 nt, Human
aaaacuuuauuuuau

SEQ ID NO: 2125416 - RNA, 16 nt, Human
aaaacuuuauuuuaua

SEQ ID NO: 2125417 - RNA, 17 nt, Human
aaaacuuuauuuuauau

SEQ ID NO: 2125418 - RNA, 18 nt, Human
aaaacuuuauuuuauaua

SEQ ID NO: 2125419 - RNA, 19 nt, Human
aaaacuuuauuuuauauaa

SEQ ID NO: 2125420 - RNA, 20 nt, Human
aaaacuuuauuuuauauaau

SEQ ID NO: 2125421 - RNA, 23 nt, Human
aaaacuuuauuuuauauaauaaa

SEQ ID NO: 2125422 - RNA, 22 nt, Human
gggaacagacuggaagcacagc

SEQ ID NO: 2125423 - RNA, 14 nt, Human
gggaacagacagga

SEQ ID NO: 2125424 - RNA, 15 nt, Human
gggaacagacaggag

SEQ ID NO: 2125425 - RNA, 16 nt, Human
gggaacagacaggaga

SEQ ID NO: 2125426 - RNA, 15 nt, Human
gggaaaggauauuuu

SEQ ID NO: 2125427 - RNA, 22 nt, Human
gggaaaggcucugaaagccagc

SEQ ID NO: 2125428 - RNA, 14 nt, Human
gggaaauaagagag

SEQ ID NO: 2125429 - RNA, 19 nt, Human
gggaacaaggguggcaucc

SEQ ID NO: 2125430 - RNA, 19 nt, Human
gggaacagacaacagaagu

SEQ ID NO: 2125431 - RNA, 14 nt, Human
gggaacagacugga

SEQ ID NO: 2125432 - RNA, 20 nt, Human
aaaaauguucuauuuuaauu

SEQ ID NO: 2125433 - RNA, 22 nt, Human
aaaaaugucuuggguaggcggg

SEQ ID NO: 2125434 - RNA, 18 nt, Human
aaaaaugcccuuaaauca

SEQ ID NO: 2125435 - RNA, 12 nt, Human
aaaaaugaaagc

SEQ ID NO: 2125436 - RNA, 10 nt, Human
aaaaaugaaa

SEQ ID NO: 2125437 - RNA, 17 nt, Human
aaaaaugacagauguug

SEQ ID NO: 2125438 - RNA, 20 nt, Human
aaaaaugacuaaaaauauua

SEQ ID NO: 2125439 - RNA, 11 nt, Human
aaaaaugagaa

SEQ ID NO: 2125440 - RNA, 12 nt, Human
aaaaaugagaac

SEQ ID NO: 2125441 - RNA, 14 nt, Human
aaaaaugagaacau

SEQ ID NO: 2125442 - RNA, 16 nt, Human
aaaaaugagaacaugu

SEQ ID NO: 2125443 - RNA, 17 nt, Human
aaaaaugagaacauguu

SEQ ID NO: 2125444 - RNA, 21 nt, Human
aaaaaugagaacauguuggua

SEQ ID NO: 2125445 - RNA, 22 nt, Human
aaaaaucugaccaaaacaaaca

SEQ ID NO: 2125446 - RNA, 18 nt, Human
gggaacagacaggagaaa

SEQ ID NO: 2125447 - RNA, 20 nt, Human
aaaacugcugacuguuuucu

SEQ ID NO: 2125448 - RNA, 19 nt, Human
aaaaccaagccguggcuuc

SEQ ID NO: 2125449 - RNA, 15 nt, Human
aaaacguuuuauugu

SEQ ID NO: 2125450 - RNA, 16 nt, Human
aaaacguuuuauugug

SEQ ID NO: 2125451 - RNA, 17 nt, Human
aaaacguuuuauugugu

SEQ ID NO: 2125452 - RNA, 19 nt, Human
aaaacguuuuauuguguuu

SEQ ID NO: 2125453 - RNA, 23 nt, Human
aaaacguuuuguuugaaaaagca

SEQ ID NO: 2125454 - RNA, 12 nt, Human
aaaacuacauuu

SEQ ID NO: 2125455 - RNA, 15 nt, Human
aaaacuacauuuuaa

SEQ ID NO: 2125456 - RNA, 16 nt, Human
aaaacuacauuuuaac

SEQ ID NO: 2125457 - RNA, 17 nt, Human
aaaacuacauuuuaaca

SEQ ID NO: 2125458 - RNA, 18 nt, Human
aaaacuacauuuuaacau

SEQ ID NO: 2125459 - RNA, 14 nt, Human
aaaaccaagaagau

SEQ ID NO: 2125460 - RNA, 15 nt, Human
aaaaccaauguucuc

SEQ ID NO: 2125461 - RNA, 18 nt, Human
aaaaauuaucuauuugua

SEQ ID NO: 2125462 - RNA, 22 nt, Human
aaaaauuaucuauuuguauaua

SEQ ID NO: 2125463 - RNA, 13 nt, Human
aaaaauuagcuga

SEQ ID NO: 2125464 - RNA, 19 nt, Human
aaaacauuuucacacaaua

SEQ ID NO: 2125465 - RNA, 11 nt, Human
aaacuccugac

SEQ ID NO: 2125466 - RNA, 19 nt, Human
aaacuccgucuuagaagug

SEQ ID NO: 2125467 - RNA, 16 nt, Human
aaacucauuucuagca

SEQ ID NO: 2125468 - RNA, 19 nt, Human
aaacuagcuuacaugagaa

SEQ ID NO: 2125469 - RNA, 23 nt, Human
aaacuagcuuacaugagaacaga

SEQ ID NO: 2125470 - RNA, 13 nt, Human
aaacuaggaaaau

SEQ ID NO: 2125471 - RNA, 15 nt, Human
aaacuaggaaaauug

SEQ ID NO: 2125472 - RNA, 17 nt, Human
aaacuaggaaaauugga

SEQ ID NO: 2125473 - RNA, 15 nt, Human
aaacuagaauuucau

SEQ ID NO: 2125474 - RNA, 16 nt, Human
aaacuagaauuucauu

SEQ ID NO: 2125475 - RNA, 21 nt, Human
aaacuagacuugaggaaacca

SEQ ID NO: 2125476 - RNA, 23 nt, Human
aaacuagacuugaggaaaccagg

SEQ ID NO: 2125477 - RNA, 20 nt, Human
aaacuggcaucugacacaaa

SEQ ID NO: 2125478 - RNA, 21 nt, Human
aaacuggcaucugacacaaaa

SEQ ID NO: 2125479 - RNA, 20 nt, Human
aaacuggcaaacuucagacu

SEQ ID NO: 2125480 - RNA, 22 nt, Human
aaacugguuuguugcagccaaa

SEQ ID NO: 2125481 - RNA, 18 nt, Human
aaaccacagcccugucag

SEQ ID NO: 2125482 - RNA, 15 nt, Human
aaaccacagcccugu

SEQ ID NO: 2125483 - RNA, 16 nt, Human
aaaccacagcccuguc

SEQ ID NO: 2125484 - RNA, 17 nt, Human
aaaccacagcccuguca

SEQ ID NO: 2125485 - RNA, 12 nt, Human
aaacgugaaaau

SEQ ID NO: 2125486 - RNA, 14 nt, Human
aaacgugcccucug

SEQ ID NO: 2125487 - RNA, 12 nt, Human
aaacuaaugagu

SEQ ID NO: 2125488 - RNA, 13 nt, Human
aaacuaaugaguu

SEQ ID NO: 2125489 - RNA, 13 nt, Human
aaacuacauuuua

SEQ ID NO: 2125490 - RNA, 14 nt, Human
aaacuacauuuuaa

SEQ ID NO: 2125491 - RNA, 15 nt, Human
aaacuacauuuuaac

SEQ ID NO: 2125492 - RNA, 16 nt, Human
aaacuacauuuuaaca

SEQ ID NO: 2125493 - RNA, 17 nt, Human
aaacuacauuuuaacau

SEQ ID NO: 2125494 - RNA, 18 nt, Human
aaacuacauuuuaacaug

SEQ ID NO: 2125495 - RNA, 16 nt, Human
aaacuaauauuuuaug

SEQ ID NO: 2125496 - RNA, 20 nt, Human
aaacuaacagauaagcaaga

SEQ ID NO: 2125497 - RNA, 15 nt, Human
aaacuaacagauaag

SEQ ID NO: 2125498 - RNA, 12 nt, Human
ggggcccugguc

SEQ ID NO: 2125499 - RNA, 21 nt, Human
ggggcccugguccuuccaggc

SEQ ID NO: 2125500 - RNA, 22 nt, Human
ggggucucccucuccugccuac

SEQ ID NO: 2125501 - RNA, 22 nt, Human
gggguccuucaaguuagcucag

SEQ ID NO: 2125502 - RNA, 15 nt, Human
ggggucuccaggagg

SEQ ID NO: 2125503 - RNA, 19 nt, Human
ggggucucccucuccugcc

SEQ ID NO: 2125504 - RNA, 20 nt, Human
ggggucucccucuccugccu

SEQ ID NO: 2125505 - RNA, 13 nt, Human
gggucaggaagga

SEQ ID NO: 2125506 - RNA, 14 nt, Human
gggucaggagaggg

SEQ ID NO: 2125507 - RNA, 15 nt, Human
gggucaggccacggc

SEQ ID NO: 2125508 - RNA, 17 nt, Human
gggucaggccacggcag

SEQ ID NO: 2125509 - RNA, 21 nt, Human
gggucaggccacggcagccua

SEQ ID NO: 2125510 - RNA, 20 nt, Human
ggguauauuuuuguuuguuu

SEQ ID NO: 2125511 - RNA, 23 nt, Human
ggguauauuuuuguuuguuuugu

SEQ ID NO: 2125512 - RNA, 16 nt, Human
ggguauaucugggcug

SEQ ID NO: 2125513 - RNA, 13 nt, Human
ggguauauucauu

SEQ ID NO: 2125514 - RNA, 19 nt, Human
ggguauccaaguuggacug

SEQ ID NO: 2125515 - RNA, 20 nt, Human
ggguauccaaguuggacugg

SEQ ID NO: 2125516 - RNA, 21 nt, Human
ggguauccaaguuggacuggg

SEQ ID NO: 2125517 - RNA, 20 nt, Human
ggguaucaggugcugccauc

SEQ ID NO: 2125518 - RNA, 16 nt, Human
ggguaggcgggaagga

SEQ ID NO: 2125519 - RNA, 12 nt, Human
ggguaggcggga

SEQ ID NO: 2125520 - RNA, 22 nt, Human
ggggccuguacaaaagggacau

SEQ ID NO: 2125521 - RNA, 19 nt, Human
ggguagcuucugaccucag

SEQ ID NO: 2125522 - RNA, 21 nt, Human
ggguagcuucugaccucagca

SEQ ID NO: 2125523 - RNA, 23 nt, Human
gggucucacuauguugcccaggc

SEQ ID NO: 2125524 - RNA, 12 nt, Human
gggucucacucu

SEQ ID NO: 2125525 - RNA, 14 nt, Human
gggucuagggagag

SEQ ID NO: 2125526 - RNA, 19 nt, Human
gggucaggaaggaugagca

SEQ ID NO: 2125527 - RNA, 20 nt, Human
gggucgucaccaccucuccu

SEQ ID NO: 2125528 - RNA, 22 nt, Human
gggucucacuauguugcccagg

SEQ ID NO: 2125529 - RNA, 14 nt, Human
aaaccaagccgugg

SEQ ID NO: 2125530 - RNA, 12 nt, Human
aaaccaagaaga

SEQ ID NO: 2125531 - RNA, 20 nt, Human
aaacauugaaguaaugaauu

SEQ ID NO: 2125532 - RNA, 18 nt, Human
aaacaagaaaguuucccc

SEQ ID NO: 2125533 - RNA, 16 nt, Human
aaacaagaaaguuucc

SEQ ID NO: 2125534 - RNA, 17 nt, Human
aaacaagaaaguuuccc

SEQ ID NO: 2125535 - RNA, 15 nt, Human
aaacaagaaaguuuc

SEQ ID NO: 2125536 - RNA, 17 nt, Human
aaacaacuuucucuugu

SEQ ID NO: 2125537 - RNA, 18 nt, Human
aaacaacuuucucuugua

SEQ ID NO: 2125538 - RNA, 15 nt, Human
aaacaaacaagcuag

SEQ ID NO: 2125539 - RNA, 13 nt, Human
aaacaaagccaga

SEQ ID NO: 2125540 - RNA, 12 nt, Human
aaacaaagccag

SEQ ID NO: 2125541 - RNA, 14 nt, Human
aaaauuuuuggauu

SEQ ID NO: 2125542 - RNA, 23 nt, Human
aaaauuuuuggauugacaguaac

SEQ ID NO: 2125543 - RNA, 21 nt, Human
aaaauguaggguuauaauaau

SEQ ID NO: 2125544 - RNA, 17 nt, Human
aaaauguauaaguugag

SEQ ID NO: 2125545 - RNA, 21 nt, Human
aaaauguauaaguugaggcau

SEQ ID NO: 2125546 - RNA, 23 nt, Human
aaaauguauaaguugaggcauuu

SEQ ID NO: 2125547 - RNA, 12 nt, Human
aaaauguacaaa

SEQ ID NO: 2125548 - RNA, 19 nt, Human
aaaauguacaaaauaaagu

SEQ ID NO: 2125549 - RNA, 21 nt, Human
aaaauguacaaaauaaaguua

SEQ ID NO: 2125550 - RNA, 23 nt, Human
aaaauguaaguaaaugucugugg

SEQ ID NO: 2125551 - RNA, 14 nt, Human
aaaauauguucuuu

SEQ ID NO: 2125552 - RNA, 11 nt, Human
aaaauauuauc

SEQ ID NO: 2125553 - RNA, 17 nt, Human
aaaauauuaucuuugua

SEQ ID NO: 2125554 - RNA, 21 nt, Human
aaaauauuaucuuuguaauua

SEQ ID NO: 2125555 - RNA, 16 nt, Human
aaaauauuauaacuua

SEQ ID NO: 2125556 - RNA, 19 nt, Human
aaaauauuauaacuuaaaa

SEQ ID NO: 2125557 - RNA, 16 nt, Human
gggcuggacuggcugu

SEQ ID NO: 2125558 - RNA, 17 nt, Human
gggcuggacuggcuguc

SEQ ID NO: 2125559 - RNA, 17 nt, Human
gggcuggccaguuggaa

SEQ ID NO: 2125560 - RNA, 13 nt, Human
aaacauaauucuu

SEQ ID NO: 2125561 - RNA, 18 nt, Human
aaacauagagggagagag

SEQ ID NO: 2125562 - RNA, 21 nt, Human
aaacauaauucuuguauauua

SEQ ID NO: 2125563 - RNA, 15 nt, Human
aaacaauaaaugugc

SEQ ID NO: 2125564 - RNA, 14 nt, Human
aaacacaauauuuu

SEQ ID NO: 2125565 - RNA, 16 nt, Human
aaacacaccaggcugu

SEQ ID NO: 2125566 - RNA, 17 nt, Human
aaacacaccaggcugug

SEQ ID NO: 2125567 - RNA, 18 nt, Human
aaacacaccaggcugugg

SEQ ID NO: 2125568 - RNA, 23 nt, Human
aaacacaccaggcugugggccuc

SEQ ID NO: 2125569 - RNA, 15 nt, Human
aaacacacugaggca

SEQ ID NO: 2125570 - RNA, 16 nt, Human
aaacacacugaggcag

SEQ ID NO: 2125571 - RNA, 19 nt, Human
aaacacacugaggcaggga

SEQ ID NO: 2125572 - RNA, 16 nt, Human
aaacauaagagagccu

SEQ ID NO: 2125573 - RNA, 13 nt, Human
aaacauaaaaagu

SEQ ID NO: 2125574 - RNA, 17 nt, Human
aaacacacugaggcagg

SEQ ID NO: 2125575 - RNA, 21 nt, Human
aaacacagacauucugccagg

SEQ ID NO: 2125576 - RNA, 13 nt, Human
ggggaacuccugg

SEQ ID NO: 2125577 - RNA, 24 nt, Human
ggggaaaaucagccugcuccagcu

SEQ ID NO: 2125578 - RNA, 13 nt, Human
aaagcuagaaaug

SEQ ID NO: 2125579 - RNA, 17 nt, Human
aaagcuaggccuggcca

SEQ ID NO: 2125580 - RNA, 18 nt, Human
aaagcuaggccuggccag

SEQ ID NO: 2125581 - RNA, 18 nt, Human
aaagcuaaaguaucugua

SEQ ID NO: 2125582 - RNA, 14 nt, Human
aaagcggggggagg

SEQ ID NO: 2125583 - RNA, 16 nt, Human
aaagcggggggagggu

SEQ ID NO: 2125584 - RNA, 18 nt, Human
aaagcggggggaggguug

SEQ ID NO: 2125585 - RNA, 12 nt, Human
aaagcacaucca

SEQ ID NO: 2125586 - RNA, 16 nt, Human
aaagcacauugaaaga

SEQ ID NO: 2125587 - RNA, 20 nt, Human
aaagcuugaagaucguuagu

SEQ ID NO: 2125588 - RNA, 15 nt, Human
aaaggaaaaaguauc

SEQ ID NO: 2125589 - RNA, 21 nt, Human
aaaggaaaaaguaucauggaa

SEQ ID NO: 2125590 - RNA, 22 nt, Human
aaaggaaaaaguaucauggaaa

SEQ ID NO: 2125591 - RNA, 11 nt, Human
aaagcuucccc

SEQ ID NO: 2125592 - RNA, 17 nt, Human
aaaggacaggcagaaag

SEQ ID NO: 2125593 - RNA, 18 nt, Human
aaaggacaggcagaaaga

SEQ ID NO: 2125594 - RNA, 19 nt, Human
aaaggacaggcagaaagag

SEQ ID NO: 2125595 - RNA, 22 nt, Human
aaaggacaccuuuuaacucacc

SEQ ID NO: 2125596 - RNA, 15 nt, Human
aaaggaauggaggcu

SEQ ID NO: 2125597 - RNA, 18 nt, Human
aaaggaaaauaguaaugu

SEQ ID NO: 2125598 - RNA, 14 nt, Human
aaaggaagucuagg

SEQ ID NO: 2125599 - RNA, 22 nt, Human
ggucuugaacuccuggccucaa

SEQ ID NO: 2125600 - RNA, 21 nt, Human
ggucuugaacuccuggccuca

SEQ ID NO: 2125601 - RNA, 15 nt, Human
ggucugucccaccag

SEQ ID NO: 2125602 - RNA, 22 nt, Human
ggucuggagaagcagugagccg

SEQ ID NO: 2125603 - RNA, 20 nt, Human
ggucugggagaggcagagug

SEQ ID NO: 2125604 - RNA, 20 nt, Human
ggucugggggucaggaggca

SEQ ID NO: 2125605 - RNA, 22 nt, Human
ggucugggggucaggaggcagg

SEQ ID NO: 2125606 - RNA, 14 nt, Human
ggucugucccacca

SEQ ID NO: 2125607 - RNA, 20 nt, Human
ggugcacagacgucccucca

SEQ ID NO: 2125608 - RNA, 20 nt, Human
ggugauuuagcaggaagcug

SEQ ID NO: 2125609 - RNA, 21 nt, Human
ggucuuuugacauguggaaag

SEQ ID NO: 2125610 - RNA, 17 nt, Human
ggucuuuugacaugugg

SEQ ID NO: 2125611 - RNA, 17 nt, Human
ggugaucugggauuagg

SEQ ID NO: 2125612 - RNA, 13 nt, Human
ggucuuguaagag

SEQ ID NO: 2125613 - RNA, 14 nt, Human
gguccaccccaugu

SEQ ID NO: 2125614 - RNA, 22 nt, Human
gguccacccaggagccccgagg

SEQ ID NO: 2125615 - RNA, 20 nt, Human
gguccacccaggagccccga

SEQ ID NO: 2125616 - RNA, 23 nt, Human
ggucccaaggcaaggggugccug

SEQ ID NO: 2125617 - RNA, 15 nt, Human
aaacuuguuagaaau

SEQ ID NO: 2125618 - RNA, 20 nt, Human
aaacuuuucuuaaaaaguua

SEQ ID NO: 2125619 - RNA, 14 nt, Human
aaacuuuaauaugu

SEQ ID NO: 2125620 - RNA, 18 nt, Human
aaacuuuaauauguauuu

SEQ ID NO: 2125621 - RNA, 24 nt, Human
aaacuuuuuugaaauaauaaaucu

SEQ ID NO: 2125622 - RNA, 15 nt, Human
aaacuguagaaauga

SEQ ID NO: 2125623 - RNA, 16 nt, Human
aaacuguagaaaugau

SEQ ID NO: 2125624 - RNA, 18 nt, Human
aaacuguagaaaugauga

SEQ ID NO: 2125625 - RNA, 15 nt, Human
aaacuguagucucag

SEQ ID NO: 2125626 - RNA, 16 nt, Human
aaacuguagucucagg

SEQ ID NO: 2125627 - RNA, 17 nt, Human
aaacugucaaagaauca

SEQ ID NO: 2125628 - RNA, 23 nt, Human
gguaguacuccugcaaaauuuua

SEQ ID NO: 2125629 - RNA, 22 nt, Human
gguaguacuccugcaaaauuuu

SEQ ID NO: 2125630 - RNA, 16 nt, Human
gguaguuaguagcaug

SEQ ID NO: 2125631 - RNA, 19 nt, Human
gguaguuaguagcauguug

SEQ ID NO: 2125632 - RNA, 23 nt, Human
gguaguuuuccauggucacagag

SEQ ID NO: 2125633 - RNA, 18 nt, Human
gguaguugcaauugaauu

SEQ ID NO: 2125634 - RNA, 17 nt, Human
gguauaaugguugacug

SEQ ID NO: 2125635 - RNA, 14 nt, Human
gguaugugugugua

SEQ ID NO: 2125636 - RNA, 20 nt, Human
gguauaaugguugacugggu

SEQ ID NO: 2125637 - RNA, 21 nt, Human
gguauggaaggguuuguggcu

SEQ ID NO: 2125638 - RNA, 18 nt, Human
gguauuccuuuuguguac

SEQ ID NO: 2125639 - RNA, 19 nt, Human
gguauuccuuuuguguaca

SEQ ID NO: 2125640 - RNA, 19 nt, Human
gguccacccaggagccccg

SEQ ID NO: 2125641 - RNA, 20 nt, Human
aaagaggcugaaagaggcca

SEQ ID NO: 2125642 - RNA, 20 nt, Human
aaagaugcaaggaccaggac

SEQ ID NO: 2125643 - RNA, 22 nt, Human
aaagaugcucagguacagagaa

SEQ ID NO: 2125644 - RNA, 23 nt, Human
aaagaugcucagguacagagaag

SEQ ID NO: 2125645 - RNA, 24 nt, Human
aaagaugcucagguacagagaagg

SEQ ID NO: 2125646 - RNA, 22 nt, Human
aaagaugccggguuuuauauuu

SEQ ID NO: 2125647 - RNA, 13 nt, Human
aaagaugugggga

SEQ ID NO: 2125648 - RNA, 20 nt, Human
aaagauguuugucagauaug

SEQ ID NO: 2125649 - RNA, 21 nt, Human
aaagauguuugucagauauga

SEQ ID NO: 2125650 - RNA, 16 nt, Human
aaagaggcugaaagag

SEQ ID NO: 2125651 - RNA, 13 nt, Human
aaagagagaaugu

SEQ ID NO: 2125652 - RNA, 13 nt, Human
aaagagagcacug

SEQ ID NO: 2125653 - RNA, 18 nt, Human
aaagagagaauguagaua

SEQ ID NO: 2125654 - RNA, 21 nt, Human
aaagaauuucaauuuguucag

SEQ ID NO: 2125655 - RNA, 18 nt, Human
aaagaauuccuacaauau

SEQ ID NO: 2125656 - RNA, 17 nt, Human
aaagaauggaaggugga

SEQ ID NO: 2125657 - RNA, 15 nt, Human
aaagacucaguguuc

SEQ ID NO: 2125658 - RNA, 15 nt, Human
aaagacuguacaaag

SEQ ID NO: 2125659 - RNA, 18 nt, Human
aaagacuuaguauauuuu

SEQ ID NO: 2125660 - RNA, 20 nt, Human
aaagacuuaguauauuuucu

SEQ ID NO: 2125661 - RNA, 15 nt, Human
aaagagaaaauugaa

SEQ ID NO: 2125662 - RNA, 22 nt, Human
aaagagaaaauugaauuuaaca

SEQ ID NO: 2125663 - RNA, 18 nt, Human
aaagagaaaaaaaguuug

SEQ ID NO: 2125664 - RNA, 20 nt, Human
aaagagaaugccauucucuu

SEQ ID NO: 2125665 - RNA, 11 nt, Human
aaagagaaacu

SEQ ID NO: 2125666 - RNA, 12 nt, Human
aaagagaaacuu

SEQ ID NO: 2125667 - RNA, 13 nt, Human
aaagagaaacuuu

SEQ ID NO: 2125668 - RNA, 14 nt, Human
aaagagaaacuuug

SEQ ID NO: 2125669 - RNA, 21 nt, Human
aaagagaaacuuugugcuaca

SEQ ID NO: 2125670 - RNA, 23 nt, Human
aaagagaaacuuugugcuacaug

SEQ ID NO: 2125671 - RNA, 13 nt, Human
gacagaacacugu

SEQ ID NO: 2125672 - RNA, 14 nt, Human
gacagaacacuguc

SEQ ID NO: 2125673 - RNA, 15 nt, Human
gacagaacacugucu

SEQ ID NO: 2125674 - RNA, 13 nt, Human
gacacagcucuuc

SEQ ID NO: 2125675 - RNA, 16 nt, Human
gacacagcucuucucc

SEQ ID NO: 2125676 - RNA, 14 nt, Human
gacacagcucuucu

SEQ ID NO: 2125677 - RNA, 21 nt, Human
gacacaggauagauaacucuu

SEQ ID NO: 2125678 - RNA, 12 nt, Human
gacacaggcccg

SEQ ID NO: 2125679 - RNA, 23 nt, Human
gacacagcucuucuccaggcugu

SEQ ID NO: 2125680 - RNA, 22 nt, Human
gacacagcucuucuccaggcug

SEQ ID NO: 2125681 - RNA, 17 nt, Human
gacacagcucuucucca

SEQ ID NO: 2125682 - RNA, 19 nt, Human
gacauuguuggccaaagcc

SEQ ID NO: 2125683 - RNA, 11 nt, Human
gacauuuccca

SEQ ID NO: 2125684 - RNA, 15 nt, Human
gacagugaucuccau

SEQ ID NO: 2125685 - RNA, 15 nt, Human
gacagugagguccug

SEQ ID NO: 2125686 - RNA, 17 nt, Human
gacagugagguccuggg

SEQ ID NO: 2125687 - RNA, 19 nt, Human
gacagugagguccuggggg

SEQ ID NO: 2125688 - RNA, 20 nt, Human
gacagugagguccugggggc

SEQ ID NO: 2125689 - RNA, 21 nt, Human
gacagugaucuccauauguua

SEQ ID NO: 2125690 - RNA, 16 nt, Human
gacagugccuauacug

SEQ ID NO: 2125691 - RNA, 13 nt, Human
gacagugccuggg

SEQ ID NO: 2125692 - RNA, 16 nt, Human
gacagugcuucagccu

SEQ ID NO: 2125693 - RNA, 16 nt, Human
gacagugaucuccaua

SEQ ID NO: 2125694 - RNA, 17 nt, Human
gacagugccugggaaug

SEQ ID NO: 2125695 - RNA, 21 nt, Human
gacagugccugggaauguauu

SEQ ID NO: 2125696 - RNA, 22 nt, Human
gacagugccugggaauguauua

SEQ ID NO: 2125697 - RNA, 13 nt, Human
gacagaagaaggc

SEQ ID NO: 2125698 - RNA, 15 nt, Human
gacauugcggacagc

SEQ ID NO: 2125699 - RNA, 14 nt, Human
gacauugcggacag

SEQ ID NO: 2125700 - RNA, 12 nt, Human
gacauugucaau

SEQ ID NO: 2125701 - RNA, 19 nt, Human
gacauuguagagcuucugg

SEQ ID NO: 2125702 - RNA, 15 nt, Human
gacauugucaauaaa

SEQ ID NO: 2125703 - RNA, 13 nt, Human
gacauugucaaua

SEQ ID NO: 2125704 - RNA, 14 nt, Human
gacauugucaauaa

SEQ ID NO: 2125705 - RNA, 17 nt, Human
gacagugcuucagccug

SEQ ID NO: 2125706 - RNA, 17 nt, Human
gacauucugccaggccc

SEQ ID NO: 2125707 - RNA, 22 nt, Human
gacauucugccaggcccccaag

SEQ ID NO: 2125708 - RNA, 14 nt, Human
gacauucugccagg

SEQ ID NO: 2125709 - RNA, 12 nt, Human
gaccagccuggg

SEQ ID NO: 2125710 - RNA, 17 nt, Human
gaccagccugggcagca

SEQ ID NO: 2125711 - RNA, 19 nt, Human
gaccauccacucuacccuc

SEQ ID NO: 2125712 - RNA, 20 nt, Human
gaccauccuggccaacauga

SEQ ID NO: 2125713 - RNA, 16 nt, Human
gaccucguccuccccc

SEQ ID NO: 2125714 - RNA, 15 nt, Human
gaccucgugcuuuaa

SEQ ID NO: 2125715 - RNA, 18 nt, Human
gaccucgugcuuuaagug

SEQ ID NO: 2125716 - RNA, 17 nt, Human
gaccucguccucccccu

SEQ ID NO: 2125717 - RNA, 18 nt, Human
gaccucguccucccccug

SEQ ID NO: 2125718 - RNA, 19 nt, Human
gaccucguccucccccugc

SEQ ID NO: 2125719 - RNA, 21 nt, Human
gaccucguccucccccugcca

SEQ ID NO: 2125720 - RNA, 13 nt, Human
gaccauccuauuu

SEQ ID NO: 2125721 - RNA, 21 nt, Human
gaccauccacucuacccuccc

SEQ ID NO: 2125722 - RNA, 23 nt, Human
gaccauccacucuacccucccac

SEQ ID NO: 2125723 - RNA, 22 nt, Human
gaccucguccucccccugccag

SEQ ID NO: 2125724 - RNA, 23 nt, Human
gaccucuauaauugccacugaga

SEQ ID NO: 2125725 - RNA, 10 nt, Human
gaccucuggg

SEQ ID NO: 2125726 - RNA, 11 nt, Human
gaccucugggc

SEQ ID NO: 2125727 - RNA, 13 nt, Human
gaccucugggcuu

SEQ ID NO: 2125728 - RNA, 15 nt, Human
gaccugacuauugaa

SEQ ID NO: 2125729 - RNA, 15 nt, Human
gaccugacucaggca

SEQ ID NO: 2125730 - RNA, 16 nt, Human
gaccugagcuccccac

SEQ ID NO: 2125731 - RNA, 18 nt, Human
gaccugagcuccccacca

SEQ ID NO: 2125732 - RNA, 22 nt, Human
gaccugagcuccccaccacccc

SEQ ID NO: 2125733 - RNA, 13 nt, Human
gaccugaggaagc

SEQ ID NO: 2125734 - RNA, 14 nt, Human
gaccugaggaagcg

SEQ ID NO: 2125735 - RNA, 13 nt, Human
gacuuuccacccc

SEQ ID NO: 2125736 - RNA, 12 nt, Human
gacuuucaggua

SEQ ID NO: 2125737 - RNA, 14 nt, Human
gacuuucagguacu

SEQ ID NO: 2125738 - RNA, 19 nt, Human
gacuuuauuuucugguaga

SEQ ID NO: 2125739 - RNA, 13 nt, Human
gacuuuagaaaua

SEQ ID NO: 2125740 - RNA, 17 nt, Human
gacuuuagaaauaaaug

SEQ ID NO: 2125741 - RNA, 18 nt, Human
gacuuuagaaauaaaugu

SEQ ID NO: 2125742 - RNA, 19 nt, Human
gacuuuauagaucagccag

SEQ ID NO: 2125743 - RNA, 12 nt, Human
gacucaccucug

SEQ ID NO: 2125744 - RNA, 13 nt, Human
gacucaccucugc

SEQ ID NO: 2125745 - RNA, 14 nt, Human
gacucaccucugcc

SEQ ID NO: 2125746 - RNA, 15 nt, Human
gacucaccucugccu

SEQ ID NO: 2125747 - RNA, 17 nt, Human
gacucaccucugccuca

SEQ ID NO: 2125748 - RNA, 18 nt, Human
gacucaccucugccucaa

SEQ ID NO: 2125749 - RNA, 14 nt, Human
gacucacuggcagc

SEQ ID NO: 2125750 - RNA, 16 nt, Human
gacucacuggcagccc

SEQ ID NO: 2125751 - RNA, 21 nt, Human
gacucacuggcagccccagca

SEQ ID NO: 2125752 - RNA, 22 nt, Human
gacucacuggcagccccagcac

SEQ ID NO: 2125753 - RNA, 23 nt, Human
gacucacuggcagccccagcacc

SEQ ID NO: 2125754 - RNA, 23 nt, Human
gacucacuuaucccaagagaaug

SEQ ID NO: 2125755 - RNA, 16 nt, Human
gacucugccuccucuu

SEQ ID NO: 2125756 - RNA, 12 nt, Human
gacucugccucc

SEQ ID NO: 2125757 - RNA, 14 nt, Human
gacucuuguuuuca

SEQ ID NO: 2125758 - RNA, 9 nt, Human
gacucuugu

SEQ ID NO: 2125759 - RNA, 17 nt, Human
gacucuguggggccuug

SEQ ID NO: 2125760 - RNA, 18 nt, Human
gacucuguggggccuugg

SEQ ID NO: 2125761 - RNA, 19 nt, Human
gacucugucucaaaaaaac

SEQ ID NO: 2125762 - RNA, 11 nt, Human
gacuguagaaa

SEQ ID NO: 2125763 - RNA, 18 nt, Human
gacugaauuguccccagu

SEQ ID NO: 2125764 - RNA, 20 nt, Human
gacuguagauugcuucugua

SEQ ID NO: 2125765 - RNA, 21 nt, Human
gacuguagauugcuucuguag

SEQ ID NO: 2125766 - RNA, 22 nt, Human
gacuguagauugcuucuguagu

SEQ ID NO: 2125767 - RNA, 13 nt, Human
gacugucuuucag

SEQ ID NO: 2125768 - RNA, 14 nt, Human
gacuguaucugugu

SEQ ID NO: 2125769 - RNA, 15 nt, Human
gacuguaucugugua

SEQ ID NO: 2125770 - RNA, 16 nt, Human
gacuguaucuguguag

SEQ ID NO: 2125771 - RNA, 17 nt, Human
gacuguaucuguguaga

SEQ ID NO: 2125772 - RNA, 18 nt, Human
gacuguauuauacauggg

SEQ ID NO: 2125773 - RNA, 22 nt, Human
gacuguauuauacauggguagc

SEQ ID NO: 2125774 - RNA, 19 nt, Human
gacuguaucuguguagacu

SEQ ID NO: 2125775 - RNA, 23 nt, Human
gacuguacuccucccaggcgccc

SEQ ID NO: 2125776 - RNA, 18 nt, Human
gacuguacuccucccagg

SEQ ID NO: 2125777 - RNA, 16 nt, Human
gacugaagccugcagg

SEQ ID NO: 2125778 - RNA, 19 nt, Human
gacucuuguuuucaguuuc

SEQ ID NO: 2125779 - RNA, 19 nt, Human
gacugugaugccacacaga

SEQ ID NO: 2125780 - RNA, 13 nt, Human
gacugugaugcca

SEQ ID NO: 2125781 - RNA, 12 nt, Human
gacuguggcugc

SEQ ID NO: 2125782 - RNA, 14 nt, Human
gacuguggcugcua

SEQ ID NO: 2125783 - RNA, 15 nt, Human
gacuguggcugcuag

SEQ ID NO: 2125784 - RNA, 21 nt, Human
gaagcagaugcaaagaggcaa

SEQ ID NO: 2125785 - RNA, 19 nt, Human
gaagcagaugcaaagaggc

SEQ ID NO: 2125786 - RNA, 20 nt, Human
gaagcagaugcaaagaggca

SEQ ID NO: 2125787 - RNA, 15 nt, Human
gaagcagaggaagga

SEQ ID NO: 2125788 - RNA, 16 nt, Human
gaagcaacagaaaaaa

SEQ ID NO: 2125789 - RNA, 16 nt, Human
gaagcaacgaagggaa

SEQ ID NO: 2125790 - RNA, 17 nt, Human
gaagcaaacacauuaag

SEQ ID NO: 2125791 - RNA, 23 nt, Human
gaagacaaugugaaaagaaaaau

SEQ ID NO: 2125792 - RNA, 14 nt, Human
gaagacaaaaauac

SEQ ID NO: 2125793 - RNA, 15 nt, Human
gaagacaaaaauacu

SEQ ID NO: 2125794 - RNA, 16 nt, Human
gaagacaaaaauacuc

SEQ ID NO: 2125795 - RNA, 17 nt, Human
gaagacaaaaauacucu

SEQ ID NO: 2125796 - RNA, 20 nt, Human
gaagacaaaaauacucuaau

SEQ ID NO: 2125797 - RNA, 17 nt, Human
gaagaauuuucagaccc

SEQ ID NO: 2125798 - RNA, 20 nt, Human
gaagaauuuucagaccccag

SEQ ID NO: 2125799 - RNA, 21 nt, Human
gaagaauuuucagaccccagc

SEQ ID NO: 2125800 - RNA, 23 nt, Human
gaagauuuugaaauuuuuauuaa

SEQ ID NO: 2125801 - RNA, 15 nt, Human
gaagcaaacacauua

SEQ ID NO: 2125802 - RNA, 13 nt, Human
gaagcaaacacau

SEQ ID NO: 2125803 - RNA, 19 nt, Human
gaagcaaaaacgaaagcug

SEQ ID NO: 2125804 - RNA, 20 nt, Human
gaagcaaaaacgaaagcugg

SEQ ID NO: 2125805 - RNA, 21 nt, Human
gaagcaaaaacgaaagcuggg

SEQ ID NO: 2125806 - RNA, 17 nt, Human
gaacccuuuuggccccc

SEQ ID NO: 2125807 - RNA, 18 nt, Human
gaacccuuuuggcccccg

SEQ ID NO: 2125808 - RNA, 19 nt, Human
gaacccuuuuggcccccga

SEQ ID NO: 2125809 - RNA, 14 nt, Human
gaaccgaaaggcca

SEQ ID NO: 2125810 - RNA, 22 nt, Human
gaacccuggugaggaagcucca

SEQ ID NO: 2125811 - RNA, 23 nt, Human
gaacccuggugaggaagcuccag

SEQ ID NO: 2125812 - RNA, 20 nt, Human
gaacucgcuucucugugacu

SEQ ID NO: 2125813 - RNA, 20 nt, Human
gaacuccugggcucaagcag

SEQ ID NO: 2125814 - RNA, 23 nt, Human
gaacucuagggauagucaccuuu

SEQ ID NO: 2125815 - RNA, 17 nt, Human
gaacucucuccacccua

SEQ ID NO: 2125816 - RNA, 11 nt, Human
gaacuccuggg

SEQ ID NO: 2125817 - RNA, 14 nt, Human
gaacuccugggcuc

SEQ ID NO: 2125818 - RNA, 23 nt, Human
gaacccuuuuggcccccgagcug

SEQ ID NO: 2125819 - RNA, 23 nt, Human
gaagaauugaacccaggaggugg

SEQ ID NO: 2125820 - RNA, 13 nt, Human
gaagaauuauuuu

SEQ ID NO: 2125821 - RNA, 18 nt, Human
gaagaauugaacccagga

SEQ ID NO: 2125822 - RNA, 19 nt, Human
gaagaauugaacccaggag

SEQ ID NO: 2125823 - RNA, 20 nt, Human
gaagaauugaacccaggagg

SEQ ID NO: 2125824 - RNA, 15 nt, Human
gaagaauuuucagac

SEQ ID NO: 2125825 - RNA, 17 nt, Human
gaacugggccuguugcc

SEQ ID NO: 2125826 - RNA, 13 nt, Human
gaagaauauuguu

SEQ ID NO: 2125827 - RNA, 19 nt, Human
gaagaauauuguuccuaag

SEQ ID NO: 2125828 - RNA, 20 nt, Human
gaagaauauuguuccuaagu

SEQ ID NO: 2125829 - RNA, 22 nt, Human
gaagaauauuguuccuaaguuc

SEQ ID NO: 2125830 - RNA, 12 nt, Human
gaacuggcugca

SEQ ID NO: 2125831 - RNA, 11 nt, Human
gaacuggcugc

SEQ ID NO: 2125832 - RNA, 23 nt, Human
gaacuggacucaggaugcccagg

SEQ ID NO: 2125833 - RNA, 15 nt, Human
gaacuggaggccagg

SEQ ID NO: 2125834 - RNA, 21 nt, Human
gaacugcuuuaucccacggaa

SEQ ID NO: 2125835 - RNA, 14 nt, Human
gaacuggacucagg

SEQ ID NO: 2125836 - RNA, 15 nt, Human
gaacuggacucagga

SEQ ID NO: 2125837 - RNA, 21 nt, Human
gaacuggacucaggaugccca

SEQ ID NO: 2125838 - RNA, 17 nt, Human
gaacugagcuccucugg

SEQ ID NO: 2125839 - RNA, 19 nt, Human
gaacugagcuccucugggc

SEQ ID NO: 2125840 - RNA, 17 nt, Human
gaacugccucuuuccug

SEQ ID NO: 2125841 - RNA, 12 nt, Human
gaauauuuauua

SEQ ID NO: 2125842 - RNA, 21 nt, Human
gaauauuguuccuaaguucuu

SEQ ID NO: 2125843 - RNA, 19 nt, Human
gaauauuuauauuucacua

SEQ ID NO: 2125844 - RNA, 10 nt, Human
gaauauuuau

SEQ ID NO: 2125845 - RNA, 13 nt, Human
gaauauuuauaac

SEQ ID NO: 2125846 - RNA, 15 nt, Human
gaauauuuauaacag

SEQ ID NO: 2125847 - RNA, 16 nt, Human
gaauauuuauaacagc

SEQ ID NO: 2125848 - RNA, 18 nt, Human
gaauauuuauaacagcau

SEQ ID NO: 2125849 - RNA, 18 nt, Human
gaauauuuauauuucacu

SEQ ID NO: 2125850 - RNA, 18 nt, Human
gaauauuuauuaccucug

SEQ ID NO: 2125851 - RNA, 17 nt, Human
gaauauuuauuaccucu

SEQ ID NO: 2125852 - RNA, 15 nt, Human
gaauauuuauuaccu

SEQ ID NO: 2125853 - RNA, 13 nt, Human
gaauauuuauuac

SEQ ID NO: 2125854 - RNA, 21 nt, Human
gaauauuuauuaccucugaua

SEQ ID NO: 2125855 - RNA, 19 nt, Human
gaauauuuauuaccucuga

SEQ ID NO: 2125856 - RNA, 20 nt, Human
gaauauuuauauuucacuau

SEQ ID NO: 2125857 - RNA, 21 nt, Human
gaauauuagcuuuacuguuug

SEQ ID NO: 2125858 - RNA, 12 nt, Human
gaauauuagcuu

SEQ ID NO: 2125859 - RNA, 13 nt, Human
gaauauaauuauc

SEQ ID NO: 2125860 - RNA, 21 nt, Human
gaauauaaacacuauauggca

SEQ ID NO: 2125861 - RNA, 14 nt, Human
gaauauaaacacua

SEQ ID NO: 2125862 - RNA, 12 nt, Human
gaauauaauuau

SEQ ID NO: 2125863 - RNA, 15 nt, Human
gaaguuaacagagac

SEQ ID NO: 2125864 - RNA, 18 nt, Human
gaaguuacuguuauagag

SEQ ID NO: 2125865 - RNA, 15 nt, Human
gaaguguguuuccuu

SEQ ID NO: 2125866 - RNA, 17 nt, Human
gaaggggaggagggcgg

SEQ ID NO: 2125867 - RNA, 23 nt, Human
gaaggggaggcagccggcaccca

SEQ ID NO: 2125868 - RNA, 19 nt, Human
gaaggggaagcacucgugu

SEQ ID NO: 2125869 - RNA, 22 nt, Human
gaaggggaggaccucugggcuu

SEQ ID NO: 2125870 - RNA, 15 nt, Human
gaaggggaggagggc

SEQ ID NO: 2125871 - RNA, 13 nt, Human
gaauauaaacacu

SEQ ID NO: 2125872 - RNA, 18 nt, Human
gaaguugggcaauauaac

SEQ ID NO: 2125873 - RNA, 22 nt, Human
gaaguugggcaauauaaccaau

SEQ ID NO: 2125874 - RNA, 17 nt, Human
gaaguugcagugagcug

SEQ ID NO: 2125875 - RNA, 13 nt, Human
gaaguuggacagc

SEQ ID NO: 2125876 - RNA, 16 nt, Human
gaaguuggacagcaaa

SEQ ID NO: 2125877 - RNA, 23 nt, Human
gaaguuggacagcaaaaccauug

SEQ ID NO: 2125878 - RNA, 22 nt, Human
gaaguuggagugaguguggcuc

SEQ ID NO: 2125879 - RNA, 19 nt, Human
gaagcuccgcuuucuaccc

SEQ ID NO: 2125880 - RNA, 14 nt, Human
gaagcucagacugg

SEQ ID NO: 2125881 - RNA, 12 nt, Human
gaagcucagccc

SEQ ID NO: 2125882 - RNA, 13 nt, Human
gaagcucagccca

SEQ ID NO: 2125883 - RNA, 22 nt, Human
gaagcuccgcuuucuacccagc

SEQ ID NO: 2125884 - RNA, 14 nt, Human
gaagcucagcccac

SEQ ID NO: 2125885 - RNA, 15 nt, Human
gaagcucagcccacc

SEQ ID NO: 2125886 - RNA, 17 nt, Human
gaagcucagcccacccc

SEQ ID NO: 2125887 - RNA, 18 nt, Human
gaagcucagcccaccccc

SEQ ID NO: 2125888 - RNA, 19 nt, Human
gaagcucagcccacccccc

SEQ ID NO: 2125889 - RNA, 12 nt, Human
gaagcuccuggu

SEQ ID NO: 2125890 - RNA, 13 nt, Human
gaagcuccuggua

SEQ ID NO: 2125891 - RNA, 13 nt, Human
gaagcucugaagu

SEQ ID NO: 2125892 - RNA, 15 nt, Human
gaagcucugaaguca

SEQ ID NO: 2125893 - RNA, 14 nt, Human
gaagcugagcacca

SEQ ID NO: 2125894 - RNA, 17 nt, Human
gaagcugagcaccaggg

SEQ ID NO: 2125895 - RNA, 19 nt, Human
gaagcugagcaccagggga

SEQ ID NO: 2125896 - RNA, 18 nt, Human
gaagcucuugaagacacu

SEQ ID NO: 2125897 - RNA, 16 nt, Human
gaagcucugaagucac

SEQ ID NO: 2125898 - RNA, 20 nt, Human
gaagcucugaagucacauca

SEQ ID NO: 2125899 - RNA, 21 nt, Human
gaagggcuuggacucaagcaa

SEQ ID NO: 2125900 - RNA, 14 nt, Human
gaagggccaguccu

SEQ ID NO: 2125901 - RNA, 16 nt, Human
gaagggccaguccugc

SEQ ID NO: 2125902 - RNA, 18 nt, Human
gaagggccaguccugccu

SEQ ID NO: 2125903 - RNA, 19 nt, Human
gaagggccaguccugccug

SEQ ID NO: 2125904 - RNA, 20 nt, Human
gaagggccaguccugccugg

SEQ ID NO: 2125905 - RNA, 22 nt, Human
gaagggccaguccugccuggcc

SEQ ID NO: 2125906 - RNA, 18 nt, Human
gaaggcuggggcuauuua

SEQ ID NO: 2125907 - RNA, 12 nt, Human
gaaggcuguccu

SEQ ID NO: 2125908 - RNA, 17 nt, Human
gaaggcuguccuuaccc

SEQ ID NO: 2125909 - RNA, 13 nt, Human
gaaggcuggcugg

SEQ ID NO: 2125910 - RNA, 16 nt, Human
gaaggcuggcugggca

SEQ ID NO: 2125911 - RNA, 22 nt, Human
gaaggccgagaagcaagaaaga

SEQ ID NO: 2125912 - RNA, 17 nt, Human
gaaggccgagaagcaag

SEQ ID NO: 2125913 - RNA, 18 nt, Human
gaaggccgagaagcaaga

SEQ ID NO: 2125914 - RNA, 20 nt, Human
gagcgcaccugcccccuggu

SEQ ID NO: 2125915 - RNA, 16 nt, Human
gagcgcaucaggccug

SEQ ID NO: 2125916 - RNA, 18 nt, Human
gagcgcaccugcccccug

SEQ ID NO: 2125917 - RNA, 16 nt, Human
gagcugcuggcuugca

SEQ ID NO: 2125918 - RNA, 21 nt, Human
gagcugcuggcuugcagugcg

SEQ ID NO: 2125919 - RNA, 15 nt, Human
gagcuggaccagugg

SEQ ID NO: 2125920 - RNA, 17 nt, Human
gagcuggaccucaccaa

SEQ ID NO: 2125921 - RNA, 12 nt, Human
gagcugcuggcu

SEQ ID NO: 2125922 - RNA, 13 nt, Human
gaggaccucuggg

SEQ ID NO: 2125923 - RNA, 14 nt, Human
gaggaccucugggc

SEQ ID NO: 2125924 - RNA, 15 nt, Human
gaggaccucugggcu

SEQ ID NO: 2125925 - RNA, 14 nt, Human
gaggcagggucuca

SEQ ID NO: 2125926 - RNA, 15 nt, Human
gaggcaggggcggag

SEQ ID NO: 2125927 - RNA, 23 nt, Human
gaggcagggccuugcccagagau

SEQ ID NO: 2125928 - RNA, 14 nt, Human
gaggcaggggcgga

SEQ ID NO: 2125929 - RNA, 19 nt, Human
gaggaccuuaucugugcgu

SEQ ID NO: 2125930 - RNA, 15 nt, Human
gaggaccuuaucugu

SEQ ID NO: 2125931 - RNA, 15 nt, Human
gaggcagggucucac

SEQ ID NO: 2125932 - RNA, 17 nt, Human
gaggccaaggugggagg

SEQ ID NO: 2125933 - RNA, 22 nt, Human
gaggccaaggugggaggauugc

SEQ ID NO: 2125934 - RNA, 13 nt, Human
gaggcagggucag

SEQ ID NO: 2125935 - RNA, 18 nt, Human
gaggcaggugacagugag

SEQ ID NO: 2125936 - RNA, 15 nt, Human
gaggccaagugcagg

SEQ ID NO: 2125937 - RNA, 17 nt, Human
gaggccaagugcaggcu

SEQ ID NO: 2125938 - RNA, 16 nt, Human
gaggcugaggcagaag

SEQ ID NO: 2125939 - RNA, 18 nt, Human
gaggcugaggcagaagaa

SEQ ID NO: 2125940 - RNA, 16 nt, Human
gaggcugaggcaggag

SEQ ID NO: 2125941 - RNA, 15 nt, Human
gaggcugaggcagga

SEQ ID NO: 2125942 - RNA, 18 nt, Human
gaggcugaggcaggagaa

SEQ ID NO: 2125943 - RNA, 17 nt, Human
gaggcugaggcaggagg

SEQ ID NO: 2125944 - RNA, 14 nt, Human
gaggggccucaggu

SEQ ID NO: 2125945 - RNA, 13 nt, Human
gaggggcccgagc

SEQ ID NO: 2125946 - RNA, 12 nt, Human
gaggcugaggcg

SEQ ID NO: 2125947 - RNA, 18 nt, Human
gaggcugaggugggcaga

SEQ ID NO: 2125948 - RNA, 17 nt, Human
gaggggcaucugccccu

SEQ ID NO: 2125949 - RNA, 22 nt, Human
gaggggcaucugccccuccccc

SEQ ID NO: 2125950 - RNA, 19 nt, Human
gaggggcauggccagcagc

SEQ ID NO: 2125951 - RNA, 13 nt, Human
gaguuuaaagcaa

SEQ ID NO: 2125952 - RNA, 18 nt, Human
gaguugauucagcucugc

SEQ ID NO: 2125953 - RNA, 16 nt, Human
gaguggaugccucaga

SEQ ID NO: 2125954 - RNA, 16 nt, Human
gaguuggcauugcauu

SEQ ID NO: 2125955 - RNA, 16 nt, Human
gaguuguuuucagacu

SEQ ID NO: 2125956 - RNA, 22 nt, Human
gaguuguuuucagacucagacu

SEQ ID NO: 2125957 - RNA, 15 nt, Human
gaggucgaggcagga

SEQ ID NO: 2125958 - RNA, 21 nt, Human
gagguccugggggccugaccu

SEQ ID NO: 2125959 - RNA, 23 nt, Human
gagguccugggggccugaccucc

SEQ ID NO: 2125960 - RNA, 22 nt, Human
gaggucgaccccaaagccccuu

SEQ ID NO: 2125961 - RNA, 20 nt, Human
gaggucgggaguucgagacc

SEQ ID NO: 2125962 - RNA, 15 nt, Human
gaggugaaagggagc

SEQ ID NO: 2125963 - RNA, 17 nt, Human
gaggucucuugagggag

SEQ ID NO: 2125964 - RNA, 19 nt, Human
gaggucuuuugacaugugg

SEQ ID NO: 2125965 - RNA, 15 nt, Human
gaggucucuugaggg

SEQ ID NO: 2125966 - RNA, 22 nt, Human
gaggucuuuugacauguggaaa

SEQ ID NO: 2125967 - RNA, 14 nt, Human
gaggucucuugagg

SEQ ID NO: 2125968 - RNA, 23 nt, Human
gaggugaacuguuuccacauuca

SEQ ID NO: 2125969 - RNA, 16 nt, Human
gaggugaaagggagcu

SEQ ID NO: 2125970 - RNA, 23 nt, Human
gaggugaccccagguuucuaugu

SEQ ID NO: 2125971 - RNA, 19 nt, Human
gagugcaaugacacagucu

SEQ ID NO: 2125972 - RNA, 22 nt, Human
gagugauacaacuucaagugca

SEQ ID NO: 2125973 - RNA, 10 nt, Human
gagugaucuu

SEQ ID NO: 2125974 - RNA, 16 nt, Human
gagugcaacaguagca

SEQ ID NO: 2125975 - RNA, 19 nt, Human
gaguggagguuaaggcuga

SEQ ID NO: 2125976 - RNA, 20 nt, Human
gagugacagaggcagcccca

SEQ ID NO: 2125977 - RNA, 19 nt, Human
gagugacaguggauugcau

SEQ ID NO: 2125978 - RNA, 14 nt, Human
gagugacagaguaa

SEQ ID NO: 2125979 - RNA, 18 nt, Human
gagucccaaggaaagccc

SEQ ID NO: 2125980 - RNA, 14 nt, Human
gagugacuagacgu

SEQ ID NO: 2125981 - RNA, 19 nt, Human
gagugaguguggcuccccu

SEQ ID NO: 2125982 - RNA, 15 nt, Human
gaguugauucagcuc

SEQ ID NO: 2125983 - RNA, 16 nt, Human
gaguugauucagcucu

SEQ ID NO: 2125984 - RNA, 17 nt, Human
gaguugauucagcucug

SEQ ID NO: 2125985 - RNA, 16 nt, Human
gaguggauagaugccc

SEQ ID NO: 2125986 - RNA, 18 nt, Human
gaguggauagaugcccug

SEQ ID NO: 2125987 - RNA, 20 nt, Human
gaguggauagaugcccugcu

SEQ ID NO: 2125988 - RNA, 18 nt, Human
gaguggaugauguuucgu

SEQ ID NO: 2125989 - RNA, 18 nt, Human
gagugacagaggcagccc

SEQ ID NO: 2125990 - RNA, 15 nt, Human
gagucccaaggaaag

SEQ ID NO: 2125991 - RNA, 16 nt, Human
gagucccaaggaaagc

SEQ ID NO: 2125992 - RNA, 18 nt, Human
gagucagguuugggguuc

SEQ ID NO: 2125993 - RNA, 14 nt, Human
gagucccaaggaaa

SEQ ID NO: 2125994 - RNA, 12 nt, Human
gagucccaccuu

SEQ ID NO: 2125995 - RNA, 11 nt, Human
gagucagccuu

SEQ ID NO: 2125996 - RNA, 17 nt, Human
gagucagggaccccugc

SEQ ID NO: 2125997 - RNA, 18 nt, Human
gagucagggaccccugcc

SEQ ID NO: 2125998 - RNA, 22 nt, Human
gagucagggaccccugcccuug

SEQ ID NO: 2125999 - RNA, 16 nt, Human
gagucaccaagcccag

SEQ ID NO: 2126000 - RNA, 15 nt, Human
gagguggaagcccuc

SEQ ID NO: 2126001 - RNA, 17 nt, Human
gagucaccaagcccagu

SEQ ID NO: 2126002 - RNA, 20 nt, Human
gagguggaagcccuccuucc

SEQ ID NO: 2126003 - RNA, 14 nt, Human
gagucaccaggaau

SEQ ID NO: 2126004 - RNA, 20 nt, Human
gagucacccaugaagacagg

SEQ ID NO: 2126005 - RNA, 21 nt, Human
gcaccuacuacaucgcccucc

SEQ ID NO: 2126006 - RNA, 23 nt, Human
gcaccuacuacaucgcccuccac

SEQ ID NO: 2126007 - RNA, 17 nt, Human
gcaccuauagucccagc

SEQ ID NO: 2126008 - RNA, 18 nt, Human
gcaccuauagucccagcu

SEQ ID NO: 2126009 - RNA, 21 nt, Human
gcaccuauagucccagcuacu

SEQ ID NO: 2126010 - RNA, 14 nt, Human
gcaccgggccacag

SEQ ID NO: 2126011 - RNA, 13 nt, Human
gcacaucccugga

SEQ ID NO: 2126012 - RNA, 19 nt, Human
gcacauccaggcaauggcc

SEQ ID NO: 2126013 - RNA, 23 nt, Human
gcaccgggccacagagaaaguac

SEQ ID NO: 2126014 - RNA, 13 nt, Human
gcacucacaugcu

SEQ ID NO: 2126015 - RNA, 14 nt, Human
gcacucacaugcug

SEQ ID NO: 2126016 - RNA, 17 nt, Human
gcacucagaagacacug

SEQ ID NO: 2126017 - RNA, 16 nt, Human
gcacucagaagacacu

SEQ ID NO: 2126018 - RNA, 13 nt, Human
gcacucagaagac

SEQ ID NO: 2126019 - RNA, 14 nt, Human
gcacuccggaggua

SEQ ID NO: 2126020 - RNA, 19 nt, Human
gcacuccucccugauguac

SEQ ID NO: 2126021 - RNA, 21 nt, Human
gauuuuuuuuuagaacagaaa

SEQ ID NO: 2126022 - RNA, 23 nt, Human
gauuuuuuuuuagaacagaaaac

SEQ ID NO: 2126023 - RNA, 16 nt, Human
gcaagucacaaaggaa

SEQ ID NO: 2126024 - RNA, 20 nt, Human
gcaagucacaaaggaaugga

SEQ ID NO: 2126025 - RNA, 14 nt, Human
gcaauauaaccaau

SEQ ID NO: 2126026 - RNA, 17 nt, Human
gcaauauaaccaauguu

SEQ ID NO: 2126027 - RNA, 13 nt, Human
gcaauaguguguu

SEQ ID NO: 2126028 - RNA, 17 nt, Human
gcaauaguguguucuga

SEQ ID NO: 2126029 - RNA, 20 nt, Human
gcaauaguguguucugauua

SEQ ID NO: 2126030 - RNA, 19 nt, Human
gcaagugugugcaugugug

SEQ ID NO: 2126031 - RNA, 21 nt, Human
gcaagugugugcaugugugcg

SEQ ID NO: 2126032 - RNA, 22 nt, Human
gcaagugugugcaugugugcga

SEQ ID NO: 2126033 - RNA, 23 nt, Human
gcaaguguguaugugcgugugug

SEQ ID NO: 2126034 - RNA, 12 nt, Human
gcaagugugugc

SEQ ID NO: 2126035 - RNA, 13 nt, Human
gcaagugugugca

SEQ ID NO: 2126036 - RNA, 23 nt, Human
gcaagugugugcacaugugugcg

SEQ ID NO: 2126037 - RNA, 21 nt, Human
gcaagugagcaaaccugcccc

SEQ ID NO: 2126038 - RNA, 22 nt, Human
gcaagugagcaaaccugcccca

SEQ ID NO: 2126039 - RNA, 21 nt, Human
gcaaguguaugcacgugugca

SEQ ID NO: 2126040 - RNA, 15 nt, Human
gcaagugucugugug

SEQ ID NO: 2126041 - RNA, 16 nt, Human
gcaagugucugugugc

SEQ ID NO: 2126042 - RNA, 17 nt, Human
gcaagugucugugugca

SEQ ID NO: 2126043 - RNA, 12 nt, Human
gcaagucaggac

SEQ ID NO: 2126044 - RNA, 20 nt, Human
gcaagucccugacucucugu

SEQ ID NO: 2126045 - RNA, 22 nt, Human
gcaagucccugacucucuguga

SEQ ID NO: 2126046 - RNA, 21 nt, Human
gcacagugcaucucagcccac

SEQ ID NO: 2126047 - RNA, 20 nt, Human
gcacagugcaucucagccca

SEQ ID NO: 2126048 - RNA, 19 nt, Human
gcacagugcaucucagccc

SEQ ID NO: 2126049 - RNA, 14 nt, Human
gcacagugccugca

SEQ ID NO: 2126050 - RNA, 14 nt, Human
gcacauagagaggg

SEQ ID NO: 2126051 - RNA, 14 nt, Human
gcacaccgggcacu

SEQ ID NO: 2126052 - RNA, 11 nt, Human
gcacaauaaau

SEQ ID NO: 2126053 - RNA, 19 nt, Human
gcacaaggcugaccaagag

SEQ ID NO: 2126054 - RNA, 22 nt, Human
gcacaagcugcacccucaggca

SEQ ID NO: 2126055 - RNA, 21 nt, Human
gauuauauaaagaccuauaaa

SEQ ID NO: 2126056 - RNA, 12 nt, Human
gauuauuggaaa

SEQ ID NO: 2126057 - RNA, 23 nt, Human
gauuauucccuguacaauauuua

SEQ ID NO: 2126058 - RNA, 18 nt, Human
gauguauccaugggggca

SEQ ID NO: 2126059 - RNA, 19 nt, Human
gauguaggguaaggugccu

SEQ ID NO: 2126060 - RNA, 20 nt, Human
gauguaggguaaggugccuu

SEQ ID NO: 2126061 - RNA, 21 nt, Human
gauguaggguaaggugccuuc

SEQ ID NO: 2126062 - RNA, 20 nt, Human
gauuauagauuggagccacc

SEQ ID NO: 2126063 - RNA, 17 nt, Human
gauuauauugagacaaa

SEQ ID NO: 2126064 - RNA, 18 nt, Human
gauuauauugagacaaaa

SEQ ID NO: 2126065 - RNA, 19 nt, Human
gauuauauugagacaaaaa

SEQ ID NO: 2126066 - RNA, 18 nt, Human
gauucuccugccucagcc

SEQ ID NO: 2126067 - RNA, 17 nt, Human
gauucuccugccucagc

SEQ ID NO: 2126068 - RNA, 15 nt, Human
gauucuccugccuca

SEQ ID NO: 2126069 - RNA, 17 nt, Human
gauucuuccucccuccc

SEQ ID NO: 2126070 - RNA, 18 nt, Human
gauucuuccucccucccu

SEQ ID NO: 2126071 - RNA, 16 nt, Human
gauucuucaaaagcau

SEQ ID NO: 2126072 - RNA, 22 nt, Human
gauucugggaggaagcagguug

SEQ ID NO: 2126073 - RNA, 15 nt, Human
gauucugggaggaag

SEQ ID NO: 2126074 - RNA, 20 nt, Human
gauuuuuuacagcugccugc

SEQ ID NO: 2126075 - RNA, 15 nt, Human
gauuuaucacacaaa

SEQ ID NO: 2126076 - RNA, 17 nt, Human
gauuuaucacacaaagc

SEQ ID NO: 2126077 - RNA, 20 nt, Human
gauuuaucacacaaagcaga

SEQ ID NO: 2126078 - RNA, 17 nt, Human
gauuuauguuguauaga

SEQ ID NO: 2126079 - RNA, 19 nt, Human
gauuuaucacacaaagcag

SEQ ID NO: 2126080 - RNA, 22 nt, Human
gauuuagugaaagcuagagaua

SEQ ID NO: 2126081 - RNA, 20 nt, Human
gauuuacccagaaugucaga

SEQ ID NO: 2126082 - RNA, 21 nt, Human
gauuuacccagaaugucagau

SEQ ID NO: 2126083 - RNA, 22 nt, Human
gauuuacccagaaugucagauu

SEQ ID NO: 2126084 - RNA, 14 nt, Human
gaugaggggaggaa

SEQ ID NO: 2126085 - RNA, 14 nt, Human
gaugaggugcuggg

SEQ ID NO: 2126086 - RNA, 16 nt, Human
gaugaggugcugggag

SEQ ID NO: 2126087 - RNA, 17 nt, Human
gaugaggugcugggagg

SEQ ID NO: 2126088 - RNA, 19 nt, Human
gaugaggugcugggaggga

SEQ ID NO: 2126089 - RNA, 17 nt, Human
gaugaguguaacaagaa

SEQ ID NO: 2126090 - RNA, 18 nt, Human
gaugaguguaacaagaaa

SEQ ID NO: 2126091 - RNA, 20 nt, Human
gaugaguguaacaagaaagg

SEQ ID NO: 2126092 - RNA, 21 nt, Human
gaugaguguaacaagaaagga

SEQ ID NO: 2126093 - RNA, 19 nt, Human
gaugauaaugaugaugacg

SEQ ID NO: 2126094 - RNA, 18 nt, Human
gauguaaaagacuuuuuu

SEQ ID NO: 2126095 - RNA, 16 nt, Human
gauguaaacagugccu

SEQ ID NO: 2126096 - RNA, 16 nt, Human
gauggagcgcaccugc

SEQ ID NO: 2126097 - RNA, 22 nt, Human
gauggagcgcaccugcccccug

SEQ ID NO: 2126098 - RNA, 19 nt, Human
gauguaaacagugccugcu

SEQ ID NO: 2126099 - RNA, 20 nt, Human
gauguaaacagugccugcug

SEQ ID NO: 2126100 - RNA, 21 nt, Human
gauguaaacagugccugcuga

SEQ ID NO: 2126101 - RNA, 16 nt, Human
gaugcuggaugcuccu

SEQ ID NO: 2126102 - RNA, 18 nt, Human
gaugcuggaugcuccuuc

SEQ ID NO: 2126103 - RNA, 14 nt, Human
gaugcuggaugcuc

SEQ ID NO: 2126104 - RNA, 14 nt, Human
gauggagagagggg

SEQ ID NO: 2126105 - RNA, 15 nt, Human
gauggagagagggga

SEQ ID NO: 2126106 - RNA, 16 nt, Human
gauggagagaggggaa

SEQ ID NO: 2126107 - RNA, 22 nt, Human
gauggagacuccaugagaagcc

SEQ ID NO: 2126108 - RNA, 12 nt, Human
gaugcugccuga

SEQ ID NO: 2126109 - RNA, 23 nt, Human
gaugcugccagggcgccaucgcc

SEQ ID NO: 2126110 - RNA, 14 nt, Human
gaugcugccugagu

SEQ ID NO: 2126111 - RNA, 16 nt, Human
gaugcugccugaguca

SEQ ID NO: 2126112 - RNA, 19 nt, Human
cuuaccucggugccuuccu

SEQ ID NO: 2126113 - RNA, 21 nt, Human
cuuaccucggugccuuccucu

SEQ ID NO: 2126114 - RNA, 17 nt, Human
cuuaccuccugcccagg

SEQ ID NO: 2126115 - RNA, 18 nt, Human
cuuaccuccugcccagga

SEQ ID NO: 2126116 - RNA, 19 nt, Human
cuuaccuccugcccaggag

SEQ ID NO: 2126117 - RNA, 20 nt, Human
cuuaccuccugcccaggaga

SEQ ID NO: 2126118 - RNA, 15 nt, Human
cuuaccucuuccgga

SEQ ID NO: 2126119 - RNA, 13 nt, Human
cuuaccucuuccg

SEQ ID NO: 2126120 - RNA, 16 nt, Human
cuuagcagcuaucucu

SEQ ID NO: 2126121 - RNA, 18 nt, Human
cuuacacaucuuccacag

SEQ ID NO: 2126122 - RNA, 12 nt, Human
cuuagcaacagc

SEQ ID NO: 2126123 - RNA, 20 nt, Human
cuuaccgugggcacugaagg

SEQ ID NO: 2126124 - RNA, 20 nt, Human
cuuaccccuuagccucccug

SEQ ID NO: 2126125 - RNA, 13 nt, Human
cuuacccuucugu

SEQ ID NO: 2126126 - RNA, 17 nt, Human
cuuacccuucugugccc

SEQ ID NO: 2126127 - RNA, 18 nt, Human
cuuacccuucugugccca

SEQ ID NO: 2126128 - RNA, 20 nt, Human
cuuacccuucugugcccagc

SEQ ID NO: 2126129 - RNA, 21 nt, Human
cuuacccuucugugcccagcu

SEQ ID NO: 2126130 - RNA, 23 nt, Human
cuuacccuucugugcccagcuca

SEQ ID NO: 2126131 - RNA, 13 nt, Human
cuuaccucggugc

SEQ ID NO: 2126132 - RNA, 14 nt, Human
cuuaccucccaccu

SEQ ID NO: 2126133 - RNA, 18 nt, Human
cuuaccucccaccuuugg

SEQ ID NO: 2126134 - RNA, 13 nt, Human
cuuaccuccugcc

SEQ ID NO: 2126135 - RNA, 14 nt, Human
cuuaccuccugccc

SEQ ID NO: 2126136 - RNA, 15 nt, Human
cuuaccuccugccca

SEQ ID NO: 2126137 - RNA, 16 nt, Human
cuuaccuccugcccag

SEQ ID NO: 2126138 - RNA, 21 nt, Human
cuuacagauaggccuucuugu

SEQ ID NO: 2126139 - RNA, 22 nt, Human
cuuacagauaggccuucuugug

SEQ ID NO: 2126140 - RNA, 23 nt, Human
cuuacagauaggccuucuuguga

SEQ ID NO: 2126141 - RNA, 16 nt, Human
cuuacagcauaaggga

SEQ ID NO: 2126142 - RNA, 23 nt, Human
cuuacagcauaagggagcguaga

SEQ ID NO: 2126143 - RNA, 14 nt, Human
cuuaaacaaaugua

SEQ ID NO: 2126144 - RNA, 23 nt, Human
cuuaaaggcugugguaguacucc

SEQ ID NO: 2126145 - RNA, 18 nt, Human
cuuaaagcugccuguagu

SEQ ID NO: 2126146 - RNA, 23 nt, Human
cuuaaagcugccuguaguuagga

SEQ ID NO: 2126147 - RNA, 21 nt, Human
cuuaaaggcugugguaguacu

SEQ ID NO: 2126148 - RNA, 20 nt, Human
cuuacaccucguuagggaag

SEQ ID NO: 2126149 - RNA, 23 nt, Human
cuuacaccucguuagggaagaga

SEQ ID NO: 2126150 - RNA, 20 nt, Human
cuuacacccacaguggaaag

SEQ ID NO: 2126151 - RNA, 11 nt, Human
cuuacacccac

SEQ ID NO: 2126152 - RNA, 13 nt, Human
cuuacacacaaaa

SEQ ID NO: 2126153 - RNA, 20 nt, Human
cuuaaaauauuccugcauuu

SEQ ID NO: 2126154 - RNA, 18 nt, Human
cuuaaaauauuccugcau

SEQ ID NO: 2126155 - RNA, 14 nt, Human
cuuaaaauauuuua

SEQ ID NO: 2126156 - RNA, 17 nt, Human
cuuaaaauauauuucag

SEQ ID NO: 2126157 - RNA, 13 nt, Human
cuuaaaauauuuu

SEQ ID NO: 2126158 - RNA, 12 nt, Human
cuguugcuuuuu

SEQ ID NO: 2126159 - RNA, 14 nt, Human
cuguucagcuccag

SEQ ID NO: 2126160 - RNA, 12 nt, Human
cuguucagcauu

SEQ ID NO: 2126161 - RNA, 13 nt, Human
cuguucagcauuc

SEQ ID NO: 2126162 - RNA, 14 nt, Human
cuguucagcauucu

SEQ ID NO: 2126163 - RNA, 17 nt, Human
cuguucagcauucuuag

SEQ ID NO: 2126164 - RNA, 13 nt, Human
cuguucagcucca

SEQ ID NO: 2126165 - RNA, 19 nt, Human
cugugucuugcaauggcag

SEQ ID NO: 2126166 - RNA, 16 nt, Human
cugugucuugcaaugg

SEQ ID NO: 2126167 - RNA, 15 nt, Human
cuguucacucuacuu

SEQ ID NO: 2126168 - RNA, 20 nt, Human
cugugucuugcaauggcagc

SEQ ID NO: 2126169 - RNA, 14 nt, Human
cugugaccagcacu

SEQ ID NO: 2126170 - RNA, 18 nt, Human
cugugaccaggaaggaag

SEQ ID NO: 2126171 - RNA, 23 nt, Human
cugugaccaggaaggaagucagc

SEQ ID NO: 2126172 - RNA, 16 nt, Human
cugugcgugaaacaca

SEQ ID NO: 2126173 - RNA, 15 nt, Human
cugugagacccccac

SEQ ID NO: 2126174 - RNA, 14 nt, Human
cugugcgugaaaca

SEQ ID NO: 2126175 - RNA, 17 nt, Human
cugugcguuacuaauug

SEQ ID NO: 2126176 - RNA, 13 nt, Human
cugugcuaugaau

SEQ ID NO: 2126177 - RNA, 15 nt, Human
cugugcuaugaauuu

SEQ ID NO: 2126178 - RNA, 16 nt, Human
cugugcuaugaauuuu

SEQ ID NO: 2126179 - RNA, 22 nt, Human
cugugacuucagcucuguuuua

SEQ ID NO: 2126180 - RNA, 21 nt, Human
cugugacugauguuaggcugg

SEQ ID NO: 2126181 - RNA, 22 nt, Human
cugugacugauguuaggcuggg

SEQ ID NO: 2126182 - RNA, 13 nt, Human
cugugagaaaacg

SEQ ID NO: 2126183 - RNA, 14 nt, Human
cugugagaccccca

SEQ ID NO: 2126184 - RNA, 17 nt, Human
cugugacuucagcucug

SEQ ID NO: 2126185 - RNA, 16 nt, Human
cugugaccugugggga

SEQ ID NO: 2126186 - RNA, 13 nt, Human
cugugaccugugg

SEQ ID NO: 2126187 - RNA, 14 nt, Human
cugugaccuguggg

SEQ ID NO: 2126188 - RNA, 15 nt, Human
cugugaccugugggg

SEQ ID NO: 2126189 - RNA, 20 nt, Human
cugugaccagcacugucuca

SEQ ID NO: 2126190 - RNA, 14 nt, Human
cugugaccauuuau

SEQ ID NO: 2126191 - RNA, 17 nt, Human
cugugaccauuuauaau

SEQ ID NO: 2126192 - RNA, 19 nt, Human
cugugaccauuuauaaugu

SEQ ID NO: 2126193 - RNA, 20 nt, Human
cugugcugcccgucuucagc

SEQ ID NO: 2126194 - RNA, 22 nt, Human
cugugcugcccgucuucagccu

SEQ ID NO: 2126195 - RNA, 21 nt, Human
cuguguacagaauucugcuac

SEQ ID NO: 2126196 - RNA, 19 nt, Human
cuguguaaucauuucuugg

SEQ ID NO: 2126197 - RNA, 16 nt, Human
cuguguaacugcccaa

SEQ ID NO: 2126198 - RNA, 11 nt, Human
cuguguaacug

SEQ ID NO: 2126199 - RNA, 13 nt, Human
cuguguaacugcc

SEQ ID NO: 2126200 - RNA, 15 nt, Human
cuguguaacugccca

SEQ ID NO: 2126201 - RNA, 14 nt, Human
cugugucuugcaau

SEQ ID NO: 2126202 - RNA, 17 nt, Human
cugugucucuuuucucu

SEQ ID NO: 2126203 - RNA, 19 nt, Human
cugugucagguggggcagc

SEQ ID NO: 2126204 - RNA, 20 nt, Human
cugugucagcauagaaguaa

SEQ ID NO: 2126205 - RNA, 21 nt, Human
cugugucagguggggcagcuu

SEQ ID NO: 2126206 - RNA, 16 nt, Human
cugugucagccugucc

SEQ ID NO: 2126207 - RNA, 13 nt, Human
cuguguagcuggg

SEQ ID NO: 2126208 - RNA, 21 nt, Human
cuuagcagggaaacagcuaau

SEQ ID NO: 2126209 - RNA, 18 nt, Human
cuuagcagggaaacagcu

SEQ ID NO: 2126210 - RNA, 22 nt, Human
cuuagcagcuaucucucaguga

SEQ ID NO: 2126211 - RNA, 23 nt, Human
cuuagcagcuaucucucagugaa

SEQ ID NO: 2126212 - RNA, 14 nt, Human
cuuauuaaugcuaa

SEQ ID NO: 2126213 - RNA, 15 nt, Human
cuuauuaaugcuaag

SEQ ID NO: 2126214 - RNA, 19 nt, Human
cuuauuaaugcuaagggca

SEQ ID NO: 2126215 - RNA, 13 nt, Human
cuuauugcccacg

SEQ ID NO: 2126216 - RNA, 12 nt, Human
cuuauugcccac

SEQ ID NO: 2126217 - RNA, 15 nt, Human
cuuauguaccucuuu

SEQ ID NO: 2126218 - RNA, 20 nt, Human
cuuccaugucgccucugcau

SEQ ID NO: 2126219 - RNA, 19 nt, Human
cuuccaugucgccucugca

SEQ ID NO: 2126220 - RNA, 18 nt, Human
cuuccaugucgccucugc

SEQ ID NO: 2126221 - RNA, 17 nt, Human
cuuccaugucgccucug

SEQ ID NO: 2126222 - RNA, 16 nt, Human
cuuccaugucgccucu

SEQ ID NO: 2126223 - RNA, 15 nt, Human
cuuccaugucgccuc

SEQ ID NO: 2126224 - RNA, 19 nt, Human
cuucauccuuagcaacagc

SEQ ID NO: 2126225 - RNA, 20 nt, Human
cuucauccuuagcaacagcc

SEQ ID NO: 2126226 - RNA, 14 nt, Human
cuucaugccuuugu

SEQ ID NO: 2126227 - RNA, 15 nt, Human
cuucaugccuuugua

SEQ ID NO: 2126228 - RNA, 16 nt, Human
cuucaugccuuuguaa

SEQ ID NO: 2126229 - RNA, 17 nt, Human
cuucaugccuuuguaag

SEQ ID NO: 2126230 - RNA, 19 nt, Human
cuucaugccuuuguaaguu

SEQ ID NO: 2126231 - RNA, 13 nt, Human
cuucagugggaga

SEQ ID NO: 2126232 - RNA, 15 nt, Human
cuucagugggagaaa

SEQ ID NO: 2126233 - RNA, 18 nt, Human
cuucaguggcagcugcuu

SEQ ID NO: 2126234 - RNA, 19 nt, Human
cuucauccggcagccugga

SEQ ID NO: 2126235 - RNA, 19 nt, Human
cuucaucccacuccaacuc

SEQ ID NO: 2126236 - RNA, 18 nt, Human
cuucagugggagaaaaca

SEQ ID NO: 2126237 - RNA, 18 nt, Human
cuuauugcccacgcugga

SEQ ID NO: 2126238 - RNA, 16 nt, Human
cuuauuaaugcuaagg

SEQ ID NO: 2126239 - RNA, 16 nt, Human
cuucagacugcaagug

SEQ ID NO: 2126240 - RNA, 15 nt, Human
cuucacuucugacca

SEQ ID NO: 2126241 - RNA, 16 nt, Human
cuucacuucugaccac

SEQ ID NO: 2126242 - RNA, 17 nt, Human
cuucacuucugaccaca

SEQ ID NO: 2126243 - RNA, 19 nt, Human
cuucacuucugaccacacu

SEQ ID NO: 2126244 - RNA, 21 nt, Human
cuucacuucugaccacacuuc

SEQ ID NO: 2126245 - RNA, 17 nt, Human
cuucagaagacacugca

SEQ ID NO: 2126246 - RNA, 13 nt, Human
cuucugacugcug

SEQ ID NO: 2126247 - RNA, 21 nt, Human
cuucugacugcugauucuccc

SEQ ID NO: 2126248 - RNA, 14 nt, Human
cuucugaccucagc

SEQ ID NO: 2126249 - RNA, 15 nt, Human
cuucugaccucagca

SEQ ID NO: 2126250 - RNA, 13 nt, Human
cuucuuaaagagu

SEQ ID NO: 2126251 - RNA, 18 nt, Human
cuuggccaguuaucccuu

SEQ ID NO: 2126252 - RNA, 22 nt, Human
cuuggccagaagggggccauga

SEQ ID NO: 2126253 - RNA, 17 nt, Human
cuuggcaugccuuccag

SEQ ID NO: 2126254 - RNA, 20 nt, Human
cuuggcaugccuuccagcac

SEQ ID NO: 2126255 - RNA, 17 nt, Human
cuuggccagaagggggc

SEQ ID NO: 2126256 - RNA, 20 nt, Human
cuuggcaucacagggcagag

SEQ ID NO: 2126257 - RNA, 22 nt, Human
cuuggcaucacagggcagagcc

SEQ ID NO: 2126258 - RNA, 16 nt, Human
cuuggcaugccuucca

SEQ ID NO: 2126259 - RNA, 12 nt, Human
cuugacagggca

SEQ ID NO: 2126260 - RNA, 14 nt, Human
cuugccuagggccu

SEQ ID NO: 2126261 - RNA, 14 nt, Human
cuugacagaacacu

SEQ ID NO: 2126262 - RNA, 16 nt, Human
cuugacagaacacugu

SEQ ID NO: 2126263 - RNA, 17 nt, Human
cuugacagaacacuguc

SEQ ID NO: 2126264 - RNA, 22 nt, Human
cuugacaaguugcgacggagag

SEQ ID NO: 2126265 - RNA, 17 nt, Human
cuugacaauagaacauu

SEQ ID NO: 2126266 - RNA, 12 nt, Human
cuugcucugcug

SEQ ID NO: 2126267 - RNA, 20 nt, Human
cuugcucuccccugcccugc

SEQ ID NO: 2126268 - RNA, 20 nt, Human
cuugcucgcuguaaaaucuu

SEQ ID NO: 2126269 - RNA, 14 nt, Human
cuugcucuaucuca

SEQ ID NO: 2126270 - RNA, 16 nt, Human
cuugcucuaucucaca

SEQ ID NO: 2126271 - RNA, 18 nt, Human
cuugcucuaucucacagc

SEQ ID NO: 2126272 - RNA, 19 nt, Human
cuugcucuaucucacagca

SEQ ID NO: 2126273 - RNA, 20 nt, Human
cuugcucuaucucacagcac

SEQ ID NO: 2126274 - RNA, 22 nt, Human
cuugcucuaucucacagcacac

SEQ ID NO: 2126275 - RNA, 23 nt, Human
cuugcucuaucucacagcacacu

SEQ ID NO: 2126276 - RNA, 19 nt, Human
cuugcucuccccugcccug

SEQ ID NO: 2126277 - RNA, 16 nt, Human
cuugccuagggccugg

SEQ ID NO: 2126278 - RNA, 18 nt, Human
cuugccuagggccugguc

SEQ ID NO: 2126279 - RNA, 19 nt, Human
cuugccuagggccuggucc

SEQ ID NO: 2126280 - RNA, 20 nt, Human
cuugccuagggccuggucca

SEQ ID NO: 2126281 - RNA, 19 nt, Human
cuuucagauacaugguugu

SEQ ID NO: 2126282 - RNA, 14 nt, Human
cuuucagagccucc

SEQ ID NO: 2126283 - RNA, 22 nt, Human
cuugugacuagugcugaagcuu

SEQ ID NO: 2126284 - RNA, 20 nt, Human
cuugugacuagugcugaagc

SEQ ID NO: 2126285 - RNA, 15 nt, Human
cuugugaucugggaa

SEQ ID NO: 2126286 - RNA, 16 nt, Human
cuugugaucugggaac

SEQ ID NO: 2126287 - RNA, 13 nt, Human
cuuguggacacag

SEQ ID NO: 2126288 - RNA, 15 nt, Human
cuuguggacacagcu

SEQ ID NO: 2126289 - RNA, 14 nt, Human
cuuguggacacagc

SEQ ID NO: 2126290 - RNA, 16 nt, Human
cuuguggacacagcuc

SEQ ID NO: 2126291 - RNA, 19 nt, Human
cuuuaacucaggacuccag

SEQ ID NO: 2126292 - RNA, 20 nt, Human
cuuuaacucaggacuccagc

SEQ ID NO: 2126293 - RNA, 21 nt, Human
cuuuaacucaggacuccagcc

SEQ ID NO: 2126294 - RNA, 17 nt, Human
cuuuaaccagucugaag

SEQ ID NO: 2126295 - RNA, 18 nt, Human
cuuuaaccagucugaagu

SEQ ID NO: 2126296 - RNA, 13 nt, Human
cuuucagaaaaca

SEQ ID NO: 2126297 - RNA, 14 nt, Human
cuuucagaaaacag

SEQ ID NO: 2126298 - RNA, 18 nt, Human
cuuucagaaaacagaaaa

SEQ ID NO: 2126299 - RNA, 23 nt, Human
cuuucagaaaacagaaaaaaaac

SEQ ID NO: 2126300 - RNA, 13 nt, Human
cuuucagagccuc

SEQ ID NO: 2126301 - RNA, 12 nt, Human
cuuucagagccu

SEQ ID NO: 2126302 - RNA, 11 nt, Human
cuuucagagcc

SEQ ID NO: 2126303 - RNA, 12 nt, Human
cuuuacaaaaag

SEQ ID NO: 2126304 - RNA, 13 nt, Human
cuuuacaaaaaga

SEQ ID NO: 2126305 - RNA, 22 nt, Human
cuuuaaucuucaguuuuaucuu

SEQ ID NO: 2126306 - RNA, 17 nt, Human
cuuuaaucuucaguuuu

SEQ ID NO: 2126307 - RNA, 21 nt, Human
cuuuaaucuucaguuuuaucu

SEQ ID NO: 2126308 - RNA, 14 nt, Human
cuuuaaucuucagu

SEQ ID NO: 2126309 - RNA, 14 nt, Human
cuuuaauauguauu

SEQ ID NO: 2126310 - RNA, 15 nt, Human
cuuuaauauguauuu

SEQ ID NO: 2126311 - RNA, 21 nt, Human
cuuuaauauguauuuuaugua

SEQ ID NO: 2126312 - RNA, 12 nt, Human
cuuuaauauaaa

SEQ ID NO: 2126313 - RNA, 20 nt, Human
cuuuaagugccuacauuauc

SEQ ID NO: 2126314 - RNA, 13 nt, Human
cuuuccuuuuucc

SEQ ID NO: 2126315 - RNA, 21 nt, Human
cuuuccuuuuucccaauaaau

SEQ ID NO: 2126316 - RNA, 22 nt, Human
cuuucggggagaggcugaggac

SEQ ID NO: 2126317 - RNA, 14 nt, Human
cuuucuagcuguug

SEQ ID NO: 2126318 - RNA, 23 nt, Human
cuuucuagcuguugagcuguuuu

SEQ ID NO: 2126319 - RNA, 21 nt, Human
cuuucuccuuagucuucucau

SEQ ID NO: 2126320 - RNA, 23 nt, Human
cuuucuccuuagucuucucauag

SEQ ID NO: 2126321 - RNA, 15 nt, Human
cuuucuccuuagucu

SEQ ID NO: 2126322 - RNA, 20 nt, Human
cuuucuccuuagucuucuca

SEQ ID NO: 2126323 - RNA, 21 nt, Human
cuuucucccaggccaggcucc

SEQ ID NO: 2126324 - RNA, 19 nt, Human
cuuucucccaggccaggcu

SEQ ID NO: 2126325 - RNA, 20 nt, Human
cuuucucccaggccaggcuc

SEQ ID NO: 2126326 - RNA, 16 nt, Human
cuuugagcuuaagaau

SEQ ID NO: 2126327 - RNA, 15 nt, Human
cuuugauuccaucuc

SEQ ID NO: 2126328 - RNA, 16 nt, Human
cuuugauuccaucucc

SEQ ID NO: 2126329 - RNA, 13 nt, Human
cuuugagugaucc

SEQ ID NO: 2126330 - RNA, 16 nt, Human
cuuugaguuuccucag

SEQ ID NO: 2126331 - RNA, 17 nt, Human
cuuugaguuuccucagg

SEQ ID NO: 2126332 - RNA, 18 nt, Human
cuuugaguuuccucaggc

SEQ ID NO: 2126333 - RNA, 19 nt, Human
cuuugaguuuccucaggcu

SEQ ID NO: 2126334 - RNA, 22 nt, Human
cuuugaguuuccucaggcugcu

SEQ ID NO: 2126335 - RNA, 23 nt, Human
cuuugguccuaagucccugcccc

SEQ ID NO: 2126336 - RNA, 15 nt, Human
cuuuucaaaacauuu

SEQ ID NO: 2126337 - RNA, 15 nt, Human
cuuuggugaacauug

SEQ ID NO: 2126338 - RNA, 17 nt, Human
cuuuggucucuugcuug

SEQ ID NO: 2126339 - RNA, 13 nt, Human
cuuuggugccuuu

SEQ ID NO: 2126340 - RNA, 14 nt, Human
cuuuggugccuuuc

SEQ ID NO: 2126341 - RNA, 15 nt, Human
cuuuggugccuuucc

SEQ ID NO: 2126342 - RNA, 16 nt, Human
cuuuggugccuuuccu

SEQ ID NO: 2126343 - RNA, 18 nt, Human
cuuuggugccuuuccugu

SEQ ID NO: 2126344 - RNA, 19 nt, Human
cuuuggugccuuuccuguu

SEQ ID NO: 2126345 - RNA, 20 nt, Human
cuuuggugccuuuccuguuc

SEQ ID NO: 2126346 - RNA, 21 nt, Human
cuuuggugcgggcacaauaaa

SEQ ID NO: 2126347 - RNA, 17 nt, Human
cuuugguggagauaaag

SEQ ID NO: 2126348 - RNA, 20 nt, Human
cuuugguguacaaaauggaa

SEQ ID NO: 2126349 - RNA, 14 nt, Human
cuuugguccuucaa

SEQ ID NO: 2126350 - RNA, 15 nt, Human
cuuuggucucuugcu

SEQ ID NO: 2126351 - RNA, 16 nt, Human
cuuuggucucuugcuu

SEQ ID NO: 2126352 - RNA, 22 nt, Human
cuuugguacauggccaguguga

SEQ ID NO: 2126353 - RNA, 20 nt, Human
cuuuggggcuuuuacaccag

SEQ ID NO: 2126354 - RNA, 21 nt, Human
cuuuggggcuuuuacaccagu

SEQ ID NO: 2126355 - RNA, 18 nt, Human
cuuuuaggccaaaaaaau

SEQ ID NO: 2126356 - RNA, 17 nt, Human
cuuuuaggacccuuccc

SEQ ID NO: 2126357 - RNA, 16 nt, Human
cuuuuaggccaaaaaa

SEQ ID NO: 2126358 - RNA, 13 nt, Human
cuuuuagccuagu

SEQ ID NO: 2126359 - RNA, 17 nt, Human
cuuuuauuucuuaaaca

SEQ ID NO: 2126360 - RNA, 15 nt, Human
cuuuuaguacccacc

SEQ ID NO: 2126361 - RNA, 16 nt, Human
cuuuuaguacccaccu

SEQ ID NO: 2126362 - RNA, 17 nt, Human
cuuuuaguacccaccug

SEQ ID NO: 2126363 - RNA, 16 nt, Human
cuggaugcuccuucca

SEQ ID NO: 2126364 - RNA, 20 nt, Human
cuggaugaaguuaucuggcu

SEQ ID NO: 2126365 - RNA, 23 nt, Human
cuggaugaaguuaucuggcuuca

SEQ ID NO: 2126366 - RNA, 12 nt, Human
cugcuuagcuug

SEQ ID NO: 2126367 - RNA, 19 nt, Human
cugcuuagcuugcaccuug

SEQ ID NO: 2126368 - RNA, 14 nt, Human
cugcuuaaugaaaa

SEQ ID NO: 2126369 - RNA, 20 nt, Human
cugcuuauccguuagccgug

SEQ ID NO: 2126370 - RNA, 23 nt, Human
cugcuuaucaauaaaccuguuug

SEQ ID NO: 2126371 - RNA, 13 nt, Human
cuggacuugagcu

SEQ ID NO: 2126372 - RNA, 15 nt, Human
cuggacuugagcuug

SEQ ID NO: 2126373 - RNA, 14 nt, Human
cuggagaagcagug

SEQ ID NO: 2126374 - RNA, 20 nt, Human
cuggaucugggacccuuucc

SEQ ID NO: 2126375 - RNA, 21 nt, Human
cuggaucugggacccuuuccu

SEQ ID NO: 2126376 - RNA, 21 nt, Human
cuggagaagcagugagccgca

SEQ ID NO: 2126377 - RNA, 22 nt, Human
cuggagaagucuuagacuugaa

SEQ ID NO: 2126378 - RNA, 13 nt, Human
cuggagaauaauu

SEQ ID NO: 2126379 - RNA, 17 nt, Human
cuggagaauaauucuuu

SEQ ID NO: 2126380 - RNA, 19 nt, Human
cuggagaauaauucuuuga

SEQ ID NO: 2126381 - RNA, 20 nt, Human
cuggagacaaugcagaugcc

SEQ ID NO: 2126382 - RNA, 21 nt, Human
cuggagacaaugcagaugcca

SEQ ID NO: 2126383 - RNA, 22 nt, Human
cugcugugaacaagugaacaca

SEQ ID NO: 2126384 - RNA, 14 nt, Human
cugcucacauaucu

SEQ ID NO: 2126385 - RNA, 19 nt, Human
cugcucacauaucugucau

SEQ ID NO: 2126386 - RNA, 16 nt, Human
cugcucacauaucugu

SEQ ID NO: 2126387 - RNA, 12 nt, Human
cugcugacagug

SEQ ID NO: 2126388 - RNA, 15 nt, Human
cugcugacaguguug

SEQ ID NO: 2126389 - RNA, 13 nt, Human
cugcugacagugu

SEQ ID NO: 2126390 - RNA, 14 nt, Human
cugcugaugcucau

SEQ ID NO: 2126391 - RNA, 15 nt, Human
cugcugaugcucaug

SEQ ID NO: 2126392 - RNA, 16 nt, Human
cugcugaugcucaugg

SEQ ID NO: 2126393 - RNA, 17 nt, Human
cugcugaugcucauggu

SEQ ID NO: 2126394 - RNA, 18 nt, Human
cugcugauguggcaacug

SEQ ID NO: 2126395 - RNA, 14 nt, Human
cuggcccugccuuc

SEQ ID NO: 2126396 - RNA, 12 nt, Human
cuggcccuuccu

SEQ ID NO: 2126397 - RNA, 13 nt, Human
cuggcccuggggc

SEQ ID NO: 2126398 - RNA, 14 nt, Human
cuggcccuggggcc

SEQ ID NO: 2126399 - RNA, 15 nt, Human
cuggcccuggggccu

SEQ ID NO: 2126400 - RNA, 16 nt, Human
cuggcccuggggccug

SEQ ID NO: 2126401 - RNA, 17 nt, Human
cuggcccuggggccugu

SEQ ID NO: 2126402 - RNA, 19 nt, Human
cuggcccuggggccuguac

SEQ ID NO: 2126403 - RNA, 17 nt, Human
cuggccgaggguccugg

SEQ ID NO: 2126404 - RNA, 21 nt, Human
cuggccgaggguccuggcucc

SEQ ID NO: 2126405 - RNA, 19 nt, Human
cuggccgaggguccuggcu

SEQ ID NO: 2126406 - RNA, 20 nt, Human
cuggccgaggguccuggcuc

SEQ ID NO: 2126407 - RNA, 11 nt, Human
cuggcccuggg

SEQ ID NO: 2126408 - RNA, 22 nt, Human
cuggcuagaguccucacuccca

SEQ ID NO: 2126409 - RNA, 20 nt, Human
cuggcuagaguccucacucc

SEQ ID NO: 2126410 - RNA, 21 nt, Human
cuggcuagaguccucacuccc

SEQ ID NO: 2126411 - RNA, 16 nt, Human
cuggcuagaguccuca

SEQ ID NO: 2126412 - RNA, 17 nt, Human
cuggcuagaguccucac

SEQ ID NO: 2126413 - RNA, 18 nt, Human
cuggcuagaguccucacu

SEQ ID NO: 2126414 - RNA, 19 nt, Human
cuggcuagaguccucacuc

SEQ ID NO: 2126415 - RNA, 12 nt, Human
cuggcucacaga

SEQ ID NO: 2126416 - RNA, 16 nt, Human
cuggcucacagacugg

SEQ ID NO: 2126417 - RNA, 18 nt, Human
cuggcucacagacuggag

SEQ ID NO: 2126418 - RNA, 19 nt, Human
cuggcucacagacuggaga

SEQ ID NO: 2126419 - RNA, 16 nt, Human
cugggacuacaggcac

SEQ ID NO: 2126420 - RNA, 15 nt, Human
cugggacuacaggca

SEQ ID NO: 2126421 - RNA, 13 nt, Human
cugggacuacagg

SEQ ID NO: 2126422 - RNA, 22 nt, Human
cugggaccacagguucaugcca

SEQ ID NO: 2126423 - RNA, 16 nt, Human
cuggcuccgcugugug

SEQ ID NO: 2126424 - RNA, 17 nt, Human
cuggcuccgcugugugg

SEQ ID NO: 2126425 - RNA, 14 nt, Human
cuggcuccugaggg

SEQ ID NO: 2126426 - RNA, 15 nt, Human
cuggcuccugagggg

SEQ ID NO: 2126427 - RNA, 16 nt, Human
cuggcuccugaggggc

SEQ ID NO: 2126428 - RNA, 17 nt, Human
cuggcuccugaggggca

SEQ ID NO: 2126429 - RNA, 17 nt, Human
cugggcagcauagcaag

SEQ ID NO: 2126430 - RNA, 18 nt, Human
cugggcagcauagcaaga

SEQ ID NO: 2126431 - RNA, 17 nt, Human
cugggcagccaggcugc

SEQ ID NO: 2126432 - RNA, 15 nt, Human
cugggcagccaggcu

SEQ ID NO: 2126433 - RNA, 16 nt, Human
cugggcagccaggcug

SEQ ID NO: 2126434 - RNA, 18 nt, Human
cugggcagccaggcugcc

SEQ ID NO: 2126435 - RNA, 20 nt, Human
cugggcagguuggugggggc

SEQ ID NO: 2126436 - RNA, 21 nt, Human
cugggcagcuguuagagucca

SEQ ID NO: 2126437 - RNA, 12 nt, Human
cugggcauugcu

SEQ ID NO: 2126438 - RNA, 13 nt, Human
cugggcauugcuu

SEQ ID NO: 2126439 - RNA, 12 nt, Human
cugggcccagag

SEQ ID NO: 2126440 - RNA, 14 nt, Human
cugggcccagaggc

SEQ ID NO: 2126441 - RNA, 15 nt, Human
cugggcccagaggca

SEQ ID NO: 2126442 - RNA, 18 nt, Human
cugggcccagaggcacag

SEQ ID NO: 2126443 - RNA, 19 nt, Human
cugggcccagaggcacagc

SEQ ID NO: 2126444 - RNA, 20 nt, Human
cugggcccagaggcacagcc

SEQ ID NO: 2126445 - RNA, 21 nt, Human
cugggcccagaggcacagccg

SEQ ID NO: 2126446 - RNA, 14 nt, Human
cugggcccagaagg

SEQ ID NO: 2126447 - RNA, 23 nt, Human
cugggcccagaagguugugauga

SEQ ID NO: 2126448 - RNA, 13 nt, Human
cuggggagaaagu

SEQ ID NO: 2126449 - RNA, 23 nt, Human
cuggggccucggagccucauccg

SEQ ID NO: 2126450 - RNA, 12 nt, Human
cuggggccucuu

SEQ ID NO: 2126451 - RNA, 18 nt, Human
cuggguggcaccagcagc

SEQ ID NO: 2126452 - RNA, 20 nt, Human
cuggguggcaccagcagccu

SEQ ID NO: 2126453 - RNA, 14 nt, Human
cugggugcucccua

SEQ ID NO: 2126454 - RNA, 15 nt, Human
cugggugcucccuac

SEQ ID NO: 2126455 - RNA, 15 nt, Human
cugggugcagcugag

SEQ ID NO: 2126456 - RNA, 12 nt, Human
cugggugcccac

SEQ ID NO: 2126457 - RNA, 13 nt, Human
cugggugcccaca

SEQ ID NO: 2126458 - RNA, 14 nt, Human
cugggugcccacag

SEQ ID NO: 2126459 - RNA, 15 nt, Human
cugggugcccacagc

SEQ ID NO: 2126460 - RNA, 16 nt, Human
cugggugcccacagcc

SEQ ID NO: 2126461 - RNA, 19 nt, Human
cugggugcccacagcccgc

SEQ ID NO: 2126462 - RNA, 23 nt, Human
cugggugcccacagcccgcaugc

SEQ ID NO: 2126463 - RNA, 23 nt, Human
cugggugacagagcaagacucug

SEQ ID NO: 2126464 - RNA, 14 nt, Human
cugggugagugggg

SEQ ID NO: 2126465 - RNA, 18 nt, Human
cugggugaguggggagac

SEQ ID NO: 2126466 - RNA, 14 nt, Human
cugggugcagcuga

SEQ ID NO: 2126467 - RNA, 22 nt, Human
cugggugacagagcaagacucu

SEQ ID NO: 2126468 - RNA, 13 nt, Human
cugggugacagag

SEQ ID NO: 2126469 - RNA, 14 nt, Human
cuggugcccggaga

SEQ ID NO: 2126470 - RNA, 19 nt, Human
cuggguguauuaggacugg

SEQ ID NO: 2126471 - RNA, 13 nt, Human
cuggugcagggcc

SEQ ID NO: 2126472 - RNA, 14 nt, Human
cuggugcagggccu

SEQ ID NO: 2126473 - RNA, 17 nt, Human
cuggugcagggccucca

SEQ ID NO: 2126474 - RNA, 20 nt, Human
cuggugcagggccuccauuc

SEQ ID NO: 2126475 - RNA, 12 nt, Human
cuggugcagugg

SEQ ID NO: 2126476 - RNA, 14 nt, Human
cuggugcauuacag

SEQ ID NO: 2126477 - RNA, 15 nt, Human
cuggugcauuacaga

SEQ ID NO: 2126478 - RNA, 16 nt, Human
cuggugcauuacagag

SEQ ID NO: 2126479 - RNA, 17 nt, Human
cuggugcauuacagaga

SEQ ID NO: 2126480 - RNA, 18 nt, Human
cuggugcauuacagagag

SEQ ID NO: 2126481 - RNA, 19 nt, Human
cuggugcauuacagagagg

SEQ ID NO: 2126482 - RNA, 16 nt, Human
cugggugguugcccuu

SEQ ID NO: 2126483 - RNA, 18 nt, Human
cugggugguugcccuuca

SEQ ID NO: 2126484 - RNA, 19 nt, Human
cuggguggucugcaggcag

SEQ ID NO: 2126485 - RNA, 21 nt, Human
cuggguggucugcaggcaggg

SEQ ID NO: 2126486 - RNA, 21 nt, Human
cuggguggcaccagcagccug

SEQ ID NO: 2126487 - RNA, 15 nt, Human
cugggugcuggcugc

SEQ ID NO: 2126488 - RNA, 13 nt, Human
cuggguggucugc

SEQ ID NO: 2126489 - RNA, 17 nt, Human
cugccccucccuucaac

SEQ ID NO: 2126490 - RNA, 14 nt, Human
cugccccucccuuc

SEQ ID NO: 2126491 - RNA, 13 nt, Human
cugccccucccuu

SEQ ID NO: 2126492 - RNA, 22 nt, Human
cugccccgugcagacuggaggg

SEQ ID NO: 2126493 - RNA, 18 nt, Human
cugccccgugcagacugg

SEQ ID NO: 2126494 - RNA, 19 nt, Human
cugccccgugcagacugga

SEQ ID NO: 2126495 - RNA, 23 nt, Human
cugccagugccuuaccuccugcc

SEQ ID NO: 2126496 - RNA, 21 nt, Human
cugccagugccuuaccuccug

SEQ ID NO: 2126497 - RNA, 22 nt, Human
cugccagugccuuaccuccugc

SEQ ID NO: 2126498 - RNA, 12 nt, Human
cugccagugccu

SEQ ID NO: 2126499 - RNA, 13 nt, Human
cugccagugccuu

SEQ ID NO: 2126500 - RNA, 14 nt, Human
cugccagugccuua

SEQ ID NO: 2126501 - RNA, 17 nt, Human
cugccagugccuuaccu

SEQ ID NO: 2126502 - RNA, 18 nt, Human
cugccagugccuuaccuc

SEQ ID NO: 2126503 - RNA, 20 nt, Human
cugccagugccuuaccuccu

SEQ ID NO: 2126504 - RNA, 17 nt, Human
cugccagucccccugcc

SEQ ID NO: 2126505 - RNA, 21 nt, Human
cugccagucccccugccccag

SEQ ID NO: 2126506 - RNA, 20 nt, Human
cugccagucccccugcccca

SEQ ID NO: 2126507 - RNA, 22 nt, Human
cugccagucccccugccccagg

SEQ ID NO: 2126508 - RNA, 12 nt, Human
cugccagggagc

SEQ ID NO: 2126509 - RNA, 13 nt, Human
cugccagggagcu

SEQ ID NO: 2126510 - RNA, 17 nt, Human
cugcccccgcucauggg

SEQ ID NO: 2126511 - RNA, 17 nt, Human
cugcccccuccccuuca

SEQ ID NO: 2126512 - RNA, 23 nt, Human
cugcccccuucucccacacugcu

SEQ ID NO: 2126513 - RNA, 15 nt, Human
cugccccgcccagcu

SEQ ID NO: 2126514 - RNA, 16 nt, Human
cugccccgcccagcug

SEQ ID NO: 2126515 - RNA, 17 nt, Human
cugccccgcccagcugc

SEQ ID NO: 2126516 - RNA, 18 nt, Human
cugccccgucaccaucuc

SEQ ID NO: 2126517 - RNA, 19 nt, Human
cugccccgucaccaucuca

SEQ ID NO: 2126518 - RNA, 21 nt, Human
cugccccgucaccaucucagg

SEQ ID NO: 2126519 - RNA, 23 nt, Human
cugccccgucaccaucucaggcc

SEQ ID NO: 2126520 - RNA, 22 nt, Human
cugccccgucucaugaggggcc

SEQ ID NO: 2126521 - RNA, 15 nt, Human
cugccccgugcagac

SEQ ID NO: 2126522 - RNA, 17 nt, Human
cugccccgugcagacug

SEQ ID NO: 2126523 - RNA, 19 nt, Human
cugccauccagguucagcu

SEQ ID NO: 2126524 - RNA, 18 nt, Human
cugccauccagguucagc

SEQ ID NO: 2126525 - RNA, 16 nt, Human
cugccauccagguuca

SEQ ID NO: 2126526 - RNA, 16 nt, Human
cugccauauucuguug

SEQ ID NO: 2126527 - RNA, 17 nt, Human
cugccauccagggaugc

SEQ ID NO: 2126528 - RNA, 16 nt, Human
cugccccaugaagcca

SEQ ID NO: 2126529 - RNA, 14 nt, Human
cugcccccacaccu

SEQ ID NO: 2126530 - RNA, 17 nt, Human
cugcccccacaccuggc

SEQ ID NO: 2126531 - RNA, 19 nt, Human
cugcccccacaccuggccc

SEQ ID NO: 2126532 - RNA, 20 nt, Human
cugcccccacaccuggcccu

SEQ ID NO: 2126533 - RNA, 13 nt, Human
cugcauuggcuuu

SEQ ID NO: 2126534 - RNA, 22 nt, Human
cugcaggccccgcuuguccagc

SEQ ID NO: 2126535 - RNA, 23 nt, Human
cugcaggccccgcuuguccagcg

SEQ ID NO: 2126536 - RNA, 24 nt, Human
cugcaggccaagagcagaggcagc

SEQ ID NO: 2126537 - RNA, 22 nt, Human
cugcaggccaagagcagaggca

SEQ ID NO: 2126538 - RNA, 23 nt, Human
cugcaggccaagagcagaggcag

SEQ ID NO: 2126539 - RNA, 11 nt, Human
cugcaggcccc

SEQ ID NO: 2126540 - RNA, 14 nt, Human
cugcaggccccgcu

SEQ ID NO: 2126541 - RNA, 20 nt, Human
cugcaggccccgcuugucca

SEQ ID NO: 2126542 - RNA, 11 nt, Human
cugcaggcagg

SEQ ID NO: 2126543 - RNA, 12 nt, Human
cugcaggcaggg

SEQ ID NO: 2126544 - RNA, 15 nt, Human
cugcaggccaagagc

SEQ ID NO: 2126545 - RNA, 19 nt, Human
cugcaggccaagagcagag

SEQ ID NO: 2126546 - RNA, 21 nt, Human
cugcaggccaagagcagaggc

SEQ ID NO: 2126547 - RNA, 12 nt, Human
cugcagcuuugu

SEQ ID NO: 2126548 - RNA, 19 nt, Human
cugcaggaugauuguacag

SEQ ID NO: 2126549 - RNA, 20 nt, Human
cugcaggaugauuguacaga

SEQ ID NO: 2126550 - RNA, 16 nt, Human
cugcaggaguuaaaaa

SEQ ID NO: 2126551 - RNA, 23 nt, Human
cugcacuauagccuaggugacag

SEQ ID NO: 2126552 - RNA, 22 nt, Human
cugcacuauagccuaggugaca

SEQ ID NO: 2126553 - RNA, 13 nt, Human
cugcacuccagcc

SEQ ID NO: 2126554 - RNA, 15 nt, Human
cugcacuccagccug

SEQ ID NO: 2126555 - RNA, 15 nt, Human
cugcaccuuaucuua

SEQ ID NO: 2126556 - RNA, 17 nt, Human
cugcacguggcuucuga

SEQ ID NO: 2126557 - RNA, 19 nt, Human
cugcacguggcuucugaug

SEQ ID NO: 2126558 - RNA, 16 nt, Human
cugcacuaauuugaug

SEQ ID NO: 2126559 - RNA, 20 nt, Human
cugcacuauagccuagguga

SEQ ID NO: 2126560 - RNA, 18 nt, Human
cugcacuauagccuaggu

SEQ ID NO: 2126561 - RNA, 17 nt, Human
cugcacuauagccuagg

SEQ ID NO: 2126562 - RNA, 16 nt, Human
cugcacuauagccuag

SEQ ID NO: 2126563 - RNA, 11 nt, Human
cugcagccucc

SEQ ID NO: 2126564 - RNA, 19 nt, Human
cugcagccucgaacuccug

SEQ ID NO: 2126565 - RNA, 20 nt, Human
cugcagccucgaacuccugg

SEQ ID NO: 2126566 - RNA, 21 nt, Human
cugcagccucgaacuccuggg

SEQ ID NO: 2126567 - RNA, 22 nt, Human
cugcagccucgaacuccugggc

SEQ ID NO: 2126568 - RNA, 23 nt, Human
cugcagccucgaacuccugggcu

SEQ ID NO: 2126569 - RNA, 11 nt, Human
cugcagccugg

SEQ ID NO: 2126570 - RNA, 14 nt, Human
cugcagccuggagg

SEQ ID NO: 2126571 - RNA, 15 nt, Human
cugcagccuggaggc

SEQ ID NO: 2126572 - RNA, 13 nt, Human
cugcagcugggcu

SEQ ID NO: 2126573 - RNA, 14 nt, Human
cugcagcugggcug

SEQ ID NO: 2126574 - RNA, 20 nt, Human
cugcagccuggaggccgggu

SEQ ID NO: 2126575 - RNA, 18 nt, Human
cugcagccuuugccuccc

SEQ ID NO: 2126576 - RNA, 20 nt, Human
cugcagccuuugccuccccg

SEQ ID NO: 2126577 - RNA, 20 nt, Human
cugcagcggccacacuguac

SEQ ID NO: 2126578 - RNA, 23 nt, Human
cugcagccucaaccuccugggcu

SEQ ID NO: 2126579 - RNA, 19 nt, Human
cugcacuccagccugggug

SEQ ID NO: 2126580 - RNA, 24 nt, Human
cugcagccucaaccuccugggcua

SEQ ID NO: 2126581 - RNA, 20 nt, Human
cugcacuccaaucuggguga

SEQ ID NO: 2126582 - RNA, 20 nt, Human
cugcacuccagccugggcga

SEQ ID NO: 2126583 - RNA, 18 nt, Human
cugcacuccagccugggu

SEQ ID NO: 2126584 - RNA, 14 nt, Human
cugcacuccagccu

SEQ ID NO: 2126585 - RNA, 18 nt, Human
cugcacuccagccugggc

SEQ ID NO: 2126586 - RNA, 19 nt, Human
cugcacuccagccugggcg

SEQ ID NO: 2126587 - RNA, 16 nt, Human
cugcacuccagccugg

SEQ ID NO: 2126588 - RNA, 17 nt, Human
cugcacuccagccuggg

SEQ ID NO: 2126589 - RNA, 15 nt, Human
cugcaacuucugccu

SEQ ID NO: 2126590 - RNA, 18 nt, Human
cugcaacuuguaaaugug

SEQ ID NO: 2126591 - RNA, 14 nt, Human
cugcaacuucugcc

SEQ ID NO: 2126592 - RNA, 19 nt, Human
cugcaacuuguaaaugugg

SEQ ID NO: 2126593 - RNA, 18 nt, Human
cugcaagaauugaagcag

SEQ ID NO: 2126594 - RNA, 15 nt, Human
cugcaaccuguugau

SEQ ID NO: 2126595 - RNA, 22 nt, Human
cugcaaccuccgccucuugggu

SEQ ID NO: 2126596 - RNA, 20 nt, Human
cugcaacaggaacugugaga

SEQ ID NO: 2126597 - RNA, 20 nt, Human
cugcaaccuccgccucuugg

SEQ ID NO: 2126598 - RNA, 17 nt, Human
cugcaaauagaaaacag

SEQ ID NO: 2126599 - RNA, 19 nt, Human
cugcaaauagaaaacagga

SEQ ID NO: 2126600 - RNA, 20 nt, Human
cugcaaauagaaaacaggaa

SEQ ID NO: 2126601 - RNA, 23 nt, Human
cugcaccgggccacagagaaagu

SEQ ID NO: 2126602 - RNA, 16 nt, Human
cugcaagucacaaagg

SEQ ID NO: 2126603 - RNA, 17 nt, Human
cugcaagucacaaagga

SEQ ID NO: 2126604 - RNA, 18 nt, Human
cugcaagucacaaaggaa

SEQ ID NO: 2126605 - RNA, 11 nt, Human
cugcaccuccc

SEQ ID NO: 2126606 - RNA, 14 nt, Human
cugcaccucccccc

SEQ ID NO: 2126607 - RNA, 17 nt, Human
cugcaccuccccccacu

SEQ ID NO: 2126608 - RNA, 18 nt, Human
cugcaccuccccccacug

SEQ ID NO: 2126609 - RNA, 19 nt, Human
cugcaccuccccccacugc

SEQ ID NO: 2126610 - RNA, 20 nt, Human
cugcaccuccccccacugca

SEQ ID NO: 2126611 - RNA, 21 nt, Human
cugcaccuccccccacugcag

SEQ ID NO: 2126612 - RNA, 22 nt, Human
cugcaccuccccccacugcagg

SEQ ID NO: 2126613 - RNA, 13 nt, Human
cugcaccugccag

SEQ ID NO: 2126614 - RNA, 16 nt, Human
cugcaccugccagccu

SEQ ID NO: 2126615 - RNA, 17 nt, Human
cugcaccugccagccug

SEQ ID NO: 2126616 - RNA, 18 nt, Human
cugcaccugccagccugg

SEQ ID NO: 2126617 - RNA, 19 nt, Human
cugcaccugccagccuggc

SEQ ID NO: 2126618 - RNA, 20 nt, Human
cugcaccugccagccuggcu

SEQ ID NO: 2126619 - RNA, 20 nt, Human
cugcaagaauugaagcagga

SEQ ID NO: 2126620 - RNA, 13 nt, Human
cugcaagagccuu

SEQ ID NO: 2126621 - RNA, 14 nt, Human
cugcaagagccuug

SEQ ID NO: 2126622 - RNA, 15 nt, Human
cugcaagagccuugg

SEQ ID NO: 2126623 - RNA, 17 nt, Human
cugcaagagccuuggug

SEQ ID NO: 2126624 - RNA, 18 nt, Human
cugcaagagccuuggugu

SEQ ID NO: 2126625 - RNA, 19 nt, Human
cugcaagagccuugguguc

SEQ ID NO: 2126626 - RNA, 23 nt, Human
cugcaagagccuugguguccacc

SEQ ID NO: 2126627 - RNA, 21 nt, Human
cugcaagagccuuggugucca

SEQ ID NO: 2126628 - RNA, 20 nt, Human
cugcaagcacaucugcauuu

SEQ ID NO: 2126629 - RNA, 22 nt, Human
cugcaaaggguaucaggugcug

SEQ ID NO: 2126630 - RNA, 13 nt, Human
cugcaaaggacug

SEQ ID NO: 2126631 - RNA, 22 nt, Human
cugcaaaggacuguuuuuuccu

SEQ ID NO: 2126632 - RNA, 23 nt, Human
cugcaaagguaauaauacagcca

SEQ ID NO: 2126633 - RNA, 21 nt, Human
cugcaaaggguaucaggugcu

SEQ ID NO: 2126634 - RNA, 23 nt, Human
cugaugggcaacccccagccugc

SEQ ID NO: 2126635 - RNA, 22 nt, Human
cugaugggcaacccccagccug

SEQ ID NO: 2126636 - RNA, 24 nt, Human
cugaugggcaacccccagccugcu

SEQ ID NO: 2126637 - RNA, 19 nt, Human
cugaugaccuaaccuaagc

SEQ ID NO: 2126638 - RNA, 21 nt, Human
cugaugggcaacccccagccu

SEQ ID NO: 2126639 - RNA, 18 nt, Human
cugaugggcaacccccag

SEQ ID NO: 2126640 - RNA, 14 nt, Human
cugauggaaacaaa

SEQ ID NO: 2126641 - RNA, 18 nt, Human
cugauggaaacaaagugg

SEQ ID NO: 2126642 - RNA, 20 nt, Human
cugauggaaacaaaguggaa

SEQ ID NO: 2126643 - RNA, 17 nt, Human
cucuuaugcacaccucc

SEQ ID NO: 2126644 - RNA, 13 nt, Human
cucuuaugccauu

SEQ ID NO: 2126645 - RNA, 18 nt, Human
cucuuaugccauuuguuu

SEQ ID NO: 2126646 - RNA, 22 nt, Human
cucuuauagaauauuuauuacc

SEQ ID NO: 2126647 - RNA, 17 nt, Human
cucuuauguaccucuuu

SEQ ID NO: 2126648 - RNA, 19 nt, Human
cucuuauguaccucuuuua

SEQ ID NO: 2126649 - RNA, 20 nt, Human
cucuuauguaccucuuuuag

SEQ ID NO: 2126650 - RNA, 14 nt, Human
cugaugacacugag

SEQ ID NO: 2126651 - RNA, 15 nt, Human
cugaugacacugaga

SEQ ID NO: 2126652 - RNA, 16 nt, Human
cucuuauucaguaaaa

SEQ ID NO: 2126653 - RNA, 12 nt, Human
cugaugacccag

SEQ ID NO: 2126654 - RNA, 13 nt, Human
cugaugacccagg

SEQ ID NO: 2126655 - RNA, 14 nt, Human
cugaugacccaggc

SEQ ID NO: 2126656 - RNA, 15 nt, Human
cugaugacccaggcu

SEQ ID NO: 2126657 - RNA, 19 nt, Human
cugaugacccaggcugccu

SEQ ID NO: 2126658 - RNA, 23 nt, Human
cugaugacccaggcugccugagc

SEQ ID NO: 2126659 - RNA, 17 nt, Human
cugaugagaauacugag

SEQ ID NO: 2126660 - RNA, 16 nt, Human
cugaugagaauuuaua

SEQ ID NO: 2126661 - RNA, 23 nt, Human
cugaugagaauuuauaaauuauu

SEQ ID NO: 2126662 - RNA, 23 nt, Human
cugaugcucccuccccugcccug

SEQ ID NO: 2126663 - RNA, 24 nt, Human
cugaugcucccuccccugcccugg

SEQ ID NO: 2126664 - RNA, 21 nt, Human
cugaugauuuagagugcuguc

SEQ ID NO: 2126665 - RNA, 12 nt, Human
cugaugcucccu

SEQ ID NO: 2126666 - RNA, 14 nt, Human
cugaugcucccucc

SEQ ID NO: 2126667 - RNA, 15 nt, Human
cugaugcucccuccc

SEQ ID NO: 2126668 - RNA, 17 nt, Human
cugaugcucccuccccu

SEQ ID NO: 2126669 - RNA, 18 nt, Human
cugaugcucccuccccug

SEQ ID NO: 2126670 - RNA, 19 nt, Human
cugaugcucccuccccugc

SEQ ID NO: 2126671 - RNA, 21 nt, Human
cugaugcucccuccccugccc

SEQ ID NO: 2126672 - RNA, 22 nt, Human
cugaugcucccuccccugcccu

SEQ ID NO: 2126673 - RNA, 22 nt, Human
aaauuuccacucaggucuguuu

SEQ ID NO: 2126674 - RNA, 16 nt, Human
aaauuuccaguaccuu

SEQ ID NO: 2126675 - RNA, 22 nt, Human
aaauuuccaguaccuuugucac

SEQ ID NO: 2126676 - RNA, 23 nt, Human
aaauuuccaguaccuuugucaca

SEQ ID NO: 2126677 - RNA, 19 nt, Human
aaauuuccagugagcuuau

SEQ ID NO: 2126678 - RNA, 14 nt, Human
aaauuuccacucag

SEQ ID NO: 2126679 - RNA, 13 nt, Human
aaauuuauaugua

SEQ ID NO: 2126680 - RNA, 20 nt, Human
aaauuuauauguauccagua

SEQ ID NO: 2126681 - RNA, 14 nt, Human
aaauuuauaauuuu

SEQ ID NO: 2126682 - RNA, 19 nt, Human
aaauuuauaauuuuaagau

SEQ ID NO: 2126683 - RNA, 21 nt, Human
aaauuuauaauuuuaagauuc

SEQ ID NO: 2126684 - RNA, 17 nt, Human
aaauuuaauucauguuu

SEQ ID NO: 2126685 - RNA, 18 nt, Human
aaauuuaauucauguuuc

SEQ ID NO: 2126686 - RNA, 12 nt, Human
aaauucccugga

SEQ ID NO: 2126687 - RNA, 20 nt, Human
aaauucccuggaccagaugc

SEQ ID NO: 2126688 - RNA, 20 nt, Human
gucacacaguauuacuucug

SEQ ID NO: 2126689 - RNA, 16 nt, Human
gucacacacuuuggcu

SEQ ID NO: 2126690 - RNA, 11 nt, Human
gucacaauaaa

SEQ ID NO: 2126691 - RNA, 12 nt, Human
gucacaauaaau

SEQ ID NO: 2126692 - RNA, 17 nt, Human
gucacaagagcccagca

SEQ ID NO: 2126693 - RNA, 12 nt, Human
gucaacagugaa

SEQ ID NO: 2126694 - RNA, 15 nt, Human
aaauuaucaagcuaa

SEQ ID NO: 2126695 - RNA, 16 nt, Human
aaauuaucaagcuaau

SEQ ID NO: 2126696 - RNA, 17 nt, Human
aaauuaucaagcuaaua

SEQ ID NO: 2126697 - RNA, 18 nt, Human
aaauuaucaagcuaauaa

SEQ ID NO: 2126698 - RNA, 19 nt, Human
aaauuaucaagcuaauaaa

SEQ ID NO: 2126699 - RNA, 20 nt, Human
aaauuaucaagcuaauaaaa

SEQ ID NO: 2126700 - RNA, 15 nt, Human
aaauuauuuuaaauu

SEQ ID NO: 2126701 - RNA, 16 nt, Human
aaauuauuuuaaauua

SEQ ID NO: 2126702 - RNA, 20 nt, Human
aaauuauuuuaaauuauaag

SEQ ID NO: 2126703 - RNA, 22 nt, Human
aaauuauuuuaaauuauaagga

SEQ ID NO: 2126704 - RNA, 20 nt, Human
aaauucagauauauuuuuca

SEQ ID NO: 2126705 - RNA, 12 nt, Human
guauuggcaaag

SEQ ID NO: 2126706 - RNA, 13 nt, Human
guauuggcaaaga

SEQ ID NO: 2126707 - RNA, 20 nt, Human
guauugggguuauuuucugg

SEQ ID NO: 2126708 - RNA, 16 nt, Human
guauuuaauuguaaac

SEQ ID NO: 2126709 - RNA, 17 nt, Human
guauuuaauuguaaacu

SEQ ID NO: 2126710 - RNA, 18 nt, Human
guauuuaauuguaaacug

SEQ ID NO: 2126711 - RNA, 19 nt, Human
guauuuaauuguaaacugu

SEQ ID NO: 2126712 - RNA, 20 nt, Human
guauuuaauuguaaacugua

SEQ ID NO: 2126713 - RNA, 21 nt, Human
guauuuaauuguaaacuguac

SEQ ID NO: 2126714 - RNA, 22 nt, Human
guauuuaauuguaaacuguacu

SEQ ID NO: 2126715 - RNA, 12 nt, Human
aaauguuacaua

SEQ ID NO: 2126716 - RNA, 17 nt, Human
aaauguuacauagugua

SEQ ID NO: 2126717 - RNA, 18 nt, Human
aaauguuacauaguguag

SEQ ID NO: 2126718 - RNA, 21 nt, Human
aaauguuacauaguguaggcu

SEQ ID NO: 2126719 - RNA, 16 nt, Human
aaauuaccaguaaagu

SEQ ID NO: 2126720 - RNA, 18 nt, Human
aaauuaccaguaaagugu

SEQ ID NO: 2126721 - RNA, 20 nt, Human
aaauuaccaguaaaguguaa

SEQ ID NO: 2126722 - RNA, 15 nt, Human
aaauuacuacaaaau

SEQ ID NO: 2126723 - RNA, 20 nt, Human
aaauguuaaguugaugguga

SEQ ID NO: 2126724 - RNA, 13 nt, Human
guaguucccugaa

SEQ ID NO: 2126725 - RNA, 17 nt, Human
guaguucccugaaaacc

SEQ ID NO: 2126726 - RNA, 20 nt, Human
guaguucccugaaaacccag

SEQ ID NO: 2126727 - RNA, 23 nt, Human
guaguucccugaaaacccagaga

SEQ ID NO: 2126728 - RNA, 16 nt, Human
aaauguaccugaugua

SEQ ID NO: 2126729 - RNA, 16 nt, Human
guaguuaguagcaugu

SEQ ID NO: 2126730 - RNA, 16 nt, Human
aaauguagguaugaau

SEQ ID NO: 2126731 - RNA, 12 nt, Human
aaauguacaaaa

SEQ ID NO: 2126732 - RNA, 19 nt, Human
aaauguacaaaauaaaguu

SEQ ID NO: 2126733 - RNA, 21 nt, Human
aaauguacaaaauaaaguuac

SEQ ID NO: 2126734 - RNA, 12 nt, Human
aaauguaauuga

SEQ ID NO: 2126735 - RNA, 20 nt, Human
guauaacacaauaugaauac

SEQ ID NO: 2126736 - RNA, 15 nt, Human
guauauucauauauu

SEQ ID NO: 2126737 - RNA, 14 nt, Human
guauauucauuuca

SEQ ID NO: 2126738 - RNA, 16 nt, Human
guauauucauuucaaa

SEQ ID NO: 2126739 - RNA, 23 nt, Human
guauaaaugaaguuuauacagua

SEQ ID NO: 2126740 - RNA, 16 nt, Human
guauaaagcucagaag

SEQ ID NO: 2126741 - RNA, 12 nt, Human
guauaaagaaca

SEQ ID NO: 2126742 - RNA, 14 nt, Human
guauaaagaaaagu

SEQ ID NO: 2126743 - RNA, 16 nt, Human
guauaaacugauggau

SEQ ID NO: 2126744 - RNA, 13 nt, Human
guauaaagaaaag

SEQ ID NO: 2126745 - RNA, 19 nt, Human
guauaaaaugguguuuuca

SEQ ID NO: 2126746 - RNA, 19 nt, Human
guauucugccuuugcagaa

SEQ ID NO: 2126747 - RNA, 21 nt, Human
guauucugccuuugcagaaac

SEQ ID NO: 2126748 - RNA, 23 nt, Human
guauucugccuuugcagaaacag

SEQ ID NO: 2126749 - RNA, 11 nt, Human
guauucuguac

SEQ ID NO: 2126750 - RNA, 12 nt, Human
guauguggaagg

SEQ ID NO: 2126751 - RNA, 15 nt, Human
guauucuuauuuaau

SEQ ID NO: 2126752 - RNA, 13 nt, Human
guaugguggcugg

SEQ ID NO: 2126753 - RNA, 17 nt, Human
guauggguuucucccag

SEQ ID NO: 2126754 - RNA, 15 nt, Human
guauggguguguguu

SEQ ID NO: 2126755 - RNA, 11 nt, Human
guaugugccau

SEQ ID NO: 2126756 - RNA, 14 nt, Human
guaugugccauuua

SEQ ID NO: 2126757 - RNA, 22 nt, Human
guaugaucacggcucacugcag

SEQ ID NO: 2126758 - RNA, 22 nt, Human
guauccucauuugggguagcua

SEQ ID NO: 2126759 - RNA, 17 nt, Human
guaucaacccagaaaca

SEQ ID NO: 2126760 - RNA, 18 nt, Human
guaucaacccagaaacac

SEQ ID NO: 2126761 - RNA, 17 nt, Human
guaucaggacgagaaug

SEQ ID NO: 2126762 - RNA, 21 nt, Human
guaucaggaaauauauaugug

SEQ ID NO: 2126763 - RNA, 19 nt, Human
guaucaaguggcaugugcu

SEQ ID NO: 2126764 - RNA, 18 nt, Human
guauggaauacaguguua

SEQ ID NO: 2126765 - RNA, 17 nt, Human
guauggaauacaguguu

SEQ ID NO: 2126766 - RNA, 15 nt, Human
guaggacuguagaaa

SEQ ID NO: 2126767 - RNA, 18 nt, Human
guaggaagguuaauguuc

SEQ ID NO: 2126768 - RNA, 11 nt, Human
guagcuucuga

SEQ ID NO: 2126769 - RNA, 19 nt, Human
guagcuucugaccucagca

SEQ ID NO: 2126770 - RNA, 18 nt, Human
guaggaacgguaaauuuc

SEQ ID NO: 2126771 - RNA, 21 nt, Human
guaggaacgguaaauuucugu

SEQ ID NO: 2126772 - RNA, 17 nt, Human
guaggcaugagggauca

SEQ ID NO: 2126773 - RNA, 20 nt, Human
guaggcaugagggaucacag

SEQ ID NO: 2126774 - RNA, 22 nt, Human
guaggcaugagggaucacaggg

SEQ ID NO: 2126775 - RNA, 23 nt, Human
guaggcaugagggaucacagggc

SEQ ID NO: 2126776 - RNA, 17 nt, Human
guagcuggauuacaggc

SEQ ID NO: 2126777 - RNA, 16 nt, Human
guagcugccccuggcu

SEQ ID NO: 2126778 - RNA, 12 nt, Human
guagcugccccu

SEQ ID NO: 2126779 - RNA, 15 nt, Human
guagcugccccuggc

SEQ ID NO: 2126780 - RNA, 12 nt, Human
guagcugggacu

SEQ ID NO: 2126781 - RNA, 19 nt, Human
guagcugggacuacaggca

SEQ ID NO: 2126782 - RNA, 18 nt, Human
guagcugggacuacaggc

SEQ ID NO: 2126783 - RNA, 18 nt, Human
guagcuguggugaggugg

SEQ ID NO: 2126784 - RNA, 21 nt, Human
guagcugggacuacaggcacc

SEQ ID NO: 2126785 - RNA, 20 nt, Human
aaaggacuguuuuuuccuga

SEQ ID NO: 2126786 - RNA, 22 nt, Human
aaaggacuguuuuuuccugagc

SEQ ID NO: 2126787 - RNA, 19 nt, Human
aaaggagagaagagagaaa

SEQ ID NO: 2126788 - RNA, 21 nt, Human
aaaggagcuuaccucccaccu

SEQ ID NO: 2126789 - RNA, 13 nt, Human
aaaggaggcuggc

SEQ ID NO: 2126790 - RNA, 14 nt, Human
aaaggaggcuggca

SEQ ID NO: 2126791 - RNA, 19 nt, Human
aaaggauaaacuuuuagaa

SEQ ID NO: 2126792 - RNA, 20 nt, Human
aaaggauaaacuuuuagaaa

SEQ ID NO: 2126793 - RNA, 15 nt, Human
aaaggauauuuucuu

SEQ ID NO: 2126794 - RNA, 13 nt, Human
aaaggauauuuaa

SEQ ID NO: 2126795 - RNA, 16 nt, Human
aaaggauauuuaagaa

SEQ ID NO: 2126796 - RNA, 19 nt, Human
aaaggauauuuaagaaaau

SEQ ID NO: 2126797 - RNA, 21 nt, Human
aaaggauauuuaagaaaauac

SEQ ID NO: 2126798 - RNA, 23 nt, Human
aaaggauauuuaagaaaauacaa

SEQ ID NO: 2126799 - RNA, 12 nt, Human
aaaggauauuuu

SEQ ID NO: 2126800 - RNA, 13 nt, Human
aaaucgaugcagu

SEQ ID NO: 2126801 - RNA, 17 nt, Human
aaauccuuuuucuuuau

SEQ ID NO: 2126802 - RNA, 18 nt, Human
aaauccuuuuucuuuaua

SEQ ID NO: 2126803 - RNA, 19 nt, Human
aaauccuuuuucuuuauaa

SEQ ID NO: 2126804 - RNA, 16 nt, Human
aaauccuuccaugaaa

SEQ ID NO: 2126805 - RNA, 13 nt, Human
aaauccuucuaau

SEQ ID NO: 2126806 - RNA, 14 nt, Human
aaauccuucuaauc

SEQ ID NO: 2126807 - RNA, 15 nt, Human
aaauccuucuaaucu

SEQ ID NO: 2126808 - RNA, 18 nt, Human
aaauccuucuaaucugcu

SEQ ID NO: 2126809 - RNA, 17 nt, Human
aaauccuaccaaccucu

SEQ ID NO: 2126810 - RNA, 19 nt, Human
aaauccuaccaaccucuga

SEQ ID NO: 2126811 - RNA, 15 nt, Human
aaauccuacugaaug

SEQ ID NO: 2126812 - RNA, 21 nt, Human
aaaucccauucauaacuuuca

SEQ ID NO: 2126813 - RNA, 11 nt, Human
aaauccucugg

SEQ ID NO: 2126814 - RNA, 12 nt, Human
aaauccucuggc

SEQ ID NO: 2126815 - RNA, 12 nt, Human
aaauccuguuga

SEQ ID NO: 2126816 - RNA, 17 nt, Human
aaauccuguugaaaagc

SEQ ID NO: 2126817 - RNA, 20 nt, Human
aaauccuguugaaaagccau

SEQ ID NO: 2126818 - RNA, 21 nt, Human
aaauccuguugaaaagccaug

SEQ ID NO: 2126819 - RNA, 15 nt, Human
aaaucccauuuaaaa

SEQ ID NO: 2126820 - RNA, 18 nt, Human
aaaucccuuaccucggug

SEQ ID NO: 2126821 - RNA, 11 nt, Human
aaaugaaaauu

SEQ ID NO: 2126822 - RNA, 12 nt, Human
aaaugaaagaaa

SEQ ID NO: 2126823 - RNA, 18 nt, Human
aaaugaaaacauguaaua

SEQ ID NO: 2126824 - RNA, 17 nt, Human
aaaugaaaaucgugaca

SEQ ID NO: 2126825 - RNA, 23 nt, Human
aaaucggaucuggggcucuggga

SEQ ID NO: 2126826 - RNA, 14 nt, Human
aaaucuaagggaaa

SEQ ID NO: 2126827 - RNA, 22 nt, Human
aaaucggaucuggggcucuggg

SEQ ID NO: 2126828 - RNA, 14 nt, Human
aaaugaaagugaga

SEQ ID NO: 2126829 - RNA, 18 nt, Human
aaaugaaagcaugucuca

SEQ ID NO: 2126830 - RNA, 15 nt, Human
aaaugaaagcaugug

SEQ ID NO: 2126831 - RNA, 20 nt, Human
aaaugaaaguauaacugagu

SEQ ID NO: 2126832 - RNA, 12 nt, Human
aaaugaaauguu

SEQ ID NO: 2126833 - RNA, 14 nt, Human
aaaugaaauguuuu

SEQ ID NO: 2126834 - RNA, 21 nt, Human
aaaugaaauguuuuaaggcuu

SEQ ID NO: 2126835 - RNA, 22 nt, Human
aaaugaaauuacuacaaaauuu

SEQ ID NO: 2126836 - RNA, 23 nt, Human
aaaugaagauuauuuuuuaugag

SEQ ID NO: 2126837 - RNA, 21 nt, Human
aaaugaaguaacuugucuuaa

SEQ ID NO: 2126838 - RNA, 11 nt, Human
aaaugaagugc

SEQ ID NO: 2126839 - RNA, 13 nt, Human
aaaugaaauuuua

SEQ ID NO: 2126840 - RNA, 14 nt, Human
aaaugaaauuuuac

SEQ ID NO: 2126841 - RNA, 15 nt, Human
aaaugaaauuuuacc

SEQ ID NO: 2126842 - RNA, 16 nt, Human
aaaugaaauuuuacca

SEQ ID NO: 2126843 - RNA, 17 nt, Human
aaaugaaauuuuaccaa

SEQ ID NO: 2126844 - RNA, 18 nt, Human
aaaugaaauuuuaccaag

SEQ ID NO: 2126845 - RNA, 20 nt, Human
aaaugaaauuuuaccaaguu

SEQ ID NO: 2126846 - RNA, 17 nt, Human
aaaugacuaaaaauauu

SEQ ID NO: 2126847 - RNA, 20 nt, Human
aaaugacuaaaaauauuaua

SEQ ID NO: 2126848 - RNA, 15 nt, Human
aaaugaccaauauua

SEQ ID NO: 2126849 - RNA, 14 nt, Human
aaaugacagauguu

SEQ ID NO: 2126850 - RNA, 19 nt, Human
aaaugacuaaaaaacaaag

SEQ ID NO: 2126851 - RNA, 22 nt, Human
aaaugacuaaaaaacaaagaag

SEQ ID NO: 2126852 - RNA, 20 nt, Human
aaaugaagugcaaauuugau

SEQ ID NO: 2126853 - RNA, 17 nt, Human
aaaugaaguuuauacag

SEQ ID NO: 2126854 - RNA, 15 nt, Human
aaaugaauaauuucc

SEQ ID NO: 2126855 - RNA, 17 nt, Human
aaaugaauaauuuccca

SEQ ID NO: 2126856 - RNA, 18 nt, Human
aaaugaauaauuucccaa

SEQ ID NO: 2126857 - RNA, 15 nt, Human
aaaugacaaugauga

SEQ ID NO: 2126858 - RNA, 23 nt, Human
aaaugauccccagcuguuuaugc

SEQ ID NO: 2126859 - RNA, 18 nt, Human
aaaugaguguguuuguca

SEQ ID NO: 2126860 - RNA, 11 nt, Human
aaaugauauua

SEQ ID NO: 2126861 - RNA, 18 nt, Human
aaaugauauuaaaaauug

SEQ ID NO: 2126862 - RNA, 19 nt, Human
aaaugauauuaaaaauugg

SEQ ID NO: 2126863 - RNA, 20 nt, Human
aaaugauauuaaaaauuggc

SEQ ID NO: 2126864 - RNA, 21 nt, Human
aaaugaguuaccuacauuuua

SEQ ID NO: 2126865 - RNA, 22 nt, Human
aaaugaguuuuuauggggcuga

SEQ ID NO: 2126866 - RNA, 12 nt, Human
aaaugagugugu

SEQ ID NO: 2126867 - RNA, 19 nt, Human
aaaugaggucagagccugc

SEQ ID NO: 2126868 - RNA, 17 nt, Human
aaaugaggucagagccu

SEQ ID NO: 2126869 - RNA, 16 nt, Human
aaaugagguacucucc

SEQ ID NO: 2126870 - RNA, 23 nt, Human
aaaugagguacucuccuggaaau

SEQ ID NO: 2126871 - RNA, 14 nt, Human
aaaugagaacaugu

SEQ ID NO: 2126872 - RNA, 15 nt, Human
aaaugagaacauguu

SEQ ID NO: 2126873 - RNA, 18 nt, Human
aaaugagaacauguuggu

SEQ ID NO: 2126874 - RNA, 22 nt, Human
aaaugagaacauguugguauuu

SEQ ID NO: 2126875 - RNA, 23 nt, Human
aaaugagaacauguugguauuua

SEQ ID NO: 2126876 - RNA, 13 nt, Human
aaaugagaaggaa

SEQ ID NO: 2126877 - RNA, 20 nt, Human
aaaugagacccucguggccu

SEQ ID NO: 2126878 - RNA, 13 nt, Human
aaaugagccuggc

SEQ ID NO: 2126879 - RNA, 19 nt, Human
aaaugagccuggcaagaau

SEQ ID NO: 2126880 - RNA, 23 nt, Human
aaaugagcucgcauuugucaaug

SEQ ID NO: 2126881 - RNA, 13 nt, Human
aaaugaggaaacu

SEQ ID NO: 2126882 - RNA, 13 nt, Human
aaaugcauggagg

SEQ ID NO: 2126883 - RNA, 14 nt, Human
aaaugccaaucucu

SEQ ID NO: 2126884 - RNA, 13 nt, Human
aaaugcccagcuu

SEQ ID NO: 2126885 - RNA, 22 nt, Human
aaaugggaaaugccuaagaaga

SEQ ID NO: 2126886 - RNA, 15 nt, Human
aaaugccuaagaaga

SEQ ID NO: 2126887 - RNA, 16 nt, Human
aaaugccuaagaagau

SEQ ID NO: 2126888 - RNA, 13 nt, Human
aaaugcaauaugu

SEQ ID NO: 2126889 - RNA, 14 nt, Human
aaaugcaagauuuu

SEQ ID NO: 2126890 - RNA, 15 nt, Human
aaaugcaauauguau

SEQ ID NO: 2126891 - RNA, 16 nt, Human
aaaugcaauauguauu

SEQ ID NO: 2126892 - RNA, 21 nt, Human
aaaugcaaacacacaaaggua

SEQ ID NO: 2126893 - RNA, 16 nt, Human
aaaugcaacaacaugu

SEQ ID NO: 2126894 - RNA, 17 nt, Human
aaaugcaaacacacaaa

SEQ ID NO: 2126895 - RNA, 22 nt, Human
aaaugaugauguggaagaacuu

SEQ ID NO: 2126896 - RNA, 16 nt, Human
aaaugaucuuuucaag

SEQ ID NO: 2126897 - RNA, 19 nt, Human
aaaugaugauguggaagaa

SEQ ID NO: 2126898 - RNA, 12 nt, Human
aaaugcagugaa

SEQ ID NO: 2126899 - RNA, 21 nt, Human
aaaugcagcgaaccaauauuu

SEQ ID NO: 2126900 - RNA, 23 nt, Human
aaaugcagcgaaccaauauuugu

SEQ ID NO: 2126901 - RNA, 12 nt, Human
aaaugcacaaug

SEQ ID NO: 2126902 - RNA, 15 nt, Human
aaaugcacaaugucu

SEQ ID NO: 2126903 - RNA, 16 nt, Human
aaaugcacaaugucuu

SEQ ID NO: 2126904 - RNA, 17 nt, Human
aaaugcacaaugucuug

SEQ ID NO: 2126905 - RNA, 18 nt, Human
aaaugcacaaugucuugg

SEQ ID NO: 2126906 - RNA, 23 nt, Human
aaaugcauccauuccucagggac

SEQ ID NO: 2126907 - RNA, 19 nt, Human
aaaugcauauccugagcca

SEQ ID NO: 2126908 - RNA, 20 nt, Human
aaaugcauauccugagccau

SEQ ID NO: 2126909 - RNA, 17 nt, Human
aaaugcaucaauccugu

SEQ ID NO: 2126910 - RNA, 18 nt, Human
aaaugcaucaauccugug

SEQ ID NO: 2126911 - RNA, 21 nt, Human
aaaugcaucaauccugugugg

SEQ ID NO: 2126912 - RNA, 16 nt, Human
aaaugcauccauuccu

SEQ ID NO: 2126913 - RNA, 20 nt, Human
aaaugcauccauuccucagg

SEQ ID NO: 2126914 - RNA, 22 nt, Human
aaaugcauccauuccucaggga

SEQ ID NO: 2126915 - RNA, 17 nt, Human
aacauugcaauagaaau

SEQ ID NO: 2126916 - RNA, 18 nt, Human
aacauugauugcuguguc

SEQ ID NO: 2126917 - RNA, 22 nt, Human
aacauuucuaacucugauguaa

SEQ ID NO: 2126918 - RNA, 14 nt, Human
aacauugcaauaga

SEQ ID NO: 2126919 - RNA, 17 nt, Human
aacauugaccaagaacu

SEQ ID NO: 2126920 - RNA, 18 nt, Human
aacauugaccaagaacug

SEQ ID NO: 2126921 - RNA, 19 nt, Human
aacauugaccaagaacugc

SEQ ID NO: 2126922 - RNA, 20 nt, Human
aacauugaccaagaacugca

SEQ ID NO: 2126923 - RNA, 21 nt, Human
aacauugaccaagaacugcau

SEQ ID NO: 2126924 - RNA, 22 nt, Human
aacauugaccaagaacugcaug

SEQ ID NO: 2126925 - RNA, 23 nt, Human
aacauugaccaagaacugcaugg

SEQ ID NO: 2126926 - RNA, 15 nt, Human
aacauugcaauagaa

SEQ ID NO: 2126927 - RNA, 16 nt, Human
aacauugcaauagaaa

SEQ ID NO: 2126928 - RNA, 16 nt, Human
aacauugaaguaauga

SEQ ID NO: 2126929 - RNA, 18 nt, Human
aacauugaaguaaugaau

SEQ ID NO: 2126930 - RNA, 19 nt, Human
aacauugaaguaaugaauu

SEQ ID NO: 2126931 - RNA, 17 nt, Human
aacauaauucuuguaua

SEQ ID NO: 2126932 - RNA, 19 nt, Human
aacaguuuuccaugaaaac

SEQ ID NO: 2126933 - RNA, 18 nt, Human
aacauaauucuuguauau

SEQ ID NO: 2126934 - RNA, 15 nt, Human
aacaguuuuccauga

SEQ ID NO: 2126935 - RNA, 16 nt, Human
aacaguuuuccaugaa

SEQ ID NO: 2126936 - RNA, 17 nt, Human
aacaguuuuccaugaaa

SEQ ID NO: 2126937 - RNA, 18 nt, Human
aacaguuuuccaugaaaa

SEQ ID NO: 2126938 - RNA, 13 nt, Human
guccuucaaaggc

SEQ ID NO: 2126939 - RNA, 19 nt, Human
guccugccuggccaggcag

SEQ ID NO: 2126940 - RNA, 20 nt, Human
guccugccuggccaggcaga

SEQ ID NO: 2126941 - RNA, 14 nt, Human
guccugccaccugg

SEQ ID NO: 2126942 - RNA, 16 nt, Human
guccugccaccugggg

SEQ ID NO: 2126943 - RNA, 17 nt, Human
guccugccaccuggggc

SEQ ID NO: 2126944 - RNA, 18 nt, Human
guccugccaccuggggca

SEQ ID NO: 2126945 - RNA, 15 nt, Human
guccugccucagccu

SEQ ID NO: 2126946 - RNA, 17 nt, Human
guccugccucagccucc

SEQ ID NO: 2126947 - RNA, 13 nt, Human
guccugccuggcc

SEQ ID NO: 2126948 - RNA, 14 nt, Human
guccugccuggcca

SEQ ID NO: 2126949 - RNA, 15 nt, Human
guccugccuggccag

SEQ ID NO: 2126950 - RNA, 16 nt, Human
guccugaccugucuca

SEQ ID NO: 2126951 - RNA, 15 nt, Human
guccugaccugucuc

SEQ ID NO: 2126952 - RNA, 16 nt, Human
guccugacggcgcccc

SEQ ID NO: 2126953 - RNA, 21 nt, Human
guccugacggcgcccccagug

SEQ ID NO: 2126954 - RNA, 13 nt, Human
guccugacucaac

SEQ ID NO: 2126955 - RNA, 13 nt, Human
guccgagcuuuga

SEQ ID NO: 2126956 - RNA, 23 nt, Human
gucccaaggaaagccccagcacu

SEQ ID NO: 2126957 - RNA, 12 nt, Human
guccgcccucuu

SEQ ID NO: 2126958 - RNA, 19 nt, Human
guccgcccucuuccccucu

SEQ ID NO: 2126959 - RNA, 15 nt, Human
gucccaacuuguaaa

SEQ ID NO: 2126960 - RNA, 16 nt, Human
gucccaaggaaagccc

SEQ ID NO: 2126961 - RNA, 12 nt, Human
aacagaaaaaaa

SEQ ID NO: 2126962 - RNA, 15 nt, Human
aacagaaaaaaaaca

SEQ ID NO: 2126963 - RNA, 16 nt, Human
aacagaaaaaaaacac

SEQ ID NO: 2126964 - RNA, 17 nt, Human
aacagaaaaaaaacaca

SEQ ID NO: 2126965 - RNA, 11 nt, Human
aacagaaaaca

SEQ ID NO: 2126966 - RNA, 13 nt, Human
aacagaaaacaac

SEQ ID NO: 2126967 - RNA, 14 nt, Human
aacagaaaacaaca

SEQ ID NO: 2126968 - RNA, 18 nt, Human
aacagaaaacaacaaaaa

SEQ ID NO: 2126969 - RNA, 20 nt, Human
aacagaaaacaacaaaaaau

SEQ ID NO: 2126970 - RNA, 21 nt, Human
guccggucccugucccagugc

SEQ ID NO: 2126971 - RNA, 19 nt, Human
aacagacccccucuagaaa

SEQ ID NO: 2126972 - RNA, 18 nt, Human
aacagacccccucuagaa

SEQ ID NO: 2126973 - RNA, 11 nt, Human
aacagacagga

SEQ ID NO: 2126974 - RNA, 14 nt, Human
aacagacaggagaa

SEQ ID NO: 2126975 - RNA, 15 nt, Human
aacagacaggagaaa

SEQ ID NO: 2126976 - RNA, 14 nt, Human
aacaguaaaugugc

SEQ ID NO: 2126977 - RNA, 23 nt, Human
aacaggcugggcuucaguggcag

SEQ ID NO: 2126978 - RNA, 13 nt, Human
aacaggcugggcu

SEQ ID NO: 2126979 - RNA, 22 nt, Human
aacaggcugggcuucaguggca

SEQ ID NO: 2126980 - RNA, 19 nt, Human
aacagacuggaagcacagc

SEQ ID NO: 2126981 - RNA, 13 nt, Human
aacagacucaggu

SEQ ID NO: 2126982 - RNA, 15 nt, Human
aacaguggaauauaa

SEQ ID NO: 2126983 - RNA, 12 nt, Human
aacaguagcaua

SEQ ID NO: 2126984 - RNA, 22 nt, Human
aacagugugguaguuaauaaaa

SEQ ID NO: 2126985 - RNA, 13 nt, Human
aacaguuuguaca

SEQ ID NO: 2126986 - RNA, 14 nt, Human
aacaguuuguacag

SEQ ID NO: 2126987 - RNA, 11 nt, Human
aacaguuuucc

SEQ ID NO: 2126988 - RNA, 13 nt, Human
aacaguuuuccau

SEQ ID NO: 2126989 - RNA, 14 nt, Human
aacaguuuuccaug

SEQ ID NO: 2126990 - RNA, 15 nt, Human
aacaguguuucccau

SEQ ID NO: 2126991 - RNA, 13 nt, Human
aacaguguuuccc

SEQ ID NO: 2126992 - RNA, 18 nt, Human
aacaguguuucccauaau

SEQ ID NO: 2126993 - RNA, 21 nt, Human
gucauuuuaacuuuaucacau

SEQ ID NO: 2126994 - RNA, 12 nt, Human
aacacuuguaau

SEQ ID NO: 2126995 - RNA, 21 nt, Human
gucauuugcgcacaacuuaaa

SEQ ID NO: 2126996 - RNA, 22 nt, Human
gucauuugagcagggcucagcg

SEQ ID NO: 2126997 - RNA, 11 nt, Human
aacacuuccau

SEQ ID NO: 2126998 - RNA, 21 nt, Human
gucauuugagcagggcucagc

SEQ ID NO: 2126999 - RNA, 22 nt, Human
aacacuuaaggguuuuagaaaa

SEQ ID NO: 2127000 - RNA, 15 nt, Human
aacacuuauugcuuu

SEQ ID NO: 2127001 - RNA, 19 nt, Human
aacacuuauugcuuugaaa

SEQ ID NO: 2127002 - RNA, 16 nt, Human
aacaaugcgaauggua

SEQ ID NO: 2127003 - RNA, 15 nt, Human
guccacagaugccuc

SEQ ID NO: 2127004 - RNA, 17 nt, Human
guccacagaugccucca

SEQ ID NO: 2127005 - RNA, 19 nt, Human
guccaauuuguaaaaacag

SEQ ID NO: 2127006 - RNA, 16 nt, Human
guccacagaugccucc

SEQ ID NO: 2127007 - RNA, 19 nt, Human
guccaagugugugugcgug

SEQ ID NO: 2127008 - RNA, 15 nt, Human
guccaagugugugug

SEQ ID NO: 2127009 - RNA, 16 nt, Human
guccaagugugugugc

SEQ ID NO: 2127010 - RNA, 17 nt, Human
guccaagugugugugcg

SEQ ID NO: 2127011 - RNA, 16 nt, Human
aacacugucuugaaga

SEQ ID NO: 2127012 - RNA, 17 nt, Human
aacacugcuuguguuuu

SEQ ID NO: 2127013 - RNA, 19 nt, Human
aacacuggcaacaacaaag

SEQ ID NO: 2127014 - RNA, 14 nt, Human
aacacugcuugugu

SEQ ID NO: 2127015 - RNA, 13 nt, Human
aacacucuauauu

SEQ ID NO: 2127016 - RNA, 14 nt, Human
aacaauuuucugca

SEQ ID NO: 2127017 - RNA, 23 nt, Human
aaauuuuucuuccuuaaacuccu

SEQ ID NO: 2127018 - RNA, 17 nt, Human
aaauuuuuccuuagcau

SEQ ID NO: 2127019 - RNA, 14 nt, Human
aacaagcuaggugc

SEQ ID NO: 2127020 - RNA, 19 nt, Human
aacaagcuaggugcuaauu

SEQ ID NO: 2127021 - RNA, 15 nt, Human
gucacaggcaggucc

SEQ ID NO: 2127022 - RNA, 13 nt, Human
gucacaggcaggu

SEQ ID NO: 2127023 - RNA, 16 nt, Human
gucacaggcaggucca

SEQ ID NO: 2127024 - RNA, 21 nt, Human
aaauuuuucagaugcuucugg

SEQ ID NO: 2127025 - RNA, 17 nt, Human
aaauuuuucagaugcuu

SEQ ID NO: 2127026 - RNA, 18 nt, Human
aaauuuuucagaugcuuc

SEQ ID NO: 2127027 - RNA, 20 nt, Human
aaauuuuucagaugcuucug

SEQ ID NO: 2127028 - RNA, 13 nt, Human
aaauuuuugaaaa

SEQ ID NO: 2127029 - RNA, 13 nt, Human
aaauuuuuggauu

SEQ ID NO: 2127030 - RNA, 15 nt, Human
aaauuuuuggauuga

SEQ ID NO: 2127031 - RNA, 17 nt, Human
aaauuuuuggauugaca

SEQ ID NO: 2127032 - RNA, 19 nt, Human
aaauuuuuggauugacagu

SEQ ID NO: 2127033 - RNA, 21 nt, Human
aaauuuuuggauugacaguaa

SEQ ID NO: 2127034 - RNA, 14 nt, Human
aaauuuuguaauuu

SEQ ID NO: 2127035 - RNA, 15 nt, Human
aaauuuuguaauuuu

SEQ ID NO: 2127036 - RNA, 17 nt, Human
aaauuuuguaauuuucu

SEQ ID NO: 2127037 - RNA, 18 nt, Human
aaauuuuguaauuuucuu

SEQ ID NO: 2127038 - RNA, 19 nt, Human
aaauuuuguaauuuucuug

SEQ ID NO: 2127039 - RNA, 21 nt, Human
aaauuuuguaauuuucuugau

SEQ ID NO: 2127040 - RNA, 22 nt, Human
aacaauuuauuuuauuuuagca

SEQ ID NO: 2127041 - RNA, 14 nt, Human
aacaagggcagugg

SEQ ID NO: 2127042 - RNA, 18 nt, Human
aacaagggcaguggaggu

SEQ ID NO: 2127043 - RNA, 19 nt, Human
aacaaggguggcaucccag

SEQ ID NO: 2127044 - RNA, 16 nt, Human
aacaagguaguuuuua

SEQ ID NO: 2127045 - RNA, 15 nt, Human
aacaauaaaugugca

SEQ ID NO: 2127046 - RNA, 16 nt, Human
aacaauauuguuucua

SEQ ID NO: 2127047 - RNA, 12 nt, Human
aacaauauuuau

SEQ ID NO: 2127048 - RNA, 15 nt, Human
aacaauauuuauugu

SEQ ID NO: 2127049 - RNA, 15 nt, Human
aacaauaacuacugu

SEQ ID NO: 2127050 - RNA, 17 nt, Human
aacaauaacuacugugu

SEQ ID NO: 2127051 - RNA, 18 nt, Human
aacaauaacuacuguguu

SEQ ID NO: 2127052 - RNA, 19 nt, Human
aacaauaacuacuguguuc

SEQ ID NO: 2127053 - RNA, 20 nt, Human
aacaauaacuacuguguucc

SEQ ID NO: 2127054 - RNA, 21 nt, Human
aacaauaacuacuguguuccu

SEQ ID NO: 2127055 - RNA, 20 nt, Human
aacaauaagagcguuugccc

SEQ ID NO: 2127056 - RNA, 12 nt, Human
aacccaggaggu

SEQ ID NO: 2127057 - RNA, 22 nt, Human
aaccccaaaaugaagauuauuu

SEQ ID NO: 2127058 - RNA, 15 nt, Human
aacccaugagauuca

SEQ ID NO: 2127059 - RNA, 17 nt, Human
aacccaucuaccccugg

SEQ ID NO: 2127060 - RNA, 20 nt, Human
aacccaucuaccccuggaug

SEQ ID NO: 2127061 - RNA, 21 nt, Human
aacccaucuaccccuggauga

SEQ ID NO: 2127062 - RNA, 11 nt, Human
aacccaggagg

SEQ ID NO: 2127063 - RNA, 15 nt, Human
aacccaucagaagga

SEQ ID NO: 2127064 - RNA, 17 nt, Human
aacccaucagaaggaga

SEQ ID NO: 2127065 - RNA, 19 nt, Human
aacccaucagaaggagaag

SEQ ID NO: 2127066 - RNA, 20 nt, Human
aaccauuuuuuuucagcaga

SEQ ID NO: 2127067 - RNA, 13 nt, Human
aacccaaaccugg

SEQ ID NO: 2127068 - RNA, 14 nt, Human
aacccaaaccugga

SEQ ID NO: 2127069 - RNA, 15 nt, Human
aacccaaaccuggag

SEQ ID NO: 2127070 - RNA, 16 nt, Human
aacccaaaccuggaga

SEQ ID NO: 2127071 - RNA, 17 nt, Human
aacccaaaccuggagau

SEQ ID NO: 2127072 - RNA, 15 nt, Human
aacccccagccugcu

SEQ ID NO: 2127073 - RNA, 14 nt, Human
aacccccagccugc

SEQ ID NO: 2127074 - RNA, 13 nt, Human
aacccccagccug

SEQ ID NO: 2127075 - RNA, 14 nt, Human
aaccccagcauccu

SEQ ID NO: 2127076 - RNA, 12 nt, Human
aaccccagcucc

SEQ ID NO: 2127077 - RNA, 15 nt, Human
aaccucagcaaccug

SEQ ID NO: 2127078 - RNA, 21 nt, Human
aaccuccuguuagcuguuauu

SEQ ID NO: 2127079 - RNA, 14 nt, Human
aaccuccugggcua

SEQ ID NO: 2127080 - RNA, 17 nt, Human
aaccuccgccucuuggg

SEQ ID NO: 2127081 - RNA, 15 nt, Human
aaccucaaagugacu

SEQ ID NO: 2127082 - RNA, 21 nt, Human
aaccucacccgaggcugccca

SEQ ID NO: 2127083 - RNA, 19 nt, Human
aaccucacgcaccucccau

SEQ ID NO: 2127084 - RNA, 22 nt, Human
aaccucacgcaccucccauccu

SEQ ID NO: 2127085 - RNA, 18 nt, Human
aaccacaucuugcucugc

SEQ ID NO: 2127086 - RNA, 15 nt, Human
aaccaauguuuaaaa

SEQ ID NO: 2127087 - RNA, 22 nt, Human
aaccaauguuuaaaaaaguuua

SEQ ID NO: 2127088 - RNA, 21 nt, Human
aaccaaaagaacaagaauuuc

SEQ ID NO: 2127089 - RNA, 15 nt, Human
aaccaauauuuguag

SEQ ID NO: 2127090 - RNA, 14 nt, Human
aaccaaucaagaua

SEQ ID NO: 2127091 - RNA, 15 nt, Human
aaccaaucaagauaa

SEQ ID NO: 2127092 - RNA, 19 nt, Human
aaccaaucaagauaaagga

SEQ ID NO: 2127093 - RNA, 22 nt, Human
aaccacaucuugcucugcugac

SEQ ID NO: 2127094 - RNA, 20 nt, Human
aaccacaucuugcucugcug

SEQ ID NO: 2127095 - RNA, 22 nt, Human
gucucccuauaaugcuggagcg

SEQ ID NO: 2127096 - RNA, 14 nt, Human
gucuccccucugcu

SEQ ID NO: 2127097 - RNA, 15 nt, Human
gucuccccucugcug

SEQ ID NO: 2127098 - RNA, 16 nt, Human
gucuccccucugcugg

SEQ ID NO: 2127099 - RNA, 17 nt, Human
gucuccccucugcuggc

SEQ ID NO: 2127100 - RNA, 19 nt, Human
gucuccccucugcuggccg

SEQ ID NO: 2127101 - RNA, 14 nt, Human
gucuccucuuaaaa

SEQ ID NO: 2127102 - RNA, 22 nt, Human
gucuccucuuaaaaaauaaaaa

SEQ ID NO: 2127103 - RNA, 23 nt, Human
gucuccucuuaaaaaauaaaaac

SEQ ID NO: 2127104 - RNA, 19 nt, Human
gucuccucuuuguuuuguu

SEQ ID NO: 2127105 - RNA, 14 nt, Human
gucuccugcaugca

SEQ ID NO: 2127106 - RNA, 13 nt, Human
gucuccugccccc

SEQ ID NO: 2127107 - RNA, 14 nt, Human
gucuccugccccca

SEQ ID NO: 2127108 - RNA, 15 nt, Human
gucuccugcccccac

SEQ ID NO: 2127109 - RNA, 19 nt, Human
gucuccugcccccacaccu

SEQ ID NO: 2127110 - RNA, 22 nt, Human
gucuccugcccccacaccuggc

SEQ ID NO: 2127111 - RNA, 23 nt, Human
gucuccugcccccacaccuggcc

SEQ ID NO: 2127112 - RNA, 22 nt, Human
aacauuuuguggucauuaagca

SEQ ID NO: 2127113 - RNA, 18 nt, Human
gucucccaucuuaacucu

SEQ ID NO: 2127114 - RNA, 18 nt, Human
gucuccccaugugccugc

SEQ ID NO: 2127115 - RNA, 19 nt, Human
gucucccagggccuuaaaa

SEQ ID NO: 2127116 - RNA, 13 nt, Human
gucucauccccag

SEQ ID NO: 2127117 - RNA, 16 nt, Human
gucucauccccagggg

SEQ ID NO: 2127118 - RNA, 14 nt, Human
gucucauccccagg

SEQ ID NO: 2127119 - RNA, 15 nt, Human
gucucauccccaggg

SEQ ID NO: 2127120 - RNA, 15 nt, Human
gucucaguuucacuu

SEQ ID NO: 2127121 - RNA, 12 nt, Human
guccuucccucu

SEQ ID NO: 2127122 - RNA, 21 nt, Human
guccuucccucuccccaagac

SEQ ID NO: 2127123 - RNA, 14 nt, Human
guccuuccaggccc

SEQ ID NO: 2127124 - RNA, 22 nt, Human
guccuuccaggcccccaccacu

SEQ ID NO: 2127125 - RNA, 17 nt, Human
guccuucucucaccucc

SEQ ID NO: 2127126 - RNA, 18 nt, Human
guccuucucucaccuccu

SEQ ID NO: 2127127 - RNA, 19 nt, Human
guccuucucucaccuccua

SEQ ID NO: 2127128 - RNA, 19 nt, Human
gucugcugaauaauaaacu

SEQ ID NO: 2127129 - RNA, 17 nt, Human
gucugcugaauaauaaa

SEQ ID NO: 2127130 - RNA, 13 nt, Human
gucugcugcccuc

SEQ ID NO: 2127131 - RNA, 15 nt, Human
gucugcugcccucca

SEQ ID NO: 2127132 - RNA, 16 nt, Human
gucugcugcccuccau

SEQ ID NO: 2127133 - RNA, 18 nt, Human
gucugcugcccuccaucc

SEQ ID NO: 2127134 - RNA, 19 nt, Human
gucugcugcccuccauccc

SEQ ID NO: 2127135 - RNA, 18 nt, Human
aaccucucacuucacccu

SEQ ID NO: 2127136 - RNA, 14 nt, Human
aaccucuuccccag

SEQ ID NO: 2127137 - RNA, 11 nt, Human
aaccucuuccc

SEQ ID NO: 2127138 - RNA, 12 nt, Human
aaccucuucccc

SEQ ID NO: 2127139 - RNA, 15 nt, Human
gucuggcuucacaga

SEQ ID NO: 2127140 - RNA, 16 nt, Human
gucugggagaggcaga

SEQ ID NO: 2127141 - RNA, 17 nt, Human
gucugggagaggcagag

SEQ ID NO: 2127142 - RNA, 19 nt, Human
gucugggagaggcagagug

SEQ ID NO: 2127143 - RNA, 18 nt, Human
gucuucccuaccucaggc

SEQ ID NO: 2127144 - RNA, 21 nt, Human
gucuucccuaccucaggcagg

SEQ ID NO: 2127145 - RNA, 16 nt, Human
gucuucccuagggcug

SEQ ID NO: 2127146 - RNA, 17 nt, Human
gucuucccuagggcugg

SEQ ID NO: 2127147 - RNA, 18 nt, Human
gucuucccuagggcuggg

SEQ ID NO: 2127148 - RNA, 19 nt, Human
gucuucccuagggcugggu

SEQ ID NO: 2127149 - RNA, 20 nt, Human
gucuucccuagggcugggug

SEQ ID NO: 2127150 - RNA, 21 nt, Human
gucuucccuagggcugggugu

SEQ ID NO: 2127151 - RNA, 18 nt, Human
gucuuccugaaaugcagu

SEQ ID NO: 2127152 - RNA, 24 nt, Human
gucuuagacuugaaauacuacuua

SEQ ID NO: 2127153 - RNA, 18 nt, Human
gucuuagacuugaaauac

SEQ ID NO: 2127154 - RNA, 23 nt, Human
gucuuagacuugaaauacuacuu

SEQ ID NO: 2127155 - RNA, 16 nt, Human
gucuuagcagugauuu

SEQ ID NO: 2127156 - RNA, 16 nt, Human
gucuucccuaccucag

SEQ ID NO: 2127157 - RNA, 15 nt, Human
gucuuagauguauau

SEQ ID NO: 2127158 - RNA, 13 nt, Human
gucuuaauuaagu

SEQ ID NO: 2127159 - RNA, 15 nt, Human
gucuuaauuaaguaa

SEQ ID NO: 2127160 - RNA, 20 nt, Human
gucuuaauuaaguaaacuaa

SEQ ID NO: 2127161 - RNA, 19 nt, Human
gucuuagaaguggaccagg

SEQ ID NO: 2127162 - RNA, 20 nt, Human
gucuuagaaguggaccagga

SEQ ID NO: 2127163 - RNA, 22 nt, Human
gucuuagaaguggaccaggaca

SEQ ID NO: 2127164 - RNA, 23 nt, Human
gucuuagaaguggaccaggacag

SEQ ID NO: 2127165 - RNA, 22 nt, Human
gucuuucuuuggugccuuuccu

SEQ ID NO: 2127166 - RNA, 13 nt, Human
gucuuugauaaag

SEQ ID NO: 2127167 - RNA, 15 nt, Human
aaccugcucuccucu

SEQ ID NO: 2127168 - RNA, 11 nt, Human
aaccugcucuc

SEQ ID NO: 2127169 - RNA, 20 nt, Human
aaccugcucuccucuugcca

SEQ ID NO: 2127170 - RNA, 22 nt, Human
aaccugcuuucaagaccccugu

SEQ ID NO: 2127171 - RNA, 17 nt, Human
aaccuggaccaaagcug

SEQ ID NO: 2127172 - RNA, 18 nt, Human
aaccuggaccaaagcuga

SEQ ID NO: 2127173 - RNA, 11 nt, Human
aaccuggagau

SEQ ID NO: 2127174 - RNA, 17 nt, Human
aaccuggagauggggag

SEQ ID NO: 2127175 - RNA, 19 nt, Human
aacuaaucuauuggguuca

SEQ ID NO: 2127176 - RNA, 20 nt, Human
aacuaaucuauuggguucau

SEQ ID NO: 2127177 - RNA, 22 nt, Human
aacuaaucuauuggguucauua

SEQ ID NO: 2127178 - RNA, 12 nt, Human
aacuaaugaguu

SEQ ID NO: 2127179 - RNA, 13 nt, Human
aacuaaugaguuu

SEQ ID NO: 2127180 - RNA, 18 nt, Human
aacuccaguacuggagcu

SEQ ID NO: 2127181 - RNA, 19 nt, Human
aacuccaguacuggagcuu

SEQ ID NO: 2127182 - RNA, 13 nt, Human
aacucccaagaac

SEQ ID NO: 2127183 - RNA, 12 nt, Human
aacuaggaaaau

SEQ ID NO: 2127184 - RNA, 15 nt, Human
aacuaggaaaauugg

SEQ ID NO: 2127185 - RNA, 18 nt, Human
aacuagcuuggaaacugg

SEQ ID NO: 2127186 - RNA, 12 nt, Human
aacuagcuggaa

SEQ ID NO: 2127187 - RNA, 23 nt, Human
aacuagcuggaauuuuuuauucu

SEQ ID NO: 2127188 - RNA, 22 nt, Human
aacuagcuuacaugagaacaga

SEQ ID NO: 2127189 - RNA, 19 nt, Human
gugaaccaccacacccagc

SEQ ID NO: 2127190 - RNA, 15 nt, Human
aacucuaauagugcu

SEQ ID NO: 2127191 - RNA, 21 nt, Human
aacucuaauucccauuuugca

SEQ ID NO: 2127192 - RNA, 22 nt, Human
aacucuaauucccauuuugcaa

SEQ ID NO: 2127193 - RNA, 19 nt, Human
guucuuaguugcuguaugu

SEQ ID NO: 2127194 - RNA, 17 nt, Human
guucuuaguuugcaguu

SEQ ID NO: 2127195 - RNA, 14 nt, Human
guucuuacugcuug

SEQ ID NO: 2127196 - RNA, 18 nt, Human
guucuuagauaucuuuuu

SEQ ID NO: 2127197 - RNA, 14 nt, Human
guucuucaucuaag

SEQ ID NO: 2127198 - RNA, 14 nt, Human
guucuuguucuguu

SEQ ID NO: 2127199 - RNA, 16 nt, Human
guucuuguucuguuuu

SEQ ID NO: 2127200 - RNA, 18 nt, Human
guucuuguucuguuuugu

SEQ ID NO: 2127201 - RNA, 21 nt, Human
guugaggaguuuccuaaaagu

SEQ ID NO: 2127202 - RNA, 17 nt, Human
guugagggaacagacag

SEQ ID NO: 2127203 - RNA, 22 nt, Human
guugaugaucuuugcagacagg

SEQ ID NO: 2127204 - RNA, 16 nt, Human
guugagguggucugaa

SEQ ID NO: 2127205 - RNA, 21 nt, Human
guugaguucagguagcugccc

SEQ ID NO: 2127206 - RNA, 22 nt, Human
guugaguucagguagcugcccc

SEQ ID NO: 2127207 - RNA, 18 nt, Human
guugauaaauuccacugg

SEQ ID NO: 2127208 - RNA, 21 nt, Human
guugauaaauuccacuggacu

SEQ ID NO: 2127209 - RNA, 19 nt, Human
guugagggaacagacagga

SEQ ID NO: 2127210 - RNA, 22 nt, Human
guugagggaacagacaggagaa

SEQ ID NO: 2127211 - RNA, 23 nt, Human
guugagggaacagacaggagaaa

SEQ ID NO: 2127212 - RNA, 16 nt, Human
guugaggggcuccugg

SEQ ID NO: 2127213 - RNA, 17 nt, Human
guugaggggcuccugga

SEQ ID NO: 2127214 - RNA, 18 nt, Human
guugaggggcuccuggaa

SEQ ID NO: 2127215 - RNA, 20 nt, Human
guugagguggaagcccuccu

SEQ ID NO: 2127216 - RNA, 23 nt, Human
guugagguggaagcccuccuucc

SEQ ID NO: 2127217 - RNA, 23 nt, Human
guugagguggucugaauguucug

SEQ ID NO: 2127218 - RNA, 17 nt, Human
guucugguuagcucagc

SEQ ID NO: 2127219 - RNA, 21 nt, Human
guucugguuagcucagcccca

SEQ ID NO: 2127220 - RNA, 23 nt, Human
guucugguuagcucagccccagc

SEQ ID NO: 2127221 - RNA, 11 nt, Human
guucugggugg

SEQ ID NO: 2127222 - RNA, 18 nt, Human
guucugggugguugcccu

SEQ ID NO: 2127223 - RNA, 14 nt, Human
guucuggggccccu

SEQ ID NO: 2127224 - RNA, 15 nt, Human
guucuggggccccuu

SEQ ID NO: 2127225 - RNA, 17 nt, Human
guucuccucuccccucu

SEQ ID NO: 2127226 - RNA, 18 nt, Human
guucuccucuccccucua

SEQ ID NO: 2127227 - RNA, 22 nt, Human
guucccuuuccuuccaucccua

SEQ ID NO: 2127228 - RNA, 20 nt, Human
guucuacaaucuauuuauug

SEQ ID NO: 2127229 - RNA, 16 nt, Human
guucuacacucaucuu

SEQ ID NO: 2127230 - RNA, 19 nt, Human
aagcuuauuaaugcuaagg

SEQ ID NO: 2127231 - RNA, 14 nt, Human
aagcuuauuaaugc

SEQ ID NO: 2127232 - RNA, 15 nt, Human
aagcuuauuaaugcu

SEQ ID NO: 2127233 - RNA, 16 nt, Human
aagcuuauuaaugcua

SEQ ID NO: 2127234 - RNA, 17 nt, Human
aagcuuauuaaugcuaa

SEQ ID NO: 2127235 - RNA, 18 nt, Human
aagcuuauuaaugcuaag

SEQ ID NO: 2127236 - RNA, 20 nt, Human
aagcuuauuaaugcuaaggg

SEQ ID NO: 2127237 - RNA, 14 nt, Human
aagcuuauuuaauu

SEQ ID NO: 2127238 - RNA, 15 nt, Human
aagcuuccaggaaaa

SEQ ID NO: 2127239 - RNA, 16 nt, Human
aagcuuccaggaaaaa

SEQ ID NO: 2127240 - RNA, 21 nt, Human
aagcuuccaggaaaaaggaca

SEQ ID NO: 2127241 - RNA, 15 nt, Human
aagcugaagccgcca

SEQ ID NO: 2127242 - RNA, 13 nt, Human
aagcugaauacau

SEQ ID NO: 2127243 - RNA, 23 nt, Human
aagcugaauacauucugcuuuca

SEQ ID NO: 2127244 - RNA, 22 nt, Human
aagcuauucaguaauaacucua

SEQ ID NO: 2127245 - RNA, 21 nt, Human
aagcucuacugaggugcuaug

SEQ ID NO: 2127246 - RNA, 23 nt, Human
aagcuccugguauggguuucucc

SEQ ID NO: 2127247 - RNA, 19 nt, Human
aagcuccuggucuugagau

SEQ ID NO: 2127248 - RNA, 21 nt, Human
guucccagugacacuucagag

SEQ ID NO: 2127249 - RNA, 22 nt, Human
guucccagugacacuucagaga

SEQ ID NO: 2127250 - RNA, 19 nt, Human
guucccaccaggcugcuca

SEQ ID NO: 2127251 - RNA, 14 nt, Human
guucccacuuggag

SEQ ID NO: 2127252 - RNA, 20 nt, Human
guucccuacuuccugugacu

SEQ ID NO: 2127253 - RNA, 15 nt, Human
guucccucucccugu

SEQ ID NO: 2127254 - RNA, 17 nt, Human
guucccucucccuguug

SEQ ID NO: 2127255 - RNA, 18 nt, Human
guucccuuggccucagaa

SEQ ID NO: 2127256 - RNA, 19 nt, Human
guucccuuggccucagaau

SEQ ID NO: 2127257 - RNA, 19 nt, Human
guucccuuuccuuccaucc

SEQ ID NO: 2127258 - RNA, 17 nt, Human
guuccccuuugcuucau

SEQ ID NO: 2127259 - RNA, 14 nt, Human
guucccauguuaaa

SEQ ID NO: 2127260 - RNA, 11 nt, Human
aagccucugcu

SEQ ID NO: 2127261 - RNA, 14 nt, Human
aagccucugcugcc

SEQ ID NO: 2127262 - RNA, 12 nt, Human
aagccucuggcu

SEQ ID NO: 2127263 - RNA, 14 nt, Human
aagccucuggcuag

SEQ ID NO: 2127264 - RNA, 14 nt, Human
aagccugcaggagu

SEQ ID NO: 2127265 - RNA, 23 nt, Human
aagccucuggcuagaggccagcc

SEQ ID NO: 2127266 - RNA, 19 nt, Human
aagccuccuccagccgcca

SEQ ID NO: 2127267 - RNA, 20 nt, Human
guucauagggucucuucagg

SEQ ID NO: 2127268 - RNA, 22 nt, Human
guucauagggucucuucagguu

SEQ ID NO: 2127269 - RNA, 17 nt, Human
guucauagggucucuuc

SEQ ID NO: 2127270 - RNA, 18 nt, Human
guucauagggucucuuca

SEQ ID NO: 2127271 - RNA, 19 nt, Human
aagccugcuuuuuaagugu

SEQ ID NO: 2127272 - RNA, 21 nt, Human
aagccugccuaggaauuccca

SEQ ID NO: 2127273 - RNA, 23 nt, Human
aagccugccuaggaauucccagc

SEQ ID NO: 2127274 - RNA, 22 nt, Human
aagcuaggccuggccagaugca

SEQ ID NO: 2127275 - RNA, 16 nt, Human
aagcuaggccuggcca

SEQ ID NO: 2127276 - RNA, 20 nt, Human
aagcuauagacccgaggaaa

SEQ ID NO: 2127277 - RNA, 18 nt, Human
aagcuaggccuggccaga

SEQ ID NO: 2127278 - RNA, 17 nt, Human
aagcuaggccuggccag

SEQ ID NO: 2127279 - RNA, 17 nt, Human
guucagcuccagcucac

SEQ ID NO: 2127280 - RNA, 16 nt, Human
guucagcuccagcuca

SEQ ID NO: 2127281 - RNA, 18 nt, Human
guucagcuccagcucacc

SEQ ID NO: 2127282 - RNA, 20 nt, Human
guucaggggacucagcccug

SEQ ID NO: 2127283 - RNA, 14 nt, Human
guuauuucuuguuu

SEQ ID NO: 2127284 - RNA, 15 nt, Human
guuauuuaaaugagu

SEQ ID NO: 2127285 - RNA, 11 nt, Human
guuauuuaaau

SEQ ID NO: 2127286 - RNA, 13 nt, Human
guuauuuaaauga

SEQ ID NO: 2127287 - RNA, 19 nt, Human
guucaggguuggccccugc

SEQ ID NO: 2127288 - RNA, 18 nt, Human
guucaggguuggccccug

SEQ ID NO: 2127289 - RNA, 17 nt, Human
guucaggguuggccccu

SEQ ID NO: 2127290 - RNA, 19 nt, Human
guucauaacagugccauug

SEQ ID NO: 2127291 - RNA, 20 nt, Human
guucauaacagugccauugu

SEQ ID NO: 2127292 - RNA, 22 nt, Human
guucauaacagugccauugucu

SEQ ID NO: 2127293 - RNA, 23 nt, Human
guucauaacagugccauugucuu

SEQ ID NO: 2127294 - RNA, 24 nt, Human
guucauaacagugccauugucuuu

SEQ ID NO: 2127295 - RNA, 15 nt, Human
guguuucccauaauu

SEQ ID NO: 2127296 - RNA, 20 nt, Human
guguuuccuucauuucugau

SEQ ID NO: 2127297 - RNA, 12 nt, Human
guguuucccaua

SEQ ID NO: 2127298 - RNA, 11 nt, Human
guguuucuagg

SEQ ID NO: 2127299 - RNA, 15 nt, Human
guguuucuagggaaa

SEQ ID NO: 2127300 - RNA, 12 nt, Human
guguuuguguga

SEQ ID NO: 2127301 - RNA, 16 nt, Human
guguuuuaaagagaau

SEQ ID NO: 2127302 - RNA, 18 nt, Human
guguuuuaaagagaaugu

SEQ ID NO: 2127303 - RNA, 22 nt, Human
guuaaguugauggugaugaaau

SEQ ID NO: 2127304 - RNA, 22 nt, Human
guuaagucuaaauauuuccuua

SEQ ID NO: 2127305 - RNA, 17 nt, Human
guuaaggcugaggaaag

SEQ ID NO: 2127306 - RNA, 16 nt, Human
guuaaggcugaggaaa

SEQ ID NO: 2127307 - RNA, 18 nt, Human
guuaaugauagcuacugu

SEQ ID NO: 2127308 - RNA, 16 nt, Human
guuaaucuugcuuucu

SEQ ID NO: 2127309 - RNA, 17 nt, Human
guuaaugaaaaugucag

SEQ ID NO: 2127310 - RNA, 13 nt, Human
guuaaucuugcuu

SEQ ID NO: 2127311 - RNA, 21 nt, Human
guuaaucuugcuuucuuuguu

SEQ ID NO: 2127312 - RNA, 16 nt, Human
guuaaugaaaauguca

SEQ ID NO: 2127313 - RNA, 12 nt, Human
guuaaucuuagg

SEQ ID NO: 2127314 - RNA, 14 nt, Human
guuaagugguuuca

SEQ ID NO: 2127315 - RNA, 23 nt, Human
guuaaguuggcuucuguuucuag

SEQ ID NO: 2127316 - RNA, 21 nt, Human
guuaguagcauguugagccag

SEQ ID NO: 2127317 - RNA, 16 nt, Human
guuaguaucuaacaug

SEQ ID NO: 2127318 - RNA, 17 nt, Human
guuaguaucuaacaugu

SEQ ID NO: 2127319 - RNA, 13 nt, Human
guuaguagaaauu

SEQ ID NO: 2127320 - RNA, 16 nt, Human
guuaguagcauguuga

SEQ ID NO: 2127321 - RNA, 11 nt, Human
guuagggaggg

SEQ ID NO: 2127322 - RNA, 13 nt, Human
guuagggaggggu

SEQ ID NO: 2127323 - RNA, 20 nt, Human
guuagguuuaacauaaaggu

SEQ ID NO: 2127324 - RNA, 21 nt, Human
guuagguagagggaguuguca

SEQ ID NO: 2127325 - RNA, 23 nt, Human
guuagggugcucuggaagagagg

SEQ ID NO: 2127326 - RNA, 18 nt, Human
guuagguagagggaguug

SEQ ID NO: 2127327 - RNA, 21 nt, Human
guuacacacuuuuuaagaaau

SEQ ID NO: 2127328 - RNA, 21 nt, Human
guuagcucagccccagcccag

SEQ ID NO: 2127329 - RNA, 23 nt, Human
guuagcucagccccagcccagcc

SEQ ID NO: 2127330 - RNA, 20 nt, Human
guuagcucaggaggcuugga

SEQ ID NO: 2127331 - RNA, 9 nt, Human
guuacaaac

SEQ ID NO: 2127332 - RNA, 13 nt, Human
guuacaaacugca

SEQ ID NO: 2127333 - RNA, 14 nt, Human
guuacaaacugcaa

SEQ ID NO: 2127334 - RNA, 15 nt, Human
guuacaaacugcaau

SEQ ID NO: 2127335 - RNA, 16 nt, Human
guuacaaacugcaaua

SEQ ID NO: 2127336 - RNA, 19 nt, Human
guuacaaacugcaauagag

SEQ ID NO: 2127337 - RNA, 21 nt, Human
guuacaaacugcaauagagac

SEQ ID NO: 2127338 - RNA, 23 nt, Human
guuacaaacugcaauagagacug

SEQ ID NO: 2127339 - RNA, 23 nt, Human
guuucuaacacuagucugugugc

SEQ ID NO: 2127340 - RNA, 16 nt, Human
guuugccucugccucu

SEQ ID NO: 2127341 - RNA, 13 nt, Human
guuugccucugcc

SEQ ID NO: 2127342 - RNA, 15 nt, Human
guuugcacacuugug

SEQ ID NO: 2127343 - RNA, 21 nt, Human
guuugauuuuagcugcagaac

SEQ ID NO: 2127344 - RNA, 17 nt, Human
guuugcaaggaagccac

SEQ ID NO: 2127345 - RNA, 22 nt, Human
guuugcaaggaagccacagcug

SEQ ID NO: 2127346 - RNA, 13 nt, Human
guuugcaaggaag

SEQ ID NO: 2127347 - RNA, 14 nt, Human
guuugcaaggaagc

SEQ ID NO: 2127348 - RNA, 15 nt, Human
guuugcaaggaagcc

SEQ ID NO: 2127349 - RNA, 22 nt, Human
guuuggggaaugcggccgcauu

SEQ ID NO: 2127350 - RNA, 15 nt, Human
guuuggggagcagag

SEQ ID NO: 2127351 - RNA, 18 nt, Human
guuuggggaugagaaagg

SEQ ID NO: 2127352 - RNA, 23 nt, Human
guuuuacaauaaaaucuugaaaa

SEQ ID NO: 2127353 - RNA, 20 nt, Human
guuuggggagcagagacacu

SEQ ID NO: 2127354 - RNA, 13 nt, Human
guuuuagaaugau

SEQ ID NO: 2127355 - RNA, 12 nt, Human
guuuucuuccca

SEQ ID NO: 2127356 - RNA, 15 nt, Human
guuuucuucccauca

SEQ ID NO: 2127357 - RNA, 20 nt, Human
guuuucuucccaucacugga

SEQ ID NO: 2127358 - RNA, 14 nt, Human
guuuuaguugcaga

SEQ ID NO: 2127359 - RNA, 21 nt, Human
guuuuaguugcagaaacauuu

SEQ ID NO: 2127360 - RNA, 17 nt, Human
aagguaaaacaaaucag

SEQ ID NO: 2127361 - RNA, 14 nt, Human
aagguaaaauucua

SEQ ID NO: 2127362 - RNA, 15 nt, Human
aagguaaaauucuaa

SEQ ID NO: 2127363 - RNA, 16 nt, Human
aagguaaaauucuaaa

SEQ ID NO: 2127364 - RNA, 17 nt, Human
aagguaaaauucuaaau

SEQ ID NO: 2127365 - RNA, 12 nt, Human
aagguaaaauug

SEQ ID NO: 2127366 - RNA, 19 nt, Human
aaggguuuuccacccugga

SEQ ID NO: 2127367 - RNA, 21 nt, Human
aaggguuuuccacccuggaau

SEQ ID NO: 2127368 - RNA, 14 nt, Human
aagggguuucuaac

SEQ ID NO: 2127369 - RNA, 20 nt, Human
aagggguugguugaggugga

SEQ ID NO: 2127370 - RNA, 16 nt, Human
aaggguaucaggugcu

SEQ ID NO: 2127371 - RNA, 16 nt, Human
aagguaaaauugaaag

SEQ ID NO: 2127372 - RNA, 15 nt, Human
guuucaaaauaaaaa

SEQ ID NO: 2127373 - RNA, 16 nt, Human
guuucaaaauaaaaac

SEQ ID NO: 2127374 - RNA, 19 nt, Human
guuucaaaauaaaaaccaa

SEQ ID NO: 2127375 - RNA, 23 nt, Human
guuucaaaauaaaaaccaagaag

SEQ ID NO: 2127376 - RNA, 19 nt, Human
aaggcuucaauuuauugca

SEQ ID NO: 2127377 - RNA, 23 nt, Human
aaggcuucaauuuauugcacaaa

SEQ ID NO: 2127378 - RNA, 16 nt, Human
aaggcuuucagggccu

SEQ ID NO: 2127379 - RNA, 17 nt, Human
aaggcuuucagggccuc

SEQ ID NO: 2127380 - RNA, 22 nt, Human
aaggcuuucagggccuccagcc

SEQ ID NO: 2127381 - RNA, 18 nt, Human
aaggggaagcacucgugu

SEQ ID NO: 2127382 - RNA, 17 nt, Human
aaggggugccugggaac

SEQ ID NO: 2127383 - RNA, 23 nt, Human
aaggggaauguuugccucugccu

SEQ ID NO: 2127384 - RNA, 22 nt, Human
aaggggaauguuugccucugcc

SEQ ID NO: 2127385 - RNA, 13 nt, Human
guuggguggaugc

SEQ ID NO: 2127386 - RNA, 13 nt, Human
guugguaguuucu

SEQ ID NO: 2127387 - RNA, 16 nt, Human
guuggucgguggguug

SEQ ID NO: 2127388 - RNA, 19 nt, Human
guugcugucauaagaauga

SEQ ID NO: 2127389 - RNA, 14 nt, Human
guugguguguuuuu

SEQ ID NO: 2127390 - RNA, 15 nt, Human
guugguguguuuuug

SEQ ID NO: 2127391 - RNA, 15 nt, Human
guugguguugcagaa

SEQ ID NO: 2127392 - RNA, 14 nt, Human
guuguaguaaagaa

SEQ ID NO: 2127393 - RNA, 17 nt, Human
guuuaagaccagccugg

SEQ ID NO: 2127394 - RNA, 12 nt, Human
guuuaagauuua

SEQ ID NO: 2127395 - RNA, 21 nt, Human
guuuaagauuuaauuugccaa

SEQ ID NO: 2127396 - RNA, 23 nt, Human
guuuaagauuuaauuugccaaaa

SEQ ID NO: 2127397 - RNA, 23 nt, Human
guuuaagaaaaaauaacacacau

SEQ ID NO: 2127398 - RNA, 12 nt, Human
guuuaacauaaa

SEQ ID NO: 2127399 - RNA, 13 nt, Human
guuuaacauaaag

SEQ ID NO: 2127400 - RNA, 15 nt, Human
guuuaacauaaaggu

SEQ ID NO: 2127401 - RNA, 22 nt, Human
guuuaacggcacuguggccuug

SEQ ID NO: 2127402 - RNA, 19 nt, Human
guuuaaaagacacacuugu

SEQ ID NO: 2127403 - RNA, 23 nt, Human
guuuaaaagacacacuuguccac

SEQ ID NO: 2127404 - RNA, 12 nt, Human
guuuaaacugau

SEQ ID NO: 2127405 - RNA, 16 nt, Human
guuuaaacugauucau

SEQ ID NO: 2127406 - RNA, 21 nt, Human
guuuaaacugauucauaauaa

SEQ ID NO: 2127407 - RNA, 13 nt, Human
guuuauuaacaaa

SEQ ID NO: 2127408 - RNA, 18 nt, Human
guuuauuaacaaauuaug

SEQ ID NO: 2127409 - RNA, 23 nt, Human
guuuauuaacaaauuauguuaca

SEQ ID NO: 2127410 - RNA, 18 nt, Human
guuuauuuuuauauagcu

SEQ ID NO: 2127411 - RNA, 15 nt, Human
aaggcuacucaccuu

SEQ ID NO: 2127412 - RNA, 20 nt, Human
guugcccagggauuuguccu

SEQ ID NO: 2127413 - RNA, 15 nt, Human
guugcccaggcaggu

SEQ ID NO: 2127414 - RNA, 21 nt, Human
guugcccaggcuggcgugcag

SEQ ID NO: 2127415 - RNA, 19 nt, Human
guugcccaggcaggucuug

SEQ ID NO: 2127416 - RNA, 18 nt, Human
guugcccaggcaggucuu

SEQ ID NO: 2127417 - RNA, 17 nt, Human
guugcccaggcaggucu

SEQ ID NO: 2127418 - RNA, 12 nt, Human
aaggccaccugc

SEQ ID NO: 2127419 - RNA, 14 nt, Human
aaggccaccugcag

SEQ ID NO: 2127420 - RNA, 19 nt, Human
aaggccaagaggcuguucc

SEQ ID NO: 2127421 - RNA, 17 nt, Human
aaggccagaguggccug

SEQ ID NO: 2127422 - RNA, 19 nt, Human
aaggccagaguggccuggc

SEQ ID NO: 2127423 - RNA, 20 nt, Human
aaggccagaguggccuggcc

SEQ ID NO: 2127424 - RNA, 21 nt, Human
aaggccagaguggccuggcca

SEQ ID NO: 2127425 - RNA, 22 nt, Human
aaggccagaguggccuggccag

SEQ ID NO: 2127426 - RNA, 23 nt, Human
aaggccagaguggccuggccagg

SEQ ID NO: 2127427 - RNA, 15 nt, Human
aaggcuauacuuguc

SEQ ID NO: 2127428 - RNA, 16 nt, Human
aaggcucagucucagg

SEQ ID NO: 2127429 - RNA, 17 nt, Human
aaggcucagucucagga

SEQ ID NO: 2127430 - RNA, 23 nt, Human
guugaugaucuuugcagacaggc

SEQ ID NO: 2127431 - RNA, 17 nt, Human
aaggauguaaacagugc

SEQ ID NO: 2127432 - RNA, 19 nt, Human
aaggauguaaacagugccu

SEQ ID NO: 2127433 - RNA, 20 nt, Human
aaggauguaaacagugccug

SEQ ID NO: 2127434 - RNA, 23 nt, Human
aaggauguaaacagugccugcug

SEQ ID NO: 2127435 - RNA, 15 nt, Human
aaggauguacauuuc

SEQ ID NO: 2127436 - RNA, 16 nt, Human
aaggauguacauuucc

SEQ ID NO: 2127437 - RNA, 23 nt, Human
aaggaugaaugaggucccaggca

SEQ ID NO: 2127438 - RNA, 15 nt, Human
aagcaagauuucaga

SEQ ID NO: 2127439 - RNA, 17 nt, Human
aagcaagagagauguuu

SEQ ID NO: 2127440 - RNA, 14 nt, Human
aagcaauaaaugaa

SEQ ID NO: 2127441 - RNA, 16 nt, Human
aagcaauaaaugaaug

SEQ ID NO: 2127442 - RNA, 15 nt, Human
aagcaagaaagaaac

SEQ ID NO: 2127443 - RNA, 15 nt, Human
aagcaagagagaugu

SEQ ID NO: 2127444 - RNA, 18 nt, Human
aagcaagagagauguuuu

SEQ ID NO: 2127445 - RNA, 11 nt, Human
aagcaaaggug

SEQ ID NO: 2127446 - RNA, 17 nt, Human
aagcaaaggugaagaga

SEQ ID NO: 2127447 - RNA, 22 nt, Human
aagcaaagacuuuccucuuagu

SEQ ID NO: 2127448 - RNA, 16 nt, Human
aagaugccaucugugu

SEQ ID NO: 2127449 - RNA, 24 nt, Human
aagaugcccacugaggaaugauga

SEQ ID NO: 2127450 - RNA, 22 nt, Human
aagaugcucagguacagagaag

SEQ ID NO: 2127451 - RNA, 15 nt, Human
aagaugcucuuuuaa

SEQ ID NO: 2127452 - RNA, 20 nt, Human
aagauguccuccuuguucua

SEQ ID NO: 2127453 - RNA, 21 nt, Human
aagaugcugaaacaggagaga

SEQ ID NO: 2127454 - RNA, 18 nt, Human
aagagguuuuaaaaaaau

SEQ ID NO: 2127455 - RNA, 23 nt, Human
gugguuucagcaauauuuaagga

SEQ ID NO: 2127456 - RNA, 23 nt, Human
gugguuuccaaggagcugagaau

SEQ ID NO: 2127457 - RNA, 13 nt, Human
aagaucuuucagg

SEQ ID NO: 2127458 - RNA, 19 nt, Human
aagagguucucgacuggag

SEQ ID NO: 2127459 - RNA, 13 nt, Human
aagauauuauuca

SEQ ID NO: 2127460 - RNA, 21 nt, Human
guguguaugacuaaagagaga

SEQ ID NO: 2127461 - RNA, 18 nt, Human
guguguaugggugugugu

SEQ ID NO: 2127462 - RNA, 20 nt, Human
guguguaugugcgugugugc

SEQ ID NO: 2127463 - RNA, 16 nt, Human
gugugucuccugcaug

SEQ ID NO: 2127464 - RNA, 19 nt, Human
gugugucuccugcaugcag

SEQ ID NO: 2127465 - RNA, 15 nt, Human
guguugaucccaaga

SEQ ID NO: 2127466 - RNA, 13 nt, Human
guguugcagaagg

SEQ ID NO: 2127467 - RNA, 18 nt, Human
guguugcgugucgugggu

SEQ ID NO: 2127468 - RNA, 20 nt, Human
guguugcccaggcuggucuc

SEQ ID NO: 2127469 - RNA, 21 nt, Human
guguuggcuaaugaagggaaa

SEQ ID NO: 2127470 - RNA, 21 nt, Human
guguuggcuugugaucuggga

SEQ ID NO: 2127471 - RNA, 22 nt, Human
guguuggcuugugaucugggaa

SEQ ID NO: 2127472 - RNA, 19 nt, Human
guguugucagcaucuucuc

SEQ ID NO: 2127473 - RNA, 18 nt, Human
gugucuuuuuucacuaca

SEQ ID NO: 2127474 - RNA, 17 nt, Human
gugugacuacuccccca

SEQ ID NO: 2127475 - RNA, 14 nt, Human
guguguagccaagg

SEQ ID NO: 2127476 - RNA, 16 nt, Human
gugugaggagcugcug

SEQ ID NO: 2127477 - RNA, 18 nt, Human
gugugaggagcugcuggc

SEQ ID NO: 2127478 - RNA, 19 nt, Human
gugugaggagcugcuggcu

SEQ ID NO: 2127479 - RNA, 16 nt, Human
aagcaauccuccugag

SEQ ID NO: 2127480 - RNA, 18 nt, Human
aagcaauccuccugagug

SEQ ID NO: 2127481 - RNA, 13 nt, Human
aagcaauugcugc

SEQ ID NO: 2127482 - RNA, 17 nt, Human
aagcaauugcugcaucu

SEQ ID NO: 2127483 - RNA, 12 nt, Human
gugucuuccaua

SEQ ID NO: 2127484 - RNA, 13 nt, Human
gugucuuccauaa

SEQ ID NO: 2127485 - RNA, 15 nt, Human
gugucuuccauaaug

SEQ ID NO: 2127486 - RNA, 18 nt, Human
gugucuugcaauggcagc

SEQ ID NO: 2127487 - RNA, 17 nt, Human
gugucuugcaauggcag

SEQ ID NO: 2127488 - RNA, 21 nt, Human
gugucuuucuuuggugccuuu

SEQ ID NO: 2127489 - RNA, 22 nt, Human
gugucuuucuuuggugccuuuc

SEQ ID NO: 2127490 - RNA, 15 nt, Human
aagagcaagucugga

SEQ ID NO: 2127491 - RNA, 18 nt, Human
aagacuguggcugcuagc

SEQ ID NO: 2127492 - RNA, 20 nt, Human
aagagccuugguguccaccu

SEQ ID NO: 2127493 - RNA, 21 nt, Human
aagagccuugguguccaccug

SEQ ID NO: 2127494 - RNA, 22 nt, Human
aagagccuugguguccaccugg

SEQ ID NO: 2127495 - RNA, 17 nt, Human
aagagcuuuacaaaaag

SEQ ID NO: 2127496 - RNA, 18 nt, Human
aagagcuuuacaaaaaga

SEQ ID NO: 2127497 - RNA, 15 nt, Human
aagaggaacugggcc

SEQ ID NO: 2127498 - RNA, 16 nt, Human
aagaggaacugggccu

SEQ ID NO: 2127499 - RNA, 19 nt, Human
guggcccgacagccuggca

SEQ ID NO: 2127500 - RNA, 18 nt, Human
guggcccgacagccuggc

SEQ ID NO: 2127501 - RNA, 16 nt, Human
aagacuaucuaaaugu

SEQ ID NO: 2127502 - RNA, 17 nt, Human
aagacuaucuaaauguu

SEQ ID NO: 2127503 - RNA, 20 nt, Human
aagacccuuuuggguuucug

SEQ ID NO: 2127504 - RNA, 17 nt, Human
aagacccuuuuggguuu

SEQ ID NO: 2127505 - RNA, 18 nt, Human
aagaccggaagcuccugg

SEQ ID NO: 2127506 - RNA, 19 nt, Human
aagaccggaagcuccuggu

SEQ ID NO: 2127507 - RNA, 17 nt, Human
aagacuguacaaaguag

SEQ ID NO: 2127508 - RNA, 12 nt, Human
aagacuguggcu

SEQ ID NO: 2127509 - RNA, 15 nt, Human
aagacuguggcugcu

SEQ ID NO: 2127510 - RNA, 18 nt, Human
aagacuaucuaaauguug

SEQ ID NO: 2127511 - RNA, 20 nt, Human
aagaccuucuccccauucug

SEQ ID NO: 2127512 - RNA, 21 nt, Human
aagaccuucuccaaaugagau

SEQ ID NO: 2127513 - RNA, 17 nt, Human
guggggugaggaccacu

SEQ ID NO: 2127514 - RNA, 22 nt, Human
guggguaagacuaaaucuguaa

SEQ ID NO: 2127515 - RNA, 15 nt, Human
guggguacagagagg

SEQ ID NO: 2127516 - RNA, 15 nt, Human
gugggagucaucuca

SEQ ID NO: 2127517 - RNA, 17 nt, Human
gugggauaucccuaugc

SEQ ID NO: 2127518 - RNA, 14 nt, Human
gugggggcagaggg

SEQ ID NO: 2127519 - RNA, 17 nt, Human
gugggggcagagggcag

SEQ ID NO: 2127520 - RNA, 18 nt, Human
gugggggcagagggcaga

SEQ ID NO: 2127521 - RNA, 20 nt, Human
gugggggaucacagccucug

SEQ ID NO: 2127522 - RNA, 22 nt, Human
gugggggcagagggcagaggcu

SEQ ID NO: 2127523 - RNA, 12 nt, Human
gugguggcucug

SEQ ID NO: 2127524 - RNA, 15 nt, Human
gugguggcucugaga

SEQ ID NO: 2127525 - RNA, 18 nt, Human
guggugggacagggaccc

SEQ ID NO: 2127526 - RNA, 13 nt, Human
gugggucuucagg

SEQ ID NO: 2127527 - RNA, 19 nt, Human
guggguggaaccaggaacc

SEQ ID NO: 2127528 - RNA, 17 nt, Human
gugggucuucagggggc

SEQ ID NO: 2127529 - RNA, 21 nt, Human
gugggucuucagggggccagg

SEQ ID NO: 2127530 - RNA, 13 nt, Human
gugggugaaagaa

SEQ ID NO: 2127531 - RNA, 18 nt, Human
gugggugaaagaaaucau

SEQ ID NO: 2127532 - RNA, 20 nt, Human
gugggugaaagaaaucaugu

SEQ ID NO: 2127533 - RNA, 21 nt, Human
gugggugaaagaaaucauguu

SEQ ID NO: 2127534 - RNA, 23 nt, Human
gugggaggaucucuugagccugg

SEQ ID NO: 2127535 - RNA, 14 nt, Human
gugggacuguacac

SEQ ID NO: 2127536 - RNA, 15 nt, Human
gugggacuguacaca

SEQ ID NO: 2127537 - RNA, 22 nt, Human
gugggacuguacacacuuuauu

SEQ ID NO: 2127538 - RNA, 13 nt, Human
guggcccuggccu

SEQ ID NO: 2127539 - RNA, 16 nt, Human
guggcccuggccugcu

SEQ ID NO: 2127540 - RNA, 17 nt, Human
guggcccuggccugcug

SEQ ID NO: 2127541 - RNA, 18 nt, Human
guggcccuggccugcugg

SEQ ID NO: 2127542 - RNA, 19 nt, Human
guggcccuggccugcuggg

SEQ ID NO: 2127543 - RNA, 21 nt, Human
guggcuaaaggucccaaggca

SEQ ID NO: 2127544 - RNA, 23 nt, Human
guggcuaaaggucccaaggcaag

SEQ ID NO: 2127545 - RNA, 13 nt, Human
guggcggugccug

SEQ ID NO: 2127546 - RNA, 14 nt, Human
guggcggugccugg

SEQ ID NO: 2127547 - RNA, 17 nt, Human
guggcggugccugggug

SEQ ID NO: 2127548 - RNA, 15 nt, Human
gugggacagagucug

SEQ ID NO: 2127549 - RNA, 19 nt, Human
guggaaguaguggagcccc

SEQ ID NO: 2127550 - RNA, 20 nt, Human
gugcugggauuacaggugug

SEQ ID NO: 2127551 - RNA, 22 nt, Human
gugcugggauuacaagcgugag

SEQ ID NO: 2127552 - RNA, 21 nt, Human
gugcugggauuacaagcguga

SEQ ID NO: 2127553 - RNA, 15 nt, Human
gugcugggagggaua

SEQ ID NO: 2127554 - RNA, 18 nt, Human
gugcuggcugcccagacc

SEQ ID NO: 2127555 - RNA, 15 nt, Human
gugcuggcugcccag

SEQ ID NO: 2127556 - RNA, 12 nt, Human
gugcuauguucu

SEQ ID NO: 2127557 - RNA, 19 nt, Human
gugcuauggauggcuucua

SEQ ID NO: 2127558 - RNA, 13 nt, Human
gugcuaugaauuu

SEQ ID NO: 2127559 - RNA, 21 nt, Human
guggaugccugguggcagcug

SEQ ID NO: 2127560 - RNA, 22 nt, Human
guggacccagggaugacauguc

SEQ ID NO: 2127561 - RNA, 13 nt, Human
guggaccaggaca

SEQ ID NO: 2127562 - RNA, 14 nt, Human
guggaccaggacag

SEQ ID NO: 2127563 - RNA, 18 nt, Human
guggaccaggacaggacc

SEQ ID NO: 2127564 - RNA, 16 nt, Human
guggacaguccuggga

SEQ ID NO: 2127565 - RNA, 14 nt, Human
guggacaguccugg

SEQ ID NO: 2127566 - RNA, 15 nt, Human
guggacaguccuggg

SEQ ID NO: 2127567 - RNA, 22 nt, Human
guggacacagcucuucuccagg

SEQ ID NO: 2127568 - RNA, 18 nt, Human
guggacacagcucuucuc

SEQ ID NO: 2127569 - RNA, 23 nt, Human
guggacacagcucuucuccaggc

SEQ ID NO: 2127570 - RNA, 13 nt, Human
guggacaguccug

SEQ ID NO: 2127571 - RNA, 13 nt, Human
guggaauauaaag

SEQ ID NO: 2127572 - RNA, 18 nt, Human
guggaauauaaggaaagc

SEQ ID NO: 2127573 - RNA, 19 nt, Human
guggcaccagcagccugga

SEQ ID NO: 2127574 - RNA, 18 nt, Human
guggcaccagcagccugg

SEQ ID NO: 2127575 - RNA, 12 nt, Human
guggcagcccug

SEQ ID NO: 2127576 - RNA, 13 nt, Human
guggcagcccugu

SEQ ID NO: 2127577 - RNA, 15 nt, Human
aagaaucccuguuca

SEQ ID NO: 2127578 - RNA, 21 nt, Human
aagaaucccuguucauuguaa

SEQ ID NO: 2127579 - RNA, 23 nt, Human
aagaaucgaugggggaugcuuca

SEQ ID NO: 2127580 - RNA, 14 nt, Human
guggcagcccugua

SEQ ID NO: 2127581 - RNA, 22 nt, Human
aagaaucauuauuuauuaaauu

SEQ ID NO: 2127582 - RNA, 22 nt, Human
aagaaucauuguaaacauuagu

SEQ ID NO: 2127583 - RNA, 23 nt, Human
aagaaucauuguaaacauuaguu

SEQ ID NO: 2127584 - RNA, 15 nt, Human
aagaaugcugguuuu

SEQ ID NO: 2127585 - RNA, 18 nt, Human
aagaaugcugguuuuccu

SEQ ID NO: 2127586 - RNA, 19 nt, Human
aagaaugcugguuuuccua

SEQ ID NO: 2127587 - RNA, 15 nt, Human
aagaaugucagaaaa

SEQ ID NO: 2127588 - RNA, 23 nt, Human
aagaaugucagaaaaacaauaag

SEQ ID NO: 2127589 - RNA, 17 nt, Human
aagaaugucgauuaaaa

SEQ ID NO: 2127590 - RNA, 18 nt, Human
aagaaugucgauuaaaau

SEQ ID NO: 2127591 - RNA, 16 nt, Human
aagaauugaagcagga

SEQ ID NO: 2127592 - RNA, 22 nt, Human
aagaaugcugguuuuccuaaau

SEQ ID NO: 2127593 - RNA, 12 nt, Human
aagacaacauua

SEQ ID NO: 2127594 - RNA, 16 nt, Human
aagacaaauucuguuu

SEQ ID NO: 2127595 - RNA, 18 nt, Human
aagacaaauucuguuucu

SEQ ID NO: 2127596 - RNA, 13 nt, Human
aagacccugucuc

SEQ ID NO: 2127597 - RNA, 14 nt, Human
aagacaaaaauacu

SEQ ID NO: 2127598 - RNA, 15 nt, Human
aagacaaaaauacuc

SEQ ID NO: 2127599 - RNA, 16 nt, Human
aagacaaaaauacucu

SEQ ID NO: 2127600 - RNA, 18 nt, Human
aagacaaaaauacucuaa

SEQ ID NO: 2127601 - RNA, 21 nt, Human
aagacaaaaauacucuaauuc

SEQ ID NO: 2127602 - RNA, 22 nt, Human
aagacaaaaauacucuaauucu

SEQ ID NO: 2127603 - RNA, 15 nt, Human
aagaauuucaauuug

SEQ ID NO: 2127604 - RNA, 19 nt, Human
aagaauugaacccaggagg

SEQ ID NO: 2127605 - RNA, 20 nt, Human
aagaauugaacccaggaggu

SEQ ID NO: 2127606 - RNA, 13 nt, Human
gugccucugccug

SEQ ID NO: 2127607 - RNA, 12 nt, Human
gugccucuggga

SEQ ID NO: 2127608 - RNA, 13 nt, Human
gugccucugggac

SEQ ID NO: 2127609 - RNA, 15 nt, Human
gugccucugccuguc

SEQ ID NO: 2127610 - RNA, 22 nt, Human
gugccguuacucuccaaccugg

SEQ ID NO: 2127611 - RNA, 15 nt, Human
gugccguuacucucc

SEQ ID NO: 2127612 - RNA, 18 nt, Human
gugccguuacucuccaac

SEQ ID NO: 2127613 - RNA, 21 nt, Human
gugccguuacucuccaaccug

SEQ ID NO: 2127614 - RNA, 18 nt, Human
gugccuauagucccagcu

SEQ ID NO: 2127615 - RNA, 21 nt, Human
gugaaccaccacacccagccc

SEQ ID NO: 2127616 - RNA, 14 nt, Human
aagaaaaaaauaau

SEQ ID NO: 2127617 - RNA, 20 nt, Human
aagaaaaaaauaauuuuaug

SEQ ID NO: 2127618 - RNA, 23 nt, Human
aagaaaaaaauaauuuuaugaac

SEQ ID NO: 2127619 - RNA, 24 nt, Human
aagaaaaaaauaauuuuaugaacu

SEQ ID NO: 2127620 - RNA, 16 nt, Human
aagaaaaaaaauaaca

SEQ ID NO: 2127621 - RNA, 18 nt, Human
aagaaaaaaaauaacaca

SEQ ID NO: 2127622 - RNA, 20 nt, Human
aagaaaaaaaauaacacaga

SEQ ID NO: 2127623 - RNA, 12 nt, Human
aacuuuaauaug

SEQ ID NO: 2127624 - RNA, 14 nt, Human
aacuuuaauaugua

SEQ ID NO: 2127625 - RNA, 15 nt, Human
aacuuuaauauguau

SEQ ID NO: 2127626 - RNA, 16 nt, Human
aacuuuaauauguauu

SEQ ID NO: 2127627 - RNA, 19 nt, Human
aacuuuaauauguauuuua

SEQ ID NO: 2127628 - RNA, 12 nt, Human
aacuugucuuaa

SEQ ID NO: 2127629 - RNA, 13 nt, Human
aacuugucuuaaa

SEQ ID NO: 2127630 - RNA, 17 nt, Human
aacuugucuuaaauaaa

SEQ ID NO: 2127631 - RNA, 19 nt, Human
aacuuggggaacaagggug

SEQ ID NO: 2127632 - RNA, 12 nt, Human
aacuugggaacu

SEQ ID NO: 2127633 - RNA, 13 nt, Human
aacuuggggaaca

SEQ ID NO: 2127634 - RNA, 21 nt, Human
gugccucuggaggccucuggg

SEQ ID NO: 2127635 - RNA, 22 nt, Human
gugccucuggaggccucugggc

SEQ ID NO: 2127636 - RNA, 13 nt, Human
aagaauacagaaa

SEQ ID NO: 2127637 - RNA, 16 nt, Human
aagaaguguccgagaa

SEQ ID NO: 2127638 - RNA, 18 nt, Human
aagaaguguccgagaacu

SEQ ID NO: 2127639 - RNA, 19 nt, Human
aagaaguguccgagaacua

SEQ ID NO: 2127640 - RNA, 18 nt, Human
aagaauacaaacauauuu

SEQ ID NO: 2127641 - RNA, 22 nt, Human
aagaauacaaacauauuuguua

SEQ ID NO: 2127642 - RNA, 14 nt, Human
aagaauacagaaag

SEQ ID NO: 2127643 - RNA, 19 nt, Human
aagaaggcagcagguggca

SEQ ID NO: 2127644 - RNA, 19 nt, Human
aagaagugaccaaggagga

SEQ ID NO: 2127645 - RNA, 20 nt, Human
aagaagugaccaaggaggag

SEQ ID NO: 2127646 - RNA, 22 nt, Human
aagaagugaccaaggaggaguu

SEQ ID NO: 2127647 - RNA, 19 nt, Human
aagaaggaaaugaauuucu

SEQ ID NO: 2127648 - RNA, 20 nt, Human
aagaaggaaaugaauuucuc

SEQ ID NO: 2127649 - RNA, 16 nt, Human
aagaaggaagacuuua

SEQ ID NO: 2127650 - RNA, 11 nt, Human
aagaaggaagu

SEQ ID NO: 2127651 - RNA, 17 nt, Human
aagaaggaaaaggcagg

SEQ ID NO: 2127652 - RNA, 13 nt, Human
aagaaaucauguu

SEQ ID NO: 2127653 - RNA, 14 nt, Human
aagaaaucauguua

SEQ ID NO: 2127654 - RNA, 15 nt, Human
aagaaaucauguuau

SEQ ID NO: 2127655 - RNA, 21 nt, Human
aagaaaucauguuaugauaaa

SEQ ID NO: 2127656 - RNA, 12 nt, Human
aagaaaucaugu

SEQ ID NO: 2127657 - RNA, 15 nt, Human
aagaaagaaggaagu

SEQ ID NO: 2127658 - RNA, 13 nt, Human
aagaaagaaggaa

SEQ ID NO: 2127659 - RNA, 14 nt, Human
aagaaagaaggaag

SEQ ID NO: 2127660 - RNA, 20 nt, Human
aagaaagacuaucuaaaugu

SEQ ID NO: 2127661 - RNA, 22 nt, Human
aagaaagacuaucuaaauguug

SEQ ID NO: 2127662 - RNA, 16 nt, Human
aagaaacucaccccca

SEQ ID NO: 2127663 - RNA, 14 nt, Human
aacuugguuauaca

SEQ ID NO: 2127664 - RNA, 15 nt, Human
aagaaaaaagaaugu

SEQ ID NO: 2127665 - RNA, 15 nt, Human
uacacauuuuucaga

SEQ ID NO: 2127666 - RNA, 17 nt, Human
uacacauuuuucagaua

SEQ ID NO: 2127667 - RNA, 15 nt, Human
aauggaggaauauga

SEQ ID NO: 2127668 - RNA, 21 nt, Human
uacacauuuuucagauauaaa

SEQ ID NO: 2127669 - RNA, 19 nt, Human
uacacauuuuucagauaua

SEQ ID NO: 2127670 - RNA, 19 nt, Human
uacaccauguuugagcuca

SEQ ID NO: 2127671 - RNA, 20 nt, Human
uacaccagagauaauaugag

SEQ ID NO: 2127672 - RNA, 19 nt, Human
uacaccagagauaauauga

SEQ ID NO: 2127673 - RNA, 15 nt, Human
uacaggccucacaca

SEQ ID NO: 2127674 - RNA, 18 nt, Human
uacagaggccaugggccu

SEQ ID NO: 2127675 - RNA, 15 nt, Human
uacaggcauagaguu

SEQ ID NO: 2127676 - RNA, 17 nt, Human
uacacuccagccugagc

SEQ ID NO: 2127677 - RNA, 18 nt, Human
uacacuccagccugagca

SEQ ID NO: 2127678 - RNA, 15 nt, Human
uacacuccagccuga

SEQ ID NO: 2127679 - RNA, 16 nt, Human
uacacuccagccugag

SEQ ID NO: 2127680 - RNA, 24 nt, Human
uacaccauguuugagcucagaccc

SEQ ID NO: 2127681 - RNA, 19 nt, Human
uacaccauuaucuuggaaa

SEQ ID NO: 2127682 - RNA, 20 nt, Human
uacacuaaggguguaaguaa

SEQ ID NO: 2127683 - RNA, 14 nt, Human
aaugugacucaaga

SEQ ID NO: 2127684 - RNA, 14 nt, Human
aauguggcuccugg

SEQ ID NO: 2127685 - RNA, 21 nt, Human
aaugugggaagaaacaaaccc

SEQ ID NO: 2127686 - RNA, 18 nt, Human
aaugugggagcagcgguu

SEQ ID NO: 2127687 - RNA, 14 nt, Human
aauguacugcauau

SEQ ID NO: 2127688 - RNA, 18 nt, Human
aauguacugcauaugaaa

SEQ ID NO: 2127689 - RNA, 16 nt, Human
aauguauucuaucucu

SEQ ID NO: 2127690 - RNA, 21 nt, Human
aauguauucuaucucucuuua

SEQ ID NO: 2127691 - RNA, 18 nt, Human
aauguauugaacuuggaa

SEQ ID NO: 2127692 - RNA, 19 nt, Human
aauguauugaacuuggaaa

SEQ ID NO: 2127693 - RNA, 22 nt, Human
aauguauuauucugcagcauga

SEQ ID NO: 2127694 - RNA, 13 nt, Human
aauguauucaaau

SEQ ID NO: 2127695 - RNA, 18 nt, Human
aauguauuauucugcagc

SEQ ID NO: 2127696 - RNA, 12 nt, Human
aauguaugugua

SEQ ID NO: 2127697 - RNA, 14 nt, Human
aauguauguguaag

SEQ ID NO: 2127698 - RNA, 15 nt, Human
uacaguaucucaggg

SEQ ID NO: 2127699 - RNA, 16 nt, Human
uacaguagugagaaga

SEQ ID NO: 2127700 - RNA, 18 nt, Human
uacaguagugagaagaau

SEQ ID NO: 2127701 - RNA, 20 nt, Human
uacaguagugagaagaauau

SEQ ID NO: 2127702 - RNA, 21 nt, Human
uacaguagugagaagaauauu

SEQ ID NO: 2127703 - RNA, 15 nt, Human
uacaguacaggcagc

SEQ ID NO: 2127704 - RNA, 23 nt, Human
uacauauuaggaaaauauggguu

SEQ ID NO: 2127705 - RNA, 15 nt, Human
uacauauucuuuaaa

SEQ ID NO: 2127706 - RNA, 17 nt, Human
uacauauuugagacuag

SEQ ID NO: 2127707 - RNA, 19 nt, Human
uacauauuugcauauguau

SEQ ID NO: 2127708 - RNA, 12 nt, Human
aauguacugcau

SEQ ID NO: 2127709 - RNA, 21 nt, Human
uacauauuugcauauguauga

SEQ ID NO: 2127710 - RNA, 18 nt, Human
uacauauuaggaaaauau

SEQ ID NO: 2127711 - RNA, 19 nt, Human
uacauauuaggaaaauaug

SEQ ID NO: 2127712 - RNA, 14 nt, Human
uacauauucuuuaa

SEQ ID NO: 2127713 - RNA, 15 nt, Human
uacauaggcagcacu

SEQ ID NO: 2127714 - RNA, 17 nt, Human
uacauaguguaggcuuu

SEQ ID NO: 2127715 - RNA, 22 nt, Human
uacauaguguaggcuuuacuua

SEQ ID NO: 2127716 - RNA, 23 nt, Human
uacauaguguaggcuuuacuuag

SEQ ID NO: 2127717 - RNA, 20 nt, Human
uacaaguagggguugugggu

SEQ ID NO: 2127718 - RNA, 17 nt, Human
uacaaguauucugccuu

SEQ ID NO: 2127719 - RNA, 13 nt, Human
aaugcauaaaaug

SEQ ID NO: 2127720 - RNA, 17 nt, Human
aaugcagugaauuguga

SEQ ID NO: 2127721 - RNA, 14 nt, Human
uacaaggcaacaua

SEQ ID NO: 2127722 - RNA, 18 nt, Human
uacaagggucuagggaga

SEQ ID NO: 2127723 - RNA, 13 nt, Human
uacaaaagaugua

SEQ ID NO: 2127724 - RNA, 18 nt, Human
uacaaaauaaaguuacau

SEQ ID NO: 2127725 - RNA, 19 nt, Human
uacaaaauaaaguuacauu

SEQ ID NO: 2127726 - RNA, 20 nt, Human
uacaaaauaaaguuacauug

SEQ ID NO: 2127727 - RNA, 19 nt, Human
uacaaaauuugaaauuuag

SEQ ID NO: 2127728 - RNA, 16 nt, Human
aaugcauaaaauguua

SEQ ID NO: 2127729 - RNA, 18 nt, Human
aaugcauauccugagcca

SEQ ID NO: 2127730 - RNA, 23 nt, Human
aaugccaacuuguccuuuuguac

SEQ ID NO: 2127731 - RNA, 13 nt, Human
aaugccaaucucu

SEQ ID NO: 2127732 - RNA, 15 nt, Human
aauggaagauuugcc

SEQ ID NO: 2127733 - RNA, 21 nt, Human
aauggaagauuugcccauuua

SEQ ID NO: 2127734 - RNA, 23 nt, Human
aauggaagauuugcccauuuaca

SEQ ID NO: 2127735 - RNA, 18 nt, Human
aauggaagguuuguauau

SEQ ID NO: 2127736 - RNA, 20 nt, Human
aauggaagguuuguauauug

SEQ ID NO: 2127737 - RNA, 14 nt, Human
aauggaaaaugauu

SEQ ID NO: 2127738 - RNA, 19 nt, Human
aauggaaaacagacucagg

SEQ ID NO: 2127739 - RNA, 18 nt, Human
aauggacaaaauccauga

SEQ ID NO: 2127740 - RNA, 15 nt, Human
uaauuauuguuuaua

SEQ ID NO: 2127741 - RNA, 22 nt, Human
uaauuauuguuuauauuuucaa

SEQ ID NO: 2127742 - RNA, 22 nt, Human
aaugagcucgcauuugucaaug

SEQ ID NO: 2127743 - RNA, 14 nt, Human
uaauuauuuuaauu

SEQ ID NO: 2127744 - RNA, 15 nt, Human
uaauuauuuuaauua

SEQ ID NO: 2127745 - RNA, 18 nt, Human
uaauuauuuuaauuaggu

SEQ ID NO: 2127746 - RNA, 20 nt, Human
uaauuauuuuaauuagguua

SEQ ID NO: 2127747 - RNA, 15 nt, Human
uaauucauguuucuu

SEQ ID NO: 2127748 - RNA, 16 nt, Human
uaauucccauuuugca

SEQ ID NO: 2127749 - RNA, 16 nt, Human
uaauuccauaugcugu

SEQ ID NO: 2127750 - RNA, 21 nt, Human
uaauuguuuuuuaucuuuucu

SEQ ID NO: 2127751 - RNA, 22 nt, Human
uaauuguuuuuuaucuuuucua

SEQ ID NO: 2127752 - RNA, 23 nt, Human
uaauuuaucuugucucugggcuu

SEQ ID NO: 2127753 - RNA, 14 nt, Human
uaauuuaugaguuu

SEQ ID NO: 2127754 - RNA, 18 nt, Human
uaauuuauaguuuauaca

SEQ ID NO: 2127755 - RNA, 19 nt, Human
uacaaaaccugauguuaaa

SEQ ID NO: 2127756 - RNA, 13 nt, Human
uacaaaaauuccu

SEQ ID NO: 2127757 - RNA, 16 nt, Human
uacaaaagaagaugaa

SEQ ID NO: 2127758 - RNA, 18 nt, Human
uacaaaagggacaugaaa

SEQ ID NO: 2127759 - RNA, 11 nt, Human
uacaaaauaaa

SEQ ID NO: 2127760 - RNA, 20 nt, Human
uacaaaaagcauaaaaauua

SEQ ID NO: 2127761 - RNA, 15 nt, Human
uacaaaaagcauaaa

SEQ ID NO: 2127762 - RNA, 12 nt, Human
uaauuuauuuau

SEQ ID NO: 2127763 - RNA, 14 nt, Human
uaauuuauuuauua

SEQ ID NO: 2127764 - RNA, 17 nt, Human
uaauuuauuuauuaaga

SEQ ID NO: 2127765 - RNA, 19 nt, Human
uaauuuauuuauuaagaug

SEQ ID NO: 2127766 - RNA, 18 nt, Human
uaauuuauuuauuaagau

SEQ ID NO: 2127767 - RNA, 20 nt, Human
uaauuuaugaguuuuugaua

SEQ ID NO: 2127768 - RNA, 20 nt, Human
uaauuuauuguuuuuccuug

SEQ ID NO: 2127769 - RNA, 21 nt, Human
uaauagcgucauaacuagaac

SEQ ID NO: 2127770 - RNA, 18 nt, Human
uaauaggaaaaacggaag

SEQ ID NO: 2127771 - RNA, 21 nt, Human
uaauagugcuuaaaaaucauu

SEQ ID NO: 2127772 - RNA, 23 nt, Human
uaaucaaauuuguaggguuucua

SEQ ID NO: 2127773 - RNA, 17 nt, Human
uaaucaacugaaagugu

SEQ ID NO: 2127774 - RNA, 18 nt, Human
uaaucaacugaaaguguu

SEQ ID NO: 2127775 - RNA, 20 nt, Human
aaucuucaguuuuaucuuua

SEQ ID NO: 2127776 - RNA, 22 nt, Human
aaucuucaguuuuaucuuuaau

SEQ ID NO: 2127777 - RNA, 17 nt, Human
uaaucauccaaugcuca

SEQ ID NO: 2127778 - RNA, 14 nt, Human
uaaugaaagacugu

SEQ ID NO: 2127779 - RNA, 17 nt, Human
uaaugaaagacuguaca

SEQ ID NO: 2127780 - RNA, 18 nt, Human
uaaugaaagacuguacaa

SEQ ID NO: 2127781 - RNA, 19 nt, Human
uaaugaaagacuguacaaa

SEQ ID NO: 2127782 - RNA, 15 nt, Human
uaaugacagagccag

SEQ ID NO: 2127783 - RNA, 22 nt, Human
uaaugaaagacuguacaaagua

SEQ ID NO: 2127784 - RNA, 23 nt, Human
uaaugaaagacuguacaaaguag

SEQ ID NO: 2127785 - RNA, 21 nt, Human
uaaugaauuuuuaugauauuc

SEQ ID NO: 2127786 - RNA, 16 nt, Human
uaaugaauuuuuauga

SEQ ID NO: 2127787 - RNA, 14 nt, Human
aaugacauguguca

SEQ ID NO: 2127788 - RNA, 21 nt, Human
aaugacaugugucaagcugcu

SEQ ID NO: 2127789 - RNA, 23 nt, Human
aaugacaugugucaagcugcuug

SEQ ID NO: 2127790 - RNA, 13 nt, Human
aaugacaucuuca

SEQ ID NO: 2127791 - RNA, 16 nt, Human
aaugacagagccagug

SEQ ID NO: 2127792 - RNA, 18 nt, Human
aaugacaucuucaaagcu

SEQ ID NO: 2127793 - RNA, 23 nt, Human
aaugaaaaugucagaaaccaguu

SEQ ID NO: 2127794 - RNA, 12 nt, Human
aaugaaaauguc

SEQ ID NO: 2127795 - RNA, 13 nt, Human
aaugaaaauguca

SEQ ID NO: 2127796 - RNA, 14 nt, Human
aaugaaaaugucag

SEQ ID NO: 2127797 - RNA, 20 nt, Human
aaugaaaaugucagaaacca

SEQ ID NO: 2127798 - RNA, 14 nt, Human
aaugaccaauauua

SEQ ID NO: 2127799 - RNA, 19 nt, Human
aaugagacccucguggccu

SEQ ID NO: 2127800 - RNA, 15 nt, Human
aaugagccuggcaag

SEQ ID NO: 2127801 - RNA, 16 nt, Human
uaaugaguuucuuuua

SEQ ID NO: 2127802 - RNA, 18 nt, Human
uaaugguguaaccugaga

SEQ ID NO: 2127803 - RNA, 15 nt, Human
uaaugguuugaauau

SEQ ID NO: 2127804 - RNA, 14 nt, Human
aaucuuguuuccaa

SEQ ID NO: 2127805 - RNA, 19 nt, Human
aaugaaaaauuuaagcauu

SEQ ID NO: 2127806 - RNA, 22 nt, Human
aaugaaaaauuuaagcauuguu

SEQ ID NO: 2127807 - RNA, 21 nt, Human
aaugaaaaauuuaagcauugu

SEQ ID NO: 2127808 - RNA, 17 nt, Human
uaauaaaaguacauguu

SEQ ID NO: 2127809 - RNA, 12 nt, Human
uaauaaaauauc

SEQ ID NO: 2127810 - RNA, 15 nt, Human
uaauaaaauaucauu

SEQ ID NO: 2127811 - RNA, 16 nt, Human
uaauaaaauaucauuc

SEQ ID NO: 2127812 - RNA, 17 nt, Human
uaauaaaauaucauuca

SEQ ID NO: 2127813 - RNA, 18 nt, Human
uaauaaaauaucauucag

SEQ ID NO: 2127814 - RNA, 13 nt, Human
uaauaaaacaucu

SEQ ID NO: 2127815 - RNA, 20 nt, Human
uaauaaaauaucauucagca

SEQ ID NO: 2127816 - RNA, 21 nt, Human
uaauaaaauaucauucagcaa

SEQ ID NO: 2127817 - RNA, 13 nt, Human
aaucauguuauga

SEQ ID NO: 2127818 - RNA, 22 nt, Human
aaucauguuaugauaaaaaauu

SEQ ID NO: 2127819 - RNA, 23 nt, Human
aaucauguuaugauaaaaaauuu

SEQ ID NO: 2127820 - RNA, 21 nt, Human
aaucauggcuaagcuuaaaaa

SEQ ID NO: 2127821 - RNA, 15 nt, Human
aaucaugguuuuucu

SEQ ID NO: 2127822 - RNA, 14 nt, Human
aaucauguacauuu

SEQ ID NO: 2127823 - RNA, 16 nt, Human
aaucauguacauuucu

SEQ ID NO: 2127824 - RNA, 19 nt, Human
aaucauguacauuucugaa

SEQ ID NO: 2127825 - RNA, 15 nt, Human
aaucauccaaugcuc

SEQ ID NO: 2127826 - RNA, 17 nt, Human
uaaguuauuucuuguuu

SEQ ID NO: 2127827 - RNA, 20 nt, Human
uaaguuauuucuuguuuguu

SEQ ID NO: 2127828 - RNA, 14 nt, Human
uaaguaucagaaag

SEQ ID NO: 2127829 - RNA, 14 nt, Human
uaaguauguuauuu

SEQ ID NO: 2127830 - RNA, 15 nt, Human
aaucagaucuuuauu

SEQ ID NO: 2127831 - RNA, 15 nt, Human
aaucagaucauuuca

SEQ ID NO: 2127832 - RNA, 14 nt, Human
aaucagaucauuuc

SEQ ID NO: 2127833 - RNA, 20 nt, Human
aaucagacccuaccccacca

SEQ ID NO: 2127834 - RNA, 14 nt, Human
aaucagauuuuccu

SEQ ID NO: 2127835 - RNA, 15 nt, Human
aaucagauuuuccug

SEQ ID NO: 2127836 - RNA, 18 nt, Human
aaucagauuuuccugugg

SEQ ID NO: 2127837 - RNA, 14 nt, Human
uaaguacuguguac

SEQ ID NO: 2127838 - RNA, 20 nt, Human
aaucuguccaaaggaggcug

SEQ ID NO: 2127839 - RNA, 21 nt, Human
aaucuguccaaaggaggcugg

SEQ ID NO: 2127840 - RNA, 15 nt, Human
aaucucaaauaacua

SEQ ID NO: 2127841 - RNA, 12 nt, Human
aaucuagaagaa

SEQ ID NO: 2127842 - RNA, 13 nt, Human
aaucuagaagaaa

SEQ ID NO: 2127843 - RNA, 14 nt, Human
aaucuagaagaaau

SEQ ID NO: 2127844 - RNA, 15 nt, Human
aaucuagaagaaaug

SEQ ID NO: 2127845 - RNA, 16 nt, Human
aaucuagaagaaauga

SEQ ID NO: 2127846 - RNA, 17 nt, Human
aaucuagaagaaaugaa

SEQ ID NO: 2127847 - RNA, 18 nt, Human
aaucuagaagaaaugaaa

SEQ ID NO: 2127848 - RNA, 19 nt, Human
aaucuagaagaaaugaaau

SEQ ID NO: 2127849 - RNA, 20 nt, Human
aaucuagaagaaaugaaauu

SEQ ID NO: 2127850 - RNA, 21 nt, Human
aaucuagaagaaaugaaauuu

SEQ ID NO: 2127851 - RNA, 22 nt, Human
aaucuagaagaaaugaaauuuu

SEQ ID NO: 2127852 - RNA, 14 nt, Human
aaucuaacaaugga

SEQ ID NO: 2127853 - RNA, 16 nt, Human
aaucuaacaauggaag

SEQ ID NO: 2127854 - RNA, 14 nt, Human
aauccuucuaaucu

SEQ ID NO: 2127855 - RNA, 12 nt, Human
aaucauugcuua

SEQ ID NO: 2127856 - RNA, 20 nt, Human
aaucauuguaaacauuaguu

SEQ ID NO: 2127857 - RNA, 16 nt, Human
aauccuagcugugugc

SEQ ID NO: 2127858 - RNA, 16 nt, Human
aauccuaacacauuau

SEQ ID NO: 2127859 - RNA, 17 nt, Human
aauccuaaguuaccuuu

SEQ ID NO: 2127860 - RNA, 16 nt, Human
aauccuaccaaccucu

SEQ ID NO: 2127861 - RNA, 18 nt, Human
aauccuaccaaccucuga

SEQ ID NO: 2127862 - RNA, 15 nt, Human
aauccucacugggug

SEQ ID NO: 2127863 - RNA, 16 nt, Human
aauccucacugggugg

SEQ ID NO: 2127864 - RNA, 20 nt, Human
aauccuguugaaaagccaug

SEQ ID NO: 2127865 - RNA, 22 nt, Human
aauccuguugaaaagccauguu

SEQ ID NO: 2127866 - RNA, 13 nt, Human
aauauuguacagu

SEQ ID NO: 2127867 - RNA, 14 nt, Human
aauauuguuccuaa

SEQ ID NO: 2127868 - RNA, 15 nt, Human
aauauuguuccuaag

SEQ ID NO: 2127869 - RNA, 18 nt, Human
aauauuguuccuaaguuc

SEQ ID NO: 2127870 - RNA, 20 nt, Human
aauauuguuccuaaguucuu

SEQ ID NO: 2127871 - RNA, 23 nt, Human
aauauuguuccuaaguucuuaga

SEQ ID NO: 2127872 - RNA, 24 nt, Human
aauauuguuccuaaguucuuagau

SEQ ID NO: 2127873 - RNA, 13 nt, Human
aauauuguuucua

SEQ ID NO: 2127874 - RNA, 19 nt, Human
aauauuuccuuaaacugug

SEQ ID NO: 2127875 - RNA, 20 nt, Human
aauauuuaaaauuuauugcu

SEQ ID NO: 2127876 - RNA, 19 nt, Human
aauauuuuaccacugcugu

SEQ ID NO: 2127877 - RNA, 21 nt, Human
aauauuuuaccacugcuguga

SEQ ID NO: 2127878 - RNA, 13 nt, Human
aauauuuuauuca

SEQ ID NO: 2127879 - RNA, 14 nt, Human
aauauuuuauucaa

SEQ ID NO: 2127880 - RNA, 15 nt, Human
aauauuuuauucaag

SEQ ID NO: 2127881 - RNA, 17 nt, Human
aauauuuuauucaaggu

SEQ ID NO: 2127882 - RNA, 20 nt, Human
aauauuuuauucaagguaaa

SEQ ID NO: 2127883 - RNA, 21 nt, Human
aauauuuccuuaaacugugug

SEQ ID NO: 2127884 - RNA, 13 nt, Human
aauauuuuaagca

SEQ ID NO: 2127885 - RNA, 14 nt, Human
aauauuuuaagcau

SEQ ID NO: 2127886 - RNA, 15 nt, Human
aauauuuuaagcauu

SEQ ID NO: 2127887 - RNA, 21 nt, Human
aauauuuuaagcauuacucuu

SEQ ID NO: 2127888 - RNA, 23 nt, Human
aauauuuuaagcauuacucuugu

SEQ ID NO: 2127889 - RNA, 21 nt, Human
aauauuuuccaugaaaaugca

SEQ ID NO: 2127890 - RNA, 14 nt, Human
aaucacuuccauag

SEQ ID NO: 2127891 - RNA, 18 nt, Human
aauaugauuaguaaagaa

SEQ ID NO: 2127892 - RNA, 19 nt, Human
aauaugauuaguaaagaaa

SEQ ID NO: 2127893 - RNA, 20 nt, Human
aauaugauuaguaaagaaau

SEQ ID NO: 2127894 - RNA, 22 nt, Human
aauaugauuaguaaagaaauga

SEQ ID NO: 2127895 - RNA, 19 nt, Human
aauaugacggaagaacaua

SEQ ID NO: 2127896 - RNA, 17 nt, Human
aauaugauauugcauau

SEQ ID NO: 2127897 - RNA, 18 nt, Human
aauauugauaugcuuaua

SEQ ID NO: 2127898 - RNA, 17 nt, Human
aauauugauaugcuuau

SEQ ID NO: 2127899 - RNA, 18 nt, Human
aauaugcacacagugcuu

SEQ ID NO: 2127900 - RNA, 16 nt, Human
aauaucugaaaaugua

SEQ ID NO: 2127901 - RNA, 17 nt, Human
aauaucugaaaauguau

SEQ ID NO: 2127902 - RNA, 18 nt, Human
aauaucugaaaauguaug

SEQ ID NO: 2127903 - RNA, 19 nt, Human
aauaucugaaaauguaugu

SEQ ID NO: 2127904 - RNA, 23 nt, Human
aauaucgaucagaugacuagaaa

SEQ ID NO: 2127905 - RNA, 20 nt, Human
aauaucugaaaauguaugug

SEQ ID NO: 2127906 - RNA, 13 nt, Human
aauaucugcugua

SEQ ID NO: 2127907 - RNA, 14 nt, Human
aauaucugcuguau

SEQ ID NO: 2127908 - RNA, 16 nt, Human
aauaucugcuguaugu

SEQ ID NO: 2127909 - RNA, 19 nt, Human
aauaugaacggugagcauu

SEQ ID NO: 2127910 - RNA, 18 nt, Human
aauaugaauacagggcau

SEQ ID NO: 2127911 - RNA, 16 nt, Human
aauaugacagcugucc

SEQ ID NO: 2127912 - RNA, 22 nt, Human
aauaugacagcugucccuguca

SEQ ID NO: 2127913 - RNA, 17 nt, Human
aauaugacggaagaaca

SEQ ID NO: 2127914 - RNA, 21 nt, Human
aauaugacggaagaacauaga

SEQ ID NO: 2127915 - RNA, 16 nt, Human
aauaugagaaucagau

SEQ ID NO: 2127916 - RNA, 21 nt, Human
uaagaaugcugguuuuccuaa

SEQ ID NO: 2127917 - RNA, 23 nt, Human
uaagaaugcugguuuuccuaaau

SEQ ID NO: 2127918 - RNA, 22 nt, Human
uaagaaugcugguuuuccuaaa

SEQ ID NO: 2127919 - RNA, 12 nt, Human
uaagaauguucu

SEQ ID NO: 2127920 - RNA, 16 nt, Human
uaagaccggaagcucc

SEQ ID NO: 2127921 - RNA, 23 nt, Human
uaagaccggaagcuccugguaug

SEQ ID NO: 2127922 - RNA, 19 nt, Human
uaagaccaccucaaauuua

SEQ ID NO: 2127923 - RNA, 22 nt, Human
uaagaccaccucaaauuuaaag

SEQ ID NO: 2127924 - RNA, 13 nt, Human
uaagaccagccug

SEQ ID NO: 2127925 - RNA, 14 nt, Human
uaagaccagccugg

SEQ ID NO: 2127926 - RNA, 15 nt, Human
uaagaaugcugguuu

SEQ ID NO: 2127927 - RNA, 21 nt, Human
uaagaaucauuguaaacauua

SEQ ID NO: 2127928 - RNA, 23 nt, Human
uaacuaaucuauuggguucauua

SEQ ID NO: 2127929 - RNA, 19 nt, Human
uaacuaaucuauuggguuc

SEQ ID NO: 2127930 - RNA, 22 nt, Human
uaacuaaucuauuggguucauu

SEQ ID NO: 2127931 - RNA, 14 nt, Human
uaacuaaauuaaca

SEQ ID NO: 2127932 - RNA, 16 nt, Human
uaacuaaauuaacauu

SEQ ID NO: 2127933 - RNA, 12 nt, Human
uaacuacugugu

SEQ ID NO: 2127934 - RNA, 14 nt, Human
uaacuacuguguuc

SEQ ID NO: 2127935 - RNA, 15 nt, Human
uaacuacuguguucc

SEQ ID NO: 2127936 - RNA, 16 nt, Human
uaacuacuguguuccu

SEQ ID NO: 2127937 - RNA, 17 nt, Human
uaacuacuguguuccug

SEQ ID NO: 2127938 - RNA, 12 nt, Human
aauauauguaug

SEQ ID NO: 2127939 - RNA, 13 nt, Human
aauauauguaugu

SEQ ID NO: 2127940 - RNA, 14 nt, Human
aauauauguaugua

SEQ ID NO: 2127941 - RNA, 19 nt, Human
aauauauguauguaaaaau

SEQ ID NO: 2127942 - RNA, 18 nt, Human
aauaguauuuaugaaaug

SEQ ID NO: 2127943 - RNA, 13 nt, Human
aauaguauuuaug

SEQ ID NO: 2127944 - RNA, 13 nt, Human
aauauauuauaau

SEQ ID NO: 2127945 - RNA, 16 nt, Human
aauauauuauaaucuu

SEQ ID NO: 2127946 - RNA, 23 nt, Human
aauauauguuuuaaauauagaau

SEQ ID NO: 2127947 - RNA, 13 nt, Human
aauaucauuuauu

SEQ ID NO: 2127948 - RNA, 13 nt, Human
aauaucauucagc

SEQ ID NO: 2127949 - RNA, 14 nt, Human
aauaucauucagca

SEQ ID NO: 2127950 - RNA, 15 nt, Human
aauaucauucagcaa

SEQ ID NO: 2127951 - RNA, 16 nt, Human
aauaucauucagcaac

SEQ ID NO: 2127952 - RNA, 23 nt, Human
aauaucauuuauuuuuuacauua

SEQ ID NO: 2127953 - RNA, 13 nt, Human
aauaucaaucauu

SEQ ID NO: 2127954 - RNA, 14 nt, Human
aauaucaaucauuu

SEQ ID NO: 2127955 - RNA, 16 nt, Human
aauaucaaucauuuuc

SEQ ID NO: 2127956 - RNA, 14 nt, Human
uaacuaaaagguau

SEQ ID NO: 2127957 - RNA, 12 nt, Human
uaaccuggugcu

SEQ ID NO: 2127958 - RNA, 15 nt, Human
uaaccuggugcugga

SEQ ID NO: 2127959 - RNA, 18 nt, Human
uaaccuggugcuggauau

SEQ ID NO: 2127960 - RNA, 19 nt, Human
uaaccuggugcuggauauu

SEQ ID NO: 2127961 - RNA, 22 nt, Human
uaaccuggugcuggauauuuuc

SEQ ID NO: 2127962 - RNA, 23 nt, Human
uaaccuggugcuggauauuuuca

SEQ ID NO: 2127963 - RNA, 19 nt, Human
uaaccuguacuucaaguua

SEQ ID NO: 2127964 - RNA, 15 nt, Human
uaacuaaaagguaug

SEQ ID NO: 2127965 - RNA, 11 nt, Human
uaaccuccuuu

SEQ ID NO: 2127966 - RNA, 17 nt, Human
uaaccucuuuucugcau

SEQ ID NO: 2127967 - RNA, 18 nt, Human
uaaccugagauggcccuc

SEQ ID NO: 2127968 - RNA, 22 nt, Human
uaaccugagauggcccucuggu

SEQ ID NO: 2127969 - RNA, 18 nt, Human
uaacauggaagggaagaa

SEQ ID NO: 2127970 - RNA, 19 nt, Human
uaacauaauuuguacauau

SEQ ID NO: 2127971 - RNA, 16 nt, Human
uaacauaauuuguaca

SEQ ID NO: 2127972 - RNA, 22 nt, Human
aauaguaaaagauaacaagauc

SEQ ID NO: 2127973 - RNA, 13 nt, Human
aauaguaauguuu

SEQ ID NO: 2127974 - RNA, 13 nt, Human
aauaggcaaaggg

SEQ ID NO: 2127975 - RNA, 21 nt, Human
aauagcuuuacccucaggcau

SEQ ID NO: 2127976 - RNA, 22 nt, Human
aauagcuauauccauguacugu

SEQ ID NO: 2127977 - RNA, 20 nt, Human
aauagcucccagauuucagu

SEQ ID NO: 2127978 - RNA, 23 nt, Human
aauagcuauauccauguacugua

SEQ ID NO: 2127979 - RNA, 15 nt, Human
aauagacaguauauu

SEQ ID NO: 2127980 - RNA, 20 nt, Human
aauagacaguauauuuauag

SEQ ID NO: 2127981 - RNA, 19 nt, Human
aauagaguugggacaauug

SEQ ID NO: 2127982 - RNA, 14 nt, Human
uaaauuuuuccuua

SEQ ID NO: 2127983 - RNA, 15 nt, Human
uaaauuaaauaaaau

SEQ ID NO: 2127984 - RNA, 16 nt, Human
uaaauuaaauaaaaua

SEQ ID NO: 2127985 - RNA, 13 nt, Human
uaaauuaaauaua

SEQ ID NO: 2127986 - RNA, 14 nt, Human
uaaauuaaauauau

SEQ ID NO: 2127987 - RNA, 21 nt, Human
uaaauuaaauauauguaugua

SEQ ID NO: 2127988 - RNA, 14 nt, Human
aauagcugggacua

SEQ ID NO: 2127989 - RNA, 13 nt, Human
aauagcugggacu

SEQ ID NO: 2127990 - RNA, 20 nt, Human
aauagccugccucuucucua

SEQ ID NO: 2127991 - RNA, 22 nt, Human
aauagccacuuaccuucaauaa

SEQ ID NO: 2127992 - RNA, 23 nt, Human
aauagccacugcauaccaaccug

SEQ ID NO: 2127993 - RNA, 20 nt, Human
aauagccacuuaccuucaau

SEQ ID NO: 2127994 - RNA, 16 nt, Human
aauagaugcugacugu

SEQ ID NO: 2127995 - RNA, 20 nt, Human
aauagcaugucacuaaagca

SEQ ID NO: 2127996 - RNA, 12 nt, Human
aauaacuuuuuu

SEQ ID NO: 2127997 - RNA, 21 nt, Human
aauaagagaagcuacuuuguu

SEQ ID NO: 2127998 - RNA, 13 nt, Human
aauaagagauuug

SEQ ID NO: 2127999 - RNA, 16 nt, Human
aauaagauacaucaca

SEQ ID NO: 2128000 - RNA, 14 nt, Human
aauaauucuuugau

SEQ ID NO: 2128001 - RNA, 15 nt, Human
aauaauucuuugauu

SEQ ID NO: 2128002 - RNA, 20 nt, Human
aauaauugauuucaagaccu

SEQ ID NO: 2128003 - RNA, 21 nt, Human
aauaauuuuaggcacccaucc

SEQ ID NO: 2128004 - RNA, 22 nt, Human
aauaauuucccaauuaggaagu

SEQ ID NO: 2128005 - RNA, 14 nt, Human
aauaauuuuaugaa

SEQ ID NO: 2128006 - RNA, 22 nt, Human
aauaauuuuaugaacugcaugu

SEQ ID NO: 2128007 - RNA, 23 nt, Human
aauaauuuuaugaacugcaugua

SEQ ID NO: 2128008 - RNA, 20 nt, Human
aauacaaaaauuagccgggc

SEQ ID NO: 2128009 - RNA, 22 nt, Human
aauaauuuuucacuucaaaaca

SEQ ID NO: 2128010 - RNA, 21 nt, Human
aauacaaaaaauuagccgggc

SEQ ID NO: 2128011 - RNA, 11 nt, Human
aauacaaacaa

SEQ ID NO: 2128012 - RNA, 21 nt, Human
aauacaaacauauuuguuaaa

SEQ ID NO: 2128013 - RNA, 17 nt, Human
aauacaaacauauuugu

SEQ ID NO: 2128014 - RNA, 20 nt, Human
aauacaaacauauuuguuaa

SEQ ID NO: 2128015 - RNA, 18 nt, Human
aauacaacuuaaauaaua

SEQ ID NO: 2128016 - RNA, 12 nt, Human
uaaauaaauaca

SEQ ID NO: 2128017 - RNA, 22 nt, Human
uaaauaccucaaccuaugguau

SEQ ID NO: 2128018 - RNA, 13 nt, Human
uaaauaacuuuuu

SEQ ID NO: 2128019 - RNA, 11 nt, Human
uaaauaagaga

SEQ ID NO: 2128020 - RNA, 13 nt, Human
uaaauaagagauu

SEQ ID NO: 2128021 - RNA, 15 nt, Human
uaaauaagagauuug

SEQ ID NO: 2128022 - RNA, 18 nt, Human
uaaauagaguauaugcac

SEQ ID NO: 2128023 - RNA, 17 nt, Human
uaaauagaccauuaauc

SEQ ID NO: 2128024 - RNA, 16 nt, Human
uaaaucuguaagcucu

SEQ ID NO: 2128025 - RNA, 18 nt, Human
uaaaucuguaagcucuuu

SEQ ID NO: 2128026 - RNA, 17 nt, Human
uaaaucuguucaaggaa

SEQ ID NO: 2128027 - RNA, 16 nt, Human
uaaaucuccuauuuuu

SEQ ID NO: 2128028 - RNA, 17 nt, Human
uaaaucuccuauuuuuu

SEQ ID NO: 2128029 - RNA, 10 nt, Human
uaaaugcaua

SEQ ID NO: 2128030 - RNA, 22 nt, Human
uaaaugcagcgaaccaauauuu

SEQ ID NO: 2128031 - RNA, 20 nt, Human
uaaaugcauauccugagcca

SEQ ID NO: 2128032 - RNA, 21 nt, Human
uaaaugcauauccugagccau

SEQ ID NO: 2128033 - RNA, 14 nt, Human
uaaaugcaauaugu

SEQ ID NO: 2128034 - RNA, 15 nt, Human
uaaaugcaauaugua

SEQ ID NO: 2128035 - RNA, 18 nt, Human
uaaaugcaauauguauua

SEQ ID NO: 2128036 - RNA, 15 nt, Human
uaaauguugaaagau

SEQ ID NO: 2128037 - RNA, 20 nt, Human
uaaauguugaaagaucaaaa

SEQ ID NO: 2128038 - RNA, 12 nt, Human
uaaauuaaacaa

SEQ ID NO: 2128039 - RNA, 13 nt, Human
uaaauuaaacaau

SEQ ID NO: 2128040 - RNA, 14 nt, Human
uaaauuaaacaauu

SEQ ID NO: 2128041 - RNA, 15 nt, Human
uaaauuaaacaauuu

SEQ ID NO: 2128042 - RNA, 16 nt, Human
uaaauuaaacaauuua

SEQ ID NO: 2128043 - RNA, 22 nt, Human
uaaauuaaacaauuuauuuuau

SEQ ID NO: 2128044 - RNA, 15 nt, Human
aaguuuuguaaauuu

SEQ ID NO: 2128045 - RNA, 14 nt, Human
uaaaguauuccacc

SEQ ID NO: 2128046 - RNA, 15 nt, Human
uaaaguauuccaccu

SEQ ID NO: 2128047 - RNA, 20 nt, Human
uaaaguauuccaccuuaaau

SEQ ID NO: 2128048 - RNA, 21 nt, Human
uaaaguauuccaccuuaaauu

SEQ ID NO: 2128049 - RNA, 23 nt, Human
uaaaguauuccaccuuaaauuaa

SEQ ID NO: 2128050 - RNA, 11 nt, Human
aauaaaaaggc

SEQ ID NO: 2128051 - RNA, 13 nt, Human
aauaaaaaggcac

SEQ ID NO: 2128052 - RNA, 18 nt, Human
aauaaaaaggcaccuaua

SEQ ID NO: 2128053 - RNA, 19 nt, Human
aauaaaacauuuucacaca

SEQ ID NO: 2128054 - RNA, 17 nt, Human
aauaaaacauuuucaca

SEQ ID NO: 2128055 - RNA, 12 nt, Human
aauaaaaccuuu

SEQ ID NO: 2128056 - RNA, 13 nt, Human
aauaaaaccuuuc

SEQ ID NO: 2128057 - RNA, 14 nt, Human
aauaaaaccuuuca

SEQ ID NO: 2128058 - RNA, 19 nt, Human
uaaagguuauuuucuccug

SEQ ID NO: 2128059 - RNA, 20 nt, Human
uaaagguugacaauaaaugu

SEQ ID NO: 2128060 - RNA, 21 nt, Human
uaaaguagauuagaucuuuua

SEQ ID NO: 2128061 - RNA, 17 nt, Human
uaaaguauauauuuauu

SEQ ID NO: 2128062 - RNA, 19 nt, Human
uaaaguauauauagaaucu

SEQ ID NO: 2128063 - RNA, 14 nt, Human
uaaaguauauauuu

SEQ ID NO: 2128064 - RNA, 17 nt, Human
guuuucuuuugccauga

SEQ ID NO: 2128065 - RNA, 12 nt, Human
guuuucuuccuu

SEQ ID NO: 2128066 - RNA, 19 nt, Human
guuuucuuccuuguaaauu

SEQ ID NO: 2128067 - RNA, 17 nt, Human
guuuugaacuaauaaaa

SEQ ID NO: 2128068 - RNA, 22 nt, Human
guuuugaacuaauaaaagcaua

SEQ ID NO: 2128069 - RNA, 21 nt, Human
uaaagguggugaggcaauaaa

SEQ ID NO: 2128070 - RNA, 17 nt, Human
uaaaggugguaugugug

SEQ ID NO: 2128071 - RNA, 21 nt, Human
uaaaggugguaugugugugua

SEQ ID NO: 2128072 - RNA, 22 nt, Human
uaaaggugguauguguguguau

SEQ ID NO: 2128073 - RNA, 23 nt, Human
uaaaggugguauguguguguaug

SEQ ID NO: 2128074 - RNA, 20 nt, Human
uaaagguggugaggcaauaa

SEQ ID NO: 2128075 - RNA, 20 nt, Human
uaaaggugaaaaaagcuuuu

SEQ ID NO: 2128076 - RNA, 14 nt, Human
uaaaggggggaggg

SEQ ID NO: 2128077 - RNA, 15 nt, Human
uaaaggggggagggg

SEQ ID NO: 2128078 - RNA, 23 nt, Human
guuuugaacuaauaaaagcauaa

SEQ ID NO: 2128079 - RNA, 14 nt, Human
aauaaauguaccug

SEQ ID NO: 2128080 - RNA, 20 nt, Human
aauaaaugugaaauucuguc

SEQ ID NO: 2128081 - RNA, 20 nt, Human
aauaaauugcuccuugacau

SEQ ID NO: 2128082 - RNA, 16 nt, Human
aauaaauugcuccuug

SEQ ID NO: 2128083 - RNA, 20 nt, Human
aauaaauugcaugcugcuuu

SEQ ID NO: 2128084 - RNA, 21 nt, Human
aauaaauugcaugcugcuuua

SEQ ID NO: 2128085 - RNA, 21 nt, Human
aauaaauguaucuuauucaca

SEQ ID NO: 2128086 - RNA, 20 nt, Human
aauaaauguaucuuauucac

SEQ ID NO: 2128087 - RNA, 13 nt, Human
aauaaaugucauu

SEQ ID NO: 2128088 - RNA, 17 nt, Human
aauaaaugucauuaaaa

SEQ ID NO: 2128089 - RNA, 23 nt, Human
aauaaccaacccuucccugaaaa

SEQ ID NO: 2128090 - RNA, 19 nt, Human
aauaacucuguggcauuau

SEQ ID NO: 2128091 - RNA, 18 nt, Human
aauaaccucaaagugacu

SEQ ID NO: 2128092 - RNA, 22 nt, Human
aauaaccacuuaaaaaaugucc

SEQ ID NO: 2128093 - RNA, 16 nt, Human
aauaaccccaaaauga

SEQ ID NO: 2128094 - RNA, 17 nt, Human
aauaaccccaaaaugaa

SEQ ID NO: 2128095 - RNA, 22 nt, Human
aauaaccccauucuuugcuuga

SEQ ID NO: 2128096 - RNA, 14 nt, Human
aauaaccacuuaaa

SEQ ID NO: 2128097 - RNA, 21 nt, Human
aauaaccacuuaaaaaauguc

SEQ ID NO: 2128098 - RNA, 12 nt, Human
aauaacacacau

SEQ ID NO: 2128099 - RNA, 20 nt, Human
aauaacacacauauaaacau

SEQ ID NO: 2128100 - RNA, 23 nt, Human
aauaaaaccuuucaaauuucaca

SEQ ID NO: 2128101 - RNA, 11 nt, Human
aauaaaguauu

SEQ ID NO: 2128102 - RNA, 15 nt, Human
aauaaaguauuccac

SEQ ID NO: 2128103 - RNA, 19 nt, Human
aauaaaguauuccaccuua

SEQ ID NO: 2128104 - RNA, 20 nt, Human
aauaaaguauuccaccuuaa

SEQ ID NO: 2128105 - RNA, 14 nt, Human
aauaaaguaucuac

SEQ ID NO: 2128106 - RNA, 15 nt, Human
aauaaaguaucuaca

SEQ ID NO: 2128107 - RNA, 16 nt, Human
aauaaaguaucuacau

SEQ ID NO: 2128108 - RNA, 15 nt, Human
aauaaaaccuuucaa

SEQ ID NO: 2128109 - RNA, 16 nt, Human
aauaaaaccuuucaaa

SEQ ID NO: 2128110 - RNA, 21 nt, Human
aauaaaaccuuucaaauuuca

SEQ ID NO: 2128111 - RNA, 22 nt, Human
aauaaaaccuuucaaauuucac

SEQ ID NO: 2128112 - RNA, 16 nt, Human
aauaaaucauaaaacu

SEQ ID NO: 2128113 - RNA, 14 nt, Human
aauaaauauuuaug

SEQ ID NO: 2128114 - RNA, 15 nt, Human
aauaaaucauguuaa

SEQ ID NO: 2128115 - RNA, 20 nt, Human
aauaaaucugguagaaaaau

SEQ ID NO: 2128116 - RNA, 17 nt, Human
aauaaaugcaauaugua

SEQ ID NO: 2128117 - RNA, 19 nt, Human
aauaaaugcaauauguauu

SEQ ID NO: 2128118 - RNA, 19 nt, Human
aauaaaguucugaguguuu

SEQ ID NO: 2128119 - RNA, 13 nt, Human
aauaaaguguuuu

SEQ ID NO: 2128120 - RNA, 15 nt, Human
aauaaaguguuuuca

SEQ ID NO: 2128121 - RNA, 16 nt, Human
aauaaaguguuuucag

SEQ ID NO: 2128122 - RNA, 17 nt, Human
aauaaaguguuuucaga

SEQ ID NO: 2128123 - RNA, 18 nt, Human
aauaaaguguuuucagag

SEQ ID NO: 2128124 - RNA, 19 nt, Human
aauaaaguguuuucagagc

SEQ ID NO: 2128125 - RNA, 13 nt, Human
uacuuuuuccugg

SEQ ID NO: 2128126 - RNA, 23 nt, Human
uacuuuguugcaaguacugcugu

SEQ ID NO: 2128127 - RNA, 19 nt, Human
uacuuuguuuuuaaaugau

SEQ ID NO: 2128128 - RNA, 18 nt, Human
uacuuuuuucuuauuuaa

SEQ ID NO: 2128129 - RNA, 14 nt, Human
uacuuuuuucuuau

SEQ ID NO: 2128130 - RNA, 20 nt, Human
aauuugcacuuucaggaaca

SEQ ID NO: 2128131 - RNA, 13 nt, Human
aauuuguguaaua

SEQ ID NO: 2128132 - RNA, 16 nt, Human
aauuuguguaauaaag

SEQ ID NO: 2128133 - RNA, 17 nt, Human
aauuuguguaauaaagu

SEQ ID NO: 2128134 - RNA, 19 nt, Human
aauuuguguaauaaagugu

SEQ ID NO: 2128135 - RNA, 20 nt, Human
aauuuguguaauaaaguguu

SEQ ID NO: 2128136 - RNA, 22 nt, Human
aauuuguguaauaaaguguuuu

SEQ ID NO: 2128137 - RNA, 16 nt, Human
aauuuguuauaaugaa

SEQ ID NO: 2128138 - RNA, 22 nt, Human
aauuuguaaaaacagcauugcu

SEQ ID NO: 2128139 - RNA, 23 nt, Human
aauuuguaaaaacagcauugcuu

SEQ ID NO: 2128140 - RNA, 24 nt, Human
aauuuguaaaaacagcauugcuuu

SEQ ID NO: 2128141 - RNA, 17 nt, Human
aauuugguucuaggccg

SEQ ID NO: 2128142 - RNA, 22 nt, Human
aauuugguucuaauagaacuca

SEQ ID NO: 2128143 - RNA, 16 nt, Human
aauuugguucuaauag

SEQ ID NO: 2128144 - RNA, 16 nt, Human
aauuugccaaaauaau

SEQ ID NO: 2128145 - RNA, 18 nt, Human
aauuugccaaaauaaugu

SEQ ID NO: 2128146 - RNA, 20 nt, Human
aauuugccaaaauaaugucu

SEQ ID NO: 2128147 - RNA, 21 nt, Human
aauuugccaaaauaaugucuu

SEQ ID NO: 2128148 - RNA, 14 nt, Human
aauuuuuacagaau

SEQ ID NO: 2128149 - RNA, 16 nt, Human
aauuuuuacagaauug

SEQ ID NO: 2128150 - RNA, 13 nt, Human
aauuuuugaaaag

SEQ ID NO: 2128151 - RNA, 18 nt, Human
aauuuuuggauugacagu

SEQ ID NO: 2128152 - RNA, 19 nt, Human
aauuuuuggauugacagua

SEQ ID NO: 2128153 - RNA, 21 nt, Human
aauuuuuggauugacaguaac

SEQ ID NO: 2128154 - RNA, 22 nt, Human
aauuuuuggauugacaguaacu

SEQ ID NO: 2128155 - RNA, 23 nt, Human
aauuuuuggauugacaguaacuu

SEQ ID NO: 2128156 - RNA, 13 nt, Human
aauuuuuaauguu

SEQ ID NO: 2128157 - RNA, 13 nt, Human
aauuuuuaagcaa

SEQ ID NO: 2128158 - RNA, 20 nt, Human
aauuuuuaaauguaaaacau

SEQ ID NO: 2128159 - RNA, 22 nt, Human
aauuuuuaaaguauauauuuau

SEQ ID NO: 2128160 - RNA, 13 nt, Human
aauuuuuaaagua

SEQ ID NO: 2128161 - RNA, 19 nt, Human
aauuuuuaaaguauauauu

SEQ ID NO: 2128162 - RNA, 20 nt, Human
aauuuuuaaaguauauauuu

SEQ ID NO: 2128163 - RNA, 18 nt, Human
uagauccacacacagagg

SEQ ID NO: 2128164 - RNA, 22 nt, Human
uagaucgaugauaugaccagaa

SEQ ID NO: 2128165 - RNA, 15 nt, Human
uagaugcccugcuag

SEQ ID NO: 2128166 - RNA, 16 nt, Human
uagaugccugaacuug

SEQ ID NO: 2128167 - RNA, 12 nt, Human
acaaauaugcaa

SEQ ID NO: 2128168 - RNA, 21 nt, Human
acaaauagucggauuagaaau

SEQ ID NO: 2128169 - RNA, 19 nt, Human
acaaauaugcaaaagguuc

SEQ ID NO: 2128170 - RNA, 11 nt, Human
acaaauaugca

SEQ ID NO: 2128171 - RNA, 16 nt, Human
uagauccacacacaga

SEQ ID NO: 2128172 - RNA, 14 nt, Human
acaaaacuuuucua

SEQ ID NO: 2128173 - RNA, 18 nt, Human
acaaagcccuuccauguc

SEQ ID NO: 2128174 - RNA, 16 nt, Human
acaaagccagaagcug

SEQ ID NO: 2128175 - RNA, 20 nt, Human
acaaagccagaagcugagca

SEQ ID NO: 2128176 - RNA, 17 nt, Human
acaaagccaacagucaa

SEQ ID NO: 2128177 - RNA, 11 nt, Human
acaaagccaga

SEQ ID NO: 2128178 - RNA, 11 nt, Human
acaaaagaugu

SEQ ID NO: 2128179 - RNA, 21 nt, Human
acaaaagauguauccuuccaa

SEQ ID NO: 2128180 - RNA, 19 nt, Human
acaaagccaaacucugcca

SEQ ID NO: 2128181 - RNA, 14 nt, Human
acaaaguggaagga

SEQ ID NO: 2128182 - RNA, 15 nt, Human
acaaaguggaaggaa

SEQ ID NO: 2128183 - RNA, 16 nt, Human
acaaaguggaaggaaa

SEQ ID NO: 2128184 - RNA, 17 nt, Human
acaaaguggaaggaaag

SEQ ID NO: 2128185 - RNA, 18 nt, Human
acaaaguggaaggaaaga

SEQ ID NO: 2128186 - RNA, 19 nt, Human
acaaaguggaaggaaagau

SEQ ID NO: 2128187 - RNA, 23 nt, Human
acaaaguggaaggaaagaugcuc

SEQ ID NO: 2128188 - RNA, 14 nt, Human
acaaaguguauuca

SEQ ID NO: 2128189 - RNA, 23 nt, Human
acaaaguguauuuuauaaaauua

SEQ ID NO: 2128190 - RNA, 14 nt, Human
acaaagucuccagc

SEQ ID NO: 2128191 - RNA, 15 nt, Human
acaaagucuccagcc

SEQ ID NO: 2128192 - RNA, 18 nt, Human
acaaaggaauggaggcuc

SEQ ID NO: 2128193 - RNA, 11 nt, Human
acaaaggaaaa

SEQ ID NO: 2128194 - RNA, 13 nt, Human
acaaaggaaaaag

SEQ ID NO: 2128195 - RNA, 13 nt, Human
acaaagcugcuaa

SEQ ID NO: 2128196 - RNA, 16 nt, Human
acaaagcugcuaaauc

SEQ ID NO: 2128197 - RNA, 17 nt, Human
acaaagcugcuaaaucu

SEQ ID NO: 2128198 - RNA, 23 nt, Human
acaaagcugcuaaaucuccuauu

SEQ ID NO: 2128199 - RNA, 18 nt, Human
acaagauucccagagaca

SEQ ID NO: 2128200 - RNA, 21 nt, Human
acaagauucccagagacagga

SEQ ID NO: 2128201 - RNA, 14 nt, Human
acaagauucccaga

SEQ ID NO: 2128202 - RNA, 15 nt, Human
acaagaucuuucagg

SEQ ID NO: 2128203 - RNA, 16 nt, Human
acaagaucuuucagga

SEQ ID NO: 2128204 - RNA, 20 nt, Human
acaagaucuuucaggaaaga

SEQ ID NO: 2128205 - RNA, 15 nt, Human
acaagauucccagag

SEQ ID NO: 2128206 - RNA, 16 nt, Human
acaagauucccagaga

SEQ ID NO: 2128207 - RNA, 17 nt, Human
acaagauucccagagac

SEQ ID NO: 2128208 - RNA, 16 nt, Human
acaagccccaggcagg

SEQ ID NO: 2128209 - RNA, 17 nt, Human
acaagccccaggcaggc

SEQ ID NO: 2128210 - RNA, 17 nt, Human
acaagcgugagccacug

SEQ ID NO: 2128211 - RNA, 19 nt, Human
acaagccccaggcaggcug

SEQ ID NO: 2128212 - RNA, 13 nt, Human
acaagaucuuuca

SEQ ID NO: 2128213 - RNA, 14 nt, Human
acaagaucuuucag

SEQ ID NO: 2128214 - RNA, 16 nt, Human
acaagagcgaaacucc

SEQ ID NO: 2128215 - RNA, 17 nt, Human
acaagagcgaaacuccg

SEQ ID NO: 2128216 - RNA, 12 nt, Human
acaagagugauu

SEQ ID NO: 2128217 - RNA, 22 nt, Human
acaagagugauucuugcugcua

SEQ ID NO: 2128218 - RNA, 17 nt, Human
acaagauaagcuuccag

SEQ ID NO: 2128219 - RNA, 22 nt, Human
uagcaagugaauuuuucucuaa

SEQ ID NO: 2128220 - RNA, 16 nt, Human
uagcaaggcaugaugu

SEQ ID NO: 2128221 - RNA, 18 nt, Human
uagcaagugaauuuuucu

SEQ ID NO: 2128222 - RNA, 18 nt, Human
uagcaagacacaucccua

SEQ ID NO: 2128223 - RNA, 20 nt, Human
uagcaagauugcuuaaaaua

SEQ ID NO: 2128224 - RNA, 24 nt, Human
uagcaagauugcuuaaaauagcaa

SEQ ID NO: 2128225 - RNA, 12 nt, Human
uagcaagacaca

SEQ ID NO: 2128226 - RNA, 17 nt, Human
uagcaagacacaucccu

SEQ ID NO: 2128227 - RNA, 22 nt, Human
acaaaugcugcgcccuucccca

SEQ ID NO: 2128228 - RNA, 16 nt, Human
acaaauggaggccugu

SEQ ID NO: 2128229 - RNA, 18 nt, Human
acaaauugcuugaaagaa

SEQ ID NO: 2128230 - RNA, 16 nt, Human
acaaauuggagcaggg

SEQ ID NO: 2128231 - RNA, 14 nt, Human
acaaauuuaaaaca

SEQ ID NO: 2128232 - RNA, 15 nt, Human
acaaauuuaaaacaa

SEQ ID NO: 2128233 - RNA, 16 nt, Human
acaaauuuaaaacaaa

SEQ ID NO: 2128234 - RNA, 18 nt, Human
acaaauuuaaaacaaaca

SEQ ID NO: 2128235 - RNA, 13 nt, Human
acaaauguaugau

SEQ ID NO: 2128236 - RNA, 12 nt, Human
acaaauucuguu

SEQ ID NO: 2128237 - RNA, 15 nt, Human
acaaauucuguuucu

SEQ ID NO: 2128238 - RNA, 16 nt, Human
acaaauucuguuucuu

SEQ ID NO: 2128239 - RNA, 14 nt, Human
acaacagcugccug

SEQ ID NO: 2128240 - RNA, 14 nt, Human
acaacauguauaau

SEQ ID NO: 2128241 - RNA, 22 nt, Human
uagccuugcccggauucuggga

SEQ ID NO: 2128242 - RNA, 14 nt, Human
uagcuagaaguggg

SEQ ID NO: 2128243 - RNA, 19 nt, Human
uagcuagaagugggccagg

SEQ ID NO: 2128244 - RNA, 23 nt, Human
uagcuacaggaagcaccccaugc

SEQ ID NO: 2128245 - RNA, 16 nt, Human
uagcuaugugaccuug

SEQ ID NO: 2128246 - RNA, 20 nt, Human
uagcuagaagugggccagga

SEQ ID NO: 2128247 - RNA, 16 nt, Human
uagcucaggugucccu

SEQ ID NO: 2128248 - RNA, 17 nt, Human
uagcuuacaugagaaca

SEQ ID NO: 2128249 - RNA, 18 nt, Human
uagcuuacaugagaacag

SEQ ID NO: 2128250 - RNA, 19 nt, Human
uagcuuacaugagaacaga

SEQ ID NO: 2128251 - RNA, 15 nt, Human
uagcuuagaccucag

SEQ ID NO: 2128252 - RNA, 11 nt, Human
uagcuauuuuu

SEQ ID NO: 2128253 - RNA, 16 nt, Human
uagcuauuuuuaugga

SEQ ID NO: 2128254 - RNA, 17 nt, Human
uagcuauuuuuauggaa

SEQ ID NO: 2128255 - RNA, 19 nt, Human
uagcuauuuuuauggaauu

SEQ ID NO: 2128256 - RNA, 14 nt, Human
uagcucagccccag

SEQ ID NO: 2128257 - RNA, 17 nt, Human
uagcucagccccagccc

SEQ ID NO: 2128258 - RNA, 18 nt, Human
uagcucagccccagccca

SEQ ID NO: 2128259 - RNA, 19 nt, Human
uagcucagccccagcccag

SEQ ID NO: 2128260 - RNA, 20 nt, Human
uagcucagccccagcccagc

SEQ ID NO: 2128261 - RNA, 18 nt, Human
acaauaggugcuuauucu

SEQ ID NO: 2128262 - RNA, 19 nt, Human
acaauagcuuuacccucag

SEQ ID NO: 2128263 - RNA, 20 nt, Human
acaauagcuuuacccucagg

SEQ ID NO: 2128264 - RNA, 15 nt, Human
acaaguuguguuuga

SEQ ID NO: 2128265 - RNA, 21 nt, Human
acaaguuuucauaagcacacu

SEQ ID NO: 2128266 - RNA, 15 nt, Human
acaauaugaauacag

SEQ ID NO: 2128267 - RNA, 21 nt, Human
acaauaugaauacagggcaug

SEQ ID NO: 2128268 - RNA, 20 nt, Human
acaaucuauuuauuggacau

SEQ ID NO: 2128269 - RNA, 17 nt, Human
acaaguugcgacggaga

SEQ ID NO: 2128270 - RNA, 22 nt, Human
acaaguugcgacggagagaaaa

SEQ ID NO: 2128271 - RNA, 14 nt, Human
acaaguuguguuug

SEQ ID NO: 2128272 - RNA, 16 nt, Human
acaagcuccuggucuu

SEQ ID NO: 2128273 - RNA, 21 nt, Human
aauugacuuauuuauauaaau

SEQ ID NO: 2128274 - RNA, 18 nt, Human
aauugacuucgacuguga

SEQ ID NO: 2128275 - RNA, 20 nt, Human
aauugagaagcguauguuuu

SEQ ID NO: 2128276 - RNA, 22 nt, Human
aauugagagaauggaaaacaga

SEQ ID NO: 2128277 - RNA, 18 nt, Human
uacuguacagauugcugc

SEQ ID NO: 2128278 - RNA, 19 nt, Human
uacuguacagauugcugcu

SEQ ID NO: 2128279 - RNA, 21 nt, Human
aauugcaauuuuaacacacau

SEQ ID NO: 2128280 - RNA, 16 nt, Human
aauugcaugcugcuuu

SEQ ID NO: 2128281 - RNA, 17 nt, Human
aauugcaugcugcuuua

SEQ ID NO: 2128282 - RNA, 18 nt, Human
aauugcaugcugcuuuaa

SEQ ID NO: 2128283 - RNA, 21 nt, Human
aauugcaugcugcuuuaauug

SEQ ID NO: 2128284 - RNA, 22 nt, Human
aauugcaugcugcuuuaauugu

SEQ ID NO: 2128285 - RNA, 22 nt, Human
aauugcauggguuuuguaggua

SEQ ID NO: 2128286 - RNA, 19 nt, Human
aauugcuuacucauuaaaa

SEQ ID NO: 2128287 - RNA, 15 nt, Human
aauugauuucaagac

SEQ ID NO: 2128288 - RNA, 19 nt, Human
aauugauuucccuucuucu

SEQ ID NO: 2128289 - RNA, 14 nt, Human
uacugacuuucuca

SEQ ID NO: 2128290 - RNA, 20 nt, Human
uacugaaagguuacccugua

SEQ ID NO: 2128291 - RNA, 18 nt, Human
uacucuccaaccuggaca

SEQ ID NO: 2128292 - RNA, 14 nt, Human
uacucuccaaccug

SEQ ID NO: 2128293 - RNA, 16 nt, Human
uacucuccaaccugga

SEQ ID NO: 2128294 - RNA, 22 nt, Human
uacucuuugagauagaagaacu

SEQ ID NO: 2128295 - RNA, 14 nt, Human
uacucuuuuuguuu

SEQ ID NO: 2128296 - RNA, 17 nt, Human
uacucuuugagauagaa

SEQ ID NO: 2128297 - RNA, 16 nt, Human
uacgucugacaggcaa

SEQ ID NO: 2128298 - RNA, 15 nt, Human
uacuagaugucuuua

SEQ ID NO: 2128299 - RNA, 19 nt, Human
uacuagaugucuuuaggca

SEQ ID NO: 2128300 - RNA, 14 nt, Human
uacuagaugucuuu

SEQ ID NO: 2128301 - RNA, 18 nt, Human
uacuaaaaauacaaacaa

SEQ ID NO: 2128302 - RNA, 15 nt, Human
uacuaaaaauacaaa

SEQ ID NO: 2128303 - RNA, 18 nt, Human
uacuaggcaguuagagau

SEQ ID NO: 2128304 - RNA, 15 nt, Human
uacuagggaccuggg

SEQ ID NO: 2128305 - RNA, 22 nt, Human
uacucuacccucuuagaaaaac

SEQ ID NO: 2128306 - RNA, 14 nt, Human
uacuauuuuacuuc

SEQ ID NO: 2128307 - RNA, 19 nt, Human
uacuauuuuacuucuagag

SEQ ID NO: 2128308 - RNA, 18 nt, Human
uacuauuuuacuucuaga

SEQ ID NO: 2128309 - RNA, 15 nt, Human
uacgucugacaggca

SEQ ID NO: 2128310 - RNA, 15 nt, Human
uacgcucuccuuucu

SEQ ID NO: 2128311 - RNA, 19 nt, Human
uacgcucuccuuucuuucu

SEQ ID NO: 2128312 - RNA, 21 nt, Human
uacgcucuccuuucuuucuaa

SEQ ID NO: 2128313 - RNA, 24 nt, Human
uacgcuccaucgcugucaucucag

SEQ ID NO: 2128314 - RNA, 13 nt, Human
uacgcucuccuuu

SEQ ID NO: 2128315 - RNA, 22 nt, Human
aauugaaucacugcucacacug

SEQ ID NO: 2128316 - RNA, 15 nt, Human
aauugaaucacugcu

SEQ ID NO: 2128317 - RNA, 13 nt, Human
aauugaauuuaac

SEQ ID NO: 2128318 - RNA, 14 nt, Human
aauugaauuuaaca

SEQ ID NO: 2128319 - RNA, 15 nt, Human
aauugaauuuaacaa

SEQ ID NO: 2128320 - RNA, 16 nt, Human
aauugaauuuaacaau

SEQ ID NO: 2128321 - RNA, 21 nt, Human
aauugaauuuaacaaugcgaa

SEQ ID NO: 2128322 - RNA, 20 nt, Human
aauugaauuuucaagcaucu

SEQ ID NO: 2128323 - RNA, 21 nt, Human
aauugaauuuucaagcaucuc

SEQ ID NO: 2128324 - RNA, 19 nt, Human
aauguguaucggaugcuuu

SEQ ID NO: 2128325 - RNA, 15 nt, Human
aauuuauacaauauc

SEQ ID NO: 2128326 - RNA, 12 nt, Human
aauuuauaauuu

SEQ ID NO: 2128327 - RNA, 13 nt, Human
aauuuauaauuuu

SEQ ID NO: 2128328 - RNA, 15 nt, Human
aauuuauaauuuuaa

SEQ ID NO: 2128329 - RNA, 16 nt, Human
aauuuauaauuuuaag

SEQ ID NO: 2128330 - RNA, 16 nt, Human
aauuuauauguaucca

SEQ ID NO: 2128331 - RNA, 17 nt, Human
aauuuaucacacuucug

SEQ ID NO: 2128332 - RNA, 17 nt, Human
aauuuauacaauaucau

SEQ ID NO: 2128333 - RNA, 15 nt, Human
aauuuauaguuuaua

SEQ ID NO: 2128334 - RNA, 16 nt, Human
aauuuauaguuuauac

SEQ ID NO: 2128335 - RNA, 17 nt, Human
aauuuauaguuuauaca

SEQ ID NO: 2128336 - RNA, 20 nt, Human
aauuucuugguaagaagccg

SEQ ID NO: 2128337 - RNA, 18 nt, Human
aauuucuucucaaagggu

SEQ ID NO: 2128338 - RNA, 17 nt, Human
aauuucuugguaagaag

SEQ ID NO: 2128339 - RNA, 15 nt, Human
aauuuacauacucug

SEQ ID NO: 2128340 - RNA, 15 nt, Human
aauuggagcagggac

SEQ ID NO: 2128341 - RNA, 21 nt, Human
aauuuaagcauuguuugcuua

SEQ ID NO: 2128342 - RNA, 23 nt, Human
aauuuaagcauuguuugcuuauu

SEQ ID NO: 2128343 - RNA, 11 nt, Human
aauuuaagcau

SEQ ID NO: 2128344 - RNA, 12 nt, Human
aauuuaagcauu

SEQ ID NO: 2128345 - RNA, 13 nt, Human
aauuuaagcauug

SEQ ID NO: 2128346 - RNA, 14 nt, Human
aauuuaagcauugu

SEQ ID NO: 2128347 - RNA, 15 nt, Human
aauuuaagcauuguu

SEQ ID NO: 2128348 - RNA, 16 nt, Human
aauuuaagcauuguuu

SEQ ID NO: 2128349 - RNA, 13 nt, Human
aauuuaacaaugc

SEQ ID NO: 2128350 - RNA, 15 nt, Human
aauuuaacaaugcga

SEQ ID NO: 2128351 - RNA, 16 nt, Human
aauuuaacaaugcgaa

SEQ ID NO: 2128352 - RNA, 17 nt, Human
aauuuaacaaugcgaau

SEQ ID NO: 2128353 - RNA, 18 nt, Human
aauuggaccauccuauuu

SEQ ID NO: 2128354 - RNA, 14 nt, Human
aauugaggucugcu

SEQ ID NO: 2128355 - RNA, 16 nt, Human
aauugcuuguuugcuu

SEQ ID NO: 2128356 - RNA, 19 nt, Human
aauugcuuguuugcuucaa

SEQ ID NO: 2128357 - RNA, 15 nt, Human
aauugcuugaaagaa

SEQ ID NO: 2128358 - RNA, 17 nt, Human
aauugcuugaaagaaaa

SEQ ID NO: 2128359 - RNA, 22 nt, Human
aauugcuugaaagaaaauaugc

SEQ ID NO: 2128360 - RNA, 22 nt, Human
uacuuagcuuaucaauuuguca

SEQ ID NO: 2128361 - RNA, 21 nt, Human
uacuuauauuuuuaauaaaag

SEQ ID NO: 2128362 - RNA, 12 nt, Human
uacuuauucauu

SEQ ID NO: 2128363 - RNA, 13 nt, Human
uacuuauucauug

SEQ ID NO: 2128364 - RNA, 14 nt, Human
uacuuauucauugu

SEQ ID NO: 2128365 - RNA, 15 nt, Human
uacuuauucauugug

SEQ ID NO: 2128366 - RNA, 13 nt, Human
uacuuauuccaga

SEQ ID NO: 2128367 - RNA, 23 nt, Human
uacuucccauuuuggaaguuuuc

SEQ ID NO: 2128368 - RNA, 18 nt, Human
uacuucuccacccugcuc

SEQ ID NO: 2128369 - RNA, 13 nt, Human
uacuucuccaccc

SEQ ID NO: 2128370 - RNA, 23 nt, Human
uacuuccugugacuucagcucug

SEQ ID NO: 2128371 - RNA, 19 nt, Human
uacuuccuaucaagccagu

SEQ ID NO: 2128372 - RNA, 12 nt, Human
uacuuccugccu

SEQ ID NO: 2128373 - RNA, 22 nt, Human
uacuuccugccuggucuccugc

SEQ ID NO: 2128374 - RNA, 15 nt, Human
uacuucugcuacaua

SEQ ID NO: 2128375 - RNA, 20 nt, Human
uacuucuccacccugcucuc

SEQ ID NO: 2128376 - RNA, 21 nt, Human
uacuucuagagauaguacaua

SEQ ID NO: 2128377 - RNA, 16 nt, Human
uacuucuuauacauuu

SEQ ID NO: 2128378 - RNA, 14 nt, Human
uacuucuuauacau

SEQ ID NO: 2128379 - RNA, 15 nt, Human
uacuucuuauacauu

SEQ ID NO: 2128380 - RNA, 11 nt, Human
uacuuugucag

SEQ ID NO: 2128381 - RNA, 23 nt, Human
uacuuugauauuuucaacgcagc

SEQ ID NO: 2128382 - RNA, 20 nt, Human
uacuuuguccuuuuuguuau

SEQ ID NO: 2128383 - RNA, 18 nt, Human
uacuucuucauucaauac

SEQ ID NO: 2128384 - RNA, 20 nt, Human
acagauguaaaagacuuuuu

SEQ ID NO: 2128385 - RNA, 16 nt, Human
acagauggauuugccu

SEQ ID NO: 2128386 - RNA, 17 nt, Human
acagauggauuugccug

SEQ ID NO: 2128387 - RNA, 12 nt, Human
acagaugccucc

SEQ ID NO: 2128388 - RNA, 21 nt, Human
acagaugccccagagcuguuu

SEQ ID NO: 2128389 - RNA, 22 nt, Human
acagaugccccagagcuguuua

SEQ ID NO: 2128390 - RNA, 15 nt, Human
acagcaaaaccauug

SEQ ID NO: 2128391 - RNA, 20 nt, Human
acagcaaaaccauugcuuca

SEQ ID NO: 2128392 - RNA, 21 nt, Human
acagcaaaaccauugcuucac

SEQ ID NO: 2128393 - RNA, 22 nt, Human
acagcaaaaccauugcuucacu

SEQ ID NO: 2128394 - RNA, 18 nt, Human
acagcaaaacuccaucuc

SEQ ID NO: 2128395 - RNA, 12 nt, Human
acagauguugaa

SEQ ID NO: 2128396 - RNA, 20 nt, Human
acagauagauauaugcucug

SEQ ID NO: 2128397 - RNA, 22 nt, Human
acagauacuggaaguuuugcau

SEQ ID NO: 2128398 - RNA, 21 nt, Human
acagauacuggaaguuuugca

SEQ ID NO: 2128399 - RNA, 16 nt, Human
acagauaggccuucuu

SEQ ID NO: 2128400 - RNA, 13 nt, Human
acagaugccccag

SEQ ID NO: 2128401 - RNA, 14 nt, Human
acagaugccccaga

SEQ ID NO: 2128402 - RNA, 16 nt, Human
acagaugccccagagc

SEQ ID NO: 2128403 - RNA, 17 nt, Human
acagaugccccagagcu

SEQ ID NO: 2128404 - RNA, 18 nt, Human
acagaugccccagagcug

SEQ ID NO: 2128405 - RNA, 19 nt, Human
acagaugccccagagcugu

SEQ ID NO: 2128406 - RNA, 14 nt, Human
acagaggaagagca

SEQ ID NO: 2128407 - RNA, 16 nt, Human
acagaggaagagcagg

SEQ ID NO: 2128408 - RNA, 21 nt, Human
acagauaagcaagagagaugu

SEQ ID NO: 2128409 - RNA, 23 nt, Human
uaugaaagauggcugugccucug

SEQ ID NO: 2128410 - RNA, 22 nt, Human
uaugaaagauggcugugccucu

SEQ ID NO: 2128411 - RNA, 20 nt, Human
uaugaaagauggcugugccu

SEQ ID NO: 2128412 - RNA, 21 nt, Human
uaucuugguguguuaagaguu

SEQ ID NO: 2128413 - RNA, 22 nt, Human
uaucuuguuuuuccacuacugc

SEQ ID NO: 2128414 - RNA, 22 nt, Human
acagccgaguggauagaugccc

SEQ ID NO: 2128415 - RNA, 20 nt, Human
uaucucugucuaccaucucc

SEQ ID NO: 2128416 - RNA, 22 nt, Human
acagccgcagccucccucugac

SEQ ID NO: 2128417 - RNA, 20 nt, Human
acagccgcagccucccucug

SEQ ID NO: 2128418 - RNA, 13 nt, Human
acagccgcagccu

SEQ ID NO: 2128419 - RNA, 17 nt, Human
uaucuugucucugggcu

SEQ ID NO: 2128420 - RNA, 14 nt, Human
uaucuuguuuuucc

SEQ ID NO: 2128421 - RNA, 18 nt, Human
uaucuuguuuuuccacua

SEQ ID NO: 2128422 - RNA, 15 nt, Human
uaucuugucucuggg

SEQ ID NO: 2128423 - RNA, 10 nt, Human
acagcaaauu

SEQ ID NO: 2128424 - RNA, 18 nt, Human
acagcaaauuuauaauuu

SEQ ID NO: 2128425 - RNA, 19 nt, Human
acagcaaauuuauaauuuu

SEQ ID NO: 2128426 - RNA, 20 nt, Human
acagcaaauuuauaauuuua

SEQ ID NO: 2128427 - RNA, 22 nt, Human
acagcaaauuuauaauuuuaag

SEQ ID NO: 2128428 - RNA, 14 nt, Human
acagagcugggaug

SEQ ID NO: 2128429 - RNA, 16 nt, Human
acagagcugacaaaau

SEQ ID NO: 2128430 - RNA, 18 nt, Human
acagagcugacaaaauuu

SEQ ID NO: 2128431 - RNA, 20 nt, Human
acagagcugacaaaauuuug

SEQ ID NO: 2128432 - RNA, 10 nt, Human
acagagcugg

SEQ ID NO: 2128433 - RNA, 18 nt, Human
acagagcugggauguuuc

SEQ ID NO: 2128434 - RNA, 21 nt, Human
acagagcugggauguuucugu

SEQ ID NO: 2128435 - RNA, 21 nt, Human
acagagcugguugggaagaca

SEQ ID NO: 2128436 - RNA, 21 nt, Human
acagagcaagugagacccugu

SEQ ID NO: 2128437 - RNA, 15 nt, Human
acagagcaagacucu

SEQ ID NO: 2128438 - RNA, 11 nt, Human
acagagccagu

SEQ ID NO: 2128439 - RNA, 16 nt, Human
uauccuaucucuccaa

SEQ ID NO: 2128440 - RNA, 14 nt, Human
uaucucacagcaca

SEQ ID NO: 2128441 - RNA, 16 nt, Human
uaucucacagcacacu

SEQ ID NO: 2128442 - RNA, 13 nt, Human
uaucucagggccu

SEQ ID NO: 2128443 - RNA, 15 nt, Human
uaucucagggccugg

SEQ ID NO: 2128444 - RNA, 18 nt, Human
uauauuuauauaauuaug

SEQ ID NO: 2128445 - RNA, 24 nt, Human
uauauuuauaacucaucauaaaau

SEQ ID NO: 2128446 - RNA, 18 nt, Human
uauauuuaaguauucaag

SEQ ID NO: 2128447 - RNA, 22 nt, Human
uauauuuaaguauucaagaaag

SEQ ID NO: 2128448 - RNA, 22 nt, Human
uauauuuauaacucaucauaaa

SEQ ID NO: 2128449 - RNA, 23 nt, Human
uauauuuauaacucaucauaaaa

SEQ ID NO: 2128450 - RNA, 20 nt, Human
acacucugaauuccaaguag

SEQ ID NO: 2128451 - RNA, 21 nt, Human
acacugaaauauacacacagc

SEQ ID NO: 2128452 - RNA, 20 nt, Human
acacugaaauauacacacag

SEQ ID NO: 2128453 - RNA, 18 nt, Human
acacugaaauauacacac

SEQ ID NO: 2128454 - RNA, 17 nt, Human
acacugaaauauacaca

SEQ ID NO: 2128455 - RNA, 14 nt, Human
acacuguucugaaa

SEQ ID NO: 2128456 - RNA, 21 nt, Human
acacugaagcucuugaagaca

SEQ ID NO: 2128457 - RNA, 19 nt, Human
acacuguuagaacacuauu

SEQ ID NO: 2128458 - RNA, 20 nt, Human
acacuguuagaacacuauuu

SEQ ID NO: 2128459 - RNA, 21 nt, Human
acacuguuagaacacuauuuu

SEQ ID NO: 2128460 - RNA, 22 nt, Human
acacuguuagaacacuauuuuc

SEQ ID NO: 2128461 - RNA, 22 nt, Human
acacugaaauauacacacagca

SEQ ID NO: 2128462 - RNA, 14 nt, Human
acacugaaaugccu

SEQ ID NO: 2128463 - RNA, 15 nt, Human
acacugaaaugccuu

SEQ ID NO: 2128464 - RNA, 20 nt, Human
acacuguucugaaagugacu

SEQ ID NO: 2128465 - RNA, 20 nt, Human
acacucucaaagcaaauaau

SEQ ID NO: 2128466 - RNA, 11 nt, Human
acacucuccug

SEQ ID NO: 2128467 - RNA, 12 nt, Human
acacucuccugg

SEQ ID NO: 2128468 - RNA, 13 nt, Human
acacucuccuggg

SEQ ID NO: 2128469 - RNA, 14 nt, Human
acacucuccugggc

SEQ ID NO: 2128470 - RNA, 15 nt, Human
acacucuccugggcc

SEQ ID NO: 2128471 - RNA, 16 nt, Human
acacucuccugggccc

SEQ ID NO: 2128472 - RNA, 17 nt, Human
acacucuccugggcccc

SEQ ID NO: 2128473 - RNA, 19 nt, Human
acacucuccugggccccuc

SEQ ID NO: 2128474 - RNA, 20 nt, Human
acacucuccugggccccucc

SEQ ID NO: 2128475 - RNA, 21 nt, Human
acacucuccugggccccuccc

SEQ ID NO: 2128476 - RNA, 22 nt, Human
acacucuccugggccccucccu

SEQ ID NO: 2128477 - RNA, 12 nt, Human
acacuccagccu

SEQ ID NO: 2128478 - RNA, 14 nt, Human
acacuccagccuga

SEQ ID NO: 2128479 - RNA, 15 nt, Human
acacuccagccugag

SEQ ID NO: 2128480 - RNA, 16 nt, Human
acacuccagccugagc

SEQ ID NO: 2128481 - RNA, 17 nt, Human
acacuccagccugagca

SEQ ID NO: 2128482 - RNA, 16 nt, Human
uauaacuagcuagaag

SEQ ID NO: 2128483 - RNA, 10 nt, Human
uauaaggacu

SEQ ID NO: 2128484 - RNA, 11 nt, Human
uauaaggacug

SEQ ID NO: 2128485 - RNA, 12 nt, Human
uauaaggacugc

SEQ ID NO: 2128486 - RNA, 13 nt, Human
uauaaggacugca

SEQ ID NO: 2128487 - RNA, 14 nt, Human
uauaaggacugcau

SEQ ID NO: 2128488 - RNA, 15 nt, Human
uauaaggacugcaug

SEQ ID NO: 2128489 - RNA, 21 nt, Human
uauaaggacugcaugguaauu

SEQ ID NO: 2128490 - RNA, 20 nt, Human
acacucagcacccccuucuc

SEQ ID NO: 2128491 - RNA, 22 nt, Human
acacucagcacccccuucucug

SEQ ID NO: 2128492 - RNA, 18 nt, Human
acacucaccucuaaaaca

SEQ ID NO: 2128493 - RNA, 19 nt, Human
acacucaccucuaaaacag

SEQ ID NO: 2128494 - RNA, 19 nt, Human
uauauuccauauauuagca

SEQ ID NO: 2128495 - RNA, 21 nt, Human
uauauuccauauauuagcauu

SEQ ID NO: 2128496 - RNA, 14 nt, Human
uauauucauauauu

SEQ ID NO: 2128497 - RNA, 12 nt, Human
acagaaagagag

SEQ ID NO: 2128498 - RNA, 16 nt, Human
acagaaagagagcacu

SEQ ID NO: 2128499 - RNA, 17 nt, Human
acagaaagagagcacug

SEQ ID NO: 2128500 - RNA, 18 nt, Human
acagaaagagagcacuga

SEQ ID NO: 2128501 - RNA, 14 nt, Human
uauauuuaaaagaa

SEQ ID NO: 2128502 - RNA, 17 nt, Human
acagacacaggcccggc

SEQ ID NO: 2128503 - RNA, 22 nt, Human
acagacacaggcccggcuccag

SEQ ID NO: 2128504 - RNA, 18 nt, Human
acagacacaggcccggcu

SEQ ID NO: 2128505 - RNA, 22 nt, Human
acagacuggaagcacagcuuca

SEQ ID NO: 2128506 - RNA, 22 nt, Human
uauauuaucaugcaaaugcugu

SEQ ID NO: 2128507 - RNA, 21 nt, Human
acagacuggaagcacagcuuc

SEQ ID NO: 2128508 - RNA, 19 nt, Human
acagacuggaagcacagcu

SEQ ID NO: 2128509 - RNA, 17 nt, Human
acagacuggaagcacag

SEQ ID NO: 2128510 - RNA, 13 nt, Human
acacuugugugug

SEQ ID NO: 2128511 - RNA, 16 nt, Human
acacuugugugugggc

SEQ ID NO: 2128512 - RNA, 18 nt, Human
acacuugugugugggcug

SEQ ID NO: 2128513 - RNA, 22 nt, Human
acacuugugugugggcugugag

SEQ ID NO: 2128514 - RNA, 19 nt, Human
acacuuguuccagcucuuu

SEQ ID NO: 2128515 - RNA, 20 nt, Human
acacuuguuccagcucuuug

SEQ ID NO: 2128516 - RNA, 17 nt, Human
acacuuguccacauagg

SEQ ID NO: 2128517 - RNA, 14 nt, Human
acacuuaacagaug

SEQ ID NO: 2128518 - RNA, 13 nt, Human
acacuuaacagau

SEQ ID NO: 2128519 - RNA, 11 nt, Human
acacuuaacag

SEQ ID NO: 2128520 - RNA, 21 nt, Human
acacuguuuacaagaaaaaau

SEQ ID NO: 2128521 - RNA, 23 nt, Human
acacuguuuacaagaaaaaauga

SEQ ID NO: 2128522 - RNA, 23 nt, Human
acacuugugugugggcugugagu

SEQ ID NO: 2128523 - RNA, 13 nt, Human
acacuuuauuuac

SEQ ID NO: 2128524 - RNA, 22 nt, Human
acacuuuggaaguuuguguucu

SEQ ID NO: 2128525 - RNA, 11 nt, Human
acagaaagaga

SEQ ID NO: 2128526 - RNA, 20 nt, Human
acacuuuucaugugugauuu

SEQ ID NO: 2128527 - RNA, 10 nt, Human
uaguuuuugu

SEQ ID NO: 2128528 - RNA, 17 nt, Human
uaguuuuuguaauuuau

SEQ ID NO: 2128529 - RNA, 17 nt, Human
uaguuuuucuucaacau

SEQ ID NO: 2128530 - RNA, 15 nt, Human
uaguuuugucaaacu

SEQ ID NO: 2128531 - RNA, 18 nt, Human
uaguuuuuaccuaccaca

SEQ ID NO: 2128532 - RNA, 13 nt, Human
uaguuuugucaaa

SEQ ID NO: 2128533 - RNA, 23 nt, Human
acacagcuuuuaguacccaccug

SEQ ID NO: 2128534 - RNA, 15 nt, Human
uaguucagacacuuu

SEQ ID NO: 2128535 - RNA, 19 nt, Human
uaguucagacacuuuggaa

SEQ ID NO: 2128536 - RNA, 18 nt, Human
uaguucagguaacaggca

SEQ ID NO: 2128537 - RNA, 14 nt, Human
uauaaaagacugac

SEQ ID NO: 2128538 - RNA, 17 nt, Human
uauaaaacaggucaaua

SEQ ID NO: 2128539 - RNA, 13 nt, Human
acacccagcccac

SEQ ID NO: 2128540 - RNA, 12 nt, Human
acacccagccca

SEQ ID NO: 2128541 - RNA, 21 nt, Human
acacauugugucacaucauga

SEQ ID NO: 2128542 - RNA, 17 nt, Human
acacauucaauaagcau

SEQ ID NO: 2128543 - RNA, 16 nt, Human
acacauucaauaagca

SEQ ID NO: 2128544 - RNA, 23 nt, Human
acacauuaucgggagcagugucu

SEQ ID NO: 2128545 - RNA, 20 nt, Human
acacauuaucgggagcagug

SEQ ID NO: 2128546 - RNA, 15 nt, Human
uauaaaauuaagcaa

SEQ ID NO: 2128547 - RNA, 18 nt, Human
acacaugcugaacaucac

SEQ ID NO: 2128548 - RNA, 16 nt, Human
uauaaaauuaaagaaa

SEQ ID NO: 2128549 - RNA, 18 nt, Human
uauaaaauuaaagaaaau

SEQ ID NO: 2128550 - RNA, 22 nt, Human
uauaaaaugguguuuucaugua

SEQ ID NO: 2128551 - RNA, 16 nt, Human
acaccucccugaacca

SEQ ID NO: 2128552 - RNA, 22 nt, Human
acaccucccugaaccaucccug

SEQ ID NO: 2128553 - RNA, 13 nt, Human
acaccucccugaa

SEQ ID NO: 2128554 - RNA, 23 nt, Human
acaccccuccccugcccuagagc

SEQ ID NO: 2128555 - RNA, 18 nt, Human
acacccccaccuccugca

SEQ ID NO: 2128556 - RNA, 16 nt, Human
acaccccuccccugcc

SEQ ID NO: 2128557 - RNA, 18 nt, Human
acaccucugcacaagcug

SEQ ID NO: 2128558 - RNA, 16 nt, Human
acaccuugacagggca

SEQ ID NO: 2128559 - RNA, 15 nt, Human
acaccuugacagggc

SEQ ID NO: 2128560 - RNA, 14 nt, Human
acaccuugacaggg

SEQ ID NO: 2128561 - RNA, 19 nt, Human
acaccucugcacaagcugc

SEQ ID NO: 2128562 - RNA, 18 nt, Human
acaccucguuagggaaga

SEQ ID NO: 2128563 - RNA, 21 nt, Human
acaccucguuagggaagagaa

SEQ ID NO: 2128564 - RNA, 22 nt, Human
acaccucguuagggaagagaaa

SEQ ID NO: 2128565 - RNA, 11 nt, Human
acaccugcacc

SEQ ID NO: 2128566 - RNA, 12 nt, Human
acaccugcaccu

SEQ ID NO: 2128567 - RNA, 14 nt, Human
acaccugcaccucc

SEQ ID NO: 2128568 - RNA, 15 nt, Human
acaccugcaccuccc

SEQ ID NO: 2128569 - RNA, 16 nt, Human
acaccugcaccucccc

SEQ ID NO: 2128570 - RNA, 18 nt, Human
acaccugcaccucccccc

SEQ ID NO: 2128571 - RNA, 19 nt, Human
acaccugcaccucccccca

SEQ ID NO: 2128572 - RNA, 24 nt, Human
acaccugcaccuccccccacugca

SEQ ID NO: 2128573 - RNA, 19 nt, Human
acacuaaccacgcuggacc

SEQ ID NO: 2128574 - RNA, 17 nt, Human
acacuaaccacgcugga

SEQ ID NO: 2128575 - RNA, 16 nt, Human
acacuaaccacgcugg

SEQ ID NO: 2128576 - RNA, 22 nt, Human
acacuaguaccuucagauccua

SEQ ID NO: 2128577 - RNA, 15 nt, Human
uauaaccccagcucc

SEQ ID NO: 2128578 - RNA, 14 nt, Human
uauaacuaguccuu

SEQ ID NO: 2128579 - RNA, 19 nt, Human
uauaacuauguugauaaaa

SEQ ID NO: 2128580 - RNA, 16 nt, Human
uauaaggaaagcaaua

SEQ ID NO: 2128581 - RNA, 18 nt, Human
uauaacuaguccuuuacu

SEQ ID NO: 2128582 - RNA, 22 nt, Human
uauaaggaaagcaauaaaugaa

SEQ ID NO: 2128583 - RNA, 23 nt, Human
uauaaggaaagcaauaaaugaau

SEQ ID NO: 2128584 - RNA, 22 nt, Human
acacuagcuaauaucaauagaa

SEQ ID NO: 2128585 - RNA, 13 nt, Human
acacuagccucuc

SEQ ID NO: 2128586 - RNA, 15 nt, Human
acacuagccucucca

SEQ ID NO: 2128587 - RNA, 19 nt, Human
acacagucuuggcucacug

SEQ ID NO: 2128588 - RNA, 13 nt, Human
acacaguauuuuc

SEQ ID NO: 2128589 - RNA, 14 nt, Human
acacaggaggagaa

SEQ ID NO: 2128590 - RNA, 23 nt, Human
acacagucucacccagacuccag

SEQ ID NO: 2128591 - RNA, 11 nt, Human
acacagugagu

SEQ ID NO: 2128592 - RNA, 16 nt, Human
acacaggauagauaac

SEQ ID NO: 2128593 - RNA, 20 nt, Human
acacaggauagauaacucuu

SEQ ID NO: 2128594 - RNA, 23 nt, Human
acacaggauagauaacucuuugg

SEQ ID NO: 2128595 - RNA, 15 nt, Human
acacaggcaacugag

SEQ ID NO: 2128596 - RNA, 16 nt, Human
acacaggcaacugagg

SEQ ID NO: 2128597 - RNA, 19 nt, Human
acacaggcaacugaggcag

SEQ ID NO: 2128598 - RNA, 20 nt, Human
acacaggcaacugaggcaga

SEQ ID NO: 2128599 - RNA, 15 nt, Human
acacacugaggcagg

SEQ ID NO: 2128600 - RNA, 16 nt, Human
acacacugaggcaggg

SEQ ID NO: 2128601 - RNA, 19 nt, Human
acacagcugcagagacaga

SEQ ID NO: 2128602 - RNA, 18 nt, Human
acacacugaggcagggaa

SEQ ID NO: 2128603 - RNA, 13 nt, Human
acacagugagucg

SEQ ID NO: 2128604 - RNA, 21 nt, Human
uagguuggcaaaaaggcagga

SEQ ID NO: 2128605 - RNA, 13 nt, Human
uagguuuaacaua

SEQ ID NO: 2128606 - RNA, 15 nt, Human
uagguuuaacauaaa

SEQ ID NO: 2128607 - RNA, 16 nt, Human
uagguuuaacauaaag

SEQ ID NO: 2128608 - RNA, 17 nt, Human
uagguuuaacauaaagg

SEQ ID NO: 2128609 - RNA, 18 nt, Human
uagguuuaacauaaaggu

SEQ ID NO: 2128610 - RNA, 16 nt, Human
uaguaagaaaacauca

SEQ ID NO: 2128611 - RNA, 17 nt, Human
uaguacuccuuaagaac

SEQ ID NO: 2128612 - RNA, 19 nt, Human
uaguacuccuuaagaacac

SEQ ID NO: 2128613 - RNA, 21 nt, Human
uaguacuccugcaaaauuuua

SEQ ID NO: 2128614 - RNA, 17 nt, Human
uaguacuccugcaaaau

SEQ ID NO: 2128615 - RNA, 19 nt, Human
uaguacuccugcaaaauuu

SEQ ID NO: 2128616 - RNA, 20 nt, Human
uaguacuccugcaaaauuuu

SEQ ID NO: 2128617 - RNA, 15 nt, Human
uaguagaaauuuuac

SEQ ID NO: 2128618 - RNA, 19 nt, Human
uaguagaaauuuuacaaua

SEQ ID NO: 2128619 - RNA, 20 nt, Human
uaguagaaauuuuacaauag

SEQ ID NO: 2128620 - RNA, 13 nt, Human
uaguagagacagg

SEQ ID NO: 2128621 - RNA, 14 nt, Human
uagucuauuagcca

SEQ ID NO: 2128622 - RNA, 17 nt, Human
uagucuaaccaaaugca

SEQ ID NO: 2128623 - RNA, 18 nt, Human
uagucuaaccaaaugcau

SEQ ID NO: 2128624 - RNA, 19 nt, Human
uagucuaaccaaaugcauc

SEQ ID NO: 2128625 - RNA, 12 nt, Human
uagucucaggac

SEQ ID NO: 2128626 - RNA, 15 nt, Human
uagucuucaagcaga

SEQ ID NO: 2128627 - RNA, 17 nt, Human
uagucuucaagcagauu

SEQ ID NO: 2128628 - RNA, 23 nt, Human
uagucugugugggacuguacaca

SEQ ID NO: 2128629 - RNA, 12 nt, Human
uagucuucucau

SEQ ID NO: 2128630 - RNA, 14 nt, Human
uagucuucucauag

SEQ ID NO: 2128631 - RNA, 18 nt, Human
uagucuucucauagcauu

SEQ ID NO: 2128632 - RNA, 12 nt, Human
uagucuuucaca

SEQ ID NO: 2128633 - RNA, 19 nt, Human
uagucuucucauagcauua

SEQ ID NO: 2128634 - RNA, 16 nt, Human
acaaugcgaaugguag

SEQ ID NO: 2128635 - RNA, 19 nt, Human
acaaugcgaaugguagucu

SEQ ID NO: 2128636 - RNA, 21 nt, Human
acaaugcgaaugguagucuaa

SEQ ID NO: 2128637 - RNA, 14 nt, Human
uagcuuaucaauuu

SEQ ID NO: 2128638 - RNA, 18 nt, Human
uagcuuaucaauuuguca

SEQ ID NO: 2128639 - RNA, 19 nt, Human
uagcuuaucaauuugucau

SEQ ID NO: 2128640 - RNA, 20 nt, Human
uagcuuaucaauuugucauu

SEQ ID NO: 2128641 - RNA, 20 nt, Human
uagcuuagaccucagccugu

SEQ ID NO: 2128642 - RNA, 23 nt, Human
uagcuuagaccucagccugugcu

SEQ ID NO: 2128643 - RNA, 16 nt, Human
uagcuuagaccucagc

SEQ ID NO: 2128644 - RNA, 17 nt, Human
uagcuuagaccucagcc

SEQ ID NO: 2128645 - RNA, 18 nt, Human
uagcuuagaccucagccu

SEQ ID NO: 2128646 - RNA, 19 nt, Human
uagcuuagaccucagccug

SEQ ID NO: 2128647 - RNA, 14 nt, Human
acacacacauacac

SEQ ID NO: 2128648 - RNA, 12 nt, Human
acacacacagcu

SEQ ID NO: 2128649 - RNA, 13 nt, Human
acacacacagcuu

SEQ ID NO: 2128650 - RNA, 11 nt, Human
acacacacagg

SEQ ID NO: 2128651 - RNA, 14 nt, Human
acacacacaggagg

SEQ ID NO: 2128652 - RNA, 12 nt, Human
acacacagcucu

SEQ ID NO: 2128653 - RNA, 11 nt, Human
acacacagcuc

SEQ ID NO: 2128654 - RNA, 21 nt, Human
acacacauauaaacaucacac

SEQ ID NO: 2128655 - RNA, 12 nt, Human
acacacauaaag

SEQ ID NO: 2128656 - RNA, 18 nt, Human
acacacauaaaggauaaa

SEQ ID NO: 2128657 - RNA, 17 nt, Human
acacacaggcaacugag

SEQ ID NO: 2128658 - RNA, 19 nt, Human
acacacagcucuguccugg

SEQ ID NO: 2128659 - RNA, 13 nt, Human
acacacaggagga

SEQ ID NO: 2128660 - RNA, 18 nt, Human
acacaccaggcugugggc

SEQ ID NO: 2128661 - RNA, 24 nt, Human
acacaccuguagucccagcuacuc

SEQ ID NO: 2128662 - RNA, 23 nt, Human
acacacgcacacacacacacagg

SEQ ID NO: 2128663 - RNA, 15 nt, Human
acacaccacacauac

SEQ ID NO: 2128664 - RNA, 12 nt, Human
acacaccaggcu

SEQ ID NO: 2128665 - RNA, 16 nt, Human
acacaccaggcugugg

SEQ ID NO: 2128666 - RNA, 22 nt, Human
acacaccaggcugugggccuca

SEQ ID NO: 2128667 - RNA, 11 nt, Human
acacacacagc

SEQ ID NO: 2128668 - RNA, 18 nt, Human
accaauauuguacaguuu

SEQ ID NO: 2128669 - RNA, 18 nt, Human
accaacaucccauugccc

SEQ ID NO: 2128670 - RNA, 19 nt, Human
accaauauuguacaguuuu

SEQ ID NO: 2128671 - RNA, 15 nt, Human
accaauauuguacag

SEQ ID NO: 2128672 - RNA, 14 nt, Human
accaauauuguaca

SEQ ID NO: 2128673 - RNA, 16 nt, Human
accaauauuguacagu

SEQ ID NO: 2128674 - RNA, 17 nt, Human
accaauauuguacaguu

SEQ ID NO: 2128675 - RNA, 15 nt, Human
accaauguucucucu

SEQ ID NO: 2128676 - RNA, 11 nt, Human
accaauauuug

SEQ ID NO: 2128677 - RNA, 13 nt, Human
accaauauuugua

SEQ ID NO: 2128678 - RNA, 16 nt, Human
accaauauuuguagaa

SEQ ID NO: 2128679 - RNA, 19 nt, Human
accaaucaagauaaaggac

SEQ ID NO: 2128680 - RNA, 20 nt, Human
accaaucaagauaaaggaca

SEQ ID NO: 2128681 - RNA, 15 nt, Human
ucaagugaaaaagga

SEQ ID NO: 2128682 - RNA, 15 nt, Human
ucaagucaccuccuu

SEQ ID NO: 2128683 - RNA, 14 nt, Human
ucaagucagcucuu

SEQ ID NO: 2128684 - RNA, 15 nt, Human
ucaagugaaucuaaa

SEQ ID NO: 2128685 - RNA, 19 nt, Human
ucaagugaaucuaaaagcu

SEQ ID NO: 2128686 - RNA, 23 nt, Human
ucaagugaaaaaggaggaagaga

SEQ ID NO: 2128687 - RNA, 14 nt, Human
accacaaaaaugaa

SEQ ID NO: 2128688 - RNA, 16 nt, Human
accaauucaacccuuu

SEQ ID NO: 2128689 - RNA, 16 nt, Human
accaauguuuaaaaaa

SEQ ID NO: 2128690 - RNA, 16 nt, Human
accacaccgcagaagc

SEQ ID NO: 2128691 - RNA, 15 nt, Human
accacaccucccuga

SEQ ID NO: 2128692 - RNA, 16 nt, Human
ucaauuccucugggaa

SEQ ID NO: 2128693 - RNA, 13 nt, Human
ucaauuccugggc

SEQ ID NO: 2128694 - RNA, 17 nt, Human
ucaauuccugggcccca

SEQ ID NO: 2128695 - RNA, 15 nt, Human
ucaauuccucuggga

SEQ ID NO: 2128696 - RNA, 22 nt, Human
accacaccucccugaaccaucc

SEQ ID NO: 2128697 - RNA, 14 nt, Human
ucaauuuucuuuaa

SEQ ID NO: 2128698 - RNA, 16 nt, Human
accacaccucccugaa

SEQ ID NO: 2128699 - RNA, 13 nt, Human
ucacaguuccucg

SEQ ID NO: 2128700 - RNA, 14 nt, Human
ucacaguuccucgc

SEQ ID NO: 2128701 - RNA, 16 nt, Human
ucacaguuccucgccc

SEQ ID NO: 2128702 - RNA, 17 nt, Human
ucacaguuccucgcccu

SEQ ID NO: 2128703 - RNA, 18 nt, Human
ucacaguuccucgcccug

SEQ ID NO: 2128704 - RNA, 19 nt, Human
ucacaguuccucgcccugg

SEQ ID NO: 2128705 - RNA, 20 nt, Human
ucacaguuccucgcccuggg

SEQ ID NO: 2128706 - RNA, 21 nt, Human
ucacaguuccucgcccugggu

SEQ ID NO: 2128707 - RNA, 22 nt, Human
ucacaguuccucgcccuggguc

SEQ ID NO: 2128708 - RNA, 18 nt, Human
ucacauccuguguuucua

SEQ ID NO: 2128709 - RNA, 19 nt, Human
ucacauccuguguuucuag

SEQ ID NO: 2128710 - RNA, 17 nt, Human
ucacauccuguguuucu

SEQ ID NO: 2128711 - RNA, 15 nt, Human
ucacauaucugucau

SEQ ID NO: 2128712 - RNA, 12 nt, Human
ucacauaucugu

SEQ ID NO: 2128713 - RNA, 20 nt, Human
ucacaaauccuaaaagaagc

SEQ ID NO: 2128714 - RNA, 23 nt, Human
ucacaaaugauauuaaaaauugg

SEQ ID NO: 2128715 - RNA, 16 nt, Human
ucacaacaaccugguc

SEQ ID NO: 2128716 - RNA, 19 nt, Human
ucacaccuguaaucccaac

SEQ ID NO: 2128717 - RNA, 22 nt, Human
ucacacgucuggcuucacagau

SEQ ID NO: 2128718 - RNA, 17 nt, Human
ucacaguguugcccagg

SEQ ID NO: 2128719 - RNA, 11 nt, Human
ucacaguguuu

SEQ ID NO: 2128720 - RNA, 14 nt, Human
ucacaguguuucga

SEQ ID NO: 2128721 - RNA, 20 nt, Human
ucacaucuuucacacuucca

SEQ ID NO: 2128722 - RNA, 22 nt, Human
ucacaucuuucacacuuccacc

SEQ ID NO: 2128723 - RNA, 14 nt, Human
ucacaucuuucaca

SEQ ID NO: 2128724 - RNA, 17 nt, Human
ucacaucuuucacacuu

SEQ ID NO: 2128725 - RNA, 22 nt, Human
ucaccaggaauguuaaagucag

SEQ ID NO: 2128726 - RNA, 23 nt, Human
ucaccaguguguggcuuucagag

SEQ ID NO: 2128727 - RNA, 14 nt, Human
ucaccaucucaggc

SEQ ID NO: 2128728 - RNA, 18 nt, Human
ucaccaguguguggcuuu

SEQ ID NO: 2128729 - RNA, 17 nt, Human
ucacccaugaagacagg

SEQ ID NO: 2128730 - RNA, 15 nt, Human
ucaccaucucaggcc

SEQ ID NO: 2128731 - RNA, 16 nt, Human
ucaccaucucaggcca

SEQ ID NO: 2128732 - RNA, 12 nt, Human
ucaccccauccc

SEQ ID NO: 2128733 - RNA, 13 nt, Human
ucaccccauccca

SEQ ID NO: 2128734 - RNA, 13 nt, Human
ucaccccacccuu

SEQ ID NO: 2128735 - RNA, 12 nt, Human
ucaccccacccu

SEQ ID NO: 2128736 - RNA, 20 nt, Human
ucacuauguugcccaggcag

SEQ ID NO: 2128737 - RNA, 19 nt, Human
ucacuauguugcccaggca

SEQ ID NO: 2128738 - RNA, 17 nt, Human
ucacuauguugcccagg

SEQ ID NO: 2128739 - RNA, 18 nt, Human
ucacuauguugcccaggc

SEQ ID NO: 2128740 - RNA, 21 nt, Human
ucacuccaggaaggggcugga

SEQ ID NO: 2128741 - RNA, 23 nt, Human
ucacuccaggaaggggcuggacu

SEQ ID NO: 2128742 - RNA, 16 nt, Human
ucacuccccuccuuuc

SEQ ID NO: 2128743 - RNA, 17 nt, Human
ucacuccccuccuuucc

SEQ ID NO: 2128744 - RNA, 14 nt, Human
ucacucccagucca

SEQ ID NO: 2128745 - RNA, 16 nt, Human
ucacucccuucuccuu

SEQ ID NO: 2128746 - RNA, 18 nt, Human
ucacucccuucuccuuga

SEQ ID NO: 2128747 - RNA, 20 nt, Human
ucacucccuucuccuugaua

SEQ ID NO: 2128748 - RNA, 23 nt, Human
ucacucccuucuccuugauaaca

SEQ ID NO: 2128749 - RNA, 14 nt, Human
ucacuccggugugc

SEQ ID NO: 2128750 - RNA, 17 nt, Human
ucacuccggugugccug

SEQ ID NO: 2128751 - RNA, 19 nt, Human
ucacuccggugugccugca

SEQ ID NO: 2128752 - RNA, 20 nt, Human
ucacuccggugugccugcag

SEQ ID NO: 2128753 - RNA, 21 nt, Human
ucacuccggugugccugcagc

SEQ ID NO: 2128754 - RNA, 22 nt, Human
ucacuccggugugccugcagcc

SEQ ID NO: 2128755 - RNA, 23 nt, Human
ucacuccggugugccugcagccc

SEQ ID NO: 2128756 - RNA, 19 nt, Human
ucacuacucacagucucuu

SEQ ID NO: 2128757 - RNA, 21 nt, Human
ucacuacucacagucucuuua

SEQ ID NO: 2128758 - RNA, 22 nt, Human
ucacuacucacagucucuuuaa

SEQ ID NO: 2128759 - RNA, 20 nt, Human
ucaccuguuuuuaagcuguu

SEQ ID NO: 2128760 - RNA, 19 nt, Human
ucaccuguuuuuaagcugu

SEQ ID NO: 2128761 - RNA, 18 nt, Human
ucaccuguuuuuaagcug

SEQ ID NO: 2128762 - RNA, 23 nt, Human
ucaccugcccagaucccagaagg

SEQ ID NO: 2128763 - RNA, 22 nt, Human
ucaccuguuuuuaagcuguuuc

SEQ ID NO: 2128764 - RNA, 21 nt, Human
ucaccuguuuuuaagcuguuu

SEQ ID NO: 2128765 - RNA, 15 nt, Human
ucaccuuaggcaggg

SEQ ID NO: 2128766 - RNA, 18 nt, Human
ucaccuuaggcagggaag

SEQ ID NO: 2128767 - RNA, 20 nt, Human
ucaccuuaggcagggaagug

SEQ ID NO: 2128768 - RNA, 21 nt, Human
accagccuccaugcugccucc

SEQ ID NO: 2128769 - RNA, 20 nt, Human
accagccuccaugcugccuc

SEQ ID NO: 2128770 - RNA, 19 nt, Human
accagccuccaugcugccu

SEQ ID NO: 2128771 - RNA, 14 nt, Human
accagccuccaugc

SEQ ID NO: 2128772 - RNA, 17 nt, Human
accagagcccaccuugg

SEQ ID NO: 2128773 - RNA, 18 nt, Human
accaggcuugccugcagg

SEQ ID NO: 2128774 - RNA, 19 nt, Human
accaggcugcucagggcug

SEQ ID NO: 2128775 - RNA, 23 nt, Human
accaggcgagagacuuguggccu

SEQ ID NO: 2128776 - RNA, 20 nt, Human
accagccuccguauuucaga

SEQ ID NO: 2128777 - RNA, 23 nt, Human
accagccucucuugguuuccuuc

SEQ ID NO: 2128778 - RNA, 16 nt, Human
ucaccugaagacucau

SEQ ID NO: 2128779 - RNA, 18 nt, Human
ucaccucuggacuggcua

SEQ ID NO: 2128780 - RNA, 19 nt, Human
ucaccucuggacuggcuag

SEQ ID NO: 2128781 - RNA, 12 nt, Human
ucaccucugccu

SEQ ID NO: 2128782 - RNA, 13 nt, Human
ucaccucugccuc

SEQ ID NO: 2128783 - RNA, 14 nt, Human
ucaccucugccuca

SEQ ID NO: 2128784 - RNA, 15 nt, Human
ucaccucugccucaa

SEQ ID NO: 2128785 - RNA, 20 nt, Human
ucaccucuaaaacaguccuu

SEQ ID NO: 2128786 - RNA, 19 nt, Human
accaggcuugccugcaggc

SEQ ID NO: 2128787 - RNA, 23 nt, Human
ucaccucuuaugcacaccuccca

SEQ ID NO: 2128788 - RNA, 11 nt, Human
accagacaggu

SEQ ID NO: 2128789 - RNA, 14 nt, Human
accagacaccuuga

SEQ ID NO: 2128790 - RNA, 19 nt, Human
accagacgguucaccagcc

SEQ ID NO: 2128791 - RNA, 20 nt, Human
accagacgguucaccagccu

SEQ ID NO: 2128792 - RNA, 16 nt, Human
accagagcccaccuug

SEQ ID NO: 2128793 - RNA, 14 nt, Human
accagagcccaccu

SEQ ID NO: 2128794 - RNA, 12 nt, Human
accagagcccac

SEQ ID NO: 2128795 - RNA, 23 nt, Human
accagacuacuugggagcaccgc

SEQ ID NO: 2128796 - RNA, 21 nt, Human
accagacuacuugggagcacc

SEQ ID NO: 2128797 - RNA, 16 nt, Human
accagaaaucaaaaag

SEQ ID NO: 2128798 - RNA, 15 nt, Human
accagaagcaacaga

SEQ ID NO: 2128799 - RNA, 14 nt, Human
accagaagccaaag

SEQ ID NO: 2128800 - RNA, 14 nt, Human
accagaagggaaac

SEQ ID NO: 2128801 - RNA, 16 nt, Human
accagaagggaaacag

SEQ ID NO: 2128802 - RNA, 17 nt, Human
accacugcacuccagcc

SEQ ID NO: 2128803 - RNA, 20 nt, Human
accacugcacuccagccugg

SEQ ID NO: 2128804 - RNA, 19 nt, Human
accacugcugugaacaagu

SEQ ID NO: 2128805 - RNA, 21 nt, Human
accacugcacuccagccuggg

SEQ ID NO: 2128806 - RNA, 18 nt, Human
accacugcacuccagccu

SEQ ID NO: 2128807 - RNA, 17 nt, Human
accacuucauucuugaa

SEQ ID NO: 2128808 - RNA, 13 nt, Human
accacuucauucu

SEQ ID NO: 2128809 - RNA, 15 nt, Human
accacuucuuuuaua

SEQ ID NO: 2128810 - RNA, 16 nt, Human
accacuucuuuuauaa

SEQ ID NO: 2128811 - RNA, 17 nt, Human
accacuucuuuuauaac

SEQ ID NO: 2128812 - RNA, 19 nt, Human
accacuguaaaaugaaauu

SEQ ID NO: 2128813 - RNA, 20 nt, Human
accacuguaaaaugaaauua

SEQ ID NO: 2128814 - RNA, 17 nt, Human
ucagaaucucucuucuu

SEQ ID NO: 2128815 - RNA, 17 nt, Human
ucagaaucugaauguaa

SEQ ID NO: 2128816 - RNA, 18 nt, Human
ucagaaucugaauguaau

SEQ ID NO: 2128817 - RNA, 22 nt, Human
ucagaaucugaauguaauuugu

SEQ ID NO: 2128818 - RNA, 14 nt, Human
ucagaaucuuuccu

SEQ ID NO: 2128819 - RNA, 15 nt, Human
ucagaaucuuuccuu

SEQ ID NO: 2128820 - RNA, 21 nt, Human
ucagaaucuuuccuuccucuc

SEQ ID NO: 2128821 - RNA, 18 nt, Human
ucagaaucucaaauaacu

SEQ ID NO: 2128822 - RNA, 19 nt, Human
ucagaaucucaaauaacua

SEQ ID NO: 2128823 - RNA, 18 nt, Human
ucagagccugcaguuauu

SEQ ID NO: 2128824 - RNA, 15 nt, Human
ucagagccugcaguu

SEQ ID NO: 2128825 - RNA, 14 nt, Human
ucagagccugcagu

SEQ ID NO: 2128826 - RNA, 13 nt, Human
ucagagccugcag

SEQ ID NO: 2128827 - RNA, 12 nt, Human
ucagagccugca

SEQ ID NO: 2128828 - RNA, 19 nt, Human
ucagaaggagaaggaagga

SEQ ID NO: 2128829 - RNA, 23 nt, Human
ucagaaggagaaggaaggagacu

SEQ ID NO: 2128830 - RNA, 12 nt, Human
ucagaaggagaa

SEQ ID NO: 2128831 - RNA, 13 nt, Human
ucagaaggagaag

SEQ ID NO: 2128832 - RNA, 14 nt, Human
ucagaaggagaagg

SEQ ID NO: 2128833 - RNA, 16 nt, Human
ucagaaggagaaggaa

SEQ ID NO: 2128834 - RNA, 18 nt, Human
ucagaaggagaaggaagg

SEQ ID NO: 2128835 - RNA, 19 nt, Human
ucagaaguuucucagcucc

SEQ ID NO: 2128836 - RNA, 14 nt, Human
ucagaagacacuga

SEQ ID NO: 2128837 - RNA, 16 nt, Human
ucagaagccuauugua

SEQ ID NO: 2128838 - RNA, 20 nt, Human
ucagaagccuauuguaaaua

SEQ ID NO: 2128839 - RNA, 22 nt, Human
ucagaagccuauuguaaauaca

SEQ ID NO: 2128840 - RNA, 13 nt, Human
ucagaagccugag

SEQ ID NO: 2128841 - RNA, 15 nt, Human
ucagaagccugaggc

SEQ ID NO: 2128842 - RNA, 20 nt, Human
ucagaagccugaggcuggga

SEQ ID NO: 2128843 - RNA, 21 nt, Human
acccagccccuugagaaaccu

SEQ ID NO: 2128844 - RNA, 20 nt, Human
acccagccccuugagaaacc

SEQ ID NO: 2128845 - RNA, 17 nt, Human
acccagccccuugagaa

SEQ ID NO: 2128846 - RNA, 16 nt, Human
acccagccccuugaga

SEQ ID NO: 2128847 - RNA, 19 nt, Human
acccagcccauucucucuc

SEQ ID NO: 2128848 - RNA, 22 nt, Human
acccagcccauucucucuccug

SEQ ID NO: 2128849 - RNA, 23 nt, Human
acccagcccauucucucuccugu

SEQ ID NO: 2128850 - RNA, 14 nt, Human
accauguacauagc

SEQ ID NO: 2128851 - RNA, 13 nt, Human
accauguaaaaca

SEQ ID NO: 2128852 - RNA, 14 nt, Human
accauguaaaacaa

SEQ ID NO: 2128853 - RNA, 15 nt, Human
accauguaaaacaaa

SEQ ID NO: 2128854 - RNA, 17 nt, Human
accauguaaaacaaaaa

SEQ ID NO: 2128855 - RNA, 20 nt, Human
accauguaaaacaaaaaaca

SEQ ID NO: 2128856 - RNA, 21 nt, Human
accauguaaaacaaaaaacaa

SEQ ID NO: 2128857 - RNA, 22 nt, Human
accauguaaaacaaaaaacaau

SEQ ID NO: 2128858 - RNA, 23 nt, Human
ucacucuuauugcccacgcugga

SEQ ID NO: 2128859 - RNA, 21 nt, Human
ucacucuuauugcccacgcug

SEQ ID NO: 2128860 - RNA, 15 nt, Human
ucacuccuaccuggu

SEQ ID NO: 2128861 - RNA, 12 nt, Human
accauugcugcu

SEQ ID NO: 2128862 - RNA, 16 nt, Human
accauugcugcuccuu

SEQ ID NO: 2128863 - RNA, 23 nt, Human
accauugcugcuccuuagcugcc

SEQ ID NO: 2128864 - RNA, 11 nt, Human
accauugcuuc

SEQ ID NO: 2128865 - RNA, 13 nt, Human
accauugcuucac

SEQ ID NO: 2128866 - RNA, 15 nt, Human
accauugcuucacua

SEQ ID NO: 2128867 - RNA, 16 nt, Human
accauugcuucacuac

SEQ ID NO: 2128868 - RNA, 20 nt, Human
accauugcuucacuacccau

SEQ ID NO: 2128869 - RNA, 21 nt, Human
accauugcuucacuacccauc

SEQ ID NO: 2128870 - RNA, 20 nt, Human
accauucaggaaccuggacc

SEQ ID NO: 2128871 - RNA, 18 nt, Human
accauuaugaagaagaga

SEQ ID NO: 2128872 - RNA, 21 nt, Human
accauguuugagcucagaccc

SEQ ID NO: 2128873 - RNA, 11 nt, Human
acccacugcuu

SEQ ID NO: 2128874 - RNA, 15 nt, Human
acccacugcucuggu

SEQ ID NO: 2128875 - RNA, 14 nt, Human
acccacugcucugg

SEQ ID NO: 2128876 - RNA, 13 nt, Human
acccacugcucug

SEQ ID NO: 2128877 - RNA, 14 nt, Human
acccagcccauucu

SEQ ID NO: 2128878 - RNA, 17 nt, Human
acccagagaggaaucag

SEQ ID NO: 2128879 - RNA, 13 nt, Human
accauuuguaaua

SEQ ID NO: 2128880 - RNA, 14 nt, Human
accauuuguaauaa

SEQ ID NO: 2128881 - RNA, 15 nt, Human
accauuuguaauaaa

SEQ ID NO: 2128882 - RNA, 16 nt, Human
accauuuguaauaaag

SEQ ID NO: 2128883 - RNA, 18 nt, Human
accauuuguaauaaagua

SEQ ID NO: 2128884 - RNA, 19 nt, Human
accauuuguaauaaaguau

SEQ ID NO: 2128885 - RNA, 21 nt, Human
accauuuguaauaaaguauau

SEQ ID NO: 2128886 - RNA, 19 nt, Human
accauugucucagagcagg

SEQ ID NO: 2128887 - RNA, 18 nt, Human
accauugucucagagcag

SEQ ID NO: 2128888 - RNA, 15 nt, Human
accauugucucagag

SEQ ID NO: 2128889 - RNA, 14 nt, Human
accauugucucaga

SEQ ID NO: 2128890 - RNA, 11 nt, Human
acccacugcuc

SEQ ID NO: 2128891 - RNA, 10 nt, Human
acccacugcu

SEQ ID NO: 2128892 - RNA, 16 nt, Human
acccccaaauuuucuu

SEQ ID NO: 2128893 - RNA, 15 nt, Human
acccccacaccucag

SEQ ID NO: 2128894 - RNA, 17 nt, Human
acccccacaccucaguu

SEQ ID NO: 2128895 - RNA, 16 nt, Human
acccccaaggggcagu

SEQ ID NO: 2128896 - RNA, 21 nt, Human
accccaccuuuauuccuucau

SEQ ID NO: 2128897 - RNA, 16 nt, Human
accccacucacagaga

SEQ ID NO: 2128898 - RNA, 18 nt, Human
accccacucacagagaca

SEQ ID NO: 2128899 - RNA, 19 nt, Human
accccacccuuccccuccu

SEQ ID NO: 2128900 - RNA, 13 nt, Human
accccacccuucc

SEQ ID NO: 2128901 - RNA, 24 nt, Human
acccagcgagcccugguggcagug

SEQ ID NO: 2128902 - RNA, 17 nt, Human
acccaggaguguggcca

SEQ ID NO: 2128903 - RNA, 19 nt, Human
acccaggcuggagugcagu

SEQ ID NO: 2128904 - RNA, 23 nt, Human
ucagccaaauguaauugaauaaa

SEQ ID NO: 2128905 - RNA, 20 nt, Human
ucagccagugaccaaccuuu

SEQ ID NO: 2128906 - RNA, 23 nt, Human
ucagccaugaggaguugcuguuu

SEQ ID NO: 2128907 - RNA, 19 nt, Human
ucagccaggagcugggcag

SEQ ID NO: 2128908 - RNA, 14 nt, Human
ucagccaaauguaa

SEQ ID NO: 2128909 - RNA, 18 nt, Human
ucagcauucuuagccugu

SEQ ID NO: 2128910 - RNA, 20 nt, Human
ucagcauucuuagccugugg

SEQ ID NO: 2128911 - RNA, 21 nt, Human
ucagcauucuuagccuguggc

SEQ ID NO: 2128912 - RNA, 16 nt, Human
ucagccaaauguaauu

SEQ ID NO: 2128913 - RNA, 22 nt, Human
ucagccaaauguaauugaauaa

SEQ ID NO: 2128914 - RNA, 17 nt, Human
ucagccaaccuuacuua

SEQ ID NO: 2128915 - RNA, 22 nt, Human
ucagccaaccuuacuuacagca

SEQ ID NO: 2128916 - RNA, 21 nt, Human
ucagccaacgaguaauuuauu

SEQ ID NO: 2128917 - RNA, 21 nt, Human
ucagagccuccuuucuggcuu

SEQ ID NO: 2128918 - RNA, 19 nt, Human
ucagccuacaggccucaca

SEQ ID NO: 2128919 - RNA, 18 nt, Human
ucagccuagccgaccuca

SEQ ID NO: 2128920 - RNA, 19 nt, Human
ucagccuagccgaccucag

SEQ ID NO: 2128921 - RNA, 20 nt, Human
ucagccuagccgaccucagc

SEQ ID NO: 2128922 - RNA, 21 nt, Human
ucagccuagccgaccucagcc

SEQ ID NO: 2128923 - RNA, 22 nt, Human
ucagccuagccgaccucagccu

SEQ ID NO: 2128924 - RNA, 23 nt, Human
acccagcgagcccugguggcagu

SEQ ID NO: 2128925 - RNA, 19 nt, Human
acccagcgagcccuggugg

SEQ ID NO: 2128926 - RNA, 23 nt, Human
ucagccguguaaccauggaccca

SEQ ID NO: 2128927 - RNA, 14 nt, Human
ucagcccacccccc

SEQ ID NO: 2128928 - RNA, 21 nt, Human
ucagcccugggccccaccacc

SEQ ID NO: 2128929 - RNA, 22 nt, Human
ucagcccugggccccaccaccu

SEQ ID NO: 2128930 - RNA, 23 nt, Human
ucagcccugggccccaccaccua

SEQ ID NO: 2128931 - RNA, 12 nt, Human
ucagcccacccc

SEQ ID NO: 2128932 - RNA, 13 nt, Human
ucagcccaccccc

SEQ ID NO: 2128933 - RNA, 21 nt, Human
ucagccaugaggaguugcugu

SEQ ID NO: 2128934 - RNA, 20 nt, Human
ucagcuuuuugucuuuucug

SEQ ID NO: 2128935 - RNA, 14 nt, Human
ucagcuucuuaaua

SEQ ID NO: 2128936 - RNA, 15 nt, Human
ucagcuugcugcccu

SEQ ID NO: 2128937 - RNA, 20 nt, Human
ucaggaaaacugacagagga

SEQ ID NO: 2128938 - RNA, 21 nt, Human
ucaggaaaacugacagaggag

SEQ ID NO: 2128939 - RNA, 22 nt, Human
ucaggaaaacugacagaggagg

SEQ ID NO: 2128940 - RNA, 14 nt, Human
ucaggaaagacgga

SEQ ID NO: 2128941 - RNA, 20 nt, Human
ucagcuauuuacugccaaag

SEQ ID NO: 2128942 - RNA, 19 nt, Human
ucagcuauuuacugccaaa

SEQ ID NO: 2128943 - RNA, 17 nt, Human
ucagcuagcaaaagaag

SEQ ID NO: 2128944 - RNA, 22 nt, Human
ucagcuagcaaaagaaguaaca

SEQ ID NO: 2128945 - RNA, 14 nt, Human
ucagcggggacagc

SEQ ID NO: 2128946 - RNA, 20 nt, Human
ucagcuuguaaauagcucag

SEQ ID NO: 2128947 - RNA, 13 nt, Human
ucagcuucuuaau

SEQ ID NO: 2128948 - RNA, 19 nt, Human
accccuguggagcccgcac

SEQ ID NO: 2128949 - RNA, 13 nt, Human
accccuguggagc

SEQ ID NO: 2128950 - RNA, 18 nt, Human
accccuguggagcccgca

SEQ ID NO: 2128951 - RNA, 15 nt, Human
accccuucgcuccug

SEQ ID NO: 2128952 - RNA, 14 nt, Human
accccuucgcuccu

SEQ ID NO: 2128953 - RNA, 16 nt, Human
accccuucgcuccugu

SEQ ID NO: 2128954 - RNA, 22 nt, Human
ucagccuuggauaaugcuguug

SEQ ID NO: 2128955 - RNA, 12 nt, Human
acccccacccca

SEQ ID NO: 2128956 - RNA, 14 nt, Human
acccccaccccaca

SEQ ID NO: 2128957 - RNA, 12 nt, Human
accccccucauu

SEQ ID NO: 2128958 - RNA, 12 nt, Human
accccccugggc

SEQ ID NO: 2128959 - RNA, 15 nt, Human
accccccugggcuga

SEQ ID NO: 2128960 - RNA, 15 nt, Human
acccccaccccacac

SEQ ID NO: 2128961 - RNA, 15 nt, Human
ucaagacuuccagag

SEQ ID NO: 2128962 - RNA, 22 nt, Human
ucaagacccuuuuggguuucug

SEQ ID NO: 2128963 - RNA, 16 nt, Human
ucaagaccuucucccc

SEQ ID NO: 2128964 - RNA, 13 nt, Human
ucaagaccagccu

SEQ ID NO: 2128965 - RNA, 15 nt, Human
ucaagaccagccugg

SEQ ID NO: 2128966 - RNA, 16 nt, Human
ucaagaccagccuggc

SEQ ID NO: 2128967 - RNA, 16 nt, Human
ucaagaccccugucuu

SEQ ID NO: 2128968 - RNA, 23 nt, Human
ucaagaagaagauggauuggugu

SEQ ID NO: 2128969 - RNA, 17 nt, Human
ucaagaaagccagucuu

SEQ ID NO: 2128970 - RNA, 18 nt, Human
ucaagaaagccagucuua

SEQ ID NO: 2128971 - RNA, 20 nt, Human
ucaagaaagccagucuuaac

SEQ ID NO: 2128972 - RNA, 14 nt, Human
ucaacaucaauguu

SEQ ID NO: 2128973 - RNA, 15 nt, Human
ucaacaucaauguuc

SEQ ID NO: 2128974 - RNA, 16 nt, Human
ucaacaucaauguuca

SEQ ID NO: 2128975 - RNA, 17 nt, Human
ucaacaucaauguucau

SEQ ID NO: 2128976 - RNA, 18 nt, Human
ucaacaucaauguucauu

SEQ ID NO: 2128977 - RNA, 19 nt, Human
ucaacaucaauguucauug

SEQ ID NO: 2128978 - RNA, 20 nt, Human
ucaacaucaauguucauugu

SEQ ID NO: 2128979 - RNA, 23 nt, Human
ucaacaucaauguucauuguaau

SEQ ID NO: 2128980 - RNA, 15 nt, Human
ucaacauguuacuga

SEQ ID NO: 2128981 - RNA, 19 nt, Human
ucaacauguuacugaccag

SEQ ID NO: 2128982 - RNA, 21 nt, Human
ucaacaucaauguucauugua

SEQ ID NO: 2128983 - RNA, 15 nt, Human
ucaacaucuuuuaca

SEQ ID NO: 2128984 - RNA, 22 nt, Human
ucaacauguuacugaccagcaa

SEQ ID NO: 2128985 - RNA, 20 nt, Human
ucaacauguuacugaccagc

SEQ ID NO: 2128986 - RNA, 21 nt, Human
ucaacauguuacugaccagca

SEQ ID NO: 2128987 - RNA, 17 nt, Human
ucaagaugucagacugg

SEQ ID NO: 2128988 - RNA, 16 nt, Human
ucaagggggacugucu

SEQ ID NO: 2128989 - RNA, 14 nt, Human
ucaagggcuguagg

SEQ ID NO: 2128990 - RNA, 18 nt, Human
ucaagaugucagacuggc

SEQ ID NO: 2128991 - RNA, 20 nt, Human
ucaagauguccuccuuguuc

SEQ ID NO: 2128992 - RNA, 15 nt, Human
ucaaggucguuuuuu

SEQ ID NO: 2128993 - RNA, 15 nt, Human
ucaagguaaaauucu

SEQ ID NO: 2128994 - RNA, 16 nt, Human
ucaagguaaaauucua

SEQ ID NO: 2128995 - RNA, 17 nt, Human
ucaagguaaaauucuaa

SEQ ID NO: 2128996 - RNA, 18 nt, Human
ucaagguaaaauucuaaa

SEQ ID NO: 2128997 - RNA, 20 nt, Human
ucaagguaaaauucuaaaua

SEQ ID NO: 2128998 - RNA, 15 nt, Human
ucaaguauccuuguu

SEQ ID NO: 2128999 - RNA, 15 nt, Human
ucaaguauuggcaaa

SEQ ID NO: 2129000 - RNA, 16 nt, Human
ucaaguauuggcaaag

SEQ ID NO: 2129001 - RNA, 22 nt, Human
acauuagcaguuugcuuuguau

SEQ ID NO: 2129002 - RNA, 18 nt, Human
acauuagcaguuugcuuu

SEQ ID NO: 2129003 - RNA, 19 nt, Human
acauuaggcauugagacuu

SEQ ID NO: 2129004 - RNA, 22 nt, Human
acauuaacaguuuuccaugaaa

SEQ ID NO: 2129005 - RNA, 16 nt, Human
acauuaacaguuuucc

SEQ ID NO: 2129006 - RNA, 17 nt, Human
acauuaacaguuuucca

SEQ ID NO: 2129007 - RNA, 18 nt, Human
acauuaacaguuuuccau

SEQ ID NO: 2129008 - RNA, 20 nt, Human
acauuaacaguuuuccauga

SEQ ID NO: 2129009 - RNA, 18 nt, Human
acauuaguucuauuucua

SEQ ID NO: 2129010 - RNA, 19 nt, Human
acauuaguucuauuucuau

SEQ ID NO: 2129011 - RNA, 22 nt, Human
acauucaagauuaaacugagug

SEQ ID NO: 2129012 - RNA, 23 nt, Human
acauucaagauuaaacugaguga

SEQ ID NO: 2129013 - RNA, 15 nt, Human
acauucaauaagcau

SEQ ID NO: 2129014 - RNA, 12 nt, Human
acauucaauguu

SEQ ID NO: 2129015 - RNA, 16 nt, Human
acauucagaacaccaa

SEQ ID NO: 2129016 - RNA, 23 nt, Human
acauucaauaagcaucaaacucu

SEQ ID NO: 2129017 - RNA, 15 nt, Human
acaugucccuacacc

SEQ ID NO: 2129018 - RNA, 11 nt, Human
acauuaacagu

SEQ ID NO: 2129019 - RNA, 12 nt, Human
acauuaacaguu

SEQ ID NO: 2129020 - RNA, 21 nt, Human
acaugcugaacaucacagcuu

SEQ ID NO: 2129021 - RNA, 14 nt, Human
acaugcugaacauc

SEQ ID NO: 2129022 - RNA, 18 nt, Human
acaugcuggacaggucug

SEQ ID NO: 2129023 - RNA, 22 nt, Human
acaugcuggacaggucugggag

SEQ ID NO: 2129024 - RNA, 12 nt, Human
ucaacagagaag

SEQ ID NO: 2129025 - RNA, 17 nt, Human
ucaacagagaaggcagg

SEQ ID NO: 2129026 - RNA, 19 nt, Human
ucaacagagaaggcaggaa

SEQ ID NO: 2129027 - RNA, 22 nt, Human
ucaacagagaaggcaggaaugu

SEQ ID NO: 2129028 - RNA, 14 nt, Human
ucaacagggcagca

SEQ ID NO: 2129029 - RNA, 23 nt, Human
ucaaauuuguaggguuucuaggu

SEQ ID NO: 2129030 - RNA, 20 nt, Human
ucaaauuuguaggguuucua

SEQ ID NO: 2129031 - RNA, 23 nt, Human
ucaacacuuaaggguuuuagaaa

SEQ ID NO: 2129032 - RNA, 18 nt, Human
acauucugcuuucaucuu

SEQ ID NO: 2129033 - RNA, 14 nt, Human
acauucuguaaaau

SEQ ID NO: 2129034 - RNA, 16 nt, Human
acauucugccaggccc

SEQ ID NO: 2129035 - RNA, 12 nt, Human
acauucugcuuu

SEQ ID NO: 2129036 - RNA, 17 nt, Human
ucaaagcugaagccgcc

SEQ ID NO: 2129037 - RNA, 19 nt, Human
ucaaaggcacagugaaggc

SEQ ID NO: 2129038 - RNA, 20 nt, Human
ucaaagcuugaagaucguua

SEQ ID NO: 2129039 - RNA, 17 nt, Human
ucaaagcuuccauucca

SEQ ID NO: 2129040 - RNA, 21 nt, Human
ucaaagcuuccauuccacauc

SEQ ID NO: 2129041 - RNA, 14 nt, Human
ucaaagcuugaaga

SEQ ID NO: 2129042 - RNA, 18 nt, Human
ucaaagccaaguuuauau

SEQ ID NO: 2129043 - RNA, 14 nt, Human
ucaaacaaagccag

SEQ ID NO: 2129044 - RNA, 15 nt, Human
ucaaacaaagccaga

SEQ ID NO: 2129045 - RNA, 16 nt, Human
ucaaacaaagccagaa

SEQ ID NO: 2129046 - RNA, 17 nt, Human
ucaaacaaagccagaag

SEQ ID NO: 2129047 - RNA, 21 nt, Human
ucaaacaaagccagaagcuga

SEQ ID NO: 2129048 - RNA, 13 nt, Human
ucaaauacaucuu

SEQ ID NO: 2129049 - RNA, 18 nt, Human
ucaaauaacuaaaaggua

SEQ ID NO: 2129050 - RNA, 21 nt, Human
acaugcuaccugaucccacuc

SEQ ID NO: 2129051 - RNA, 15 nt, Human
acaugaucuucuuua

SEQ ID NO: 2129052 - RNA, 17 nt, Human
acaugaucuucuuuaua

SEQ ID NO: 2129053 - RNA, 15 nt, Human
ucaaaauauguucuu

SEQ ID NO: 2129054 - RNA, 13 nt, Human
ucaaaauaaaaac

SEQ ID NO: 2129055 - RNA, 20 nt, Human
ucaaaauaaaaaccaagaag

SEQ ID NO: 2129056 - RNA, 14 nt, Human
ucaaaauaaauuga

SEQ ID NO: 2129057 - RNA, 16 nt, Human
ucaaaauaaauugaaa

SEQ ID NO: 2129058 - RNA, 18 nt, Human
ucaaaagcaaaugagauc

SEQ ID NO: 2129059 - RNA, 14 nt, Human
ucaaaaguugaaau

SEQ ID NO: 2129060 - RNA, 15 nt, Human
ucaaaaguugaaauu

SEQ ID NO: 2129061 - RNA, 16 nt, Human
ucaaaaguugaaauua

SEQ ID NO: 2129062 - RNA, 15 nt, Human
ucaaaaugacagcca

SEQ ID NO: 2129063 - RNA, 14 nt, Human
ucaaaaugucugua

SEQ ID NO: 2129064 - RNA, 19 nt, Human
ucaaaagaaucagaaacag

SEQ ID NO: 2129065 - RNA, 19 nt, Human
uauuuuuauauagcuugaa

SEQ ID NO: 2129066 - RNA, 23 nt, Human
uauuuuuauauagcuugaaacau

SEQ ID NO: 2129067 - RNA, 15 nt, Human
uauuuuuauacagua

SEQ ID NO: 2129068 - RNA, 13 nt, Human
uauuuuuagaugg

SEQ ID NO: 2129069 - RNA, 20 nt, Human
uauuuuuagaugguuacacu

SEQ ID NO: 2129070 - RNA, 22 nt, Human
uauuuuuagaugguuacacugu

SEQ ID NO: 2129071 - RNA, 23 nt, Human
uauuuuuagaugguuacacuguu

SEQ ID NO: 2129072 - RNA, 16 nt, Human
acaucucauccaucaa

SEQ ID NO: 2129073 - RNA, 17 nt, Human
uauuuuuaauuaaauaa

SEQ ID NO: 2129074 - RNA, 21 nt, Human
acauagcuuacaagccagcug

SEQ ID NO: 2129075 - RNA, 15 nt, Human
acauagaugucccuu

SEQ ID NO: 2129076 - RNA, 17 nt, Human
acauagauucaccugua

SEQ ID NO: 2129077 - RNA, 19 nt, Human
acauagauucaccuguaaa

SEQ ID NO: 2129078 - RNA, 20 nt, Human
acauagauucaccuguaaaa

SEQ ID NO: 2129079 - RNA, 22 nt, Human
acauagauucaccuguaaaacu

SEQ ID NO: 2129080 - RNA, 16 nt, Human
acauagacuagagaaa

SEQ ID NO: 2129081 - RNA, 17 nt, Human
acauagacuagagaaac

SEQ ID NO: 2129082 - RNA, 13 nt, Human
acauagauguccc

SEQ ID NO: 2129083 - RNA, 20 nt, Human
acauauaaacaucacacaca

SEQ ID NO: 2129084 - RNA, 17 nt, Human
acauaguguaggcuuua

SEQ ID NO: 2129085 - RNA, 19 nt, Human
acauaguguaggcuuuacu

SEQ ID NO: 2129086 - RNA, 23 nt, Human
acauaguguaggcuuuacuuagc

SEQ ID NO: 2129087 - RNA, 16 nt, Human
acauauaauauauguu

SEQ ID NO: 2129088 - RNA, 21 nt, Human
acauagugaugguuccccugu

SEQ ID NO: 2129089 - RNA, 16 nt, Human
acauagugaugguucc

SEQ ID NO: 2129090 - RNA, 16 nt, Human
acauagugaaaguuua

SEQ ID NO: 2129091 - RNA, 22 nt, Human
acauagcuugauaaagggccaa

SEQ ID NO: 2129092 - RNA, 13 nt, Human
acauaugugaaua

SEQ ID NO: 2129093 - RNA, 13 nt, Human
acauauguaaaau

SEQ ID NO: 2129094 - RNA, 14 nt, Human
acauauguaaaaua

SEQ ID NO: 2129095 - RNA, 18 nt, Human
acauauuaggaaaauaug

SEQ ID NO: 2129096 - RNA, 14 nt, Human
acauauuaugucuu

SEQ ID NO: 2129097 - RNA, 15 nt, Human
acauauauacacaca

SEQ ID NO: 2129098 - RNA, 20 nt, Human
acauauauauauuuuuuaau

SEQ ID NO: 2129099 - RNA, 15 nt, Human
acauaugaaauuuaa

SEQ ID NO: 2129100 - RNA, 18 nt, Human
acauaugaaauuuaauau

SEQ ID NO: 2129101 - RNA, 15 nt, Human
acauaugaaaauaca

SEQ ID NO: 2129102 - RNA, 16 nt, Human
acaucaacaucuuggu

SEQ ID NO: 2129103 - RNA, 18 nt, Human
acaucaacaucuugguca

SEQ ID NO: 2129104 - RNA, 14 nt, Human
acaucaagcacaga

SEQ ID NO: 2129105 - RNA, 18 nt, Human
acaucaagcacagaagga

SEQ ID NO: 2129106 - RNA, 13 nt, Human
acaucaauguuca

SEQ ID NO: 2129107 - RNA, 20 nt, Human
acaucaauguucauuguaau

SEQ ID NO: 2129108 - RNA, 17 nt, Human
acaucaauguucauugu

SEQ ID NO: 2129109 - RNA, 18 nt, Human
acaucaauguucauugua

SEQ ID NO: 2129110 - RNA, 14 nt, Human
acaucaauguucau

SEQ ID NO: 2129111 - RNA, 15 nt, Human
acaucaauguucauu

SEQ ID NO: 2129112 - RNA, 16 nt, Human
acaucaauguucauug

SEQ ID NO: 2129113 - RNA, 20 nt, Human
acauauuuguuaaauauuua

SEQ ID NO: 2129114 - RNA, 14 nt, Human
acauauuuguuaaa

SEQ ID NO: 2129115 - RNA, 19 nt, Human
acauauuuguuaaauauuu

SEQ ID NO: 2129116 - RNA, 20 nt, Human
acauauucauuuggaaauaa

SEQ ID NO: 2129117 - RNA, 12 nt, Human
acauauucauuu

SEQ ID NO: 2129118 - RNA, 13 nt, Human
acaucacacacac

SEQ ID NO: 2129119 - RNA, 20 nt, Human
acauaugcuuuaagaaucga

SEQ ID NO: 2129120 - RNA, 13 nt, Human
acaucacaggaca

SEQ ID NO: 2129121 - RNA, 14 nt, Human
acaucuuaguauuu

SEQ ID NO: 2129122 - RNA, 18 nt, Human
acaucuuaguauuugcau

SEQ ID NO: 2129123 - RNA, 16 nt, Human
acaucuguuuuaaauu

SEQ ID NO: 2129124 - RNA, 17 nt, Human
acaucuguuuuaaauuu

SEQ ID NO: 2129125 - RNA, 23 nt, Human
acaucuucccuagaggguuccug

SEQ ID NO: 2129126 - RNA, 16 nt, Human
acaucuucagcaaaua

SEQ ID NO: 2129127 - RNA, 13 nt, Human
acaucuucaaagc

SEQ ID NO: 2129128 - RNA, 11 nt, Human
acaucuuccac

SEQ ID NO: 2129129 - RNA, 15 nt, Human
acaucuuccacaggu

SEQ ID NO: 2129130 - RNA, 23 nt, Human
acaucuuccacaggucucagaau

SEQ ID NO: 2129131 - RNA, 14 nt, Human
acaucuugcucugc

SEQ ID NO: 2129132 - RNA, 13 nt, Human
acaucuugcucug

SEQ ID NO: 2129133 - RNA, 21 nt, Human
acaucuccuccauacucagga

SEQ ID NO: 2129134 - RNA, 20 nt, Human
acaucucuuugaugucauau

SEQ ID NO: 2129135 - RNA, 13 nt, Human
acaucugaaagcc

SEQ ID NO: 2129136 - RNA, 22 nt, Human
acaucuggaaaauaaaaggucu

SEQ ID NO: 2129137 - RNA, 19 nt, Human
acaucuugcucugcugaca

SEQ ID NO: 2129138 - RNA, 18 nt, Human
acaucuugcucugcugac

SEQ ID NO: 2129139 - RNA, 21 nt, Human
acaucuugcucugcugacaga

SEQ ID NO: 2129140 - RNA, 21 nt, Human
uauuugggguugcaucagaaa

SEQ ID NO: 2129141 - RNA, 22 nt, Human
uauuugggguugcaucagaaau

SEQ ID NO: 2129142 - RNA, 17 nt, Human
uauuugguacuguauuu

SEQ ID NO: 2129143 - RNA, 15 nt, Human
acaguuuuuauugcu

SEQ ID NO: 2129144 - RNA, 19 nt, Human
acaguuuuccuaaauguau

SEQ ID NO: 2129145 - RNA, 20 nt, Human
acaguuuuccuaaauguaua

SEQ ID NO: 2129146 - RNA, 14 nt, Human
acaguuuuccuucu

SEQ ID NO: 2129147 - RNA, 22 nt, Human
acaguuuuccuucucaucugug

SEQ ID NO: 2129148 - RNA, 13 nt, Human
acaguuuuaaaga

SEQ ID NO: 2129149 - RNA, 14 nt, Human
acaguuuuaaagaa

SEQ ID NO: 2129150 - RNA, 19 nt, Human
acaguuuuaaagaaucauu

SEQ ID NO: 2129151 - RNA, 21 nt, Human
acaguuuuaaagaaucauuau

SEQ ID NO: 2129152 - RNA, 12 nt, Human
acaguuuuccau

SEQ ID NO: 2129153 - RNA, 14 nt, Human
acaguuuuccauga

SEQ ID NO: 2129154 - RNA, 15 nt, Human
acaguuuuccaugaa

SEQ ID NO: 2129155 - RNA, 16 nt, Human
acaguuuuccaugaaa

SEQ ID NO: 2129156 - RNA, 17 nt, Human
acaguuuuccaugaaaa

SEQ ID NO: 2129157 - RNA, 18 nt, Human
acaguuuuccaugaaaac

SEQ ID NO: 2129158 - RNA, 19 nt, Human
acaguuuuccaugaaaacg

SEQ ID NO: 2129159 - RNA, 21 nt, Human
acaguuuuccaugaaaacguu

SEQ ID NO: 2129160 - RNA, 23 nt, Human
acaguuuuccaugaaaacguuuu

SEQ ID NO: 2129161 - RNA, 15 nt, Human
acauaccagcuuaga

SEQ ID NO: 2129162 - RNA, 14 nt, Human
acauacucugcuua

SEQ ID NO: 2129163 - RNA, 12 nt, Human
acauacuucagc

SEQ ID NO: 2129164 - RNA, 24 nt, Human
acauacuccuuccaucaaauagaa

SEQ ID NO: 2129165 - RNA, 12 nt, Human
acauacugcugu

SEQ ID NO: 2129166 - RNA, 15 nt, Human
uauuucgaaagcugc

SEQ ID NO: 2129167 - RNA, 15 nt, Human
uauuuccuuaaacug

SEQ ID NO: 2129168 - RNA, 19 nt, Human
uauuuccuuaaacugugug

SEQ ID NO: 2129169 - RNA, 18 nt, Human
uauuucccucucauuuug

SEQ ID NO: 2129170 - RNA, 23 nt, Human
uauuuccuauauuguuuucagug

SEQ ID NO: 2129171 - RNA, 22 nt, Human
uauuucccucaccuuucccauc

SEQ ID NO: 2129172 - RNA, 20 nt, Human
uaugaagaaaaaauacauuu

SEQ ID NO: 2129173 - RNA, 13 nt, Human
uaugaagaaaaaa

SEQ ID NO: 2129174 - RNA, 15 nt, Human
uaugaagaaaaaaua

SEQ ID NO: 2129175 - RNA, 16 nt, Human
uaugaagaaaaaauac

SEQ ID NO: 2129176 - RNA, 15 nt, Human
uaugaagaagagagu

SEQ ID NO: 2129177 - RNA, 21 nt, Human
uaugaagcuaccucaaacuuc

SEQ ID NO: 2129178 - RNA, 20 nt, Human
acaguugaaaaacagcugag

SEQ ID NO: 2129179 - RNA, 15 nt, Human
acaguugcugucaua

SEQ ID NO: 2129180 - RNA, 21 nt, Human
acaguugcugucauaagaaug

SEQ ID NO: 2129181 - RNA, 22 nt, Human
acaguugcugucauaagaauga

SEQ ID NO: 2129182 - RNA, 15 nt, Human
acaguugaaaaacag

SEQ ID NO: 2129183 - RNA, 16 nt, Human
acaguugaaaaacagc

SEQ ID NO: 2129184 - RNA, 22 nt, Human
acaguucuuuuguuguaaagag

SEQ ID NO: 2129185 - RNA, 20 nt, Human
acaguugggaaaauaugucc

SEQ ID NO: 2129186 - RNA, 19 nt, Human
acaguuucuuuuuucuuac

SEQ ID NO: 2129187 - RNA, 19 nt, Human
uccaaguccacaguggaac

SEQ ID NO: 2129188 - RNA, 18 nt, Human
uccaaggguacuaaggaa

SEQ ID NO: 2129189 - RNA, 21 nt, Human
uccaagcuggucccacucagu

SEQ ID NO: 2129190 - RNA, 14 nt, Human
uccaauccucacug

SEQ ID NO: 2129191 - RNA, 15 nt, Human
uccaauccucacugg

SEQ ID NO: 2129192 - RNA, 16 nt, Human
uccaauccucacuggg

SEQ ID NO: 2129193 - RNA, 17 nt, Human
uccaauccucacugggu

SEQ ID NO: 2129194 - RNA, 18 nt, Human
uccaauccucacugggug

SEQ ID NO: 2129195 - RNA, 22 nt, Human
uccaauccuggcucuguggcuu

SEQ ID NO: 2129196 - RNA, 18 nt, Human
uccaaucccaccaacccu

SEQ ID NO: 2129197 - RNA, 20 nt, Human
uccaagcuggucccacucag

SEQ ID NO: 2129198 - RNA, 16 nt, Human
uccaagcuggucccac

SEQ ID NO: 2129199 - RNA, 15 nt, Human
uccaacuucauuuga

SEQ ID NO: 2129200 - RNA, 15 nt, Human
accugaaaauguuag

SEQ ID NO: 2129201 - RNA, 12 nt, Human
uccaacugcugc

SEQ ID NO: 2129202 - RNA, 16 nt, Human
uccaacugcugcccca

SEQ ID NO: 2129203 - RNA, 12 nt, Human
uccaacuccagu

SEQ ID NO: 2129204 - RNA, 21 nt, Human
uccaacuccaguacuggagcu

SEQ ID NO: 2129205 - RNA, 24 nt, Human
uccaacucuucccccucucccagu

SEQ ID NO: 2129206 - RNA, 11 nt, Human
uccaacuccag

SEQ ID NO: 2129207 - RNA, 18 nt, Human
uccaaccuaaccccuuuc

SEQ ID NO: 2129208 - RNA, 20 nt, Human
uccaaccuaaccccuuuccu

SEQ ID NO: 2129209 - RNA, 21 nt, Human
uccaaccuaaccccuuuccug

SEQ ID NO: 2129210 - RNA, 23 nt, Human
uccaaccuaaccccuuuccugcg

SEQ ID NO: 2129211 - RNA, 14 nt, Human
uccaaccuggacaa

SEQ ID NO: 2129212 - RNA, 17 nt, Human
uccaaccuggacaacaa

SEQ ID NO: 2129213 - RNA, 18 nt, Human
accugccacuaggcuggg

SEQ ID NO: 2129214 - RNA, 19 nt, Human
accugccacuaggcugggu

SEQ ID NO: 2129215 - RNA, 21 nt, Human
accugccacuaggcugggugc

SEQ ID NO: 2129216 - RNA, 22 nt, Human
accugccacuaggcugggugcc

SEQ ID NO: 2129217 - RNA, 14 nt, Human
accugccagccugg

SEQ ID NO: 2129218 - RNA, 15 nt, Human
accugccagccuggc

SEQ ID NO: 2129219 - RNA, 16 nt, Human
accugccagccuggcu

SEQ ID NO: 2129220 - RNA, 18 nt, Human
accugccagccuggcuuc

SEQ ID NO: 2129221 - RNA, 21 nt, Human
accugccagccuggcuucugg

SEQ ID NO: 2129222 - RNA, 15 nt, Human
uccaacccaugauga

SEQ ID NO: 2129223 - RNA, 17 nt, Human
uccaaccccccaccugc

SEQ ID NO: 2129224 - RNA, 22 nt, Human
uccaacccaugaugagcuccuc

SEQ ID NO: 2129225 - RNA, 16 nt, Human
uccaacccgaggcccg

SEQ ID NO: 2129226 - RNA, 15 nt, Human
uccacccaggagccc

SEQ ID NO: 2129227 - RNA, 14 nt, Human
uccacccaggagcc

SEQ ID NO: 2129228 - RNA, 12 nt, Human
uccacccaggag

SEQ ID NO: 2129229 - RNA, 12 nt, Human
uccacccagccc

SEQ ID NO: 2129230 - RNA, 19 nt, Human
uccacccaccucagccucc

SEQ ID NO: 2129231 - RNA, 18 nt, Human
uccacccaccucagccuc

SEQ ID NO: 2129232 - RNA, 17 nt, Human
uccacccaccucagccu

SEQ ID NO: 2129233 - RNA, 14 nt, Human
uccaaucuuguuuc

SEQ ID NO: 2129234 - RNA, 17 nt, Human
uccaaucuuguuuccaa

SEQ ID NO: 2129235 - RNA, 18 nt, Human
uccaaucuuguuuccaaa

SEQ ID NO: 2129236 - RNA, 13 nt, Human
uccacccagccca

SEQ ID NO: 2129237 - RNA, 14 nt, Human
uccacccagcccau

SEQ ID NO: 2129238 - RNA, 15 nt, Human
uccacccagcccauu

SEQ ID NO: 2129239 - RNA, 17 nt, Human
uccacccagcccauucu

SEQ ID NO: 2129240 - RNA, 17 nt, Human
accuggguucccuuucc

SEQ ID NO: 2129241 - RNA, 22 nt, Human
accuggguucccuuuccuucca

SEQ ID NO: 2129242 - RNA, 21 nt, Human
accuggucacaggacucugcc

SEQ ID NO: 2129243 - RNA, 20 nt, Human
accuguuuuuaagcuguuuc

SEQ ID NO: 2129244 - RNA, 19 nt, Human
accuguuuuuaagcuguuu

SEQ ID NO: 2129245 - RNA, 18 nt, Human
accuguuuuuaagcuguu

SEQ ID NO: 2129246 - RNA, 16 nt, Human
accuguuuuuaagcug

SEQ ID NO: 2129247 - RNA, 12 nt, Human
accuuaaauuaa

SEQ ID NO: 2129248 - RNA, 13 nt, Human
accuuaaauuaaa

SEQ ID NO: 2129249 - RNA, 14 nt, Human
accuuaaauuaaac

SEQ ID NO: 2129250 - RNA, 16 nt, Human
accuuaaauuaaacaa

SEQ ID NO: 2129251 - RNA, 17 nt, Human
accuuaaauuaaacaau

SEQ ID NO: 2129252 - RNA, 19 nt, Human
accuuaaauuaaacaauuu

SEQ ID NO: 2129253 - RNA, 21 nt, Human
accuuaaauuaaacaauuuau

SEQ ID NO: 2129254 - RNA, 22 nt, Human
accuuaaauuaaacaauuuauu

SEQ ID NO: 2129255 - RNA, 17 nt, Human
uccacucaggucuguuu

SEQ ID NO: 2129256 - RNA, 19 nt, Human
uccaccuucccaugcccug

SEQ ID NO: 2129257 - RNA, 18 nt, Human
uccaccuucccaugcccu

SEQ ID NO: 2129258 - RNA, 16 nt, Human
uccaccuucccaugcc

SEQ ID NO: 2129259 - RNA, 23 nt, Human
accuucaauaaaguaucuacaug

SEQ ID NO: 2129260 - RNA, 13 nt, Human
accuucaauaaag

SEQ ID NO: 2129261 - RNA, 14 nt, Human
accuucaauaaagu

SEQ ID NO: 2129262 - RNA, 15 nt, Human
accuucaauaaagua

SEQ ID NO: 2129263 - RNA, 17 nt, Human
accuucaauaaaguauc

SEQ ID NO: 2129264 - RNA, 19 nt, Human
accuucaauaaaguaucua

SEQ ID NO: 2129265 - RNA, 20 nt, Human
accuucaauaaaguaucuac

SEQ ID NO: 2129266 - RNA, 16 nt, Human
accuucaauuccuggg

SEQ ID NO: 2129267 - RNA, 12 nt, Human
accuucaauaaa

SEQ ID NO: 2129268 - RNA, 13 nt, Human
accuucaaagcug

SEQ ID NO: 2129269 - RNA, 14 nt, Human
accuucaaagcuga

SEQ ID NO: 2129270 - RNA, 11 nt, Human
accuuaucuua

SEQ ID NO: 2129271 - RNA, 18 nt, Human
accuuauuguacguuuaa

SEQ ID NO: 2129272 - RNA, 22 nt, Human
accuuauuguaccucucuuaua

SEQ ID NO: 2129273 - RNA, 20 nt, Human
accuuauuguaccucucuua

SEQ ID NO: 2129274 - RNA, 18 nt, Human
accuuauuguaccucucu

SEQ ID NO: 2129275 - RNA, 17 nt, Human
accuuauuguaccucuc

SEQ ID NO: 2129276 - RNA, 14 nt, Human
accuuauuguaccu

SEQ ID NO: 2129277 - RNA, 23 nt, Human
accuuaucugugcgugaaacaca

SEQ ID NO: 2129278 - RNA, 14 nt, Human
uccagagacuggga

SEQ ID NO: 2129279 - RNA, 19 nt, Human
uccagagagagaagugccc

SEQ ID NO: 2129280 - RNA, 18 nt, Human
uccagacccggcugcgug

SEQ ID NO: 2129281 - RNA, 15 nt, Human
uccagacccggcugc

SEQ ID NO: 2129282 - RNA, 19 nt, Human
uccagacccggcugcgugg

SEQ ID NO: 2129283 - RNA, 19 nt, Human
uccagacaaaccagaagca

SEQ ID NO: 2129284 - RNA, 24 nt, Human
uccagacaaaccagaagcaacaga

SEQ ID NO: 2129285 - RNA, 10 nt, Human
uccacuggac

SEQ ID NO: 2129286 - RNA, 12 nt, Human
uccacuggacuu

SEQ ID NO: 2129287 - RNA, 16 nt, Human
uccacuggacuugagc

SEQ ID NO: 2129288 - RNA, 22 nt, Human
uccacugccuucgauacaccgg

SEQ ID NO: 2129289 - RNA, 15 nt, Human
uccacugccuucgau

SEQ ID NO: 2129290 - RNA, 13 nt, Human
uccacugccuucg

SEQ ID NO: 2129291 - RNA, 12 nt, Human
uccacugcccuc

SEQ ID NO: 2129292 - RNA, 15 nt, Human
uccacugcccucugu

SEQ ID NO: 2129293 - RNA, 14 nt, Human
uccagacccggcug

SEQ ID NO: 2129294 - RNA, 17 nt, Human
uccacuggacuugagcu

SEQ ID NO: 2129295 - RNA, 14 nt, Human
uccagggaagcugg

SEQ ID NO: 2129296 - RNA, 16 nt, Human
uccagggaagcuggcc

SEQ ID NO: 2129297 - RNA, 12 nt, Human
uccagggaagcu

SEQ ID NO: 2129298 - RNA, 20 nt, Human
uccaggcugucuuucacuga

SEQ ID NO: 2129299 - RNA, 21 nt, Human
uccaggcuguaucccaugagc

SEQ ID NO: 2129300 - RNA, 12 nt, Human
acgaggaagccc

SEQ ID NO: 2129301 - RNA, 19 nt, Human
acgagacccuacaggagag

SEQ ID NO: 2129302 - RNA, 20 nt, Human
acgagacccuacaggagagg

SEQ ID NO: 2129303 - RNA, 17 nt, Human
uccagggaagcuggccg

SEQ ID NO: 2129304 - RNA, 18 nt, Human
uccagggaagcuggccga

SEQ ID NO: 2129305 - RNA, 17 nt, Human
acgagauaaugugaacu

SEQ ID NO: 2129306 - RNA, 19 nt, Human
acgagaucaagagaucaag

SEQ ID NO: 2129307 - RNA, 15 nt, Human
uccagagaguggcuc

SEQ ID NO: 2129308 - RNA, 21 nt, Human
uccagagagagaagugccccu

SEQ ID NO: 2129309 - RNA, 23 nt, Human
uccagagagagaagugccccugc

SEQ ID NO: 2129310 - RNA, 17 nt, Human
uccagagaguggcuccu

SEQ ID NO: 2129311 - RNA, 16 nt, Human
uccagagaguggcucc

SEQ ID NO: 2129312 - RNA, 14 nt, Human
uccaggcuguaucc

SEQ ID NO: 2129313 - RNA, 21 nt, Human
uccaggccaucagaggccuag

SEQ ID NO: 2129314 - RNA, 21 nt, Human
uccaggccccaaaaccacagc

SEQ ID NO: 2129315 - RNA, 15 nt, Human
accuacaguguacag

SEQ ID NO: 2129316 - RNA, 13 nt, Human
accuacagaauac

SEQ ID NO: 2129317 - RNA, 22 nt, Human
accuacagaauacuagccagag

SEQ ID NO: 2129318 - RNA, 22 nt, Human
accuacaccauuaucuuggaaa

SEQ ID NO: 2129319 - RNA, 19 nt, Human
accuaauuagagcagauga

SEQ ID NO: 2129320 - RNA, 19 nt, Human
accuaauguuuaugagcca

SEQ ID NO: 2129321 - RNA, 20 nt, Human
accuaauguuuaugagccag

SEQ ID NO: 2129322 - RNA, 15 nt, Human
accuaauuagagcag

SEQ ID NO: 2129323 - RNA, 16 nt, Human
accuaauuagagcaga

SEQ ID NO: 2129324 - RNA, 17 nt, Human
accuaaccccuuuccug

SEQ ID NO: 2129325 - RNA, 12 nt, Human
accuaauguuua

SEQ ID NO: 2129326 - RNA, 16 nt, Human
accuacaguguacagu

SEQ ID NO: 2129327 - RNA, 17 nt, Human
accuacaguguacaguc

SEQ ID NO: 2129328 - RNA, 18 nt, Human
accuacaguguacagucu

SEQ ID NO: 2129329 - RNA, 20 nt, Human
accuacaguguacagucuug

SEQ ID NO: 2129330 - RNA, 15 nt, Human
accuaccacaguguc

SEQ ID NO: 2129331 - RNA, 16 nt, Human
accuaccacagugucu

SEQ ID NO: 2129332 - RNA, 17 nt, Human
accuaccacagugucug

SEQ ID NO: 2129333 - RNA, 19 nt, Human
accuaccacagugucugua

SEQ ID NO: 2129334 - RNA, 15 nt, Human
accuaguagucauuu

SEQ ID NO: 2129335 - RNA, 23 nt, Human
accucaaacuuccagucagguag

SEQ ID NO: 2129336 - RNA, 15 nt, Human
accuauaaaacaggu

SEQ ID NO: 2129337 - RNA, 18 nt, Human
accuauaaaacaggucaa

SEQ ID NO: 2129338 - RNA, 18 nt, Human
ucaggaaauauauaugug

SEQ ID NO: 2129339 - RNA, 19 nt, Human
ucaggaaauauauaugugu

SEQ ID NO: 2129340 - RNA, 20 nt, Human
ucaggaaauauauaugugug

SEQ ID NO: 2129341 - RNA, 21 nt, Human
ucaggaaauauauaugugugu

SEQ ID NO: 2129342 - RNA, 13 nt, Human
ucaggaacacucu

SEQ ID NO: 2129343 - RNA, 13 nt, Human
ucaggaacagaag

SEQ ID NO: 2129344 - RNA, 14 nt, Human
ucaggaacagaagg

SEQ ID NO: 2129345 - RNA, 16 nt, Human
ucaggaacagaaggau

SEQ ID NO: 2129346 - RNA, 15 nt, Human
accuaaccccuuucc

SEQ ID NO: 2129347 - RNA, 16 nt, Human
accuaaccccuuuccu

SEQ ID NO: 2129348 - RNA, 11 nt, Human
accuaacauuc

SEQ ID NO: 2129349 - RNA, 12 nt, Human
accuaacauucg

SEQ ID NO: 2129350 - RNA, 19 nt, Human
accuaacauucgaucucau

SEQ ID NO: 2129351 - RNA, 20 nt, Human
accuaaauaaacacauagau

SEQ ID NO: 2129352 - RNA, 21 nt, Human
accuaaaaggaaaucucaccc

SEQ ID NO: 2129353 - RNA, 22 nt, Human
accuaaaaggaaaucucacccc

SEQ ID NO: 2129354 - RNA, 18 nt, Human
ucaggaacagcuauggga

SEQ ID NO: 2129355 - RNA, 15 nt, Human
accgcgucuggugac

SEQ ID NO: 2129356 - RNA, 13 nt, Human
accgcuccccagc

SEQ ID NO: 2129357 - RNA, 14 nt, Human
accgcuccccagcc

SEQ ID NO: 2129358 - RNA, 12 nt, Human
accuccugccuc

SEQ ID NO: 2129359 - RNA, 13 nt, Human
accuccugccucg

SEQ ID NO: 2129360 - RNA, 12 nt, Human
accucaaauuua

SEQ ID NO: 2129361 - RNA, 15 nt, Human
accucaaauuuaaag

SEQ ID NO: 2129362 - RNA, 21 nt, Human
accucaacccccauuucuauu

SEQ ID NO: 2129363 - RNA, 19 nt, Human
accucaacccccauuucua

SEQ ID NO: 2129364 - RNA, 15 nt, Human
accucaaccuguaaa

SEQ ID NO: 2129365 - RNA, 16 nt, Human
accucaaccuguaaau

SEQ ID NO: 2129366 - RNA, 17 nt, Human
accucaaccuguaaauu

SEQ ID NO: 2129367 - RNA, 18 nt, Human
accucaaccuguaaauua

SEQ ID NO: 2129368 - RNA, 19 nt, Human
accucaaccuguaaauuau

SEQ ID NO: 2129369 - RNA, 21 nt, Human
accucaaccuguaaauuauuu

SEQ ID NO: 2129370 - RNA, 23 nt, Human
accucaaccuguaaauuauuuua

SEQ ID NO: 2129371 - RNA, 16 nt, Human
accucaaccugugaug

SEQ ID NO: 2129372 - RNA, 22 nt, Human
accucaacccccauuucuauuu

SEQ ID NO: 2129373 - RNA, 14 nt, Human
accucccugaacca

SEQ ID NO: 2129374 - RNA, 15 nt, Human
accucccugaaccau

SEQ ID NO: 2129375 - RNA, 20 nt, Human
accucccugaaccaucccug

SEQ ID NO: 2129376 - RNA, 23 nt, Human
accuccugccucgaacuggcugc

SEQ ID NO: 2129377 - RNA, 20 nt, Human
ucauccccaggggucccagc

SEQ ID NO: 2129378 - RNA, 21 nt, Human
ucauccccaggggucccagcc

SEQ ID NO: 2129379 - RNA, 14 nt, Human
ucaucccauugucu

SEQ ID NO: 2129380 - RNA, 15 nt, Human
ucaucccauugucuu

SEQ ID NO: 2129381 - RNA, 14 nt, Human
ucauccccaccuug

SEQ ID NO: 2129382 - RNA, 12 nt, Human
ucauccccaggg

SEQ ID NO: 2129383 - RNA, 14 nt, Human
ucauccgaggcagg

SEQ ID NO: 2129384 - RNA, 15 nt, Human
ucauccgaggcaggg

SEQ ID NO: 2129385 - RNA, 21 nt, Human
ucaucccuaugggauucagug

SEQ ID NO: 2129386 - RNA, 15 nt, Human
ucauccuaagcuauu

SEQ ID NO: 2129387 - RNA, 19 nt, Human
ucauccggcagccuggaug

SEQ ID NO: 2129388 - RNA, 15 nt, Human
ucauccggcagccug

SEQ ID NO: 2129389 - RNA, 17 nt, Human
ucauccggcagccugga

SEQ ID NO: 2129390 - RNA, 12 nt, Human
ucauccugcagg

SEQ ID NO: 2129391 - RNA, 13 nt, Human
ucauccugcaggc

SEQ ID NO: 2129392 - RNA, 13 nt, Human
ucaugaagcccaa

SEQ ID NO: 2129393 - RNA, 18 nt, Human
ucaucuauuucugagaag

SEQ ID NO: 2129394 - RNA, 11 nt, Human
ucaucuauuuc

SEQ ID NO: 2129395 - RNA, 14 nt, Human
ucaucuauuucuga

SEQ ID NO: 2129396 - RNA, 15 nt, Human
ucaucuauuucugag

SEQ ID NO: 2129397 - RNA, 16 nt, Human
ucaucuauuucugaga

SEQ ID NO: 2129398 - RNA, 17 nt, Human
ucaucuauuucugagaa

SEQ ID NO: 2129399 - RNA, 12 nt, Human
ucauucuucugu

SEQ ID NO: 2129400 - RNA, 18 nt, Human
ucauucuugaaagcugug

SEQ ID NO: 2129401 - RNA, 17 nt, Human
ucauucuugaaagcugu

SEQ ID NO: 2129402 - RNA, 16 nt, Human
ucaugaucuugugaca

SEQ ID NO: 2129403 - RNA, 17 nt, Human
ucaugaucuugugacau

SEQ ID NO: 2129404 - RNA, 18 nt, Human
ucaugaucuugugacaua

SEQ ID NO: 2129405 - RNA, 13 nt, Human
ucaugaucucccu

SEQ ID NO: 2129406 - RNA, 14 nt, Human
ucaugaucucccug

SEQ ID NO: 2129407 - RNA, 15 nt, Human
ucaugaucucccugc

SEQ ID NO: 2129408 - RNA, 16 nt, Human
ucaugaucucccugcc

SEQ ID NO: 2129409 - RNA, 17 nt, Human
ucaugaucucccugccg

SEQ ID NO: 2129410 - RNA, 18 nt, Human
ucaugaucucccugccgc

SEQ ID NO: 2129411 - RNA, 19 nt, Human
ucaugaucucccugccgcc

SEQ ID NO: 2129412 - RNA, 22 nt, Human
ucaugaucucccugccgccuca

SEQ ID NO: 2129413 - RNA, 13 nt, Human
ucaugauuagcaa

SEQ ID NO: 2129414 - RNA, 16 nt, Human
ucaugauuagcaaguu

SEQ ID NO: 2129415 - RNA, 14 nt, Human
ucaugauuagcaag

SEQ ID NO: 2129416 - RNA, 13 nt, Human
ucauuaccacagg

SEQ ID NO: 2129417 - RNA, 13 nt, Human
accuccugggcua

SEQ ID NO: 2129418 - RNA, 19 nt, Human
accucggugccuuccucuu

SEQ ID NO: 2129419 - RNA, 18 nt, Human
accuccuuuacccucauc

SEQ ID NO: 2129420 - RNA, 19 nt, Human
accuccuuuacccucaucu

SEQ ID NO: 2129421 - RNA, 18 nt, Human
accucuaaaacaguccuu

SEQ ID NO: 2129422 - RNA, 20 nt, Human
accucguccucccccugcca

SEQ ID NO: 2129423 - RNA, 21 nt, Human
accucguccucccccugccag

SEQ ID NO: 2129424 - RNA, 14 nt, Human
accucgugcuuuaa

SEQ ID NO: 2129425 - RNA, 17 nt, Human
accucgugcuuuaagug

SEQ ID NO: 2129426 - RNA, 23 nt, Human
accucguuagggaagagaaacag

SEQ ID NO: 2129427 - RNA, 14 nt, Human
accucguccucccc

SEQ ID NO: 2129428 - RNA, 15 nt, Human
accucguccuccccc

SEQ ID NO: 2129429 - RNA, 18 nt, Human
accucguccucccccugc

SEQ ID NO: 2129430 - RNA, 17 nt, Human
ucauugccuuaacugga

SEQ ID NO: 2129431 - RNA, 23 nt, Human
ucauugccuuaacuggagcccca

SEQ ID NO: 2129432 - RNA, 20 nt, Human
ucauugccuuaacuggagcc

SEQ ID NO: 2129433 - RNA, 18 nt, Human
ucauccuuagcaacagcc

SEQ ID NO: 2129434 - RNA, 18 nt, Human
ucauugauugucagcuac

SEQ ID NO: 2129435 - RNA, 13 nt, Human
ucauugccagugu

SEQ ID NO: 2129436 - RNA, 15 nt, Human
ucauugccagugucu

SEQ ID NO: 2129437 - RNA, 16 nt, Human
ucauugccagugucuu

SEQ ID NO: 2129438 - RNA, 17 nt, Human
ucauugccagugucuuu

SEQ ID NO: 2129439 - RNA, 18 nt, Human
ucauugccagugucuuuc

SEQ ID NO: 2129440 - RNA, 20 nt, Human
ucauugccagugucuuucuu

SEQ ID NO: 2129441 - RNA, 21 nt, Human
ucauugccagugucuuucuuu

SEQ ID NO: 2129442 - RNA, 22 nt, Human
ucauugccagugucuuucuuug

SEQ ID NO: 2129443 - RNA, 23 nt, Human
ucauugccagugucuuucuuugg

SEQ ID NO: 2129444 - RNA, 14 nt, Human
ucauugaaguauuu

SEQ ID NO: 2129445 - RNA, 22 nt, Human
accugcaccuccccccacugca

SEQ ID NO: 2129446 - RNA, 21 nt, Human
accugcaccuccccccacugc

SEQ ID NO: 2129447 - RNA, 15 nt, Human
accugcaggccaaga

SEQ ID NO: 2129448 - RNA, 19 nt, Human
accugcaggccaagagcag

SEQ ID NO: 2129449 - RNA, 21 nt, Human
accugcauccguaguucccug

SEQ ID NO: 2129450 - RNA, 22 nt, Human
accugcauccguaguucccuga

SEQ ID NO: 2129451 - RNA, 19 nt, Human
accugcauccguaguuccc

SEQ ID NO: 2129452 - RNA, 13 nt, Human
accugaggaagcg

SEQ ID NO: 2129453 - RNA, 15 nt, Human
accugagcuccccac

SEQ ID NO: 2129454 - RNA, 12 nt, Human
accugagcugcc

SEQ ID NO: 2129455 - RNA, 18 nt, Human
accugagcugccauccag

SEQ ID NO: 2129456 - RNA, 13 nt, Human
accugagcuuugg

SEQ ID NO: 2129457 - RNA, 14 nt, Human
accugagcuuugga

SEQ ID NO: 2129458 - RNA, 23 nt, Human
accugagcuuuggacgcacacag

SEQ ID NO: 2129459 - RNA, 14 nt, Human
accugagcucccca

SEQ ID NO: 2129460 - RNA, 16 nt, Human
accugagauggcccuc

SEQ ID NO: 2129461 - RNA, 21 nt, Human
accugagauggcccucuggua

SEQ ID NO: 2129462 - RNA, 20 nt, Human
accugacuauugaaguugca

SEQ ID NO: 2129463 - RNA, 17 nt, Human
accugacucaggcauca

SEQ ID NO: 2129464 - RNA, 12 nt, Human
accugaaaagau

SEQ ID NO: 2129465 - RNA, 22 nt, Human
accugaaaagauguugugucuu

SEQ ID NO: 2129466 - RNA, 22 nt, Human
accucuuugaaagaaggaagac

SEQ ID NO: 2129467 - RNA, 17 nt, Human
accucuuuuagucauuu

SEQ ID NO: 2129468 - RNA, 21 nt, Human
accucuuuuagucauuuugcu

SEQ ID NO: 2129469 - RNA, 18 nt, Human
accucuuuucugcaucau

SEQ ID NO: 2129470 - RNA, 22 nt, Human
accucguccucccccugccagu

SEQ ID NO: 2129471 - RNA, 12 nt, Human
acuaaccacgcu

SEQ ID NO: 2129472 - RNA, 12 nt, Human
acuaacauuaua

SEQ ID NO: 2129473 - RNA, 17 nt, Human
acuaacaggauauuuaa

SEQ ID NO: 2129474 - RNA, 17 nt, Human
acuaacagauaagcaag

SEQ ID NO: 2129475 - RNA, 12 nt, Human
acguuggacuuu

SEQ ID NO: 2129476 - RNA, 19 nt, Human
acguuggacuuuucguuaa

SEQ ID NO: 2129477 - RNA, 21 nt, Human
acguuggacuuuucguuaaca

SEQ ID NO: 2129478 - RNA, 23 nt, Human
acguuggacuuuucguuaacauu

SEQ ID NO: 2129479 - RNA, 21 nt, Human
acguuccuuacugcagaauag

SEQ ID NO: 2129480 - RNA, 11 nt, Human
acuacaggcac

SEQ ID NO: 2129481 - RNA, 22 nt, Human
acuacaauuuaaagcaaaggag

SEQ ID NO: 2129482 - RNA, 18 nt, Human
acuacagacauuaaauaa

SEQ ID NO: 2129483 - RNA, 17 nt, Human
acuacaauuuaaagcaa

SEQ ID NO: 2129484 - RNA, 15 nt, Human
acuacaggcacccac

SEQ ID NO: 2129485 - RNA, 12 nt, Human
ucccagccaccc

SEQ ID NO: 2129486 - RNA, 13 nt, Human
ucccagccacccc

SEQ ID NO: 2129487 - RNA, 14 nt, Human
ucccagccaccccg

SEQ ID NO: 2129488 - RNA, 20 nt, Human
ucccagccaccccgggcucu

SEQ ID NO: 2129489 - RNA, 24 nt, Human
ucccagccaccccgggcucucugc

SEQ ID NO: 2129490 - RNA, 17 nt, Human
ucccagcugugcucugg

SEQ ID NO: 2129491 - RNA, 22 nt, Human
ucccagcucucccucuggcccu

SEQ ID NO: 2129492 - RNA, 23 nt, Human
ucccagcucucccucuggcccug

SEQ ID NO: 2129493 - RNA, 17 nt, Human
ucccagcugaaauacug

SEQ ID NO: 2129494 - RNA, 15 nt, Human
ucccagcccaaagcu

SEQ ID NO: 2129495 - RNA, 20 nt, Human
ucccagauuucagucuuuuc

SEQ ID NO: 2129496 - RNA, 14 nt, Human
ucccagcucucccu

SEQ ID NO: 2129497 - RNA, 16 nt, Human
ucccagcucucccucu

SEQ ID NO: 2129498 - RNA, 18 nt, Human
ucccagcucucccucugg

SEQ ID NO: 2129499 - RNA, 19 nt, Human
ucccagcucucccucuggc

SEQ ID NO: 2129500 - RNA, 21 nt, Human
ucccagcucucccucuggccc

SEQ ID NO: 2129501 - RNA, 19 nt, Human
ucccagcacuuugggaggc

SEQ ID NO: 2129502 - RNA, 21 nt, Human
ucccagcacuuugggaggcca

SEQ ID NO: 2129503 - RNA, 23 nt, Human
ucccagcacuuugggaggccaag

SEQ ID NO: 2129504 - RNA, 21 nt, Human
ucccagcacuuugggaggccg

SEQ ID NO: 2129505 - RNA, 18 nt, Human
ucccagcacuuugggagg

SEQ ID NO: 2129506 - RNA, 16 nt, Human
ucccagcacuuuggga

SEQ ID NO: 2129507 - RNA, 13 nt, Human
uccccaccaguga

SEQ ID NO: 2129508 - RNA, 21 nt, Human
uccccaccagugaaugaaagu

SEQ ID NO: 2129509 - RNA, 15 nt, Human
uccccaccaccccag

SEQ ID NO: 2129510 - RNA, 13 nt, Human
ucccaucccaucc

SEQ ID NO: 2129511 - RNA, 14 nt, Human
ucccaucccauccc

SEQ ID NO: 2129512 - RNA, 15 nt, Human
ucccaucccauccca

SEQ ID NO: 2129513 - RNA, 16 nt, Human
ucccaucccaucccau

SEQ ID NO: 2129514 - RNA, 17 nt, Human
ucccaucccaucccauc

SEQ ID NO: 2129515 - RNA, 19 nt, Human
ucccaucccaucccauccc

SEQ ID NO: 2129516 - RNA, 20 nt, Human
ucccaucccaucccauccca

SEQ ID NO: 2129517 - RNA, 18 nt, Human
ucccaucccaucccgcuc

SEQ ID NO: 2129518 - RNA, 22 nt, Human
ucccaucacuggagcaccaggc

SEQ ID NO: 2129519 - RNA, 14 nt, Human
ucccaucacuggag

SEQ ID NO: 2129520 - RNA, 22 nt, Human
ucccaucccagcugaaauacug

SEQ ID NO: 2129521 - RNA, 16 nt, Human
ucccaucccagcugaa

SEQ ID NO: 2129522 - RNA, 15 nt, Human
ucccaucccgcucuu

SEQ ID NO: 2129523 - RNA, 18 nt, Human
ucccaucccgcucuuuuc

SEQ ID NO: 2129524 - RNA, 19 nt, Human
ucccaucccgcucuuuucc

SEQ ID NO: 2129525 - RNA, 20 nt, Human
ucccaucccgcucuuuuccu

SEQ ID NO: 2129526 - RNA, 14 nt, Human
ucccagcugucugu

SEQ ID NO: 2129527 - RNA, 22 nt, Human
ucccagcugucugugucagccu

SEQ ID NO: 2129528 - RNA, 13 nt, Human
ucccagcugcccc

SEQ ID NO: 2129529 - RNA, 14 nt, Human
ucccagcugccccu

SEQ ID NO: 2129530 - RNA, 16 nt, Human
ucccagcugccccucc

SEQ ID NO: 2129531 - RNA, 17 nt, Human
ucccagcugccccuccc

SEQ ID NO: 2129532 - RNA, 19 nt, Human
ucccagcugccccucccug

SEQ ID NO: 2129533 - RNA, 22 nt, Human
ucccagcugccccucccugcca

SEQ ID NO: 2129534 - RNA, 14 nt, Human
ucccaucaaaacuc

SEQ ID NO: 2129535 - RNA, 20 nt, Human
ucccaguccaaauguccucc

SEQ ID NO: 2129536 - RNA, 21 nt, Human
ucccccaacccccaccccaca

SEQ ID NO: 2129537 - RNA, 12 nt, Human
acuacauuuuaa

SEQ ID NO: 2129538 - RNA, 14 nt, Human
acuacauuuuaaca

SEQ ID NO: 2129539 - RNA, 15 nt, Human
acuacauuuuaacau

SEQ ID NO: 2129540 - RNA, 16 nt, Human
acuacauuuuaacaug

SEQ ID NO: 2129541 - RNA, 13 nt, Human
ucccccaaagugg

SEQ ID NO: 2129542 - RNA, 14 nt, Human
ucccccaaccccca

SEQ ID NO: 2129543 - RNA, 15 nt, Human
ucccccaacccccac

SEQ ID NO: 2129544 - RNA, 16 nt, Human
ucccccaacccccacc

SEQ ID NO: 2129545 - RNA, 17 nt, Human
ucccccaacccccaccc

SEQ ID NO: 2129546 - RNA, 19 nt, Human
ucccccaacccccacccca

SEQ ID NO: 2129547 - RNA, 20 nt, Human
ucccccaacccccaccccac

SEQ ID NO: 2129548 - RNA, 20 nt, Human
uccccaugugccugcaccag

SEQ ID NO: 2129549 - RNA, 22 nt, Human
uccccaugugccugcaccagga

SEQ ID NO: 2129550 - RNA, 19 nt, Human
uccccauuagagucagccu

SEQ ID NO: 2129551 - RNA, 21 nt, Human
uccccauuagagucagccuuc

SEQ ID NO: 2129552 - RNA, 23 nt, Human
uccccauggcaugggggccucag

SEQ ID NO: 2129553 - RNA, 16 nt, Human
acgguucaccagccuc

SEQ ID NO: 2129554 - RNA, 19 nt, Human
acgguucaccagccucucu

SEQ ID NO: 2129555 - RNA, 16 nt, Human
acgggcaguagcugug

SEQ ID NO: 2129556 - RNA, 14 nt, Human
acgggcugcccugc

SEQ ID NO: 2129557 - RNA, 16 nt, Human
ucccaccccacccccu

SEQ ID NO: 2129558 - RNA, 18 nt, Human
ucccaccccacccccuuc

SEQ ID NO: 2129559 - RNA, 20 nt, Human
ucccaccccacccccuucag

SEQ ID NO: 2129560 - RNA, 22 nt, Human
ucccaccccacccccuucagug

SEQ ID NO: 2129561 - RNA, 12 nt, Human
ucccaccccacc

SEQ ID NO: 2129562 - RNA, 13 nt, Human
ucccaccccaccc

SEQ ID NO: 2129563 - RNA, 16 nt, Human
ucccacaaaggagagc

SEQ ID NO: 2129564 - RNA, 18 nt, Human
ucccaauagcacuuucau

SEQ ID NO: 2129565 - RNA, 20 nt, Human
ucccaauagcacuuucauug

SEQ ID NO: 2129566 - RNA, 23 nt, Human
ucccaauagcacuuucauugcca

SEQ ID NO: 2129567 - RNA, 17 nt, Human
ucccaagugccagucuu

SEQ ID NO: 2129568 - RNA, 13 nt, Human
ucccacacccugg

SEQ ID NO: 2129569 - RNA, 22 nt, Human
ucccacacugcuaggugggcca

SEQ ID NO: 2129570 - RNA, 20 nt, Human
acgugggcggcagagaggac

SEQ ID NO: 2129571 - RNA, 19 nt, Human
acgugggcaaacaggcagu

SEQ ID NO: 2129572 - RNA, 15 nt, Human
acgugggcggcagag

SEQ ID NO: 2129573 - RNA, 22 nt, Human
acguaguguagauuuguuuugu

SEQ ID NO: 2129574 - RNA, 22 nt, Human
acgugggucuucagggggccag

SEQ ID NO: 2129575 - RNA, 18 nt, Human
acguguacuacaauuuaa

SEQ ID NO: 2129576 - RNA, 14 nt, Human
acguggggcagcac

SEQ ID NO: 2129577 - RNA, 15 nt, Human
acguggggcagcaca

SEQ ID NO: 2129578 - RNA, 19 nt, Human
acguggggcagcacagaga

SEQ ID NO: 2129579 - RNA, 20 nt, Human
acguggggcagcacagagag

SEQ ID NO: 2129580 - RNA, 11 nt, Human
acgugugugac

SEQ ID NO: 2129581 - RNA, 16 nt, Human
acgugugugacucaga

SEQ ID NO: 2129582 - RNA, 14 nt, Human
acguucaccccucc

SEQ ID NO: 2129583 - RNA, 16 nt, Human
acguucaccccuccac

SEQ ID NO: 2129584 - RNA, 16 nt, Human
acguuccuuacugcag

SEQ ID NO: 2129585 - RNA, 18 nt, Human
acguuccuuacugcagaa

SEQ ID NO: 2129586 - RNA, 19 nt, Human
acguuccuuacugcagaau

SEQ ID NO: 2129587 - RNA, 20 nt, Human
acguuccuuacugcagaaua

SEQ ID NO: 2129588 - RNA, 14 nt, Human
acguucggggcaug

SEQ ID NO: 2129589 - RNA, 16 nt, Human
acgugggcaaacaggc

SEQ ID NO: 2129590 - RNA, 21 nt, Human
acgugggaguucagcugcuuc

SEQ ID NO: 2129591 - RNA, 23 nt, Human
acgugggaguucagcugcuucuc

SEQ ID NO: 2129592 - RNA, 15 nt, Human
acguggcuucugaug

SEQ ID NO: 2129593 - RNA, 20 nt, Human
acguggcuucugaugaaucu

SEQ ID NO: 2129594 - RNA, 23 nt, Human
acguggcuucugaugaaucuugc

SEQ ID NO: 2129595 - RNA, 16 nt, Human
acguauugguccagcu

SEQ ID NO: 2129596 - RNA, 20 nt, Human
acguauguuuuuguguauuu

SEQ ID NO: 2129597 - RNA, 18 nt, Human
acguacuuagcagcuauc

SEQ ID NO: 2129598 - RNA, 20 nt, Human
acguacugcagccuccagag

SEQ ID NO: 2129599 - RNA, 14 nt, Human
acguacucugguua

SEQ ID NO: 2129600 - RNA, 16 nt, Human
acguacuuagcagcua

SEQ ID NO: 2129601 - RNA, 21 nt, Human
ucccaaacuaagcuaugugaa

SEQ ID NO: 2129602 - RNA, 15 nt, Human
acgguuuuacugcag

SEQ ID NO: 2129603 - RNA, 17 nt, Human
acgguuuuacugcagcu

SEQ ID NO: 2129604 - RNA, 13 nt, Human
ucccaaagagcug

SEQ ID NO: 2129605 - RNA, 15 nt, Human
ucccaaagagcugcc

SEQ ID NO: 2129606 - RNA, 16 nt, Human
ucccaaagagcugccu

SEQ ID NO: 2129607 - RNA, 18 nt, Human
uccauuccuggagcccga

SEQ ID NO: 2129608 - RNA, 23 nt, Human
ucccaaaaguaucgggggcuggg

SEQ ID NO: 2129609 - RNA, 14 nt, Human
uccauuuaguucuu

SEQ ID NO: 2129610 - RNA, 20 nt, Human
uccauuuaguucuuuguuau

SEQ ID NO: 2129611 - RNA, 20 nt, Human
uccauuucgccccucauuua

SEQ ID NO: 2129612 - RNA, 21 nt, Human
uccauuucaucuauuucugag

SEQ ID NO: 2129613 - RNA, 23 nt, Human
uccauuucaucuauuucugagaa

SEQ ID NO: 2129614 - RNA, 12 nt, Human
uccauuucucuc

SEQ ID NO: 2129615 - RNA, 16 nt, Human
uccauuucucucucca

SEQ ID NO: 2129616 - RNA, 18 nt, Human
uccauuucucucuccagu

SEQ ID NO: 2129617 - RNA, 14 nt, Human
ucccaaagugcugg

SEQ ID NO: 2129618 - RNA, 13 nt, Human
ucccaaagugcug

SEQ ID NO: 2129619 - RNA, 12 nt, Human
uccaucuccuug

SEQ ID NO: 2129620 - RNA, 14 nt, Human
uccaucucgccacc

SEQ ID NO: 2129621 - RNA, 23 nt, Human
uccaucucgccaccccuccuucc

SEQ ID NO: 2129622 - RNA, 16 nt, Human
uccaucucgccacccc

SEQ ID NO: 2129623 - RNA, 12 nt, Human
uccauuccucag

SEQ ID NO: 2129624 - RNA, 13 nt, Human
uccauuccucagg

SEQ ID NO: 2129625 - RNA, 14 nt, Human
uccauuccucaggg

SEQ ID NO: 2129626 - RNA, 15 nt, Human
uccauuccucaggga

SEQ ID NO: 2129627 - RNA, 16 nt, Human
uccaugaaaaugcaac

SEQ ID NO: 2129628 - RNA, 15 nt, Human
uccaugaaaaugcaa

SEQ ID NO: 2129629 - RNA, 23 nt, Human
uccauuuaauggggugcaccugu

SEQ ID NO: 2129630 - RNA, 22 nt, Human
uccccucaaggacaaagucucc

SEQ ID NO: 2129631 - RNA, 23 nt, Human
uccccucaaggacaaagucucca

SEQ ID NO: 2129632 - RNA, 24 nt, Human
uccccucaaggacaaagucuccag

SEQ ID NO: 2129633 - RNA, 14 nt, Human
uccccucccuccuc

SEQ ID NO: 2129634 - RNA, 16 nt, Human
uccccucccuccucug

SEQ ID NO: 2129635 - RNA, 13 nt, Human
uccccucccuggc

SEQ ID NO: 2129636 - RNA, 13 nt, Human
uccccuaaugccu

SEQ ID NO: 2129637 - RNA, 15 nt, Human
acucaccauguaaaa

SEQ ID NO: 2129638 - RNA, 12 nt, Human
acucacccaagc

SEQ ID NO: 2129639 - RNA, 19 nt, Human
uccccuauggggauggucc

SEQ ID NO: 2129640 - RNA, 18 nt, Human
uccccuauccacccagcc

SEQ ID NO: 2129641 - RNA, 20 nt, Human
uccccuauccacccagccca

SEQ ID NO: 2129642 - RNA, 21 nt, Human
uccccuauccacccagcccau

SEQ ID NO: 2129643 - RNA, 15 nt, Human
uccccuauccaccca

SEQ ID NO: 2129644 - RNA, 16 nt, Human
uccccuauccacccag

SEQ ID NO: 2129645 - RNA, 17 nt, Human
uccccuauccacccagc

SEQ ID NO: 2129646 - RNA, 21 nt, Human
acucacauuuauucugcucac

SEQ ID NO: 2129647 - RNA, 17 nt, Human
acuacucagggaaugaa

SEQ ID NO: 2129648 - RNA, 15 nt, Human
acuacucagggaaug

SEQ ID NO: 2129649 - RNA, 17 nt, Human
acuacucccccaggugg

SEQ ID NO: 2129650 - RNA, 17 nt, Human
ucccgaguagcugggac

SEQ ID NO: 2129651 - RNA, 16 nt, Human
ucccgaguagcuggga

SEQ ID NO: 2129652 - RNA, 18 nt, Human
ucccgaguagcugggacu

SEQ ID NO: 2129653 - RNA, 17 nt, Human
uccccuuuuauugcugc

SEQ ID NO: 2129654 - RNA, 15 nt, Human
ucccgaguagcuggg

SEQ ID NO: 2129655 - RNA, 20 nt, Human
ucccgaauagcugggacuac

SEQ ID NO: 2129656 - RNA, 16 nt, Human
uccccuuucgcccaca

SEQ ID NO: 2129657 - RNA, 19 nt, Human
uccccuuucgcccacaguc

SEQ ID NO: 2129658 - RNA, 24 nt, Human
uccccuuugcuucauucaagucag

SEQ ID NO: 2129659 - RNA, 20 nt, Human
uccccuugcccagggcucag

SEQ ID NO: 2129660 - RNA, 22 nt, Human
uccccuugcccagggcucagcc

SEQ ID NO: 2129661 - RNA, 24 nt, Human
uccccuugcccagggcucagccug

SEQ ID NO: 2129662 - RNA, 20 nt, Human
acuacccaucgguguccauu

SEQ ID NO: 2129663 - RNA, 23 nt, Human
uccccuccuugccuccuguguaa

SEQ ID NO: 2129664 - RNA, 17 nt, Human
uccccucuauuuagcau

SEQ ID NO: 2129665 - RNA, 15 nt, Human
uccccucccuggcuc

SEQ ID NO: 2129666 - RNA, 16 nt, Human
uccccucccuggcucc

SEQ ID NO: 2129667 - RNA, 19 nt, Human
uccccucccuggcucccau

SEQ ID NO: 2129668 - RNA, 21 nt, Human
uccccucccuggcucccauga

SEQ ID NO: 2129669 - RNA, 22 nt, Human
uccccuccuugccuccugugua

SEQ ID NO: 2129670 - RNA, 16 nt, Human
ucccugacucucugug

SEQ ID NO: 2129671 - RNA, 20 nt, Human
ucccugacucucugugaccu

SEQ ID NO: 2129672 - RNA, 17 nt, Human
ucccugacucucuguga

SEQ ID NO: 2129673 - RNA, 18 nt, Human
ucccugacucucugugac

SEQ ID NO: 2129674 - RNA, 20 nt, Human
ucccugaggcuggacuccag

SEQ ID NO: 2129675 - RNA, 14 nt, Human
ucccugagucacca

SEQ ID NO: 2129676 - RNA, 15 nt, Human
ucccugagucaccag

SEQ ID NO: 2129677 - RNA, 16 nt, Human
ucccugagucaccagg

SEQ ID NO: 2129678 - RNA, 12 nt, Human
ucccugauguac

SEQ ID NO: 2129679 - RNA, 16 nt, Human
ucccugauguacaguu

SEQ ID NO: 2129680 - RNA, 17 nt, Human
ucccugagucaccagga

SEQ ID NO: 2129681 - RNA, 21 nt, Human
ucccugagucaccaggaaugu

SEQ ID NO: 2129682 - RNA, 13 nt, Human
acucaccugcugg

SEQ ID NO: 2129683 - RNA, 16 nt, Human
acucaccugcuggccc

SEQ ID NO: 2129684 - RNA, 17 nt, Human
acucaccugcuggcccc

SEQ ID NO: 2129685 - RNA, 18 nt, Human
acucaccugcuggccccu

SEQ ID NO: 2129686 - RNA, 19 nt, Human
acucaccugcuggccccuc

SEQ ID NO: 2129687 - RNA, 20 nt, Human
acucaccugcuggccccuca

SEQ ID NO: 2129688 - RNA, 14 nt, Human
acucaccuugaaca

SEQ ID NO: 2129689 - RNA, 21 nt, Human
acucaccuugaacaccacgcu

SEQ ID NO: 2129690 - RNA, 23 nt, Human
acucacgauaaauaaucggccca

SEQ ID NO: 2129691 - RNA, 15 nt, Human
acucacuggcagccc

SEQ ID NO: 2129692 - RNA, 17 nt, Human
acucacuggcagcccca

SEQ ID NO: 2129693 - RNA, 18 nt, Human
acucacuggcagccccag

SEQ ID NO: 2129694 - RNA, 20 nt, Human
acucacuggcagccccagca

SEQ ID NO: 2129695 - RNA, 21 nt, Human
acucacuggcagccccagcac

SEQ ID NO: 2129696 - RNA, 15 nt, Human
acucacucaaguuca

SEQ ID NO: 2129697 - RNA, 19 nt, Human
acucacucaaguucaagga

SEQ ID NO: 2129698 - RNA, 18 nt, Human
ucccuccacguucacccc

SEQ ID NO: 2129699 - RNA, 19 nt, Human
ucccuccacguucaccccu

SEQ ID NO: 2129700 - RNA, 20 nt, Human
ucccuccacguucaccccuc

SEQ ID NO: 2129701 - RNA, 23 nt, Human
ucccuccacuccuuccugccacc

SEQ ID NO: 2129702 - RNA, 21 nt, Human
ucccucuuucccucccuuccu

SEQ ID NO: 2129703 - RNA, 18 nt, Human
ucccucuuucccucccuu

SEQ ID NO: 2129704 - RNA, 20 nt, Human
ucccucuuucccucccuucc

SEQ ID NO: 2129705 - RNA, 14 nt, Human
ucccucuuucccuc

SEQ ID NO: 2129706 - RNA, 14 nt, Human
ucccuuuucuugac

SEQ ID NO: 2129707 - RNA, 20 nt, Human
ucccuuuuuauaucccauuu

SEQ ID NO: 2129708 - RNA, 13 nt, Human
ucccuuucuuggc

SEQ ID NO: 2129709 - RNA, 13 nt, Human
ucccuuuuacaua

SEQ ID NO: 2129710 - RNA, 16 nt, Human
ucccuuucuuggccag

SEQ ID NO: 2129711 - RNA, 17 nt, Human
ucccuuucuuggccagu

SEQ ID NO: 2129712 - RNA, 17 nt, Human
ucccuuuuacauacugc

SEQ ID NO: 2129713 - RNA, 19 nt, Human
ucccuuuuacauacugcug

SEQ ID NO: 2129714 - RNA, 20 nt, Human
ucccuuuuacauacugcugu

SEQ ID NO: 2129715 - RNA, 21 nt, Human
ucccuuucuuggccaguuauc

SEQ ID NO: 2129716 - RNA, 17 nt, Human
uccggucccugucccag

SEQ ID NO: 2129717 - RNA, 15 nt, Human
uccuaaaugcaguga

SEQ ID NO: 2129718 - RNA, 19 nt, Human
uccuaaaugcagugaauug

SEQ ID NO: 2129719 - RNA, 12 nt, Human
uccuaaauguau

SEQ ID NO: 2129720 - RNA, 16 nt, Human
uccuaacacagcaugu

SEQ ID NO: 2129721 - RNA, 16 nt, Human
uccuagaaauucccca

SEQ ID NO: 2129722 - RNA, 12 nt, Human
ucccugucccag

SEQ ID NO: 2129723 - RNA, 12 nt, Human
ucccuguccacc

SEQ ID NO: 2129724 - RNA, 13 nt, Human
ucccuguccaccc

SEQ ID NO: 2129725 - RNA, 14 nt, Human
ucccuguccacccc

SEQ ID NO: 2129726 - RNA, 12 nt, Human
ucccuguccucc

SEQ ID NO: 2129727 - RNA, 14 nt, Human
ucccuguccuccuc

SEQ ID NO: 2129728 - RNA, 15 nt, Human
ucccuguccuccucg

SEQ ID NO: 2129729 - RNA, 18 nt, Human
ucccugggggaagcccug

SEQ ID NO: 2129730 - RNA, 19 nt, Human
ucccugggggaagcccugg

SEQ ID NO: 2129731 - RNA, 20 nt, Human
ucccugggggaagcccugga

SEQ ID NO: 2129732 - RNA, 21 nt, Human
ucccugggggaagcccuggau

SEQ ID NO: 2129733 - RNA, 21 nt, Human
ucccugguaauaaguacugug

SEQ ID NO: 2129734 - RNA, 14 nt, Human
ucccuuuccuucca

SEQ ID NO: 2129735 - RNA, 17 nt, Human
ucccuuuccuuccaucc

SEQ ID NO: 2129736 - RNA, 23 nt, Human
ucccuuuccuuccaucccuaccc

SEQ ID NO: 2129737 - RNA, 18 nt, Human
ucccuuuccuuccauccc

SEQ ID NO: 2129738 - RNA, 19 nt, Human
ucccuuuccuuccaucccu

SEQ ID NO: 2129739 - RNA, 13 nt, Human
acucauucaaaag

SEQ ID NO: 2129740 - RNA, 21 nt, Human
acucauucaaaaguugaaauu

SEQ ID NO: 2129741 - RNA, 23 nt, Human
acucauucagggauagcacugag

SEQ ID NO: 2129742 - RNA, 15 nt, Human
acucauucuucugua

SEQ ID NO: 2129743 - RNA, 14 nt, Human
acucagaaacauca

SEQ ID NO: 2129744 - RNA, 15 nt, Human
acucagaaacaucag

SEQ ID NO: 2129745 - RNA, 13 nt, Human
acuccucugucca

SEQ ID NO: 2129746 - RNA, 14 nt, Human
acuccucuguccag

SEQ ID NO: 2129747 - RNA, 12 nt, Human
acuccagcccau

SEQ ID NO: 2129748 - RNA, 13 nt, Human
acuccagccugag

SEQ ID NO: 2129749 - RNA, 14 nt, Human
acuccagccugagc

SEQ ID NO: 2129750 - RNA, 12 nt, Human
acuccagccugg

SEQ ID NO: 2129751 - RNA, 15 nt, Human
acuccagccugagca

SEQ ID NO: 2129752 - RNA, 19 nt, Human
acuccagccugagcaacag

SEQ ID NO: 2129753 - RNA, 20 nt, Human
acuccagccugagcaacaga

SEQ ID NO: 2129754 - RNA, 19 nt, Human
acuccagccuggcgacaga

SEQ ID NO: 2129755 - RNA, 13 nt, Human
acuccagccuggg

SEQ ID NO: 2129756 - RNA, 14 nt, Human
acuccagccugggc

SEQ ID NO: 2129757 - RNA, 21 nt, Human
uccuuuaauuuuuuacuauuu

SEQ ID NO: 2129758 - RNA, 15 nt, Human
uccuuuacccucauc

SEQ ID NO: 2129759 - RNA, 16 nt, Human
uccuuuacccucaucu

SEQ ID NO: 2129760 - RNA, 17 nt, Human
uccuuuacccucaucug

SEQ ID NO: 2129761 - RNA, 19 nt, Human
uccuuuagcgcccaguugg

SEQ ID NO: 2129762 - RNA, 15 nt, Human
uccuuuagcgcccag

SEQ ID NO: 2129763 - RNA, 17 nt, Human
uccuuuaaauccuucca

SEQ ID NO: 2129764 - RNA, 15 nt, Human
uccuuguauuuaaau

SEQ ID NO: 2129765 - RNA, 16 nt, Human
uccuugucuuggcagc

SEQ ID NO: 2129766 - RNA, 21 nt, Human
uccuugucuuggcagccuacu

SEQ ID NO: 2129767 - RNA, 16 nt, Human
uccuuguggcacauuu

SEQ ID NO: 2129768 - RNA, 12 nt, Human
uccuucucccuu

SEQ ID NO: 2129769 - RNA, 20 nt, Human
uccuucucucaccuccuaaa

SEQ ID NO: 2129770 - RNA, 19 nt, Human
uccuuccuugcuguccuag

SEQ ID NO: 2129771 - RNA, 23 nt, Human
uccuucuaaucugcuaugcuuga

SEQ ID NO: 2129772 - RNA, 14 nt, Human
uccuucuacuuaca

SEQ ID NO: 2129773 - RNA, 16 nt, Human
uccuuccuugaccagc

SEQ ID NO: 2129774 - RNA, 15 nt, Human
uccuuccaccaaguu

SEQ ID NO: 2129775 - RNA, 13 nt, Human
uccuuccaggccc

SEQ ID NO: 2129776 - RNA, 14 nt, Human
uccuuccuucccug

SEQ ID NO: 2129777 - RNA, 15 nt, Human
uccuuccuucccugg

SEQ ID NO: 2129778 - RNA, 16 nt, Human
uccuuccuucccuggc

SEQ ID NO: 2129779 - RNA, 15 nt, Human
uccuuccaucaaaua

SEQ ID NO: 2129780 - RNA, 16 nt, Human
uccuuccaggccccca

SEQ ID NO: 2129781 - RNA, 21 nt, Human
uccuuccaggcccccaccacu

SEQ ID NO: 2129782 - RNA, 16 nt, Human
uccuuccaucccuacc

SEQ ID NO: 2129783 - RNA, 17 nt, Human
uccuuccaucccuaccc

SEQ ID NO: 2129784 - RNA, 13 nt, Human
uccuuccaugaaa

SEQ ID NO: 2129785 - RNA, 16 nt, Human
uccuuccacggacuca

SEQ ID NO: 2129786 - RNA, 21 nt, Human
acuggccccuagaaucagccu

SEQ ID NO: 2129787 - RNA, 14 nt, Human
acuggcccucuucu

SEQ ID NO: 2129788 - RNA, 15 nt, Human
acuggcccucuucuu

SEQ ID NO: 2129789 - RNA, 16 nt, Human
acuggcccucuucuua

SEQ ID NO: 2129790 - RNA, 17 nt, Human
acuggcccucuucuuac

SEQ ID NO: 2129791 - RNA, 13 nt, Human
ucgagaccagccu

SEQ ID NO: 2129792 - RNA, 18 nt, Human
ucgagaccaaccugacca

SEQ ID NO: 2129793 - RNA, 17 nt, Human
ucgagaccagccuggcc

SEQ ID NO: 2129794 - RNA, 16 nt, Human
ucgagaccagccuggc

SEQ ID NO: 2129795 - RNA, 14 nt, Human
ucgagaccagccug

SEQ ID NO: 2129796 - RNA, 15 nt, Human
ucgagaccagccugg

SEQ ID NO: 2129797 - RNA, 18 nt, Human
ucgagaccagccuggcca

SEQ ID NO: 2129798 - RNA, 19 nt, Human
ucgagaccagccuggccaa

SEQ ID NO: 2129799 - RNA, 15 nt, Human
uccuuucuuucuaac

SEQ ID NO: 2129800 - RNA, 13 nt, Human
uccuuucuggcuu

SEQ ID NO: 2129801 - RNA, 18 nt, Human
ucgaagcucagcccaccc

SEQ ID NO: 2129802 - RNA, 19 nt, Human
ucgaagcucagcccacccc

SEQ ID NO: 2129803 - RNA, 14 nt, Human
uccuuucucagccg

SEQ ID NO: 2129804 - RNA, 23 nt, Human
uccuuucucagccgcuucugacu

SEQ ID NO: 2129805 - RNA, 23 nt, Human
uccuuuagcgcccaguugggugg

SEQ ID NO: 2129806 - RNA, 22 nt, Human
uccuuuagcgcccaguugggug

SEQ ID NO: 2129807 - RNA, 19 nt, Human
ucgagcuauauuuaaguau

SEQ ID NO: 2129808 - RNA, 17 nt, Human
ucgaggaaccagagcca

SEQ ID NO: 2129809 - RNA, 18 nt, Human
ucgcucaaucaagaaaau

SEQ ID NO: 2129810 - RNA, 18 nt, Human
ucgcuccaccuugcagcu

SEQ ID NO: 2129811 - RNA, 17 nt, Human
acuggcugucaguauga

SEQ ID NO: 2129812 - RNA, 21 nt, Human
acuggcugucaguaugacauu

SEQ ID NO: 2129813 - RNA, 16 nt, Human
acuggcuguccuuucc

SEQ ID NO: 2129814 - RNA, 13 nt, Human
acuggcugugggc

SEQ ID NO: 2129815 - RNA, 16 nt, Human
acuggcugugggcucc

SEQ ID NO: 2129816 - RNA, 17 nt, Human
acuggcugugggcuccc

SEQ ID NO: 2129817 - RNA, 19 nt, Human
acuggcugugggcucccuu

SEQ ID NO: 2129818 - RNA, 20 nt, Human
acuggcugugggcucccuuc

SEQ ID NO: 2129819 - RNA, 21 nt, Human
acuggcugugggcucccuucc

SEQ ID NO: 2129820 - RNA, 22 nt, Human
acuggcugugggcucccuuccu

SEQ ID NO: 2129821 - RNA, 16 nt, Human
acuggcuuugucccac

SEQ ID NO: 2129822 - RNA, 19 nt, Human
acuggcuuugucccacagc

SEQ ID NO: 2129823 - RNA, 20 nt, Human
acuggcuuugucccacagcu

SEQ ID NO: 2129824 - RNA, 21 nt, Human
acuggcuuugucccacagcuu

SEQ ID NO: 2129825 - RNA, 22 nt, Human
acuggcuuugucccacagcuug

SEQ ID NO: 2129826 - RNA, 17 nt, Human
acuggaugcagaaacag

SEQ ID NO: 2129827 - RNA, 18 nt, Human
acuggaugcagaaacagu

SEQ ID NO: 2129828 - RNA, 18 nt, Human
acuggauacugcccgggg

SEQ ID NO: 2129829 - RNA, 18 nt, Human
acugcuuuuaacuucuga

SEQ ID NO: 2129830 - RNA, 20 nt, Human
acugcuuuuaacuucugaua

SEQ ID NO: 2129831 - RNA, 14 nt, Human
acugcuuuuggucu

SEQ ID NO: 2129832 - RNA, 18 nt, Human
acugcuuguguuuuuaac

SEQ ID NO: 2129833 - RNA, 16 nt, Human
acugcuuguguuuuua

SEQ ID NO: 2129834 - RNA, 17 nt, Human
acugcucuaagcacacg

SEQ ID NO: 2129835 - RNA, 19 nt, Human
acugcucuaagcacacgga

SEQ ID NO: 2129836 - RNA, 15 nt, Human
acugcuggcugccuu

SEQ ID NO: 2129837 - RNA, 14 nt, Human
acugcuggcugccu

SEQ ID NO: 2129838 - RNA, 13 nt, Human
acugcugggacug

SEQ ID NO: 2129839 - RNA, 18 nt, Human
acugcugggacuggccag

SEQ ID NO: 2129840 - RNA, 19 nt, Human
acugcugggacuggccagg

SEQ ID NO: 2129841 - RNA, 22 nt, Human
acugcuguaaauaaaugcuuua

SEQ ID NO: 2129842 - RNA, 16 nt, Human
acugcugugaacaagu

SEQ ID NO: 2129843 - RNA, 23 nt, Human
acugcugugaacaagugaacaca

SEQ ID NO: 2129844 - RNA, 23 nt, Human
acugcuacaaauacucuuaggaa

SEQ ID NO: 2129845 - RNA, 14 nt, Human
acugccuuaaaacu

SEQ ID NO: 2129846 - RNA, 14 nt, Human
acugccugggcucc

SEQ ID NO: 2129847 - RNA, 15 nt, Human
acugccuuaaaacuu

SEQ ID NO: 2129848 - RNA, 16 nt, Human
acugccuuaaaacuuu

SEQ ID NO: 2129849 - RNA, 15 nt, Human
acugccucuuccucc

SEQ ID NO: 2129850 - RNA, 14 nt, Human
acugccucuuccuc

SEQ ID NO: 2129851 - RNA, 16 nt, Human
acugccucucccuggc

SEQ ID NO: 2129852 - RNA, 17 nt, Human
acugccucucccuggcc

SEQ ID NO: 2129853 - RNA, 18 nt, Human
acugccucucccuggccc

SEQ ID NO: 2129854 - RNA, 19 nt, Human
acugccucucccuggcccu

SEQ ID NO: 2129855 - RNA, 9 nt, Human
acugccugc

SEQ ID NO: 2129856 - RNA, 12 nt, Human
acugccugccca

SEQ ID NO: 2129857 - RNA, 13 nt, Human
acugccugcccac

SEQ ID NO: 2129858 - RNA, 14 nt, Human
acugccugcccacc

SEQ ID NO: 2129859 - RNA, 16 nt, Human
acugccugcccacccg

SEQ ID NO: 2129860 - RNA, 19 nt, Human
acugccugcccacccgugg

SEQ ID NO: 2129861 - RNA, 22 nt, Human
acugccugcccacccguggaga

SEQ ID NO: 2129862 - RNA, 23 nt, Human
acugccugcccacccguggagau

SEQ ID NO: 2129863 - RNA, 16 nt, Human
acugcauuagaaauua

SEQ ID NO: 2129864 - RNA, 14 nt, Human
acugcauggaccua

SEQ ID NO: 2129865 - RNA, 17 nt, Human
acugcauggaccuaaca

SEQ ID NO: 2129866 - RNA, 20 nt, Human
acugcauggaccuaacauuc

SEQ ID NO: 2129867 - RNA, 21 nt, Human
acugcauggaccuaacauucg

SEQ ID NO: 2129868 - RNA, 16 nt, Human
acugcaugguaauuua

SEQ ID NO: 2129869 - RNA, 17 nt, Human
acugcaugguaauuuau

SEQ ID NO: 2129870 - RNA, 14 nt, Human
acugcauguauaaa

SEQ ID NO: 2129871 - RNA, 15 nt, Human
acugcauguauaaau

SEQ ID NO: 2129872 - RNA, 20 nt, Human
acugcauguauaaaugaagu

SEQ ID NO: 2129873 - RNA, 18 nt, Human
uccuacuuuacauaugcu

SEQ ID NO: 2129874 - RNA, 15 nt, Human
acugcauugagaacu

SEQ ID NO: 2129875 - RNA, 22 nt, Human
uccuagagaaaacuugaauuca

SEQ ID NO: 2129876 - RNA, 17 nt, Human
uccuacuuuuccuuccc

SEQ ID NO: 2129877 - RNA, 21 nt, Human
uccuagaaauuccccacccug

SEQ ID NO: 2129878 - RNA, 22 nt, Human
uccuagaaauuccccacccuga

SEQ ID NO: 2129879 - RNA, 16 nt, Human
acugcauaugaaagga

SEQ ID NO: 2129880 - RNA, 22 nt, Human
acugcauaccaaccugggcaau

SEQ ID NO: 2129881 - RNA, 15 nt, Human
ucuaaaauccugcuu

SEQ ID NO: 2129882 - RNA, 22 nt, Human
ucuaaggaagaucacuuugcuc

SEQ ID NO: 2129883 - RNA, 18 nt, Human
ucuaagccuuuccauaag

SEQ ID NO: 2129884 - RNA, 21 nt, Human
acuguucucuauuagacuuua

SEQ ID NO: 2129885 - RNA, 15 nt, Human
ucuaccaacuggaag

SEQ ID NO: 2129886 - RNA, 16 nt, Human
ucuaccaacuggaagc

SEQ ID NO: 2129887 - RNA, 20 nt, Human
ucuaccaacuggaagcacag

SEQ ID NO: 2129888 - RNA, 12 nt, Human
ucuaccaucucc

SEQ ID NO: 2129889 - RNA, 15 nt, Human
ucuaccaucucccuc

SEQ ID NO: 2129890 - RNA, 17 nt, Human
ucuaccauuuucugguu

SEQ ID NO: 2129891 - RNA, 12 nt, Human
ucuacccagccc

SEQ ID NO: 2129892 - RNA, 20 nt, Human
ucuaccauuuucugguucuu

SEQ ID NO: 2129893 - RNA, 14 nt, Human
acuguuagaacacu

SEQ ID NO: 2129894 - RNA, 15 nt, Human
acuguuagaacacua

SEQ ID NO: 2129895 - RNA, 16 nt, Human
acuguuagaacacuau

SEQ ID NO: 2129896 - RNA, 17 nt, Human
acuguuagaacacuauu

SEQ ID NO: 2129897 - RNA, 18 nt, Human
acuguuagaacacuauuu

SEQ ID NO: 2129898 - RNA, 19 nt, Human
acuguuagaacacuauuuu

SEQ ID NO: 2129899 - RNA, 23 nt, Human
acuguuagaacacuauuuucaga

SEQ ID NO: 2129900 - RNA, 13 nt, Human
acuuaauaaauuc

SEQ ID NO: 2129901 - RNA, 17 nt, Human
acuuaauaaauucagau

SEQ ID NO: 2129902 - RNA, 18 nt, Human
acuguugcccaggcuggc

SEQ ID NO: 2129903 - RNA, 17 nt, Human
acuguugcccaggcugg

SEQ ID NO: 2129904 - RNA, 14 nt, Human
acuguugcccaggc

SEQ ID NO: 2129905 - RNA, 13 nt, Human
acuguugcccagg

SEQ ID NO: 2129906 - RNA, 12 nt, Human
acuguugcccag

SEQ ID NO: 2129907 - RNA, 16 nt, Human
acuuagaaauugcauu

SEQ ID NO: 2129908 - RNA, 20 nt, Human
acuuagugcggacaaguuuu

SEQ ID NO: 2129909 - RNA, 14 nt, Human
acuucagcucuguu

SEQ ID NO: 2129910 - RNA, 15 nt, Human
acuuaccuucaauaa

SEQ ID NO: 2129911 - RNA, 16 nt, Human
acuuaccuucaauaaa

SEQ ID NO: 2129912 - RNA, 17 nt, Human
acuuaccuagauuuaca

SEQ ID NO: 2129913 - RNA, 17 nt, Human
acuuaccuucaauaaag

SEQ ID NO: 2129914 - RNA, 19 nt, Human
acuuaccuucaauaaagua

SEQ ID NO: 2129915 - RNA, 20 nt, Human
acuuaccuucaauaaaguau

SEQ ID NO: 2129916 - RNA, 16 nt, Human
acuuaccauaugugcu

SEQ ID NO: 2129917 - RNA, 21 nt, Human
ucgguaaguugaauggccugc

SEQ ID NO: 2129918 - RNA, 14 nt, Human
ucgggggcuggggc

SEQ ID NO: 2129919 - RNA, 16 nt, Human
ucggggggacagcucc

SEQ ID NO: 2129920 - RNA, 12 nt, Human
ucgggcucagcu

SEQ ID NO: 2129921 - RNA, 15 nt, Human
ucgggcucagcucug

SEQ ID NO: 2129922 - RNA, 16 nt, Human
ucgggcucagcucugg

SEQ ID NO: 2129923 - RNA, 17 nt, Human
ucgggcucagcucuggc

SEQ ID NO: 2129924 - RNA, 15 nt, Human
ucgggaacaguguuu

SEQ ID NO: 2129925 - RNA, 19 nt, Human
acuguguggacugugaugc

SEQ ID NO: 2129926 - RNA, 19 nt, Human
acugugugcagacucaaua

SEQ ID NO: 2129927 - RNA, 17 nt, Human
acuguguggacugugau

SEQ ID NO: 2129928 - RNA, 18 nt, Human
acuguguggacugugaug

SEQ ID NO: 2129929 - RNA, 21 nt, Human
ucggcuccuggacucauugcu

SEQ ID NO: 2129930 - RNA, 17 nt, Human
ucgggaggucgaggcag

SEQ ID NO: 2129931 - RNA, 14 nt, Human
ucgggaacaguguu

SEQ ID NO: 2129932 - RNA, 19 nt, Human
ucgggaggucgaggcagga

SEQ ID NO: 2129933 - RNA, 21 nt, Human
ucgggaggucgaggcaggagg

SEQ ID NO: 2129934 - RNA, 14 nt, Human
ucgguccugucucc

SEQ ID NO: 2129935 - RNA, 18 nt, Human
ucgguccugucuccccuc

SEQ ID NO: 2129936 - RNA, 15 nt, Human
ucgguguccauuuau

SEQ ID NO: 2129937 - RNA, 22 nt, Human
ucgguguccauuuauagaauaa

SEQ ID NO: 2129938 - RNA, 17 nt, Human
ucguuugaaucacagua

SEQ ID NO: 2129939 - RNA, 17 nt, Human
ucguuuuuuucauucca

SEQ ID NO: 2129940 - RNA, 18 nt, Human
ucuaaaaaacagaggcca

SEQ ID NO: 2129941 - RNA, 14 nt, Human
ucuaaaaacaccaa

SEQ ID NO: 2129942 - RNA, 10 nt, Human
ucguuuguuu

SEQ ID NO: 2129943 - RNA, 13 nt, Human
ucguuuguuuguu

SEQ ID NO: 2129944 - RNA, 14 nt, Human
ucguuuguuuguuu

SEQ ID NO: 2129945 - RNA, 13 nt, Human
ucuaaaaugaguu

SEQ ID NO: 2129946 - RNA, 14 nt, Human
acuguggaaaaaua

SEQ ID NO: 2129947 - RNA, 15 nt, Human
acuguggaaaaauau

SEQ ID NO: 2129948 - RNA, 17 nt, Human
acuguggaaaaauauuu

SEQ ID NO: 2129949 - RNA, 19 nt, Human
acuguggaaaaauauuuaa

SEQ ID NO: 2129950 - RNA, 17 nt, Human
acuguccuacccacccu

SEQ ID NO: 2129951 - RNA, 23 nt, Human
acuguccuacccacccuccuuuc

SEQ ID NO: 2129952 - RNA, 18 nt, Human
acuguccuacccacccuc

SEQ ID NO: 2129953 - RNA, 19 nt, Human
acugggaagauaggcucug

SEQ ID NO: 2129954 - RNA, 22 nt, Human
acugggaagauaggcucugcac

SEQ ID NO: 2129955 - RNA, 23 nt, Human
acugggaagauaggcucugcaca

SEQ ID NO: 2129956 - RNA, 15 nt, Human
acugucacuguuucu

SEQ ID NO: 2129957 - RNA, 16 nt, Human
acugucacuguuucuc

SEQ ID NO: 2129958 - RNA, 20 nt, Human
acugucacuguuucucugcu

SEQ ID NO: 2129959 - RNA, 21 nt, Human
acugucacuguuucucugcug

SEQ ID NO: 2129960 - RNA, 12 nt, Human
acuguguaacug

SEQ ID NO: 2129961 - RNA, 13 nt, Human
acuguguaacugc

SEQ ID NO: 2129962 - RNA, 17 nt, Human
acuguguaacugcccaa

SEQ ID NO: 2129963 - RNA, 14 nt, Human
acuguguaacugcc

SEQ ID NO: 2129964 - RNA, 15 nt, Human
acuguguaacugccc

SEQ ID NO: 2129965 - RNA, 16 nt, Human
acuguguauguacaua

SEQ ID NO: 2129966 - RNA, 18 nt, Human
acuguguauguacauaua

SEQ ID NO: 2129967 - RNA, 20 nt, Human
acuguguauguacauauaua

SEQ ID NO: 2129968 - RNA, 18 nt, Human
acugugucccucucucug

SEQ ID NO: 2129969 - RNA, 19 nt, Human
acugugucccucucucugg

SEQ ID NO: 2129970 - RNA, 21 nt, Human
acugugucccucucucuggaa

SEQ ID NO: 2129971 - RNA, 22 nt, Human
acugugucccucucucuggaaa

SEQ ID NO: 2129972 - RNA, 17 nt, Human
agaaacaggguguuguc

SEQ ID NO: 2129973 - RNA, 13 nt, Human
agaaacaguuaac

SEQ ID NO: 2129974 - RNA, 18 nt, Human
agaaaccuuauuguaccu

SEQ ID NO: 2129975 - RNA, 16 nt, Human
agaaaccuuauuguac

SEQ ID NO: 2129976 - RNA, 20 nt, Human
agaaacaguuaacuuucaga

SEQ ID NO: 2129977 - RNA, 19 nt, Human
agaaacagagacaggccca

SEQ ID NO: 2129978 - RNA, 15 nt, Human
agaaacagagacagg

SEQ ID NO: 2129979 - RNA, 11 nt, Human
agaaacagauu

SEQ ID NO: 2129980 - RNA, 11 nt, Human
agaaacacuga

SEQ ID NO: 2129981 - RNA, 14 nt, Human
agaaacagagacag

SEQ ID NO: 2129982 - RNA, 23 nt, Human
agaaacucacccccaaggggcag

SEQ ID NO: 2129983 - RNA, 15 nt, Human
agaaacucaccccca

SEQ ID NO: 2129984 - RNA, 22 nt, Human
agaaacucacccccaaggggca

SEQ ID NO: 2129985 - RNA, 16 nt, Human
agaaacuuaucuuaca

SEQ ID NO: 2129986 - RNA, 18 nt, Human
agaaacuuaucuuacaaa

SEQ ID NO: 2129987 - RNA, 22 nt, Human
agaaacuuaucuuacaaagugu

SEQ ID NO: 2129988 - RNA, 20 nt, Human
agaaaccuuauuguaccucu

SEQ ID NO: 2129989 - RNA, 14 nt, Human
agaaaaaggagcuu

SEQ ID NO: 2129990 - RNA, 21 nt, Human
agaaaagaaucccuguucauu

SEQ ID NO: 2129991 - RNA, 17 nt, Human
agaaaagacaugaauau

SEQ ID NO: 2129992 - RNA, 19 nt, Human
agaaacaccuagaucagaa

SEQ ID NO: 2129993 - RNA, 20 nt, Human
agaaacaccuagaucagaac

SEQ ID NO: 2129994 - RNA, 20 nt, Human
agaaaaagcaauaaccucaa

SEQ ID NO: 2129995 - RNA, 21 nt, Human
ucucuuuaaugucacaggcag

SEQ ID NO: 2129996 - RNA, 20 nt, Human
ucucuuuaaugucacaggca

SEQ ID NO: 2129997 - RNA, 13 nt, Human
agaaaaagaaaaa

SEQ ID NO: 2129998 - RNA, 17 nt, Human
ucucuuuaaucuucagu

SEQ ID NO: 2129999 - RNA, 20 nt, Human
ucucuuuaaucuucaguuuu

SEQ ID NO: 2130000 - RNA, 15 nt, Human
ucucuuuaacucagg

SEQ ID NO: 2130001 - RNA, 17 nt, Human
ucucuuuaacucaggac

SEQ ID NO: 2130002 - RNA, 20 nt, Human
ucucuuuaacucaggacucc

SEQ ID NO: 2130003 - RNA, 23 nt, Human
ucucuuuaacucaggacuccagc

SEQ ID NO: 2130004 - RNA, 18 nt, Human
ucucuuggcuggcuuccu

SEQ ID NO: 2130005 - RNA, 16 nt, Human
ucucuuuaaucuucag

SEQ ID NO: 2130006 - RNA, 22 nt, Human
ucucuugccuaaguauuccuuu

SEQ ID NO: 2130007 - RNA, 13 nt, Human
ucucuugagggag

SEQ ID NO: 2130008 - RNA, 22 nt, Human
ucucuugagggagcuuagccaa

SEQ ID NO: 2130009 - RNA, 18 nt, Human
ucucuugagccugggagg

SEQ ID NO: 2130010 - RNA, 18 nt, Human
ucucuugaggccaggagu

SEQ ID NO: 2130011 - RNA, 17 nt, Human
ucucuugagccugggag

SEQ ID NO: 2130012 - RNA, 11 nt, Human
ucucugcuuca

SEQ ID NO: 2130013 - RNA, 14 nt, Human
ucucugcuucagcu

SEQ ID NO: 2130014 - RNA, 11 nt, Human
ucucugcugua

SEQ ID NO: 2130015 - RNA, 16 nt, Human
ucucuggaaaggagga

SEQ ID NO: 2130016 - RNA, 13 nt, Human
ucucugcugaagg

SEQ ID NO: 2130017 - RNA, 12 nt, Human
ucucugcuggcc

SEQ ID NO: 2130018 - RNA, 14 nt, Human
ucucugcuggccca

SEQ ID NO: 2130019 - RNA, 15 nt, Human
ucucugcuggcccag

SEQ ID NO: 2130020 - RNA, 16 nt, Human
ucucugcuggcccagc

SEQ ID NO: 2130021 - RNA, 19 nt, Human
ucucugcuggcccagccaa

SEQ ID NO: 2130022 - RNA, 19 nt, Human
ucucuggcccuucuugccu

SEQ ID NO: 2130023 - RNA, 11 nt, Human
ucucuccuccu

SEQ ID NO: 2130024 - RNA, 20 nt, Human
ucucucccucccuuugaaau

SEQ ID NO: 2130025 - RNA, 14 nt, Human
ucucuccucagacu

SEQ ID NO: 2130026 - RNA, 16 nt, Human
ucucuccucagacugc

SEQ ID NO: 2130027 - RNA, 16 nt, Human
acuuguuagaaaugca

SEQ ID NO: 2130028 - RNA, 15 nt, Human
acuuucucuuguaaa

SEQ ID NO: 2130029 - RNA, 18 nt, Human
ucugaagucacugcacag

SEQ ID NO: 2130030 - RNA, 16 nt, Human
ucugaagucacugcac

SEQ ID NO: 2130031 - RNA, 15 nt, Human
ucugaagucacugca

SEQ ID NO: 2130032 - RNA, 12 nt, Human
ucugacacacag

SEQ ID NO: 2130033 - RNA, 16 nt, Human
ucugaccugcaggcca

SEQ ID NO: 2130034 - RNA, 17 nt, Human
ucugaccugcaggccaa

SEQ ID NO: 2130035 - RNA, 19 nt, Human
ucugaccugcaggccaaga

SEQ ID NO: 2130036 - RNA, 21 nt, Human
ucugaccugcaggccaagagc

SEQ ID NO: 2130037 - RNA, 13 nt, Human
ucugacacaaaaa

SEQ ID NO: 2130038 - RNA, 14 nt, Human
ucugacacaaaaaa

SEQ ID NO: 2130039 - RNA, 22 nt, Human
ucugaagaguggguuucacaag

SEQ ID NO: 2130040 - RNA, 12 nt, Human
ucugaagcagau

SEQ ID NO: 2130041 - RNA, 17 nt, Human
ucugaagucacaucaca

SEQ ID NO: 2130042 - RNA, 20 nt, Human
ucugaagucacaucacagga

SEQ ID NO: 2130043 - RNA, 22 nt, Human
ucugaagucacaucacaggaca

SEQ ID NO: 2130044 - RNA, 23 nt, Human
ucugaagucacaucacaggacac

SEQ ID NO: 2130045 - RNA, 23 nt, Human
agaaacuugugaaguggaaaugu

SEQ ID NO: 2130046 - RNA, 13 nt, Human
agaaacuugugaa

SEQ ID NO: 2130047 - RNA, 11 nt, Human
agaaaucaugu

SEQ ID NO: 2130048 - RNA, 12 nt, Human
agaaaucauguu

SEQ ID NO: 2130049 - RNA, 13 nt, Human
agaaaucauguua

SEQ ID NO: 2130050 - RNA, 14 nt, Human
agaaaucauguuau

SEQ ID NO: 2130051 - RNA, 17 nt, Human
agaaaucauguuaugau

SEQ ID NO: 2130052 - RNA, 18 nt, Human
agaaaucauguuaugaua

SEQ ID NO: 2130053 - RNA, 21 nt, Human
agaaaucauguuaugauaaaa

SEQ ID NO: 2130054 - RNA, 21 nt, Human
agaaaucccccuuucucuaau

SEQ ID NO: 2130055 - RNA, 14 nt, Human
agaaauauaauuga

SEQ ID NO: 2130056 - RNA, 19 nt, Human
agaaauaucugaaaaugua

SEQ ID NO: 2130057 - RNA, 20 nt, Human
agaaauaucugaaaauguau

SEQ ID NO: 2130058 - RNA, 18 nt, Human
ucugauucccaagcucug

SEQ ID NO: 2130059 - RNA, 23 nt, Human
ucugaugcaagcaagaaacacug

SEQ ID NO: 2130060 - RNA, 14 nt, Human
ucugauguaaauga

SEQ ID NO: 2130061 - RNA, 15 nt, Human
ucugauguaaaugaa

SEQ ID NO: 2130062 - RNA, 16 nt, Human
ucugauguaaaugaag

SEQ ID NO: 2130063 - RNA, 18 nt, Human
ucugauguaaaugaagua

SEQ ID NO: 2130064 - RNA, 19 nt, Human
ucugauguaaaugaaguaa

SEQ ID NO: 2130065 - RNA, 14 nt, Human
ucugaguuuaccau

SEQ ID NO: 2130066 - RNA, 15 nt, Human
ucugaguuuaccauu

SEQ ID NO: 2130067 - RNA, 20 nt, Human
ucugaguuuaccauuuguaa

SEQ ID NO: 2130068 - RNA, 21 nt, Human
ucugaguuuaccauuuguaau

SEQ ID NO: 2130069 - RNA, 22 nt, Human
ucugaguuuaccauuuguaaua

SEQ ID NO: 2130070 - RNA, 24 nt, Human
ucugaguguuuuuacuacaguugu

SEQ ID NO: 2130071 - RNA, 14 nt, Human
agaaauucccugga

SEQ ID NO: 2130072 - RNA, 17 nt, Human
agaaauucccuggacca

SEQ ID NO: 2130073 - RNA, 18 nt, Human
agaaauucccuggaccag

SEQ ID NO: 2130074 - RNA, 22 nt, Human
agaaauucccuggaccagaugc

SEQ ID NO: 2130075 - RNA, 23 nt, Human
agaaauucccuggaccagaugcu

SEQ ID NO: 2130076 - RNA, 24 nt, Human
agaaauucccuggaccagaugcug

SEQ ID NO: 2130077 - RNA, 19 nt, Human
ucugcaggaugauuguaca

SEQ ID NO: 2130078 - RNA, 16 nt, Human
ucugcagcaugaccug

SEQ ID NO: 2130079 - RNA, 20 nt, Human
ucugcagcaugaccugugac

SEQ ID NO: 2130080 - RNA, 14 nt, Human
ucugcagccagccc

SEQ ID NO: 2130081 - RNA, 15 nt, Human
ucugcagccagccca

SEQ ID NO: 2130082 - RNA, 16 nt, Human
ucugcagccagcccag

SEQ ID NO: 2130083 - RNA, 18 nt, Human
ucugcagccagcccagcc

SEQ ID NO: 2130084 - RNA, 19 nt, Human
ucugcagccagcccagccc

SEQ ID NO: 2130085 - RNA, 22 nt, Human
acuucgggaggucgaggcagga

SEQ ID NO: 2130086 - RNA, 15 nt, Human
acuuccugugacuuc

SEQ ID NO: 2130087 - RNA, 17 nt, Human
acuuccuguccagagag

SEQ ID NO: 2130088 - RNA, 12 nt, Human
ucucacucuguc

SEQ ID NO: 2130089 - RNA, 16 nt, Human
ucucacuauguugccc

SEQ ID NO: 2130090 - RNA, 15 nt, Human
acuucuaaaugaagu

SEQ ID NO: 2130091 - RNA, 16 nt, Human
acuucuaaaugaagug

SEQ ID NO: 2130092 - RNA, 20 nt, Human
acuucguuuugguuaaguug

SEQ ID NO: 2130093 - RNA, 23 nt, Human
acuucguuuugguuaaguuggcu

SEQ ID NO: 2130094 - RNA, 14 nt, Human
acuucgacugugac

SEQ ID NO: 2130095 - RNA, 17 nt, Human
acuucuaaaugcauauc

SEQ ID NO: 2130096 - RNA, 17 nt, Human
acuucuaauugccaugu

SEQ ID NO: 2130097 - RNA, 14 nt, Human
acuucuaauugcca

SEQ ID NO: 2130098 - RNA, 23 nt, Human
acuucuacuucugcccuugccaa

SEQ ID NO: 2130099 - RNA, 14 nt, Human
acuucuccacccug

SEQ ID NO: 2130100 - RNA, 20 nt, Human
ucuauuucugagaagguccu

SEQ ID NO: 2130101 - RNA, 12 nt, Human
ucuauuucugag

SEQ ID NO: 2130102 - RNA, 13 nt, Human
ucuauuucugaga

SEQ ID NO: 2130103 - RNA, 15 nt, Human
ucuauuucugagaag

SEQ ID NO: 2130104 - RNA, 14 nt, Human
acuucaggcucuuc

SEQ ID NO: 2130105 - RNA, 11 nt, Human
acuucagcuga

SEQ ID NO: 2130106 - RNA, 16 nt, Human
acuucagcugacuuuu

SEQ ID NO: 2130107 - RNA, 20 nt, Human
ucucacgggcaguagcugug

SEQ ID NO: 2130108 - RNA, 18 nt, Human
ucucacagcacacucagc

SEQ ID NO: 2130109 - RNA, 20 nt, Human
ucucacagcacacucagcac

SEQ ID NO: 2130110 - RNA, 16 nt, Human
acuucuccacccugcu

SEQ ID NO: 2130111 - RNA, 15 nt, Human
acuucuccacccugc

SEQ ID NO: 2130112 - RNA, 16 nt, Human
acuugaaugugucacu

SEQ ID NO: 2130113 - RNA, 12 nt, Human
acuugagcaugu

SEQ ID NO: 2130114 - RNA, 21 nt, Human
acuugagcgugaaucuguauc

SEQ ID NO: 2130115 - RNA, 18 nt, Human
acuuguggacacagcucu

SEQ ID NO: 2130116 - RNA, 17 nt, Human
acuuguggacacagcuc

SEQ ID NO: 2130117 - RNA, 16 nt, Human
acuuguggacacagcu

SEQ ID NO: 2130118 - RNA, 19 nt, Human
acuuggagccccagugcca

SEQ ID NO: 2130119 - RNA, 14 nt, Human
acuuggccucugga

SEQ ID NO: 2130120 - RNA, 16 nt, Human
ucuccaggcuguaucc

SEQ ID NO: 2130121 - RNA, 17 nt, Human
ucuccaucagcuguaag

SEQ ID NO: 2130122 - RNA, 15 nt, Human
ucuccauauguuaca

SEQ ID NO: 2130123 - RNA, 17 nt, Human
ucuccaucagaggacac

SEQ ID NO: 2130124 - RNA, 13 nt, Human
ucuccaucagcug

SEQ ID NO: 2130125 - RNA, 15 nt, Human
ucuccagugcaccug

SEQ ID NO: 2130126 - RNA, 15 nt, Human
ucuccaguuuucagu

SEQ ID NO: 2130127 - RNA, 14 nt, Human
ucuccauauguuac

SEQ ID NO: 2130128 - RNA, 11 nt, Human
ucuccaaagcu

SEQ ID NO: 2130129 - RNA, 12 nt, Human
ucuccaaagcuu

SEQ ID NO: 2130130 - RNA, 21 nt, Human
ucuccaaagcuuuccuggaga

SEQ ID NO: 2130131 - RNA, 12 nt, Human
ucuccaaaugag

SEQ ID NO: 2130132 - RNA, 24 nt, Human
ucuccaaaugagaucuaagccuuu

SEQ ID NO: 2130133 - RNA, 15 nt, Human
ucuccaaccuggaca

SEQ ID NO: 2130134 - RNA, 19 nt, Human
ucucagggccuggucguuu

SEQ ID NO: 2130135 - RNA, 16 nt, Human
ucucagggaagcccag

SEQ ID NO: 2130136 - RNA, 17 nt, Human
ucucagggaagcccagc

SEQ ID NO: 2130137 - RNA, 18 nt, Human
ucucagggaagcccagcu

SEQ ID NO: 2130138 - RNA, 19 nt, Human
ucucagggaagcccagcuc

SEQ ID NO: 2130139 - RNA, 20 nt, Human
ucucagggaagcccagcucc

SEQ ID NO: 2130140 - RNA, 21 nt, Human
ucucagggaagcccagcucca

SEQ ID NO: 2130141 - RNA, 22 nt, Human
ucucagggaagcccagcuccag

SEQ ID NO: 2130142 - RNA, 23 nt, Human
ucucagggaagcccagcuccagg

SEQ ID NO: 2130143 - RNA, 14 nt, Human
ucucagggccuggu

SEQ ID NO: 2130144 - RNA, 15 nt, Human
ucucagggccugguc

SEQ ID NO: 2130145 - RNA, 15 nt, Human
acuugaggaaaccag

SEQ ID NO: 2130146 - RNA, 12 nt, Human
ucucauucagua

SEQ ID NO: 2130147 - RNA, 13 nt, Human
ucucauucaguau

SEQ ID NO: 2130148 - RNA, 17 nt, Human
ucucauucaguauuaaa

SEQ ID NO: 2130149 - RNA, 13 nt, Human
ucucauuccccag

SEQ ID NO: 2130150 - RNA, 14 nt, Human
ucucauuccccagg

SEQ ID NO: 2130151 - RNA, 16 nt, Human
ucucauuccccaggug

SEQ ID NO: 2130152 - RNA, 12 nt, Human
ucucagggccug

SEQ ID NO: 2130153 - RNA, 13 nt, Human
ucucagggccugg

SEQ ID NO: 2130154 - RNA, 14 nt, Human
ucucaggcucugcc

SEQ ID NO: 2130155 - RNA, 15 nt, Human
ucucaggcucugccc

SEQ ID NO: 2130156 - RNA, 17 nt, Human
ucucaggcucugcccug

SEQ ID NO: 2130157 - RNA, 19 nt, Human
ucucaggcucugcccugcc

SEQ ID NO: 2130158 - RNA, 20 nt, Human
ucucaggcucugcccugccc

SEQ ID NO: 2130159 - RNA, 12 nt, Human
ucucagccuccc

SEQ ID NO: 2130160 - RNA, 13 nt, Human
ucucagccuccca

SEQ ID NO: 2130161 - RNA, 14 nt, Human
ucuccuccugccca

SEQ ID NO: 2130162 - RNA, 16 nt, Human
ucuccuccugcccacc

SEQ ID NO: 2130163 - RNA, 16 nt, Human
ucuccucgcaagcugg

SEQ ID NO: 2130164 - RNA, 13 nt, Human
ucuccucuccccu

SEQ ID NO: 2130165 - RNA, 12 nt, Human
ucuccuauuuuu

SEQ ID NO: 2130166 - RNA, 13 nt, Human
ucuccuauuuuuu

SEQ ID NO: 2130167 - RNA, 20 nt, Human
ucuccuauuuuuuuaaaauc

SEQ ID NO: 2130168 - RNA, 16 nt, Human
ucuccucuccccucua

SEQ ID NO: 2130169 - RNA, 15 nt, Human
acuuguuccagcucu

SEQ ID NO: 2130170 - RNA, 16 nt, Human
acuuguuccagcucuu

SEQ ID NO: 2130171 - RNA, 15 nt, Human
acuuuaaaauaaaau

SEQ ID NO: 2130172 - RNA, 21 nt, Human
acuuguucaaaauauguucuu

SEQ ID NO: 2130173 - RNA, 17 nt, Human
acuuguuccagcucuuu

SEQ ID NO: 2130174 - RNA, 13 nt, Human
acuuuaauaugua

SEQ ID NO: 2130175 - RNA, 16 nt, Human
acuuuaauauguauuu

SEQ ID NO: 2130176 - RNA, 22 nt, Human
acuuuaauauguauuuuaugua

SEQ ID NO: 2130177 - RNA, 16 nt, Human
ucuccauguuugaugu

SEQ ID NO: 2130178 - RNA, 17 nt, Human
ucuccaucuggcagggu

SEQ ID NO: 2130179 - RNA, 19 nt, Human
ucucccacuagacaagucc

SEQ ID NO: 2130180 - RNA, 17 nt, Human
ucuccuagacugacccu

SEQ ID NO: 2130181 - RNA, 23 nt, Human
ucuccuagacugacccugaucag

SEQ ID NO: 2130182 - RNA, 22 nt, Human
ucuccccacacuaaccuggguu

SEQ ID NO: 2130183 - RNA, 11 nt, Human
ucuccccacac

SEQ ID NO: 2130184 - RNA, 13 nt, Human
ucuccccacacua

SEQ ID NO: 2130185 - RNA, 10 nt, Human
ucuccccaca

SEQ ID NO: 2130186 - RNA, 15 nt, Human
ucucccaucuuaacu

SEQ ID NO: 2130187 - RNA, 21 nt, Human
ucucccaucuuaacucuuugc

SEQ ID NO: 2130188 - RNA, 13 nt, Human
ucucccaguuguc

SEQ ID NO: 2130189 - RNA, 17 nt, Human
ucucccagcucuagaca

SEQ ID NO: 2130190 - RNA, 17 nt, Human
ucuccagucuuccaccu

SEQ ID NO: 2130191 - RNA, 11 nt, Human
ucucccaguug

SEQ ID NO: 2130192 - RNA, 16 nt, Human
agaaauuuccacucag

SEQ ID NO: 2130193 - RNA, 22 nt, Human
agaaauuuccacucaggucugu

SEQ ID NO: 2130194 - RNA, 23 nt, Human
agaaccccaggguccuguagccc

SEQ ID NO: 2130195 - RNA, 20 nt, Human
agaacccuggugaggaagcu

SEQ ID NO: 2130196 - RNA, 22 nt, Human
agaacccuggugaggaagcucc

SEQ ID NO: 2130197 - RNA, 15 nt, Human
agaauguuguauuca

SEQ ID NO: 2130198 - RNA, 19 nt, Human
agaauguugaauacuuaua

SEQ ID NO: 2130199 - RNA, 19 nt, Human
agaauguuguauucaguga

SEQ ID NO: 2130200 - RNA, 18 nt, Human
agaauguuguauucagug

SEQ ID NO: 2130201 - RNA, 21 nt, Human
agaauguguuuaaacuugguu

SEQ ID NO: 2130202 - RNA, 14 nt, Human
agaauguucucaau

SEQ ID NO: 2130203 - RNA, 19 nt, Human
agaauguuauagugaauua

SEQ ID NO: 2130204 - RNA, 22 nt, Human
agaauguuauagugaauuaucc

SEQ ID NO: 2130205 - RNA, 18 nt, Human
agaaugugcucaugcauu

SEQ ID NO: 2130206 - RNA, 21 nt, Human
ucugggguucagccccuccuc

SEQ ID NO: 2130207 - RNA, 22 nt, Human
ucugggguucagccccuccucu

SEQ ID NO: 2130208 - RNA, 16 nt, Human
ucugggguucagcccc

SEQ ID NO: 2130209 - RNA, 17 nt, Human
ucugggguucagccccu

SEQ ID NO: 2130210 - RNA, 18 nt, Human
ucugggguucagccccuc

SEQ ID NO: 2130211 - RNA, 19 nt, Human
ucugggguucagccccucc

SEQ ID NO: 2130212 - RNA, 23 nt, Human
ucugggguucagccccuccucug

SEQ ID NO: 2130213 - RNA, 13 nt, Human
ucuggguucuggg

SEQ ID NO: 2130214 - RNA, 15 nt, Human
ucuggguucugggug

SEQ ID NO: 2130215 - RNA, 16 nt, Human
ucuggguucugggugg

SEQ ID NO: 2130216 - RNA, 21 nt, Human
ucugggcuuggggcuuccuaa

SEQ ID NO: 2130217 - RNA, 22 nt, Human
ucugggcuuugauuccaucucc

SEQ ID NO: 2130218 - RNA, 19 nt, Human
ucugggcuuggggcuuccu

SEQ ID NO: 2130219 - RNA, 13 nt, Human
ucugggggucagg

SEQ ID NO: 2130220 - RNA, 20 nt, Human
agaauuauaauuaguuccuc

SEQ ID NO: 2130221 - RNA, 15 nt, Human
agaauucccagcugu

SEQ ID NO: 2130222 - RNA, 20 nt, Human
agaauucucagaaucucaaa

SEQ ID NO: 2130223 - RNA, 19 nt, Human
agaauuccuacaauauaua

SEQ ID NO: 2130224 - RNA, 19 nt, Human
agaauucuccaaaacaauu

SEQ ID NO: 2130225 - RNA, 17 nt, Human
ucugggcugcuacccag

SEQ ID NO: 2130226 - RNA, 22 nt, Human
ucugggcugcuacccagaaauc

SEQ ID NO: 2130227 - RNA, 18 nt, Human
ucuguacgucugacaggc

SEQ ID NO: 2130228 - RNA, 20 nt, Human
ucugguaggaauagcauguc

SEQ ID NO: 2130229 - RNA, 13 nt, Human
ucugguagacaca

SEQ ID NO: 2130230 - RNA, 20 nt, Human
ucugguagacacaggauaga

SEQ ID NO: 2130231 - RNA, 16 nt, Human
ucugguagauagaaau

SEQ ID NO: 2130232 - RNA, 18 nt, Human
ucugguagauagaaauaa

SEQ ID NO: 2130233 - RNA, 20 nt, Human
ucugguagauuuuuaacgaa

SEQ ID NO: 2130234 - RNA, 21 nt, Human
ucuguaucggagacagugauc

SEQ ID NO: 2130235 - RNA, 18 nt, Human
ucuguaucggagacagug

SEQ ID NO: 2130236 - RNA, 19 nt, Human
ucuguaucggagacaguga

SEQ ID NO: 2130237 - RNA, 23 nt, Human
ucuguauuuaugugugaggagcu

SEQ ID NO: 2130238 - RNA, 13 nt, Human
ucuguccagggcc

SEQ ID NO: 2130239 - RNA, 17 nt, Human
ucuguccagggcccuga

SEQ ID NO: 2130240 - RNA, 19 nt, Human
ucuguccagggcccugagc

SEQ ID NO: 2130241 - RNA, 20 nt, Human
ucuguccagggcccugagcu

SEQ ID NO: 2130242 - RNA, 15 nt, Human
ucuguggccuuguuc

SEQ ID NO: 2130243 - RNA, 22 nt, Human
ucuguggccuuguucucucuau

SEQ ID NO: 2130244 - RNA, 14 nt, Human
ucugugccccaugc

SEQ ID NO: 2130245 - RNA, 15 nt, Human
ucugugccccaugcc

SEQ ID NO: 2130246 - RNA, 17 nt, Human
ucugugccccaugccug

SEQ ID NO: 2130247 - RNA, 12 nt, Human
ucugugcccagc

SEQ ID NO: 2130248 - RNA, 13 nt, Human
ucugugcccagcu

SEQ ID NO: 2130249 - RNA, 14 nt, Human
ucugugcccagcuc

SEQ ID NO: 2130250 - RNA, 16 nt, Human
ucugugcccagcucag

SEQ ID NO: 2130251 - RNA, 19 nt, Human
ucugugcccagcucagucu

SEQ ID NO: 2130252 - RNA, 14 nt, Human
ucuuacaaacaugu

SEQ ID NO: 2130253 - RNA, 23 nt, Human
ucuuaauuuaaucuuuuuuaugu

SEQ ID NO: 2130254 - RNA, 12 nt, Human
agacagugaucu

SEQ ID NO: 2130255 - RNA, 15 nt, Human
agacagugaucucca

SEQ ID NO: 2130256 - RNA, 17 nt, Human
agacagugaucuccaua

SEQ ID NO: 2130257 - RNA, 18 nt, Human
agacagugaucuccauau

SEQ ID NO: 2130258 - RNA, 20 nt, Human
agacagugaucuccauaugu

SEQ ID NO: 2130259 - RNA, 21 nt, Human
agacagugaucuccauauguu

SEQ ID NO: 2130260 - RNA, 22 nt, Human
agacagugccuauacugccucu

SEQ ID NO: 2130261 - RNA, 20 nt, Human
agacagucaaggaguggcuu

SEQ ID NO: 2130262 - RNA, 17 nt, Human
agacagucaaggagugg

SEQ ID NO: 2130263 - RNA, 13 nt, Human
ucuuacaaagugu

SEQ ID NO: 2130264 - RNA, 16 nt, Human
ucuuacaaaguguauu

SEQ ID NO: 2130265 - RNA, 20 nt, Human
ucuuacaaaguguauuuuau

SEQ ID NO: 2130266 - RNA, 15 nt, Human
ucuuacccuucugug

SEQ ID NO: 2130267 - RNA, 16 nt, Human
ucuuacccuucugugc

SEQ ID NO: 2130268 - RNA, 18 nt, Human
ucuuacccuucugugccc

SEQ ID NO: 2130269 - RNA, 20 nt, Human
ucuuacccuucugugcccag

SEQ ID NO: 2130270 - RNA, 21 nt, Human
ucuuacccuucugugcccagc

SEQ ID NO: 2130271 - RNA, 22 nt, Human
ucuuacccuucugugcccagcu

SEQ ID NO: 2130272 - RNA, 15 nt, Human
ucuuacauguuuucu

SEQ ID NO: 2130273 - RNA, 14 nt, Human
ucuuacauguuuuc

SEQ ID NO: 2130274 - RNA, 17 nt, Human
ucuuacuauuaagcagu

SEQ ID NO: 2130275 - RNA, 21 nt, Human
ucuuacuauuaagcaguaaaa

SEQ ID NO: 2130276 - RNA, 23 nt, Human
ucuuacuauuaagcaguaaaaac

SEQ ID NO: 2130277 - RNA, 20 nt, Human
ucuuacuuauuaucuucagg

SEQ ID NO: 2130278 - RNA, 12 nt, Human
ucuuacugcuug

SEQ ID NO: 2130279 - RNA, 13 nt, Human
ucuuacugaaggu

SEQ ID NO: 2130280 - RNA, 23 nt, Human
ucuuacugaagguaaaauugaaa

SEQ ID NO: 2130281 - RNA, 17 nt, Human
ucuuauguaccucuuuu

SEQ ID NO: 2130282 - RNA, 18 nt, Human
ucuuauguaccucuuuua

SEQ ID NO: 2130283 - RNA, 18 nt, Human
ucuuauguaugugaaagu

SEQ ID NO: 2130284 - RNA, 12 nt, Human
ucuuagauguau

SEQ ID NO: 2130285 - RNA, 17 nt, Human
agacacaggcccggcuc

SEQ ID NO: 2130286 - RNA, 11 nt, Human
agacacacaca

SEQ ID NO: 2130287 - RNA, 17 nt, Human
agacacacgcacacaca

SEQ ID NO: 2130288 - RNA, 18 nt, Human
agacacacgcacacacac

SEQ ID NO: 2130289 - RNA, 22 nt, Human
agacacaggcccggcuccaggc

SEQ ID NO: 2130290 - RNA, 21 nt, Human
agacacaggcccggcuccagg

SEQ ID NO: 2130291 - RNA, 20 nt, Human
agacacaggcccggcuccag

SEQ ID NO: 2130292 - RNA, 19 nt, Human
agacacaggcccggcucca

SEQ ID NO: 2130293 - RNA, 17 nt, Human
agaauucucuuauccaa

SEQ ID NO: 2130294 - RNA, 13 nt, Human
agaauucugcuac

SEQ ID NO: 2130295 - RNA, 20 nt, Human
agaauucugcuaccucacug

SEQ ID NO: 2130296 - RNA, 22 nt, Human
agaauucugcuaccucacuggg

SEQ ID NO: 2130297 - RNA, 22 nt, Human
agacaccuugacagggcacacc

SEQ ID NO: 2130298 - RNA, 19 nt, Human
agacaccuugacagggcac

SEQ ID NO: 2130299 - RNA, 23 nt, Human
agacacaggcccggcuccaggcu

SEQ ID NO: 2130300 - RNA, 13 nt, Human
agacacacuuguc

SEQ ID NO: 2130301 - RNA, 14 nt, Human
agacacagaacaca

SEQ ID NO: 2130302 - RNA, 16 nt, Human
agacacagaacacaga

SEQ ID NO: 2130303 - RNA, 15 nt, Human
agacacuuuggaagu

SEQ ID NO: 2130304 - RNA, 23 nt, Human
agacacuuuggaaguuuguguuc

SEQ ID NO: 2130305 - RNA, 15 nt, Human
agacuuccagagccu

SEQ ID NO: 2130306 - RNA, 17 nt, Human
agacuucauuuuuccua

SEQ ID NO: 2130307 - RNA, 19 nt, Human
agacuuaguauauuuucuu

SEQ ID NO: 2130308 - RNA, 22 nt, Human
agacuuaguauauuuucuuuuc

SEQ ID NO: 2130309 - RNA, 18 nt, Human
agacuuaguauauuuucu

SEQ ID NO: 2130310 - RNA, 15 nt, Human
agacuucccugaaug

SEQ ID NO: 2130311 - RNA, 19 nt, Human
agacuucccugaauguauu

SEQ ID NO: 2130312 - RNA, 14 nt, Human
agacuucccagcuu

SEQ ID NO: 2130313 - RNA, 15 nt, Human
agacuucccagcuuc

SEQ ID NO: 2130314 - RNA, 18 nt, Human
agacuucccagcuucugc

SEQ ID NO: 2130315 - RNA, 14 nt, Human
agacugucucaaga

SEQ ID NO: 2130316 - RNA, 22 nt, Human
agacuguagauugcuucuguag

SEQ ID NO: 2130317 - RNA, 23 nt, Human
agacuguagauugcuucuguagu

SEQ ID NO: 2130318 - RNA, 21 nt, Human
agacugucagcuuccaaacau

SEQ ID NO: 2130319 - RNA, 23 nt, Human
agacuguuuuucagggagguggc

SEQ ID NO: 2130320 - RNA, 21 nt, Human
agacugggugaggauaacaca

SEQ ID NO: 2130321 - RNA, 15 nt, Human
agacuguacaaagua

SEQ ID NO: 2130322 - RNA, 16 nt, Human
agacuguacaaaguag

SEQ ID NO: 2130323 - RNA, 17 nt, Human
agagacagacuugagaa

SEQ ID NO: 2130324 - RNA, 18 nt, Human
agagacagacuugagaac

SEQ ID NO: 2130325 - RNA, 19 nt, Human
agagacagacuugagaacu

SEQ ID NO: 2130326 - RNA, 13 nt, Human
agagacagagagg

SEQ ID NO: 2130327 - RNA, 14 nt, Human
agagacaagaagca

SEQ ID NO: 2130328 - RNA, 16 nt, Human
agagacaagaagcaaa

SEQ ID NO: 2130329 - RNA, 15 nt, Human
agagacaagacuucg

SEQ ID NO: 2130330 - RNA, 13 nt, Human
agagaaaaaagaa

SEQ ID NO: 2130331 - RNA, 17 nt, Human
agagaaaaaagaagugu

SEQ ID NO: 2130332 - RNA, 17 nt, Human
agagaauguagauauug

SEQ ID NO: 2130333 - RNA, 16 nt, Human
agagaaugucugaucu

SEQ ID NO: 2130334 - RNA, 13 nt, Human
agagaauguuaua

SEQ ID NO: 2130335 - RNA, 18 nt, Human
agagaauguuauagugaa

SEQ ID NO: 2130336 - RNA, 20 nt, Human
agagaauguuauagugaauu

SEQ ID NO: 2130337 - RNA, 21 nt, Human
agagaauguuauagugaauua

SEQ ID NO: 2130338 - RNA, 22 nt, Human
agagaauguuauagugaauuau

SEQ ID NO: 2130339 - RNA, 19 nt, Human
agagaauuguuugaacccg

SEQ ID NO: 2130340 - RNA, 22 nt, Human
agacuugguguccuuucccucc

SEQ ID NO: 2130341 - RNA, 23 nt, Human
agacuugguguccuuucccucca

SEQ ID NO: 2130342 - RNA, 19 nt, Human
agacuugguguccuuuccc

SEQ ID NO: 2130343 - RNA, 18 nt, Human
agacuuguaugaaagaug

SEQ ID NO: 2130344 - RNA, 14 nt, Human
agacuuuaaagaau

SEQ ID NO: 2130345 - RNA, 12 nt, Human
agacuuuagaaa

SEQ ID NO: 2130346 - RNA, 16 nt, Human
agacuuuagaaauaaa

SEQ ID NO: 2130347 - RNA, 17 nt, Human
agacuuuagaaauaaau

SEQ ID NO: 2130348 - RNA, 18 nt, Human
agacuuuagaaauaaaug

SEQ ID NO: 2130349 - RNA, 18 nt, Human
agacuuuccccauacucu

SEQ ID NO: 2130350 - RNA, 13 nt, Human
agacuuuucuuug

SEQ ID NO: 2130351 - RNA, 19 nt, Human
agacuuuuuuuaaauagua

SEQ ID NO: 2130352 - RNA, 12 nt, Human
agacuuuuuggu

SEQ ID NO: 2130353 - RNA, 13 nt, Human
agacuuuuuggug

SEQ ID NO: 2130354 - RNA, 19 nt, Human
agacuuuuugguggaugua

SEQ ID NO: 2130355 - RNA, 20 nt, Human
agacuuuuugguggauguaa

SEQ ID NO: 2130356 - RNA, 23 nt, Human
agacuuuuugguggauguaaaua

SEQ ID NO: 2130357 - RNA, 21 nt, Human
agagaaaaaaaguuugccaga

SEQ ID NO: 2130358 - RNA, 22 nt, Human
agagaaaaaauauuuuccugcc

SEQ ID NO: 2130359 - RNA, 22 nt, Human
ucuuucugcagaaacagaaagg

SEQ ID NO: 2130360 - RNA, 16 nt, Human
ucuuucuggccugccu

SEQ ID NO: 2130361 - RNA, 18 nt, Human
ucuuucuggccugccuuc

SEQ ID NO: 2130362 - RNA, 23 nt, Human
ucuuucuggccugccuucguuaa

SEQ ID NO: 2130363 - RNA, 14 nt, Human
ucuuucuuccucug

SEQ ID NO: 2130364 - RNA, 20 nt, Human
ucuuuauaauucuacuuuga

SEQ ID NO: 2130365 - RNA, 13 nt, Human
ucuuucugcuuug

SEQ ID NO: 2130366 - RNA, 16 nt, Human
ucuuucuuccucugcu

SEQ ID NO: 2130367 - RNA, 15 nt, Human
ucuuucuuccucugc

SEQ ID NO: 2130368 - RNA, 17 nt, Human
ucuuucuuccucugcug

SEQ ID NO: 2130369 - RNA, 15 nt, Human
ucuuuaguuuuugug

SEQ ID NO: 2130370 - RNA, 22 nt, Human
ucuuuaaugucacaggcagguc

SEQ ID NO: 2130371 - RNA, 20 nt, Human
ucuuuaaugucacaggcagg

SEQ ID NO: 2130372 - RNA, 20 nt, Human
ucuuguaagagcuauacagu

SEQ ID NO: 2130373 - RNA, 11 nt, Human
ucuuguaagau

SEQ ID NO: 2130374 - RNA, 13 nt, Human
ucuuguaagauuu

SEQ ID NO: 2130375 - RNA, 16 nt, Human
ucuuguaagauuuuga

SEQ ID NO: 2130376 - RNA, 17 nt, Human
ucuuguaagauuuugaa

SEQ ID NO: 2130377 - RNA, 18 nt, Human
ucuuguaagauuuugaaa

SEQ ID NO: 2130378 - RNA, 19 nt, Human
ucuuguaagauuuugaaaa

SEQ ID NO: 2130379 - RNA, 15 nt, Human
ucuuguaagcaaaag

SEQ ID NO: 2130380 - RNA, 15 nt, Human
ucuugguuuccuucc

SEQ ID NO: 2130381 - RNA, 14 nt, Human
agaccuagggagga

SEQ ID NO: 2130382 - RNA, 15 nt, Human
agaccuagggaggac

SEQ ID NO: 2130383 - RNA, 16 nt, Human
agaccuauuugacaua

SEQ ID NO: 2130384 - RNA, 11 nt, Human
agaccucagcc

SEQ ID NO: 2130385 - RNA, 19 nt, Human
agaccuagggaggaccuua

SEQ ID NO: 2130386 - RNA, 12 nt, Human
agaccucagcca

SEQ ID NO: 2130387 - RNA, 14 nt, Human
agaccucagccaug

SEQ ID NO: 2130388 - RNA, 12 nt, Human
agaccucagccu

SEQ ID NO: 2130389 - RNA, 13 nt, Human
agaccucagccug

SEQ ID NO: 2130390 - RNA, 14 nt, Human
agaccucagccugu

SEQ ID NO: 2130391 - RNA, 15 nt, Human
agaccucagccugug

SEQ ID NO: 2130392 - RNA, 16 nt, Human
agaccucagccugugc

SEQ ID NO: 2130393 - RNA, 17 nt, Human
agaccucagccugugcu

SEQ ID NO: 2130394 - RNA, 19 nt, Human
agaccucagccugugcugc

SEQ ID NO: 2130395 - RNA, 20 nt, Human
agaccucagccugugcugcc

SEQ ID NO: 2130396 - RNA, 18 nt, Human
agaccucagccaugagga

SEQ ID NO: 2130397 - RNA, 18 nt, Human
agaccucugugcacuuau

SEQ ID NO: 2130398 - RNA, 19 nt, Human
agaccucuauauuugcucu

SEQ ID NO: 2130399 - RNA, 16 nt, Human
agacccuaccccacca

SEQ ID NO: 2130400 - RNA, 18 nt, Human
agacccuaccccaccacg

SEQ ID NO: 2130401 - RNA, 17 nt, Human
agacccuuuuggguuuc

SEQ ID NO: 2130402 - RNA, 19 nt, Human
agacccuuuuggguuucug

SEQ ID NO: 2130403 - RNA, 12 nt, Human
agaccggaagcu

SEQ ID NO: 2130404 - RNA, 16 nt, Human
agaccggaagcuccug

SEQ ID NO: 2130405 - RNA, 18 nt, Human
agaccggaagcuccuggu

SEQ ID NO: 2130406 - RNA, 18 nt, Human
agaccgucgggggcugag

SEQ ID NO: 2130407 - RNA, 23 nt, Human
agaccgucgggggcugaggggca

SEQ ID NO: 2130408 - RNA, 17 nt, Human
agaccaaaaugacaaug

SEQ ID NO: 2130409 - RNA, 18 nt, Human
agaccaaaaugacaauga

SEQ ID NO: 2130410 - RNA, 14 nt, Human
agaccccuggcuuu

SEQ ID NO: 2130411 - RNA, 15 nt, Human
agaccccuggcuuuu

SEQ ID NO: 2130412 - RNA, 21 nt, Human
agaccccuggcuuuucacugc

SEQ ID NO: 2130413 - RNA, 17 nt, Human
agacccuaaaucugagg

SEQ ID NO: 2130414 - RNA, 13 nt, Human
agaccccugucuc

SEQ ID NO: 2130415 - RNA, 14 nt, Human
agaccccugucucc

SEQ ID NO: 2130416 - RNA, 13 nt, Human
agaccccugucuu

SEQ ID NO: 2130417 - RNA, 23 nt, Human
agaccccugucuuugcugagagc

SEQ ID NO: 2130418 - RNA, 15 nt, Human
agacccgaggaaacu

SEQ ID NO: 2130419 - RNA, 14 nt, Human
agacccggcugcgu

SEQ ID NO: 2130420 - RNA, 14 nt, Human
agacuauuugcuua

SEQ ID NO: 2130421 - RNA, 16 nt, Human
agacuauugacaucag

SEQ ID NO: 2130422 - RNA, 20 nt, Human
agacuauugacaucagcauc

SEQ ID NO: 2130423 - RNA, 12 nt, Human
agacucaccucu

SEQ ID NO: 2130424 - RNA, 14 nt, Human
agacucaccucugc

SEQ ID NO: 2130425 - RNA, 16 nt, Human
agacucaccucugccu

SEQ ID NO: 2130426 - RNA, 22 nt, Human
agacucagguuguaguaaagaa

SEQ ID NO: 2130427 - RNA, 23 nt, Human
agacucagguuguaguaaagaaa

SEQ ID NO: 2130428 - RNA, 20 nt, Human
agaccugcugagggaccagc

SEQ ID NO: 2130429 - RNA, 15 nt, Human
agacucauucuucug

SEQ ID NO: 2130430 - RNA, 15 nt, Human
agacucaccucugcc

SEQ ID NO: 2130431 - RNA, 12 nt, Human
agacucaguguu

SEQ ID NO: 2130432 - RNA, 13 nt, Human
agacucaguguuc

SEQ ID NO: 2130433 - RNA, 12 nt, Human
agacucaguuug

SEQ ID NO: 2130434 - RNA, 18 nt, Human
agacucauacagaaggug

SEQ ID NO: 2130435 - RNA, 15 nt, Human
agacucaguuuguca

SEQ ID NO: 2130436 - RNA, 16 nt, Human
agacucaguuugucag

SEQ ID NO: 2130437 - RNA, 17 nt, Human
agacucaguuugucaga

SEQ ID NO: 2130438 - RNA, 21 nt, Human
agacucaguuugucagacuuu

SEQ ID NO: 2130439 - RNA, 21 nt, Human
ucuugaguuuuguuuuaaaau

SEQ ID NO: 2130440 - RNA, 14 nt, Human
ucuucuucagaaga

SEQ ID NO: 2130441 - RNA, 14 nt, Human
ucuucuuccaggua

SEQ ID NO: 2130442 - RNA, 16 nt, Human
ucuucuucagaagaca

SEQ ID NO: 2130443 - RNA, 23 nt, Human
ucuucuguacgucugacaggcaa

SEQ ID NO: 2130444 - RNA, 15 nt, Human
ucuucuuacaugcau

SEQ ID NO: 2130445 - RNA, 20 nt, Human
ucuucuguacgucugacagg

SEQ ID NO: 2130446 - RNA, 14 nt, Human
ucuucuucuucaga

SEQ ID NO: 2130447 - RNA, 22 nt, Human
agacauacuccuuccaucaaau

SEQ ID NO: 2130448 - RNA, 15 nt, Human
ucuucuucuucagaa

SEQ ID NO: 2130449 - RNA, 14 nt, Human
agacaugaauauga

SEQ ID NO: 2130450 - RNA, 17 nt, Human
agacaugaauaugauua

SEQ ID NO: 2130451 - RNA, 17 nt, Human
agacaugaaugcacacu

SEQ ID NO: 2130452 - RNA, 22 nt, Human
agacauuuguaaauguaaaacu

SEQ ID NO: 2130453 - RNA, 16 nt, Human
agacauggcuugccac

SEQ ID NO: 2130454 - RNA, 22 nt, Human
agacauggcuugccacagcucu

SEQ ID NO: 2130455 - RNA, 12 nt, Human
agacauggggag

SEQ ID NO: 2130456 - RNA, 18 nt, Human
ucuucugccggcccuggg

SEQ ID NO: 2130457 - RNA, 19 nt, Human
ucuucugccggcccugggg

SEQ ID NO: 2130458 - RNA, 11 nt, Human
ucuucugcucc

SEQ ID NO: 2130459 - RNA, 12 nt, Human
ucuucugcucca

SEQ ID NO: 2130460 - RNA, 13 nt, Human
ucuucugcuccac

SEQ ID NO: 2130461 - RNA, 22 nt, Human
ucuucugcuucagccucccgag

SEQ ID NO: 2130462 - RNA, 22 nt, Human
ucuucuguacgucugacaggca

SEQ ID NO: 2130463 - RNA, 21 nt, Human
ucuucuguacgucugacaggc

SEQ ID NO: 2130464 - RNA, 17 nt, Human
ucuuauuuaaugaaaga

SEQ ID NO: 2130465 - RNA, 17 nt, Human
ucuuauucaguaaaaaa

SEQ ID NO: 2130466 - RNA, 18 nt, Human
ucuuauucaguaaaaaac

SEQ ID NO: 2130467 - RNA, 15 nt, Human
ucuuauucucacucc

SEQ ID NO: 2130468 - RNA, 13 nt, Human
ucuuauuuauuau

SEQ ID NO: 2130469 - RNA, 17 nt, Human
ugaccaauauuguacag

SEQ ID NO: 2130470 - RNA, 18 nt, Human
ugaccaauauuguacagu

SEQ ID NO: 2130471 - RNA, 23 nt, Human
ugaccaauauuauacuaagaaaa

SEQ ID NO: 2130472 - RNA, 19 nt, Human
ugaccaauauuguacaguu

SEQ ID NO: 2130473 - RNA, 21 nt, Human
ugaccaauauuguacaguuuu

SEQ ID NO: 2130474 - RNA, 18 nt, Human
ugaccaaugauggucacc

SEQ ID NO: 2130475 - RNA, 22 nt, Human
ugacauuguagagcuucuggca

SEQ ID NO: 2130476 - RNA, 21 nt, Human
ugacauuguuggccaaagcca

SEQ ID NO: 2130477 - RNA, 20 nt, Human
ugacauuguuggccaaagcc

SEQ ID NO: 2130478 - RNA, 12 nt, Human
agaucaugaaga

SEQ ID NO: 2130479 - RNA, 18 nt, Human
agaucauagauuucugau

SEQ ID NO: 2130480 - RNA, 19 nt, Human
agaucauagauuucugauu

SEQ ID NO: 2130481 - RNA, 20 nt, Human
agaucauagauuucugauuu

SEQ ID NO: 2130482 - RNA, 21 nt, Human
agaucauagauuucugauuuu

SEQ ID NO: 2130483 - RNA, 23 nt, Human
agaucauagauuucugauuuuau

SEQ ID NO: 2130484 - RNA, 13 nt, Human
agaucagccuggg

SEQ ID NO: 2130485 - RNA, 15 nt, Human
agaucagccugggca

SEQ ID NO: 2130486 - RNA, 20 nt, Human
ugacagggcacaccgggcac

SEQ ID NO: 2130487 - RNA, 21 nt, Human
ugacagugccugggaauguau

SEQ ID NO: 2130488 - RNA, 16 nt, Human
ugacagggcacaccgg

SEQ ID NO: 2130489 - RNA, 11 nt, Human
ugacagggcac

SEQ ID NO: 2130490 - RNA, 21 nt, Human
ugacacacagcucuguccugg

SEQ ID NO: 2130491 - RNA, 22 nt, Human
ugacagccucccacccccaucu

SEQ ID NO: 2130492 - RNA, 17 nt, Human
ugacagccucccacccc

SEQ ID NO: 2130493 - RNA, 19 nt, Human
ugacagccucccaccccca

SEQ ID NO: 2130494 - RNA, 20 nt, Human
ugacaggcaaugcuggcugu

SEQ ID NO: 2130495 - RNA, 16 nt, Human
ugacagcugucccugu

SEQ ID NO: 2130496 - RNA, 17 nt, Human
ugacagcugucccuguc

SEQ ID NO: 2130497 - RNA, 18 nt, Human
ugacagcugucccuguca

SEQ ID NO: 2130498 - RNA, 20 nt, Human
ugacagcugucccugucacc

SEQ ID NO: 2130499 - RNA, 21 nt, Human
ugacagcugucccugucacca

SEQ ID NO: 2130500 - RNA, 12 nt, Human
ugacagcugucc

SEQ ID NO: 2130501 - RNA, 14 nt, Human
ugacagcugucccu

SEQ ID NO: 2130502 - RNA, 13 nt, Human
agaugccucccug

SEQ ID NO: 2130503 - RNA, 19 nt, Human
agaugccucccugacccug

SEQ ID NO: 2130504 - RNA, 21 nt, Human
agaugccucccugacccugca

SEQ ID NO: 2130505 - RNA, 22 nt, Human
agaugccucccugacccugcag

SEQ ID NO: 2130506 - RNA, 23 nt, Human
agaugccucccugacccugcaga

SEQ ID NO: 2130507 - RNA, 15 nt, Human
agaugcaccagcccu

SEQ ID NO: 2130508 - RNA, 14 nt, Human
agaugcaccagccc

SEQ ID NO: 2130509 - RNA, 21 nt, Human
agaucccagaaggaccuccug

SEQ ID NO: 2130510 - RNA, 13 nt, Human
ugacccacugcuu

SEQ ID NO: 2130511 - RNA, 12 nt, Human
ugacccacugcu

SEQ ID NO: 2130512 - RNA, 13 nt, Human
ugacccacagccu

SEQ ID NO: 2130513 - RNA, 14 nt, Human
ugacccacagccuc

SEQ ID NO: 2130514 - RNA, 15 nt, Human
ugacccacagccucu

SEQ ID NO: 2130515 - RNA, 19 nt, Human
ugacccacagccucugccu

SEQ ID NO: 2130516 - RNA, 20 nt, Human
ugacccacagccucugccug

SEQ ID NO: 2130517 - RNA, 14 nt, Human
ugaccauuuauaau

SEQ ID NO: 2130518 - RNA, 23 nt, Human
ugaccauuuauaauguuaguaga

SEQ ID NO: 2130519 - RNA, 14 nt, Human
ugacccaauuaagu

SEQ ID NO: 2130520 - RNA, 15 nt, Human
agaugcuucucacug

SEQ ID NO: 2130521 - RNA, 15 nt, Human
agauguucacccaac

SEQ ID NO: 2130522 - RNA, 21 nt, Human
agauguggccuuccauuuaua

SEQ ID NO: 2130523 - RNA, 18 nt, Human
agaucacgccacugcacu

SEQ ID NO: 2130524 - RNA, 17 nt, Human
agaucacgccacugcac

SEQ ID NO: 2130525 - RNA, 21 nt, Human
agaucaccaguguguggcuuu

SEQ ID NO: 2130526 - RNA, 13 nt, Human
agaucacgagguc

SEQ ID NO: 2130527 - RNA, 22 nt, Human
agaucacgccacugcacuccag

SEQ ID NO: 2130528 - RNA, 11 nt, Human
ugaauuucauc

SEQ ID NO: 2130529 - RNA, 13 nt, Human
ugaauuucuaaaa

SEQ ID NO: 2130530 - RNA, 12 nt, Human
ugaauuucucua

SEQ ID NO: 2130531 - RNA, 14 nt, Human
ugaauuucucuaca

SEQ ID NO: 2130532 - RNA, 15 nt, Human
ugaauuucucuacag

SEQ ID NO: 2130533 - RNA, 23 nt, Human
ugaauuuucuuuuuaauaaaaag

SEQ ID NO: 2130534 - RNA, 22 nt, Human
ugaauuuuucucuaacucagaa

SEQ ID NO: 2130535 - RNA, 13 nt, Human
ugaauuuucaagc

SEQ ID NO: 2130536 - RNA, 18 nt, Human
ugaauuuucaagcaucuc

SEQ ID NO: 2130537 - RNA, 20 nt, Human
ugacacacagcucuguccug

SEQ ID NO: 2130538 - RNA, 21 nt, Human
ugaauuuuuuucaucuucucu

SEQ ID NO: 2130539 - RNA, 23 nt, Human
ugaauuuuuuucaucuucucugg

SEQ ID NO: 2130540 - RNA, 16 nt, Human
agaucacgccacugca

SEQ ID NO: 2130541 - RNA, 15 nt, Human
agaucacgccacugc

SEQ ID NO: 2130542 - RNA, 14 nt, Human
agaucacgccacug

SEQ ID NO: 2130543 - RNA, 16 nt, Human
agaucacauaacagaa

SEQ ID NO: 2130544 - RNA, 18 nt, Human
agaucacauaacagaaug

SEQ ID NO: 2130545 - RNA, 19 nt, Human
agaucacauaacagaaugc

SEQ ID NO: 2130546 - RNA, 20 nt, Human
agaucacauaacagaaugca

SEQ ID NO: 2130547 - RNA, 17 nt, Human
agauauggcagcgaaag

SEQ ID NO: 2130548 - RNA, 12 nt, Human
agauauuauuca

SEQ ID NO: 2130549 - RNA, 20 nt, Human
agauauuauucaccauguaa

SEQ ID NO: 2130550 - RNA, 21 nt, Human
agauauuauucaccauguaaa

SEQ ID NO: 2130551 - RNA, 12 nt, Human
agauauucaagu

SEQ ID NO: 2130552 - RNA, 18 nt, Human
agauauugugaaguacau

SEQ ID NO: 2130553 - RNA, 19 nt, Human
agauauugugaaguacaua

SEQ ID NO: 2130554 - RNA, 21 nt, Human
agauauugugaaguacauauu

SEQ ID NO: 2130555 - RNA, 18 nt, Human
agauaaagauuucuugag

SEQ ID NO: 2130556 - RNA, 12 nt, Human
agauaaaugugc

SEQ ID NO: 2130557 - RNA, 13 nt, Human
agauaaaggacag

SEQ ID NO: 2130558 - RNA, 19 nt, Human
agauacuggaaguuuugca

SEQ ID NO: 2130559 - RNA, 20 nt, Human
agauacuggaaguuuugcau

SEQ ID NO: 2130560 - RNA, 21 nt, Human
agauacuggaaguuuugcauu

SEQ ID NO: 2130561 - RNA, 20 nt, Human
agauacgacuuuauuuucug

SEQ ID NO: 2130562 - RNA, 13 nt, Human
agauaaauuauaa

SEQ ID NO: 2130563 - RNA, 21 nt, Human
agauaacaagaucuuucagga

SEQ ID NO: 2130564 - RNA, 18 nt, Human
agauaacaagaucuuuca

SEQ ID NO: 2130565 - RNA, 19 nt, Human
agauacgacuuuauuuucu

SEQ ID NO: 2130566 - RNA, 12 nt, Human
agaguccuauuu

SEQ ID NO: 2130567 - RNA, 13 nt, Human
agaguccucacuc

SEQ ID NO: 2130568 - RNA, 14 nt, Human
agaguccucacucc

SEQ ID NO: 2130569 - RNA, 14 nt, Human
agagucuugcagug

SEQ ID NO: 2130570 - RNA, 18 nt, Human
agagucuugcagugauua

SEQ ID NO: 2130571 - RNA, 22 nt, Human
agagucuuuguaaguaaacugc

SEQ ID NO: 2130572 - RNA, 12 nt, Human
agagucugucuc

SEQ ID NO: 2130573 - RNA, 19 nt, Human
agaguugggacaauugcuu

SEQ ID NO: 2130574 - RNA, 19 nt, Human
agaguugugcacauggcuu

SEQ ID NO: 2130575 - RNA, 14 nt, Human
agaguuguguuguu

SEQ ID NO: 2130576 - RNA, 17 nt, Human
agaguuguguuguucuu

SEQ ID NO: 2130577 - RNA, 18 nt, Human
agaguuguguuguucuuu

SEQ ID NO: 2130578 - RNA, 21 nt, Human
agaguuguguuguucuuuucc

SEQ ID NO: 2130579 - RNA, 20 nt, Human
ugaaugguuuucaaaauaaa

SEQ ID NO: 2130580 - RNA, 20 nt, Human
ugaaugguauggaacucucu

SEQ ID NO: 2130581 - RNA, 17 nt, Human
ugaauggguccauuuug

SEQ ID NO: 2130582 - RNA, 13 nt, Human
ugaaugguaugga

SEQ ID NO: 2130583 - RNA, 14 nt, Human
agaguccaggcccc

SEQ ID NO: 2130584 - RNA, 15 nt, Human
agaguccaggcccca

SEQ ID NO: 2130585 - RNA, 16 nt, Human
agaguccaggccccaa

SEQ ID NO: 2130586 - RNA, 19 nt, Human
agagucaucuccaucagcu

SEQ ID NO: 2130587 - RNA, 21 nt, Human
agagucaucuccaucagcugu

SEQ ID NO: 2130588 - RNA, 13 nt, Human
agagucaucucca

SEQ ID NO: 2130589 - RNA, 14 nt, Human
agagucaucuccau

SEQ ID NO: 2130590 - RNA, 18 nt, Human
agagucaucuccaucagc

SEQ ID NO: 2130591 - RNA, 18 nt, Human
agagucagccuucccccu

SEQ ID NO: 2130592 - RNA, 14 nt, Human
ugaaugugucacua

SEQ ID NO: 2130593 - RNA, 16 nt, Human
agagucagcagaacug

SEQ ID NO: 2130594 - RNA, 12 nt, Human
ugaacuccuggc

SEQ ID NO: 2130595 - RNA, 15 nt, Human
ugaacuccuggccuc

SEQ ID NO: 2130596 - RNA, 14 nt, Human
ugaacuccuggccu

SEQ ID NO: 2130597 - RNA, 22 nt, Human
ugaacaaccucggcuccuggac

SEQ ID NO: 2130598 - RNA, 19 nt, Human
ugaacuagcuggaauuuuu

SEQ ID NO: 2130599 - RNA, 22 nt, Human
ugaaccgaugagaaauaaaguu

SEQ ID NO: 2130600 - RNA, 12 nt, Human
ugaaccugcccu

SEQ ID NO: 2130601 - RNA, 15 nt, Human
ugaaauuuuuauuaa

SEQ ID NO: 2130602 - RNA, 20 nt, Human
agagcuguucccaaauuuuc

SEQ ID NO: 2130603 - RNA, 19 nt, Human
agagcuguuuauggccuca

SEQ ID NO: 2130604 - RNA, 20 nt, Human
agagcuguuuauggccucag

SEQ ID NO: 2130605 - RNA, 21 nt, Human
agagcuguuuauggccucagc

SEQ ID NO: 2130606 - RNA, 18 nt, Human
agagcugccuaagaggca

SEQ ID NO: 2130607 - RNA, 21 nt, Human
agagcugccuaagaggcaaug

SEQ ID NO: 2130608 - RNA, 14 nt, Human
agagcugccucucg

SEQ ID NO: 2130609 - RNA, 17 nt, Human
agagcuggaccaguggu

SEQ ID NO: 2130610 - RNA, 15 nt, Human
ugaagaaaaaauaca

SEQ ID NO: 2130611 - RNA, 17 nt, Human
ugaagaaaaaauacauu

SEQ ID NO: 2130612 - RNA, 18 nt, Human
ugaagaaaaaauacauuu

SEQ ID NO: 2130613 - RNA, 19 nt, Human
ugaagaaaaaauacauuuu

SEQ ID NO: 2130614 - RNA, 15 nt, Human
ugaagaaaagugggc

SEQ ID NO: 2130615 - RNA, 18 nt, Human
ugaagaaaagugggccag

SEQ ID NO: 2130616 - RNA, 24 nt, Human
agaggcagccccauucugccugcc

SEQ ID NO: 2130617 - RNA, 14 nt, Human
agaggcagagugcc

SEQ ID NO: 2130618 - RNA, 19 nt, Human
agaggcagagugccccacc

SEQ ID NO: 2130619 - RNA, 21 nt, Human
agaggcagagugccccaccug

SEQ ID NO: 2130620 - RNA, 22 nt, Human
agaggcagagugccccaccugc

SEQ ID NO: 2130621 - RNA, 19 nt, Human
agaggcagccccauucugc

SEQ ID NO: 2130622 - RNA, 13 nt, Human
agaggcagcccca

SEQ ID NO: 2130623 - RNA, 17 nt, Human
agaggaaaaaaaugacu

SEQ ID NO: 2130624 - RNA, 16 nt, Human
agaggaaaaaaaugac

SEQ ID NO: 2130625 - RNA, 22 nt, Human
agagcuuucuucccgaacccca

SEQ ID NO: 2130626 - RNA, 15 nt, Human
agagcuuuacaaaaa

SEQ ID NO: 2130627 - RNA, 16 nt, Human
agagcuuuacaaaaag

SEQ ID NO: 2130628 - RNA, 17 nt, Human
agagcuuuacaaaaaga

SEQ ID NO: 2130629 - RNA, 22 nt, Human
agagcuuucuguccuuuuggca

SEQ ID NO: 2130630 - RNA, 23 nt, Human
agagcuuucuguccuuuuggcac

SEQ ID NO: 2130631 - RNA, 13 nt, Human
agaggcagggucu

SEQ ID NO: 2130632 - RNA, 10 nt, Human
agaggcaggg

SEQ ID NO: 2130633 - RNA, 14 nt, Human
agaggccauggcag

SEQ ID NO: 2130634 - RNA, 13 nt, Human
agaggcagggagg

SEQ ID NO: 2130635 - RNA, 17 nt, Human
agaggcagggaggggac

SEQ ID NO: 2130636 - RNA, 15 nt, Human
agaggccauggcaga

SEQ ID NO: 2130637 - RNA, 16 nt, Human
agaggccauggcagaa

SEQ ID NO: 2130638 - RNA, 20 nt, Human
agaggccauggcagaauaau

SEQ ID NO: 2130639 - RNA, 23 nt, Human
agaggccauggcagaauaaucuu

SEQ ID NO: 2130640 - RNA, 19 nt, Human
agaggccaugggccuccug

SEQ ID NO: 2130641 - RNA, 13 nt, Human
agaggcugaaaga

SEQ ID NO: 2130642 - RNA, 19 nt, Human
agaggcugaaagaggccaa

SEQ ID NO: 2130643 - RNA, 13 nt, Human
agaggcugaggac

SEQ ID NO: 2130644 - RNA, 16 nt, Human
agaggucaagcccagg

SEQ ID NO: 2130645 - RNA, 18 nt, Human
agaggucaagcccaggag

SEQ ID NO: 2130646 - RNA, 20 nt, Human
agaggucaagcccaggagga

SEQ ID NO: 2130647 - RNA, 13 nt, Human
agaggcugaggca

SEQ ID NO: 2130648 - RNA, 16 nt, Human
agagguagggcugcca

SEQ ID NO: 2130649 - RNA, 12 nt, Human
agaggucuuuuu

SEQ ID NO: 2130650 - RNA, 14 nt, Human
agagguugucugug

SEQ ID NO: 2130651 - RNA, 16 nt, Human
agaggucuuuuuuaaa

SEQ ID NO: 2130652 - RNA, 17 nt, Human
agagguucauuucaaau

SEQ ID NO: 2130653 - RNA, 18 nt, Human
ugaagcaaaucagaaacu

SEQ ID NO: 2130654 - RNA, 14 nt, Human
ugaagcaaaucaga

SEQ ID NO: 2130655 - RNA, 15 nt, Human
ugaagcaaaucagaa

SEQ ID NO: 2130656 - RNA, 17 nt, Human
agagguuuuaugauauu

SEQ ID NO: 2130657 - RNA, 17 nt, Human
ugaaaguuugcacugua

SEQ ID NO: 2130658 - RNA, 18 nt, Human
ugaaaguuuucagaaccu

SEQ ID NO: 2130659 - RNA, 20 nt, Human
ugaaaguuuucagaaccucu

SEQ ID NO: 2130660 - RNA, 18 nt, Human
ugaaagucuugugacuag

SEQ ID NO: 2130661 - RNA, 20 nt, Human
ugaaagucuugugacuagug

SEQ ID NO: 2130662 - RNA, 21 nt, Human
ugaaagucuugugacuagugc

SEQ ID NO: 2130663 - RNA, 22 nt, Human
ugaaagucuugugacuagugcu

SEQ ID NO: 2130664 - RNA, 23 nt, Human
ugaaagucuugugacuagugcug

SEQ ID NO: 2130665 - RNA, 11 nt, Human
ugaaagugacu

SEQ ID NO: 2130666 - RNA, 12 nt, Human
agagcgaggcug

SEQ ID NO: 2130667 - RNA, 14 nt, Human
agagcgaggcugag

SEQ ID NO: 2130668 - RNA, 23 nt, Human
agagcgaggcugagccuacagau

SEQ ID NO: 2130669 - RNA, 17 nt, Human
agagcgagagucugucu

SEQ ID NO: 2130670 - RNA, 22 nt, Human
agagccuugguguccaccuggc

SEQ ID NO: 2130671 - RNA, 23 nt, Human
agagccuugguguccaccuggcc

SEQ ID NO: 2130672 - RNA, 14 nt, Human
agagcgccugcccc

SEQ ID NO: 2130673 - RNA, 15 nt, Human
agagcgccugccccu

SEQ ID NO: 2130674 - RNA, 20 nt, Human
agagcgccugccccucccag

SEQ ID NO: 2130675 - RNA, 21 nt, Human
agagcgccugccccucccaga

SEQ ID NO: 2130676 - RNA, 23 nt, Human
agagcgccugccccucccagaac

SEQ ID NO: 2130677 - RNA, 17 nt, Human
ugaaagucuugugacua

SEQ ID NO: 2130678 - RNA, 12 nt, Human
ugaaauaugcau

SEQ ID NO: 2130679 - RNA, 23 nt, Human
agagccuugguucaucaguguua

SEQ ID NO: 2130680 - RNA, 21 nt, Human
ugaaauagugguucuuggaaa

SEQ ID NO: 2130681 - RNA, 22 nt, Human
ugaaauagugguucuuggaaaa

SEQ ID NO: 2130682 - RNA, 19 nt, Human
ugaaauaguucaaagccaa

SEQ ID NO: 2130683 - RNA, 15 nt, Human
ugaaauauacacaca

SEQ ID NO: 2130684 - RNA, 17 nt, Human
ugaaauauacacacagc

SEQ ID NO: 2130685 - RNA, 16 nt, Human
ugaaauauacacacag

SEQ ID NO: 2130686 - RNA, 14 nt, Human
ugaaauaauaaauc

SEQ ID NO: 2130687 - RNA, 22 nt, Human
ugaaauugucuagcagagcagg

SEQ ID NO: 2130688 - RNA, 18 nt, Human
ugaaauuguuuaaguguu

SEQ ID NO: 2130689 - RNA, 23 nt, Human
ugaaauuguuuaaguguuguaaa

SEQ ID NO: 2130690 - RNA, 13 nt, Human
ugaaauuuuacca

SEQ ID NO: 2130691 - RNA, 14 nt, Human
ugaaauuuuaccaa

SEQ ID NO: 2130692 - RNA, 15 nt, Human
ugaaauuuuaccaag

SEQ ID NO: 2130693 - RNA, 16 nt, Human
ugaaauuuuaccaagu

SEQ ID NO: 2130694 - RNA, 17 nt, Human
ugaaauuuuaccaaguu

SEQ ID NO: 2130695 - RNA, 19 nt, Human
ugaaauuuuaccaaguuau

SEQ ID NO: 2130696 - RNA, 13 nt, Human
agagacaggaaaa

SEQ ID NO: 2130697 - RNA, 22 nt, Human
ucuuuggacucuccccucuuau

SEQ ID NO: 2130698 - RNA, 21 nt, Human
agagacaggaaaauccucugg

SEQ ID NO: 2130699 - RNA, 17 nt, Human
agagcacuguauacccc

SEQ ID NO: 2130700 - RNA, 14 nt, Human
agagcaagucugga

SEQ ID NO: 2130701 - RNA, 14 nt, Human
agagcacacuguag

SEQ ID NO: 2130702 - RNA, 15 nt, Human
agagcaagcuuuuuu

SEQ ID NO: 2130703 - RNA, 17 nt, Human
agagcaagcuuuuuuau

SEQ ID NO: 2130704 - RNA, 18 nt, Human
agagcaagcuuuuuuauu

SEQ ID NO: 2130705 - RNA, 23 nt, Human
agagcaagauccugucuuuaagg

SEQ ID NO: 2130706 - RNA, 11 nt, Human
agagccuugcg

SEQ ID NO: 2130707 - RNA, 21 nt, Human
agagccuugcggaagguucua

SEQ ID NO: 2130708 - RNA, 17 nt, Human
agagccuugguguccac

SEQ ID NO: 2130709 - RNA, 19 nt, Human
agagccuugguguccaccu

SEQ ID NO: 2130710 - RNA, 20 nt, Human
agagccuugguguccaccug

SEQ ID NO: 2130711 - RNA, 21 nt, Human
agagccuugguguccaccugg

SEQ ID NO: 2130712 - RNA, 23 nt, Human
agagccaauggaguagaccccug

SEQ ID NO: 2130713 - RNA, 12 nt, Human
agagcaggcaca

SEQ ID NO: 2130714 - RNA, 13 nt, Human
agagcaggcacau

SEQ ID NO: 2130715 - RNA, 18 nt, Human
agagcaggcacauggagg

SEQ ID NO: 2130716 - RNA, 19 nt, Human
agagcaggcacauggagga

SEQ ID NO: 2130717 - RNA, 20 nt, Human
agagcaggcacauggaggag

SEQ ID NO: 2130718 - RNA, 18 nt, Human
agagcaggugcuggcucu

SEQ ID NO: 2130719 - RNA, 13 nt, Human
agagcagggcaag

SEQ ID NO: 2130720 - RNA, 14 nt, Human
agagcagaggcagc

SEQ ID NO: 2130721 - RNA, 16 nt, Human
agcauuugucaacaaa

SEQ ID NO: 2130722 - RNA, 20 nt, Human
agcauuuaguccaaugucuu

SEQ ID NO: 2130723 - RNA, 13 nt, Human
agcauuuauguuu

SEQ ID NO: 2130724 - RNA, 15 nt, Human
agcauuuacuuugaa

SEQ ID NO: 2130725 - RNA, 17 nt, Human
agcauuuacuuugaauu

SEQ ID NO: 2130726 - RNA, 21 nt, Human
agcauuuaguccaaugucuuu

SEQ ID NO: 2130727 - RNA, 23 nt, Human
agcauuuuagcaauuuauacaau

SEQ ID NO: 2130728 - RNA, 18 nt, Human
agccaaacccaugaggca

SEQ ID NO: 2130729 - RNA, 19 nt, Human
agccaaacccaugaggcaa

SEQ ID NO: 2130730 - RNA, 14 nt, Human
agccaaacccuguc

SEQ ID NO: 2130731 - RNA, 15 nt, Human
agccaaacccugucu

SEQ ID NO: 2130732 - RNA, 15 nt, Human
agcauuuugcuaaau

SEQ ID NO: 2130733 - RNA, 22 nt, Human
agcauuuugcuaaaugugaaug

SEQ ID NO: 2130734 - RNA, 17 nt, Human
agcauucuuagccugug

SEQ ID NO: 2130735 - RNA, 18 nt, Human
agcauucuuagccugugg

SEQ ID NO: 2130736 - RNA, 19 nt, Human
agcauucuuagccuguggc

SEQ ID NO: 2130737 - RNA, 20 nt, Human
agcauucuuagccuguggca

SEQ ID NO: 2130738 - RNA, 23 nt, Human
agcauucuuagccuguggcagua

SEQ ID NO: 2130739 - RNA, 16 nt, Human
agcauucuugucacaa

SEQ ID NO: 2130740 - RNA, 19 nt, Human
agcauucuugucacaauaa

SEQ ID NO: 2130741 - RNA, 20 nt, Human
agcauucuugucacaauaaa

SEQ ID NO: 2130742 - RNA, 21 nt, Human
agcauucuugucacaauaaau

SEQ ID NO: 2130743 - RNA, 22 nt, Human
agcauucuugucacaauaaaug

SEQ ID NO: 2130744 - RNA, 22 nt, Human
agcauucucacuccuaccuggu

SEQ ID NO: 2130745 - RNA, 21 nt, Human
agcauuguuugcuuauuguuc

SEQ ID NO: 2130746 - RNA, 22 nt, Human
agcauuguuugcuuauuguucc

SEQ ID NO: 2130747 - RNA, 23 nt, Human
agcauuguuugcuuauuguucca

SEQ ID NO: 2130748 - RNA, 20 nt, Human
agcauucucacuccuaccug

SEQ ID NO: 2130749 - RNA, 18 nt, Human
agcauucucacuccuacc

SEQ ID NO: 2130750 - RNA, 13 nt, Human
agcauguaauggu

SEQ ID NO: 2130751 - RNA, 15 nt, Human
agcauggugcaugcc

SEQ ID NO: 2130752 - RNA, 16 nt, Human
agcauggugcaugccg

SEQ ID NO: 2130753 - RNA, 17 nt, Human
agcauggugcaugccgc

SEQ ID NO: 2130754 - RNA, 15 nt, Human
agcauuacucuugua

SEQ ID NO: 2130755 - RNA, 16 nt, Human
agcauuacucuuguaa

SEQ ID NO: 2130756 - RNA, 17 nt, Human
agcauuacucuuguaag

SEQ ID NO: 2130757 - RNA, 18 nt, Human
agcauuacucuuguaaga

SEQ ID NO: 2130758 - RNA, 19 nt, Human
agcauuacucuuguaagau

SEQ ID NO: 2130759 - RNA, 20 nt, Human
agcauuacucuuguaagauu

SEQ ID NO: 2130760 - RNA, 21 nt, Human
agcauuacucuuguaagauuu

SEQ ID NO: 2130761 - RNA, 19 nt, Human
agcauuaugauguggguca

SEQ ID NO: 2130762 - RNA, 22 nt, Human
agcauucaauuuauucaagaaa

SEQ ID NO: 2130763 - RNA, 23 nt, Human
agcauucaauuuauucaagaaaa

SEQ ID NO: 2130764 - RNA, 14 nt, Human
ugaucacggcucac

SEQ ID NO: 2130765 - RNA, 13 nt, Human
ugaucacggcuca

SEQ ID NO: 2130766 - RNA, 15 nt, Human
ugaucacggcucacu

SEQ ID NO: 2130767 - RNA, 18 nt, Human
ugaucacggcucacugca

SEQ ID NO: 2130768 - RNA, 18 nt, Human
ugauacccauagcuucca

SEQ ID NO: 2130769 - RNA, 21 nt, Human
ugauacccauagcuuccauga

SEQ ID NO: 2130770 - RNA, 14 nt, Human
ugaucaauuaaaug

SEQ ID NO: 2130771 - RNA, 15 nt, Human
ugaucaauuaaaugu

SEQ ID NO: 2130772 - RNA, 16 nt, Human
ugaucaauuaaaugua

SEQ ID NO: 2130773 - RNA, 17 nt, Human
ugaucaauuaaauguag

SEQ ID NO: 2130774 - RNA, 21 nt, Human
ugaucaauaaaaugugauuuu

SEQ ID NO: 2130775 - RNA, 15 nt, Human
agcauccucaguucc

SEQ ID NO: 2130776 - RNA, 16 nt, Human
agcauccucaguuccu

SEQ ID NO: 2130777 - RNA, 24 nt, Human
agcauccauguguggacucaaguc

SEQ ID NO: 2130778 - RNA, 21 nt, Human
agcaucauuauuugcagagac

SEQ ID NO: 2130779 - RNA, 20 nt, Human
agcaucaccucaggccaggu

SEQ ID NO: 2130780 - RNA, 17 nt, Human
agcaucacuugggauua

SEQ ID NO: 2130781 - RNA, 18 nt, Human
agcaucaccuagaaacuu

SEQ ID NO: 2130782 - RNA, 13 nt, Human
agcaucaccucag

SEQ ID NO: 2130783 - RNA, 14 nt, Human
agcaucaccucagg

SEQ ID NO: 2130784 - RNA, 15 nt, Human
agcaucaccucaggc

SEQ ID NO: 2130785 - RNA, 16 nt, Human
agcaucaccucaggcc

SEQ ID NO: 2130786 - RNA, 19 nt, Human
agcaucaccucaggccagg

SEQ ID NO: 2130787 - RNA, 21 nt, Human
ugaugaucuuugcagacaggc

SEQ ID NO: 2130788 - RNA, 22 nt, Human
ugauggcaccacugcacuccag

SEQ ID NO: 2130789 - RNA, 22 nt, Human
ugaugggcaacccccagccugc

SEQ ID NO: 2130790 - RNA, 21 nt, Human
ugaugggcaacccccagccug

SEQ ID NO: 2130791 - RNA, 20 nt, Human
ugaugaucuuugcagacagg

SEQ ID NO: 2130792 - RNA, 19 nt, Human
ugaugaucuuugcagacag

SEQ ID NO: 2130793 - RNA, 18 nt, Human
ugaugaaauguaaauacu

SEQ ID NO: 2130794 - RNA, 11 nt, Human
ugaugaaagcu

SEQ ID NO: 2130795 - RNA, 13 nt, Human
ugaugaaagcuga

SEQ ID NO: 2130796 - RNA, 15 nt, Human
ugaugaaagcugauu

SEQ ID NO: 2130797 - RNA, 19 nt, Human
ugaugaaagcugauuacug

SEQ ID NO: 2130798 - RNA, 23 nt, Human
ugaugaaaugaggucagagccug

SEQ ID NO: 2130799 - RNA, 22 nt, Human
ugaugaaaugaggucagagccu

SEQ ID NO: 2130800 - RNA, 16 nt, Human
agccacggccaggcca

SEQ ID NO: 2130801 - RNA, 20 nt, Human
ugauuaaccacuucagcuga

SEQ ID NO: 2130802 - RNA, 14 nt, Human
ugauggggaaggag

SEQ ID NO: 2130803 - RNA, 15 nt, Human
ugauggucagacaca

SEQ ID NO: 2130804 - RNA, 14 nt, Human
ugauggucagaggg

SEQ ID NO: 2130805 - RNA, 15 nt, Human
ugauggucagagggc

SEQ ID NO: 2130806 - RNA, 17 nt, Human
ugauggggaaggaggcu

SEQ ID NO: 2130807 - RNA, 19 nt, Human
ugaucccaagugccagucu

SEQ ID NO: 2130808 - RNA, 18 nt, Human
agccaccccagaaauggu

SEQ ID NO: 2130809 - RNA, 14 nt, Human
agccaccccgggcu

SEQ ID NO: 2130810 - RNA, 20 nt, Human
agccaccccagaaaugguga

SEQ ID NO: 2130811 - RNA, 19 nt, Human
agccaccccgggcucucug

SEQ ID NO: 2130812 - RNA, 20 nt, Human
agccaccccgggcucucugc

SEQ ID NO: 2130813 - RNA, 21 nt, Human
agccaccccgggcucucugcu

SEQ ID NO: 2130814 - RNA, 23 nt, Human
agccaccccgggcucucugcugu

SEQ ID NO: 2130815 - RNA, 20 nt, Human
ugauccucccaccucagccu

SEQ ID NO: 2130816 - RNA, 19 nt, Human
ugauccucccaccucagcc

SEQ ID NO: 2130817 - RNA, 17 nt, Human
ugaucguucuuucuagc

SEQ ID NO: 2130818 - RNA, 22 nt, Human
ugaucgugcuaaauuuucagua

SEQ ID NO: 2130819 - RNA, 22 nt, Human
ugauccguuccauugcaagcuu

SEQ ID NO: 2130820 - RNA, 18 nt, Human
ugauccucccaccucagc

SEQ ID NO: 2130821 - RNA, 12 nt, Human
ugaucccagcac

SEQ ID NO: 2130822 - RNA, 13 nt, Human
ugaucccagcacu

SEQ ID NO: 2130823 - RNA, 17 nt, Human
agccaccacguccagcu

SEQ ID NO: 2130824 - RNA, 23 nt, Human
agccaccaugcccagcucagagg

SEQ ID NO: 2130825 - RNA, 21 nt, Human
agccacacugugggacucuuc

SEQ ID NO: 2130826 - RNA, 13 nt, Human
agccacagcuggu

SEQ ID NO: 2130827 - RNA, 12 nt, Human
agccacagccca

SEQ ID NO: 2130828 - RNA, 13 nt, Human
agccacagcccag

SEQ ID NO: 2130829 - RNA, 16 nt, Human
agccacagcccaggcc

SEQ ID NO: 2130830 - RNA, 17 nt, Human
agccacagcccaggccu

SEQ ID NO: 2130831 - RNA, 18 nt, Human
agccacagcccaggccuc

SEQ ID NO: 2130832 - RNA, 19 nt, Human
agccacagcccaggccucc

SEQ ID NO: 2130833 - RNA, 21 nt, Human
agccacagcccaggccuccag

SEQ ID NO: 2130834 - RNA, 16 nt, Human
agccaaacccugucug

SEQ ID NO: 2130835 - RNA, 18 nt, Human
ugaguggaugauguuucg

SEQ ID NO: 2130836 - RNA, 19 nt, Human
ugaguggggagacaccuca

SEQ ID NO: 2130837 - RNA, 20 nt, Human
ugaguggggagacaccucag

SEQ ID NO: 2130838 - RNA, 21 nt, Human
ugaguggggagacaccucaga

SEQ ID NO: 2130839 - RNA, 22 nt, Human
ugaguggggagacaccucagag

SEQ ID NO: 2130840 - RNA, 23 nt, Human
ugaguggggagacaccucagagc

SEQ ID NO: 2130841 - RNA, 18 nt, Human
ugagucaccaagcccagu

SEQ ID NO: 2130842 - RNA, 13 nt, Human
ugagucaccagga

SEQ ID NO: 2130843 - RNA, 16 nt, Human
ugagucacccaugaag

SEQ ID NO: 2130844 - RNA, 21 nt, Human
ugagucaugaucucccugccg

SEQ ID NO: 2130845 - RNA, 20 nt, Human
ugagucaugaucucccugcc

SEQ ID NO: 2130846 - RNA, 22 nt, Human
ugagucaugaucucccugccgc

SEQ ID NO: 2130847 - RNA, 17 nt, Human
ugagugaucccauuucu

SEQ ID NO: 2130848 - RNA, 15 nt, Human
ugagugauccuccaa

SEQ ID NO: 2130849 - RNA, 20 nt, Human
ugagugauccuccaacuuca

SEQ ID NO: 2130850 - RNA, 18 nt, Human
ugaguucauacccuguua

SEQ ID NO: 2130851 - RNA, 22 nt, Human
ugaguguuuuuacuacaguugu

SEQ ID NO: 2130852 - RNA, 15 nt, Human
ugaguuacuuccuau

SEQ ID NO: 2130853 - RNA, 14 nt, Human
ugaguguggcuccc

SEQ ID NO: 2130854 - RNA, 16 nt, Human
ugaguguggcuccccu

SEQ ID NO: 2130855 - RNA, 17 nt, Human
ugaguguggcuccccuc

SEQ ID NO: 2130856 - RNA, 18 nt, Human
ugaguguggcuccccucu

SEQ ID NO: 2130857 - RNA, 17 nt, Human
ugaguguguccaagugu

SEQ ID NO: 2130858 - RNA, 21 nt, Human
ugagugggggaucacagccuc

SEQ ID NO: 2130859 - RNA, 19 nt, Human
agcaguccugccucagccu

SEQ ID NO: 2130860 - RNA, 22 nt, Human
agcaguccugccucagccuccg

SEQ ID NO: 2130861 - RNA, 15 nt, Human
agcaguuugaaauug

SEQ ID NO: 2130862 - RNA, 14 nt, Human
agcaguuugcuuug

SEQ ID NO: 2130863 - RNA, 20 nt, Human
agcaguuugguuucuagcau

SEQ ID NO: 2130864 - RNA, 19 nt, Human
agcauaaaaauuagccaag

SEQ ID NO: 2130865 - RNA, 23 nt, Human
agcaguuugguuucuagcaugaa

SEQ ID NO: 2130866 - RNA, 22 nt, Human
agcaguuugguuucuagcauga

SEQ ID NO: 2130867 - RNA, 21 nt, Human
agcaguagaaauaauaugcau

SEQ ID NO: 2130868 - RNA, 22 nt, Human
agcaguagaaauaauaugcauu

SEQ ID NO: 2130869 - RNA, 20 nt, Human
agcagguugaggggcuccug

SEQ ID NO: 2130870 - RNA, 21 nt, Human
agcagguugaggggcuccugg

SEQ ID NO: 2130871 - RNA, 22 nt, Human
agcagguugaggggcuccugga

SEQ ID NO: 2130872 - RNA, 17 nt, Human
agcaguaacugacaacu

SEQ ID NO: 2130873 - RNA, 15 nt, Human
agcaguaaaaacugu

SEQ ID NO: 2130874 - RNA, 17 nt, Human
agcagguuuuucuccuc

SEQ ID NO: 2130875 - RNA, 14 nt, Human
ugaguaagagcugg

SEQ ID NO: 2130876 - RNA, 16 nt, Human
ugaguaagagcuggug

SEQ ID NO: 2130877 - RNA, 17 nt, Human
ugaguaagagcuggugu

SEQ ID NO: 2130878 - RNA, 18 nt, Human
ugaguaagagcugguguc

SEQ ID NO: 2130879 - RNA, 21 nt, Human
ugaguaagagcuggugucuga

SEQ ID NO: 2130880 - RNA, 23 nt, Human
ugaguaagagcuggugucugauu

SEQ ID NO: 2130881 - RNA, 23 nt, Human
agcagucacuuuuccugugcugu

SEQ ID NO: 2130882 - RNA, 23 nt, Human
agcauaaaaauuagccaagugug

SEQ ID NO: 2130883 - RNA, 13 nt, Human
agcauacauuuau

SEQ ID NO: 2130884 - RNA, 14 nt, Human
agcauacauuuaua

SEQ ID NO: 2130885 - RNA, 20 nt, Human
agcauacauuuauaauguuu

SEQ ID NO: 2130886 - RNA, 13 nt, Human
agcaggcccaccu

SEQ ID NO: 2130887 - RNA, 14 nt, Human
agcaggcccaccua

SEQ ID NO: 2130888 - RNA, 17 nt, Human
agcaggcccaccuaccu

SEQ ID NO: 2130889 - RNA, 23 nt, Human
agcaggcccaccuaccuucaaag

SEQ ID NO: 2130890 - RNA, 15 nt, Human
agcaggccuguugcu

SEQ ID NO: 2130891 - RNA, 16 nt, Human
agcaggccuguugcuu

SEQ ID NO: 2130892 - RNA, 18 nt, Human
agcaggccuguugcuuuu

SEQ ID NO: 2130893 - RNA, 21 nt, Human
agcaggccuuuugauauuaaa

SEQ ID NO: 2130894 - RNA, 16 nt, Human
agcaggcacauggagg

SEQ ID NO: 2130895 - RNA, 21 nt, Human
agcaggauaguugcuccgccu

SEQ ID NO: 2130896 - RNA, 14 nt, Human
agcaggcacaugga

SEQ ID NO: 2130897 - RNA, 19 nt, Human
agcaggcacauggaggagc

SEQ ID NO: 2130898 - RNA, 22 nt, Human
agcaggauaguugcuccgccuc

SEQ ID NO: 2130899 - RNA, 23 nt, Human
agcaggacugaauuguccccagu

SEQ ID NO: 2130900 - RNA, 15 nt, Human
agcaggaagcucaga

SEQ ID NO: 2130901 - RNA, 16 nt, Human
agcagcagggagggcu

SEQ ID NO: 2130902 - RNA, 18 nt, Human
agcagcacuuauaaauca

SEQ ID NO: 2130903 - RNA, 18 nt, Human
agcagcaucugcuaauaa

SEQ ID NO: 2130904 - RNA, 20 nt, Human
agcaggaagcugugagagca

SEQ ID NO: 2130905 - RNA, 12 nt, Human
agcaggaagcuc

SEQ ID NO: 2130906 - RNA, 14 nt, Human
agcaggaagcucag

SEQ ID NO: 2130907 - RNA, 20 nt, Human
agcagccaagcuccuuggga

SEQ ID NO: 2130908 - RNA, 21 nt, Human
agcagccaagcuccuugggag

SEQ ID NO: 2130909 - RNA, 22 nt, Human
agcagccaagcuccuugggagg

SEQ ID NO: 2130910 - RNA, 23 nt, Human
ugacccagccccuugagaaaccu

SEQ ID NO: 2130911 - RNA, 14 nt, Human
agcagcacuuauaa

SEQ ID NO: 2130912 - RNA, 15 nt, Human
agcagcacuuauaaa

SEQ ID NO: 2130913 - RNA, 21 nt, Human
ugacccagccccuugagaaac

SEQ ID NO: 2130914 - RNA, 19 nt, Human
ugacccagccccuugagaa

SEQ ID NO: 2130915 - RNA, 18 nt, Human
ugacccagccccuugaga

SEQ ID NO: 2130916 - RNA, 15 nt, Human
agcagggcucagcgg

SEQ ID NO: 2130917 - RNA, 14 nt, Human
agcagggcucagcg

SEQ ID NO: 2130918 - RNA, 13 nt, Human
agcagggcucagc

SEQ ID NO: 2130919 - RNA, 20 nt, Human
agcagggagggcuucugcca

SEQ ID NO: 2130920 - RNA, 22 nt, Human
agcagggcucagcggggacagc

SEQ ID NO: 2130921 - RNA, 18 nt, Human
agcaggguagucugguuu

SEQ ID NO: 2130922 - RNA, 21 nt, Human
agcaggguagucugguuucua

SEQ ID NO: 2130923 - RNA, 14 nt, Human
agcagguaccacug

SEQ ID NO: 2130924 - RNA, 13 nt, Human
agcagguggggag

SEQ ID NO: 2130925 - RNA, 14 nt, Human
agcagguggggagg

SEQ ID NO: 2130926 - RNA, 15 nt, Human
agcagggaaacagcu

SEQ ID NO: 2130927 - RNA, 14 nt, Human
agcagggaaacagc

SEQ ID NO: 2130928 - RNA, 13 nt, Human
agcagggaaacag

SEQ ID NO: 2130929 - RNA, 17 nt, Human
agcccugggccccacca

SEQ ID NO: 2130930 - RNA, 19 nt, Human
agcccugggccccaccacc

SEQ ID NO: 2130931 - RNA, 23 nt, Human
agcccugggccccaccaccuagg

SEQ ID NO: 2130932 - RNA, 16 nt, Human
agcccugggccccacc

SEQ ID NO: 2130933 - RNA, 21 nt, Human
agcccugggccccaccaccua

SEQ ID NO: 2130934 - RNA, 13 nt, Human
ugcacaugugugc

SEQ ID NO: 2130935 - RNA, 10 nt, Human
ugcaccagga

SEQ ID NO: 2130936 - RNA, 12 nt, Human
ugcaccaggaga

SEQ ID NO: 2130937 - RNA, 13 nt, Human
ugcaccaggagac

SEQ ID NO: 2130938 - RNA, 14 nt, Human
ugcaccaggagaca

SEQ ID NO: 2130939 - RNA, 15 nt, Human
ugcaccaggagacag

SEQ ID NO: 2130940 - RNA, 14 nt, Human
ugcaccccaagucc

SEQ ID NO: 2130941 - RNA, 14 nt, Human
ugcaccccccuggg

SEQ ID NO: 2130942 - RNA, 15 nt, Human
ugcaccccccugggc

SEQ ID NO: 2130943 - RNA, 16 nt, Human
ugcaccccccugggcu

SEQ ID NO: 2130944 - RNA, 13 nt, Human
ugcaccagcccuu

SEQ ID NO: 2130945 - RNA, 21 nt, Human
ugcaccacugcacuccagccu

SEQ ID NO: 2130946 - RNA, 15 nt, Human
ugcaccacugcacuc

SEQ ID NO: 2130947 - RNA, 19 nt, Human
ugcacaugugugcgugugc

SEQ ID NO: 2130948 - RNA, 20 nt, Human
ugcacuccagccugggcaac

SEQ ID NO: 2130949 - RNA, 18 nt, Human
ugcacuccagccugggcg

SEQ ID NO: 2130950 - RNA, 16 nt, Human
ugcacuccagccuggg

SEQ ID NO: 2130951 - RNA, 14 nt, Human
ugcacuccaaucug

SEQ ID NO: 2130952 - RNA, 12 nt, Human
ugcacuccagcc

SEQ ID NO: 2130953 - RNA, 13 nt, Human
ugcacuccagccu

SEQ ID NO: 2130954 - RNA, 17 nt, Human
ugcacuccagccugggc

SEQ ID NO: 2130955 - RNA, 20 nt, Human
ugcaccgccggccagcuggg

SEQ ID NO: 2130956 - RNA, 18 nt, Human
ugcacuccagccugggca

SEQ ID NO: 2130957 - RNA, 15 nt, Human
ugcacuccagccugg

SEQ ID NO: 2130958 - RNA, 14 nt, Human
ugcacuccagccug

SEQ ID NO: 2130959 - RNA, 12 nt, Human
agccccuccucu

SEQ ID NO: 2130960 - RNA, 13 nt, Human
agccccuccucug

SEQ ID NO: 2130961 - RNA, 14 nt, Human
agccccuccucugc

SEQ ID NO: 2130962 - RNA, 15 nt, Human
agccccuccucugcc

SEQ ID NO: 2130963 - RNA, 16 nt, Human
agccccuccucugcca

SEQ ID NO: 2130964 - RNA, 17 nt, Human
agccccuccucugccac

SEQ ID NO: 2130965 - RNA, 18 nt, Human
agccccuccucugccacc

SEQ ID NO: 2130966 - RNA, 23 nt, Human
agccccucccaccacagcaggug

SEQ ID NO: 2130967 - RNA, 11 nt, Human
agccccuccuc

SEQ ID NO: 2130968 - RNA, 23 nt, Human
agccccuccucugccaccucccc

SEQ ID NO: 2130969 - RNA, 19 nt, Human
agccccuccucugccaccu

SEQ ID NO: 2130970 - RNA, 20 nt, Human
agccccuccucugccaccuc

SEQ ID NO: 2130971 - RNA, 21 nt, Human
agccccuccucugccaccucc

SEQ ID NO: 2130972 - RNA, 22 nt, Human
agccccuccucugccaccuccc

SEQ ID NO: 2130973 - RNA, 14 nt, Human
agccccgaggccuu

SEQ ID NO: 2130974 - RNA, 15 nt, Human
agccccgcgccuccu

SEQ ID NO: 2130975 - RNA, 18 nt, Human
agccccgcgccuccuucc

SEQ ID NO: 2130976 - RNA, 18 nt, Human
agcccaggccuccagcuc

SEQ ID NO: 2130977 - RNA, 19 nt, Human
agcccaggccuccagcuca

SEQ ID NO: 2130978 - RNA, 22 nt, Human
agcccaggccuccagcucagca

SEQ ID NO: 2130979 - RNA, 23 nt, Human
agcccugaguuucaaguauccuu

SEQ ID NO: 2130980 - RNA, 21 nt, Human
agcccugauugcgcaaaacug

SEQ ID NO: 2130981 - RNA, 20 nt, Human
ugcaaauucccagauuugaa

SEQ ID NO: 2130982 - RNA, 12 nt, Human
ugcaacacacag

SEQ ID NO: 2130983 - RNA, 13 nt, Human
ugcaacacacaga

SEQ ID NO: 2130984 - RNA, 14 nt, Human
ugcaacacacagac

SEQ ID NO: 2130985 - RNA, 13 nt, Human
ugcaacaacaugu

SEQ ID NO: 2130986 - RNA, 15 nt, Human
ugcaacaacauguau

SEQ ID NO: 2130987 - RNA, 13 nt, Human
ugcaacaggcugg

SEQ ID NO: 2130988 - RNA, 15 nt, Human
ugcaacacacagaca

SEQ ID NO: 2130989 - RNA, 13 nt, Human
ugcaacagacaag

SEQ ID NO: 2130990 - RNA, 15 nt, Human
ugcaaaugcuguauu

SEQ ID NO: 2130991 - RNA, 22 nt, Human
ugcaaauggugguuguuucuuc

SEQ ID NO: 2130992 - RNA, 24 nt, Human
ugcaaauggugguuguuucuucca

SEQ ID NO: 2130993 - RNA, 14 nt, Human
ugcaaauagaaaac

SEQ ID NO: 2130994 - RNA, 15 nt, Human
ugcaaauagaaaaca

SEQ ID NO: 2130995 - RNA, 17 nt, Human
ugcaaauagaaaacagg

SEQ ID NO: 2130996 - RNA, 19 nt, Human
ugcaaggaagccacagcug

SEQ ID NO: 2130997 - RNA, 20 nt, Human
ugcaaggaagccacagcugg

SEQ ID NO: 2130998 - RNA, 12 nt, Human
ugcaaggaagga

SEQ ID NO: 2130999 - RNA, 15 nt, Human
ugcaaggaaggaaag

SEQ ID NO: 2131000 - RNA, 16 nt, Human
ugcaaggaaggaaaga

SEQ ID NO: 2131001 - RNA, 19 nt, Human
ugcaaggaaggaaagaaag

SEQ ID NO: 2131002 - RNA, 13 nt, Human
ugcaaggaccagg

SEQ ID NO: 2131003 - RNA, 14 nt, Human
ugcaaggaccagga

SEQ ID NO: 2131004 - RNA, 15 nt, Human
ugcaaggaccaggac

SEQ ID NO: 2131005 - RNA, 23 nt, Human
ugcaagagccuugguguccaccu

SEQ ID NO: 2131006 - RNA, 14 nt, Human
ugcaagagccuugg

SEQ ID NO: 2131007 - RNA, 23 nt, Human
ugcaagagggagcacgugacugu

SEQ ID NO: 2131008 - RNA, 18 nt, Human
ugcaaggggaaaaucuca

SEQ ID NO: 2131009 - RNA, 15 nt, Human
ugcaaguacugcugu

SEQ ID NO: 2131010 - RNA, 19 nt, Human
ugcaaguacugcuguaaau

SEQ ID NO: 2131011 - RNA, 19 nt, Human
ugcaaguguguaugugcgu

SEQ ID NO: 2131012 - RNA, 22 nt, Human
ugcaaguguguaugugcgugug

SEQ ID NO: 2131013 - RNA, 13 nt, Human
ugcaaggcaaaga

SEQ ID NO: 2131014 - RNA, 11 nt, Human
ugcaaggcacu

SEQ ID NO: 2131015 - RNA, 17 nt, Human
ugcaaggaccaggacuc

SEQ ID NO: 2131016 - RNA, 17 nt, Human
ugcaaggcacuguacua

SEQ ID NO: 2131017 - RNA, 23 nt, Human
ugcaaggccgcuguucacccaca

SEQ ID NO: 2131018 - RNA, 24 nt, Human
ugcaaggccgcuguucacccacag

SEQ ID NO: 2131019 - RNA, 14 nt, Human
ugcaauauguauua

SEQ ID NO: 2131020 - RNA, 18 nt, Human
ugcaagugugugcaugug

SEQ ID NO: 2131021 - RNA, 23 nt, Human
ugcaagugugugcaugugugcga

SEQ ID NO: 2131022 - RNA, 13 nt, Human
ugcaagugugugc

SEQ ID NO: 2131023 - RNA, 14 nt, Human
ugcaagugugugca

SEQ ID NO: 2131024 - RNA, 21 nt, Human
ugcaagugugugcacaugugu

SEQ ID NO: 2131025 - RNA, 23 nt, Human
ugcaagugugugcacaugugugc

SEQ ID NO: 2131026 - RNA, 14 nt, Human
ugauuuccaaagag

SEQ ID NO: 2131027 - RNA, 22 nt, Human
ugauuuaucugagucaacuccu

SEQ ID NO: 2131028 - RNA, 16 nt, Human
ugauuuaucacacaaa

SEQ ID NO: 2131029 - RNA, 18 nt, Human
ugauuuaucacacaaagc

SEQ ID NO: 2131030 - RNA, 18 nt, Human
ugauuaaggucucucuuu

SEQ ID NO: 2131031 - RNA, 20 nt, Human
ugauuaaggucucucuuugg

SEQ ID NO: 2131032 - RNA, 22 nt, Human
ugauuaaggucucucuuuggac

SEQ ID NO: 2131033 - RNA, 18 nt, Human
agccacggccaggccaga

SEQ ID NO: 2131034 - RNA, 17 nt, Human
agccacggccaggccag

SEQ ID NO: 2131035 - RNA, 21 nt, Human
ugauuuccccuccaagguaug

SEQ ID NO: 2131036 - RNA, 18 nt, Human
ugauuuccaaagagaaaa

SEQ ID NO: 2131037 - RNA, 12 nt, Human
ugauuuggaaaa

SEQ ID NO: 2131038 - RNA, 23 nt, Human
ugcaaaguucccuacuuccugug

SEQ ID NO: 2131039 - RNA, 21 nt, Human
ugcaaaggguaucaggugcug

SEQ ID NO: 2131040 - RNA, 12 nt, Human
ugcaaaggacug

SEQ ID NO: 2131041 - RNA, 12 nt, Human
ugcaaagauuug

SEQ ID NO: 2131042 - RNA, 12 nt, Human
ugcaaagaaaau

SEQ ID NO: 2131043 - RNA, 16 nt, Human
ugcaaagaaaaucaga

SEQ ID NO: 2131044 - RNA, 13 nt, Human
ugcaaagaggcaa

SEQ ID NO: 2131045 - RNA, 15 nt, Human
ugcaaagaggcaaga

SEQ ID NO: 2131046 - RNA, 19 nt, Human
ugcaaagaggcaagaggcu

SEQ ID NO: 2131047 - RNA, 17 nt, Human
agccugugccucuggga

SEQ ID NO: 2131048 - RNA, 18 nt, Human
agccugugccucugggac

SEQ ID NO: 2131049 - RNA, 19 nt, Human
agccugugccucugggacu

SEQ ID NO: 2131050 - RNA, 15 nt, Human
agccuguaaucccag

SEQ ID NO: 2131051 - RNA, 16 nt, Human
agccuguaaucccagc

SEQ ID NO: 2131052 - RNA, 17 nt, Human
agccuguaaucccagcu

SEQ ID NO: 2131053 - RNA, 18 nt, Human
agccuguaaucccagcua

SEQ ID NO: 2131054 - RNA, 17 nt, Human
agccugaggcugagacu

SEQ ID NO: 2131055 - RNA, 11 nt, Human
agccugaggcu

SEQ ID NO: 2131056 - RNA, 15 nt, Human
ugcauggaccuaaca

SEQ ID NO: 2131057 - RNA, 17 nt, Human
ugcauggaccuaacauu

SEQ ID NO: 2131058 - RNA, 18 nt, Human
ugcauggaccuaacauuc

SEQ ID NO: 2131059 - RNA, 20 nt, Human
ugcauggaccuaacauucga

SEQ ID NO: 2131060 - RNA, 21 nt, Human
ugcauggaccuaacauucgau

SEQ ID NO: 2131061 - RNA, 15 nt, Human
ugcauggcagcaggc

SEQ ID NO: 2131062 - RNA, 22 nt, Human
ugcauggcagcaggccuguugc

SEQ ID NO: 2131063 - RNA, 22 nt, Human
agccuuagaagucacacaguau

SEQ ID NO: 2131064 - RNA, 20 nt, Human
agccuuagaagucacacagu

SEQ ID NO: 2131065 - RNA, 23 nt, Human
agccuugggaacaugcgugugac

SEQ ID NO: 2131066 - RNA, 19 nt, Human
agccuuggauaaugcuguu

SEQ ID NO: 2131067 - RNA, 20 nt, Human
agccuuggauaaugcuguug

SEQ ID NO: 2131068 - RNA, 22 nt, Human
agccuuggauaaugcuguugcc

SEQ ID NO: 2131069 - RNA, 23 nt, Human
agccuuggauaaugcuguugccu

SEQ ID NO: 2131070 - RNA, 16 nt, Human
agccuuggauguauau

SEQ ID NO: 2131071 - RNA, 19 nt, Human
agccuugcggaagguucua

SEQ ID NO: 2131072 - RNA, 12 nt, Human
ugccagugucuu

SEQ ID NO: 2131073 - RNA, 13 nt, Human
ugccagugucuuu

SEQ ID NO: 2131074 - RNA, 14 nt, Human
ugccagugucuuuc

SEQ ID NO: 2131075 - RNA, 15 nt, Human
ugccagugucuuucu

SEQ ID NO: 2131076 - RNA, 16 nt, Human
ugccagugucuuucuu

SEQ ID NO: 2131077 - RNA, 20 nt, Human
ugccagugucuuucuuuggu

SEQ ID NO: 2131078 - RNA, 17 nt, Human
ugccagcucagucccau

SEQ ID NO: 2131079 - RNA, 20 nt, Human
ugccagugccuuaccuccug

SEQ ID NO: 2131080 - RNA, 21 nt, Human
ugccagugccuuaccuccugc

SEQ ID NO: 2131081 - RNA, 22 nt, Human
ugccagugccuuaccuccugcc

SEQ ID NO: 2131082 - RNA, 23 nt, Human
ugccagugccuuaccuccugccc

SEQ ID NO: 2131083 - RNA, 16 nt, Human
ugccagccuggcuucu

SEQ ID NO: 2131084 - RNA, 17 nt, Human
ugccagccuggcuucug

SEQ ID NO: 2131085 - RNA, 18 nt, Human
ugccagccuggcuucugg

SEQ ID NO: 2131086 - RNA, 20 nt, Human
ugccagccuggcuucuggag

SEQ ID NO: 2131087 - RNA, 21 nt, Human
ugccagccuggcuucuggagc

SEQ ID NO: 2131088 - RNA, 22 nt, Human
ugccagccuggcuucuggagcc

SEQ ID NO: 2131089 - RNA, 23 nt, Human
ugccagccuggcuucuggagccc

SEQ ID NO: 2131090 - RNA, 23 nt, Human
ugccagccagcagccagcucuca

SEQ ID NO: 2131091 - RNA, 12 nt, Human
ugccagccuggc

SEQ ID NO: 2131092 - RNA, 15 nt, Human
ugccagccuggcuuc

SEQ ID NO: 2131093 - RNA, 16 nt, Human
ugccagccagcagcca

SEQ ID NO: 2131094 - RNA, 17 nt, Human
ugccagccagcagccag

SEQ ID NO: 2131095 - RNA, 22 nt, Human
ugccagccagcagccagcucuc

SEQ ID NO: 2131096 - RNA, 12 nt, Human
ugccacagcucu

SEQ ID NO: 2131097 - RNA, 22 nt, Human
agcgccuaguggggucucccuc

SEQ ID NO: 2131098 - RNA, 21 nt, Human
agcgccuaguggggucucccu

SEQ ID NO: 2131099 - RNA, 19 nt, Human
ugccaagcacagugccugc

SEQ ID NO: 2131100 - RNA, 20 nt, Human
ugccaaugaggucugaaaug

SEQ ID NO: 2131101 - RNA, 22 nt, Human
ugccaaggccagaguggccugg

SEQ ID NO: 2131102 - RNA, 21 nt, Human
ugccaaugaggucugaaaugg

SEQ ID NO: 2131103 - RNA, 16 nt, Human
ugccaaggccagagug

SEQ ID NO: 2131104 - RNA, 20 nt, Human
ugccaaggccagaguggccu

SEQ ID NO: 2131105 - RNA, 21 nt, Human
ugccaaggccagaguggccug

SEQ ID NO: 2131106 - RNA, 18 nt, Human
ugccaagccccauccugc

SEQ ID NO: 2131107 - RNA, 13 nt, Human
ugcagggccucca

SEQ ID NO: 2131108 - RNA, 14 nt, Human
ugcagggccuccau

SEQ ID NO: 2131109 - RNA, 22 nt, Human
ugcaggggcaaacaccugcuga

SEQ ID NO: 2131110 - RNA, 20 nt, Human
agccucuccggcagaaggga

SEQ ID NO: 2131111 - RNA, 20 nt, Human
agccucuuaaagcugccugu

SEQ ID NO: 2131112 - RNA, 22 nt, Human
agccucuuaaagcugccuguag

SEQ ID NO: 2131113 - RNA, 23 nt, Human
agccucuuaaagcugccuguagu

SEQ ID NO: 2131114 - RNA, 21 nt, Human
ugcagacaggcaagcaccucc

SEQ ID NO: 2131115 - RNA, 13 nt, Human
ugcagacaggcaa

SEQ ID NO: 2131116 - RNA, 12 nt, Human
ugcagacaggca

SEQ ID NO: 2131117 - RNA, 23 nt, Human
agccucuccaggaaugccuccuc

SEQ ID NO: 2131118 - RNA, 14 nt, Human
agccucucaucccc

SEQ ID NO: 2131119 - RNA, 12 nt, Human
agccucuccagg

SEQ ID NO: 2131120 - RNA, 14 nt, Human
agccucuccaggaa

SEQ ID NO: 2131121 - RNA, 20 nt, Human
agccucgccgucugugaauu

SEQ ID NO: 2131122 - RNA, 21 nt, Human
agccuccuguguagcugggau

SEQ ID NO: 2131123 - RNA, 16 nt, Human
agccuccuuucuggcu

SEQ ID NO: 2131124 - RNA, 15 nt, Human
agccucgaacuccug

SEQ ID NO: 2131125 - RNA, 16 nt, Human
agccucgaacuccugg

SEQ ID NO: 2131126 - RNA, 17 nt, Human
agccucgaacuccuggg

SEQ ID NO: 2131127 - RNA, 19 nt, Human
agccucgaacuccugggcu

SEQ ID NO: 2131128 - RNA, 21 nt, Human
agccucgaacuccugggcuca

SEQ ID NO: 2131129 - RNA, 21 nt, Human
ugcagucagucaugauggcac

SEQ ID NO: 2131130 - RNA, 17 nt, Human
ugcauagagccacguau

SEQ ID NO: 2131131 - RNA, 13 nt, Human
ugcauagaaggag

SEQ ID NO: 2131132 - RNA, 17 nt, Human
ugcauagaaggaggaga

SEQ ID NO: 2131133 - RNA, 18 nt, Human
ugcauagaaggaggagag

SEQ ID NO: 2131134 - RNA, 13 nt, Human
ugcagucaucuug

SEQ ID NO: 2131135 - RNA, 15 nt, Human
ugcaucucagcccac

SEQ ID NO: 2131136 - RNA, 14 nt, Human
ugcaucucagccca

SEQ ID NO: 2131137 - RNA, 13 nt, Human
ugcaucucagccc

SEQ ID NO: 2131138 - RNA, 21 nt, Human
ugcaucucacuggaugcaaag

SEQ ID NO: 2131139 - RNA, 16 nt, Human
ugcaucuacucaggcc

SEQ ID NO: 2131140 - RNA, 19 nt, Human
ugcauagagccacguaugu

SEQ ID NO: 2131141 - RNA, 17 nt, Human
ugcaucguuucaucuuc

SEQ ID NO: 2131142 - RNA, 22 nt, Human
ugcaucuuacugaagguaaaau

SEQ ID NO: 2131143 - RNA, 14 nt, Human
ugcaucuuacugaa

SEQ ID NO: 2131144 - RNA, 17 nt, Human
ugcaucuuacugaaggu

SEQ ID NO: 2131145 - RNA, 18 nt, Human
ugcaucuuacugaaggua

SEQ ID NO: 2131146 - RNA, 19 nt, Human
ugcaugaagguuucugaaa

SEQ ID NO: 2131147 - RNA, 21 nt, Human
ugcaugaagguuucugaaaau

SEQ ID NO: 2131148 - RNA, 13 nt, Human
ugcaugaagguuu

SEQ ID NO: 2131149 - RNA, 18 nt, Human
ugcaugaagguuucugaa

SEQ ID NO: 2131150 - RNA, 14 nt, Human
ugcaugccgcugca

SEQ ID NO: 2131151 - RNA, 13 nt, Human
ugcaugcugcuuu

SEQ ID NO: 2131152 - RNA, 15 nt, Human
ugcaugcugcuuuaa

SEQ ID NO: 2131153 - RNA, 17 nt, Human
ugcaugcugcuuuaauu

SEQ ID NO: 2131154 - RNA, 20 nt, Human
ugcaugcugcuuuaauugug

SEQ ID NO: 2131155 - RNA, 16 nt, Human
ugcaugcucucugcag

SEQ ID NO: 2131156 - RNA, 17 nt, Human
ugcaugcucucugcagc

SEQ ID NO: 2131157 - RNA, 18 nt, Human
ugcaugcucucugcagcc

SEQ ID NO: 2131158 - RNA, 19 nt, Human
ugcaugcucucugcagcca

SEQ ID NO: 2131159 - RNA, 21 nt, Human
aggaccuguggccaaguucuu

SEQ ID NO: 2131160 - RNA, 15 nt, Human
aggaccuuaucugug

SEQ ID NO: 2131161 - RNA, 16 nt, Human
aggaccuuaucugugc

SEQ ID NO: 2131162 - RNA, 14 nt, Human
aggacaaggcuaga

SEQ ID NO: 2131163 - RNA, 17 nt, Human
aggacaacgaggaagcc

SEQ ID NO: 2131164 - RNA, 18 nt, Human
aggacaacgaggaagccc

SEQ ID NO: 2131165 - RNA, 14 nt, Human
aggacaacgaggaa

SEQ ID NO: 2131166 - RNA, 23 nt, Human
aggaauucccagcccaaagcugu

SEQ ID NO: 2131167 - RNA, 22 nt, Human
aggaauucuaggcaucccaggg

SEQ ID NO: 2131168 - RNA, 16 nt, Human
aggacaacgaggaagc

SEQ ID NO: 2131169 - RNA, 23 nt, Human
aggacucccuccucaccucugga

SEQ ID NO: 2131170 - RNA, 18 nt, Human
aggacucccuccucaccu

SEQ ID NO: 2131171 - RNA, 19 nt, Human
aggacucccuccucaccuc

SEQ ID NO: 2131172 - RNA, 13 nt, Human
aggacucugaggc

SEQ ID NO: 2131173 - RNA, 14 nt, Human
aggacucugaggcu

SEQ ID NO: 2131174 - RNA, 17 nt, Human
aggacucugaggcucuu

SEQ ID NO: 2131175 - RNA, 15 nt, Human
aggacucugcccaga

SEQ ID NO: 2131176 - RNA, 18 nt, Human
aggacucugcccagacca

SEQ ID NO: 2131177 - RNA, 11 nt, Human
aggacuccagc

SEQ ID NO: 2131178 - RNA, 12 nt, Human
aggacuccagcc

SEQ ID NO: 2131179 - RNA, 12 nt, Human
aggacucccucc

SEQ ID NO: 2131180 - RNA, 13 nt, Human
aggacucccuccu

SEQ ID NO: 2131181 - RNA, 14 nt, Human
aggacucccuccuc

SEQ ID NO: 2131182 - RNA, 15 nt, Human
aggacucccuccuca

SEQ ID NO: 2131183 - RNA, 16 nt, Human
aggacucccuccucac

SEQ ID NO: 2131184 - RNA, 17 nt, Human
aggacucccuccucacc

SEQ ID NO: 2131185 - RNA, 14 nt, Human
aggacgugggcggc

SEQ ID NO: 2131186 - RNA, 20 nt, Human
aggacgugggcggcagagag

SEQ ID NO: 2131187 - RNA, 20 nt, Human
aggagauggaaguugcagug

SEQ ID NO: 2131188 - RNA, 16 nt, Human
aggagaaaugcaucca

SEQ ID NO: 2131189 - RNA, 16 nt, Human
aggacuugaaagcauc

SEQ ID NO: 2131190 - RNA, 19 nt, Human
aggacuugaaagcauccau

SEQ ID NO: 2131191 - RNA, 13 nt, Human
aggacuugcccuc

SEQ ID NO: 2131192 - RNA, 21 nt, Human
aggacuugaaagcauccaugu

SEQ ID NO: 2131193 - RNA, 12 nt, Human
aggagaaaugca

SEQ ID NO: 2131194 - RNA, 22 nt, Human
aggagauccagggcaaggccau

SEQ ID NO: 2131195 - RNA, 17 nt, Human
aggagagucuugcagug

SEQ ID NO: 2131196 - RNA, 21 nt, Human
aggagagucuugcagugauua

SEQ ID NO: 2131197 - RNA, 17 nt, Human
aggagccccgaggccuu

SEQ ID NO: 2131198 - RNA, 19 nt, Human
aggacuuuucuuuguggcu

SEQ ID NO: 2131199 - RNA, 17 nt, Human
aggacuuuucuuugugg

SEQ ID NO: 2131200 - RNA, 22 nt, Human
aggacuuuucuuuguggcuucc

SEQ ID NO: 2131201 - RNA, 18 nt, Human
aggacucugccuccucuu

SEQ ID NO: 2131202 - RNA, 17 nt, Human
aggacucugccuccucu

SEQ ID NO: 2131203 - RNA, 16 nt, Human
aggacucugccuccuc

SEQ ID NO: 2131204 - RNA, 14 nt, Human
aggacucugccucc

SEQ ID NO: 2131205 - RNA, 13 nt, Human
aggacucugccuc

SEQ ID NO: 2131206 - RNA, 12 nt, Human
aggacucugccu

SEQ ID NO: 2131207 - RNA, 22 nt, Human
aggacuggcuuugucccacagc

SEQ ID NO: 2131208 - RNA, 22 nt, Human
aggacugccgaccgaggcugga

SEQ ID NO: 2131209 - RNA, 12 nt, Human
aggacugcacca

SEQ ID NO: 2131210 - RNA, 16 nt, Human
aggacugcaccauugc

SEQ ID NO: 2131211 - RNA, 19 nt, Human
aggacugcaccauugcugc

SEQ ID NO: 2131212 - RNA, 20 nt, Human
aggacugcaccauugcugcu

SEQ ID NO: 2131213 - RNA, 21 nt, Human
aggacugcaccauugcugcuc

SEQ ID NO: 2131214 - RNA, 19 nt, Human
aggacugcaugguaauuua

SEQ ID NO: 2131215 - RNA, 20 nt, Human
aggacugcaugguaauuuau

SEQ ID NO: 2131216 - RNA, 21 nt, Human
aggacugcaugguaauuuaua

SEQ ID NO: 2131217 - RNA, 18 nt, Human
aggacugccccgugcaga

SEQ ID NO: 2131218 - RNA, 21 nt, Human
aggacugccccgugcagacug

SEQ ID NO: 2131219 - RNA, 13 nt, Human
aggacugccgacc

SEQ ID NO: 2131220 - RNA, 17 nt, Human
aggacugccgaccgagg

SEQ ID NO: 2131221 - RNA, 21 nt, Human
aggacugccgaccgaggcugg

SEQ ID NO: 2131222 - RNA, 18 nt, Human
ugcuuuuggucuguguga

SEQ ID NO: 2131223 - RNA, 20 nt, Human
ugcuuuugucuaugggacuc

SEQ ID NO: 2131224 - RNA, 23 nt, Human
ugcuuuuuaauauugauaugcuu

SEQ ID NO: 2131225 - RNA, 16 nt, Human
ugcuuugggcugcccu

SEQ ID NO: 2131226 - RNA, 17 nt, Human
aggagccuauggcaucu

SEQ ID NO: 2131227 - RNA, 15 nt, Human
ugcuugagcucagga

SEQ ID NO: 2131228 - RNA, 20 nt, Human
ugcuugacauaauuucacug

SEQ ID NO: 2131229 - RNA, 15 nt, Human
ugcuuugggcugccc

SEQ ID NO: 2131230 - RNA, 14 nt, Human
ugcuuugggcugcc

SEQ ID NO: 2131231 - RNA, 16 nt, Human
ugcuugagcccaggag

SEQ ID NO: 2131232 - RNA, 13 nt, Human
ugcuugagcccag

SEQ ID NO: 2131233 - RNA, 14 nt, Human
ugcuugagcccagg

SEQ ID NO: 2131234 - RNA, 17 nt, Human
uggaaauuggaagagca

SEQ ID NO: 2131235 - RNA, 16 nt, Human
uggaaauuggaagagc

SEQ ID NO: 2131236 - RNA, 21 nt, Human
uggaaauuuguuauaaugaau

SEQ ID NO: 2131237 - RNA, 23 nt, Human
uggaaauuuguuauaaugaauga

SEQ ID NO: 2131238 - RNA, 17 nt, Human
ugcuuuuuaaguguuaa

SEQ ID NO: 2131239 - RNA, 14 nt, Human
uggaaagugaauuu

SEQ ID NO: 2131240 - RNA, 15 nt, Human
uggaaagugaauuug

SEQ ID NO: 2131241 - RNA, 16 nt, Human
uggaaagugaauuuga

SEQ ID NO: 2131242 - RNA, 17 nt, Human
uggaaagugaauuugaa

SEQ ID NO: 2131243 - RNA, 20 nt, Human
uggaaagugaauuugaauga

SEQ ID NO: 2131244 - RNA, 21 nt, Human
uggaaagugaauuugaaugaa

SEQ ID NO: 2131245 - RNA, 23 nt, Human
uggaaagugaauuugaaugaaaa

SEQ ID NO: 2131246 - RNA, 19 nt, Human
aggaugcagagucagcaga

SEQ ID NO: 2131247 - RNA, 17 nt, Human
aggauucuuccucccuc

SEQ ID NO: 2131248 - RNA, 19 nt, Human
aggauucuuccucccuccc

SEQ ID NO: 2131249 - RNA, 18 nt, Human
aggaugcagagucagcag

SEQ ID NO: 2131250 - RNA, 15 nt, Human
aggaugauuguacag

SEQ ID NO: 2131251 - RNA, 20 nt, Human
aggaugauuguacagaauca

SEQ ID NO: 2131252 - RNA, 13 nt, Human
aggaucagucuga

SEQ ID NO: 2131253 - RNA, 18 nt, Human
aggaucuuuugaacccag

SEQ ID NO: 2131254 - RNA, 13 nt, Human
aggaucuuuugaa

SEQ ID NO: 2131255 - RNA, 19 nt, Human
aggaugaaugaggucccag

SEQ ID NO: 2131256 - RNA, 20 nt, Human
aggaugaaugaggucccagg

SEQ ID NO: 2131257 - RNA, 21 nt, Human
aggaugaaugaggucccaggc

SEQ ID NO: 2131258 - RNA, 22 nt, Human
aggaugaaugaggucccaggca

SEQ ID NO: 2131259 - RNA, 19 nt, Human
uggaagcauauuguuauua

SEQ ID NO: 2131260 - RNA, 22 nt, Human
uggaagcauguaggagaaucca

SEQ ID NO: 2131261 - RNA, 12 nt, Human
uggaagcccucc

SEQ ID NO: 2131262 - RNA, 13 nt, Human
uggaagcccuccu

SEQ ID NO: 2131263 - RNA, 15 nt, Human
uggaagcccuccuuc

SEQ ID NO: 2131264 - RNA, 16 nt, Human
uggaagcccuccuucc

SEQ ID NO: 2131265 - RNA, 17 nt, Human
uggaagcccuccuucca

SEQ ID NO: 2131266 - RNA, 17 nt, Human
uggaagcauguaggaga

SEQ ID NO: 2131267 - RNA, 19 nt, Human
uggaagcauguaggagaau

SEQ ID NO: 2131268 - RNA, 19 nt, Human
uggaagcccuccuuccacg

SEQ ID NO: 2131269 - RNA, 16 nt, Human
aggaggagagggaaaa

SEQ ID NO: 2131270 - RNA, 16 nt, Human
aggaggcugaggcaga

SEQ ID NO: 2131271 - RNA, 17 nt, Human
aggaggcugaggcagaa

SEQ ID NO: 2131272 - RNA, 17 nt, Human
aggaggcugaggcagga

SEQ ID NO: 2131273 - RNA, 19 nt, Human
aggaggcugaggcaggagg

SEQ ID NO: 2131274 - RNA, 13 nt, Human
aggaggcugaggg

SEQ ID NO: 2131275 - RNA, 13 nt, Human
aggaggcuggcuu

SEQ ID NO: 2131276 - RNA, 13 nt, Human
aggaggcugaggu

SEQ ID NO: 2131277 - RNA, 12 nt, Human
aggaggcuggag

SEQ ID NO: 2131278 - RNA, 16 nt, Human
aggaggcuggaggaag

SEQ ID NO: 2131279 - RNA, 18 nt, Human
aggaggcuggaggaaggg

SEQ ID NO: 2131280 - RNA, 21 nt, Human
aggaggcuggaggaagggggg

SEQ ID NO: 2131281 - RNA, 13 nt, Human
aggaggcuggcag

SEQ ID NO: 2131282 - RNA, 16 nt, Human
aggaggcuggcaggua

SEQ ID NO: 2131283 - RNA, 17 nt, Human
uggagugcaaugacaca

SEQ ID NO: 2131284 - RNA, 14 nt, Human
uggagugcagugag

SEQ ID NO: 2131285 - RNA, 17 nt, Human
uggagguuaaggcugag

SEQ ID NO: 2131286 - RNA, 19 nt, Human
uggagguuaaggcugagga

SEQ ID NO: 2131287 - RNA, 16 nt, Human
uggagguggggcaugg

SEQ ID NO: 2131288 - RNA, 16 nt, Human
aggcauuugcugaaua

SEQ ID NO: 2131289 - RNA, 20 nt, Human
aggcauuugcugaauacaga

SEQ ID NO: 2131290 - RNA, 19 nt, Human
uggaguguguauuguuccc

SEQ ID NO: 2131291 - RNA, 15 nt, Human
uggaguguguauugu

SEQ ID NO: 2131292 - RNA, 20 nt, Human
uggaguguguauuguuccca

SEQ ID NO: 2131293 - RNA, 13 nt, Human
uggaguggaugcc

SEQ ID NO: 2131294 - RNA, 17 nt, Human
uggaguggaugccucag

SEQ ID NO: 2131295 - RNA, 23 nt, Human
uggaugccugguggcagcugcgg

SEQ ID NO: 2131296 - RNA, 21 nt, Human
uggaugccugguggcagcugc

SEQ ID NO: 2131297 - RNA, 22 nt, Human
uggaguugaaagaguuaagaau

SEQ ID NO: 2131298 - RNA, 23 nt, Human
uggaugcggaacccaaauuacgu

SEQ ID NO: 2131299 - RNA, 21 nt, Human
uggcacauuuccccagaccug

SEQ ID NO: 2131300 - RNA, 13 nt, Human
uggcaccacucuc

SEQ ID NO: 2131301 - RNA, 18 nt, Human
uggcaccacugcacucca

SEQ ID NO: 2131302 - RNA, 19 nt, Human
uggcaccacugcacuccag

SEQ ID NO: 2131303 - RNA, 21 nt, Human
uggcaccacugcacuccagcc

SEQ ID NO: 2131304 - RNA, 12 nt, Human
uggauucucaga

SEQ ID NO: 2131305 - RNA, 13 nt, Human
uggauucucagau

SEQ ID NO: 2131306 - RNA, 14 nt, Human
uggauucucagaua

SEQ ID NO: 2131307 - RNA, 15 nt, Human
uggauucucagauau

SEQ ID NO: 2131308 - RNA, 16 nt, Human
uggauucucagauauu

SEQ ID NO: 2131309 - RNA, 17 nt, Human
uggauugacaguaacuu

SEQ ID NO: 2131310 - RNA, 20 nt, Human
uggauugacaguaacuuggu

SEQ ID NO: 2131311 - RNA, 21 nt, Human
uggauugacaguaacuugguu

SEQ ID NO: 2131312 - RNA, 19 nt, Human
uggauucucagauauuuau

SEQ ID NO: 2131313 - RNA, 15 nt, Human
aggccccaggaagcc

SEQ ID NO: 2131314 - RNA, 16 nt, Human
aggccccaggaagccg

SEQ ID NO: 2131315 - RNA, 13 nt, Human
aggcccccaagcc

SEQ ID NO: 2131316 - RNA, 22 nt, Human
aggcccaaauuaucaagcuaau

SEQ ID NO: 2131317 - RNA, 23 nt, Human
aggcccaaauuaucaagcuaaua

SEQ ID NO: 2131318 - RNA, 12 nt, Human
aggcccaagaga

SEQ ID NO: 2131319 - RNA, 20 nt, Human
aggcccaagagaugaagagu

SEQ ID NO: 2131320 - RNA, 22 nt, Human
aggcccaccuaccuucaaagcu

SEQ ID NO: 2131321 - RNA, 23 nt, Human
aggcccaccuaccuucaaagcug

SEQ ID NO: 2131322 - RNA, 19 nt, Human
aggcccgcaugcggcccag

SEQ ID NO: 2131323 - RNA, 13 nt, Human
aggcccggcucca

SEQ ID NO: 2131324 - RNA, 20 nt, Human
uggcacccggccccugcugg

SEQ ID NO: 2131325 - RNA, 19 nt, Human
uggcacccggccccugcug

SEQ ID NO: 2131326 - RNA, 18 nt, Human
uggcacccggccccugcu

SEQ ID NO: 2131327 - RNA, 11 nt, Human
aggccaccugc

SEQ ID NO: 2131328 - RNA, 12 nt, Human
aggccaccugca

SEQ ID NO: 2131329 - RNA, 14 nt, Human
aggccaccugcagg

SEQ ID NO: 2131330 - RNA, 13 nt, Human
aggccaccugccc

SEQ ID NO: 2131331 - RNA, 13 nt, Human
aggccagccuggc

SEQ ID NO: 2131332 - RNA, 18 nt, Human
aggccaccugcccccuuc

SEQ ID NO: 2131333 - RNA, 19 nt, Human
aggccaccugcccccuucu

SEQ ID NO: 2131334 - RNA, 14 nt, Human
aggccaccugcccc

SEQ ID NO: 2131335 - RNA, 15 nt, Human
aggccaccugccccc

SEQ ID NO: 2131336 - RNA, 16 nt, Human
aggccaccugcccccu

SEQ ID NO: 2131337 - RNA, 17 nt, Human
aggccaccugcccccuu

SEQ ID NO: 2131338 - RNA, 21 nt, Human
aggcccaaauuaucaagcuaa

SEQ ID NO: 2131339 - RNA, 17 nt, Human
aggcaagcaccuccugc

SEQ ID NO: 2131340 - RNA, 17 nt, Human
uggagccaauggagacu

SEQ ID NO: 2131341 - RNA, 17 nt, Human
uggagccaaggguucag

SEQ ID NO: 2131342 - RNA, 17 nt, Human
uggagccaccuguccca

SEQ ID NO: 2131343 - RNA, 22 nt, Human
uggagccaccugucccaccuca

SEQ ID NO: 2131344 - RNA, 15 nt, Human
uggagccacucuguu

SEQ ID NO: 2131345 - RNA, 16 nt, Human
uggagccacucuguuc

SEQ ID NO: 2131346 - RNA, 19 nt, Human
uggagcagggacagaucau

SEQ ID NO: 2131347 - RNA, 19 nt, Human
aggcaagcaccuccugccu

SEQ ID NO: 2131348 - RNA, 18 nt, Human
aggcaagcaccuccugcc

SEQ ID NO: 2131349 - RNA, 20 nt, Human
aggcaagcaccuccugccuc

SEQ ID NO: 2131350 - RNA, 17 nt, Human
aggauugcuacuguccu

SEQ ID NO: 2131351 - RNA, 15 nt, Human
aggauugcuacuguc

SEQ ID NO: 2131352 - RNA, 18 nt, Human
aggauugcuacuguccua

SEQ ID NO: 2131353 - RNA, 17 nt, Human
uggacuuaaccggaguu

SEQ ID NO: 2131354 - RNA, 21 nt, Human
uggagcacucugaguuuacca

SEQ ID NO: 2131355 - RNA, 22 nt, Human
uggagcacucugaguuuaccau

SEQ ID NO: 2131356 - RNA, 17 nt, Human
uggagcaccaggcacga

SEQ ID NO: 2131357 - RNA, 18 nt, Human
uggagcacaaaagccucu

SEQ ID NO: 2131358 - RNA, 20 nt, Human
uggacuucuuuuacucauga

SEQ ID NO: 2131359 - RNA, 14 nt, Human
uggagaaacccugu

SEQ ID NO: 2131360 - RNA, 16 nt, Human
uggagaaacccugucu

SEQ ID NO: 2131361 - RNA, 17 nt, Human
uggagaaacccuugaaa

SEQ ID NO: 2131362 - RNA, 17 nt, Human
uggagaaacuguagucu

SEQ ID NO: 2131363 - RNA, 22 nt, Human
uggagaaacuguagucucagga

SEQ ID NO: 2131364 - RNA, 13 nt, Human
aggcauaggccug

SEQ ID NO: 2131365 - RNA, 14 nt, Human
aggcauaggccugg

SEQ ID NO: 2131366 - RNA, 15 nt, Human
aggcauaggccuggg

SEQ ID NO: 2131367 - RNA, 16 nt, Human
aggcauaggccugggu

SEQ ID NO: 2131368 - RNA, 15 nt, Human
aggcauuuaggaacu

SEQ ID NO: 2131369 - RNA, 22 nt, Human
aggcaggucuugaacuccuggc

SEQ ID NO: 2131370 - RNA, 20 nt, Human
aggcagggucaggagagggg

SEQ ID NO: 2131371 - RNA, 23 nt, Human
aggcagggucaggagaggggcag

SEQ ID NO: 2131372 - RNA, 12 nt, Human
aggcagggucuc

SEQ ID NO: 2131373 - RNA, 14 nt, Human
aggcagggucagga

SEQ ID NO: 2131374 - RNA, 17 nt, Human
aggcagggucaggagag

SEQ ID NO: 2131375 - RNA, 19 nt, Human
aggcagggucaggagaggg

SEQ ID NO: 2131376 - RNA, 21 nt, Human
aggcaggugccccucucucca

SEQ ID NO: 2131377 - RNA, 16 nt, Human
aggcaggugacaguga

SEQ ID NO: 2131378 - RNA, 17 nt, Human
aggcaggugacagugag

SEQ ID NO: 2131379 - RNA, 18 nt, Human
aggcaggugacagugagg

SEQ ID NO: 2131380 - RNA, 17 nt, Human
aggcaggugggauggau

SEQ ID NO: 2131381 - RNA, 13 nt, Human
aggcaggggcgga

SEQ ID NO: 2131382 - RNA, 21 nt, Human
aggcagggccuugcccagaga

SEQ ID NO: 2131383 - RNA, 23 nt, Human
aggcagggccuugcccagagaug

SEQ ID NO: 2131384 - RNA, 22 nt, Human
aggcagggaaaggcucugaaag

SEQ ID NO: 2131385 - RNA, 22 nt, Human
aggcagggccuugcccagagau

SEQ ID NO: 2131386 - RNA, 20 nt, Human
aggcacagccggggccugcc

SEQ ID NO: 2131387 - RNA, 21 nt, Human
aggcacagccggggccugccu

SEQ ID NO: 2131388 - RNA, 14 nt, Human
aggcacacagcugc

SEQ ID NO: 2131389 - RNA, 18 nt, Human
aggcacacagcugcagag

SEQ ID NO: 2131390 - RNA, 23 nt, Human
aggcacacagcugcagagacaga

SEQ ID NO: 2131391 - RNA, 12 nt, Human
aggcacacuucu

SEQ ID NO: 2131392 - RNA, 15 nt, Human
aggcacacuucuucu

SEQ ID NO: 2131393 - RNA, 16 nt, Human
aggcacacuucuucuu

SEQ ID NO: 2131394 - RNA, 20 nt, Human
aggcacacuucuucuugguc

SEQ ID NO: 2131395 - RNA, 20 nt, Human
aggcagcuuuuucucuccca

SEQ ID NO: 2131396 - RNA, 20 nt, Human
aggcaggaagggcaggaagg

SEQ ID NO: 2131397 - RNA, 16 nt, Human
aggcaggaagggcagg

SEQ ID NO: 2131398 - RNA, 17 nt, Human
aggcaggaagggcagga

SEQ ID NO: 2131399 - RNA, 13 nt, Human
agcuguuuaugca

SEQ ID NO: 2131400 - RNA, 17 nt, Human
agcuguuuauggccuca

SEQ ID NO: 2131401 - RNA, 18 nt, Human
agcuguuuauggccucag

SEQ ID NO: 2131402 - RNA, 19 nt, Human
agcuguuuauggccucagc

SEQ ID NO: 2131403 - RNA, 20 nt, Human
agcuguuuauggccucagcu

SEQ ID NO: 2131404 - RNA, 21 nt, Human
agcuguuuauggccucagcug

SEQ ID NO: 2131405 - RNA, 23 nt, Human
ugcuacaugacgacaaagcugcu

SEQ ID NO: 2131406 - RNA, 24 nt, Human
ugcuacaugacgacaaagcugcua

SEQ ID NO: 2131407 - RNA, 20 nt, Human
ugcuaaucggguugucacuc

SEQ ID NO: 2131408 - RNA, 17 nt, Human
ugcuaaucuucagggca

SEQ ID NO: 2131409 - RNA, 14 nt, Human
ugcggucaaggcca

SEQ ID NO: 2131410 - RNA, 12 nt, Human
ugcuaauaaaac

SEQ ID NO: 2131411 - RNA, 15 nt, Human
ugcgguccacccagg

SEQ ID NO: 2131412 - RNA, 14 nt, Human
ugcgguccacccag

SEQ ID NO: 2131413 - RNA, 15 nt, Human
agcuuacaagccagc

SEQ ID NO: 2131414 - RNA, 17 nt, Human
agcuuacaagccagcug

SEQ ID NO: 2131415 - RNA, 19 nt, Human
agcuuacaagccagcugga

SEQ ID NO: 2131416 - RNA, 22 nt, Human
agcuugaggguugggcuggugu

SEQ ID NO: 2131417 - RNA, 18 nt, Human
agcuugauaaagggccaa

SEQ ID NO: 2131418 - RNA, 16 nt, Human
agcuuguuauuuauaa

SEQ ID NO: 2131419 - RNA, 23 nt, Human
agcuuguccaacccgaggcccgc

SEQ ID NO: 2131420 - RNA, 22 nt, Human
agcuugucuaugguacaaaaau

SEQ ID NO: 2131421 - RNA, 19 nt, Human
agcuugcucuucaguggga

SEQ ID NO: 2131422 - RNA, 22 nt, Human
agcuugcucuucagugggagaa

SEQ ID NO: 2131423 - RNA, 16 nt, Human
agcuugcugcacccca

SEQ ID NO: 2131424 - RNA, 20 nt, Human
agcuugcugcaccccaaguc

SEQ ID NO: 2131425 - RNA, 16 nt, Human
agcuugcugcccuagg

SEQ ID NO: 2131426 - RNA, 22 nt, Human
agcuuguccaacccgaggcccg

SEQ ID NO: 2131427 - RNA, 23 nt, Human
agcuugcguuagaaugaggagga

SEQ ID NO: 2131428 - RNA, 14 nt, Human
agcuugcucuucag

SEQ ID NO: 2131429 - RNA, 14 nt, Human
aggaaaagcugcug

SEQ ID NO: 2131430 - RNA, 13 nt, Human
aggaaaagaaaag

SEQ ID NO: 2131431 - RNA, 14 nt, Human
agcuuuggacgcac

SEQ ID NO: 2131432 - RNA, 19 nt, Human
agcuuuggacgcacacagc

SEQ ID NO: 2131433 - RNA, 20 nt, Human
agcuuuggacgcacacagcu

SEQ ID NO: 2131434 - RNA, 21 nt, Human
agcuuuggacgcacacagcuu

SEQ ID NO: 2131435 - RNA, 16 nt, Human
agcuuuggaaacagga

SEQ ID NO: 2131436 - RNA, 12 nt, Human
agcuuuggacac

SEQ ID NO: 2131437 - RNA, 14 nt, Human
agcuuuggacacac

SEQ ID NO: 2131438 - RNA, 19 nt, Human
agcuuuggacacacacagc

SEQ ID NO: 2131439 - RNA, 20 nt, Human
agcuuuggacacacacagcu

SEQ ID NO: 2131440 - RNA, 21 nt, Human
agcuuuggacacacacagcuu

SEQ ID NO: 2131441 - RNA, 23 nt, Human
agcuuuggacacacacagcuucu

SEQ ID NO: 2131442 - RNA, 20 nt, Human
agcuuugcuucucucucuaa

SEQ ID NO: 2131443 - RNA, 19 nt, Human
agcuuugauuuagauugag

SEQ ID NO: 2131444 - RNA, 14 nt, Human
aggaagcagccaag

SEQ ID NO: 2131445 - RNA, 13 nt, Human
aggaagcaacgaa

SEQ ID NO: 2131446 - RNA, 19 nt, Human
aggaagcaacgaagggaaa

SEQ ID NO: 2131447 - RNA, 15 nt, Human
aggaagccacagcug

SEQ ID NO: 2131448 - RNA, 16 nt, Human
aggaagccacagcugg

SEQ ID NO: 2131449 - RNA, 18 nt, Human
aggaagccacagcuggug

SEQ ID NO: 2131450 - RNA, 14 nt, Human
aggaaggaugagca

SEQ ID NO: 2131451 - RNA, 17 nt, Human
aggaaggaugagcauuu

SEQ ID NO: 2131452 - RNA, 15 nt, Human
aggaaugucuuuggu

SEQ ID NO: 2131453 - RNA, 14 nt, Human
aggaauguuaaagu

SEQ ID NO: 2131454 - RNA, 18 nt, Human
aggaauguagcugguuuc

SEQ ID NO: 2131455 - RNA, 23 nt, Human
aggaauuaaguuagggaauggca

SEQ ID NO: 2131456 - RNA, 22 nt, Human
aggaauguuaaagucaguggga

SEQ ID NO: 2131457 - RNA, 22 nt, Human
aggaauucccagcccaaagcug

SEQ ID NO: 2131458 - RNA, 17 nt, Human
aggaaauaaaaaagucu

SEQ ID NO: 2131459 - RNA, 18 nt, Human
aggaaauaaaaaagucuc

SEQ ID NO: 2131460 - RNA, 20 nt, Human
aggaaauaaaaaagucucua

SEQ ID NO: 2131461 - RNA, 21 nt, Human
aggaaauaaaaaagucucuau

SEQ ID NO: 2131462 - RNA, 22 nt, Human
aggaaauaaaaaagucucuauu

SEQ ID NO: 2131463 - RNA, 14 nt, Human
aggaaauaaaaccu

SEQ ID NO: 2131464 - RNA, 17 nt, Human
aggaaauaaaaccuuuc

SEQ ID NO: 2131465 - RNA, 18 nt, Human
aggaaagugauaugcauu

SEQ ID NO: 2131466 - RNA, 16 nt, Human
aggaaauaaaaccuuu

SEQ ID NO: 2131467 - RNA, 18 nt, Human
aggaagaucacuuugcuc

SEQ ID NO: 2131468 - RNA, 20 nt, Human
aggaagaucacuuugcucug

SEQ ID NO: 2131469 - RNA, 21 nt, Human
aggaagaucacuuugcucuga

SEQ ID NO: 2131470 - RNA, 14 nt, Human
aggaagaucaggcc

SEQ ID NO: 2131471 - RNA, 13 nt, Human
aggaaagggaagg

SEQ ID NO: 2131472 - RNA, 15 nt, Human
ugcugagagacccaa

SEQ ID NO: 2131473 - RNA, 17 nt, Human
ugcugagagacccaagg

SEQ ID NO: 2131474 - RNA, 18 nt, Human
ugcugagagacccaagga

SEQ ID NO: 2131475 - RNA, 21 nt, Human
ugcugagagacccaaggagga

SEQ ID NO: 2131476 - RNA, 22 nt, Human
ugcugagagacccaaggaggaa

SEQ ID NO: 2131477 - RNA, 17 nt, Human
ugcucuuaugccauuug

SEQ ID NO: 2131478 - RNA, 16 nt, Human
ugcucugcugacagac

SEQ ID NO: 2131479 - RNA, 15 nt, Human
ugcucugcugacaga

SEQ ID NO: 2131480 - RNA, 14 nt, Human
ugcucugcugacag

SEQ ID NO: 2131481 - RNA, 13 nt, Human
ugcucuucagugg

SEQ ID NO: 2131482 - RNA, 18 nt, Human
ugcucugaacacgaagcu

SEQ ID NO: 2131483 - RNA, 17 nt, Human
ugcucucugcagccagc

SEQ ID NO: 2131484 - RNA, 20 nt, Human
ugcucucugcagccagccca

SEQ ID NO: 2131485 - RNA, 21 nt, Human
ugcucucugcagccagcccag

SEQ ID NO: 2131486 - RNA, 14 nt, Human
ugcucucuacccag

SEQ ID NO: 2131487 - RNA, 16 nt, Human
ugcucucuacccagcc

SEQ ID NO: 2131488 - RNA, 17 nt, Human
ugcucucuacccagccc

SEQ ID NO: 2131489 - RNA, 18 nt, Human
ugcucucuacccagccca

SEQ ID NO: 2131490 - RNA, 19 nt, Human
ugcucucuacccagcccau

SEQ ID NO: 2131491 - RNA, 20 nt, Human
ugcucucuacccagcccauc

SEQ ID NO: 2131492 - RNA, 22 nt, Human
ugcucucuacccagcccaucuu

SEQ ID NO: 2131493 - RNA, 13 nt, Human
ugcucucugcagc

SEQ ID NO: 2131494 - RNA, 14 nt, Human
ugcucucugcagcc

SEQ ID NO: 2131495 - RNA, 15 nt, Human
ugcucucugcagcca

SEQ ID NO: 2131496 - RNA, 20 nt, Human
ugcuccagcuguucagcugg

SEQ ID NO: 2131497 - RNA, 21 nt, Human
ugcuccagcuguucagcuggu

SEQ ID NO: 2131498 - RNA, 16 nt, Human
aggaaaagcugcugac

SEQ ID NO: 2131499 - RNA, 12 nt, Human
aggaaaauugga

SEQ ID NO: 2131500 - RNA, 13 nt, Human
aggaaaauuucac

SEQ ID NO: 2131501 - RNA, 16 nt, Human
ugcuauggauggcuuc

SEQ ID NO: 2131502 - RNA, 12 nt, Human
ugcuauggggac

SEQ ID NO: 2131503 - RNA, 12 nt, Human
ugcuauggggag

SEQ ID NO: 2131504 - RNA, 18 nt, Human
ugcuauggggagaaaaga

SEQ ID NO: 2131505 - RNA, 19 nt, Human
ugcuauggggagaaaagac

SEQ ID NO: 2131506 - RNA, 13 nt, Human
ugcuaugaaugau

SEQ ID NO: 2131507 - RNA, 14 nt, Human
ugcucaagaaacaa

SEQ ID NO: 2131508 - RNA, 12 nt, Human
ugcuauuuuacu

SEQ ID NO: 2131509 - RNA, 15 nt, Human
ugcuauuuuacuguc

SEQ ID NO: 2131510 - RNA, 17 nt, Human
ugcuauuuuacugucuu

SEQ ID NO: 2131511 - RNA, 18 nt, Human
ugcuauuuuacugucuua

SEQ ID NO: 2131512 - RNA, 19 nt, Human
ugcuauuuuacugucuuaa

SEQ ID NO: 2131513 - RNA, 15 nt, Human
ugcucaaaaaaugag

SEQ ID NO: 2131514 - RNA, 15 nt, Human
agcuccaguccugcu

SEQ ID NO: 2131515 - RNA, 17 nt, Human
agcuccaguccugcucu

SEQ ID NO: 2131516 - RNA, 14 nt, Human
agcuccaguggaag

SEQ ID NO: 2131517 - RNA, 19 nt, Human
agcuccaguggaagaagaa

SEQ ID NO: 2131518 - RNA, 20 nt, Human
agcuccaguggaagaagaaa

SEQ ID NO: 2131519 - RNA, 23 nt, Human
agcuccaguggaagaagaaaaca

SEQ ID NO: 2131520 - RNA, 15 nt, Human
agcuccuucuguccu

SEQ ID NO: 2131521 - RNA, 16 nt, Human
agcuccaucuccacuc

SEQ ID NO: 2131522 - RNA, 15 nt, Human
agcuccaucuccacu

SEQ ID NO: 2131523 - RNA, 13 nt, Human
agcuccaucucca

SEQ ID NO: 2131524 - RNA, 13 nt, Human
agcuccaguucga

SEQ ID NO: 2131525 - RNA, 21 nt, Human
agcuccuucuguccuacucug

SEQ ID NO: 2131526 - RNA, 16 nt, Human
agcuccuucuguccua

SEQ ID NO: 2131527 - RNA, 22 nt, Human
agcuccuugggaggccccacug

SEQ ID NO: 2131528 - RNA, 12 nt, Human
agcucgguggac

SEQ ID NO: 2131529 - RNA, 14 nt, Human
agcucgguggaccc

SEQ ID NO: 2131530 - RNA, 15 nt, Human
agcucgguggaccca

SEQ ID NO: 2131531 - RNA, 16 nt, Human
agcucgguggacccag

SEQ ID NO: 2131532 - RNA, 17 nt, Human
agcucgguggacccagg

SEQ ID NO: 2131533 - RNA, 18 nt, Human
agcucgguggacccaggg

SEQ ID NO: 2131534 - RNA, 19 nt, Human
agcucgguggacccaggga

SEQ ID NO: 2131535 - RNA, 20 nt, Human
agcucgguggacccagggau

SEQ ID NO: 2131536 - RNA, 14 nt, Human
agcucuguccuggg

SEQ ID NO: 2131537 - RNA, 21 nt, Human
agcucugaagucacaucacag

SEQ ID NO: 2131538 - RNA, 23 nt, Human
agcucugaagucacaucacagga

SEQ ID NO: 2131539 - RNA, 12 nt, Human
agcucuggcuuc

SEQ ID NO: 2131540 - RNA, 20 nt, Human
agcucuggcuuccagaaaac

SEQ ID NO: 2131541 - RNA, 15 nt, Human
ugcccuuaaaucaua

SEQ ID NO: 2131542 - RNA, 14 nt, Human
ugccgacacgcucc

SEQ ID NO: 2131543 - RNA, 15 nt, Human
ugccgaccagagccc

SEQ ID NO: 2131544 - RNA, 21 nt, Human
ugccgaccagagccccacacg

SEQ ID NO: 2131545 - RNA, 22 nt, Human
ugccgaccagagccccacacgg

SEQ ID NO: 2131546 - RNA, 15 nt, Human
ugccgaccgaggcug

SEQ ID NO: 2131547 - RNA, 16 nt, Human
ugccgaccgaggcugg

SEQ ID NO: 2131548 - RNA, 22 nt, Human
ugccgaccgaggcuggagcugg

SEQ ID NO: 2131549 - RNA, 23 nt, Human
ugccgaccgaggcuggagcuggc

SEQ ID NO: 2131550 - RNA, 14 nt, Human
ugccgaccucgucc

SEQ ID NO: 2131551 - RNA, 15 nt, Human
ugccgaccucguccu

SEQ ID NO: 2131552 - RNA, 17 nt, Human
ugccgaccucguccucc

SEQ ID NO: 2131553 - RNA, 21 nt, Human
ugccgaccucguccucccccu

SEQ ID NO: 2131554 - RNA, 13 nt, Human
ugccucagccucc

SEQ ID NO: 2131555 - RNA, 12 nt, Human
ugccucagccuc

SEQ ID NO: 2131556 - RNA, 18 nt, Human
ugccgcaccccagagugu

SEQ ID NO: 2131557 - RNA, 22 nt, Human
ugccgaccucguccucccccug

SEQ ID NO: 2131558 - RNA, 12 nt, Human
ugccgcacccca

SEQ ID NO: 2131559 - RNA, 13 nt, Human
ugccgcaccccag

SEQ ID NO: 2131560 - RNA, 15 nt, Human
ugccgcaccccagag

SEQ ID NO: 2131561 - RNA, 23 nt, Human
agcucuguccugggagugagcug

SEQ ID NO: 2131562 - RNA, 20 nt, Human
agcugauuuuaacaauaacu

SEQ ID NO: 2131563 - RNA, 21 nt, Human
agcucuguccugggagugagc

SEQ ID NO: 2131564 - RNA, 16 nt, Human
agcucuguccugggag

SEQ ID NO: 2131565 - RNA, 21 nt, Human
agcugcaagugacaucucuuu

SEQ ID NO: 2131566 - RNA, 15 nt, Human
agcugcaagugacau

SEQ ID NO: 2131567 - RNA, 18 nt, Human
agcugcaagugacaucuc

SEQ ID NO: 2131568 - RNA, 11 nt, Human
agcugcagaac

SEQ ID NO: 2131569 - RNA, 15 nt, Human
agcugcagagacaga

SEQ ID NO: 2131570 - RNA, 17 nt, Human
agcugcagagacagaga

SEQ ID NO: 2131571 - RNA, 18 nt, Human
agcugcagagacagagag

SEQ ID NO: 2131572 - RNA, 19 nt, Human
agcugcagagacagagagg

SEQ ID NO: 2131573 - RNA, 17 nt, Human
agcugccauccagggau

SEQ ID NO: 2131574 - RNA, 14 nt, Human
agcugccccuggcu

SEQ ID NO: 2131575 - RNA, 13 nt, Human
agcugccccuccc

SEQ ID NO: 2131576 - RNA, 16 nt, Human
agcugccccucccugc

SEQ ID NO: 2131577 - RNA, 17 nt, Human
agcugccccucccugcc

SEQ ID NO: 2131578 - RNA, 18 nt, Human
agcugcccccgcucaugg

SEQ ID NO: 2131579 - RNA, 19 nt, Human
agcugcccccgcucauggg

SEQ ID NO: 2131580 - RNA, 14 nt, Human
ugccuguucccauu

SEQ ID NO: 2131581 - RNA, 19 nt, Human
agcuguuacugucuucagu

SEQ ID NO: 2131582 - RNA, 19 nt, Human
ugccugugccacccaccag

SEQ ID NO: 2131583 - RNA, 20 nt, Human
ugccugugccacccaccagg

SEQ ID NO: 2131584 - RNA, 19 nt, Human
agcuguuauuucuauuuuu

SEQ ID NO: 2131585 - RNA, 23 nt, Human
agcugugugaaauaccagugugg

SEQ ID NO: 2131586 - RNA, 20 nt, Human
ugccugugcacggccagcug

SEQ ID NO: 2131587 - RNA, 21 nt, Human
ugccugugcacggccagcugc

SEQ ID NO: 2131588 - RNA, 14 nt, Human
ugccugugccaccc

SEQ ID NO: 2131589 - RNA, 16 nt, Human
ugccugugccacccac

SEQ ID NO: 2131590 - RNA, 14 nt, Human
ugccuuaccuccug

SEQ ID NO: 2131591 - RNA, 15 nt, Human
ugccuuaccuccugc

SEQ ID NO: 2131592 - RNA, 16 nt, Human
ugccuuaccuccugcc

SEQ ID NO: 2131593 - RNA, 17 nt, Human
ugccuuaccuccugccc

SEQ ID NO: 2131594 - RNA, 18 nt, Human
ugccuuaccuccugccca

SEQ ID NO: 2131595 - RNA, 16 nt, Human
ugccuugggcugcucc

SEQ ID NO: 2131596 - RNA, 17 nt, Human
ugccuugggcugcuccu

SEQ ID NO: 2131597 - RNA, 19 nt, Human
ugccuugggcugcuccuca

SEQ ID NO: 2131598 - RNA, 16 nt, Human
ugccuuaacuggagcc

SEQ ID NO: 2131599 - RNA, 16 nt, Human
agcugggacuacaggu

SEQ ID NO: 2131600 - RNA, 23 nt, Human
agcugggacuacaggcacccacc

SEQ ID NO: 2131601 - RNA, 20 nt, Human
agcugggacuacaggcaccc

SEQ ID NO: 2131602 - RNA, 20 nt, Human
agcuggguaaucgauggggg

SEQ ID NO: 2131603 - RNA, 18 nt, Human
agcugugcucuggacagg

SEQ ID NO: 2131604 - RNA, 17 nt, Human
agcugugcucuggacag

SEQ ID NO: 2131605 - RNA, 15 nt, Human
agcugugguuuucuu

SEQ ID NO: 2131606 - RNA, 22 nt, Human
agcugugguuuucuuuugccau

SEQ ID NO: 2131607 - RNA, 15 nt, Human
agcuguguccuugca

SEQ ID NO: 2131608 - RNA, 18 nt, Human
agcuguguccuugcaccu

SEQ ID NO: 2131609 - RNA, 20 nt, Human
agcuguguccuugcaccugc

SEQ ID NO: 2131610 - RNA, 21 nt, Human
agcuguggguacagagagguc

SEQ ID NO: 2131611 - RNA, 18 nt, Human
agcuguuacugucuucag

SEQ ID NO: 2131612 - RNA, 14 nt, Human
agcuguuacugucu

SEQ ID NO: 2131613 - RNA, 21 nt, Human
agcuguguccuugcaccugca

SEQ ID NO: 2131614 - RNA, 24 nt, Human
agcuguguccuugcaccugcaucc

SEQ ID NO: 2131615 - RNA, 13 nt, Human
agcugugugaaau

SEQ ID NO: 2131616 - RNA, 14 nt, Human
agcugugugaaaua

SEQ ID NO: 2131617 - RNA, 16 nt, Human
agcugccuguucagcu

SEQ ID NO: 2131618 - RNA, 14 nt, Human
agcugccuguucag

SEQ ID NO: 2131619 - RNA, 18 nt, Human
agcugccuguucagcucc

SEQ ID NO: 2131620 - RNA, 20 nt, Human
ugccuggaagagcagcccua

SEQ ID NO: 2131621 - RNA, 19 nt, Human
ugccuggaagagcagcccu

SEQ ID NO: 2131622 - RNA, 15 nt, Human
ugccuggacaaaccc

SEQ ID NO: 2131623 - RNA, 14 nt, Human
agcugcuggcuugc

SEQ ID NO: 2131624 - RNA, 17 nt, Human
agcugcuggcuugcagu

SEQ ID NO: 2131625 - RNA, 18 nt, Human
agcuggcgucugucuuca

SEQ ID NO: 2131626 - RNA, 15 nt, Human
agcuggcgucugucu

SEQ ID NO: 2131627 - RNA, 22 nt, Human
agcugcuuggaccucgugcuuu

SEQ ID NO: 2131628 - RNA, 23 nt, Human
agcugcuuggaccucgugcuuua

SEQ ID NO: 2131629 - RNA, 23 nt, Human
agcuggccgaggguccuggcucc

SEQ ID NO: 2131630 - RNA, 17 nt, Human
ugccucugccucugaca

SEQ ID NO: 2131631 - RNA, 20 nt, Human
ugccucugccucugacacac

SEQ ID NO: 2131632 - RNA, 18 nt, Human
ugccucugccucugacac

SEQ ID NO: 2131633 - RNA, 14 nt, Human
ugccucagccuccc

SEQ ID NO: 2131634 - RNA, 13 nt, Human
agcugcagugagc

SEQ ID NO: 2131635 - RNA, 23 nt, Human
ugccugcccaggccccugccacc

SEQ ID NO: 2131636 - RNA, 22 nt, Human
ugccugcccaggccccugccac

SEQ ID NO: 2131637 - RNA, 20 nt, Human
ugccugcccaggccccugcc

SEQ ID NO: 2131638 - RNA, 12 nt, Human
ugccucugccug

SEQ ID NO: 2131639 - RNA, 18 nt, Human
ugccuggaagagcagccc

SEQ ID NO: 2131640 - RNA, 18 nt, Human
uguaugucucgugguagg

SEQ ID NO: 2131641 - RNA, 17 nt, Human
uguaugugcgugugugc

SEQ ID NO: 2131642 - RNA, 16 nt, Human
uguaugugccauuuau

SEQ ID NO: 2131643 - RNA, 14 nt, Human
uguauguguguaug

SEQ ID NO: 2131644 - RNA, 17 nt, Human
uguauccaguacauuua

SEQ ID NO: 2131645 - RNA, 17 nt, Human
uguaucauuugaacaac

SEQ ID NO: 2131646 - RNA, 15 nt, Human
uguaucaaacuagug

SEQ ID NO: 2131647 - RNA, 18 nt, Human
uguaucaacccagaaaca

SEQ ID NO: 2131648 - RNA, 21 nt, Human
uguaucaggaaauauauaugu

SEQ ID NO: 2131649 - RNA, 17 nt, Human
uguaucaaugaguaaca

SEQ ID NO: 2131650 - RNA, 14 nt, Human
aguagaauugauuu

SEQ ID NO: 2131651 - RNA, 14 nt, Human
uguauguuugcaca

SEQ ID NO: 2131652 - RNA, 16 nt, Human
uguauguuugcacacu

SEQ ID NO: 2131653 - RNA, 22 nt, Human
uguauguuugcacacuugugug

SEQ ID NO: 2131654 - RNA, 14 nt, Human
uguauguugugaag

SEQ ID NO: 2131655 - RNA, 19 nt, Human
uguauguugugaagauguu

SEQ ID NO: 2131656 - RNA, 22 nt, Human
uguauguugugaagauguuugc

SEQ ID NO: 2131657 - RNA, 23 nt, Human
uguauguugugaagauguuugca

SEQ ID NO: 2131658 - RNA, 14 nt, Human
uguauguuuacacu

SEQ ID NO: 2131659 - RNA, 17 nt, Human
uguauguuuacacuguc

SEQ ID NO: 2131660 - RNA, 18 nt, Human
uguauguuuacacuguca

SEQ ID NO: 2131661 - RNA, 20 nt, Human
uguauguuuacacugucaaa

SEQ ID NO: 2131662 - RNA, 19 nt, Human
uguauuccaguuuguuuau

SEQ ID NO: 2131663 - RNA, 18 nt, Human
uguauucccaccccugga

SEQ ID NO: 2131664 - RNA, 17 nt, Human
uguauucccaguuacuu

SEQ ID NO: 2131665 - RNA, 21 nt, Human
uguauuaauauucauuguaua

SEQ ID NO: 2131666 - RNA, 23 nt, Human
ugucaaaaaugucuuggguaggc

SEQ ID NO: 2131667 - RNA, 16 nt, Human
ugucaaacaaagccag

SEQ ID NO: 2131668 - RNA, 17 nt, Human
ugucaaacaaagccaga

SEQ ID NO: 2131669 - RNA, 21 nt, Human
ugucaaacaaagccagaagcu

SEQ ID NO: 2131670 - RNA, 22 nt, Human
ugucaaacaaagccagaagcug

SEQ ID NO: 2131671 - RNA, 16 nt, Human
ugucaaacuguagaaa

SEQ ID NO: 2131672 - RNA, 13 nt, Human
ugucaaggugcug

SEQ ID NO: 2131673 - RNA, 16 nt, Human
ugucaaggugcuguug

SEQ ID NO: 2131674 - RNA, 16 nt, Human
ugucaagucucugcug

SEQ ID NO: 2131675 - RNA, 18 nt, Human
aguauuacuucugcuaca

SEQ ID NO: 2131676 - RNA, 17 nt, Human
aguaugguggcuggguu

SEQ ID NO: 2131677 - RNA, 15 nt, Human
aguauuacuucugcu

SEQ ID NO: 2131678 - RNA, 13 nt, Human
aguagucagacug

SEQ ID NO: 2131679 - RNA, 16 nt, Human
aguaugguggcugggu

SEQ ID NO: 2131680 - RNA, 15 nt, Human
aguaugguggcuggg

SEQ ID NO: 2131681 - RNA, 13 nt, Human
aguagggucaggc

SEQ ID NO: 2131682 - RNA, 13 nt, Human
aguaggugcuuga

SEQ ID NO: 2131683 - RNA, 19 nt, Human
ugucaagucucugcuggcc

SEQ ID NO: 2131684 - RNA, 17 nt, Human
ugucaagucucugcugg

SEQ ID NO: 2131685 - RNA, 18 nt, Human
ugucaagucucugcuggc

SEQ ID NO: 2131686 - RNA, 23 nt, Human
agucacacagugagucgaggaca

SEQ ID NO: 2131687 - RNA, 15 nt, Human
agucacacagugagu

SEQ ID NO: 2131688 - RNA, 23 nt, Human
agucacacaguauuacuucugcu

SEQ ID NO: 2131689 - RNA, 14 nt, Human
aguaugguggcugg

SEQ ID NO: 2131690 - RNA, 23 nt, Human
uguagaaaagggaacugaacauu

SEQ ID NO: 2131691 - RNA, 21 nt, Human
uguagaaaugaugauguggaa

SEQ ID NO: 2131692 - RNA, 18 nt, Human
uguagagccagggucuca

SEQ ID NO: 2131693 - RNA, 16 nt, Human
uguagagccagggucu

SEQ ID NO: 2131694 - RNA, 10 nt, Human
agguuuguga

SEQ ID NO: 2131695 - RNA, 22 nt, Human
agguuugugagagcgaggcuga

SEQ ID NO: 2131696 - RNA, 14 nt, Human
uguagagcuucugg

SEQ ID NO: 2131697 - RNA, 18 nt, Human
uguagaaaagggaacuga

SEQ ID NO: 2131698 - RNA, 19 nt, Human
uguagaaaagggaacugaa

SEQ ID NO: 2131699 - RNA, 20 nt, Human
uguagaaaagggaacugaac

SEQ ID NO: 2131700 - RNA, 21 nt, Human
uguagaaaagggaacugaaca

SEQ ID NO: 2131701 - RNA, 14 nt, Human
aguaaaacuugcug

SEQ ID NO: 2131702 - RNA, 20 nt, Human
agguuuuuggaauuaugucu

SEQ ID NO: 2131703 - RNA, 15 nt, Human
agguuuuaugauauu

SEQ ID NO: 2131704 - RNA, 23 nt, Human
agguuuuaugauauuuuuuuaag

SEQ ID NO: 2131705 - RNA, 14 nt, Human
aguacauguuaaac

SEQ ID NO: 2131706 - RNA, 23 nt, Human
aguacagguaaggugagggaaua

SEQ ID NO: 2131707 - RNA, 22 nt, Human
aguaauuaucgggaacaguguu

SEQ ID NO: 2131708 - RNA, 20 nt, Human
aguaauuaucgggaacagug

SEQ ID NO: 2131709 - RNA, 21 nt, Human
aguacagguaaggugagggaa

SEQ ID NO: 2131710 - RNA, 18 nt, Human
aguacauauuaggaaaau

SEQ ID NO: 2131711 - RNA, 19 nt, Human
aguacagugguucuacaau

SEQ ID NO: 2131712 - RNA, 21 nt, Human
aguacagugguucuacaaucu

SEQ ID NO: 2131713 - RNA, 22 nt, Human
aguacagugguucuacaaucua

SEQ ID NO: 2131714 - RNA, 22 nt, Human
aguacauaaaggugguaugugu

SEQ ID NO: 2131715 - RNA, 17 nt, Human
aguacauauuaggaaaa

SEQ ID NO: 2131716 - RNA, 13 nt, Human
aguaauuaucggg

SEQ ID NO: 2131717 - RNA, 21 nt, Human
aguagaagucuuagauguaua

SEQ ID NO: 2131718 - RNA, 19 nt, Human
aguagaagucuuagaugua

SEQ ID NO: 2131719 - RNA, 20 nt, Human
aguagaagucuuagauguau

SEQ ID NO: 2131720 - RNA, 12 nt, Human
aguacccaccug

SEQ ID NO: 2131721 - RNA, 13 nt, Human
aguacccaccuga

SEQ ID NO: 2131722 - RNA, 15 nt, Human
aguacccaccugagc

SEQ ID NO: 2131723 - RNA, 16 nt, Human
aguacccaccugagcu

SEQ ID NO: 2131724 - RNA, 17 nt, Human
aguacccaccugagcuu

SEQ ID NO: 2131725 - RNA, 22 nt, Human
aguacccaccugagcuuuggac

SEQ ID NO: 2131726 - RNA, 17 nt, Human
uguaggcuuuacuuagc

SEQ ID NO: 2131727 - RNA, 20 nt, Human
uguaggcuuuacuuagcuua

SEQ ID NO: 2131728 - RNA, 15 nt, Human
uguaguauaaagaaa

SEQ ID NO: 2131729 - RNA, 11 nt, Human
aguagagacag

SEQ ID NO: 2131730 - RNA, 13 nt, Human
aguagaccccugg

SEQ ID NO: 2131731 - RNA, 16 nt, Human
aguagaccccuggcug

SEQ ID NO: 2131732 - RNA, 17 nt, Human
aguagccgagagccugc

SEQ ID NO: 2131733 - RNA, 18 nt, Human
aguagccgagagccugcu

SEQ ID NO: 2131734 - RNA, 19 nt, Human
aguagccgagagccugcuc

SEQ ID NO: 2131735 - RNA, 22 nt, Human
aguagccccaacccaaaccugg

SEQ ID NO: 2131736 - RNA, 23 nt, Human
aguagccccaacccaaaccugga

SEQ ID NO: 2131737 - RNA, 15 nt, Human
aguagccgagagccu

SEQ ID NO: 2131738 - RNA, 16 nt, Human
aguagccgagagccug

SEQ ID NO: 2131739 - RNA, 19 nt, Human
ugguuuccucauuccugaa

SEQ ID NO: 2131740 - RNA, 12 nt, Human
ugguuauacaug

SEQ ID NO: 2131741 - RNA, 13 nt, Human
ugguuauacauga

SEQ ID NO: 2131742 - RNA, 17 nt, Human
ugguuauacaugacacu

SEQ ID NO: 2131743 - RNA, 19 nt, Human
ugguuauacaugacacuga

SEQ ID NO: 2131744 - RNA, 21 nt, Human
ugguuauacaugacacugaaa

SEQ ID NO: 2131745 - RNA, 14 nt, Human
ugguuauggagagg

SEQ ID NO: 2131746 - RNA, 14 nt, Human
ugguuuucaaaaua

SEQ ID NO: 2131747 - RNA, 15 nt, Human
ugguuuucaaaauaa

SEQ ID NO: 2131748 - RNA, 17 nt, Human
ugguuuucaaaauaaaa

SEQ ID NO: 2131749 - RNA, 16 nt, Human
uguaaaguguaaaucc

SEQ ID NO: 2131750 - RNA, 17 nt, Human
uguaaaguguaaauccu

SEQ ID NO: 2131751 - RNA, 19 nt, Human
uguaaauaaccccauucuu

SEQ ID NO: 2131752 - RNA, 21 nt, Human
uguaaauaaccccauucuuug

SEQ ID NO: 2131753 - RNA, 23 nt, Human
uguaaauaaccccauucuuugcu

SEQ ID NO: 2131754 - RNA, 12 nt, Human
uguaaauaagag

SEQ ID NO: 2131755 - RNA, 15 nt, Human
uguaaauaagagauu

SEQ ID NO: 2131756 - RNA, 21 nt, Human
uguaaauacuguuuuuaacaa

SEQ ID NO: 2131757 - RNA, 16 nt, Human
uguaaauagcucaggu

SEQ ID NO: 2131758 - RNA, 15 nt, Human
uguaaauagcucagg

SEQ ID NO: 2131759 - RNA, 20 nt, Human
aggugugcucugaucaucca

SEQ ID NO: 2131760 - RNA, 15 nt, Human
aggugugcucugauc

SEQ ID NO: 2131761 - RNA, 17 nt, Human
aggugugaaccaccaca

SEQ ID NO: 2131762 - RNA, 14 nt, Human
agguggggguuggc

SEQ ID NO: 2131763 - RNA, 18 nt, Human
agguggggguuggcuggg

SEQ ID NO: 2131764 - RNA, 20 nt, Human
agguggggguuggcugggua

SEQ ID NO: 2131765 - RNA, 19 nt, Human
agguucugguuagcucagc

SEQ ID NO: 2131766 - RNA, 20 nt, Human
agguucugguuagcucagcc

SEQ ID NO: 2131767 - RNA, 21 nt, Human
agguucugguuagcucagccc

SEQ ID NO: 2131768 - RNA, 22 nt, Human
agguucugguuagcucagcccc

SEQ ID NO: 2131769 - RNA, 16 nt, Human
agguucuuacugcuug

SEQ ID NO: 2131770 - RNA, 17 nt, Human
agguucuuagugucacu

SEQ ID NO: 2131771 - RNA, 14 nt, Human
agguucuuacugcu

SEQ ID NO: 2131772 - RNA, 14 nt, Human
agguuuaagcuguu

SEQ ID NO: 2131773 - RNA, 21 nt, Human
aggugcaucuggggaacuaga

SEQ ID NO: 2131774 - RNA, 23 nt, Human
aggugcaucuggggaacuagagg

SEQ ID NO: 2131775 - RNA, 20 nt, Human
aggugauccacccaccucag

SEQ ID NO: 2131776 - RNA, 14 nt, Human
aggugauccaccca

SEQ ID NO: 2131777 - RNA, 17 nt, Human
aggugccccucucucca

SEQ ID NO: 2131778 - RNA, 17 nt, Human
aggugccccaaaaugca

SEQ ID NO: 2131779 - RNA, 20 nt, Human
aggugcccacauguguccau

SEQ ID NO: 2131780 - RNA, 23 nt, Human
agguggggcagcuugaggguugg

SEQ ID NO: 2131781 - RNA, 16 nt, Human
agguggggcagcuuga

SEQ ID NO: 2131782 - RNA, 11 nt, Human
aggugccugug

SEQ ID NO: 2131783 - RNA, 17 nt, Human
aggugccugugaggcag

SEQ ID NO: 2131784 - RNA, 23 nt, Human
aggugggauaucccuaugcugcc

SEQ ID NO: 2131785 - RNA, 19 nt, Human
aggugcccuuggaggccag

SEQ ID NO: 2131786 - RNA, 20 nt, Human
aggugcccuuggaggccagc

SEQ ID NO: 2131787 - RNA, 21 nt, Human
aggugcccuuggaggccagcc

SEQ ID NO: 2131788 - RNA, 22 nt, Human
aggugcccuuggaggccagcca

SEQ ID NO: 2131789 - RNA, 21 nt, Human
uggugccucuggaggccucug

SEQ ID NO: 2131790 - RNA, 18 nt, Human
uggugcugccacacuuca

SEQ ID NO: 2131791 - RNA, 19 nt, Human
uggugcugcugcugcugug

SEQ ID NO: 2131792 - RNA, 12 nt, Human
uggugcuggaua

SEQ ID NO: 2131793 - RNA, 17 nt, Human
uggugcuggauauuuuc

SEQ ID NO: 2131794 - RNA, 21 nt, Human
uggugcuggauauuuucaaau

SEQ ID NO: 2131795 - RNA, 18 nt, Human
uggugcuggauauuuuca

SEQ ID NO: 2131796 - RNA, 13 nt, Human
uggugcugccaca

SEQ ID NO: 2131797 - RNA, 14 nt, Human
uggugcucauuuca

SEQ ID NO: 2131798 - RNA, 17 nt, Human
uggugcgaucuggguuc

SEQ ID NO: 2131799 - RNA, 18 nt, Human
uggugcgggcacaauaaa

SEQ ID NO: 2131800 - RNA, 19 nt, Human
uggugcgggcacaauaaau

SEQ ID NO: 2131801 - RNA, 16 nt, Human
uggugcgaucuggguu

SEQ ID NO: 2131802 - RNA, 13 nt, Human
uggugccuuuccu

SEQ ID NO: 2131803 - RNA, 15 nt, Human
uggugccuuuccugu

SEQ ID NO: 2131804 - RNA, 19 nt, Human
uggugccuuuccuguucag

SEQ ID NO: 2131805 - RNA, 20 nt, Human
uggugccuuuccuguucagc

SEQ ID NO: 2131806 - RNA, 22 nt, Human
uggugccuuuccuguucagcau

SEQ ID NO: 2131807 - RNA, 20 nt, Human
uggugcgaucauggcucacu

SEQ ID NO: 2131808 - RNA, 16 nt, Human
ugguggacaguccugg

SEQ ID NO: 2131809 - RNA, 17 nt, Human
ugguggacaguccuggg

SEQ ID NO: 2131810 - RNA, 18 nt, Human
ugguggacaguccuggga

SEQ ID NO: 2131811 - RNA, 14 nt, Human
ugguggauguaaau

SEQ ID NO: 2131812 - RNA, 15 nt, Human
ugguggauguaaaua

SEQ ID NO: 2131813 - RNA, 12 nt, Human
ugguggcagugg

SEQ ID NO: 2131814 - RNA, 15 nt, Human
ugguggcagcugcgg

SEQ ID NO: 2131815 - RNA, 13 nt, Human
ugguggcagcugc

SEQ ID NO: 2131816 - RNA, 14 nt, Human
ugguggcagcugcg

SEQ ID NO: 2131817 - RNA, 13 nt, Human
ugguuagcucagc

SEQ ID NO: 2131818 - RNA, 15 nt, Human
ugguuagcucagccc

SEQ ID NO: 2131819 - RNA, 16 nt, Human
ugguuagcucagcccc

SEQ ID NO: 2131820 - RNA, 18 nt, Human
ugguuagcucagccccag

SEQ ID NO: 2131821 - RNA, 19 nt, Human
ugguuagcucagccccagc

SEQ ID NO: 2131822 - RNA, 20 nt, Human
ugguuagcucagccccagcc

SEQ ID NO: 2131823 - RNA, 21 nt, Human
ugguuagcucagccccagccc

SEQ ID NO: 2131824 - RNA, 22 nt, Human
ugguuagcucagccccagccca

SEQ ID NO: 2131825 - RNA, 23 nt, Human
ugguuagcucagccccagcccag

SEQ ID NO: 2131826 - RNA, 13 nt, Human
ugguuaaugccau

SEQ ID NO: 2131827 - RNA, 13 nt, Human
ugguuacacuguu

SEQ ID NO: 2131828 - RNA, 14 nt, Human
ugguuacacuguua

SEQ ID NO: 2131829 - RNA, 21 nt, Human
ugguuacacuguuagaacacu

SEQ ID NO: 2131830 - RNA, 22 nt, Human
ugguuacacuguuagaacacua

SEQ ID NO: 2131831 - RNA, 23 nt, Human
ugguuacacuguuagaacacuau

SEQ ID NO: 2131832 - RNA, 21 nt, Human
ugguggcagugcagcaaccag

SEQ ID NO: 2131833 - RNA, 15 nt, Human
uggugugaaagucag

SEQ ID NO: 2131834 - RNA, 18 nt, Human
aggucagagccugcaguu

SEQ ID NO: 2131835 - RNA, 17 nt, Human
aggucagagccugcagu

SEQ ID NO: 2131836 - RNA, 15 nt, Human
aggucagagccugca

SEQ ID NO: 2131837 - RNA, 14 nt, Human
aggucagagccugc

SEQ ID NO: 2131838 - RNA, 13 nt, Human
aggucagagccug

SEQ ID NO: 2131839 - RNA, 16 nt, Human
uggucagauuugaacu

SEQ ID NO: 2131840 - RNA, 15 nt, Human
uggucagauuugaac

SEQ ID NO: 2131841 - RNA, 13 nt, Human
uggucacugccau

SEQ ID NO: 2131842 - RNA, 14 nt, Human
uggucacugccaug

SEQ ID NO: 2131843 - RNA, 22 nt, Human
uggucacugccauggaggcaca

SEQ ID NO: 2131844 - RNA, 16 nt, Human
aggucuugaacuccug

SEQ ID NO: 2131845 - RNA, 22 nt, Human
uggucagacacaaacaaacaag

SEQ ID NO: 2131846 - RNA, 21 nt, Human
uggucagaguaagcugcuuuu

SEQ ID NO: 2131847 - RNA, 16 nt, Human
aggucagcuugcugcc

SEQ ID NO: 2131848 - RNA, 18 nt, Human
aggucagcuugcugcccu

SEQ ID NO: 2131849 - RNA, 15 nt, Human
aggucaggaguuccu

SEQ ID NO: 2131850 - RNA, 19 nt, Human
aggucaggaguuagaggcc

SEQ ID NO: 2131851 - RNA, 21 nt, Human
aggucaggaguuagaggccag

SEQ ID NO: 2131852 - RNA, 16 nt, Human
aggucaggaguuccua

SEQ ID NO: 2131853 - RNA, 20 nt, Human
aggucaggaguuccuaacca

SEQ ID NO: 2131854 - RNA, 15 nt, Human
aggugacagagugag

SEQ ID NO: 2131855 - RNA, 13 nt, Human
aggugacagagug

SEQ ID NO: 2131856 - RNA, 17 nt, Human
aggucuugaacuccugg

SEQ ID NO: 2131857 - RNA, 18 nt, Human
aggucuugaacuccuggc

SEQ ID NO: 2131858 - RNA, 13 nt, Human
aggugaccccagg

SEQ ID NO: 2131859 - RNA, 18 nt, Human
aggugacagugagguccu

SEQ ID NO: 2131860 - RNA, 21 nt, Human
aggugacagugagguccuggg

SEQ ID NO: 2131861 - RNA, 22 nt, Human
aggugacagagugagacucugu

SEQ ID NO: 2131862 - RNA, 13 nt, Human
aggugagggaagc

SEQ ID NO: 2131863 - RNA, 21 nt, Human
aggugagaagcagaggaagga

SEQ ID NO: 2131864 - RNA, 23 nt, Human
aggugagaagcagaggaaggaga

SEQ ID NO: 2131865 - RNA, 16 nt, Human
aggugagaagcagagg

SEQ ID NO: 2131866 - RNA, 16 nt, Human
aggugaccuucuggga

SEQ ID NO: 2131867 - RNA, 19 nt, Human
ugggagacacccaaagggu

SEQ ID NO: 2131868 - RNA, 18 nt, Human
ugggagacugcugaguca

SEQ ID NO: 2131869 - RNA, 14 nt, Human
ugggagagcccagc

SEQ ID NO: 2131870 - RNA, 18 nt, Human
ugggagagcccagccauu

SEQ ID NO: 2131871 - RNA, 18 nt, Human
ugggaggaucucuugagc

SEQ ID NO: 2131872 - RNA, 20 nt, Human
ugggacucaaugcacugaca

SEQ ID NO: 2131873 - RNA, 15 nt, Human
ugggacuaaaugccc

SEQ ID NO: 2131874 - RNA, 18 nt, Human
ugggacuaaaugcccugc

SEQ ID NO: 2131875 - RNA, 18 nt, Human
ugggacugcugcuucuua

SEQ ID NO: 2131876 - RNA, 12 nt, Human
ugggacuggagu

SEQ ID NO: 2131877 - RNA, 13 nt, Human
ugggacuggaguc

SEQ ID NO: 2131878 - RNA, 18 nt, Human
ugggacuggagucccugu

SEQ ID NO: 2131879 - RNA, 23 nt, Human
ugggacuggccagguuucugccc

SEQ ID NO: 2131880 - RNA, 14 nt, Human
ugggagaaccucag

SEQ ID NO: 2131881 - RNA, 15 nt, Human
ugggagaaccucagg

SEQ ID NO: 2131882 - RNA, 22 nt, Human
ugggagaagggggucaaagcaa

SEQ ID NO: 2131883 - RNA, 23 nt, Human
ugggagaagggggucaaagcaag

SEQ ID NO: 2131884 - RNA, 22 nt, Human
ugggagaaccucaggcuuccuu

SEQ ID NO: 2131885 - RNA, 23 nt, Human
ugggagaaccucaggcuuccuug

SEQ ID NO: 2131886 - RNA, 21 nt, Human
ugggagaauucuuacauguuu

SEQ ID NO: 2131887 - RNA, 22 nt, Human
ugggagaauucuuacauguuuu

SEQ ID NO: 2131888 - RNA, 13 nt, Human
agggagcugggac

SEQ ID NO: 2131889 - RNA, 13 nt, Human
agggagcacuggg

SEQ ID NO: 2131890 - RNA, 15 nt, Human
agggagagccagcuc

SEQ ID NO: 2131891 - RNA, 14 nt, Human
agggagagcggggc

SEQ ID NO: 2131892 - RNA, 16 nt, Human
agggagagcggggcag

SEQ ID NO: 2131893 - RNA, 10 nt, Human
agggacagag

SEQ ID NO: 2131894 - RNA, 18 nt, Human
agggacagagacaccugc

SEQ ID NO: 2131895 - RNA, 19 nt, Human
agggacagagacaccugca

SEQ ID NO: 2131896 - RNA, 20 nt, Human
agggacagagacaccugcac

SEQ ID NO: 2131897 - RNA, 16 nt, Human
ugggacuacaggcacc

SEQ ID NO: 2131898 - RNA, 15 nt, Human
ugggacuacaggcac

SEQ ID NO: 2131899 - RNA, 14 nt, Human
ugggacuacaggca

SEQ ID NO: 2131900 - RNA, 21 nt, Human
agggaggaaucgaggaaccag

SEQ ID NO: 2131901 - RNA, 22 nt, Human
agggaggaaucgaggaaccaga

SEQ ID NO: 2131902 - RNA, 23 nt, Human
agggaggaaucgaggaaccagag

SEQ ID NO: 2131903 - RNA, 16 nt, Human
agggaagcuggccgag

SEQ ID NO: 2131904 - RNA, 16 nt, Human
agggaagaucuaacau

SEQ ID NO: 2131905 - RNA, 13 nt, Human
agggaagcuggcc

SEQ ID NO: 2131906 - RNA, 12 nt, Human
agggaagcccag

SEQ ID NO: 2131907 - RNA, 13 nt, Human
agggaagcccagc

SEQ ID NO: 2131908 - RNA, 14 nt, Human
agggaagcccagcu

SEQ ID NO: 2131909 - RNA, 18 nt, Human
agggaagcccagcuccag

SEQ ID NO: 2131910 - RNA, 23 nt, Human
agggaagcccagcuccagggcca

SEQ ID NO: 2131911 - RNA, 24 nt, Human
agggaagcccagcuccagggccag

SEQ ID NO: 2131912 - RNA, 16 nt, Human
agggaagccugaaaaa

SEQ ID NO: 2131913 - RNA, 14 nt, Human
agggaagagugcau

SEQ ID NO: 2131914 - RNA, 13 nt, Human
agggaagagaaac

SEQ ID NO: 2131915 - RNA, 14 nt, Human
agggaagagaaaca

SEQ ID NO: 2131916 - RNA, 15 nt, Human
agggaagagaaacag

SEQ ID NO: 2131917 - RNA, 13 nt, Human
agggaacagacag

SEQ ID NO: 2131918 - RNA, 14 nt, Human
agggaacagacagg

SEQ ID NO: 2131919 - RNA, 15 nt, Human
agggaacagacagga

SEQ ID NO: 2131920 - RNA, 21 nt, Human
agggaacagacaggagaaaug

SEQ ID NO: 2131921 - RNA, 14 nt, Human
agggaacaggaaaa

SEQ ID NO: 2131922 - RNA, 17 nt, Human
agggaacagacaggaga

SEQ ID NO: 2131923 - RNA, 18 nt, Human
agggaacagacaggagaa

SEQ ID NO: 2131924 - RNA, 19 nt, Human
agggaacagacaggagaaa

SEQ ID NO: 2131925 - RNA, 20 nt, Human
agggaacagacaggagaaau

SEQ ID NO: 2131926 - RNA, 16 nt, Human
agggaagaaaagagcu

SEQ ID NO: 2131927 - RNA, 19 nt, Human
agggaacgggguccuucaa

SEQ ID NO: 2131928 - RNA, 15 nt, Human
aggcccggggcuggc

SEQ ID NO: 2131929 - RNA, 20 nt, Human
aggcccggcuccaggcuccu

SEQ ID NO: 2131930 - RNA, 18 nt, Human
aggcccggcuccaggcuc

SEQ ID NO: 2131931 - RNA, 21 nt, Human
aggcccggcuccaggcuccuu

SEQ ID NO: 2131932 - RNA, 13 nt, Human
aggcccggggcug

SEQ ID NO: 2131933 - RNA, 14 nt, Human
aggcccggggcugg

SEQ ID NO: 2131934 - RNA, 15 nt, Human
aggcccguccggcag

SEQ ID NO: 2131935 - RNA, 21 nt, Human
agggaaggggaggcagccggc

SEQ ID NO: 2131936 - RNA, 20 nt, Human
agggaaggggaggcagccgg

SEQ ID NO: 2131937 - RNA, 16 nt, Human
agggaaggccaccugc

SEQ ID NO: 2131938 - RNA, 17 nt, Human
agggaaggccaccugca

SEQ ID NO: 2131939 - RNA, 16 nt, Human
agggaaggccccacag

SEQ ID NO: 2131940 - RNA, 15 nt, Human
agggaauggcacagc

SEQ ID NO: 2131941 - RNA, 15 nt, Human
agggaauuucaggaa

SEQ ID NO: 2131942 - RNA, 16 nt, Human
agggaauugcagagua

SEQ ID NO: 2131943 - RNA, 14 nt, Human
agggaauucucuug

SEQ ID NO: 2131944 - RNA, 15 nt, Human
agggaauucucuugg

SEQ ID NO: 2131945 - RNA, 18 nt, Human
agggaauugaggucugcu

SEQ ID NO: 2131946 - RNA, 19 nt, Human
agggacaaauuuaaaacaa

SEQ ID NO: 2131947 - RNA, 20 nt, Human
agggacaaauuuaaaacaaa

SEQ ID NO: 2131948 - RNA, 15 nt, Human
agggaaguccccagg

SEQ ID NO: 2131949 - RNA, 13 nt, Human
agggaaguuuugu

SEQ ID NO: 2131950 - RNA, 21 nt, Human
agggaaugaaggugucagaau

SEQ ID NO: 2131951 - RNA, 18 nt, Human
agggcaugcauuuugcag

SEQ ID NO: 2131952 - RNA, 15 nt, Human
agggccacgugccag

SEQ ID NO: 2131953 - RNA, 16 nt, Human
agggccacgugccagg

SEQ ID NO: 2131954 - RNA, 17 nt, Human
agggcaugcgcacaagg

SEQ ID NO: 2131955 - RNA, 21 nt, Human
agggcaugcgcacaaggcuga

SEQ ID NO: 2131956 - RNA, 23 nt, Human
agggcaggaaggagagccugcug

SEQ ID NO: 2131957 - RNA, 19 nt, Human
agggcaggaaggagagccu

SEQ ID NO: 2131958 - RNA, 21 nt, Human
agggcaggaaggagagccugc

SEQ ID NO: 2131959 - RNA, 16 nt, Human
agggcaggaaggagag

SEQ ID NO: 2131960 - RNA, 18 nt, Human
agggcaggaaggagagcc

SEQ ID NO: 2131961 - RNA, 12 nt, Human
agggcaucuccu

SEQ ID NO: 2131962 - RNA, 21 nt, Human
agggcaucuccugugcauggg

SEQ ID NO: 2131963 - RNA, 23 nt, Human
agggcaucuccugugcaugggug

SEQ ID NO: 2131964 - RNA, 13 nt, Human
agggcaucuccug

SEQ ID NO: 2131965 - RNA, 14 nt, Human
agggcaucuccugu

SEQ ID NO: 2131966 - RNA, 16 nt, Human
agggcaucuccugugc

SEQ ID NO: 2131967 - RNA, 14 nt, Human
agggcacugguggc

SEQ ID NO: 2131968 - RNA, 16 nt, Human
agggcacugcugcugc

SEQ ID NO: 2131969 - RNA, 16 nt, Human
agggcacugguggccc

SEQ ID NO: 2131970 - RNA, 16 nt, Human
agggcccugagcucgg

SEQ ID NO: 2131971 - RNA, 13 nt, Human
agggcccuaccug

SEQ ID NO: 2131972 - RNA, 12 nt, Human
agggcccugcag

SEQ ID NO: 2131973 - RNA, 13 nt, Human
agggcccugcaga

SEQ ID NO: 2131974 - RNA, 12 nt, Human
agggcucagccu

SEQ ID NO: 2131975 - RNA, 13 nt, Human
agggcucagccug

SEQ ID NO: 2131976 - RNA, 23 nt, Human
agggcucagcggggacagcuccu

SEQ ID NO: 2131977 - RNA, 22 nt, Human
agggcucagcggggacagcucc

SEQ ID NO: 2131978 - RNA, 20 nt, Human
agggcucagcggggacagcu

SEQ ID NO: 2131979 - RNA, 19 nt, Human
agggcucagcggggacagc

SEQ ID NO: 2131980 - RNA, 15 nt, Human
agggcccacuuguau

SEQ ID NO: 2131981 - RNA, 23 nt, Human
agggcccacuuguauccucuggu

SEQ ID NO: 2131982 - RNA, 15 nt, Human
agggccaugaacuuu

SEQ ID NO: 2131983 - RNA, 19 nt, Human
agggccaguccugccuggc

SEQ ID NO: 2131984 - RNA, 21 nt, Human
agggccaguccugccuggcca

SEQ ID NO: 2131985 - RNA, 22 nt, Human
agggccaguccugccuggccag

SEQ ID NO: 2131986 - RNA, 23 nt, Human
agggccaguccugccuggccagg

SEQ ID NO: 2131987 - RNA, 18 nt, Human
agggccacgugccaggcc

SEQ ID NO: 2131988 - RNA, 19 nt, Human
agggccacgugccaggccc

SEQ ID NO: 2131989 - RNA, 20 nt, Human
agggccacgugccaggcccg

SEQ ID NO: 2131990 - RNA, 14 nt, Human
agggccacucugcc

SEQ ID NO: 2131991 - RNA, 15 nt, Human
agggccacucugccu

SEQ ID NO: 2131992 - RNA, 18 nt, Human
agggccacucugccucug

SEQ ID NO: 2131993 - RNA, 20 nt, Human
agggcaccaagcccacaggu

SEQ ID NO: 2131994 - RNA, 14 nt, Human
ugggccccucugac

SEQ ID NO: 2131995 - RNA, 14 nt, Human
ugggccaguguggg

SEQ ID NO: 2131996 - RNA, 11 nt, Human
ugggccccucc

SEQ ID NO: 2131997 - RNA, 13 nt, Human
ugggccccucccu

SEQ ID NO: 2131998 - RNA, 14 nt, Human
ugggccccucccua

SEQ ID NO: 2131999 - RNA, 16 nt, Human
ugggccccucccuacc

SEQ ID NO: 2132000 - RNA, 18 nt, Human
ugggccccucccuaccuc

SEQ ID NO: 2132001 - RNA, 19 nt, Human
ugggccccucccuaccuca

SEQ ID NO: 2132002 - RNA, 20 nt, Human
ugggccccucccuaccucaa

SEQ ID NO: 2132003 - RNA, 16 nt, Human
ugggcacuggauuagu

SEQ ID NO: 2132004 - RNA, 18 nt, Human
ugggcagaaggccaagag

SEQ ID NO: 2132005 - RNA, 17 nt, Human
ugggcagaaggccaaga

SEQ ID NO: 2132006 - RNA, 16 nt, Human
ugggcagaaggccaag

SEQ ID NO: 2132007 - RNA, 15 nt, Human
ugggcagaaggccaa

SEQ ID NO: 2132008 - RNA, 20 nt, Human
ugggaggaucucuugagccu

SEQ ID NO: 2132009 - RNA, 21 nt, Human
ugggaggaucucuugagccug

SEQ ID NO: 2132010 - RNA, 22 nt, Human
ugggaggaucucuugagccugg

SEQ ID NO: 2132011 - RNA, 19 nt, Human
ugggaggccaaggugggag

SEQ ID NO: 2132012 - RNA, 20 nt, Human
ugggaggccaaggugggagg

SEQ ID NO: 2132013 - RNA, 20 nt, Human
ugggaggcagagguugcagu

SEQ ID NO: 2132014 - RNA, 14 nt, Human
ugggaggccaagga

SEQ ID NO: 2132015 - RNA, 16 nt, Human
ugggaggccccacugg

SEQ ID NO: 2132016 - RNA, 19 nt, Human
ugggcacgcugugggcagg

SEQ ID NO: 2132017 - RNA, 21 nt, Human
ugggcacgcugugggcaggug

SEQ ID NO: 2132018 - RNA, 20 nt, Human
ugggaggccccacuggggaa

SEQ ID NO: 2132019 - RNA, 19 nt, Human
ugggcaccuauaauaccag

SEQ ID NO: 2132020 - RNA, 15 nt, Human
ugggcaccuggggag

SEQ ID NO: 2132021 - RNA, 18 nt, Human
ugggaggccccacugggg

SEQ ID NO: 2132022 - RNA, 17 nt, Human
ugggcaccuggggagug

SEQ ID NO: 2132023 - RNA, 19 nt, Human
ugggcaccuggggaguggg

SEQ ID NO: 2132024 - RNA, 20 nt, Human
ugggcaccuggggaguggga

SEQ ID NO: 2132025 - RNA, 16 nt, Human
ugggguccuggggccu

SEQ ID NO: 2132026 - RNA, 21 nt, Human
uggggucucacaguguugccc

SEQ ID NO: 2132027 - RNA, 23 nt, Human
uggggucucacaguguugcccag

SEQ ID NO: 2132028 - RNA, 13 nt, Human
uggggucucccuc

SEQ ID NO: 2132029 - RNA, 19 nt, Human
uggggucucccucuccugc

SEQ ID NO: 2132030 - RNA, 21 nt, Human
uggggucucccucuccugccu

SEQ ID NO: 2132031 - RNA, 22 nt, Human
uggggucucccucuccugccua

SEQ ID NO: 2132032 - RNA, 19 nt, Human
ugggguacccacugcucug

SEQ ID NO: 2132033 - RNA, 18 nt, Human
ugggguacccacugcucu

SEQ ID NO: 2132034 - RNA, 17 nt, Human
ugggguacccacugcuc

SEQ ID NO: 2132035 - RNA, 19 nt, Human
uggggcugcuccuccaggg

SEQ ID NO: 2132036 - RNA, 21 nt, Human
uggggcugcuccuccagggcc

SEQ ID NO: 2132037 - RNA, 14 nt, Human
uggggcugcuccuc

SEQ ID NO: 2132038 - RNA, 15 nt, Human
uggggcugcuccucc

SEQ ID NO: 2132039 - RNA, 16 nt, Human
uggggcugcuccucca

SEQ ID NO: 2132040 - RNA, 17 nt, Human
uggggcugcuccuccag

SEQ ID NO: 2132041 - RNA, 13 nt, Human
uggggugggagag

SEQ ID NO: 2132042 - RNA, 15 nt, Human
uggggugggagaggu

SEQ ID NO: 2132043 - RNA, 14 nt, Human
uggggugaggacca

SEQ ID NO: 2132044 - RNA, 17 nt, Human
uggggugaggaccacuc

SEQ ID NO: 2132045 - RNA, 19 nt, Human
uggggugcccuccacugcc

SEQ ID NO: 2132046 - RNA, 23 nt, Human
aggggaaaccaguguagccuugc

SEQ ID NO: 2132047 - RNA, 20 nt, Human
aggggaaaccaguguagccu

SEQ ID NO: 2132048 - RNA, 21 nt, Human
aggggaaaccaguguagccuu

SEQ ID NO: 2132049 - RNA, 14 nt, Human
aggggaacagacug

SEQ ID NO: 2132050 - RNA, 18 nt, Human
aggggaaaaucagccugc

SEQ ID NO: 2132051 - RNA, 22 nt, Human
aggggaaaaucagccugcucca

SEQ ID NO: 2132052 - RNA, 17 nt, Human
aggggaagcacucgugu

SEQ ID NO: 2132053 - RNA, 13 nt, Human
aggggaauguuug

SEQ ID NO: 2132054 - RNA, 17 nt, Human
aggggaauaauagaaga

SEQ ID NO: 2132055 - RNA, 18 nt, Human
aggggaauaauagaagaa

SEQ ID NO: 2132056 - RNA, 19 nt, Human
aggggaauaauagaagaac

SEQ ID NO: 2132057 - RNA, 11 nt, Human
aggggaauauu

SEQ ID NO: 2132058 - RNA, 16 nt, Human
aggggaauauuuuauu

SEQ ID NO: 2132059 - RNA, 19 nt, Human
aggggaauauuuuauucaa

SEQ ID NO: 2132060 - RNA, 22 nt, Human
aggggaauauuuuauucaaggu

SEQ ID NO: 2132061 - RNA, 23 nt, Human
aggggaauauuuuauucaaggua

SEQ ID NO: 2132062 - RNA, 21 nt, Human
uggggccccuuuuuacucccc

SEQ ID NO: 2132063 - RNA, 22 nt, Human
uggggccccuuuuuacuccccu

SEQ ID NO: 2132064 - RNA, 19 nt, Human
uggggaggggcggcaggag

SEQ ID NO: 2132065 - RNA, 14 nt, Human
agggcucagccugg

SEQ ID NO: 2132066 - RNA, 15 nt, Human
agggcucagccuggu

SEQ ID NO: 2132067 - RNA, 23 nt, Human
agggcucuaaaaaaagccccaaa

SEQ ID NO: 2132068 - RNA, 15 nt, Human
agggcucuaaaaaaa

SEQ ID NO: 2132069 - RNA, 15 nt, Human
agggcucugauauuc

SEQ ID NO: 2132070 - RNA, 22 nt, Human
agggcucugauauuccaugaau

SEQ ID NO: 2132071 - RNA, 20 nt, Human
agggcugacacguccacccc

SEQ ID NO: 2132072 - RNA, 17 nt, Human
agggcucugauauucca

SEQ ID NO: 2132073 - RNA, 21 nt, Human
agggcucugauauuccaugaa

SEQ ID NO: 2132074 - RNA, 22 nt, Human
uggggagccaacagaagcuucc

SEQ ID NO: 2132075 - RNA, 16 nt, Human
uggggagccaacagaa

SEQ ID NO: 2132076 - RNA, 23 nt, Human
uggggagacauaaccacugcuuc

SEQ ID NO: 2132077 - RNA, 20 nt, Human
uggggagaucggggccagag

SEQ ID NO: 2132078 - RNA, 23 nt, Human
uggggagaucggggccagaggca

SEQ ID NO: 2132079 - RNA, 15 nt, Human
uggggagcagagaca

SEQ ID NO: 2132080 - RNA, 17 nt, Human
uggggagcagagacacu

SEQ ID NO: 2132081 - RNA, 12 nt, Human
aggggguuacaa

SEQ ID NO: 2132082 - RNA, 14 nt, Human
aggggguuacaaac

SEQ ID NO: 2132083 - RNA, 19 nt, Human
aggggguuacaaacugcaa

SEQ ID NO: 2132084 - RNA, 20 nt, Human
aggggguuacaaacugcaau

SEQ ID NO: 2132085 - RNA, 16 nt, Human
aggggguuugggggcu

SEQ ID NO: 2132086 - RNA, 22 nt, Human
aggggguuugggggcuugcaag

SEQ ID NO: 2132087 - RNA, 21 nt, Human
aggggucaaguuauuaauuuc

SEQ ID NO: 2132088 - RNA, 15 nt, Human
aggggucaaguuauu

SEQ ID NO: 2132089 - RNA, 16 nt, Human
agggucucacucuguc

SEQ ID NO: 2132090 - RNA, 14 nt, Human
aggguaaggugccu

SEQ ID NO: 2132091 - RNA, 15 nt, Human
agggucucacucugu

SEQ ID NO: 2132092 - RNA, 14 nt, Human
agggucucacucug

SEQ ID NO: 2132093 - RNA, 22 nt, Human
agggguuuucgaagcucagccc

SEQ ID NO: 2132094 - RNA, 21 nt, Human
agggguuuucgaagcucagcc

SEQ ID NO: 2132095 - RNA, 14 nt, Human
aggguaaauuauuc

SEQ ID NO: 2132096 - RNA, 15 nt, Human
aggguaaauuauuca

SEQ ID NO: 2132097 - RNA, 17 nt, Human
aggguaaauuauucagu

SEQ ID NO: 2132098 - RNA, 21 nt, Human
agggguggaggagagccuggu

SEQ ID NO: 2132099 - RNA, 19 nt, Human
agggguugguugaggugga

SEQ ID NO: 2132100 - RNA, 23 nt, Human
agggguugguugagguggaagcc

SEQ ID NO: 2132101 - RNA, 20 nt, Human
agggguugguugagguggaa

SEQ ID NO: 2132102 - RNA, 15 nt, Human
agggguuucuaacac

SEQ ID NO: 2132103 - RNA, 21 nt, Human
aggggaauguuugccucugcc

SEQ ID NO: 2132104 - RNA, 20 nt, Human
aggggaauguuugccucugc

SEQ ID NO: 2132105 - RNA, 19 nt, Human
aggggaauguuugccucug

SEQ ID NO: 2132106 - RNA, 17 nt, Human
agggggcaucuggccuu

SEQ ID NO: 2132107 - RNA, 10 nt, Human
agggggccac

SEQ ID NO: 2132108 - RNA, 15 nt, Human
agggggccaccuccc

SEQ ID NO: 2132109 - RNA, 22 nt, Human
aggggcugcugaccuccacagc

SEQ ID NO: 2132110 - RNA, 19 nt, Human
agggggccaccuccccagg

SEQ ID NO: 2132111 - RNA, 15 nt, Human
agggggccaggugca

SEQ ID NO: 2132112 - RNA, 11 nt, Human
aggggcucugc

SEQ ID NO: 2132113 - RNA, 16 nt, Human
aggggagcucugucug

SEQ ID NO: 2132114 - RNA, 17 nt, Human
aggggagcucugucugu

SEQ ID NO: 2132115 - RNA, 13 nt, Human
aggggcuccugga

SEQ ID NO: 2132116 - RNA, 14 nt, Human
aggggcuccuggaa

SEQ ID NO: 2132117 - RNA, 23 nt, Human
aggggcuccuggaaaggcucagu

SEQ ID NO: 2132118 - RNA, 16 nt, Human
aggguggugaccucug

SEQ ID NO: 2132119 - RNA, 17 nt, Human
agggugggauggaggag

SEQ ID NO: 2132120 - RNA, 18 nt, Human
agggugggauggaggaga

SEQ ID NO: 2132121 - RNA, 13 nt, Human
agggucuggagaa

SEQ ID NO: 2132122 - RNA, 14 nt, Human
agggucuggagaag

SEQ ID NO: 2132123 - RNA, 19 nt, Human
agggucuggagaagcagug

SEQ ID NO: 2132124 - RNA, 15 nt, Human
agggucuggagaagc

SEQ ID NO: 2132125 - RNA, 15 nt, Human
agggucuucccuacc

SEQ ID NO: 2132126 - RNA, 17 nt, Human
agggucuucccuaccuc

SEQ ID NO: 2132127 - RNA, 18 nt, Human
uggguccucacaucuuuc

SEQ ID NO: 2132128 - RNA, 17 nt, Human
ugggucccccacgugac

SEQ ID NO: 2132129 - RNA, 15 nt, Human
ugggugcccacagcc

SEQ ID NO: 2132130 - RNA, 16 nt, Human
ugggugcccacagccc

SEQ ID NO: 2132131 - RNA, 18 nt, Human
ugggugcccacagcccgc

SEQ ID NO: 2132132 - RNA, 23 nt, Human
ugggugcccacagcccgcaugca

SEQ ID NO: 2132133 - RNA, 23 nt, Human
ugggugccccccuugccagacau

SEQ ID NO: 2132134 - RNA, 23 nt, Human
ugggugaccaguugcacuuggcc

SEQ ID NO: 2132135 - RNA, 17 nt, Human
ugggugacagagcaaga

SEQ ID NO: 2132136 - RNA, 14 nt, Human
ugggugacagagca

SEQ ID NO: 2132137 - RNA, 15 nt, Human
ugggugaagggagag

SEQ ID NO: 2132138 - RNA, 20 nt, Human
ugguagaauuggagaguaaa

SEQ ID NO: 2132139 - RNA, 20 nt, Human
ugguagagugugccugaagu

SEQ ID NO: 2132140 - RNA, 22 nt, Human
ugguaagaagccgggaacagac

SEQ ID NO: 2132141 - RNA, 14 nt, Human
ugguaagagaaugu

SEQ ID NO: 2132142 - RNA, 16 nt, Human
ugguaagagaauguua

SEQ ID NO: 2132143 - RNA, 23 nt, Human
ugguaagagaauguuauagugaa

SEQ ID NO: 2132144 - RNA, 13 nt, Human
ugguaaagauauu

SEQ ID NO: 2132145 - RNA, 17 nt, Human
ugguaaagauauuauuc

SEQ ID NO: 2132146 - RNA, 18 nt, Human
ugguaaagauauuauuca

SEQ ID NO: 2132147 - RNA, 22 nt, Human
ugguaaagauauuauucaccau

SEQ ID NO: 2132148 - RNA, 21 nt, Human
ugguaaauuaguauuuauuua

SEQ ID NO: 2132149 - RNA, 17 nt, Human
uggguggcaccagcagc

SEQ ID NO: 2132150 - RNA, 20 nt, Human
uggguggcaccagcagccug

SEQ ID NO: 2132151 - RNA, 21 nt, Human
uggguggcaccagcagccugg

SEQ ID NO: 2132152 - RNA, 13 nt, Human
uuaauaaagacag

SEQ ID NO: 2132153 - RNA, 14 nt, Human
uuaauaaagacagg

SEQ ID NO: 2132154 - RNA, 22 nt, Human
uuaauaaagacgauuugucagu

SEQ ID NO: 2132155 - RNA, 14 nt, Human
uuaaguaucagaaa

SEQ ID NO: 2132156 - RNA, 18 nt, Human
uuaauaacauaacaaaua

SEQ ID NO: 2132157 - RNA, 23 nt, Human
uuaaugaaagacuguacaaagua

SEQ ID NO: 2132158 - RNA, 20 nt, Human
uuaaugaaagacuguacaaa

SEQ ID NO: 2132159 - RNA, 17 nt, Human
uuaaguuggcuucuguu

SEQ ID NO: 2132160 - RNA, 18 nt, Human
uuaaguuggcuucuguuu

SEQ ID NO: 2132161 - RNA, 21 nt, Human
uuaaguuggcuucuguuucua

SEQ ID NO: 2132162 - RNA, 22 nt, Human
uuaaguuggcuucuguuucuag

SEQ ID NO: 2132163 - RNA, 23 nt, Human
uuaaguuggcuucuguuucuagu

SEQ ID NO: 2132164 - RNA, 15 nt, Human
uuaauucauguuucu

SEQ ID NO: 2132165 - RNA, 14 nt, Human
uuaauucauguuuc

SEQ ID NO: 2132166 - RNA, 22 nt, Human
auaaaauucuauuacaguaugu

SEQ ID NO: 2132167 - RNA, 19 nt, Human
uuaauuuuuuugagacaga

SEQ ID NO: 2132168 - RNA, 15 nt, Human
uuacaaaaagacacu

SEQ ID NO: 2132169 - RNA, 13 nt, Human
auaaaauuaagaa

SEQ ID NO: 2132170 - RNA, 16 nt, Human
auaaaauuaagaaugu

SEQ ID NO: 2132171 - RNA, 15 nt, Human
auaaaauuaaagaaa

SEQ ID NO: 2132172 - RNA, 17 nt, Human
auaaaauuaaagaaaau

SEQ ID NO: 2132173 - RNA, 18 nt, Human
auaaaauuaaagaaaaua

SEQ ID NO: 2132174 - RNA, 21 nt, Human
auaaaauuaaagaaaauaaaa

SEQ ID NO: 2132175 - RNA, 13 nt, Human
auaaaauuaugcc

SEQ ID NO: 2132176 - RNA, 13 nt, Human
uuacaaaagaugu

SEQ ID NO: 2132177 - RNA, 14 nt, Human
uuacaaaagaugua

SEQ ID NO: 2132178 - RNA, 18 nt, Human
uuacaaaagauguauccu

SEQ ID NO: 2132179 - RNA, 16 nt, Human
auaaaauuaaagcuga

SEQ ID NO: 2132180 - RNA, 22 nt, Human
uuaaguuacacauuuuucagau

SEQ ID NO: 2132181 - RNA, 18 nt, Human
uuaaguuagggaauggca

SEQ ID NO: 2132182 - RNA, 19 nt, Human
uuaaguguacuaauuaaca

SEQ ID NO: 2132183 - RNA, 21 nt, Human
uuaaguguuguaaauauuuau

SEQ ID NO: 2132184 - RNA, 16 nt, Human
uuaagugcuuuguaau

SEQ ID NO: 2132185 - RNA, 16 nt, Human
uuaagugaugaacauu

SEQ ID NO: 2132186 - RNA, 17 nt, Human
uuaaguacuauguauca

SEQ ID NO: 2132187 - RNA, 13 nt, Human
uuaagaggcaggg

SEQ ID NO: 2132188 - RNA, 16 nt, Human
uuaagaggcagggucu

SEQ ID NO: 2132189 - RNA, 15 nt, Human
uuaagaggcaggguc

SEQ ID NO: 2132190 - RNA, 13 nt, Human
uuaaguaaacuaa

SEQ ID NO: 2132191 - RNA, 19 nt, Human
uuaaguaaacuaaugaguu

SEQ ID NO: 2132192 - RNA, 15 nt, Human
auaaaaguacauguu

SEQ ID NO: 2132193 - RNA, 21 nt, Human
auaaaaguacauguuaaacuu

SEQ ID NO: 2132194 - RNA, 13 nt, Human
auaaaagugauca

SEQ ID NO: 2132195 - RNA, 17 nt, Human
auaaaagugaucaauaa

SEQ ID NO: 2132196 - RNA, 18 nt, Human
auaaaagugaucaauaaa

SEQ ID NO: 2132197 - RNA, 22 nt, Human
auaaaagugaucaauaaaaugu

SEQ ID NO: 2132198 - RNA, 16 nt, Human
auaaaaggucuaugcu

SEQ ID NO: 2132199 - RNA, 18 nt, Human
aguuucagguguuuaguu

SEQ ID NO: 2132200 - RNA, 13 nt, Human
auaaaauaaagua

SEQ ID NO: 2132201 - RNA, 14 nt, Human
auaaaauaaaguau

SEQ ID NO: 2132202 - RNA, 16 nt, Human
auaaaaguugcaaagg

SEQ ID NO: 2132203 - RNA, 16 nt, Human
auaaaauaaaguauau

SEQ ID NO: 2132204 - RNA, 21 nt, Human
auaaaaugguguuuucaugua

SEQ ID NO: 2132205 - RNA, 22 nt, Human
auaaaaugguguuuucauguaa

SEQ ID NO: 2132206 - RNA, 13 nt, Human
auaaaaugugauu

SEQ ID NO: 2132207 - RNA, 20 nt, Human
auaaaaugugauuuuucuga

SEQ ID NO: 2132208 - RNA, 18 nt, Human
auaaaaucauguacauuu

SEQ ID NO: 2132209 - RNA, 20 nt, Human
auaaaaucauguacauuucu

SEQ ID NO: 2132210 - RNA, 19 nt, Human
auaacuagaacugaauuuu

SEQ ID NO: 2132211 - RNA, 13 nt, Human
auaacuacugugu

SEQ ID NO: 2132212 - RNA, 15 nt, Human
auaacuacuguguuc

SEQ ID NO: 2132213 - RNA, 22 nt, Human
auaaauguauucaaauaccaau

SEQ ID NO: 2132214 - RNA, 21 nt, Human
auaacuaacaaccaaagacua

SEQ ID NO: 2132215 - RNA, 17 nt, Human
auaaaugucauuaaaau

SEQ ID NO: 2132216 - RNA, 16 nt, Human
auaacuaaaagguaug

SEQ ID NO: 2132217 - RNA, 18 nt, Human
auaaauguaucuuauuca

SEQ ID NO: 2132218 - RNA, 15 nt, Human
auaaauguaucuuau

SEQ ID NO: 2132219 - RNA, 16 nt, Human
auaaaugaaguuuaua

SEQ ID NO: 2132220 - RNA, 17 nt, Human
auaaaugaaguuuauac

SEQ ID NO: 2132221 - RNA, 18 nt, Human
auaaaugaaguuuauaca

SEQ ID NO: 2132222 - RNA, 21 nt, Human
auaaaugaaguuuauacagua

SEQ ID NO: 2132223 - RNA, 22 nt, Human
auaaaugaaguuuauacaguac

SEQ ID NO: 2132224 - RNA, 11 nt, Human
auaaaugaaug

SEQ ID NO: 2132225 - RNA, 13 nt, Human
uuacagcugccug

SEQ ID NO: 2132226 - RNA, 16 nt, Human
auaacuaguguugcuu

SEQ ID NO: 2132227 - RNA, 17 nt, Human
uuacagccucacuugaa

SEQ ID NO: 2132228 - RNA, 19 nt, Human
auaacuacuguguuccugg

SEQ ID NO: 2132229 - RNA, 16 nt, Human
auaacuacuguguucc

SEQ ID NO: 2132230 - RNA, 18 nt, Human
auaacuacuguguuccug

SEQ ID NO: 2132231 - RNA, 14 nt, Human
uuacagcugccugc

SEQ ID NO: 2132232 - RNA, 12 nt, Human
auaaauaacuuu

SEQ ID NO: 2132233 - RNA, 14 nt, Human
auaaauaacuuuuu

SEQ ID NO: 2132234 - RNA, 18 nt, Human
auaaaguuggugacagau

SEQ ID NO: 2132235 - RNA, 21 nt, Human
auaaauaaucggcccacagcu

SEQ ID NO: 2132236 - RNA, 13 nt, Human
auaaaguguuuuc

SEQ ID NO: 2132237 - RNA, 15 nt, Human
auaaaguguuuucag

SEQ ID NO: 2132238 - RNA, 16 nt, Human
auaaaguguuuucaga

SEQ ID NO: 2132239 - RNA, 17 nt, Human
auaaaguguuuucagag

SEQ ID NO: 2132240 - RNA, 18 nt, Human
auaaaguguuuucagagc

SEQ ID NO: 2132241 - RNA, 14 nt, Human
auaaacacauagau

SEQ ID NO: 2132242 - RNA, 15 nt, Human
auaaacacauagauu

SEQ ID NO: 2132243 - RNA, 20 nt, Human
auaaacacauagauucaccu

SEQ ID NO: 2132244 - RNA, 23 nt, Human
auaaacacauagauucaccugua

SEQ ID NO: 2132245 - RNA, 24 nt, Human
auaaacacauagauucaccuguaa

SEQ ID NO: 2132246 - RNA, 22 nt, Human
auaaaguugaagcuaagauuua

SEQ ID NO: 2132247 - RNA, 21 nt, Human
auaaaguucugaguguuuuua

SEQ ID NO: 2132248 - RNA, 17 nt, Human
auaaaguuggugacaga

SEQ ID NO: 2132249 - RNA, 16 nt, Human
auaaaguuggugacag

SEQ ID NO: 2132250 - RNA, 11 nt, Human
auaaauagcua

SEQ ID NO: 2132251 - RNA, 20 nt, Human
uuacauaagauaaaugugcu

SEQ ID NO: 2132252 - RNA, 14 nt, Human
uuacauacugcugu

SEQ ID NO: 2132253 - RNA, 18 nt, Human
uuacaucaaggcuucaaa

SEQ ID NO: 2132254 - RNA, 16 nt, Human
uuacauaguguaggcu

SEQ ID NO: 2132255 - RNA, 20 nt, Human
uuacauaguguaggcuuuac

SEQ ID NO: 2132256 - RNA, 21 nt, Human
uuacauaguguaggcuuuacu

SEQ ID NO: 2132257 - RNA, 22 nt, Human
uuacauauuugcauauguauga

SEQ ID NO: 2132258 - RNA, 17 nt, Human
uuacauccuuguggcac

SEQ ID NO: 2132259 - RNA, 21 nt, Human
uuacauccuuguggcacauuu

SEQ ID NO: 2132260 - RNA, 14 nt, Human
uuacaucuguuuua

SEQ ID NO: 2132261 - RNA, 18 nt, Human
uuacaucuguuuuaaauu

SEQ ID NO: 2132262 - RNA, 13 nt, Human
uuaccugugaaau

SEQ ID NO: 2132263 - RNA, 21 nt, Human
uuacucaaaguuaaccuaccu

SEQ ID NO: 2132264 - RNA, 19 nt, Human
uuacuauuuuacuucuaga

SEQ ID NO: 2132265 - RNA, 14 nt, Human
uuacuauuaagcag

SEQ ID NO: 2132266 - RNA, 19 nt, Human
uuacuauuaagcaguaaaa

SEQ ID NO: 2132267 - RNA, 23 nt, Human
uuacuauuaagcaguaaaaacug

SEQ ID NO: 2132268 - RNA, 19 nt, Human
uuacugagcuucucuguga

SEQ ID NO: 2132269 - RNA, 13 nt, Human
uuacugaucaugc

SEQ ID NO: 2132270 - RNA, 14 nt, Human
uuacugaucaugca

SEQ ID NO: 2132271 - RNA, 15 nt, Human
uuacugaucaugcau

SEQ ID NO: 2132272 - RNA, 16 nt, Human
uuacugaucaugcauu

SEQ ID NO: 2132273 - RNA, 17 nt, Human
uuacugaucaugcauug

SEQ ID NO: 2132274 - RNA, 18 nt, Human
uuacugaucaugcauugu

SEQ ID NO: 2132275 - RNA, 21 nt, Human
uuacugaucaugcauuguuga

SEQ ID NO: 2132276 - RNA, 12 nt, Human
uuacucagcccu

SEQ ID NO: 2132277 - RNA, 13 nt, Human
uuacugagcuucu

SEQ ID NO: 2132278 - RNA, 12 nt, Human
uuacugaccagc

SEQ ID NO: 2132279 - RNA, 18 nt, Human
uuacugagcuucucugug

SEQ ID NO: 2132280 - RNA, 17 nt, Human
uuacugagcuucucugu

SEQ ID NO: 2132281 - RNA, 16 nt, Human
uuacugagcuucucug

SEQ ID NO: 2132282 - RNA, 14 nt, Human
uuacugagcuucuc

SEQ ID NO: 2132283 - RNA, 14 nt, Human
uuagacaaaucuaa

SEQ ID NO: 2132284 - RNA, 22 nt, Human
uuagacaaaucuaagggaaaaa

SEQ ID NO: 2132285 - RNA, 11 nt, Human
uuagacagagu

SEQ ID NO: 2132286 - RNA, 13 nt, Human
uuagaaccuuucu

SEQ ID NO: 2132287 - RNA, 11 nt, Human
uuagaaauaua

SEQ ID NO: 2132288 - RNA, 17 nt, Human
uuagaaauaaagcaucu

SEQ ID NO: 2132289 - RNA, 22 nt, Human
uuagaaauaaagcaucucauuu

SEQ ID NO: 2132290 - RNA, 19 nt, Human
uuagaaauaaauguaccug

SEQ ID NO: 2132291 - RNA, 13 nt, Human
uuagaaauagaca

SEQ ID NO: 2132292 - RNA, 15 nt, Human
uuagaaauagacagu

SEQ ID NO: 2132293 - RNA, 12 nt, Human
uuagaaauauaa

SEQ ID NO: 2132294 - RNA, 14 nt, Human
uuagaaauauaauu

SEQ ID NO: 2132295 - RNA, 19 nt, Human
uuacugaucaugcauuguu

SEQ ID NO: 2132296 - RNA, 22 nt, Human
uuacugcagccuuugccucccc

SEQ ID NO: 2132297 - RNA, 20 nt, Human
aguucuuaguugcuguaugu

SEQ ID NO: 2132298 - RNA, 21 nt, Human
aguucuuaguugcuguauguc

SEQ ID NO: 2132299 - RNA, 22 nt, Human
aguucuuaaggauugugauauu

SEQ ID NO: 2132300 - RNA, 14 nt, Human
aguucuuagauauc

SEQ ID NO: 2132301 - RNA, 15 nt, Human
aguucuuagauaucu

SEQ ID NO: 2132302 - RNA, 18 nt, Human
aguucuuagauaucuuuu

SEQ ID NO: 2132303 - RNA, 21 nt, Human
aguucuuagauaucuuuuuau

SEQ ID NO: 2132304 - RNA, 20 nt, Human
aguugcacuuggccucugga

SEQ ID NO: 2132305 - RNA, 11 nt, Human
aguugcagaaa

SEQ ID NO: 2132306 - RNA, 16 nt, Human
aguugcagacucaguu

SEQ ID NO: 2132307 - RNA, 17 nt, Human
aguugcagacucaguuu

SEQ ID NO: 2132308 - RNA, 18 nt, Human
aguugcagacucaguuug

SEQ ID NO: 2132309 - RNA, 22 nt, Human
aguugcagacucaguuugucag

SEQ ID NO: 2132310 - RNA, 16 nt, Human
aguugcagauucauuu

SEQ ID NO: 2132311 - RNA, 20 nt, Human
aguugcgacggagagaaaaa

SEQ ID NO: 2132312 - RNA, 21 nt, Human
aguugcgacggagagaaaaaa

SEQ ID NO: 2132313 - RNA, 22 nt, Human
aguugcgacggagagaaaaaag

SEQ ID NO: 2132314 - RNA, 23 nt, Human
aguugcagacucaguuugucaga

SEQ ID NO: 2132315 - RNA, 16 nt, Human
aguuggcuaggacccc

SEQ ID NO: 2132316 - RNA, 16 nt, Human
aguuggccagagagcc

SEQ ID NO: 2132317 - RNA, 21 nt, Human
aguugcuccgccucugcuggc

SEQ ID NO: 2132318 - RNA, 17 nt, Human
aguuggguggaugccug

SEQ ID NO: 2132319 - RNA, 13 nt, Human
aguuggcuucuaa

SEQ ID NO: 2132320 - RNA, 23 nt, Human
aguugggaacuucagauggaccu

SEQ ID NO: 2132321 - RNA, 21 nt, Human
aguuggguggaugccuggugg

SEQ ID NO: 2132322 - RNA, 15 nt, Human
aguuggcuucuguuu

SEQ ID NO: 2132323 - RNA, 19 nt, Human
aguuggcuucuguuucuag

SEQ ID NO: 2132324 - RNA, 22 nt, Human
aguuggcuucuguuucuaguug

SEQ ID NO: 2132325 - RNA, 13 nt, Human
aguugguguguuu

SEQ ID NO: 2132326 - RNA, 23 nt, Human
aguugguguguuuuugggauguc

SEQ ID NO: 2132327 - RNA, 13 nt, Human
aguuggugacaga

SEQ ID NO: 2132328 - RNA, 19 nt, Human
aguuguuuucagacucaga

SEQ ID NO: 2132329 - RNA, 15 nt, Human
uuaaauuucuaccgc

SEQ ID NO: 2132330 - RNA, 20 nt, Human
uuaaauucuuuuuuaaauuu

SEQ ID NO: 2132331 - RNA, 22 nt, Human
uuaaauucuuuuuuaaauuuuc

SEQ ID NO: 2132332 - RNA, 19 nt, Human
uuaacaaacccucguuucu

SEQ ID NO: 2132333 - RNA, 23 nt, Human
uuaacaaacccucguuucugauu

SEQ ID NO: 2132334 - RNA, 16 nt, Human
uuaaauuuuaauuuau

SEQ ID NO: 2132335 - RNA, 15 nt, Human
uuaaauuuuaauuua

SEQ ID NO: 2132336 - RNA, 18 nt, Human
aguuucagagaaguucug

SEQ ID NO: 2132337 - RNA, 12 nt, Human
aguuucagagaa

SEQ ID NO: 2132338 - RNA, 15 nt, Human
aguuucacugacuua

SEQ ID NO: 2132339 - RNA, 17 nt, Human
aguuucaauucagugcu

SEQ ID NO: 2132340 - RNA, 11 nt, Human
uuaacauaaag

SEQ ID NO: 2132341 - RNA, 21 nt, Human
uuaacauaaagguuauuuucu

SEQ ID NO: 2132342 - RNA, 17 nt, Human
uuaacaguuuuccauga

SEQ ID NO: 2132343 - RNA, 19 nt, Human
uuaacaguuuuccaugaaa

SEQ ID NO: 2132344 - RNA, 20 nt, Human
uuaacaguuuuccaugaaaa

SEQ ID NO: 2132345 - RNA, 21 nt, Human
uuaacaguuuuccaugaaaac

SEQ ID NO: 2132346 - RNA, 13 nt, Human
uuaacaguuuucc

SEQ ID NO: 2132347 - RNA, 14 nt, Human
uuaacaguuuucca

SEQ ID NO: 2132348 - RNA, 16 nt, Human
uuaacaguuuuccaug

SEQ ID NO: 2132349 - RNA, 21 nt, Human
uuaaaggggcagaaaaacucu

SEQ ID NO: 2132350 - RNA, 21 nt, Human
uuaaauaaaugucauuaaaau

SEQ ID NO: 2132351 - RNA, 18 nt, Human
uuaaauaaaugucauuaa

SEQ ID NO: 2132352 - RNA, 20 nt, Human
uuaaauaaaugucauuaaaa

SEQ ID NO: 2132353 - RNA, 15 nt, Human
uuaaaauuuauugcu

SEQ ID NO: 2132354 - RNA, 17 nt, Human
uuaaaggcuaccuuauu

SEQ ID NO: 2132355 - RNA, 15 nt, Human
uuaaaggcuguggua

SEQ ID NO: 2132356 - RNA, 16 nt, Human
uuaaaaaauuuuugaa

SEQ ID NO: 2132357 - RNA, 17 nt, Human
uuaaaaaauuuuugaaa

SEQ ID NO: 2132358 - RNA, 13 nt, Human
uuaaaaaaugucc

SEQ ID NO: 2132359 - RNA, 16 nt, Human
uuaaaaaauguccaug

SEQ ID NO: 2132360 - RNA, 15 nt, Human
aguuuauacaguaca

SEQ ID NO: 2132361 - RNA, 14 nt, Human
aguuuauacaguuu

SEQ ID NO: 2132362 - RNA, 22 nt, Human
aguuuauacaguuuuaaagaau

SEQ ID NO: 2132363 - RNA, 20 nt, Human
aguuuagugugauaaaggca

SEQ ID NO: 2132364 - RNA, 17 nt, Human
aguuuaagaccagccug

SEQ ID NO: 2132365 - RNA, 23 nt, Human
uuaaaaagggcagggcaucuccu

SEQ ID NO: 2132366 - RNA, 13 nt, Human
uuaaaauuuauau

SEQ ID NO: 2132367 - RNA, 12 nt, Human
uuaaaauuuauu

SEQ ID NO: 2132368 - RNA, 16 nt, Human
aguucuuaguugcugu

SEQ ID NO: 2132369 - RNA, 12 nt, Human
aguucugggugc

SEQ ID NO: 2132370 - RNA, 19 nt, Human
aguucugggugcucccuac

SEQ ID NO: 2132371 - RNA, 17 nt, Human
aguucugggugcucccu

SEQ ID NO: 2132372 - RNA, 20 nt, Human
uguuuugauguuuguggccu

SEQ ID NO: 2132373 - RNA, 14 nt, Human
aguucugaguguuu

SEQ ID NO: 2132374 - RNA, 15 nt, Human
aguucugaguguuuu

SEQ ID NO: 2132375 - RNA, 15 nt, Human
aguucugcaaauaga

SEQ ID NO: 2132376 - RNA, 16 nt, Human
aguucugcaaauagaa

SEQ ID NO: 2132377 - RNA, 18 nt, Human
aguucugcaaauagaaaa

SEQ ID NO: 2132378 - RNA, 20 nt, Human
aguucugcaaauagaaaaca

SEQ ID NO: 2132379 - RNA, 22 nt, Human
aguucugaguguuuuuacuaca

SEQ ID NO: 2132380 - RNA, 16 nt, Human
uguuugcaauaucgau

SEQ ID NO: 2132381 - RNA, 18 nt, Human
uguuugcaauaucgauca

SEQ ID NO: 2132382 - RNA, 15 nt, Human
uguuugcuuauuguu

SEQ ID NO: 2132383 - RNA, 16 nt, Human
uguuugcuuauuguuc

SEQ ID NO: 2132384 - RNA, 18 nt, Human
uguuugcuuauuguucca

SEQ ID NO: 2132385 - RNA, 15 nt, Human
uguuugcuucaacug

SEQ ID NO: 2132386 - RNA, 20 nt, Human
uguuugcuuauuguuccaag

SEQ ID NO: 2132387 - RNA, 21 nt, Human
uguuugcuuauuguuccaaga

SEQ ID NO: 2132388 - RNA, 23 nt, Human
uguuugcuuauuguuccaagaca

SEQ ID NO: 2132389 - RNA, 12 nt, Human
uguuuucccuga

SEQ ID NO: 2132390 - RNA, 15 nt, Human
uguuuucauaauaaa

SEQ ID NO: 2132391 - RNA, 19 nt, Human
uguuuucauguaaauaaau

SEQ ID NO: 2132392 - RNA, 20 nt, Human
uguuuucauguaaauaaaua

SEQ ID NO: 2132393 - RNA, 16 nt, Human
uguuuucccugaccuc

SEQ ID NO: 2132394 - RNA, 18 nt, Human
uguuucuuccaaagcaca

SEQ ID NO: 2132395 - RNA, 17 nt, Human
uguuucuuccaaagcac

SEQ ID NO: 2132396 - RNA, 19 nt, Human
uguuucuuccaaagcacau

SEQ ID NO: 2132397 - RNA, 22 nt, Human
uguuuauuuauaagcagauuua

SEQ ID NO: 2132398 - RNA, 23 nt, Human
uguuuauuuauaagcagauuuaa

SEQ ID NO: 2132399 - RNA, 15 nt, Human
uguuuauuuaucagu

SEQ ID NO: 2132400 - RNA, 14 nt, Human
uguuugagcucaga

SEQ ID NO: 2132401 - RNA, 23 nt, Human
uguuugagcucagacccccacuc

SEQ ID NO: 2132402 - RNA, 16 nt, Human
uguuugaaaauauuau

SEQ ID NO: 2132403 - RNA, 19 nt, Human
uguuugaaaauauuaucuu

SEQ ID NO: 2132404 - RNA, 22 nt, Human
uguuugaaaauauuaucuuugu

SEQ ID NO: 2132405 - RNA, 13 nt, Human
uguuugagcucag

SEQ ID NO: 2132406 - RNA, 22 nt, Human
uguuugacaaagaaacccaagu

SEQ ID NO: 2132407 - RNA, 21 nt, Human
uguuugacaaagaaacccaag

SEQ ID NO: 2132408 - RNA, 13 nt, Human
uguuuauuaacaa

SEQ ID NO: 2132409 - RNA, 14 nt, Human
uguuuauuaacaaa

SEQ ID NO: 2132410 - RNA, 16 nt, Human
uguuuauuaacaaauu

SEQ ID NO: 2132411 - RNA, 19 nt, Human
uguuuauuaacaaauuaug

SEQ ID NO: 2132412 - RNA, 14 nt, Human
uguuuaucagcagu

SEQ ID NO: 2132413 - RNA, 19 nt, Human
uguuuaucagcaguuguua

SEQ ID NO: 2132414 - RNA, 15 nt, Human
uguuuauacagcuca

SEQ ID NO: 2132415 - RNA, 15 nt, Human
uguuuauauuuucaa

SEQ ID NO: 2132416 - RNA, 14 nt, Human
uguuuaguugcaga

SEQ ID NO: 2132417 - RNA, 14 nt, Human
uguugcucagaagu

SEQ ID NO: 2132418 - RNA, 23 nt, Human
uguugcucagcaaggggcucugc

SEQ ID NO: 2132419 - RNA, 19 nt, Human
uguugcucaaaaaaugagc

SEQ ID NO: 2132420 - RNA, 19 nt, Human
uguugcccaggcaggucuu

SEQ ID NO: 2132421 - RNA, 17 nt, Human
aguggaaguaguggagc

SEQ ID NO: 2132422 - RNA, 20 nt, Human
aguggacaccaggagucccu

SEQ ID NO: 2132423 - RNA, 22 nt, Human
aguggacaccaggagucccugg

SEQ ID NO: 2132424 - RNA, 20 nt, Human
aguggaccaggacaggacca

SEQ ID NO: 2132425 - RNA, 16 nt, Human
aguggaccaggacagg

SEQ ID NO: 2132426 - RNA, 19 nt, Human
aguggaccaggacaggacc

SEQ ID NO: 2132427 - RNA, 13 nt, Human
aguggaccaggac

SEQ ID NO: 2132428 - RNA, 14 nt, Human
aguggaccaggaca

SEQ ID NO: 2132429 - RNA, 15 nt, Human
aguggaccaggacag

SEQ ID NO: 2132430 - RNA, 17 nt, Human
aguggugcgaucugggu

SEQ ID NO: 2132431 - RNA, 22 nt, Human
agugguggcagugcagcaacca

SEQ ID NO: 2132432 - RNA, 14 nt, Human
agugguggcucuga

SEQ ID NO: 2132433 - RNA, 15 nt, Human
agugguggcucugag

SEQ ID NO: 2132434 - RNA, 16 nt, Human
agugguggcucugaga

SEQ ID NO: 2132435 - RNA, 16 nt, Human
agugugcacgaguggg

SEQ ID NO: 2132436 - RNA, 19 nt, Human
agugugcacgagugggaag

SEQ ID NO: 2132437 - RNA, 22 nt, Human
agugugcacgagugggaaggac

SEQ ID NO: 2132438 - RNA, 15 nt, Human
aguguguauuguucc

SEQ ID NO: 2132439 - RNA, 16 nt, Human
aguguguauuguuccc

SEQ ID NO: 2132440 - RNA, 14 nt, Human
aguguaaauccuuu

SEQ ID NO: 2132441 - RNA, 21 nt, Human
aguguaaauccuuuuucuuua

SEQ ID NO: 2132442 - RNA, 13 nt, Human
aguguaacaagaa

SEQ ID NO: 2132443 - RNA, 15 nt, Human
aguguaacaagaaag

SEQ ID NO: 2132444 - RNA, 16 nt, Human
aguguaacaagaaagg

SEQ ID NO: 2132445 - RNA, 17 nt, Human
aguguaacaagaaagga

SEQ ID NO: 2132446 - RNA, 19 nt, Human
aguguaacaagaaaggaga

SEQ ID NO: 2132447 - RNA, 20 nt, Human
aguguaacaagaaaggagag

SEQ ID NO: 2132448 - RNA, 13 nt, Human
aguguaacagcug

SEQ ID NO: 2132449 - RNA, 14 nt, Human
aguguaacagcuga

SEQ ID NO: 2132450 - RNA, 15 nt, Human
aguguaacagcugag

SEQ ID NO: 2132451 - RNA, 16 nt, Human
aguguaacagcugagg

SEQ ID NO: 2132452 - RNA, 17 nt, Human
aguguaacagcugaggu

SEQ ID NO: 2132453 - RNA, 16 nt, Human
aguguacuaauuaaca

SEQ ID NO: 2132454 - RNA, 23 nt, Human
aguguacuaauuaacauauaaua

SEQ ID NO: 2132455 - RNA, 17 nt, Human
agugguguuuuaaagag

SEQ ID NO: 2132456 - RNA, 18 nt, Human
uguuauagguuguuggau

SEQ ID NO: 2132457 - RNA, 20 nt, Human
uguuccacaaguuaaauaaa

SEQ ID NO: 2132458 - RNA, 19 nt, Human
aguguguauuguucccagu

SEQ ID NO: 2132459 - RNA, 21 nt, Human
aguguguauuguucccaguga

SEQ ID NO: 2132460 - RNA, 18 nt, Human
aguguguccaagugugug

SEQ ID NO: 2132461 - RNA, 21 nt, Human
aguguguccaagugugugugc

SEQ ID NO: 2132462 - RNA, 17 nt, Human
agugugugcaaguaugu

SEQ ID NO: 2132463 - RNA, 13 nt, Human
agugugucuccug

SEQ ID NO: 2132464 - RNA, 14 nt, Human
agugugucuccugc

SEQ ID NO: 2132465 - RNA, 15 nt, Human
agugugucuccugca

SEQ ID NO: 2132466 - RNA, 19 nt, Human
agugugucuccugcaugca

SEQ ID NO: 2132467 - RNA, 18 nt, Human
agugugugcacaugugug

SEQ ID NO: 2132468 - RNA, 19 nt, Human
agugugugcacaugugugc

SEQ ID NO: 2132469 - RNA, 20 nt, Human
agugugugcacaugugugcg

SEQ ID NO: 2132470 - RNA, 16 nt, Human
uguucugggacacagu

SEQ ID NO: 2132471 - RNA, 15 nt, Human
uguuccuaaguucuu

SEQ ID NO: 2132472 - RNA, 18 nt, Human
uguuccuaaguucuuaga

SEQ ID NO: 2132473 - RNA, 20 nt, Human
uguuccuaaguucuuagaua

SEQ ID NO: 2132474 - RNA, 22 nt, Human
uguucccagugacacuucagag

SEQ ID NO: 2132475 - RNA, 14 nt, Human
uguuccagcucuuu

SEQ ID NO: 2132476 - RNA, 21 nt, Human
uguucccaccaggcugcucag

SEQ ID NO: 2132477 - RNA, 20 nt, Human
uguucccaccaggcugcuca

SEQ ID NO: 2132478 - RNA, 18 nt, Human
uguugcccaggcaggucu

SEQ ID NO: 2132479 - RNA, 17 nt, Human
uguugcccaggcagguc

SEQ ID NO: 2132480 - RNA, 16 nt, Human
uguugcccaggcaggu

SEQ ID NO: 2132481 - RNA, 15 nt, Human
uguugcccaggcagg

SEQ ID NO: 2132482 - RNA, 12 nt, Human
uguugcccaggc

SEQ ID NO: 2132483 - RNA, 13 nt, Human
uguugcccaggca

SEQ ID NO: 2132484 - RNA, 19 nt, Human
uguugcaaguacugcugua

SEQ ID NO: 2132485 - RNA, 17 nt, Human
uguugcaaguacugcug

SEQ ID NO: 2132486 - RNA, 15 nt, Human
uguucuguuuguuaa

SEQ ID NO: 2132487 - RNA, 16 nt, Human
uguucuguuuguuaaa

SEQ ID NO: 2132488 - RNA, 17 nt, Human
uguucuguuuguuaaaa

SEQ ID NO: 2132489 - RNA, 20 nt, Human
uguucuguuuguuaaaacug

SEQ ID NO: 2132490 - RNA, 21 nt, Human
uguucuguuuguuaaaacugg

SEQ ID NO: 2132491 - RNA, 13 nt, Human
uguucuguuuugu

SEQ ID NO: 2132492 - RNA, 23 nt, Human
agugcugaagcuuauuaaugcua

SEQ ID NO: 2132493 - RNA, 21 nt, Human
agugcugaagcuuauuaaugc

SEQ ID NO: 2132494 - RNA, 22 nt, Human
agugcugaagcuuauuaaugcu

SEQ ID NO: 2132495 - RNA, 12 nt, Human
agugcugaagcu

SEQ ID NO: 2132496 - RNA, 13 nt, Human
agugcugaagcuu

SEQ ID NO: 2132497 - RNA, 15 nt, Human
agugcugaagcuuau

SEQ ID NO: 2132498 - RNA, 16 nt, Human
agugcugaagcuuauu

SEQ ID NO: 2132499 - RNA, 21 nt, Human
agugcugggauuacaggugug

SEQ ID NO: 2132500 - RNA, 12 nt, Human
agugcuguaaaa

SEQ ID NO: 2132501 - RNA, 20 nt, Human
agugcugggauuacaggugu

SEQ ID NO: 2132502 - RNA, 18 nt, Human
uguguaacugcccaaagc

SEQ ID NO: 2132503 - RNA, 21 nt, Human
uguguaacugcccaaagcagc

SEQ ID NO: 2132504 - RNA, 14 nt, Human
agugcuguggccug

SEQ ID NO: 2132505 - RNA, 16 nt, Human
agugcuguggccuggg

SEQ ID NO: 2132506 - RNA, 17 nt, Human
agugcuguggccugggc

SEQ ID NO: 2132507 - RNA, 18 nt, Human
agugcuguggccugggca

SEQ ID NO: 2132508 - RNA, 20 nt, Human
agugcuguggccugggcaag

SEQ ID NO: 2132509 - RNA, 14 nt, Human
uguguguguauguu

SEQ ID NO: 2132510 - RNA, 19 nt, Human
ugugugugggcugugagug

SEQ ID NO: 2132511 - RNA, 14 nt, Human
uguguguguaugcu

SEQ ID NO: 2132512 - RNA, 13 nt, Human
uguguguguaugu

SEQ ID NO: 2132513 - RNA, 16 nt, Human
ugugucuuguguuuuu

SEQ ID NO: 2132514 - RNA, 21 nt, Human
ugugucuugcaauggcagccu

SEQ ID NO: 2132515 - RNA, 14 nt, Human
uguguaagagaaug

SEQ ID NO: 2132516 - RNA, 18 nt, Human
uguguaagagaauguuga

SEQ ID NO: 2132517 - RNA, 19 nt, Human
uguguaagagaauguugaa

SEQ ID NO: 2132518 - RNA, 14 nt, Human
uguguaauaaagug

SEQ ID NO: 2132519 - RNA, 15 nt, Human
uguguaauaaagugu

SEQ ID NO: 2132520 - RNA, 17 nt, Human
uguguaauaaaguguuu

SEQ ID NO: 2132521 - RNA, 18 nt, Human
uguguaauaaaguguuuu

SEQ ID NO: 2132522 - RNA, 19 nt, Human
uguguaauaaaguguuuuc

SEQ ID NO: 2132523 - RNA, 20 nt, Human
uguguaauaaaguguuuuca

SEQ ID NO: 2132524 - RNA, 21 nt, Human
uguguaauaaaguguuuucag

SEQ ID NO: 2132525 - RNA, 22 nt, Human
uguguaauaaaguguuuucaga

SEQ ID NO: 2132526 - RNA, 23 nt, Human
uguguaauaaaguguuuucagag

SEQ ID NO: 2132527 - RNA, 16 nt, Human
uguuaaauauuuacau

SEQ ID NO: 2132528 - RNA, 24 nt, Human
uguuaaaucccauucauaacuuuc

SEQ ID NO: 2132529 - RNA, 12 nt, Human
uguguuaagagu

SEQ ID NO: 2132530 - RNA, 17 nt, Human
uguguucugauuagaaa

SEQ ID NO: 2132531 - RNA, 16 nt, Human
uguguguuugugcuga

SEQ ID NO: 2132532 - RNA, 15 nt, Human
uguguguuugugcug

SEQ ID NO: 2132533 - RNA, 11 nt, Human
uguguuccugg

SEQ ID NO: 2132534 - RNA, 10 nt, Human
uguguuccug

SEQ ID NO: 2132535 - RNA, 15 nt, Human
uguguuccuggcaau

SEQ ID NO: 2132536 - RNA, 16 nt, Human
uguguuccuggcaaua

SEQ ID NO: 2132537 - RNA, 24 nt, Human
uguguuccuggcaauaguguguuc

SEQ ID NO: 2132538 - RNA, 15 nt, Human
uguguucguucuugu

SEQ ID NO: 2132539 - RNA, 17 nt, Human
uguguucguucuuguuc

SEQ ID NO: 2132540 - RNA, 18 nt, Human
uguguucuguuuguuaaa

SEQ ID NO: 2132541 - RNA, 19 nt, Human
uguguucuguuuguuaaaa

SEQ ID NO: 2132542 - RNA, 21 nt, Human
uguguucuguuuguuaaaacu

SEQ ID NO: 2132543 - RNA, 15 nt, Human
ugucuuguguuucuu

SEQ ID NO: 2132544 - RNA, 21 nt, Human
ugugaaagucagaugcccaga

SEQ ID NO: 2132545 - RNA, 14 nt, Human
ugugaaaugaaaac

SEQ ID NO: 2132546 - RNA, 21 nt, Human
ugugaaauaguucaaagccaa

SEQ ID NO: 2132547 - RNA, 22 nt, Human
ugugaaagucagaugcccagag

SEQ ID NO: 2132548 - RNA, 14 nt, Human
ugugaaaugcuggc

SEQ ID NO: 2132549 - RNA, 17 nt, Human
ugucuugguacuugcug

SEQ ID NO: 2132550 - RNA, 15 nt, Human
ugucuuguaagcaaa

SEQ ID NO: 2132551 - RNA, 20 nt, Human
ugucagaccuauuugacaua

SEQ ID NO: 2132552 - RNA, 12 nt, Human
ugucagacuuua

SEQ ID NO: 2132553 - RNA, 13 nt, Human
ugucagacuggcu

SEQ ID NO: 2132554 - RNA, 14 nt, Human
ugucagacuuuaaa

SEQ ID NO: 2132555 - RNA, 23 nt, Human
ugucagacuuuaaagaauaauau

SEQ ID NO: 2132556 - RNA, 11 nt, Human
ugucagagcug

SEQ ID NO: 2132557 - RNA, 20 nt, Human
agucacccggcccccaugca

SEQ ID NO: 2132558 - RNA, 13 nt, Human
agucaccuuuuaa

SEQ ID NO: 2132559 - RNA, 14 nt, Human
agucaccuuuuaaa

SEQ ID NO: 2132560 - RNA, 16 nt, Human
agucaccuuuuaaauc

SEQ ID NO: 2132561 - RNA, 19 nt, Human
agucaccuuuuaaauccug

SEQ ID NO: 2132562 - RNA, 20 nt, Human
agucaccuuuuaaauccugu

SEQ ID NO: 2132563 - RNA, 21 nt, Human
agucaccuuuuaaauccuguu

SEQ ID NO: 2132564 - RNA, 19 nt, Human
ugucagaaaaacaauaaga

SEQ ID NO: 2132565 - RNA, 22 nt, Human
ugucagaaaaacaauaagagcg

SEQ ID NO: 2132566 - RNA, 16 nt, Human
ugucagaaaccaguua

SEQ ID NO: 2132567 - RNA, 21 nt, Human
ugucagaaaccaguuauguga

SEQ ID NO: 2132568 - RNA, 14 nt, Human
ugugacuagugcug

SEQ ID NO: 2132569 - RNA, 15 nt, Human
ugugacuagugcuga

SEQ ID NO: 2132570 - RNA, 16 nt, Human
ugugacuagugcugaa

SEQ ID NO: 2132571 - RNA, 17 nt, Human
ugugacuagugcugaag

SEQ ID NO: 2132572 - RNA, 19 nt, Human
ugugacuagugcugaagcu

SEQ ID NO: 2132573 - RNA, 20 nt, Human
ugugacuagugcugaagcuu

SEQ ID NO: 2132574 - RNA, 22 nt, Human
ugugacuagugcugaagcuuau

SEQ ID NO: 2132575 - RNA, 23 nt, Human
ugugacuagugcugaagcuuauu

SEQ ID NO: 2132576 - RNA, 14 nt, Human
ugugaagagaacca

SEQ ID NO: 2132577 - RNA, 17 nt, Human
ugugacccucaauucau

SEQ ID NO: 2132578 - RNA, 20 nt, Human
ugugaacuuggggaacaagg

SEQ ID NO: 2132579 - RNA, 21 nt, Human
ugugaaccaccacacccagcc

SEQ ID NO: 2132580 - RNA, 20 nt, Human
ugugaaccaccacacccagc

SEQ ID NO: 2132581 - RNA, 19 nt, Human
ugugaaccaccacacccag

SEQ ID NO: 2132582 - RNA, 22 nt, Human
agucuuguauuaaguuguuaau

SEQ ID NO: 2132583 - RNA, 15 nt, Human
agucuuggcucacug

SEQ ID NO: 2132584 - RNA, 16 nt, Human
agucuuguauuaaguu

SEQ ID NO: 2132585 - RNA, 18 nt, Human
agucuuguauuaaguugu

SEQ ID NO: 2132586 - RNA, 22 nt, Human
agucuuuguaaguaaacugccc

SEQ ID NO: 2132587 - RNA, 23 nt, Human
agucuuuguaaguaaacugcccu

SEQ ID NO: 2132588 - RNA, 16 nt, Human
agucuucaagggcugc

SEQ ID NO: 2132589 - RNA, 20 nt, Human
agucuucaagggcugcuuca

SEQ ID NO: 2132590 - RNA, 23 nt, Human
agucuucaagcagauuggagaaa

SEQ ID NO: 2132591 - RNA, 17 nt, Human
agucucuucuccacugg

SEQ ID NO: 2132592 - RNA, 12 nt, Human
agucucuucaga

SEQ ID NO: 2132593 - RNA, 18 nt, Human
agucucuucuccacugga

SEQ ID NO: 2132594 - RNA, 16 nt, Human
agucucuucuccacug

SEQ ID NO: 2132595 - RNA, 15 nt, Human
agucucuucuccacu

SEQ ID NO: 2132596 - RNA, 15 nt, Human
agucuuccaccugga

SEQ ID NO: 2132597 - RNA, 16 nt, Human
agucuuccaccuggaa

SEQ ID NO: 2132598 - RNA, 17 nt, Human
agucuuccaccuggaag

SEQ ID NO: 2132599 - RNA, 16 nt, Human
agucuugcagugauua

SEQ ID NO: 2132600 - RNA, 19 nt, Human
agucuugcagugauuaagg

SEQ ID NO: 2132601 - RNA, 16 nt, Human
agucuugcuguggucu

SEQ ID NO: 2132602 - RNA, 20 nt, Human
agucuugcuguggucucuuu

SEQ ID NO: 2132603 - RNA, 21 nt, Human
agucuugcuguggucucuuug

SEQ ID NO: 2132604 - RNA, 23 nt, Human
agucuugcuguggucucuuugug

SEQ ID NO: 2132605 - RNA, 17 nt, Human
ugugagagcgaggcuga

SEQ ID NO: 2132606 - RNA, 13 nt, Human
agucucaggagca

SEQ ID NO: 2132607 - RNA, 17 nt, Human
agucucaggagcauggg

SEQ ID NO: 2132608 - RNA, 14 nt, Human
agucucuucuccac

SEQ ID NO: 2132609 - RNA, 13 nt, Human
agucucuucucca

SEQ ID NO: 2132610 - RNA, 15 nt, Human
agucucucuuacccu

SEQ ID NO: 2132611 - RNA, 19 nt, Human
agucucucuuacccuucug

SEQ ID NO: 2132612 - RNA, 12 nt, Human
agucucuauuua

SEQ ID NO: 2132613 - RNA, 15 nt, Human
agucucuauuuaaau

SEQ ID NO: 2132614 - RNA, 18 nt, Human
agucucuauuuaaauucu

SEQ ID NO: 2132615 - RNA, 20 nt, Human
agucucuauuuaaauucuuu

SEQ ID NO: 2132616 - RNA, 21 nt, Human
agucucuauuuaaauucuuuu

SEQ ID NO: 2132617 - RNA, 22 nt, Human
agucucuauuuaaauucuuuuu

SEQ ID NO: 2132618 - RNA, 18 nt, Human
uguggccaaguucuuagu

SEQ ID NO: 2132619 - RNA, 24 nt, Human
uguggccaaaggagggucaggaag

SEQ ID NO: 2132620 - RNA, 16 nt, Human
uguggccaaaggaggg

SEQ ID NO: 2132621 - RNA, 17 nt, Human
uguggcaucuuugccuu

SEQ ID NO: 2132622 - RNA, 21 nt, Human
uguggcaucuuugccuugggc

SEQ ID NO: 2132623 - RNA, 15 nt, Human
agugagucgaggaca

SEQ ID NO: 2132624 - RNA, 20 nt, Human
agugagggcuugucauuacc

SEQ ID NO: 2132625 - RNA, 13 nt, Human
agugagggucaga

SEQ ID NO: 2132626 - RNA, 15 nt, Human
agugagggucagaga

SEQ ID NO: 2132627 - RNA, 16 nt, Human
agugagggucagagag

SEQ ID NO: 2132628 - RNA, 22 nt, Human
agugagggucagagaggaguca

SEQ ID NO: 2132629 - RNA, 23 nt, Human
agugagggucagagaggagucag

SEQ ID NO: 2132630 - RNA, 16 nt, Human
agugagguccuggggg

SEQ ID NO: 2132631 - RNA, 17 nt, Human
agugagguccugggggc

SEQ ID NO: 2132632 - RNA, 18 nt, Human
agugagguccugggggcc

SEQ ID NO: 2132633 - RNA, 21 nt, Human
uguggagguacacucuuauag

SEQ ID NO: 2132634 - RNA, 16 nt, Human
uguggcagcugucuca

SEQ ID NO: 2132635 - RNA, 18 nt, Human
uguggcaguaaagagaaa

SEQ ID NO: 2132636 - RNA, 19 nt, Human
uguggcaguaaagagaaac

SEQ ID NO: 2132637 - RNA, 20 nt, Human
uguggcaguaaagagaaacu

SEQ ID NO: 2132638 - RNA, 21 nt, Human
uguggcaguaaagagaaacuu

SEQ ID NO: 2132639 - RNA, 22 nt, Human
uguggcaguaaagagaaacuuu

SEQ ID NO: 2132640 - RNA, 12 nt, Human
ugugcccaguua

SEQ ID NO: 2132641 - RNA, 21 nt, Human
ugugcccaguuaaucuugcuu

SEQ ID NO: 2132642 - RNA, 12 nt, Human
ugugcccagcuc

SEQ ID NO: 2132643 - RNA, 13 nt, Human
ugugcccagcuca

SEQ ID NO: 2132644 - RNA, 14 nt, Human
ugugcccagcucag

SEQ ID NO: 2132645 - RNA, 15 nt, Human
ugugcccagcucagu

SEQ ID NO: 2132646 - RNA, 16 nt, Human
ugugcccagcucaguc

SEQ ID NO: 2132647 - RNA, 22 nt, Human
ugugcccaguuaaucuugcuuu

SEQ ID NO: 2132648 - RNA, 14 nt, Human
ugugccccaugccu

SEQ ID NO: 2132649 - RNA, 16 nt, Human
ugugcccccagacgca

SEQ ID NO: 2132650 - RNA, 22 nt, Human
ugugcccccagacgcacguggg

SEQ ID NO: 2132651 - RNA, 23 nt, Human
ugugccccaugccuguccagccu

SEQ ID NO: 2132652 - RNA, 15 nt, Human
ugugccccaugccug

SEQ ID NO: 2132653 - RNA, 19 nt, Human
ugugccccaugccugucca

SEQ ID NO: 2132654 - RNA, 21 nt, Human
ugugcccccauguaagcaccc

SEQ ID NO: 2132655 - RNA, 20 nt, Human
ugugccagguuuuuggucug

SEQ ID NO: 2132656 - RNA, 16 nt, Human
ugugccaugugccagg

SEQ ID NO: 2132657 - RNA, 12 nt, Human
ugugccaugugc

SEQ ID NO: 2132658 - RNA, 22 nt, Human
ugugcauuuuugugaaaugaaa

SEQ ID NO: 2132659 - RNA, 21 nt, Human
ugugcauuuuugugaaaugaa

SEQ ID NO: 2132660 - RNA, 16 nt, Human
ugugccacccaccagg

SEQ ID NO: 2132661 - RNA, 20 nt, Human
ugugccacccaccagggcga

SEQ ID NO: 2132662 - RNA, 13 nt, Human
ugugaucugggaa

SEQ ID NO: 2132663 - RNA, 18 nt, Human
ugugaucccaagugccag

SEQ ID NO: 2132664 - RNA, 23 nt, Human
ugugaucccaagugccagucuug

SEQ ID NO: 2132665 - RNA, 18 nt, Human
ugugaucuugcucuaucu

SEQ ID NO: 2132666 - RNA, 14 nt, Human
ugugauugugccua

SEQ ID NO: 2132667 - RNA, 20 nt, Human
auauuuguauuuaaaugaaa

SEQ ID NO: 2132668 - RNA, 12 nt, Human
auauuuguagaa

SEQ ID NO: 2132669 - RNA, 20 nt, Human
auauuugucgauauuuccau

SEQ ID NO: 2132670 - RNA, 13 nt, Human
auauuuguuaaau

SEQ ID NO: 2132671 - RNA, 21 nt, Human
auauuuguuaaauauuuacau

SEQ ID NO: 2132672 - RNA, 22 nt, Human
auauuuguuaaauauuuacaua

SEQ ID NO: 2132673 - RNA, 16 nt, Human
auauugcauaugcaua

SEQ ID NO: 2132674 - RNA, 12 nt, Human
auauugcaauga

SEQ ID NO: 2132675 - RNA, 20 nt, Human
auauuguuuucaguguacau

SEQ ID NO: 2132676 - RNA, 13 nt, Human
auauuguuccuaa

SEQ ID NO: 2132677 - RNA, 14 nt, Human
auauuguuccuaag

SEQ ID NO: 2132678 - RNA, 18 nt, Human
auauuguuccuaaguucu

SEQ ID NO: 2132679 - RNA, 19 nt, Human
auauuguuccuaaguucuu

SEQ ID NO: 2132680 - RNA, 20 nt, Human
auauuguuauuauauaauua

SEQ ID NO: 2132681 - RNA, 15 nt, Human
auauuuaaaagaaag

SEQ ID NO: 2132682 - RNA, 15 nt, Human
auauuucgaaagcug

SEQ ID NO: 2132683 - RNA, 13 nt, Human
auauugaugugug

SEQ ID NO: 2132684 - RNA, 13 nt, Human
auauucuuucaau

SEQ ID NO: 2132685 - RNA, 15 nt, Human
auauucuuucaauaa

SEQ ID NO: 2132686 - RNA, 23 nt, Human
auauucuuauguaugugaaaguu

SEQ ID NO: 2132687 - RNA, 12 nt, Human
auauucuuucaa

SEQ ID NO: 2132688 - RNA, 16 nt, Human
auauucuguuggccag

SEQ ID NO: 2132689 - RNA, 13 nt, Human
auauucucuuugg

SEQ ID NO: 2132690 - RNA, 22 nt, Human
auauucucuuugguguacaaaa

SEQ ID NO: 2132691 - RNA, 17 nt, Human
auauucuggcugauaaa

SEQ ID NO: 2132692 - RNA, 14 nt, Human
auauucuuauguau

SEQ ID NO: 2132693 - RNA, 21 nt, Human
auauuccugcagccuggaggc

SEQ ID NO: 2132694 - RNA, 22 nt, Human
auauucucacgggcaguagcug

SEQ ID NO: 2132695 - RNA, 15 nt, Human
auauuccugaaugaa

SEQ ID NO: 2132696 - RNA, 17 nt, Human
auauuccugaaugaaau

SEQ ID NO: 2132697 - RNA, 18 nt, Human
auauuccugaaugaaaua

SEQ ID NO: 2132698 - RNA, 22 nt, Human
auauuccugaaugaaauaucag

SEQ ID NO: 2132699 - RNA, 23 nt, Human
auauuccugaaugaaauaucaga

SEQ ID NO: 2132700 - RNA, 15 nt, Human
auauuccaugaaugu

SEQ ID NO: 2132701 - RNA, 16 nt, Human
auauuccaugaaugua

SEQ ID NO: 2132702 - RNA, 19 nt, Human
auauuccaugaauguauca

SEQ ID NO: 2132703 - RNA, 18 nt, Human
auauuccccuaucucuag

SEQ ID NO: 2132704 - RNA, 13 nt, Human
auauucauuucaa

SEQ ID NO: 2132705 - RNA, 13 nt, Human
auauucauuugga

SEQ ID NO: 2132706 - RNA, 15 nt, Human
auauucauuuggaaa

SEQ ID NO: 2132707 - RNA, 12 nt, Human
auauuccauagu

SEQ ID NO: 2132708 - RNA, 16 nt, Human
auauuccauaguauau

SEQ ID NO: 2132709 - RNA, 17 nt, Human
auauuccauaguauauu

SEQ ID NO: 2132710 - RNA, 20 nt, Human
auauuccauaguauauuaaa

SEQ ID NO: 2132711 - RNA, 22 nt, Human
auauuccauaguauauuaaaaa

SEQ ID NO: 2132712 - RNA, 23 nt, Human
auauuccauaguauauuaaaaau

SEQ ID NO: 2132713 - RNA, 18 nt, Human
auauuccauauauuagca

SEQ ID NO: 2132714 - RNA, 23 nt, Human
auauucauuguauaaaaauagaa

SEQ ID NO: 2132715 - RNA, 24 nt, Human
auauuaagaaagacuaucuaaaug

SEQ ID NO: 2132716 - RNA, 22 nt, Human
auauuaaggaagacaaugugaa

SEQ ID NO: 2132717 - RNA, 23 nt, Human
auauuaaauauguuagcaaagag

SEQ ID NO: 2132718 - RNA, 12 nt, Human
uucauguuucuu

SEQ ID NO: 2132719 - RNA, 13 nt, Human
uucauguuucuua

SEQ ID NO: 2132720 - RNA, 18 nt, Human
auauguuuuaagaggcag

SEQ ID NO: 2132721 - RNA, 17 nt, Human
auauguuuuaaauauag

SEQ ID NO: 2132722 - RNA, 22 nt, Human
auauguuuuaaauauagaauuu

SEQ ID NO: 2132723 - RNA, 14 nt, Human
uucauguaaauaaa

SEQ ID NO: 2132724 - RNA, 20 nt, Human
auauguuuuaagaggcaggg

SEQ ID NO: 2132725 - RNA, 14 nt, Human
aucacguaaagcua

SEQ ID NO: 2132726 - RNA, 21 nt, Human
aucacguaaagcuagaaauga

SEQ ID NO: 2132727 - RNA, 13 nt, Human
aucacuaacauua

SEQ ID NO: 2132728 - RNA, 14 nt, Human
aucacuaacauuau

SEQ ID NO: 2132729 - RNA, 16 nt, Human
aucacuaacauuauau

SEQ ID NO: 2132730 - RNA, 18 nt, Human
aucacuaacauuauauug

SEQ ID NO: 2132731 - RNA, 21 nt, Human
aucacuaacauuauauugcaa

SEQ ID NO: 2132732 - RNA, 22 nt, Human
aucacggcucacugcagccuca

SEQ ID NO: 2132733 - RNA, 20 nt, Human
uuccuuuuaaaacacuucca

SEQ ID NO: 2132734 - RNA, 22 nt, Human
uuccuuuuaaaacacuuccaua

SEQ ID NO: 2132735 - RNA, 21 nt, Human
uuccuuuuaaaacacuuccau

SEQ ID NO: 2132736 - RNA, 20 nt, Human
uuccuuuuagccuaguucau

SEQ ID NO: 2132737 - RNA, 21 nt, Human
uuccuuuguuuuuuuuuccug

SEQ ID NO: 2132738 - RNA, 22 nt, Human
aucacuggcaaugaaaaauucu

SEQ ID NO: 2132739 - RNA, 23 nt, Human
aucacuggcaaugaaaaauucuc

SEQ ID NO: 2132740 - RNA, 18 nt, Human
aucacuggcaaugaaaaa

SEQ ID NO: 2132741 - RNA, 18 nt, Human
aucaagaugucagacugg

SEQ ID NO: 2132742 - RNA, 13 nt, Human
aucaaucaaaccc

SEQ ID NO: 2132743 - RNA, 15 nt, Human
aucaagaaaguguug

SEQ ID NO: 2132744 - RNA, 15 nt, Human
aucaagauaaaggac

SEQ ID NO: 2132745 - RNA, 16 nt, Human
aucaagauaaaggaca

SEQ ID NO: 2132746 - RNA, 17 nt, Human
aucaagauaaaggacag

SEQ ID NO: 2132747 - RNA, 18 nt, Human
aucaagauaaaggacagu

SEQ ID NO: 2132748 - RNA, 22 nt, Human
aucaagaugagagaacuggagg

SEQ ID NO: 2132749 - RNA, 20 nt, Human
uuccuguucuuaagacguga

SEQ ID NO: 2132750 - RNA, 14 nt, Human
uuccuguucagcau

SEQ ID NO: 2132751 - RNA, 15 nt, Human
uuccuguucagcauu

SEQ ID NO: 2132752 - RNA, 17 nt, Human
uuccuguucagcauucu

SEQ ID NO: 2132753 - RNA, 21 nt, Human
uuccuguucagcauucuuagc

SEQ ID NO: 2132754 - RNA, 15 nt, Human
uuccuucagcuucca

SEQ ID NO: 2132755 - RNA, 20 nt, Human
auauuuucaacgcagcccug

SEQ ID NO: 2132756 - RNA, 19 nt, Human
auauuuucaacgcagcccu

SEQ ID NO: 2132757 - RNA, 22 nt, Human
uuccuucagugcaucugggaag

SEQ ID NO: 2132758 - RNA, 16 nt, Human
auauuuucaauucaaa

SEQ ID NO: 2132759 - RNA, 21 nt, Human
auauuuucaauucaaaaaugu

SEQ ID NO: 2132760 - RNA, 23 nt, Human
auauuuucaauucaaaaauguac

SEQ ID NO: 2132761 - RNA, 11 nt, Human
uuccucuuucc

SEQ ID NO: 2132762 - RNA, 15 nt, Human
uuccuggggugcccu

SEQ ID NO: 2132763 - RNA, 20 nt, Human
uuccuggggugcccuccacu

SEQ ID NO: 2132764 - RNA, 21 nt, Human
uuccuggggugcccuccacug

SEQ ID NO: 2132765 - RNA, 22 nt, Human
uuccuggggugcccuccacugc

SEQ ID NO: 2132766 - RNA, 14 nt, Human
auauuuuauaauuu

SEQ ID NO: 2132767 - RNA, 15 nt, Human
auauuuuaugugaga

SEQ ID NO: 2132768 - RNA, 12 nt, Human
auauuuuauuca

SEQ ID NO: 2132769 - RNA, 16 nt, Human
auauuuuauucaaggu

SEQ ID NO: 2132770 - RNA, 19 nt, Human
auauuuuauucaagguaaa

SEQ ID NO: 2132771 - RNA, 20 nt, Human
auauuuuaugugagagaaag

SEQ ID NO: 2132772 - RNA, 19 nt, Human
auauuuucaaaguacauaa

SEQ ID NO: 2132773 - RNA, 17 nt, Human
auauuuucaaauuguau

SEQ ID NO: 2132774 - RNA, 24 nt, Human
auauuuucaaauuguaucuagugc

SEQ ID NO: 2132775 - RNA, 14 nt, Human
uuccuaaguucuua

SEQ ID NO: 2132776 - RNA, 17 nt, Human
uuccuaaguucuuagau

SEQ ID NO: 2132777 - RNA, 18 nt, Human
uuccuaaguucuuagaua

SEQ ID NO: 2132778 - RNA, 14 nt, Human
uuccucgcccuggg

SEQ ID NO: 2132779 - RNA, 19 nt, Human
uuccucuagugcccuccac

SEQ ID NO: 2132780 - RNA, 23 nt, Human
uuccucuagugcccuccacagcc

SEQ ID NO: 2132781 - RNA, 13 nt, Human
uuccucuucccca

SEQ ID NO: 2132782 - RNA, 12 nt, Human
uuccucugggaa

SEQ ID NO: 2132783 - RNA, 21 nt, Human
uucuaggucaaggccuguccc

SEQ ID NO: 2132784 - RNA, 15 nt, Human
uucuagggaaaugaa

SEQ ID NO: 2132785 - RNA, 17 nt, Human
uucuaguugaggaguuu

SEQ ID NO: 2132786 - RNA, 20 nt, Human
uucuaguugaggaguuuccu

SEQ ID NO: 2132787 - RNA, 13 nt, Human
uucuaggccuggg

SEQ ID NO: 2132788 - RNA, 17 nt, Human
uuccuuuuguguacagu

SEQ ID NO: 2132789 - RNA, 15 nt, Human
uuccuuuuguguaca

SEQ ID NO: 2132790 - RNA, 14 nt, Human
uuccuuuucuuguu

SEQ ID NO: 2132791 - RNA, 22 nt, Human
uuccuuuucuuguuuaucagca

SEQ ID NO: 2132792 - RNA, 18 nt, Human
uuccuuuucuaacucucc

SEQ ID NO: 2132793 - RNA, 18 nt, Human
uucucaagccgcauccca

SEQ ID NO: 2132794 - RNA, 23 nt, Human
uucucaagccgcaucccagacuu

SEQ ID NO: 2132795 - RNA, 15 nt, Human
uucucaagcccugca

SEQ ID NO: 2132796 - RNA, 14 nt, Human
uucucaagcccugc

SEQ ID NO: 2132797 - RNA, 13 nt, Human
uucuaguuuuguc

SEQ ID NO: 2132798 - RNA, 23 nt, Human
uucucagaaucucaaauaacuaa

SEQ ID NO: 2132799 - RNA, 22 nt, Human
uucucagucaguaauugccaaa

SEQ ID NO: 2132800 - RNA, 19 nt, Human
uucucagaaucucaaauaa

SEQ ID NO: 2132801 - RNA, 22 nt, Human
uucucagaaucucaaauaacua

SEQ ID NO: 2132802 - RNA, 14 nt, Human
aucagaaaguaauu

SEQ ID NO: 2132803 - RNA, 22 nt, Human
aucagaaaguaauuucuucuca

SEQ ID NO: 2132804 - RNA, 13 nt, Human
uucucauagcauu

SEQ ID NO: 2132805 - RNA, 14 nt, Human
uucucauagcauua

SEQ ID NO: 2132806 - RNA, 17 nt, Human
uucucauagcauuaacu

SEQ ID NO: 2132807 - RNA, 18 nt, Human
uucucauagcauuaacua

SEQ ID NO: 2132808 - RNA, 21 nt, Human
uucucauagcauuaacuaauc

SEQ ID NO: 2132809 - RNA, 22 nt, Human
uucucauagcauuaacuaaucu

SEQ ID NO: 2132810 - RNA, 16 nt, Human
uucucauagccccggu

SEQ ID NO: 2132811 - RNA, 17 nt, Human
uucucauagccccggug

SEQ ID NO: 2132812 - RNA, 11 nt, Human
aucagaaaugu

SEQ ID NO: 2132813 - RNA, 23 nt, Human
aucagaaaugucuggagaauaau

SEQ ID NO: 2132814 - RNA, 13 nt, Human
aucagaacagcag

SEQ ID NO: 2132815 - RNA, 14 nt, Human
aucagaacagcaga

SEQ ID NO: 2132816 - RNA, 14 nt, Human
aucagaggacaccu

SEQ ID NO: 2132817 - RNA, 17 nt, Human
aucagaagccuauugua

SEQ ID NO: 2132818 - RNA, 18 nt, Human
aucagaagccuauuguaa

SEQ ID NO: 2132819 - RNA, 23 nt, Human
aucagaagccuauuguaaauaca

SEQ ID NO: 2132820 - RNA, 12 nt, Human
aucagaaggaga

SEQ ID NO: 2132821 - RNA, 22 nt, Human
aucagaucauuucaaaacucau

SEQ ID NO: 2132822 - RNA, 23 nt, Human
aucagaugacuagaaagugaaua

SEQ ID NO: 2132823 - RNA, 18 nt, Human
aucagaucauuucaaaac

SEQ ID NO: 2132824 - RNA, 19 nt, Human
aucagugguuauuuaggga

SEQ ID NO: 2132825 - RNA, 22 nt, Human
aucaguggcauggcuccagucu

SEQ ID NO: 2132826 - RNA, 14 nt, Human
aucaguccuuugau

SEQ ID NO: 2132827 - RNA, 21 nt, Human
aucaguccucuuucaaaggua

SEQ ID NO: 2132828 - RNA, 12 nt, Human
aucauucagcaa

SEQ ID NO: 2132829 - RNA, 13 nt, Human
aucauucagcaac

SEQ ID NO: 2132830 - RNA, 23 nt, Human
aucauaguggcuuaaaacaacac

SEQ ID NO: 2132831 - RNA, 17 nt, Human
aucauagauuucugauu

SEQ ID NO: 2132832 - RNA, 18 nt, Human
aucauagauuucugauuu

SEQ ID NO: 2132833 - RNA, 19 nt, Human
aucauagauuucugauuuu

SEQ ID NO: 2132834 - RNA, 20 nt, Human
aucauagauuucugauuuua

SEQ ID NO: 2132835 - RNA, 23 nt, Human
aucauagauuucugauuuuaugu

SEQ ID NO: 2132836 - RNA, 12 nt, Human
aucauaguacag

SEQ ID NO: 2132837 - RNA, 17 nt, Human
aucauguuaugauaaaa

SEQ ID NO: 2132838 - RNA, 18 nt, Human
aucauguuaugauaaaaa

SEQ ID NO: 2132839 - RNA, 20 nt, Human
aucauguuaugauaaaaaau

SEQ ID NO: 2132840 - RNA, 22 nt, Human
aucauguuaugauaaaaaauuu

SEQ ID NO: 2132841 - RNA, 17 nt, Human
aucauuugaacaacuag

SEQ ID NO: 2132842 - RNA, 15 nt, Human
aucauuucuugggcc

SEQ ID NO: 2132843 - RNA, 18 nt, Human
aucauuucuugggcccuc

SEQ ID NO: 2132844 - RNA, 19 nt, Human
aucauuucuugggcccucc

SEQ ID NO: 2132845 - RNA, 22 nt, Human
aucauuucuugggcccuccuga

SEQ ID NO: 2132846 - RNA, 16 nt, Human
auccagguucagcuug

SEQ ID NO: 2132847 - RNA, 15 nt, Human
auccagguucagcuu

SEQ ID NO: 2132848 - RNA, 12 nt, Human
auccauguacug

SEQ ID NO: 2132849 - RNA, 14 nt, Human
auccauguacugua

SEQ ID NO: 2132850 - RNA, 18 nt, Human
auccauguacuguaguuu

SEQ ID NO: 2132851 - RNA, 22 nt, Human
auccauguacuguaguuuuucu

SEQ ID NO: 2132852 - RNA, 20 nt, Human
auccauguacuguaguuuuu

SEQ ID NO: 2132853 - RNA, 18 nt, Human
auccauguuaguuuuuac

SEQ ID NO: 2132854 - RNA, 22 nt, Human
auccauuccucagggacagaga

SEQ ID NO: 2132855 - RNA, 14 nt, Human
auccauuccucagg

SEQ ID NO: 2132856 - RNA, 18 nt, Human
auccauuccucagggaca

SEQ ID NO: 2132857 - RNA, 19 nt, Human
auccauguuaguuuuuacu

SEQ ID NO: 2132858 - RNA, 20 nt, Human
auccauguuaguuuuuacuu

SEQ ID NO: 2132859 - RNA, 12 nt, Human
aucccuguucau

SEQ ID NO: 2132860 - RNA, 13 nt, Human
aucccuguucauu

SEQ ID NO: 2132861 - RNA, 14 nt, Human
aucccuguucauug

SEQ ID NO: 2132862 - RNA, 16 nt, Human
aucccuguucauugua

SEQ ID NO: 2132863 - RNA, 17 nt, Human
aucccuguucauuguaa

SEQ ID NO: 2132864 - RNA, 16 nt, Human
aucccugggcauugcu

SEQ ID NO: 2132865 - RNA, 17 nt, Human
aucccugggcauugcuu

SEQ ID NO: 2132866 - RNA, 18 nt, Human
aucccugggcauugcuuu

SEQ ID NO: 2132867 - RNA, 12 nt, Human
aucccaggggac

SEQ ID NO: 2132868 - RNA, 19 nt, Human
aucccaggggaccacaccu

SEQ ID NO: 2132869 - RNA, 20 nt, Human
aucccaggggaccacaccuc

SEQ ID NO: 2132870 - RNA, 23 nt, Human
aucccaggggaccacaccucccu

SEQ ID NO: 2132871 - RNA, 20 nt, Human
uucucugugaacgauuuaga

SEQ ID NO: 2132872 - RNA, 12 nt, Human
uucucugugaac

SEQ ID NO: 2132873 - RNA, 19 nt, Human
uucugaaaauuaacacugc

SEQ ID NO: 2132874 - RNA, 16 nt, Human
uucugaaaauuccaga

SEQ ID NO: 2132875 - RNA, 13 nt, Human
uucugaaacuaau

SEQ ID NO: 2132876 - RNA, 17 nt, Human
uucugaaacuaaugaaa

SEQ ID NO: 2132877 - RNA, 18 nt, Human
uucugaaacuaaugaaag

SEQ ID NO: 2132878 - RNA, 15 nt, Human
uucucuuaauuuaau

SEQ ID NO: 2132879 - RNA, 14 nt, Human
uucugccacauaaa

SEQ ID NO: 2132880 - RNA, 15 nt, Human
uucugccacauaaaa

SEQ ID NO: 2132881 - RNA, 14 nt, Human
uucugaaauauuuu

SEQ ID NO: 2132882 - RNA, 22 nt, Human
uucugggacacaguucaauucu

SEQ ID NO: 2132883 - RNA, 11 nt, Human
uucugggacac

SEQ ID NO: 2132884 - RNA, 10 nt, Human
uucugggaca

SEQ ID NO: 2132885 - RNA, 16 nt, Human
uucugccgugugcccu

SEQ ID NO: 2132886 - RNA, 17 nt, Human
uucugccggcccugggg

SEQ ID NO: 2132887 - RNA, 18 nt, Human
uucugccggcccuggggc

SEQ ID NO: 2132888 - RNA, 17 nt, Human
uucuguaccaaaguguu

SEQ ID NO: 2132889 - RNA, 20 nt, Human
uucugcaucaucuguagaua

SEQ ID NO: 2132890 - RNA, 17 nt, Human
uucuggguucugggugg

SEQ ID NO: 2132891 - RNA, 18 nt, Human
uucugggugguugcccuu

SEQ ID NO: 2132892 - RNA, 16 nt, Human
uucugggaggaagcag

SEQ ID NO: 2132893 - RNA, 22 nt, Human
uucugggagacacccaaagggu

SEQ ID NO: 2132894 - RNA, 22 nt, Human
uucugguaggaauagcauguca

SEQ ID NO: 2132895 - RNA, 14 nt, Human
uucuggucucucua

SEQ ID NO: 2132896 - RNA, 20 nt, Human
uucugguaggaauagcaugu

SEQ ID NO: 2132897 - RNA, 19 nt, Human
uucugguagauagaaauaa

SEQ ID NO: 2132898 - RNA, 17 nt, Human
uucugguagauagaaau

SEQ ID NO: 2132899 - RNA, 18 nt, Human
uucugguagauagaaaua

SEQ ID NO: 2132900 - RNA, 20 nt, Human
auagcgucauaacuagaacu

SEQ ID NO: 2132901 - RNA, 18 nt, Human
auagcgucauaacuagaa

SEQ ID NO: 2132902 - RNA, 16 nt, Human
auagcgaggcucuaac

SEQ ID NO: 2132903 - RNA, 13 nt, Human
auagcguuggaau

SEQ ID NO: 2132904 - RNA, 20 nt, Human
auagcguuggaauuaaaaca

SEQ ID NO: 2132905 - RNA, 21 nt, Human
auagcguuggaauuaaaacaa

SEQ ID NO: 2132906 - RNA, 22 nt, Human
auagcguuggaauuaaaacaau

SEQ ID NO: 2132907 - RNA, 12 nt, Human
auaagagauuug

SEQ ID NO: 2132908 - RNA, 16 nt, Human
auaacuucaagcaaac

SEQ ID NO: 2132909 - RNA, 16 nt, Human
auaagaguuggcuggu

SEQ ID NO: 2132910 - RNA, 18 nt, Human
auagccugccucuucucu

SEQ ID NO: 2132911 - RNA, 13 nt, Human
auaagauaaaugu

SEQ ID NO: 2132912 - RNA, 17 nt, Human
auaagauaaaugugcug

SEQ ID NO: 2132913 - RNA, 16 nt, Human
auagcuacaggaagca

SEQ ID NO: 2132914 - RNA, 19 nt, Human
auagcucaggugucccugc

SEQ ID NO: 2132915 - RNA, 14 nt, Human
auagcuauauccau

SEQ ID NO: 2132916 - RNA, 16 nt, Human
auagcuauauccaugu

SEQ ID NO: 2132917 - RNA, 17 nt, Human
auagcuauauccaugua

SEQ ID NO: 2132918 - RNA, 19 nt, Human
auagcuauauccauguacu

SEQ ID NO: 2132919 - RNA, 20 nt, Human
auagcuauauccauguacug

SEQ ID NO: 2132920 - RNA, 22 nt, Human
auagcuauauccauguacugua

SEQ ID NO: 2132921 - RNA, 23 nt, Human
auagcuauauccauguacuguag

SEQ ID NO: 2132922 - RNA, 15 nt, Human
auagcuacaggaagc

SEQ ID NO: 2132923 - RNA, 22 nt, Human
auagcucaggugucccugcacu

SEQ ID NO: 2132924 - RNA, 20 nt, Human
auagcuccccgcuucugccu

SEQ ID NO: 2132925 - RNA, 20 nt, Human
auagcuauuuuuauggaauu

SEQ ID NO: 2132926 - RNA, 13 nt, Human
auagcucaguuua

SEQ ID NO: 2132927 - RNA, 12 nt, Human
auagcuauuuuu

SEQ ID NO: 2132928 - RNA, 18 nt, Human
auagcuauuuuuauggaa

SEQ ID NO: 2132929 - RNA, 21 nt, Human
auagcucaggugucccugcac

SEQ ID NO: 2132930 - RNA, 20 nt, Human
auagcucaggugucccugca

SEQ ID NO: 2132931 - RNA, 12 nt, Human
auagcugggacu

SEQ ID NO: 2132932 - RNA, 17 nt, Human
auagcugagauuccugg

SEQ ID NO: 2132933 - RNA, 21 nt, Human
auagcugagauuccugguucg

SEQ ID NO: 2132934 - RNA, 23 nt, Human
auagcuccccgcuucugccugca

SEQ ID NO: 2132935 - RNA, 22 nt, Human
auagcucaguuuauccaaggug

SEQ ID NO: 2132936 - RNA, 14 nt, Human
uuauuuaucaguga

SEQ ID NO: 2132937 - RNA, 18 nt, Human
uuauuuaucagugacaga

SEQ ID NO: 2132938 - RNA, 13 nt, Human
uuauuuauuaaga

SEQ ID NO: 2132939 - RNA, 14 nt, Human
uuauuuauuaagau

SEQ ID NO: 2132940 - RNA, 15 nt, Human
uuauuuauuaagaug

SEQ ID NO: 2132941 - RNA, 15 nt, Human
uuauuuauuuaugga

SEQ ID NO: 2132942 - RNA, 23 nt, Human
uuauuucaaaauauacauucaaa

SEQ ID NO: 2132943 - RNA, 11 nt, Human
uuauuucagaa

SEQ ID NO: 2132944 - RNA, 15 nt, Human
uuauuucagaaaugu

SEQ ID NO: 2132945 - RNA, 17 nt, Human
uuauuucagaaauguac

SEQ ID NO: 2132946 - RNA, 22 nt, Human
uuauuuacugagcuucucugug

SEQ ID NO: 2132947 - RNA, 16 nt, Human
uuauuuaauguuaugu

SEQ ID NO: 2132948 - RNA, 14 nt, Human
uuauuuaauuaaaa

SEQ ID NO: 2132949 - RNA, 21 nt, Human
uuauuuacugagcuucucugu

SEQ ID NO: 2132950 - RNA, 17 nt, Human
uuauuuacugagcuucu

SEQ ID NO: 2132951 - RNA, 16 nt, Human
uuauuuaguuccuuga

SEQ ID NO: 2132952 - RNA, 17 nt, Human
uuauuuagggaacugcu

SEQ ID NO: 2132953 - RNA, 18 nt, Human
uuauuuagggaacugcuu

SEQ ID NO: 2132954 - RNA, 21 nt, Human
uuauuuagggaacugcuugac

SEQ ID NO: 2132955 - RNA, 17 nt, Human
auagcugggacuacagg

SEQ ID NO: 2132956 - RNA, 20 nt, Human
uuauuguguuuuuaauuuau

SEQ ID NO: 2132957 - RNA, 13 nt, Human
uuauuguuccaag

SEQ ID NO: 2132958 - RNA, 16 nt, Human
uuauuguuccaagaca

SEQ ID NO: 2132959 - RNA, 18 nt, Human
uuauuuaaugaaagacug

SEQ ID NO: 2132960 - RNA, 22 nt, Human
uuauuuaaugaaagacuguaca

SEQ ID NO: 2132961 - RNA, 12 nt, Human
uuauuuaaauga

SEQ ID NO: 2132962 - RNA, 14 nt, Human
uuauuuaaauuuua

SEQ ID NO: 2132963 - RNA, 23 nt, Human
uuauuguuccaagacauugucaa

SEQ ID NO: 2132964 - RNA, 17 nt, Human
uuauuguuccaagacau

SEQ ID NO: 2132965 - RNA, 18 nt, Human
uuauuguuccaagacauu

SEQ ID NO: 2132966 - RNA, 19 nt, Human
uuauuguuccaagacauug

SEQ ID NO: 2132967 - RNA, 22 nt, Human
uuauuguuccaagacauuguca

SEQ ID NO: 2132968 - RNA, 20 nt, Human
uucaagugauucuccugccu

SEQ ID NO: 2132969 - RNA, 22 nt, Human
uucaagugcaugcucucugcag

SEQ ID NO: 2132970 - RNA, 17 nt, Human
uucaaguuaaauuuuau

SEQ ID NO: 2132971 - RNA, 16 nt, Human
uucaaguuagcucagg

SEQ ID NO: 2132972 - RNA, 13 nt, Human
uucaaguuaaagu

SEQ ID NO: 2132973 - RNA, 17 nt, Human
uucaaguuagcucagga

SEQ ID NO: 2132974 - RNA, 15 nt, Human
uucaagguaaaauuc

SEQ ID NO: 2132975 - RNA, 16 nt, Human
uucaagguaaaauucu

SEQ ID NO: 2132976 - RNA, 18 nt, Human
uucaagguaaaauucuaa

SEQ ID NO: 2132977 - RNA, 19 nt, Human
uucaagguaaaauucuaaa

SEQ ID NO: 2132978 - RNA, 16 nt, Human
uucaagggcugcuuca

SEQ ID NO: 2132979 - RNA, 19 nt, Human
uucaagaaaaguaagcccu

SEQ ID NO: 2132980 - RNA, 21 nt, Human
uucaagaaagccagucuuaac

SEQ ID NO: 2132981 - RNA, 22 nt, Human
uucaagaaagccagucuuaaca

SEQ ID NO: 2132982 - RNA, 16 nt, Human
uucaaaauauguucuu

SEQ ID NO: 2132983 - RNA, 14 nt, Human
uucaaaaugucugu

SEQ ID NO: 2132984 - RNA, 18 nt, Human
uucaaaaugucuguagcu

SEQ ID NO: 2132985 - RNA, 22 nt, Human
uucaaaccaguauacaagauaa

SEQ ID NO: 2132986 - RNA, 11 nt, Human
uucaaaaaugu

SEQ ID NO: 2132987 - RNA, 16 nt, Human
uucaaaaauguacaaa

SEQ ID NO: 2132988 - RNA, 17 nt, Human
uucaaaaauguacaaaa

SEQ ID NO: 2132989 - RNA, 21 nt, Human
uucaaaaauguacaaaauaaa

SEQ ID NO: 2132990 - RNA, 13 nt, Human
uucaaaaauuugg

SEQ ID NO: 2132991 - RNA, 17 nt, Human
uucaaaaauuuggaauu

SEQ ID NO: 2132992 - RNA, 21 nt, Human
uucaaaaagucuacgcucucc

SEQ ID NO: 2132993 - RNA, 22 nt, Human
auagcuuacaagccagcuggag

SEQ ID NO: 2132994 - RNA, 14 nt, Human
auagcuugaaacau

SEQ ID NO: 2132995 - RNA, 10 nt, Human
auagcuuuau

SEQ ID NO: 2132996 - RNA, 18 nt, Human
auagcuuuauuuuuuaag

SEQ ID NO: 2132997 - RNA, 19 nt, Human
auagcuuuauuuuuuaagu

SEQ ID NO: 2132998 - RNA, 21 nt, Human
auagcuuuauuuuuuaaguau

SEQ ID NO: 2132999 - RNA, 19 nt, Human
uucacauccuguguuucua

SEQ ID NO: 2133000 - RNA, 22 nt, Human
auagcuuuauuuuuuaaguauu

SEQ ID NO: 2133001 - RNA, 23 nt, Human
auagcuuuauuuuuuaaguauuu

SEQ ID NO: 2133002 - RNA, 22 nt, Human
auaggccaaacuggcaaacuuc

SEQ ID NO: 2133003 - RNA, 12 nt, Human
uucaccauguaa

SEQ ID NO: 2133004 - RNA, 16 nt, Human
uucaccauguaaaaca

SEQ ID NO: 2133005 - RNA, 17 nt, Human
uucaccauguaaaacaa

SEQ ID NO: 2133006 - RNA, 20 nt, Human
uucaccauguaaaacaaaaa

SEQ ID NO: 2133007 - RNA, 21 nt, Human
uucaccauguaaaacaaaaaa

SEQ ID NO: 2133008 - RNA, 22 nt, Human
uucaccauguaaaacaaaaaac

SEQ ID NO: 2133009 - RNA, 23 nt, Human
uucaccauguaaaacaaaaaaca

SEQ ID NO: 2133010 - RNA, 22 nt, Human
uucaccacaugugcacaugcac

SEQ ID NO: 2133011 - RNA, 18 nt, Human
uucacauccuguguuucu

SEQ ID NO: 2133012 - RNA, 18 nt, Human
uucacaguaccaucugaa

SEQ ID NO: 2133013 - RNA, 12 nt, Human
uucacaguguuu

SEQ ID NO: 2133014 - RNA, 19 nt, Human
uucacauaaaauagauuuu

SEQ ID NO: 2133015 - RNA, 22 nt, Human
uucacaguguuucgacagcuga

SEQ ID NO: 2133016 - RNA, 17 nt, Human
uucacauagaugucccu

SEQ ID NO: 2133017 - RNA, 15 nt, Human
uucacagcucugugu

SEQ ID NO: 2133018 - RNA, 23 nt, Human
uucacagcucuguguugccaugu

SEQ ID NO: 2133019 - RNA, 13 nt, Human
uucaauaaaguau

SEQ ID NO: 2133020 - RNA, 12 nt, Human
uucaauaaagua

SEQ ID NO: 2133021 - RNA, 14 nt, Human
uucaauaaaguauc

SEQ ID NO: 2133022 - RNA, 19 nt, Human
uucaauaaaguaucuacau

SEQ ID NO: 2133023 - RNA, 23 nt, Human
uucagcaccuacaguguacaguc

SEQ ID NO: 2133024 - RNA, 22 nt, Human
uucagcaccuacaguguacagu

SEQ ID NO: 2133025 - RNA, 18 nt, Human
uucagcaauauuuaagga

SEQ ID NO: 2133026 - RNA, 21 nt, Human
uucagcaauauuuaaggagau

SEQ ID NO: 2133027 - RNA, 16 nt, Human
uucagcaccacccuag

SEQ ID NO: 2133028 - RNA, 17 nt, Human
uucagccaggagcuggg

SEQ ID NO: 2133029 - RNA, 13 nt, Human
uucagccccuccu

SEQ ID NO: 2133030 - RNA, 13 nt, Human
uucagccaggagc

SEQ ID NO: 2133031 - RNA, 12 nt, Human
uucagccaggag

SEQ ID NO: 2133032 - RNA, 15 nt, Human
uucagcccucagaau

SEQ ID NO: 2133033 - RNA, 14 nt, Human
uucagccccuccuc

SEQ ID NO: 2133034 - RNA, 15 nt, Human
uucagccccuccucu

SEQ ID NO: 2133035 - RNA, 16 nt, Human
uucagccccuccucug

SEQ ID NO: 2133036 - RNA, 17 nt, Human
uucagccccuccucugc

SEQ ID NO: 2133037 - RNA, 18 nt, Human
uucagccccuccucugcc

SEQ ID NO: 2133038 - RNA, 19 nt, Human
uucagccccuccucugcca

SEQ ID NO: 2133039 - RNA, 20 nt, Human
uucagccccuccucugccac

SEQ ID NO: 2133040 - RNA, 23 nt, Human
uucagccccuccucugccaccuc

SEQ ID NO: 2133041 - RNA, 14 nt, Human
uucagaugcuuuag

SEQ ID NO: 2133042 - RNA, 13 nt, Human
uucagauccuacc

SEQ ID NO: 2133043 - RNA, 14 nt, Human
uucagauccuaccc

SEQ ID NO: 2133044 - RNA, 15 nt, Human
uucagauccuacccc

SEQ ID NO: 2133045 - RNA, 15 nt, Human
uucagaugcuucugg

SEQ ID NO: 2133046 - RNA, 19 nt, Human
uucagaugcuucugggaga

SEQ ID NO: 2133047 - RNA, 17 nt, Human
uucagaucagugcuuga

SEQ ID NO: 2133048 - RNA, 15 nt, Human
uucagacacuuugga

SEQ ID NO: 2133049 - RNA, 16 nt, Human
uucagacacuuuggaa

SEQ ID NO: 2133050 - RNA, 13 nt, Human
uucagaaucugaa

SEQ ID NO: 2133051 - RNA, 15 nt, Human
uucagaaucugaaug

SEQ ID NO: 2133052 - RNA, 17 nt, Human
uucagaaucugaaugua

SEQ ID NO: 2133053 - RNA, 18 nt, Human
uucagaaucugaauguaa

SEQ ID NO: 2133054 - RNA, 21 nt, Human
uucagaaucugaauguaauuu

SEQ ID NO: 2133055 - RNA, 23 nt, Human
uucagaaucugaauguaauuugu

SEQ ID NO: 2133056 - RNA, 13 nt, Human
uucacuggcccaa

SEQ ID NO: 2133057 - RNA, 15 nt, Human
uucagaaagaagugg

SEQ ID NO: 2133058 - RNA, 12 nt, Human
uucagaagagau

SEQ ID NO: 2133059 - RNA, 19 nt, Human
uucacugcuggcugccuua

SEQ ID NO: 2133060 - RNA, 18 nt, Human
uucacugcuggcugccuu

SEQ ID NO: 2133061 - RNA, 17 nt, Human
uucacugcuggcugccu

SEQ ID NO: 2133062 - RNA, 16 nt, Human
uucacugcuggcugcc

SEQ ID NO: 2133063 - RNA, 15 nt, Human
uucacugcuggcugc

SEQ ID NO: 2133064 - RNA, 13 nt, Human
uucacugcuggcu

SEQ ID NO: 2133065 - RNA, 13 nt, Human
auauauagaaucu

SEQ ID NO: 2133066 - RNA, 14 nt, Human
auauauacauauau

SEQ ID NO: 2133067 - RNA, 14 nt, Human
auauauacauaaca

SEQ ID NO: 2133068 - RNA, 17 nt, Human
auauaaauuuuuuuugu

SEQ ID NO: 2133069 - RNA, 22 nt, Human
auauaaauuuuuuuuguuucau

SEQ ID NO: 2133070 - RNA, 18 nt, Human
auauaaagaccuauaaau

SEQ ID NO: 2133071 - RNA, 23 nt, Human
auauaaggaaagcaauaaaugaa

SEQ ID NO: 2133072 - RNA, 15 nt, Human
auauaggaauuaaga

SEQ ID NO: 2133073 - RNA, 16 nt, Human
auauaguuuacuauuu

SEQ ID NO: 2133074 - RNA, 17 nt, Human
auauaguaccuuugcuc

SEQ ID NO: 2133075 - RNA, 21 nt, Human
auauauacacacacaaagaga

SEQ ID NO: 2133076 - RNA, 19 nt, Human
auagucaauguuucuuuua

SEQ ID NO: 2133077 - RNA, 14 nt, Human
auagucacaagagc

SEQ ID NO: 2133078 - RNA, 21 nt, Human
auagggucucuucagguucuu

SEQ ID NO: 2133079 - RNA, 22 nt, Human
auagggccuggucccugggagg

SEQ ID NO: 2133080 - RNA, 16 nt, Human
auagggucucuucagg

SEQ ID NO: 2133081 - RNA, 15 nt, Human
auagucaccuuuuaa

SEQ ID NO: 2133082 - RNA, 16 nt, Human
auagucaccuuuuaaa

SEQ ID NO: 2133083 - RNA, 23 nt, Human
auagucaccuuuuaaauccuguu

SEQ ID NO: 2133084 - RNA, 13 nt, Human
auauaaacacuau

SEQ ID NO: 2133085 - RNA, 15 nt, Human
auauaaacacuauau

SEQ ID NO: 2133086 - RNA, 13 nt, Human
auauaaagagaaa

SEQ ID NO: 2133087 - RNA, 15 nt, Human
auauaaagagaaaau

SEQ ID NO: 2133088 - RNA, 17 nt, Human
auauaaagagaaaauug

SEQ ID NO: 2133089 - RNA, 19 nt, Human
auaugcacacagugcuuuc

SEQ ID NO: 2133090 - RNA, 16 nt, Human
auauguauuaauauuc

SEQ ID NO: 2133091 - RNA, 16 nt, Human
auauguauguguguau

SEQ ID NO: 2133092 - RNA, 15 nt, Human
auauguaugugugua

SEQ ID NO: 2133093 - RNA, 14 nt, Human
auauguaugguuuu

SEQ ID NO: 2133094 - RNA, 13 nt, Human
auauguauguaaa

SEQ ID NO: 2133095 - RNA, 15 nt, Human
auauguauguaaaaa

SEQ ID NO: 2133096 - RNA, 18 nt, Human
auauguauccaguacauu

SEQ ID NO: 2133097 - RNA, 19 nt, Human
auauguauccaguacauuu

SEQ ID NO: 2133098 - RNA, 22 nt, Human
auauguauccaguacauuuaau

SEQ ID NO: 2133099 - RNA, 14 nt, Human
auaugucaagccau

SEQ ID NO: 2133100 - RNA, 13 nt, Human
auauguauuuuau

SEQ ID NO: 2133101 - RNA, 17 nt, Human
auauguauuuuauguau

SEQ ID NO: 2133102 - RNA, 18 nt, Human
auauguauuuuauguaug

SEQ ID NO: 2133103 - RNA, 19 nt, Human
auauguauuuuauguaugu

SEQ ID NO: 2133104 - RNA, 22 nt, Human
auauguauuuuauguauguuua

SEQ ID NO: 2133105 - RNA, 14 nt, Human
auaugucagggcgu

SEQ ID NO: 2133106 - RNA, 22 nt, Human
auaucugaaaauguauguguaa

SEQ ID NO: 2133107 - RNA, 20 nt, Human
auaucuaucuuauauaguuu

SEQ ID NO: 2133108 - RNA, 21 nt, Human
auaucuaucuuauauaguuua

SEQ ID NO: 2133109 - RNA, 15 nt, Human
auaucuaucagagua

SEQ ID NO: 2133110 - RNA, 13 nt, Human
auaucuaucuuau

SEQ ID NO: 2133111 - RNA, 14 nt, Human
auaucuaucuuaua

SEQ ID NO: 2133112 - RNA, 12 nt, Human
auaucuucacaa

SEQ ID NO: 2133113 - RNA, 16 nt, Human
auaucuguuuuacugc

SEQ ID NO: 2133114 - RNA, 20 nt, Human
auaucuguuuuacugcuuuu

SEQ ID NO: 2133115 - RNA, 13 nt, Human
auaucugcuguau

SEQ ID NO: 2133116 - RNA, 15 nt, Human
auaucugcuguaugu

SEQ ID NO: 2133117 - RNA, 16 nt, Human
auaucugcuguauguc

SEQ ID NO: 2133118 - RNA, 20 nt, Human
auaugauuuaaaucagccgu

SEQ ID NO: 2133119 - RNA, 15 nt, Human
auaucuugaaaugaa

SEQ ID NO: 2133120 - RNA, 19 nt, Human
auaucuucugauuuguccc

SEQ ID NO: 2133121 - RNA, 20 nt, Human
auaucuaauuauuuugcagu

SEQ ID NO: 2133122 - RNA, 18 nt, Human
uucauccaauccucacug

SEQ ID NO: 2133123 - RNA, 20 nt, Human
uucauccaauccucacuggg

SEQ ID NO: 2133124 - RNA, 21 nt, Human
uucauccaauccucacugggu

SEQ ID NO: 2133125 - RNA, 22 nt, Human
uucauccaauccucacugggug

SEQ ID NO: 2133126 - RNA, 16 nt, Human
uucauccaauccucac

SEQ ID NO: 2133127 - RNA, 18 nt, Human
uucaucauccuaagcuau

SEQ ID NO: 2133128 - RNA, 21 nt, Human
uucaucauccuaagcuauuca

SEQ ID NO: 2133129 - RNA, 18 nt, Human
uucagggcagggcucuga

SEQ ID NO: 2133130 - RNA, 13 nt, Human
uucagggccucca

SEQ ID NO: 2133131 - RNA, 16 nt, Human
uucaggggacucagcc

SEQ ID NO: 2133132 - RNA, 17 nt, Human
uucaggggacucagccc

SEQ ID NO: 2133133 - RNA, 19 nt, Human
uucaggggacucagcccug

SEQ ID NO: 2133134 - RNA, 20 nt, Human
uucaggggacucagcccuga

SEQ ID NO: 2133135 - RNA, 20 nt, Human
uucagccuagccgaccucag

SEQ ID NO: 2133136 - RNA, 21 nt, Human
uucagccuagccgaccucagc

SEQ ID NO: 2133137 - RNA, 22 nt, Human
uucagccuagccgaccucagcc

SEQ ID NO: 2133138 - RNA, 23 nt, Human
uucagccuagccgaccucagccu

SEQ ID NO: 2133139 - RNA, 14 nt, Human
uucaguaauaacuc

SEQ ID NO: 2133140 - RNA, 13 nt, Human
uucagggggccag

SEQ ID NO: 2133141 - RNA, 21 nt, Human
uucaggggagucccgucagga

SEQ ID NO: 2133142 - RNA, 23 nt, Human
uucaggggacucagcccugaggu

SEQ ID NO: 2133143 - RNA, 13 nt, Human
uucagggucauag

SEQ ID NO: 2133144 - RNA, 22 nt, Human
uucagggggccaggugcacaga

SEQ ID NO: 2133145 - RNA, 14 nt, Human
uucauagauuuccu

SEQ ID NO: 2133146 - RNA, 20 nt, Human
uucauagcugguuccugcua

SEQ ID NO: 2133147 - RNA, 22 nt, Human
uucauagcugguuccugcuaga

SEQ ID NO: 2133148 - RNA, 13 nt, Human
uucauaggagaca

SEQ ID NO: 2133149 - RNA, 16 nt, Human
uucauaggagacacau

SEQ ID NO: 2133150 - RNA, 19 nt, Human
uucauagggucucuucagg

SEQ ID NO: 2133151 - RNA, 16 nt, Human
uucauauuuacuucuu

SEQ ID NO: 2133152 - RNA, 21 nt, Human
uucauauuuacuucuuauaca

SEQ ID NO: 2133153 - RNA, 16 nt, Human
uucaguauaauuuaac

SEQ ID NO: 2133154 - RNA, 20 nt, Human
uucaguauaauuuaacuuca

SEQ ID NO: 2133155 - RNA, 23 nt, Human
uucaguauaauuuaacuucagag

SEQ ID NO: 2133156 - RNA, 14 nt, Human
uuguaaauuucucu

SEQ ID NO: 2133157 - RNA, 16 nt, Human
uuguaacaagaaaaca

SEQ ID NO: 2133158 - RNA, 17 nt, Human
uuguaacaagaaaacau

SEQ ID NO: 2133159 - RNA, 17 nt, Human
uuguaagagcuauacag

SEQ ID NO: 2133160 - RNA, 18 nt, Human
uuguaagagcuauacagu

SEQ ID NO: 2133161 - RNA, 21 nt, Human
uuguaagagcuauacaguuuu

SEQ ID NO: 2133162 - RNA, 18 nt, Human
uuguaauaaaguauauaa

SEQ ID NO: 2133163 - RNA, 19 nt, Human
uuguaauaaaguauauaau

SEQ ID NO: 2133164 - RNA, 20 nt, Human
uuguaauaaaguauauaauu

SEQ ID NO: 2133165 - RNA, 11 nt, Human
uuguaagauuu

SEQ ID NO: 2133166 - RNA, 14 nt, Human
uuguaagauuuuga

SEQ ID NO: 2133167 - RNA, 15 nt, Human
uuguaagauuuugaa

SEQ ID NO: 2133168 - RNA, 16 nt, Human
uuguaagauuuugaaa

SEQ ID NO: 2133169 - RNA, 17 nt, Human
uuguaagauuuugaaaa

SEQ ID NO: 2133170 - RNA, 19 nt, Human
uuguaagauuuugaaaacu

SEQ ID NO: 2133171 - RNA, 12 nt, Human
uuguaauuuucu

SEQ ID NO: 2133172 - RNA, 13 nt, Human
uuguaauuuucuu

SEQ ID NO: 2133173 - RNA, 15 nt, Human
uuguaauuuucuuga

SEQ ID NO: 2133174 - RNA, 16 nt, Human
uuguaauuuucuugau

SEQ ID NO: 2133175 - RNA, 19 nt, Human
uuguaauuuucuugaugac

SEQ ID NO: 2133176 - RNA, 22 nt, Human
uuguaauuuucuugaugacugg

SEQ ID NO: 2133177 - RNA, 23 nt, Human
uuguaauuuucuugaugacugga

SEQ ID NO: 2133178 - RNA, 15 nt, Human
uuguaaucguuaugu

SEQ ID NO: 2133179 - RNA, 20 nt, Human
uuguaaucguuaugugugua

SEQ ID NO: 2133180 - RNA, 23 nt, Human
uuggguagaaagagauacagagg

SEQ ID NO: 2133181 - RNA, 14 nt, Human
uuggguaggcggga

SEQ ID NO: 2133182 - RNA, 21 nt, Human
uuggguauccugcccaguguu

SEQ ID NO: 2133183 - RNA, 20 nt, Human
uugggugcaagagggagcac

SEQ ID NO: 2133184 - RNA, 19 nt, Human
uugguuuuaauugaaggaa

SEQ ID NO: 2133185 - RNA, 20 nt, Human
uugguuuuaauugaaggaaa

SEQ ID NO: 2133186 - RNA, 22 nt, Human
uugguuuuaauugaaggaaaga

SEQ ID NO: 2133187 - RNA, 13 nt, Human
uugguguugacau

SEQ ID NO: 2133188 - RNA, 23 nt, Human
uugguguguuuuugggaugucuu

SEQ ID NO: 2133189 - RNA, 18 nt, Human
uugguggcucacgccugu

SEQ ID NO: 2133190 - RNA, 14 nt, Human
uugguggauguaaa

SEQ ID NO: 2133191 - RNA, 15 nt, Human
uugguggauguaaau

SEQ ID NO: 2133192 - RNA, 16 nt, Human
uugguggauguaaaua

SEQ ID NO: 2133193 - RNA, 21 nt, Human
uugguggcagauuuuacaaaa

SEQ ID NO: 2133194 - RNA, 12 nt, Human
uuggugguuuuu

SEQ ID NO: 2133195 - RNA, 16 nt, Human
augaaagugagacuuu

SEQ ID NO: 2133196 - RNA, 18 nt, Human
augaaagucuugugacua

SEQ ID NO: 2133197 - RNA, 19 nt, Human
augaaagucuugugacuag

SEQ ID NO: 2133198 - RNA, 19 nt, Human
augaaauaaaucauguuaa

SEQ ID NO: 2133199 - RNA, 17 nt, Human
augaaauaaaugcccca

SEQ ID NO: 2133200 - RNA, 20 nt, Human
augaaagucuugugacuagu

SEQ ID NO: 2133201 - RNA, 15 nt, Human
uuggaggccagccag

SEQ ID NO: 2133202 - RNA, 19 nt, Human
uuggaggaccaaaaaaaua

SEQ ID NO: 2133203 - RNA, 21 nt, Human
augaaauuuaauauagcuauu

SEQ ID NO: 2133204 - RNA, 14 nt, Human
augaaauuuuacca

SEQ ID NO: 2133205 - RNA, 15 nt, Human
augaaauuuuaccaa

SEQ ID NO: 2133206 - RNA, 16 nt, Human
augaaauuuuaccaag

SEQ ID NO: 2133207 - RNA, 18 nt, Human
augaaauuuuaccaaguu

SEQ ID NO: 2133208 - RNA, 20 nt, Human
augaaauuuuaccaaguuau

SEQ ID NO: 2133209 - RNA, 21 nt, Human
augaaauuuuaccaaguuaua

SEQ ID NO: 2133210 - RNA, 15 nt, Human
augaaauaugcaucu

SEQ ID NO: 2133211 - RNA, 13 nt, Human
augaaauaugcau

SEQ ID NO: 2133212 - RNA, 13 nt, Human
augaaauaucaga

SEQ ID NO: 2133213 - RNA, 19 nt, Human
augaaauaucagacuagug

SEQ ID NO: 2133214 - RNA, 18 nt, Human
augaacacaucagcuagc

SEQ ID NO: 2133215 - RNA, 22 nt, Human
augaaccacaucuugcucugcu

SEQ ID NO: 2133216 - RNA, 23 nt, Human
augaaccacaucuugcucugcug

SEQ ID NO: 2133217 - RNA, 15 nt, Human
augaagcaaacacau

SEQ ID NO: 2133218 - RNA, 17 nt, Human
augaaugaaacauuuug

SEQ ID NO: 2133219 - RNA, 15 nt, Human
augaauguaucagga

SEQ ID NO: 2133220 - RNA, 16 nt, Human
augaauguaucaggaa

SEQ ID NO: 2133221 - RNA, 21 nt, Human
augaagaaaagugggccagug

SEQ ID NO: 2133222 - RNA, 22 nt, Human
augaagaaaagugggccagugu

SEQ ID NO: 2133223 - RNA, 14 nt, Human
augaagcaaacaca

SEQ ID NO: 2133224 - RNA, 12 nt, Human
augaagauuauu

SEQ ID NO: 2133225 - RNA, 20 nt, Human
augaagauuauuuuuuauga

SEQ ID NO: 2133226 - RNA, 21 nt, Human
augaagaugucuaauaguuau

SEQ ID NO: 2133227 - RNA, 22 nt, Human
augaagauguuucaaaaaaucu

SEQ ID NO: 2133228 - RNA, 15 nt, Human
augaagaaaaaauac

SEQ ID NO: 2133229 - RNA, 17 nt, Human
augaagaaaaaauacau

SEQ ID NO: 2133230 - RNA, 19 nt, Human
augaagaaaaaauacauuu

SEQ ID NO: 2133231 - RNA, 20 nt, Human
augaagaaaaaauacauuuu

SEQ ID NO: 2133232 - RNA, 22 nt, Human
augaagaaaaaauacauuuuau

SEQ ID NO: 2133233 - RNA, 19 nt, Human
augaagaaaagugggccag

SEQ ID NO: 2133234 - RNA, 12 nt, Human
aucuuaacucuu

SEQ ID NO: 2133235 - RNA, 13 nt, Human
aucuuaacucuuu

SEQ ID NO: 2133236 - RNA, 14 nt, Human
aucuuaacucuuug

SEQ ID NO: 2133237 - RNA, 15 nt, Human
aucuuaacucuuugc

SEQ ID NO: 2133238 - RNA, 23 nt, Human
aucuuaacucuuugccuuugcca

SEQ ID NO: 2133239 - RNA, 19 nt, Human
aucuuaaaguguguuucua

SEQ ID NO: 2133240 - RNA, 14 nt, Human
aucuugcucugcug

SEQ ID NO: 2133241 - RNA, 14 nt, Human
aucuuggacugaca

SEQ ID NO: 2133242 - RNA, 16 nt, Human
aucuuggacugacauu

SEQ ID NO: 2133243 - RNA, 19 nt, Human
aucuuggacugacauuuag

SEQ ID NO: 2133244 - RNA, 21 nt, Human
aucuuggacugacauuuagcg

SEQ ID NO: 2133245 - RNA, 16 nt, Human
aucuugcucugcugac

SEQ ID NO: 2133246 - RNA, 15 nt, Human
aucuugcucugcuga

SEQ ID NO: 2133247 - RNA, 12 nt, Human
aucuuggcaggg

SEQ ID NO: 2133248 - RNA, 14 nt, Human
aucuuguuuccaaa

SEQ ID NO: 2133249 - RNA, 22 nt, Human
aucugucauuugagcagggcuc

SEQ ID NO: 2133250 - RNA, 17 nt, Human
aucugucauuugagcag

SEQ ID NO: 2133251 - RNA, 12 nt, Human
aucugucauuug

SEQ ID NO: 2133252 - RNA, 17 nt, Human
uugcccggauucuggga

SEQ ID NO: 2133253 - RNA, 13 nt, Human
uugccccugagac

SEQ ID NO: 2133254 - RNA, 12 nt, Human
uugccccccacc

SEQ ID NO: 2133255 - RNA, 13 nt, Human
uugccccccaccc

SEQ ID NO: 2133256 - RNA, 16 nt, Human
uugccccccaccccag

SEQ ID NO: 2133257 - RNA, 19 nt, Human
uugccccccaccccagccu

SEQ ID NO: 2133258 - RNA, 19 nt, Human
uugcccggauucugggagg

SEQ ID NO: 2133259 - RNA, 15 nt, Human
uugcccuagaugagc

SEQ ID NO: 2133260 - RNA, 21 nt, Human
aucugugcccagagaugggac

SEQ ID NO: 2133261 - RNA, 16 nt, Human
aucugugcgugaaaca

SEQ ID NO: 2133262 - RNA, 17 nt, Human
aucugugcgugaaacac

SEQ ID NO: 2133263 - RNA, 18 nt, Human
aucugugcgugaaacaca

SEQ ID NO: 2133264 - RNA, 19 nt, Human
aucugugcgugaaacacac

SEQ ID NO: 2133265 - RNA, 12 nt, Human
aucugugcccca

SEQ ID NO: 2133266 - RNA, 13 nt, Human
aucugugccccau

SEQ ID NO: 2133267 - RNA, 15 nt, Human
aucugugccccaugc

SEQ ID NO: 2133268 - RNA, 23 nt, Human
aucugugccccaugccuguccag

SEQ ID NO: 2133269 - RNA, 22 nt, Human
aucugugcaaauccuugauacu

SEQ ID NO: 2133270 - RNA, 14 nt, Human
aucugugcccagag

SEQ ID NO: 2133271 - RNA, 17 nt, Human
aucugugcccagagaug

SEQ ID NO: 2133272 - RNA, 13 nt, Human
aucuguguccugg

SEQ ID NO: 2133273 - RNA, 22 nt, Human
aucugugggcauggucaaaggc

SEQ ID NO: 2133274 - RNA, 19 nt, Human
aucugugggcauggucaaa

SEQ ID NO: 2133275 - RNA, 19 nt, Human
uuggaaaagaauacagaaa

SEQ ID NO: 2133276 - RNA, 22 nt, Human
uuggaaaagaauacagaaagau

SEQ ID NO: 2133277 - RNA, 15 nt, Human
uuggacugacauuua

SEQ ID NO: 2133278 - RNA, 18 nt, Human
uuggacucuccccucuua

SEQ ID NO: 2133279 - RNA, 14 nt, Human
uuggacugacauuu

SEQ ID NO: 2133280 - RNA, 15 nt, Human
uuggaaaauaaauca

SEQ ID NO: 2133281 - RNA, 12 nt, Human
uuggaaaauaaa

SEQ ID NO: 2133282 - RNA, 17 nt, Human
uuggaaaauaaauuauu

SEQ ID NO: 2133283 - RNA, 16 nt, Human
uugcuuuguaugcacu

SEQ ID NO: 2133284 - RNA, 14 nt, Human
uuggaaaagaauac

SEQ ID NO: 2133285 - RNA, 21 nt, Human
uuggaaaaauccagaaagaaa

SEQ ID NO: 2133286 - RNA, 18 nt, Human
uuggacuuuucguuaaca

SEQ ID NO: 2133287 - RNA, 20 nt, Human
uuggacuuuucguuaacauu

SEQ ID NO: 2133288 - RNA, 22 nt, Human
uuggacuuuucguuaacauuga

SEQ ID NO: 2133289 - RNA, 22 nt, Human
uugcucuugcagagaagccuug

SEQ ID NO: 2133290 - RNA, 14 nt, Human
uugcugaaagaucu

SEQ ID NO: 2133291 - RNA, 15 nt, Human
aucuuguuuuuccac

SEQ ID NO: 2133292 - RNA, 23 nt, Human
aucuuguuuuuccacuacugcua

SEQ ID NO: 2133293 - RNA, 19 nt, Human
uugcucuuaaguuguggag

SEQ ID NO: 2133294 - RNA, 13 nt, Human
uugcuuuguaugc

SEQ ID NO: 2133295 - RNA, 14 nt, Human
uugcuuucugaaau

SEQ ID NO: 2133296 - RNA, 15 nt, Human
uugcuuucugaaauu

SEQ ID NO: 2133297 - RNA, 15 nt, Human
uugcuucugggaagg

SEQ ID NO: 2133298 - RNA, 19 nt, Human
uugcuucugggaagggguu

SEQ ID NO: 2133299 - RNA, 12 nt, Human
uugcuucuguag

SEQ ID NO: 2133300 - RNA, 13 nt, Human
uugcuuucugaaa

SEQ ID NO: 2133301 - RNA, 21 nt, Human
uugcuuugaaacuagacuuga

SEQ ID NO: 2133302 - RNA, 21 nt, Human
uugcuucauagcugguuccug

SEQ ID NO: 2133303 - RNA, 12 nt, Human
uugcuuaugaau

SEQ ID NO: 2133304 - RNA, 15 nt, Human
uugcuuauuguucca

SEQ ID NO: 2133305 - RNA, 16 nt, Human
uugcuuauuguuccaa

SEQ ID NO: 2133306 - RNA, 18 nt, Human
uugcuuauuguuccaaga

SEQ ID NO: 2133307 - RNA, 20 nt, Human
uugcuuauuguuccaagaca

SEQ ID NO: 2133308 - RNA, 22 nt, Human
uugcuuauuguuccaagacauu

SEQ ID NO: 2133309 - RNA, 23 nt, Human
uugcuuauuguuccaagacauug

SEQ ID NO: 2133310 - RNA, 13 nt, Human
uugcuuauuuaau

SEQ ID NO: 2133311 - RNA, 16 nt, Human
uugcuuauuuaauaaa

SEQ ID NO: 2133312 - RNA, 22 nt, Human
aucucuuuguucuaaagaugga

SEQ ID NO: 2133313 - RNA, 15 nt, Human
aucucuugaggccag

SEQ ID NO: 2133314 - RNA, 22 nt, Human
aucucuuuugaauccaugcuug

SEQ ID NO: 2133315 - RNA, 21 nt, Human
aucugaagagcuauuauauaa

SEQ ID NO: 2133316 - RNA, 17 nt, Human
aucugaauaccucuuug

SEQ ID NO: 2133317 - RNA, 22 nt, Human
aucugaauaccucuuugaaaga

SEQ ID NO: 2133318 - RNA, 15 nt, Human
aucucacagcacacu

SEQ ID NO: 2133319 - RNA, 20 nt, Human
aucucacagcacacucagca

SEQ ID NO: 2133320 - RNA, 13 nt, Human
aucucaccccauc

SEQ ID NO: 2133321 - RNA, 14 nt, Human
aucucaccccaucc

SEQ ID NO: 2133322 - RNA, 16 nt, Human
aucucaccccauccca

SEQ ID NO: 2133323 - RNA, 22 nt, Human
aucucaccccaucccacacccu

SEQ ID NO: 2133324 - RNA, 23 nt, Human
aucucaccccaucccacacccug

SEQ ID NO: 2133325 - RNA, 14 nt, Human
uugcaagaaucagu

SEQ ID NO: 2133326 - RNA, 13 nt, Human
uugauguuugugg

SEQ ID NO: 2133327 - RNA, 15 nt, Human
uugauguuuguggcc

SEQ ID NO: 2133328 - RNA, 16 nt, Human
uugauguuuguggccu

SEQ ID NO: 2133329 - RNA, 17 nt, Human
uugauguuuguggccuc

SEQ ID NO: 2133330 - RNA, 18 nt, Human
uugauguuuguggccuca

SEQ ID NO: 2133331 - RNA, 19 nt, Human
uugauguuuguggccucag

SEQ ID NO: 2133332 - RNA, 13 nt, Human
aucugacugcacg

SEQ ID NO: 2133333 - RNA, 22 nt, Human
uugcaauagaaauccaauugga

SEQ ID NO: 2133334 - RNA, 19 nt, Human
uugcaauaucgaucagaug

SEQ ID NO: 2133335 - RNA, 14 nt, Human
uugcaauggcagcc

SEQ ID NO: 2133336 - RNA, 15 nt, Human
uugcaauagaaaucc

SEQ ID NO: 2133337 - RNA, 20 nt, Human
uugauguuuguggccucaga

SEQ ID NO: 2133338 - RNA, 21 nt, Human
uugcaccacugcacuccagcc

SEQ ID NO: 2133339 - RNA, 16 nt, Human
uugcauggguuuugua

SEQ ID NO: 2133340 - RNA, 17 nt, Human
uugcauggguuuuguag

SEQ ID NO: 2133341 - RNA, 20 nt, Human
uugcauggguuuuguaggua

SEQ ID NO: 2133342 - RNA, 15 nt, Human
uugcaugcugcuuua

SEQ ID NO: 2133343 - RNA, 21 nt, Human
uugcaugcugcuuuaauugug

SEQ ID NO: 2133344 - RNA, 22 nt, Human
uugcaugcugcuuuaauuguga

SEQ ID NO: 2133345 - RNA, 17 nt, Human
uugcaccuaccucacag

SEQ ID NO: 2133346 - RNA, 20 nt, Human
uugccaagaacugaaaacau

SEQ ID NO: 2133347 - RNA, 13 nt, Human
uugcaaugaagga

SEQ ID NO: 2133348 - RNA, 15 nt, Human
uugcccauuuacacu

SEQ ID NO: 2133349 - RNA, 16 nt, Human
uugcccauuuacacuu

SEQ ID NO: 2133350 - RNA, 18 nt, Human
uugcccaggcuggucuca

SEQ ID NO: 2133351 - RNA, 17 nt, Human
uugcccagggcucagcc

SEQ ID NO: 2133352 - RNA, 18 nt, Human
uugcccagggcucagccu

SEQ ID NO: 2133353 - RNA, 19 nt, Human
uugcccagggcucagccug

SEQ ID NO: 2133354 - RNA, 20 nt, Human
uugcccagggcucagccugg

SEQ ID NO: 2133355 - RNA, 23 nt, Human
uugcccaggcuggcgugcagugg

SEQ ID NO: 2133356 - RNA, 14 nt, Human
uugcccaggcuggc

SEQ ID NO: 2133357 - RNA, 12 nt, Human
uugcccaggcug

SEQ ID NO: 2133358 - RNA, 11 nt, Human
uugcccaggcu

SEQ ID NO: 2133359 - RNA, 18 nt, Human
uugcccaggcaggucuug

SEQ ID NO: 2133360 - RNA, 16 nt, Human
uugcccaggcaggucu

SEQ ID NO: 2133361 - RNA, 14 nt, Human
uugcccaggcaggu

SEQ ID NO: 2133362 - RNA, 13 nt, Human
uugcccaggcagg

SEQ ID NO: 2133363 - RNA, 15 nt, Human
uugccacaacccugu

SEQ ID NO: 2133364 - RNA, 13 nt, Human
uugccacagcucu

SEQ ID NO: 2133365 - RNA, 21 nt, Human
uugccaaugaggucugaaaug

SEQ ID NO: 2133366 - RNA, 19 nt, Human
uugccaccaacuggcccuc

SEQ ID NO: 2133367 - RNA, 21 nt, Human
uugccaccaacuggcccucuu

SEQ ID NO: 2133368 - RNA, 13 nt, Human
uugccaccaggag

SEQ ID NO: 2133369 - RNA, 14 nt, Human
uugccaccaggaga

SEQ ID NO: 2133370 - RNA, 15 nt, Human
uugccaccaggagaa

SEQ ID NO: 2133371 - RNA, 16 nt, Human
uugccaccaggagaac

SEQ ID NO: 2133372 - RNA, 12 nt, Human
uugacagggcac

SEQ ID NO: 2133373 - RNA, 10 nt, Human
uugacagggc

SEQ ID NO: 2133374 - RNA, 19 nt, Human
uugacaggauuauuggaaa

SEQ ID NO: 2133375 - RNA, 18 nt, Human
uugacaauaauuucaggu

SEQ ID NO: 2133376 - RNA, 14 nt, Human
aucccuuuucuuga

SEQ ID NO: 2133377 - RNA, 15 nt, Human
aucccuuuucuugac

SEQ ID NO: 2133378 - RNA, 15 nt, Human
uugacaauuccuaga

SEQ ID NO: 2133379 - RNA, 19 nt, Human
uugacaauuccuagauaaa

SEQ ID NO: 2133380 - RNA, 19 nt, Human
aucccuuccuuuuagccua

SEQ ID NO: 2133381 - RNA, 21 nt, Human
aucccuuccuuuuagccuagu

SEQ ID NO: 2133382 - RNA, 11 nt, Human
uugagacagag

SEQ ID NO: 2133383 - RNA, 13 nt, Human
uugagaauuuuaa

SEQ ID NO: 2133384 - RNA, 23 nt, Human
uugagaaaccuuauuguaccucu

SEQ ID NO: 2133385 - RNA, 20 nt, Human
uugagaaacaaauaauuugu

SEQ ID NO: 2133386 - RNA, 13 nt, Human
uugagacaaaaau

SEQ ID NO: 2133387 - RNA, 15 nt, Human
uugagacaaaaauua

SEQ ID NO: 2133388 - RNA, 16 nt, Human
uugagacaaaaauuau

SEQ ID NO: 2133389 - RNA, 17 nt, Human
uugagacaaaaauuauc

SEQ ID NO: 2133390 - RNA, 23 nt, Human
uugagacaaaaauuaucuauuug

SEQ ID NO: 2133391 - RNA, 12 nt, Human
uugagcagggcu

SEQ ID NO: 2133392 - RNA, 16 nt, Human
uugagcagggcucagc

SEQ ID NO: 2133393 - RNA, 22 nt, Human
uugagaaaccuuauuguaccuc

SEQ ID NO: 2133394 - RNA, 10 nt, Human
uugagaaacc

SEQ ID NO: 2133395 - RNA, 14 nt, Human
uugacauguggaaa

SEQ ID NO: 2133396 - RNA, 22 nt, Human
uugacauguggaaagugaauuu

SEQ ID NO: 2133397 - RNA, 14 nt, Human
uugaccaagaacug

SEQ ID NO: 2133398 - RNA, 15 nt, Human
uugaccaagaacugc

SEQ ID NO: 2133399 - RNA, 16 nt, Human
uugaccaagaacugca

SEQ ID NO: 2133400 - RNA, 17 nt, Human
uugaccaagaacugcau

SEQ ID NO: 2133401 - RNA, 18 nt, Human
uugaccaagaacugcaug

SEQ ID NO: 2133402 - RNA, 21 nt, Human
uugaccaagaacugcauggac

SEQ ID NO: 2133403 - RNA, 16 nt, Human
uugaccaagcaggaag

SEQ ID NO: 2133404 - RNA, 18 nt, Human
uugaccaagcaggaagcu

SEQ ID NO: 2133405 - RNA, 20 nt, Human
uugaccaagcaggaagcuca

SEQ ID NO: 2133406 - RNA, 22 nt, Human
uugaccaagcaggaagcucaga

SEQ ID NO: 2133407 - RNA, 21 nt, Human
uugaccagcagaucccagcuc

SEQ ID NO: 2133408 - RNA, 22 nt, Human
uugaccagcagaucccagcuca

SEQ ID NO: 2133409 - RNA, 21 nt, Human
uugagugcugucuccauguuu

SEQ ID NO: 2133410 - RNA, 17 nt, Human
uugaguguuuuaagaua

SEQ ID NO: 2133411 - RNA, 17 nt, Human
uugaguggaugauguuu

SEQ ID NO: 2133412 - RNA, 19 nt, Human
uugaguggaugauguuucg

SEQ ID NO: 2133413 - RNA, 13 nt, Human
uugauacuuguuu

SEQ ID NO: 2133414 - RNA, 16 nt, Human
uugauacuuguucaaa

SEQ ID NO: 2133415 - RNA, 17 nt, Human
uugauacuuguucaaaa

SEQ ID NO: 2133416 - RNA, 23 nt, Human
aucuaauauguaacaagccaccc

SEQ ID NO: 2133417 - RNA, 20 nt, Human
aucuaauauguaacaagcca

SEQ ID NO: 2133418 - RNA, 16 nt, Human
aucuaauuauuuugca

SEQ ID NO: 2133419 - RNA, 16 nt, Human
aucuaccuuuucucuu

SEQ ID NO: 2133420 - RNA, 14 nt, Human
aucuagcaaauguu

SEQ ID NO: 2133421 - RNA, 18 nt, Human
aucuagcaaauguuaugc

SEQ ID NO: 2133422 - RNA, 23 nt, Human
aucucaaauaacuaaaagguaug

SEQ ID NO: 2133423 - RNA, 14 nt, Human
aucucaaauaacua

SEQ ID NO: 2133424 - RNA, 21 nt, Human
aucucaaauaacuaaaaggua

SEQ ID NO: 2133425 - RNA, 14 nt, Human
aucucaaaaaauaa

SEQ ID NO: 2133426 - RNA, 20 nt, Human
uuuacccuucuuuucugacu

SEQ ID NO: 2133427 - RNA, 21 nt, Human
augcuacuacaaaaaaguugu

SEQ ID NO: 2133428 - RNA, 13 nt, Human
uuuacccuuggcu

SEQ ID NO: 2133429 - RNA, 19 nt, Human
uuuaccuaccacagugucu

SEQ ID NO: 2133430 - RNA, 18 nt, Human
uuuaccuaccacaguguc

SEQ ID NO: 2133431 - RNA, 17 nt, Human
augcgaaugguagucua

SEQ ID NO: 2133432 - RNA, 19 nt, Human
augcuaccaugccucucca

SEQ ID NO: 2133433 - RNA, 22 nt, Human
uuuacugccaaagggaaauauc

SEQ ID NO: 2133434 - RNA, 16 nt, Human
uuuacugucuuaauua

SEQ ID NO: 2133435 - RNA, 21 nt, Human
uuuacugucuuaauuaaguaa

SEQ ID NO: 2133436 - RNA, 12 nt, Human
uuuacugcuuuu

SEQ ID NO: 2133437 - RNA, 11 nt, Human
uuuacuuaaac

SEQ ID NO: 2133438 - RNA, 14 nt, Human
uuuacuguuuguua

SEQ ID NO: 2133439 - RNA, 16 nt, Human
uuuacugcagcuuugu

SEQ ID NO: 2133440 - RNA, 21 nt, Human
uuuacugagcuucucugugaa

SEQ ID NO: 2133441 - RNA, 18 nt, Human
uuuacugagcuucucugu

SEQ ID NO: 2133442 - RNA, 17 nt, Human
uuuacugagcuucucug

SEQ ID NO: 2133443 - RNA, 14 nt, Human
uuuacugagcuucu

SEQ ID NO: 2133444 - RNA, 18 nt, Human
uuuacuccccuugagcug

SEQ ID NO: 2133445 - RNA, 12 nt, Human
uuuacuccccuu

SEQ ID NO: 2133446 - RNA, 13 nt, Human
uuuacuccccuug

SEQ ID NO: 2133447 - RNA, 13 nt, Human
uuuacuucuuaua

SEQ ID NO: 2133448 - RNA, 14 nt, Human
uuuacuucuuauac

SEQ ID NO: 2133449 - RNA, 15 nt, Human
uuuacuucuuauaca

SEQ ID NO: 2133450 - RNA, 17 nt, Human
uuuauauguauccagua

SEQ ID NO: 2133451 - RNA, 15 nt, Human
uuuaguguaaaaaug

SEQ ID NO: 2133452 - RNA, 16 nt, Human
uuuaguguaaaaauga

SEQ ID NO: 2133453 - RNA, 17 nt, Human
uuuaguguaaaaaugag

SEQ ID NO: 2133454 - RNA, 18 nt, Human
uuuaguguaaaaaugaga

SEQ ID NO: 2133455 - RNA, 22 nt, Human
uuuaguguaaaaaugagaacau

SEQ ID NO: 2133456 - RNA, 20 nt, Human
augccccuguacuccagccu

SEQ ID NO: 2133457 - RNA, 17 nt, Human
augcccagggccacucu

SEQ ID NO: 2133458 - RNA, 17 nt, Human
augccaucugugggcac

SEQ ID NO: 2133459 - RNA, 19 nt, Human
augccaucuguguccuggu

SEQ ID NO: 2133460 - RNA, 21 nt, Human
augcccagggccacucugccu

SEQ ID NO: 2133461 - RNA, 16 nt, Human
augcccagcucagagg

SEQ ID NO: 2133462 - RNA, 18 nt, Human
augccagcucagucccau

SEQ ID NO: 2133463 - RNA, 19 nt, Human
augccagcucagucccauc

SEQ ID NO: 2133464 - RNA, 20 nt, Human
augccagagcaaagggccag

SEQ ID NO: 2133465 - RNA, 21 nt, Human
uuuaaugaaagacuguacaaa

SEQ ID NO: 2133466 - RNA, 23 nt, Human
uuuaaugaaagacuguacaaagu

SEQ ID NO: 2133467 - RNA, 16 nt, Human
uuucccuauuagagaa

SEQ ID NO: 2133468 - RNA, 20 nt, Human
uuucccuaagccaagggccu

SEQ ID NO: 2133469 - RNA, 12 nt, Human
uuucccaagcug

SEQ ID NO: 2133470 - RNA, 15 nt, Human
uuucccaauuaggaa

SEQ ID NO: 2133471 - RNA, 21 nt, Human
uuuccauugguuuaccuguga

SEQ ID NO: 2133472 - RNA, 21 nt, Human
uuuccauuauuuauauuaguu

SEQ ID NO: 2133473 - RNA, 13 nt, Human
uuuccauuauuua

SEQ ID NO: 2133474 - RNA, 19 nt, Human
uuucauggggguauuaucc

SEQ ID NO: 2133475 - RNA, 23 nt, Human
uuucaucccuaugggauucagug

SEQ ID NO: 2133476 - RNA, 20 nt, Human
uuucagaaauaugugguuuc

SEQ ID NO: 2133477 - RNA, 16 nt, Human
uuucaucuauuucuga

SEQ ID NO: 2133478 - RNA, 13 nt, Human
uuucaucuauuuc

SEQ ID NO: 2133479 - RNA, 18 nt, Human
uuucaucuauuucugaga

SEQ ID NO: 2133480 - RNA, 16 nt, Human
uuucaucucuuguaua

SEQ ID NO: 2133481 - RNA, 20 nt, Human
uuucaaaccaguauacaaga

SEQ ID NO: 2133482 - RNA, 22 nt, Human
uuucaaaccaguauacaagaua

SEQ ID NO: 2133483 - RNA, 24 nt, Human
uuucaaaccaguauacaagauaag

SEQ ID NO: 2133484 - RNA, 15 nt, Human
uuucacauuaauauu

SEQ ID NO: 2133485 - RNA, 16 nt, Human
auggaaggguuugugg

SEQ ID NO: 2133486 - RNA, 16 nt, Human
uuucagaaauaugugg

SEQ ID NO: 2133487 - RNA, 19 nt, Human
uuucacuauuuuuauuuau

SEQ ID NO: 2133488 - RNA, 21 nt, Human
uuucagaaagaaguggggaca

SEQ ID NO: 2133489 - RNA, 23 nt, Human
uuucaccuguuuuuaagcuguuu

SEQ ID NO: 2133490 - RNA, 15 nt, Human
uuucacgggagauuu

SEQ ID NO: 2133491 - RNA, 22 nt, Human
uuucaccuguuuuuaagcuguu

SEQ ID NO: 2133492 - RNA, 14 nt, Human
augcuucugggaga

SEQ ID NO: 2133493 - RNA, 17 nt, Human
auggaagauuuuaaauu

SEQ ID NO: 2133494 - RNA, 16 nt, Human
auggaagauuuuaaau

SEQ ID NO: 2133495 - RNA, 17 nt, Human
augcuucugacuucaua

SEQ ID NO: 2133496 - RNA, 16 nt, Human
augcuucucacugcca

SEQ ID NO: 2133497 - RNA, 20 nt, Human
augcuucucacugccaugcc

SEQ ID NO: 2133498 - RNA, 20 nt, Human
augcuggcuguuggcugggg

SEQ ID NO: 2133499 - RNA, 19 nt, Human
augcuggcuguuggcuggg

SEQ ID NO: 2133500 - RNA, 20 nt, Human
augcugucaacuaugauaug

SEQ ID NO: 2133501 - RNA, 22 nt, Human
augcugucaacuaugauauggu

SEQ ID NO: 2133502 - RNA, 14 nt, Human
augcuguuucagag

SEQ ID NO: 2133503 - RNA, 15 nt, Human
augcuguugccucau

SEQ ID NO: 2133504 - RNA, 16 nt, Human
augcuguugccucauc

SEQ ID NO: 2133505 - RNA, 17 nt, Human
augcuguugccucaucu

SEQ ID NO: 2133506 - RNA, 18 nt, Human
augcuguugccucaucua

SEQ ID NO: 2133507 - RNA, 14 nt, Human
augcuguugccuca

SEQ ID NO: 2133508 - RNA, 18 nt, Human
augcuggcuguuggcugg

SEQ ID NO: 2133509 - RNA, 11 nt, Human
augcuggagcg

SEQ ID NO: 2133510 - RNA, 14 nt, Human
augcuggagcggcu

SEQ ID NO: 2133511 - RNA, 19 nt, Human
augcuggaugcuccuucca

SEQ ID NO: 2133512 - RNA, 18 nt, Human
augcuggcucccagggcc

SEQ ID NO: 2133513 - RNA, 19 nt, Human
augcuggcucccagggcca

SEQ ID NO: 2133514 - RNA, 14 nt, Human
augcuccuggccca

SEQ ID NO: 2133515 - RNA, 19 nt, Human
augcucaugguccccaugg

SEQ ID NO: 2133516 - RNA, 18 nt, Human
augcuggacaggucuggg

SEQ ID NO: 2133517 - RNA, 21 nt, Human
augcuggacaggucugggaga

SEQ ID NO: 2133518 - RNA, 23 nt, Human
augcuggacaggucugggagagg

SEQ ID NO: 2133519 - RNA, 21 nt, Human
augcuggacggcauuccugcu

SEQ ID NO: 2133520 - RNA, 22 nt, Human
augcuggacggcauuccugcuu

SEQ ID NO: 2133521 - RNA, 19 nt, Human
augcuccuggcccacugca

SEQ ID NO: 2133522 - RNA, 14 nt, Human
uuuaucagaauucu

SEQ ID NO: 2133523 - RNA, 13 nt, Human
augcucacacucc

SEQ ID NO: 2133524 - RNA, 12 nt, Human
uuuaucagcagu

SEQ ID NO: 2133525 - RNA, 16 nt, Human
uuuaucagcaguuguu

SEQ ID NO: 2133526 - RNA, 22 nt, Human
uuuaucagcaguuguuauuaca

SEQ ID NO: 2133527 - RNA, 13 nt, Human
uuuaucagugaca

SEQ ID NO: 2133528 - RNA, 18 nt, Human
uuuaucagugacagaguu

SEQ ID NO: 2133529 - RNA, 21 nt, Human
uuuaucagugacagaguucac

SEQ ID NO: 2133530 - RNA, 16 nt, Human
augcucacgcucccaa

SEQ ID NO: 2133531 - RNA, 18 nt, Human
augcucagguacagagaa

SEQ ID NO: 2133532 - RNA, 19 nt, Human
augcucagguacagagaag

SEQ ID NO: 2133533 - RNA, 21 nt, Human
augcucagguacagagaagga

SEQ ID NO: 2133534 - RNA, 22 nt, Human
augcucagguacagagaaggaa

SEQ ID NO: 2133535 - RNA, 17 nt, Human
augcucccuccccugcc

SEQ ID NO: 2133536 - RNA, 18 nt, Human
augcucccuccccugccc

SEQ ID NO: 2133537 - RNA, 19 nt, Human
augcucccuccccugcccu

SEQ ID NO: 2133538 - RNA, 20 nt, Human
augcucccuccccugcccug

SEQ ID NO: 2133539 - RNA, 22 nt, Human
augcucccuccccugcccuggu

SEQ ID NO: 2133540 - RNA, 13 nt, Human
uuuaaaugaaagu

SEQ ID NO: 2133541 - RNA, 21 nt, Human
uuuaaaugaaagugagacuuu

SEQ ID NO: 2133542 - RNA, 12 nt, Human
uuuaaauccugu

SEQ ID NO: 2133543 - RNA, 17 nt, Human
uuuaaauccuguugaaa

SEQ ID NO: 2133544 - RNA, 20 nt, Human
uuuaaauccuguugaaaagc

SEQ ID NO: 2133545 - RNA, 16 nt, Human
uuuaaauauauuuuca

SEQ ID NO: 2133546 - RNA, 16 nt, Human
uuuaaauguaaaacau

SEQ ID NO: 2133547 - RNA, 15 nt, Human
augcagagucagcag

SEQ ID NO: 2133548 - RNA, 16 nt, Human
augcagagucagcaga

SEQ ID NO: 2133549 - RNA, 17 nt, Human
augcagagucagcagaa

SEQ ID NO: 2133550 - RNA, 22 nt, Human
uuuaaaaaaauacaguauucug

SEQ ID NO: 2133551 - RNA, 23 nt, Human
uuuaaaaauacagauagauauau

SEQ ID NO: 2133552 - RNA, 14 nt, Human
uuuaagaggcaggg

SEQ ID NO: 2133553 - RNA, 11 nt, Human
uuuaagcuguu

SEQ ID NO: 2133554 - RNA, 15 nt, Human
uuuaaggaagaaaaa

SEQ ID NO: 2133555 - RNA, 16 nt, Human
uuuaaggaagaaaaau

SEQ ID NO: 2133556 - RNA, 21 nt, Human
uuuaagcuguuacugucuuca

SEQ ID NO: 2133557 - RNA, 18 nt, Human
uuuaagcuguuuccauag

SEQ ID NO: 2133558 - RNA, 22 nt, Human
uuuaagcuuauuuaauuaaaaa

SEQ ID NO: 2133559 - RNA, 13 nt, Human
uuuaagcuguuuc

SEQ ID NO: 2133560 - RNA, 12 nt, Human
uuuaagcuguuu

SEQ ID NO: 2133561 - RNA, 20 nt, Human
uuuaaggagauguaagagcu

SEQ ID NO: 2133562 - RNA, 21 nt, Human
uuuaaggagauguaagagcuu

SEQ ID NO: 2133563 - RNA, 18 nt, Human
uuuaaggcuaaaacuuaa

SEQ ID NO: 2133564 - RNA, 16 nt, Human
uuuaaggcuucaauuu

SEQ ID NO: 2133565 - RNA, 22 nt, Human
uuuaaggcuucaauuuauugca

SEQ ID NO: 2133566 - RNA, 20 nt, Human
uuuaaggguuuguggaaaau

SEQ ID NO: 2133567 - RNA, 17 nt, Human
uuuaaggguuuguggaa

SEQ ID NO: 2133568 - RNA, 22 nt, Human
uuuaaggguuuguggaaaauga

SEQ ID NO: 2133569 - RNA, 16 nt, Human
uuuaaugaaagacugu

SEQ ID NO: 2133570 - RNA, 20 nt, Human
augauuuccaaagagaaaaa

SEQ ID NO: 2133571 - RNA, 20 nt, Human
augcaaacauaacaaaauca

SEQ ID NO: 2133572 - RNA, 14 nt, Human
augcaaagaggcaa

SEQ ID NO: 2133573 - RNA, 15 nt, Human
augcaaagaggcaag

SEQ ID NO: 2133574 - RNA, 23 nt, Human
augcaaaagguucacuaaagcag

SEQ ID NO: 2133575 - RNA, 22 nt, Human
augauugugcacauacuugaga

SEQ ID NO: 2133576 - RNA, 14 nt, Human
augauuuacucauu

SEQ ID NO: 2133577 - RNA, 15 nt, Human
augauuuacucauua

SEQ ID NO: 2133578 - RNA, 18 nt, Human
augauuuagagugcuguc

SEQ ID NO: 2133579 - RNA, 22 nt, Human
augcacgugugcacacacacca

SEQ ID NO: 2133580 - RNA, 16 nt, Human
augcaaagaggcaaga

SEQ ID NO: 2133581 - RNA, 22 nt, Human
uugugaugucccaacuuguaaa

SEQ ID NO: 2133582 - RNA, 18 nt, Human
uugugaugucccaacuug

SEQ ID NO: 2133583 - RNA, 14 nt, Human
uugugaucuugcuc

SEQ ID NO: 2133584 - RNA, 15 nt, Human
uugugaucuugcucu

SEQ ID NO: 2133585 - RNA, 15 nt, Human
uuguguacucuggcc

SEQ ID NO: 2133586 - RNA, 17 nt, Human
uuguguacucuggccuc

SEQ ID NO: 2133587 - RNA, 18 nt, Human
uuguguacucuggccucu

SEQ ID NO: 2133588 - RNA, 17 nt, Human
uuguguaauaaaguguu

SEQ ID NO: 2133589 - RNA, 19 nt, Human
uuguguaauaaaguguuuu

SEQ ID NO: 2133590 - RNA, 21 nt, Human
uuguguaauaaaguguuuuca

SEQ ID NO: 2133591 - RNA, 22 nt, Human
uuguguaauaaaguguuuucag

SEQ ID NO: 2133592 - RNA, 15 nt, Human
uuguguacagugugu

SEQ ID NO: 2133593 - RNA, 18 nt, Human
uugugaauugauaauaaa

SEQ ID NO: 2133594 - RNA, 13 nt, Human
uugucccacagcu

SEQ ID NO: 2133595 - RNA, 14 nt, Human
uugucccacagcuu

SEQ ID NO: 2133596 - RNA, 23 nt, Human
uugucccauuucuaaaggccucu

SEQ ID NO: 2133597 - RNA, 13 nt, Human
uuguccagcgccu

SEQ ID NO: 2133598 - RNA, 20 nt, Human
uugucccacucaagccaagc

SEQ ID NO: 2133599 - RNA, 11 nt, Human
uuguccccagu

SEQ ID NO: 2133600 - RNA, 13 nt, Human
uuguccagagaca

SEQ ID NO: 2133601 - RNA, 23 nt, Human
uugugaauauguacauaggcagc

SEQ ID NO: 2133602 - RNA, 16 nt, Human
uugugaccaaguuaua

SEQ ID NO: 2133603 - RNA, 17 nt, Human
uugugacccaauuaagu

SEQ ID NO: 2133604 - RNA, 15 nt, Human
augaguuugcccugg

SEQ ID NO: 2133605 - RNA, 22 nt, Human
augaguuugcccugguuucacu

SEQ ID NO: 2133606 - RNA, 19 nt, Human
augaguuguuuucagacuc

SEQ ID NO: 2133607 - RNA, 20 nt, Human
augaguuguuuucagacuca

SEQ ID NO: 2133608 - RNA, 22 nt, Human
augaguuguuuucagacucaga

SEQ ID NO: 2133609 - RNA, 23 nt, Human
augaguuguuuucagacucagac

SEQ ID NO: 2133610 - RNA, 21 nt, Human
uuguccaacccgaggcccgca

SEQ ID NO: 2133611 - RNA, 21 nt, Human
uugucauauaagauucauauu

SEQ ID NO: 2133612 - RNA, 13 nt, Human
uugucagagcugg

SEQ ID NO: 2133613 - RNA, 15 nt, Human
uugucagagcuggga

SEQ ID NO: 2133614 - RNA, 18 nt, Human
uugucagauaugauaugu

SEQ ID NO: 2133615 - RNA, 12 nt, Human
uugucagcuacu

SEQ ID NO: 2133616 - RNA, 12 nt, Human
uugucagacuuu

SEQ ID NO: 2133617 - RNA, 14 nt, Human
uugucagacuuuaa

SEQ ID NO: 2133618 - RNA, 18 nt, Human
uugucagacuuuaaagaa

SEQ ID NO: 2133619 - RNA, 20 nt, Human
uugucagacuuuaaagaaua

SEQ ID NO: 2133620 - RNA, 13 nt, Human
uugucacaauaaa

SEQ ID NO: 2133621 - RNA, 14 nt, Human
uugucacaauaaau

SEQ ID NO: 2133622 - RNA, 23 nt, Human
uugucacaauccuaacacauuau

SEQ ID NO: 2133623 - RNA, 17 nt, Human
uugucacacacuuuggc

SEQ ID NO: 2133624 - RNA, 18 nt, Human
augaggucagagccugca

SEQ ID NO: 2133625 - RNA, 16 nt, Human
augaggucagagccug

SEQ ID NO: 2133626 - RNA, 23 nt, Human
uuguaacauccaauaggaaugcu

SEQ ID NO: 2133627 - RNA, 15 nt, Human
augaggucagagccu

SEQ ID NO: 2133628 - RNA, 20 nt, Human
augaggucagagccugcagu

SEQ ID NO: 2133629 - RNA, 19 nt, Human
augaggucagagccugcag

SEQ ID NO: 2133630 - RNA, 22 nt, Human
augagguucaacuguugauugc

SEQ ID NO: 2133631 - RNA, 22 nt, Human
augaggucagagccugcaguua

SEQ ID NO: 2133632 - RNA, 17 nt, Human
auuaauauucauuguau

SEQ ID NO: 2133633 - RNA, 19 nt, Human
auuaauauucauuguauaa

SEQ ID NO: 2133634 - RNA, 14 nt, Human
auuaauauuuuaau

SEQ ID NO: 2133635 - RNA, 13 nt, Human
auuacugucaaua

SEQ ID NO: 2133636 - RNA, 15 nt, Human
auuacugucaauaaa

SEQ ID NO: 2133637 - RNA, 16 nt, Human
auuacugucaauaaac

SEQ ID NO: 2133638 - RNA, 17 nt, Human
auuacugucaauaaaca

SEQ ID NO: 2133639 - RNA, 13 nt, Human
auuacuucugcua

SEQ ID NO: 2133640 - RNA, 12 nt, Human
auuacuucugcu

SEQ ID NO: 2133641 - RNA, 14 nt, Human
auuacuucugcuac

SEQ ID NO: 2133642 - RNA, 13 nt, Human
auuagagaagaga

SEQ ID NO: 2133643 - RNA, 21 nt, Human
uuuugugaaguuuaauugacu

SEQ ID NO: 2133644 - RNA, 24 nt, Human
uuuugugaaaugaaaacauguaau

SEQ ID NO: 2133645 - RNA, 21 nt, Human
uuuuguggucauuaagcauug

SEQ ID NO: 2133646 - RNA, 13 nt, Human
uuuuguguacagu

SEQ ID NO: 2133647 - RNA, 16 nt, Human
uuuuggaaucuagaag

SEQ ID NO: 2133648 - RNA, 17 nt, Human
uuuuggaaucuagaaga

SEQ ID NO: 2133649 - RNA, 22 nt, Human
uuuuggaaucuagaagaaauga

SEQ ID NO: 2133650 - RNA, 18 nt, Human
uuuugcuguuuccuuuua

SEQ ID NO: 2133651 - RNA, 13 nt, Human
auuaaaacaaugu

SEQ ID NO: 2133652 - RNA, 11 nt, Human
auuaaaaucuu

SEQ ID NO: 2133653 - RNA, 12 nt, Human
auuaaaaucuua

SEQ ID NO: 2133654 - RNA, 13 nt, Human
auuaaaaucuuaa

SEQ ID NO: 2133655 - RNA, 15 nt, Human
auuaaaaucuuaaac

SEQ ID NO: 2133656 - RNA, 13 nt, Human
auuaaaaugaaua

SEQ ID NO: 2133657 - RNA, 11 nt, Human
auuaaacaauu

SEQ ID NO: 2133658 - RNA, 15 nt, Human
auuaaacaauuuauu

SEQ ID NO: 2133659 - RNA, 16 nt, Human
auuaaacaauuuauuu

SEQ ID NO: 2133660 - RNA, 17 nt, Human
auuaaacaauuuauuuu

SEQ ID NO: 2133661 - RNA, 19 nt, Human
auuaaacaauuuauuuuau

SEQ ID NO: 2133662 - RNA, 20 nt, Human
auuaaacaauuuauuuuauu

SEQ ID NO: 2133663 - RNA, 18 nt, Human
uuuuuauauagcuugaaa

SEQ ID NO: 2133664 - RNA, 16 nt, Human
uuuuuaauuuauuuau

SEQ ID NO: 2133665 - RNA, 17 nt, Human
uuuuuaauuugaugaaa

SEQ ID NO: 2133666 - RNA, 20 nt, Human
uuuuuaauuugaugaaagcu

SEQ ID NO: 2133667 - RNA, 22 nt, Human
uuuuuaauuugaugaaagcuga

SEQ ID NO: 2133668 - RNA, 16 nt, Human
uuuuguuuuaaaauua

SEQ ID NO: 2133669 - RNA, 16 nt, Human
uuuuguuuuugucuua

SEQ ID NO: 2133670 - RNA, 16 nt, Human
uuuuguuaccuuuaug

SEQ ID NO: 2133671 - RNA, 16 nt, Human
uuuuucaauauuuauu

SEQ ID NO: 2133672 - RNA, 19 nt, Human
uuuuuauuuguuugugcau

SEQ ID NO: 2133673 - RNA, 14 nt, Human
uuuuugauagcuuu

SEQ ID NO: 2133674 - RNA, 17 nt, Human
uuuuuggauugacagua

SEQ ID NO: 2133675 - RNA, 15 nt, Human
uuuuugggaugucuu

SEQ ID NO: 2133676 - RNA, 15 nt, Human
uuuuugguggaugua

SEQ ID NO: 2133677 - RNA, 17 nt, Human
uuuuugguggauguaaa

SEQ ID NO: 2133678 - RNA, 18 nt, Human
uuuuugguggauguaaau

SEQ ID NO: 2133679 - RNA, 19 nt, Human
uuuuugguggauguaaaua

SEQ ID NO: 2133680 - RNA, 15 nt, Human
auuaagccuuccaca

SEQ ID NO: 2133681 - RNA, 13 nt, Human
auuaaggaagaca

SEQ ID NO: 2133682 - RNA, 18 nt, Human
auuaaguacuauguauca

SEQ ID NO: 2133683 - RNA, 15 nt, Human
auuaaggucucucuu

SEQ ID NO: 2133684 - RNA, 16 nt, Human
auuaaggucucucuuu

SEQ ID NO: 2133685 - RNA, 17 nt, Human
auuaaggucucucuuug

SEQ ID NO: 2133686 - RNA, 19 nt, Human
auuaaggucucucuuugga

SEQ ID NO: 2133687 - RNA, 21 nt, Human
auuaaggucucucuuuggacu

SEQ ID NO: 2133688 - RNA, 16 nt, Human
auuaaggcaacugaac

SEQ ID NO: 2133689 - RNA, 19 nt, Human
auuaaggcaacugaacaaa

SEQ ID NO: 2133690 - RNA, 20 nt, Human
auuaaggcaacugaacaaaa

SEQ ID NO: 2133691 - RNA, 21 nt, Human
auuaaggcaacugaacaaaaa

SEQ ID NO: 2133692 - RNA, 19 nt, Human
auuaaguacuauguaucaa

SEQ ID NO: 2133693 - RNA, 20 nt, Human
auucaguugguaagcuucca

SEQ ID NO: 2133694 - RNA, 18 nt, Human
auuccagagaguggcucc

SEQ ID NO: 2133695 - RNA, 17 nt, Human
auucccaagcucugcuc

SEQ ID NO: 2133696 - RNA, 19 nt, Human
auucccaagcucugcuccu

SEQ ID NO: 2133697 - RNA, 18 nt, Human
auucccaagcucugcucc

SEQ ID NO: 2133698 - RNA, 18 nt, Human
auuccagagacaucagca

SEQ ID NO: 2133699 - RNA, 12 nt, Human
auucccagagac

SEQ ID NO: 2133700 - RNA, 21 nt, Human
auuccccagguggcugaccca

SEQ ID NO: 2133701 - RNA, 22 nt, Human
auuccccagguggcugacccag

SEQ ID NO: 2133702 - RNA, 20 nt, Human
auuccuaacacagcaugugu

SEQ ID NO: 2133703 - RNA, 18 nt, Human
auuccuacaaagauguuu

SEQ ID NO: 2133704 - RNA, 20 nt, Human
auucagcccauuucacaccu

SEQ ID NO: 2133705 - RNA, 14 nt, Human
auucacuugcauuu

SEQ ID NO: 2133706 - RNA, 20 nt, Human
auucacugaaguucuccuga

SEQ ID NO: 2133707 - RNA, 16 nt, Human
auucagugagggucuu

SEQ ID NO: 2133708 - RNA, 21 nt, Human
auucagugagggucuucuuac

SEQ ID NO: 2133709 - RNA, 11 nt, Human
auucaggcugc

SEQ ID NO: 2133710 - RNA, 13 nt, Human
auucaggcugcuu

SEQ ID NO: 2133711 - RNA, 16 nt, Human
auucaggcugcuuggg

SEQ ID NO: 2133712 - RNA, 17 nt, Human
auucagugcuguggccu

SEQ ID NO: 2133713 - RNA, 20 nt, Human
auucagugcuguggccuggg

SEQ ID NO: 2133714 - RNA, 14 nt, Human
auucagugcuucuu

SEQ ID NO: 2133715 - RNA, 17 nt, Human
auucagugcuucuuaaa

SEQ ID NO: 2133716 - RNA, 21 nt, Human
auucagugcuguggccugggc

SEQ ID NO: 2133717 - RNA, 22 nt, Human
auucagugcuguggccugggca

SEQ ID NO: 2133718 - RNA, 14 nt, Human
auucaguuaagaaa

SEQ ID NO: 2133719 - RNA, 15 nt, Human
auucaguuaagaaaa

SEQ ID NO: 2133720 - RNA, 16 nt, Human
auucaguuaagaaaaa

SEQ ID NO: 2133721 - RNA, 17 nt, Human
auucaguuaagaaaaaa

SEQ ID NO: 2133722 - RNA, 18 nt, Human
auucaguuaagaaaaaaa

SEQ ID NO: 2133723 - RNA, 20 nt, Human
auucaguuaagaaaaaaaua

SEQ ID NO: 2133724 - RNA, 19 nt, Human
auucagugcuucuuaaaga

SEQ ID NO: 2133725 - RNA, 15 nt, Human
auuauucaccaugua

SEQ ID NO: 2133726 - RNA, 18 nt, Human
auuauucaccauguaaaa

SEQ ID NO: 2133727 - RNA, 20 nt, Human
auuauucaccauguaaaaca

SEQ ID NO: 2133728 - RNA, 21 nt, Human
auuauucaccauguaaaacaa

SEQ ID NO: 2133729 - RNA, 22 nt, Human
auuauucaccauguaaaacaaa

SEQ ID NO: 2133730 - RNA, 16 nt, Human
auuauaucuaauuauu

SEQ ID NO: 2133731 - RNA, 15 nt, Human
auuauaacuuaaaaa

SEQ ID NO: 2133732 - RNA, 22 nt, Human
auuauaacuuaaaaaaaugaca

SEQ ID NO: 2133733 - RNA, 15 nt, Human
auuauaacuuaaaau

SEQ ID NO: 2133734 - RNA, 16 nt, Human
auuauaacuuaaaaua

SEQ ID NO: 2133735 - RNA, 19 nt, Human
auuagacuuuagaaauaaa

SEQ ID NO: 2133736 - RNA, 20 nt, Human
auuagacuuuagaaauaaau

SEQ ID NO: 2133737 - RNA, 21 nt, Human
auuauaacugaaggagaaggu

SEQ ID NO: 2133738 - RNA, 12 nt, Human
auucaaaaaugu

SEQ ID NO: 2133739 - RNA, 14 nt, Human
auucaaaaauguac

SEQ ID NO: 2133740 - RNA, 16 nt, Human
auucaaaaauguacaa

SEQ ID NO: 2133741 - RNA, 12 nt, Human
auuauuuuuaau

SEQ ID NO: 2133742 - RNA, 17 nt, Human
auuauuuuuaauaugua

SEQ ID NO: 2133743 - RNA, 14 nt, Human
auuauuuuuuauga

SEQ ID NO: 2133744 - RNA, 12 nt, Human
auuauuguuuau

SEQ ID NO: 2133745 - RNA, 19 nt, Human
auuauuguuuauauuuuca

SEQ ID NO: 2133746 - RNA, 23 nt, Human
auuauuguguguuauuuaaauga

SEQ ID NO: 2133747 - RNA, 18 nt, Human
auuauuggaauuaaccug

SEQ ID NO: 2133748 - RNA, 14 nt, Human
auuauuggaauuaa

SEQ ID NO: 2133749 - RNA, 13 nt, Human
auuauugcuguug

SEQ ID NO: 2133750 - RNA, 15 nt, Human
auuauucaguuaaga

SEQ ID NO: 2133751 - RNA, 18 nt, Human
auuauucaguuaagaaaa

SEQ ID NO: 2133752 - RNA, 12 nt, Human
auuauugcauua

SEQ ID NO: 2133753 - RNA, 23 nt, Human
auucaccuuccagugucucggag

SEQ ID NO: 2133754 - RNA, 12 nt, Human
auucaccuguaa

SEQ ID NO: 2133755 - RNA, 13 nt, Human
auucaccuguaaa

SEQ ID NO: 2133756 - RNA, 14 nt, Human
auucaccuguaaaa

SEQ ID NO: 2133757 - RNA, 15 nt, Human
auucaccuguaaaac

SEQ ID NO: 2133758 - RNA, 16 nt, Human
auucaccuguaaaacu

SEQ ID NO: 2133759 - RNA, 17 nt, Human
auucaccuguaaaacuu

SEQ ID NO: 2133760 - RNA, 18 nt, Human
auucaccuguaaaacuuu

SEQ ID NO: 2133761 - RNA, 19 nt, Human
auucaccuguaaaacuuua

SEQ ID NO: 2133762 - RNA, 19 nt, Human
auucacccagacagcuccc

SEQ ID NO: 2133763 - RNA, 19 nt, Human
auucaccauguaaaacaaa

SEQ ID NO: 2133764 - RNA, 21 nt, Human
auucaccauguaaaacaaaaa

SEQ ID NO: 2133765 - RNA, 22 nt, Human
auucaccauguaaaacaaaaaa

SEQ ID NO: 2133766 - RNA, 14 nt, Human
auucacccagacag

SEQ ID NO: 2133767 - RNA, 13 nt, Human
uuuguuucauauu

SEQ ID NO: 2133768 - RNA, 18 nt, Human
uuuguuucucccccuggg

SEQ ID NO: 2133769 - RNA, 16 nt, Human
uuuguuucugaaaauu

SEQ ID NO: 2133770 - RNA, 20 nt, Human
uuuguuuuaaggaagaaaaa

SEQ ID NO: 2133771 - RNA, 14 nt, Human
uuuguuuguuuugu

SEQ ID NO: 2133772 - RNA, 15 nt, Human
uuuguuuuaaaauua

SEQ ID NO: 2133773 - RNA, 11 nt, Human
uuuguuuguuu

SEQ ID NO: 2133774 - RNA, 15 nt, Human
uuuguuuguuugggu

SEQ ID NO: 2133775 - RNA, 23 nt, Human
uuugucuuaaaaaguggaaaaau

SEQ ID NO: 2133776 - RNA, 13 nt, Human
uuugucuuaaaaa

SEQ ID NO: 2133777 - RNA, 14 nt, Human
uuugucuuaaaaag

SEQ ID NO: 2133778 - RNA, 13 nt, Human
uuuguaagaaacc

SEQ ID NO: 2133779 - RNA, 13 nt, Human
uuuguaaguuauu

SEQ ID NO: 2133780 - RNA, 15 nt, Human
uuuguaauuuucuug

SEQ ID NO: 2133781 - RNA, 16 nt, Human
uuuguaauuuucuuga

SEQ ID NO: 2133782 - RNA, 14 nt, Human
uuuguaauaaagua

SEQ ID NO: 2133783 - RNA, 19 nt, Human
uuuguacagacguaugcuu

SEQ ID NO: 2133784 - RNA, 22 nt, Human
uuuguacagacguaugcuuauu

SEQ ID NO: 2133785 - RNA, 21 nt, Human
uuuguacaauugaacuuaaau

SEQ ID NO: 2133786 - RNA, 18 nt, Human
uuuguacagacguaugcu

SEQ ID NO: 2133787 - RNA, 14 nt, Human
uuuguagguacuuu

SEQ ID NO: 2133788 - RNA, 16 nt, Human
uuuguagguacuuuug

SEQ ID NO: 2133789 - RNA, 16 nt, Human
uuuguaggguuucuag

SEQ ID NO: 2133790 - RNA, 15 nt, Human
uuuguaggguuucua

SEQ ID NO: 2133791 - RNA, 17 nt, Human
auguccuccuuguucua

SEQ ID NO: 2133792 - RNA, 15 nt, Human
augucgccucugcau

SEQ ID NO: 2133793 - RNA, 23 nt, Human
auguccuccagaagccucuggcu

SEQ ID NO: 2133794 - RNA, 20 nt, Human
auguccuccagaagccucug

SEQ ID NO: 2133795 - RNA, 22 nt, Human
auguccuccagaagccucuggc

SEQ ID NO: 2133796 - RNA, 19 nt, Human
augugacaugcgggcuggg

SEQ ID NO: 2133797 - RNA, 18 nt, Human
augugacaauuuuguaca

SEQ ID NO: 2133798 - RNA, 20 nt, Human
augugacaauuuuguacaaa

SEQ ID NO: 2133799 - RNA, 21 nt, Human
augugacaauuuuguacaaau

SEQ ID NO: 2133800 - RNA, 14 nt, Human
augugagagaaagu

SEQ ID NO: 2133801 - RNA, 15 nt, Human
augugagagaaagug

SEQ ID NO: 2133802 - RNA, 21 nt, Human
augugauacccauagcuucca

SEQ ID NO: 2133803 - RNA, 22 nt, Human
augugaguguguguuugugcug

SEQ ID NO: 2133804 - RNA, 20 nt, Human
augugauaaggaucagaaca

SEQ ID NO: 2133805 - RNA, 16 nt, Human
augucauuaaacauga

SEQ ID NO: 2133806 - RNA, 16 nt, Human
auguccuccagaagcc

SEQ ID NO: 2133807 - RNA, 18 nt, Human
auguccuccagaagccuc

SEQ ID NO: 2133808 - RNA, 19 nt, Human
auguccuccagaagccucu

SEQ ID NO: 2133809 - RNA, 20 nt, Human
augucccuuucuuggccagu

SEQ ID NO: 2133810 - RNA, 16 nt, Human
augucccuuucuuggc

SEQ ID NO: 2133811 - RNA, 17 nt, Human
augucauuaaaauaaau

SEQ ID NO: 2133812 - RNA, 20 nt, Human
augucauuaaaauaaauaaa

SEQ ID NO: 2133813 - RNA, 14 nt, Human
augucaucccauug

SEQ ID NO: 2133814 - RNA, 19 nt, Human
auguauauuuaaaagaaag

SEQ ID NO: 2133815 - RNA, 12 nt, Human
auguaucaauga

SEQ ID NO: 2133816 - RNA, 16 nt, Human
auguauauguguucau

SEQ ID NO: 2133817 - RNA, 13 nt, Human
uuugagacagagu

SEQ ID NO: 2133818 - RNA, 13 nt, Human
uuugagacaggag

SEQ ID NO: 2133819 - RNA, 19 nt, Human
uuugagaccagccugggca

SEQ ID NO: 2133820 - RNA, 16 nt, Human
uuugagaccagccugg

SEQ ID NO: 2133821 - RNA, 15 nt, Human
uuugauccaagcugg

SEQ ID NO: 2133822 - RNA, 14 nt, Human
uuugauccaagcug

SEQ ID NO: 2133823 - RNA, 23 nt, Human
uuugagaccugaauagcucccag

SEQ ID NO: 2133824 - RNA, 16 nt, Human
uuugaugaaagcugau

SEQ ID NO: 2133825 - RNA, 15 nt, Human
uuugauuaugacugu

SEQ ID NO: 2133826 - RNA, 15 nt, Human
uuugacaacaaauua

SEQ ID NO: 2133827 - RNA, 14 nt, Human
uuucauguaaauaa

SEQ ID NO: 2133828 - RNA, 20 nt, Human
uuugacaauuccuagauaaa

SEQ ID NO: 2133829 - RNA, 19 nt, Human
uuucccuccacuccuuccu

SEQ ID NO: 2133830 - RNA, 15 nt, Human
uuucccuacucccca

SEQ ID NO: 2133831 - RNA, 23 nt, Human
uuucccucccuuccucuuuccau

SEQ ID NO: 2133832 - RNA, 13 nt, Human
uuucccugaccuc

SEQ ID NO: 2133833 - RNA, 22 nt, Human
uuucccugcuuaaugaaaagcu

SEQ ID NO: 2133834 - RNA, 15 nt, Human
uuucccuucuucugu

SEQ ID NO: 2133835 - RNA, 21 nt, Human
uuugcgcacaacuuaaaaagu

SEQ ID NO: 2133836 - RNA, 14 nt, Human
uuugcggacgggcu

SEQ ID NO: 2133837 - RNA, 21 nt, Human
uuugccuugggcugcuccuca

SEQ ID NO: 2133838 - RNA, 12 nt, Human
uuugcaaaauuu

SEQ ID NO: 2133839 - RNA, 12 nt, Human
uuugccugugcc

SEQ ID NO: 2133840 - RNA, 17 nt, Human
uuugauuuagauugagu

SEQ ID NO: 2133841 - RNA, 15 nt, Human
uuugauucugugugu

SEQ ID NO: 2133842 - RNA, 22 nt, Human
uuuggauuggaugaauuccaaa

SEQ ID NO: 2133843 - RNA, 22 nt, Human
uuugcuaacuagcuuggaaacu

SEQ ID NO: 2133844 - RNA, 23 nt, Human
uuuggauugacaguaacuugguu

SEQ ID NO: 2133845 - RNA, 22 nt, Human
uuugggguacccacugcucugg

SEQ ID NO: 2133846 - RNA, 20 nt, Human
uuugggguagcuagaggaac

SEQ ID NO: 2133847 - RNA, 21 nt, Human
uuugggguugcaucagaaaug

SEQ ID NO: 2133848 - RNA, 13 nt, Human
uuuggguaaauca

SEQ ID NO: 2133849 - RNA, 21 nt, Human
uuugggguacccacugcucug

SEQ ID NO: 2133850 - RNA, 14 nt, Human
auguauaauauuuu

SEQ ID NO: 2133851 - RNA, 23 nt, Human
auguauaauauuuuuaauuaaau

SEQ ID NO: 2133852 - RNA, 14 nt, Human
uuugggcugcccug

SEQ ID NO: 2133853 - RNA, 12 nt, Human
uuugggaugucu

SEQ ID NO: 2133854 - RNA, 14 nt, Human
uuugggaugucuua

SEQ ID NO: 2133855 - RNA, 15 nt, Human
uuugggaugucuuau

SEQ ID NO: 2133856 - RNA, 17 nt, Human
uuugggaugucuuauuu

SEQ ID NO: 2133857 - RNA, 22 nt, Human
uuugggaugucuuauuuuuaga

SEQ ID NO: 2133858 - RNA, 17 nt, Human
uuugggaggcugaggug

SEQ ID NO: 2133859 - RNA, 21 nt, Human
uuuucugcaucaucuguagau

SEQ ID NO: 2133860 - RNA, 23 nt, Human
uuuucuguugaaguuuacaauca

SEQ ID NO: 2133861 - RNA, 12 nt, Human
auguuuaagauu

SEQ ID NO: 2133862 - RNA, 13 nt, Human
auguuuaagauuu

SEQ ID NO: 2133863 - RNA, 14 nt, Human
auguuuaagauuua

SEQ ID NO: 2133864 - RNA, 21 nt, Human
auguuuaagauuuaauuugcc

SEQ ID NO: 2133865 - RNA, 15 nt, Human
auguugguauuuauc

SEQ ID NO: 2133866 - RNA, 17 nt, Human
auguugguauuuaucua

SEQ ID NO: 2133867 - RNA, 21 nt, Human
auguugguauuuaucuauugu

SEQ ID NO: 2133868 - RNA, 17 nt, Human
auguuggccaggcuggu

SEQ ID NO: 2133869 - RNA, 21 nt, Human
auguuuuucugccagggagcu

SEQ ID NO: 2133870 - RNA, 22 nt, Human
auguuuuucugccagggagcuu

SEQ ID NO: 2133871 - RNA, 16 nt, Human
auguuuuuaaauauau

SEQ ID NO: 2133872 - RNA, 17 nt, Human
auguuuuuaaauauauu

SEQ ID NO: 2133873 - RNA, 20 nt, Human
auuaaaaauuggcuaguuga

SEQ ID NO: 2133874 - RNA, 11 nt, Human
auuaaaacaau

SEQ ID NO: 2133875 - RNA, 14 nt, Human
auuaaaacaauauu

SEQ ID NO: 2133876 - RNA, 18 nt, Human
auuaaaacaauauuguuu

SEQ ID NO: 2133877 - RNA, 20 nt, Human
auuaaaacaauauuguuucu

SEQ ID NO: 2133878 - RNA, 21 nt, Human
auuaaaacaauauuguuucua

SEQ ID NO: 2133879 - RNA, 13 nt, Human
auuaaaaauggua

SEQ ID NO: 2133880 - RNA, 14 nt, Human
auuaaaaaugguaa

SEQ ID NO: 2133881 - RNA, 17 nt, Human
auuaaaaaugguaaaau

SEQ ID NO: 2133882 - RNA, 18 nt, Human
auuaaaaaugguaaaauu

SEQ ID NO: 2133883 - RNA, 19 nt, Human
auuaaaaaugguaaaauug

SEQ ID NO: 2133884 - RNA, 21 nt, Human
auuaaaaaugguaaaauugca

SEQ ID NO: 2133885 - RNA, 23 nt, Human
auuaaaaaugguaaaauugcaug

SEQ ID NO: 2133886 - RNA, 16 nt, Human
auguuuuuuauuaugc

SEQ ID NO: 2133887 - RNA, 22 nt, Human
uuuucucuugggcugagacugg

SEQ ID NO: 2133888 - RNA, 14 nt, Human
uuuucucuuucucc

SEQ ID NO: 2133889 - RNA, 22 nt, Human
uuuucucuuucuccuuagucuu

SEQ ID NO: 2133890 - RNA, 23 nt, Human
uuuucaguagggcuacaaaaccu

SEQ ID NO: 2133891 - RNA, 11 nt, Human
uuuuauugugu

SEQ ID NO: 2133892 - RNA, 13 nt, Human
uuuuccacuacug

SEQ ID NO: 2133893 - RNA, 15 nt, Human
uuuuccacuacugcu

SEQ ID NO: 2133894 - RNA, 22 nt, Human
uuuuccacaagauucccagaga

SEQ ID NO: 2133895 - RNA, 15 nt, Human
uuuuccacccuggaa

SEQ ID NO: 2133896 - RNA, 14 nt, Human
uuuucaguguacau

SEQ ID NO: 2133897 - RNA, 15 nt, Human
uuuuaguagagacag

SEQ ID NO: 2133898 - RNA, 16 nt, Human
uuuuagucauuuugcu

SEQ ID NO: 2133899 - RNA, 22 nt, Human
uuuuagacaaaucuaagggaaa

SEQ ID NO: 2133900 - RNA, 15 nt, Human
uuuuaguacccaccu

SEQ ID NO: 2133901 - RNA, 21 nt, Human
uuuuaguacccaccugagcuu

SEQ ID NO: 2133902 - RNA, 12 nt, Human
uuuuauuaaauu

SEQ ID NO: 2133903 - RNA, 12 nt, Human
uuuuauucuugu

SEQ ID NO: 2133904 - RNA, 13 nt, Human
uuuuauucuugug

SEQ ID NO: 2133905 - RNA, 18 nt, Human
uuuuauucuugugaauau

SEQ ID NO: 2133906 - RNA, 19 nt, Human
uuuuauugagaauuuuaaa

SEQ ID NO: 2133907 - RNA, 12 nt, Human
auguugaaagau

SEQ ID NO: 2133908 - RNA, 14 nt, Human
auguucaaagucaa

SEQ ID NO: 2133909 - RNA, 23 nt, Human
auguucaaagucaaauaacuccu

SEQ ID NO: 2133910 - RNA, 14 nt, Human
auguucaacuggag

SEQ ID NO: 2133911 - RNA, 22 nt, Human
auguucaacuggagacacuauu

SEQ ID NO: 2133912 - RNA, 15 nt, Human
auguugcccaggcag

SEQ ID NO: 2133913 - RNA, 14 nt, Human
auguugcccaggca

SEQ ID NO: 2133914 - RNA, 13 nt, Human
auguugcccaggc

SEQ ID NO: 2133915 - RNA, 18 nt, Human
auguugaaagaucaaaag

SEQ ID NO: 2133916 - RNA, 21 nt, Human
uuuuagacccuauugcugcuu

SEQ ID NO: 2133917 - RNA, 18 nt, Human
auguuaugcauaaaguca

SEQ ID NO: 2133918 - RNA, 13 nt, Human
auguuauugaaaa

SEQ ID NO: 2133919 - RNA, 14 nt, Human
auguuauugaaaaa

SEQ ID NO: 2133920 - RNA, 22 nt, Human
auguuauugaaaaaaauuggca

SEQ ID NO: 2133921 - RNA, 18 nt, Human
auguuauuuucuguugaa

SEQ ID NO: 2133922 - RNA, 21 nt, Human
auguuauuuucuguugaaguu

SEQ ID NO: 2133923 - RNA, 20 nt, Human
auguuacauaagauaaaugu

SEQ ID NO: 2133924 - RNA, 23 nt, Human
auguuacauaguguaggcuuuac

SEQ ID NO: 2133925 - RNA, 20 nt, Human
auguuacaucuguuuuaaau

SEQ ID NO: 2133926 - RNA, 17 nt, Human
auguuacacuaagggug

SEQ ID NO: 2133927 - RNA, 14 nt, Human
auguuacauuguuu

SEQ ID NO: 2133928 - RNA, 21 nt, Human
auguuaccuccuauaaacuua

SEQ ID NO: 2133929 - RNA, 23 nt, Human
auguuaucuugguguguuaagag

SEQ ID NO: 2133930 - RNA, 13 nt, Human
auguuaugauaaa

SEQ ID NO: 2133931 - RNA, 16 nt, Human
auguuaugauaaaaaa

SEQ ID NO: 2133932 - RNA, 20 nt, Human
auguuaugauaaaaaauuuu

SEQ ID NO: 2133933 - RNA, 21 nt, Human
auguuaugauaaaaaauuuug

SEQ ID NO: 2133934 - RNA, 22 nt, Human
auguuaugauaaaaaauuuugu

SEQ ID NO: 2133935 - RNA, 23 nt, Human
auguuaugauaaaaaauuuugua

SEQ ID NO: 2133936 - RNA, 17 nt, Human
auguuaugcauaaaguc

SEQ ID NO: 2133937 - RNA, 19 nt, Human
auguuacauaagauaaaug

SEQ ID NO: 2133938 - RNA, 23 nt, Human
auguuaaccagaauaaaguucug

SEQ ID NO: 2133939 - RNA, 18 nt, Human
auguuaaccucaguguca

SEQ ID NO: 2133940 - RNA, 21 nt, Human
auguuaaccucagugucauuu

SEQ ID NO: 2133941 - RNA, 18 nt, Human
auguuaaaucccauucau

SEQ ID NO: 2133942 - RNA, 20 nt, Human
auguuaaaucccauucauaa

SEQ ID NO: 2133943 - RNA, 18 nt, Human
auguguuugguucugggg

SEQ ID NO: 2133944 - RNA, 14 nt, Human
auguguguauaugu

SEQ ID NO: 2133945 - RNA, 12 nt, Human
auguguguauau

SEQ ID NO: 2133946 - RNA, 16 nt, Human
auguguguauauguau

SEQ ID NO: 2133947 - RNA, 17 nt, Human
auguguguauauguaug

SEQ ID NO: 2133948 - RNA, 18 nt, Human
auguguguauauguaugu

SEQ ID NO: 2133949 - RNA, 22 nt, Human
auguguguauauguaugugugu

SEQ ID NO: 2133950 - RNA, 20 nt, Human
auguguguaugggugugugu

SEQ ID NO: 2133951 - RNA, 15 nt, Human
auguggaaagugaau

SEQ ID NO: 2133952 - RNA, 16 nt, Human
auguggaaagugaauu

SEQ ID NO: 2133953 - RNA, 17 nt, Human
auguggaaagugaauuu

SEQ ID NO: 2133954 - RNA, 10 nt, Human
auguguguau

SEQ ID NO: 2133955 - RNA, 19 nt, Human
auguggaaagugaauuuga

SEQ ID NO: 2133956 - RNA, 15 nt, Human
auguguggcagauuu

SEQ ID NO: 2133957 - RNA, 18 nt, Human
augugcugugaccauuua

SEQ ID NO: 2133958 - RNA, 21 nt, Human
augugccagguuuuuggucug

SEQ ID NO: 2133959 - RNA, 23 nt, Human
uuuguuuuuuaaagucuugcugu

SEQ ID NO: 2133960 - RNA, 20 nt, Human
augugcauuuuugugaaaug

SEQ ID NO: 2133961 - RNA, 21 nt, Human
augugcauuuuugugaaauga

SEQ ID NO: 2133962 - RNA, 11 nt, Human
uuuguuuuguu

SEQ ID NO: 2133963 - RNA, 13 nt, Human
uuuguuuuuaauu

SEQ ID NO: 2133964 - RNA, 14 nt, Human
uuuguuuuuaugaa

SEQ ID NO: 2133965 - RNA, 21 nt, Human
uuuuaaaaaacugcugacugu

SEQ ID NO: 2133966 - RNA, 18 nt, Human
uuuuaaaaaacugcugac

SEQ ID NO: 2133967 - RNA, 19 nt, Human
auuuauuuuuuacauuauu

SEQ ID NO: 2133968 - RNA, 18 nt, Human
auuuauuuuuuacauuau

SEQ ID NO: 2133969 - RNA, 14 nt, Human
auuuauuuuuuaca

SEQ ID NO: 2133970 - RNA, 17 nt, Human
auuuauuuuccucccca

SEQ ID NO: 2133971 - RNA, 13 nt, Human
auuuauuuuccuc

SEQ ID NO: 2133972 - RNA, 20 nt, Human
auuuauuuuccuccccagca

SEQ ID NO: 2133973 - RNA, 12 nt, Human
auuuauuuuauu

SEQ ID NO: 2133974 - RNA, 20 nt, Human
auuuauuuuauuuuagcagu

SEQ ID NO: 2133975 - RNA, 18 nt, Human
auuuauuguauuuuagua

SEQ ID NO: 2133976 - RNA, 19 nt, Human
auuuauuguuuauuuauca

SEQ ID NO: 2133977 - RNA, 20 nt, Human
auuuauuguuuauuuaucag

SEQ ID NO: 2133978 - RNA, 21 nt, Human
auuuauuguuuauuuaucagu

SEQ ID NO: 2133979 - RNA, 22 nt, Human
auuuauuguuuauuuaucagug

SEQ ID NO: 2133980 - RNA, 14 nt, Human
auuucauuccuaac

SEQ ID NO: 2133981 - RNA, 15 nt, Human
auuuccauuauuuau

SEQ ID NO: 2133982 - RNA, 17 nt, Human
auuuccauuauuuauau

SEQ ID NO: 2133983 - RNA, 12 nt, Human
auuucaaaaauu

SEQ ID NO: 2133984 - RNA, 14 nt, Human
auuucaaaaauuug

SEQ ID NO: 2133985 - RNA, 16 nt, Human
auuucaaaaauuugga

SEQ ID NO: 2133986 - RNA, 17 nt, Human
auuucaaaaauuuggaa

SEQ ID NO: 2133987 - RNA, 19 nt, Human
auuucaaaaauuuggaauu

SEQ ID NO: 2133988 - RNA, 20 nt, Human
auuucaaaaauuuggaauuc

SEQ ID NO: 2133989 - RNA, 22 nt, Human
auuucaaaaauuuggaauucug

SEQ ID NO: 2133990 - RNA, 14 nt, Human
auuucaaaacucau

SEQ ID NO: 2133991 - RNA, 14 nt, Human
auuucuaaaaaaca

SEQ ID NO: 2133992 - RNA, 20 nt, Human
auuucuaaaaaacagaggcc

SEQ ID NO: 2133993 - RNA, 21 nt, Human
auuucgccguugaagaggaag

SEQ ID NO: 2133994 - RNA, 21 nt, Human
auuucuaaaaaacagaggcca

SEQ ID NO: 2133995 - RNA, 20 nt, Human
auuuccuauguaacugcauu

SEQ ID NO: 2133996 - RNA, 13 nt, Human
auuuauugcacaa

SEQ ID NO: 2133997 - RNA, 14 nt, Human
auuuauugcacaaa

SEQ ID NO: 2133998 - RNA, 18 nt, Human
auuuauguuguauagauu

SEQ ID NO: 2133999 - RNA, 19 nt, Human
auuuauugcuugauacuuu

SEQ ID NO: 2134000 - RNA, 20 nt, Human
auuuauugcuugauacuuuu

SEQ ID NO: 2134001 - RNA, 15 nt, Human
auuuauuaccucuga

SEQ ID NO: 2134002 - RNA, 14 nt, Human
auuuauuaccucug

SEQ ID NO: 2134003 - RNA, 17 nt, Human
auuguuuucaguguaca

SEQ ID NO: 2134004 - RNA, 14 nt, Human
auuguauaaaaaua

SEQ ID NO: 2134005 - RNA, 15 nt, Human
auuguauaaaaauag

SEQ ID NO: 2134006 - RNA, 17 nt, Human
auuguauaaaaauagaa

SEQ ID NO: 2134007 - RNA, 18 nt, Human
auuguuuucaguguacau

SEQ ID NO: 2134008 - RNA, 19 nt, Human
auuguuuucaguguacaug

SEQ ID NO: 2134009 - RNA, 16 nt, Human
auuguuuuuuaucuuu

SEQ ID NO: 2134010 - RNA, 23 nt, Human
auuguuuuuuaucuuuucuacag

SEQ ID NO: 2134011 - RNA, 14 nt, Human
auuuaaaaaaaauc

SEQ ID NO: 2134012 - RNA, 16 nt, Human
auuuaaauauuaaaua

SEQ ID NO: 2134013 - RNA, 19 nt, Human
auuuaaauguaaagacaaa

SEQ ID NO: 2134014 - RNA, 12 nt, Human
auuuacacuuuu

SEQ ID NO: 2134015 - RNA, 20 nt, Human
auuuacacuuuugagacuuu

SEQ ID NO: 2134016 - RNA, 21 nt, Human
auuuacagccucacuugaaug

SEQ ID NO: 2134017 - RNA, 14 nt, Human
auuuacauaugaaa

SEQ ID NO: 2134018 - RNA, 15 nt, Human
auuuacauaugaaau

SEQ ID NO: 2134019 - RNA, 20 nt, Human
auuuacugagcuucucugug

SEQ ID NO: 2134020 - RNA, 13 nt, Human
auuuacugagcuu

SEQ ID NO: 2134021 - RNA, 13 nt, Human
auuuacucauuau

SEQ ID NO: 2134022 - RNA, 16 nt, Human
auuuacauaugaaauu

SEQ ID NO: 2134023 - RNA, 21 nt, Human
auuuacauaugaaauuuaaua

SEQ ID NO: 2134024 - RNA, 23 nt, Human
auuuaccagccuccguauuucag

SEQ ID NO: 2134025 - RNA, 18 nt, Human
auuuauggucaacacuua

SEQ ID NO: 2134026 - RNA, 14 nt, Human
auuuauaacucauc

SEQ ID NO: 2134027 - RNA, 23 nt, Human
auuuauguaaacugcauuagaaa

SEQ ID NO: 2134028 - RNA, 13 nt, Human
auuuauaacucau

SEQ ID NO: 2134029 - RNA, 13 nt, Human
auuuaugugugag

SEQ ID NO: 2134030 - RNA, 18 nt, Human
auuuaugugugaggagcu

SEQ ID NO: 2134031 - RNA, 19 nt, Human
auuuaugugugaggagcug

SEQ ID NO: 2134032 - RNA, 22 nt, Human
auuuaugugugaggagcugcug

SEQ ID NO: 2134033 - RNA, 20 nt, Human
auuuauguagaugugcauuu

SEQ ID NO: 2134034 - RNA, 21 nt, Human
auuuauguagaugugcauuuu

SEQ ID NO: 2134035 - RNA, 12 nt, Human
auuuauguaaac

SEQ ID NO: 2134036 - RNA, 12 nt, Human
auuuauguagau

SEQ ID NO: 2134037 - RNA, 14 nt, Human
auuuauguagaugu

SEQ ID NO: 2134038 - RNA, 18 nt, Human
auuuauguagaugugcau

SEQ ID NO: 2134039 - RNA, 15 nt, Human
auuuacuuugaauuu

SEQ ID NO: 2134040 - RNA, 19 nt, Human
auuuacuucuuauacauuu

SEQ ID NO: 2134041 - RNA, 20 nt, Human
auuuacuucuuauacauuug

SEQ ID NO: 2134042 - RNA, 17 nt, Human
auuuaguucuuuguuau

SEQ ID NO: 2134043 - RNA, 12 nt, Human
auuuaguucuuu

SEQ ID NO: 2134044 - RNA, 16 nt, Human
auuuaguucuuuguua

SEQ ID NO: 2134045 - RNA, 18 nt, Human
auuuauugcuacuuccug

SEQ ID NO: 2134046 - RNA, 22 nt, Human
auuuauugcuguguaacacugu

SEQ ID NO: 2134047 - RNA, 14 nt, Human
auuuauugcuugau

SEQ ID NO: 2134048 - RNA, 18 nt, Human
auuugguucuaggccggg

SEQ ID NO: 2134049 - RNA, 15 nt, Human
auuugguucuaauag

SEQ ID NO: 2134050 - RNA, 14 nt, Human
auuuguaauaaagu

SEQ ID NO: 2134051 - RNA, 18 nt, Human
auuuguaauaaaguauau

SEQ ID NO: 2134052 - RNA, 17 nt, Human
auuuggagacucugugg

SEQ ID NO: 2134053 - RNA, 20 nt, Human
auuugauguuuacaggugga

SEQ ID NO: 2134054 - RNA, 11 nt, Human
auuuggagacu

SEQ ID NO: 2134055 - RNA, 11 nt, Human
auuugaugaaa

SEQ ID NO: 2134056 - RNA, 15 nt, Human
auuugaugaaagcug

SEQ ID NO: 2134057 - RNA, 16 nt, Human
auuugaugaaagcuga

SEQ ID NO: 2134058 - RNA, 21 nt, Human
auuugaugaaagcugauuacu

SEQ ID NO: 2134059 - RNA, 14 nt, Human
auuugaugcuaaau

SEQ ID NO: 2134060 - RNA, 13 nt, Human
auuugagacauuc

SEQ ID NO: 2134061 - RNA, 15 nt, Human
auuugagacauucca

SEQ ID NO: 2134062 - RNA, 17 nt, Human
auuugaucguuccaguu

SEQ ID NO: 2134063 - RNA, 23 nt, Human
auuugaucguuccaguucccacu

SEQ ID NO: 2134064 - RNA, 20 nt, Human
auuugauaguauugugcaua

SEQ ID NO: 2134065 - RNA, 16 nt, Human
auuugagcagggcuca

SEQ ID NO: 2134066 - RNA, 15 nt, Human
auuugagcagggcuc

SEQ ID NO: 2134067 - RNA, 21 nt, Human
auuucuugaguuuuguuuuaa

SEQ ID NO: 2134068 - RNA, 11 nt, Human
auuucuuauag

SEQ ID NO: 2134069 - RNA, 13 nt, Human
auuucuuguuugu

SEQ ID NO: 2134070 - RNA, 14 nt, Human
auuucuuguuuguu

SEQ ID NO: 2134071 - RNA, 20 nt, Human
auuucuugggcccuccugaa

SEQ ID NO: 2134072 - RNA, 20 nt, Human
auuucuugguaagaagccgg

SEQ ID NO: 2134073 - RNA, 14 nt, Human
auuucuugggcccu

SEQ ID NO: 2134074 - RNA, 16 nt, Human
auuucuugggcccucc

SEQ ID NO: 2134075 - RNA, 17 nt, Human
auuucuugggcccuccu

SEQ ID NO: 2134076 - RNA, 18 nt, Human
auuucuugggcccuccug

SEQ ID NO: 2134077 - RNA, 19 nt, Human
auuucuugguaagaagccg

SEQ ID NO: 2134078 - RNA, 20 nt, Human
auuuuaagugcuuuguaaug

SEQ ID NO: 2134079 - RNA, 23 nt, Human
auugcauuaaauauaauaugcac

SEQ ID NO: 2134080 - RNA, 15 nt, Human
auugcaugcugcuuu

SEQ ID NO: 2134081 - RNA, 16 nt, Human
auugcaugcugcuuua

SEQ ID NO: 2134082 - RNA, 17 nt, Human
auugcaugcugcuuuaa

SEQ ID NO: 2134083 - RNA, 20 nt, Human
auugcaugcugcuuuaauug

SEQ ID NO: 2134084 - RNA, 17 nt, Human
auugcauggguuuugua

SEQ ID NO: 2134085 - RNA, 19 nt, Human
auugcauggguuuuguagg

SEQ ID NO: 2134086 - RNA, 18 nt, Human
auugccuuaacuggagcc

SEQ ID NO: 2134087 - RNA, 22 nt, Human
auugccugcggucaaggccagc

SEQ ID NO: 2134088 - RNA, 16 nt, Human
auugcauauauacaua

SEQ ID NO: 2134089 - RNA, 16 nt, Human
auuggcauuaaaacuu

SEQ ID NO: 2134090 - RNA, 17 nt, Human
auuggagccaccaugcc

SEQ ID NO: 2134091 - RNA, 18 nt, Human
auuggagaguaaaaacug

SEQ ID NO: 2134092 - RNA, 19 nt, Human
auuggcuauuuaaagacaa

SEQ ID NO: 2134093 - RNA, 17 nt, Human
auuggcuaguugaaucu

SEQ ID NO: 2134094 - RNA, 15 nt, Human
auuguacguuuaaag

SEQ ID NO: 2134095 - RNA, 19 nt, Human
auuguacguuuaaagugua

SEQ ID NO: 2134096 - RNA, 13 nt, Human
auugauggggaag

SEQ ID NO: 2134097 - RNA, 14 nt, Human
auugacaaacucuc

SEQ ID NO: 2134098 - RNA, 13 nt, Human
auugacaaacucu

SEQ ID NO: 2134099 - RNA, 16 nt, Human
auugauggggaaggag

SEQ ID NO: 2134100 - RNA, 13 nt, Human
auugaugugcaaa

SEQ ID NO: 2134101 - RNA, 16 nt, Human
auugaugugcaaaaau

SEQ ID NO: 2134102 - RNA, 17 nt, Human
auugaugugcaaaaauu

SEQ ID NO: 2134103 - RNA, 18 nt, Human
auugaugugcaaaaauuu

SEQ ID NO: 2134104 - RNA, 20 nt, Human
auugaugugcaaaaauuuuu

SEQ ID NO: 2134105 - RNA, 19 nt, Human
auugcaacaggcugggcuu

SEQ ID NO: 2134106 - RNA, 12 nt, Human
auugcaccacug

SEQ ID NO: 2134107 - RNA, 18 nt, Human
auugcaacaggcugggcu

SEQ ID NO: 2134108 - RNA, 17 nt, Human
auugcaacaggcugggc

SEQ ID NO: 2134109 - RNA, 15 nt, Human
auugcacuccagccu

SEQ ID NO: 2134110 - RNA, 17 nt, Human
auugcacuccagccugg

SEQ ID NO: 2134111 - RNA, 16 nt, Human
auugcacuccagccug

SEQ ID NO: 2134112 - RNA, 18 nt, Human
auugcacuccagccuggg

SEQ ID NO: 2134113 - RNA, 19 nt, Human
auugcacuccagccugggc

SEQ ID NO: 2134114 - RNA, 14 nt, Human
auugaacccaggag

SEQ ID NO: 2134115 - RNA, 17 nt, Human
auugaaggaugcugucu

SEQ ID NO: 2134116 - RNA, 15 nt, Human
auugaacccaggagg

SEQ ID NO: 2134117 - RNA, 22 nt, Human
auugaacaaguuguuucauuga

SEQ ID NO: 2134118 - RNA, 17 nt, Human
auuccuauauaguuuau

SEQ ID NO: 2134119 - RNA, 15 nt, Human
auuccuagauaaaaa

SEQ ID NO: 2134120 - RNA, 19 nt, Human
auuccuagauaaaaagaug

SEQ ID NO: 2134121 - RNA, 21 nt, Human
auuccuagauaaaaagauggc

SEQ ID NO: 2134122 - RNA, 24 nt, Human
auuccuagaaacugacacaugcug

SEQ ID NO: 2134123 - RNA, 17 nt, Human
auuccuacaauauauau

SEQ ID NO: 2134124 - RNA, 18 nt, Human
auuccuacaauauauauu

SEQ ID NO: 2134125 - RNA, 22 nt, Human
auuccuacaauauauauucugg

SEQ ID NO: 2134126 - RNA, 13 nt, Human
auugaauuuaaca

SEQ ID NO: 2134127 - RNA, 14 nt, Human
auugaauuuaacaa

SEQ ID NO: 2134128 - RNA, 15 nt, Human
auugaauuuaacaau

SEQ ID NO: 2134129 - RNA, 16 nt, Human
auugaauuuaacaaug

SEQ ID NO: 2134130 - RNA, 13 nt, Human
auugaauuuucaa

SEQ ID NO: 2134131 - RNA, 20 nt, Human
auugaauuuucaagcaucuc

SEQ ID NO: 2134132 - RNA, 14 nt, Human
auugaaguaaugaa

SEQ ID NO: 2134133 - RNA, 15 nt, Human
auugaaguaaugaau

SEQ ID NO: 2134134 - RNA, 16 nt, Human
auugaaguaaugaauu

SEQ ID NO: 2134135 - RNA, 19 nt, Human
auugaauaaaguugaagcu

SEQ ID NO: 2134136 - RNA, 19 nt, Human
caccauguuggccaggcug

SEQ ID NO: 2134137 - RNA, 18 nt, Human
caccauguacauagcuug

SEQ ID NO: 2134138 - RNA, 15 nt, Human
caccauguaaaacaa

SEQ ID NO: 2134139 - RNA, 16 nt, Human
caccauguaaaacaaa

SEQ ID NO: 2134140 - RNA, 18 nt, Human
caccauguaaaacaaaaa

SEQ ID NO: 2134141 - RNA, 19 nt, Human
caccauguaaaacaaaaaa

SEQ ID NO: 2134142 - RNA, 21 nt, Human
caccauguaaaacaaaaaaca

SEQ ID NO: 2134143 - RNA, 12 nt, Human
caccauggccag

SEQ ID NO: 2134144 - RNA, 16 nt, Human
caccauggccagccaa

SEQ ID NO: 2134145 - RNA, 20 nt, Human
caccauggcuaaggcaccag

SEQ ID NO: 2134146 - RNA, 22 nt, Human
caccauggcuaaggcaccagcc

SEQ ID NO: 2134147 - RNA, 22 nt, Human
caccaucucaggccaccugccc

SEQ ID NO: 2134148 - RNA, 18 nt, Human
caccaucucaggccaccu

SEQ ID NO: 2134149 - RNA, 19 nt, Human
caccaucucaggccaccug

SEQ ID NO: 2134150 - RNA, 20 nt, Human
caccaucucaggccaccugc

SEQ ID NO: 2134151 - RNA, 21 nt, Human
caccaucucaggccaccugcc

SEQ ID NO: 2134152 - RNA, 13 nt, Human
caccaucucaggc

SEQ ID NO: 2134153 - RNA, 14 nt, Human
caccaucucaggcc

SEQ ID NO: 2134154 - RNA, 18 nt, Human
caccaucaugucuggcua

SEQ ID NO: 2134155 - RNA, 17 nt, Human
caccaucaugucuggcu

SEQ ID NO: 2134156 - RNA, 15 nt, Human
caccaucaugucugg

SEQ ID NO: 2134157 - RNA, 20 nt, Human
caccagugaaugaaagucuu

SEQ ID NO: 2134158 - RNA, 22 nt, Human
caccagugaaugaaagucuugu

SEQ ID NO: 2134159 - RNA, 16 nt, Human
caccagguagaacaca

SEQ ID NO: 2134160 - RNA, 14 nt, Human
caccaggucucccg

SEQ ID NO: 2134161 - RNA, 22 nt, Human
caccaggucucccgggaagcca

SEQ ID NO: 2134162 - RNA, 16 nt, Human
caccauauucagugcu

SEQ ID NO: 2134163 - RNA, 21 nt, Human
caccauauucagugcuguggc

SEQ ID NO: 2134164 - RNA, 19 nt, Human
caccaacuggcccucuucu

SEQ ID NO: 2134165 - RNA, 18 nt, Human
caccaguuccuuucaaug

SEQ ID NO: 2134166 - RNA, 23 nt, Human
caccaguguguggcuuucagagc

SEQ ID NO: 2134167 - RNA, 21 nt, Human
caccaguguguggcuuucaga

SEQ ID NO: 2134168 - RNA, 15 nt, Human
caccaguguccuccc

SEQ ID NO: 2134169 - RNA, 17 nt, Human
caccaguguccuccccu

SEQ ID NO: 2134170 - RNA, 18 nt, Human
caccaguguccuccccuc

SEQ ID NO: 2134171 - RNA, 19 nt, Human
caccaguguccuccccuca

SEQ ID NO: 2134172 - RNA, 23 nt, Human
caccaguguccuccccucaagga

SEQ ID NO: 2134173 - RNA, 15 nt, Human
caccagagcccaccu

SEQ ID NO: 2134174 - RNA, 22 nt, Human
caccacgauguggcccuggccu

SEQ ID NO: 2134175 - RNA, 22 nt, Human
caccagagcccaccuuggcuca

SEQ ID NO: 2134176 - RNA, 20 nt, Human
caccagagcccaccuuggcu

SEQ ID NO: 2134177 - RNA, 18 nt, Human
caccagagcccaccuugg

SEQ ID NO: 2134178 - RNA, 17 nt, Human
caccagagcccaccuug

SEQ ID NO: 2134179 - RNA, 19 nt, Human
caccacacccagcccacuu

SEQ ID NO: 2134180 - RNA, 13 nt, Human
caccaccuuccca

SEQ ID NO: 2134181 - RNA, 14 nt, Human
caccaccuucccag

SEQ ID NO: 2134182 - RNA, 18 nt, Human
caccacgauguggcccug

SEQ ID NO: 2134183 - RNA, 19 nt, Human
caccacgauguggcccugg

SEQ ID NO: 2134184 - RNA, 20 nt, Human
caccacgauguggcccuggc

SEQ ID NO: 2134185 - RNA, 21 nt, Human
caccacgauguggcccuggcc

SEQ ID NO: 2134186 - RNA, 15 nt, Human
caccaccuucccagc

SEQ ID NO: 2134187 - RNA, 16 nt, Human
caccaccuucccagcu

SEQ ID NO: 2134188 - RNA, 18 nt, Human
caccaccuucccagcucu

SEQ ID NO: 2134189 - RNA, 19 nt, Human
caccaccuucccagcucuc

SEQ ID NO: 2134190 - RNA, 22 nt, Human
caccaccuucccagcucucccu

SEQ ID NO: 2134191 - RNA, 21 nt, Human
caccaccuucccagcucuccc

SEQ ID NO: 2134192 - RNA, 15 nt, Human
caccacgauguggcc

SEQ ID NO: 2134193 - RNA, 19 nt, Human
caccaagacuugaaggugc

SEQ ID NO: 2134194 - RNA, 22 nt, Human
caccaagacuuguuuuaugcuc

SEQ ID NO: 2134195 - RNA, 15 nt, Human
caccaagaaagcagg

SEQ ID NO: 2134196 - RNA, 23 nt, Human
caccaaguuggaacauccuugga

SEQ ID NO: 2134197 - RNA, 22 nt, Human
caccaaguuggaacauccuugg

SEQ ID NO: 2134198 - RNA, 12 nt, Human
caccaagcccag

SEQ ID NO: 2134199 - RNA, 13 nt, Human
caccaagcccagu

SEQ ID NO: 2134200 - RNA, 13 nt, Human
caccaagcugcug

SEQ ID NO: 2134201 - RNA, 13 nt, Human
caccaagcccaca

SEQ ID NO: 2134202 - RNA, 14 nt, Human
caccaagcccacag

SEQ ID NO: 2134203 - RNA, 15 nt, Human
caccaagcccacagg

SEQ ID NO: 2134204 - RNA, 23 nt, Human
caccaagcccacaggugucccca

SEQ ID NO: 2134205 - RNA, 18 nt, Human
cacagcucuucuccaggc

SEQ ID NO: 2134206 - RNA, 19 nt, Human
cacagcccaaagaaggaaa

SEQ ID NO: 2134207 - RNA, 18 nt, Human
cacagcaauuccucaggc

SEQ ID NO: 2134208 - RNA, 16 nt, Human
cacagcaauuccucag

SEQ ID NO: 2134209 - RNA, 15 nt, Human
cacagcacacucagc

SEQ ID NO: 2134210 - RNA, 22 nt, Human
cacacggacacucaaaagcugg

SEQ ID NO: 2134211 - RNA, 19 nt, Human
cacacgucauguuucuuca

SEQ ID NO: 2134212 - RNA, 20 nt, Human
cacacgucugacccucucca

SEQ ID NO: 2134213 - RNA, 24 nt, Human
cacacgucugacccucuccacccc

SEQ ID NO: 2134214 - RNA, 21 nt, Human
cacacggaggcaucugcaccc

SEQ ID NO: 2134215 - RNA, 17 nt, Human
cacacguacuuaaauga

SEQ ID NO: 2134216 - RNA, 18 nt, Human
cacacggaggcaucugca

SEQ ID NO: 2134217 - RNA, 20 nt, Human
cacacggaggcaucugcacc

SEQ ID NO: 2134218 - RNA, 20 nt, Human
cacagcucuucuccaggcug

SEQ ID NO: 2134219 - RNA, 19 nt, Human
cacagcucuucuccaggcu

SEQ ID NO: 2134220 - RNA, 21 nt, Human
cacagcucuucuccaggcugu

SEQ ID NO: 2134221 - RNA, 16 nt, Human
cacaggacucugccuc

SEQ ID NO: 2134222 - RNA, 15 nt, Human
cacaggacucugccu

SEQ ID NO: 2134223 - RNA, 17 nt, Human
cacaggaucagucugau

SEQ ID NO: 2134224 - RNA, 14 nt, Human
cacaggcccggcuc

SEQ ID NO: 2134225 - RNA, 22 nt, Human
cacagucucuuuaaucuucagu

SEQ ID NO: 2134226 - RNA, 19 nt, Human
cacaggcagguccaggguu

SEQ ID NO: 2134227 - RNA, 20 nt, Human
cacaggcaacugaggcagac

SEQ ID NO: 2134228 - RNA, 13 nt, Human
cacaggcaacuga

SEQ ID NO: 2134229 - RNA, 19 nt, Human
cacaggauggucucugcca

SEQ ID NO: 2134230 - RNA, 20 nt, Human
cacaggauggucucugccau

SEQ ID NO: 2134231 - RNA, 14 nt, Human
cacaggcaacugag

SEQ ID NO: 2134232 - RNA, 17 nt, Human
cacaggcaacugaggca

SEQ ID NO: 2134233 - RNA, 18 nt, Human
cacaggcaacugaggcag

SEQ ID NO: 2134234 - RNA, 19 nt, Human
cacaggcaacugaggcaga

SEQ ID NO: 2134235 - RNA, 17 nt, Human
cacagugaaggcugucc

SEQ ID NO: 2134236 - RNA, 22 nt, Human
cacagugaaggcuguccuuacc

SEQ ID NO: 2134237 - RNA, 21 nt, Human
cacaugucagcaaguccuaag

SEQ ID NO: 2134238 - RNA, 14 nt, Human
cacaugcuggacag

SEQ ID NO: 2134239 - RNA, 15 nt, Human
cacaugcuggacagg

SEQ ID NO: 2134240 - RNA, 19 nt, Human
cacaugcuggacaggucug

SEQ ID NO: 2134241 - RNA, 23 nt, Human
cacaugcuggacaggucugggag

SEQ ID NO: 2134242 - RNA, 18 nt, Human
cacaugcacgugugugca

SEQ ID NO: 2134243 - RNA, 21 nt, Human
cacaugagaucuaggugagga

SEQ ID NO: 2134244 - RNA, 13 nt, Human
caccauugcugcu

SEQ ID NO: 2134245 - RNA, 17 nt, Human
caccauugcugcuccuu

SEQ ID NO: 2134246 - RNA, 14 nt, Human
cacccaaaagucaa

SEQ ID NO: 2134247 - RNA, 23 nt, Human
cacccaaaagucaaaaggugccu

SEQ ID NO: 2134248 - RNA, 15 nt, Human
cacccaaaccccggg

SEQ ID NO: 2134249 - RNA, 19 nt, Human
caccauguuugagcucaga

SEQ ID NO: 2134250 - RNA, 22 nt, Human
caccauguuugagcucagaccc

SEQ ID NO: 2134251 - RNA, 18 nt, Human
caccauguuugagcucag

SEQ ID NO: 2134252 - RNA, 23 nt, Human
caccauguuugagcucagacccc

SEQ ID NO: 2134253 - RNA, 15 nt, Human
caccauucaggaacc

SEQ ID NO: 2134254 - RNA, 22 nt, Human
caccauucaggaaccuggacca

SEQ ID NO: 2134255 - RNA, 18 nt, Human
caaagugguauagaaaug

SEQ ID NO: 2134256 - RNA, 19 nt, Human
caaagugguauagaaaugc

SEQ ID NO: 2134257 - RNA, 23 nt, Human
caaaggguaucaggugcugccau

SEQ ID NO: 2134258 - RNA, 21 nt, Human
caaaggguaucaggugcugcc

SEQ ID NO: 2134259 - RNA, 20 nt, Human
caaaggguaucaggugcugc

SEQ ID NO: 2134260 - RNA, 24 nt, Human
caaaggaauggaggcucuaauuga

SEQ ID NO: 2134261 - RNA, 23 nt, Human
caaagccccuugcucuccccugc

SEQ ID NO: 2134262 - RNA, 23 nt, Human
caaaggacuguuuuuuccugagc

SEQ ID NO: 2134263 - RNA, 17 nt, Human
caaagggaaauaucauu

SEQ ID NO: 2134264 - RNA, 15 nt, Human
caaagggaaauauca

SEQ ID NO: 2134265 - RNA, 18 nt, Human
caaagggaaauaucauuu

SEQ ID NO: 2134266 - RNA, 14 nt, Human
caaagggagagaga

SEQ ID NO: 2134267 - RNA, 22 nt, Human
caaagggagcacuggguugacu

SEQ ID NO: 2134268 - RNA, 17 nt, Human
caaauauuccagagacu

SEQ ID NO: 2134269 - RNA, 13 nt, Human
caaauauuccaga

SEQ ID NO: 2134270 - RNA, 22 nt, Human
caaaguucccuacuuccuguga

SEQ ID NO: 2134271 - RNA, 17 nt, Human
caaaguggaaggaaaga

SEQ ID NO: 2134272 - RNA, 23 nt, Human
caaaguggaaggaaagaugcuca

SEQ ID NO: 2134273 - RNA, 13 nt, Human
caaaguggcaaaa

SEQ ID NO: 2134274 - RNA, 21 nt, Human
caaaguucccuacuuccugug

SEQ ID NO: 2134275 - RNA, 15 nt, Human
caaauuggagcaggg

SEQ ID NO: 2134276 - RNA, 19 nt, Human
caaauugcuugaaagaaaa

SEQ ID NO: 2134277 - RNA, 17 nt, Human
caaauugcuugaaagaa

SEQ ID NO: 2134278 - RNA, 14 nt, Human
caaauucuguuucu

SEQ ID NO: 2134279 - RNA, 15 nt, Human
caaauucuguuucuu

SEQ ID NO: 2134280 - RNA, 19 nt, Human
caaauugagagaauggaaa

SEQ ID NO: 2134281 - RNA, 12 nt, Human
caaagggccagg

SEQ ID NO: 2134282 - RNA, 19 nt, Human
caaagcccaaagugguaua

SEQ ID NO: 2134283 - RNA, 17 nt, Human
caaagcccaaaguggua

SEQ ID NO: 2134284 - RNA, 16 nt, Human
caaagaguuaauauau

SEQ ID NO: 2134285 - RNA, 14 nt, Human
caaagacagaagcc

SEQ ID NO: 2134286 - RNA, 18 nt, Human
caaagaccaaauuccuug

SEQ ID NO: 2134287 - RNA, 16 nt, Human
caaagacuuaguauau

SEQ ID NO: 2134288 - RNA, 19 nt, Human
caaagacuuaguauauuuu

SEQ ID NO: 2134289 - RNA, 20 nt, Human
caaagacuuaguauauuuuc

SEQ ID NO: 2134290 - RNA, 14 nt, Human
caaagagguuuuaa

SEQ ID NO: 2134291 - RNA, 21 nt, Human
caaagagguuuuaaaaaaauc

SEQ ID NO: 2134292 - RNA, 20 nt, Human
caaagacaaauucuguuucu

SEQ ID NO: 2134293 - RNA, 21 nt, Human
caaagacaaauucuguuucuu

SEQ ID NO: 2134294 - RNA, 14 nt, Human
caaagaaugccuug

SEQ ID NO: 2134295 - RNA, 15 nt, Human
caaagaaugccuuga

SEQ ID NO: 2134296 - RNA, 22 nt, Human
caaagaauuucaauuuguucag

SEQ ID NO: 2134297 - RNA, 19 nt, Human
caaacuggcaaacuucaga

SEQ ID NO: 2134298 - RNA, 17 nt, Human
caaacuggcaaacuuca

SEQ ID NO: 2134299 - RNA, 19 nt, Human
caaacugccuuggcuucag

SEQ ID NO: 2134300 - RNA, 12 nt, Human
auuuuaagugcu

SEQ ID NO: 2134301 - RNA, 14 nt, Human
auuuuaagugcuuu

SEQ ID NO: 2134302 - RNA, 16 nt, Human
auuuuaagugcuuugu

SEQ ID NO: 2134303 - RNA, 17 nt, Human
auuuuaagugcuuugua

SEQ ID NO: 2134304 - RNA, 18 nt, Human
auuuuaagugcuuuguaa

SEQ ID NO: 2134305 - RNA, 23 nt, Human
caaacugccuaagcccuccgcca

SEQ ID NO: 2134306 - RNA, 18 nt, Human
caaacugccuaagcccuc

SEQ ID NO: 2134307 - RNA, 17 nt, Human
caaacugccuaagcccu

SEQ ID NO: 2134308 - RNA, 13 nt, Human
auuuuaaucuaau

SEQ ID NO: 2134309 - RNA, 11 nt, Human
caaacugcaau

SEQ ID NO: 2134310 - RNA, 13 nt, Human
caaacugcaauag

SEQ ID NO: 2134311 - RNA, 15 nt, Human
caaacugcaauagag

SEQ ID NO: 2134312 - RNA, 19 nt, Human
caaacugcaauagagacug

SEQ ID NO: 2134313 - RNA, 20 nt, Human
caaacugcaauagagacugu

SEQ ID NO: 2134314 - RNA, 21 nt, Human
auuuuaaugcaccugaauguu

SEQ ID NO: 2134315 - RNA, 14 nt, Human
auuuuaaucaaauu

SEQ ID NO: 2134316 - RNA, 21 nt, Human
auuuuaaauaaaagugaucaa

SEQ ID NO: 2134317 - RNA, 20 nt, Human
auuuuaaauaaaagugauca

SEQ ID NO: 2134318 - RNA, 22 nt, Human
auuuuaaaguuaaacauuuuua

SEQ ID NO: 2134319 - RNA, 18 nt, Human
auuuguacuacaguucuu

SEQ ID NO: 2134320 - RNA, 16 nt, Human
auuuguacauauguaa

SEQ ID NO: 2134321 - RNA, 18 nt, Human
auuuguacauauguaaaa

SEQ ID NO: 2134322 - RNA, 19 nt, Human
auuuguacauauguaaaau

SEQ ID NO: 2134323 - RNA, 21 nt, Human
auuuguacauauguaaaauaa

SEQ ID NO: 2134324 - RNA, 14 nt, Human
auuuuaagauuccu

SEQ ID NO: 2134325 - RNA, 15 nt, Human
auuuuaagauuccuu

SEQ ID NO: 2134326 - RNA, 16 nt, Human
auuuuaagauuccuuu

SEQ ID NO: 2134327 - RNA, 17 nt, Human
auuuuaagauuccuuuu

SEQ ID NO: 2134328 - RNA, 22 nt, Human
auuuuaagauuccuuuucuugu

SEQ ID NO: 2134329 - RNA, 14 nt, Human
auuuuaagcauuac

SEQ ID NO: 2134330 - RNA, 15 nt, Human
auuuuaagcauuacu

SEQ ID NO: 2134331 - RNA, 21 nt, Human
auuuuaagcauuacucuugua

SEQ ID NO: 2134332 - RNA, 23 nt, Human
auuuuaagcauuacucuuguaag

SEQ ID NO: 2134333 - RNA, 24 nt, Human
auuuuaagcauuacucuuguaaga

SEQ ID NO: 2134334 - RNA, 11 nt, Human
auuuuaaauua

SEQ ID NO: 2134335 - RNA, 13 nt, Human
auuuuaaauuaua

SEQ ID NO: 2134336 - RNA, 14 nt, Human
auuuuaaauuauaa

SEQ ID NO: 2134337 - RNA, 22 nt, Human
auuuuaaauuauaacuuaaaau

SEQ ID NO: 2134338 - RNA, 17 nt, Human
auuuuaaauuauaagga

SEQ ID NO: 2134339 - RNA, 18 nt, Human
auuuuaaauuauaaggac

SEQ ID NO: 2134340 - RNA, 19 nt, Human
auuuuaaauuauaaggacu

SEQ ID NO: 2134341 - RNA, 20 nt, Human
auuuuaaauuauaaggacug

SEQ ID NO: 2134342 - RNA, 21 nt, Human
auuuuaaauuauaaggacugc

SEQ ID NO: 2134343 - RNA, 23 nt, Human
auuuuaaauuauaaggacugcau

SEQ ID NO: 2134344 - RNA, 16 nt, Human
auuuuaaauucacaau

SEQ ID NO: 2134345 - RNA, 20 nt, Human
caacaggcugggcuucagug

SEQ ID NO: 2134346 - RNA, 14 nt, Human
caagccagcuggag

SEQ ID NO: 2134347 - RNA, 16 nt, Human
caagccaagcagccaa

SEQ ID NO: 2134348 - RNA, 19 nt, Human
caagccagggauggggcca

SEQ ID NO: 2134349 - RNA, 22 nt, Human
caagccagggauggggccacag

SEQ ID NO: 2134350 - RNA, 23 nt, Human
caagccagggauggggccacagc

SEQ ID NO: 2134351 - RNA, 24 nt, Human
caagccagggauggggccacagcc

SEQ ID NO: 2134352 - RNA, 12 nt, Human
caagcccaggag

SEQ ID NO: 2134353 - RNA, 23 nt, Human
caagcccacagguguccccagcc

SEQ ID NO: 2134354 - RNA, 13 nt, Human
caagccccaggca

SEQ ID NO: 2134355 - RNA, 15 nt, Human
caagccccaggcagg

SEQ ID NO: 2134356 - RNA, 17 nt, Human
caagccccaggcaggcu

SEQ ID NO: 2134357 - RNA, 18 nt, Human
caagccccaggcaggcug

SEQ ID NO: 2134358 - RNA, 13 nt, Human
caagccccauccu

SEQ ID NO: 2134359 - RNA, 16 nt, Human
caagccccauccugcc

SEQ ID NO: 2134360 - RNA, 18 nt, Human
caagccaacgacaaagcc

SEQ ID NO: 2134361 - RNA, 19 nt, Human
caagccaacgacaaagcca

SEQ ID NO: 2134362 - RNA, 13 nt, Human
caagccaagcagc

SEQ ID NO: 2134363 - RNA, 14 nt, Human
caagccaagcagcc

SEQ ID NO: 2134364 - RNA, 15 nt, Human
caagccaagcagcca

SEQ ID NO: 2134365 - RNA, 14 nt, Human
caagcaggaagcuc

SEQ ID NO: 2134366 - RNA, 18 nt, Human
caagcagucuacccaccu

SEQ ID NO: 2134367 - RNA, 12 nt, Human
caagcaggaagc

SEQ ID NO: 2134368 - RNA, 13 nt, Human
caagcaggaagcu

SEQ ID NO: 2134369 - RNA, 13 nt, Human
caagcaucuccug

SEQ ID NO: 2134370 - RNA, 14 nt, Human
caagcaucuccuga

SEQ ID NO: 2134371 - RNA, 15 nt, Human
caagcaucuccugag

SEQ ID NO: 2134372 - RNA, 17 nt, Human
caagcaucuccugagga

SEQ ID NO: 2134373 - RNA, 18 nt, Human
caagcaucuccugaggau

SEQ ID NO: 2134374 - RNA, 21 nt, Human
caaggcugggggaagaagcuc

SEQ ID NO: 2134375 - RNA, 17 nt, Human
caagcuuguccaacccg

SEQ ID NO: 2134376 - RNA, 13 nt, Human
caagcuucuuuua

SEQ ID NO: 2134377 - RNA, 19 nt, Human
caacuugagcauguuacug

SEQ ID NO: 2134378 - RNA, 18 nt, Human
caacuugagcauguuacu

SEQ ID NO: 2134379 - RNA, 20 nt, Human
caacuugagcauguuacuga

SEQ ID NO: 2134380 - RNA, 20 nt, Human
caacuucuuuuuauuuucuu

SEQ ID NO: 2134381 - RNA, 19 nt, Human
caacuucuacuucugcccu

SEQ ID NO: 2134382 - RNA, 14 nt, Human
caagaaaguuuccc

SEQ ID NO: 2134383 - RNA, 13 nt, Human
caagaaaguuucc

SEQ ID NO: 2134384 - RNA, 13 nt, Human
caagaccugacuc

SEQ ID NO: 2134385 - RNA, 14 nt, Human
caagaccugacuca

SEQ ID NO: 2134386 - RNA, 21 nt, Human
caagacccuuuuggguuucug

SEQ ID NO: 2134387 - RNA, 17 nt, Human
caagagggucugaggaa

SEQ ID NO: 2134388 - RNA, 16 nt, Human
caagagggucugagga

SEQ ID NO: 2134389 - RNA, 12 nt, Human
caagagggucug

SEQ ID NO: 2134390 - RNA, 12 nt, Human
caagagccuugg

SEQ ID NO: 2134391 - RNA, 18 nt, Human
caagagccuuggugucca

SEQ ID NO: 2134392 - RNA, 21 nt, Human
caagagccuugguguccaccu

SEQ ID NO: 2134393 - RNA, 13 nt, Human
caagcagccaagc

SEQ ID NO: 2134394 - RNA, 14 nt, Human
caagcagccaagcu

SEQ ID NO: 2134395 - RNA, 21 nt, Human
caagcagauuggagaaacccu

SEQ ID NO: 2134396 - RNA, 22 nt, Human
caagcagccaagcuccuuggga

SEQ ID NO: 2134397 - RNA, 15 nt, Human
caagacuuuucuuug

SEQ ID NO: 2134398 - RNA, 17 nt, Human
caagacuuuucuuugaa

SEQ ID NO: 2134399 - RNA, 18 nt, Human
caagacuuuucuuugaag

SEQ ID NO: 2134400 - RNA, 19 nt, Human
caagacuucgggaaggugu

SEQ ID NO: 2134401 - RNA, 21 nt, Human
caagacuucgggaaggugucu

SEQ ID NO: 2134402 - RNA, 17 nt, Human
caagacuugaaggugcc

SEQ ID NO: 2134403 - RNA, 18 nt, Human
caagacuugaaggugccu

SEQ ID NO: 2134404 - RNA, 21 nt, Human
caagacuugguguccuuuccc

SEQ ID NO: 2134405 - RNA, 20 nt, Human
caagagggcacugguggccc

SEQ ID NO: 2134406 - RNA, 19 nt, Human
caagagggcacugguggcc

SEQ ID NO: 2134407 - RNA, 18 nt, Human
caagagggcacugguggc

SEQ ID NO: 2134408 - RNA, 17 nt, Human
caagagggcacuggugg

SEQ ID NO: 2134409 - RNA, 20 nt, Human
caagugauucuccugccuca

SEQ ID NO: 2134410 - RNA, 13 nt, Human
caagugaaucuaa

SEQ ID NO: 2134411 - RNA, 18 nt, Human
caagugacuguaucugug

SEQ ID NO: 2134412 - RNA, 19 nt, Human
caagugacuguaucugugu

SEQ ID NO: 2134413 - RNA, 19 nt, Human
caagugcaugcucucugca

SEQ ID NO: 2134414 - RNA, 21 nt, Human
caagugacuguaucuguguag

SEQ ID NO: 2134415 - RNA, 22 nt, Human
caagugccacugcccgagcugg

SEQ ID NO: 2134416 - RNA, 23 nt, Human
caagugccacugcccgagcuggu

SEQ ID NO: 2134417 - RNA, 20 nt, Human
caagugccagucuugugucu

SEQ ID NO: 2134418 - RNA, 18 nt, Human
caagugauucuccugccu

SEQ ID NO: 2134419 - RNA, 19 nt, Human
caagugauucuccugccuc

SEQ ID NO: 2134420 - RNA, 15 nt, Human
caagugagacccugu

SEQ ID NO: 2134421 - RNA, 19 nt, Human
caagugagacccugucuca

SEQ ID NO: 2134422 - RNA, 22 nt, Human
caagugaaaaaggaggaagaga

SEQ ID NO: 2134423 - RNA, 23 nt, Human
caagugaaaaaggaggaagagaa

SEQ ID NO: 2134424 - RNA, 13 nt, Human
caagugaacacau

SEQ ID NO: 2134425 - RNA, 14 nt, Human
caagugagacccug

SEQ ID NO: 2134426 - RNA, 19 nt, Human
caagugaauuuuucucuaa

SEQ ID NO: 2134427 - RNA, 15 nt, Human
caagugacaucucuu

SEQ ID NO: 2134428 - RNA, 16 nt, Human
caagugacaucucuuu

SEQ ID NO: 2134429 - RNA, 21 nt, Human
caaggggaauguuugccucug

SEQ ID NO: 2134430 - RNA, 20 nt, Human
caagcuuugauuuagauuga

SEQ ID NO: 2134431 - RNA, 14 nt, Human
caagggcaguggag

SEQ ID NO: 2134432 - RNA, 16 nt, Human
caagggcaguggaggu

SEQ ID NO: 2134433 - RNA, 16 nt, Human
caagguagcccuggcc

SEQ ID NO: 2134434 - RNA, 21 nt, Human
caagguagcccuggccagagg

SEQ ID NO: 2134435 - RNA, 23 nt, Human
caagguagcccuggccagaggcu

SEQ ID NO: 2134436 - RNA, 23 nt, Human
caaggggaauguuugccucugcc

SEQ ID NO: 2134437 - RNA, 21 nt, Human
caaggggacccauaggaaauc

SEQ ID NO: 2134438 - RNA, 12 nt, Human
caagggccucuu

SEQ ID NO: 2134439 - RNA, 18 nt, Human
caaggggcagucuggagg

SEQ ID NO: 2134440 - RNA, 16 nt, Human
caaggggcagucugga

SEQ ID NO: 2134441 - RNA, 19 nt, Human
caaggggcagucuggaggg

SEQ ID NO: 2134442 - RNA, 20 nt, Human
caaggguucagagacucagg

SEQ ID NO: 2134443 - RNA, 13 nt, Human
caagguaaaauuc

SEQ ID NO: 2134444 - RNA, 15 nt, Human
caagguaaaauucua

SEQ ID NO: 2134445 - RNA, 16 nt, Human
caagguaaaauucuaa

SEQ ID NO: 2134446 - RNA, 17 nt, Human
caagguaaaauucuaaa

SEQ ID NO: 2134447 - RNA, 14 nt, Human
caacaguuccuuca

SEQ ID NO: 2134448 - RNA, 13 nt, Human
caaccuaaauuug

SEQ ID NO: 2134449 - RNA, 18 nt, Human
caaccuaaccccuuuccu

SEQ ID NO: 2134450 - RNA, 11 nt, Human
caaccucagca

SEQ ID NO: 2134451 - RNA, 14 nt, Human
caaccucagcaacc

SEQ ID NO: 2134452 - RNA, 14 nt, Human
caacaggcugggcu

SEQ ID NO: 2134453 - RNA, 17 nt, Human
caacaggcugggcuuca

SEQ ID NO: 2134454 - RNA, 22 nt, Human
caacugcaagucacaaaggaau

SEQ ID NO: 2134455 - RNA, 14 nt, Human
caacuggcccucuu

SEQ ID NO: 2134456 - RNA, 21 nt, Human
caacuggcccucuucuuacuu

SEQ ID NO: 2134457 - RNA, 23 nt, Human
caacuggcccucuucuuacuuga

SEQ ID NO: 2134458 - RNA, 13 nt, Human
caacugggcccaa

SEQ ID NO: 2134459 - RNA, 21 nt, Human
caacugucuccuaccucugcu

SEQ ID NO: 2134460 - RNA, 13 nt, Human
caacugaaaagac

SEQ ID NO: 2134461 - RNA, 14 nt, Human
caacugaaaagacu

SEQ ID NO: 2134462 - RNA, 22 nt, Human
caacugaaaagacucaguguuc

SEQ ID NO: 2134463 - RNA, 14 nt, Human
caacugaaaguguu

SEQ ID NO: 2134464 - RNA, 15 nt, Human
caacugaaaguguuu

SEQ ID NO: 2134465 - RNA, 19 nt, Human
caacugaaaguguuuccuu

SEQ ID NO: 2134466 - RNA, 22 nt, Human
caacugaaaguguuuccuucau

SEQ ID NO: 2134467 - RNA, 14 nt, Human
caacugaacaaaaa

SEQ ID NO: 2134468 - RNA, 15 nt, Human
caacugaacaaaaaa

SEQ ID NO: 2134469 - RNA, 16 nt, Human
caacugaacaaaaaaa

SEQ ID NO: 2134470 - RNA, 17 nt, Human
caacugaacaaaaaaau

SEQ ID NO: 2134471 - RNA, 18 nt, Human
caagccaagcagccaagc

SEQ ID NO: 2134472 - RNA, 16 nt, Human
cacaaagguauaauuu

SEQ ID NO: 2134473 - RNA, 13 nt, Human
cacaacuuaaaaa

SEQ ID NO: 2134474 - RNA, 23 nt, Human
cacaacuuaaaaagucugcauua

SEQ ID NO: 2134475 - RNA, 20 nt, Human
cacaauccuaacacauuauc

SEQ ID NO: 2134476 - RNA, 22 nt, Human
cacaauccuaacacauuaucgg

SEQ ID NO: 2134477 - RNA, 23 nt, Human
cacaauccuaacacauuaucggg

SEQ ID NO: 2134478 - RNA, 22 nt, Human
cacaagugccacugcccgagcu

SEQ ID NO: 2134479 - RNA, 17 nt, Human
cacaaggugcaaaucaa

SEQ ID NO: 2134480 - RNA, 15 nt, Human
cacaaggugggcagg

SEQ ID NO: 2134481 - RNA, 20 nt, Human
cacaaguagaugccugaacu

SEQ ID NO: 2134482 - RNA, 21 nt, Human
cacaaguagaugccugaacuu

SEQ ID NO: 2134483 - RNA, 22 nt, Human
cacaaguagaugccugaacuug

SEQ ID NO: 2134484 - RNA, 21 nt, Human
cacaaggcugaccaagagaga

SEQ ID NO: 2134485 - RNA, 12 nt, Human
cacaagugaaaa

SEQ ID NO: 2134486 - RNA, 16 nt, Human
cacaagugaaaaacau

SEQ ID NO: 2134487 - RNA, 14 nt, Human
cacaaggcugacca

SEQ ID NO: 2134488 - RNA, 18 nt, Human
cacaaggcugaccaagag

SEQ ID NO: 2134489 - RNA, 19 nt, Human
cacaaggcugaccaagaga

SEQ ID NO: 2134490 - RNA, 13 nt, Human
caaugguuugcaa

SEQ ID NO: 2134491 - RNA, 16 nt, Human
caaugguuugcaagga

SEQ ID NO: 2134492 - RNA, 17 nt, Human
caaugguuugcaaggaa

SEQ ID NO: 2134493 - RNA, 18 nt, Human
caaugguuugcaaggaag

SEQ ID NO: 2134494 - RNA, 23 nt, Human
caauuauaucaguccucuuucaa

SEQ ID NO: 2134495 - RNA, 19 nt, Human
caaugguuugcaaggaagc

SEQ ID NO: 2134496 - RNA, 20 nt, Human
caaugguuugcaaggaagcc

SEQ ID NO: 2134497 - RNA, 17 nt, Human
cacaaacgggcucagca

SEQ ID NO: 2134498 - RNA, 19 nt, Human
caauuuucuuuaaccaguc

SEQ ID NO: 2134499 - RNA, 18 nt, Human
caauuuugcaugcucgau

SEQ ID NO: 2134500 - RNA, 13 nt, Human
caauuauuuuuac

SEQ ID NO: 2134501 - RNA, 14 nt, Human
caauucaaaaaugu

SEQ ID NO: 2134502 - RNA, 15 nt, Human
caauucaaaaaugua

SEQ ID NO: 2134503 - RNA, 16 nt, Human
caauucaaaaauguac

SEQ ID NO: 2134504 - RNA, 22 nt, Human
caauuuuuacacaaaccugaaa

SEQ ID NO: 2134505 - RNA, 14 nt, Human
cacacacuuuggcu

SEQ ID NO: 2134506 - RNA, 12 nt, Human
cacacacacaca

SEQ ID NO: 2134507 - RNA, 13 nt, Human
cacacaccccaau

SEQ ID NO: 2134508 - RNA, 15 nt, Human
cacacacacaacaaa

SEQ ID NO: 2134509 - RNA, 14 nt, Human
cacacagagugguc

SEQ ID NO: 2134510 - RNA, 20 nt, Human
cacacagaguggucuuucug

SEQ ID NO: 2134511 - RNA, 21 nt, Human
cacacagaggcugccucuccc

SEQ ID NO: 2134512 - RNA, 20 nt, Human
cacacaccagagcccaccuu

SEQ ID NO: 2134513 - RNA, 16 nt, Human
cacacaccagagccca

SEQ ID NO: 2134514 - RNA, 13 nt, Human
cacacacaaagag

SEQ ID NO: 2134515 - RNA, 14 nt, Human
cacacacaaagaga

SEQ ID NO: 2134516 - RNA, 15 nt, Human
cacacacaaagagag

SEQ ID NO: 2134517 - RNA, 15 nt, Human
cacacacaacaaaaa

SEQ ID NO: 2134518 - RNA, 15 nt, Human
cacacaccagagccc

SEQ ID NO: 2134519 - RNA, 18 nt, Human
cacacaaugugucugaga

SEQ ID NO: 2134520 - RNA, 21 nt, Human
cacacaaauuaucuuaaaacu

SEQ ID NO: 2134521 - RNA, 13 nt, Human
cacacaacaaaaa

SEQ ID NO: 2134522 - RNA, 14 nt, Human
cacacaacaaaaau

SEQ ID NO: 2134523 - RNA, 15 nt, Human
cacacagcucugucc

SEQ ID NO: 2134524 - RNA, 14 nt, Human
cacacagcucuguc

SEQ ID NO: 2134525 - RNA, 13 nt, Human
cacacagcucugu

SEQ ID NO: 2134526 - RNA, 15 nt, Human
cacacagcagcaguu

SEQ ID NO: 2134527 - RNA, 22 nt, Human
cacaccagagcccaccuuggcu

SEQ ID NO: 2134528 - RNA, 21 nt, Human
cacaccagagcccaccuuggc

SEQ ID NO: 2134529 - RNA, 15 nt, Human
cacacagaguggucu

SEQ ID NO: 2134530 - RNA, 13 nt, Human
cacaccaggcugu

SEQ ID NO: 2134531 - RNA, 20 nt, Human
cacaccaggcugugggccuc

SEQ ID NO: 2134532 - RNA, 23 nt, Human
cacacgcacacacacacacagga

SEQ ID NO: 2134533 - RNA, 17 nt, Human
cacaccucccugaacca

SEQ ID NO: 2134534 - RNA, 14 nt, Human
cacaccucccugaa

SEQ ID NO: 2134535 - RNA, 16 nt, Human
cacaccucccugaacc

SEQ ID NO: 2134536 - RNA, 22 nt, Human
cacaccucaguucccuuggccu

SEQ ID NO: 2134537 - RNA, 13 nt, Human
cacaccucaguuc

SEQ ID NO: 2134538 - RNA, 17 nt, Human
cacaccucaguucccuu

SEQ ID NO: 2134539 - RNA, 18 nt, Human
cacaccucaguucccuug

SEQ ID NO: 2134540 - RNA, 20 nt, Human
cacaccucaguucccuuggc

SEQ ID NO: 2134541 - RNA, 21 nt, Human
cacaccucaguucccuuggcc

SEQ ID NO: 2134542 - RNA, 20 nt, Human
cacacccagcccacuucugc

SEQ ID NO: 2134543 - RNA, 14 nt, Human
cacacccagcccac

SEQ ID NO: 2134544 - RNA, 14 nt, Human
cacaccaggcugug

SEQ ID NO: 2134545 - RNA, 17 nt, Human
cacaccaggcugugggc

SEQ ID NO: 2134546 - RNA, 19 nt, Human
cacaccaggcugugggccu

SEQ ID NO: 2134547 - RNA, 13 nt, Human
cacacacacacaa

SEQ ID NO: 2134548 - RNA, 22 nt, Human
caauccugugugguuuagugua

SEQ ID NO: 2134549 - RNA, 13 nt, Human
caaucuauuuauu

SEQ ID NO: 2134550 - RNA, 19 nt, Human
caaucuauuuauuggacau

SEQ ID NO: 2134551 - RNA, 13 nt, Human
caauauuccugaa

SEQ ID NO: 2134552 - RNA, 21 nt, Human
caauauuccugaaugaaauau

SEQ ID NO: 2134553 - RNA, 18 nt, Human
caauccugugggugaaga

SEQ ID NO: 2134554 - RNA, 22 nt, Human
caauauuauaauuuuuuucaau

SEQ ID NO: 2134555 - RNA, 14 nt, Human
caauauuauaauuu

SEQ ID NO: 2134556 - RNA, 14 nt, Human
caauauuauacuaa

SEQ ID NO: 2134557 - RNA, 18 nt, Human
caauauuauacuaagaaa

SEQ ID NO: 2134558 - RNA, 19 nt, Human
caauauuauacuaagaaaa

SEQ ID NO: 2134559 - RNA, 21 nt, Human
caauauuauacuaagaaaaga

SEQ ID NO: 2134560 - RNA, 22 nt, Human
caauauuauacuaagaaaagau

SEQ ID NO: 2134561 - RNA, 23 nt, Human
caauauuauacuaagaaaagaua

SEQ ID NO: 2134562 - RNA, 13 nt, Human
caauauuauaauu

SEQ ID NO: 2134563 - RNA, 16 nt, Human
caagugccugcuuuua

SEQ ID NO: 2134564 - RNA, 14 nt, Human
caaugcacugacau

SEQ ID NO: 2134565 - RNA, 22 nt, Human
caaugauuguuaauuuacagcu

SEQ ID NO: 2134566 - RNA, 14 nt, Human
caaugauggucacc

SEQ ID NO: 2134567 - RNA, 15 nt, Human
caaugauuguuaauu

SEQ ID NO: 2134568 - RNA, 12 nt, Human
caaucuuguuuc

SEQ ID NO: 2134569 - RNA, 17 nt, Human
caaugaaaguuugcacu

SEQ ID NO: 2134570 - RNA, 13 nt, Human
caaugauggucac

SEQ ID NO: 2134571 - RNA, 21 nt, Human
cacacuaaccuggguucccuu

SEQ ID NO: 2134572 - RNA, 18 nt, Human
cauuuuucagauauaaaa

SEQ ID NO: 2134573 - RNA, 20 nt, Human
cauuuuucagauauaaaaga

SEQ ID NO: 2134574 - RNA, 13 nt, Human
cauuuuuccuaac

SEQ ID NO: 2134575 - RNA, 18 nt, Human
cauuuuuccuaacaggau

SEQ ID NO: 2134576 - RNA, 16 nt, Human
ccaaacagccacacug

SEQ ID NO: 2134577 - RNA, 22 nt, Human
cauuuuguggucauuaagcauu

SEQ ID NO: 2134578 - RNA, 15 nt, Human
cauuuuagacaguaa

SEQ ID NO: 2134579 - RNA, 17 nt, Human
cauuuuagacaguaagu

SEQ ID NO: 2134580 - RNA, 19 nt, Human
cauuuuagacaguaaguau

SEQ ID NO: 2134581 - RNA, 18 nt, Human
cauuugagcagggcucag

SEQ ID NO: 2134582 - RNA, 17 nt, Human
cauuugagcagggcuca

SEQ ID NO: 2134583 - RNA, 20 nt, Human
cauuugagcagggcucagcg

SEQ ID NO: 2134584 - RNA, 20 nt, Human
cauuugcuaacuagcuugga

SEQ ID NO: 2134585 - RNA, 21 nt, Human
cauuugcgaaugguuccauuc

SEQ ID NO: 2134586 - RNA, 20 nt, Human
cauuugcgcacaacuuaaaa

SEQ ID NO: 2134587 - RNA, 23 nt, Human
cauuugcgcacaacuuaaaaagu

SEQ ID NO: 2134588 - RNA, 13 nt, Human
cauuugcugaaua

SEQ ID NO: 2134589 - RNA, 21 nt, Human
cauuugaauaaagccugcuuu

SEQ ID NO: 2134590 - RNA, 20 nt, Human
cauuuccugacagaaggacu

SEQ ID NO: 2134591 - RNA, 13 nt, Human
cauuuccugacag

SEQ ID NO: 2134592 - RNA, 17 nt, Human
cauuuaggggccacuuu

SEQ ID NO: 2134593 - RNA, 17 nt, Human
cauuuccuauguaacug

SEQ ID NO: 2134594 - RNA, 19 nt, Human
cauuuccuauguaacugca

SEQ ID NO: 2134595 - RNA, 15 nt, Human
cauuguuuggcauug

SEQ ID NO: 2134596 - RNA, 22 nt, Human
cauuguuugucugucuucauag

SEQ ID NO: 2134597 - RNA, 18 nt, Human
cauuguuugucugucuuc

SEQ ID NO: 2134598 - RNA, 13 nt, Human
cauuuccuguguc

SEQ ID NO: 2134599 - RNA, 12 nt, Human
cauuuccugugu

SEQ ID NO: 2134600 - RNA, 17 nt, Human
cauuucgccccucauuu

SEQ ID NO: 2134601 - RNA, 21 nt, Human
cauuucgccccucauuuaucc

SEQ ID NO: 2134602 - RNA, 17 nt, Human
cauuucuaaaggccucu

SEQ ID NO: 2134603 - RNA, 18 nt, Human
cauuucuaaaggccucuu

SEQ ID NO: 2134604 - RNA, 23 nt, Human
cauuucuaaaggccucuuccuug

SEQ ID NO: 2134605 - RNA, 19 nt, Human
cauuucuaacucugaugua

SEQ ID NO: 2134606 - RNA, 20 nt, Human
cauuucuaacucugauguaa

SEQ ID NO: 2134607 - RNA, 23 nt, Human
cauuucuaacucugauguaaaug

SEQ ID NO: 2134608 - RNA, 18 nt, Human
cauuucuauuuauuuacu

SEQ ID NO: 2134609 - RNA, 14 nt, Human
cauuucuauuuauu

SEQ ID NO: 2134610 - RNA, 13 nt, Human
cauuucuauuuau

SEQ ID NO: 2134611 - RNA, 20 nt, Human
cauuucuagcgcauggccug

SEQ ID NO: 2134612 - RNA, 23 nt, Human
cauuucuagaacaucccugccag

SEQ ID NO: 2134613 - RNA, 17 nt, Human
cauuguuggccaaagcc

SEQ ID NO: 2134614 - RNA, 16 nt, Human
cauuguugaggugguc

SEQ ID NO: 2134615 - RNA, 21 nt, Human
cauuguugagguggucugaau

SEQ ID NO: 2134616 - RNA, 19 nt, Human
cauuguggcugucagcagg

SEQ ID NO: 2134617 - RNA, 21 nt, Human
cauuguggcugucagcaggaa

SEQ ID NO: 2134618 - RNA, 18 nt, Human
cauuguugagguggucug

SEQ ID NO: 2134619 - RNA, 17 nt, Human
cauuguuuauuaacaaa

SEQ ID NO: 2134620 - RNA, 18 nt, Human
cauuguuggccaaagcca

SEQ ID NO: 2134621 - RNA, 14 nt, Human
cauuguuugcuuau

SEQ ID NO: 2134622 - RNA, 17 nt, Human
cauuguuugcuuauugu

SEQ ID NO: 2134623 - RNA, 18 nt, Human
cauuguuugcuuauuguu

SEQ ID NO: 2134624 - RNA, 19 nt, Human
cauuguuugcuuauuguuc

SEQ ID NO: 2134625 - RNA, 20 nt, Human
cauuguuugcuuauuguucc

SEQ ID NO: 2134626 - RNA, 21 nt, Human
cauuguuugcuuauuguucca

SEQ ID NO: 2134627 - RNA, 22 nt, Human
cauuguuugcuuauuguuccaa

SEQ ID NO: 2134628 - RNA, 15 nt, Human
cauugucuuuauaug

SEQ ID NO: 2134629 - RNA, 16 nt, Human
cauugucuuuauauga

SEQ ID NO: 2134630 - RNA, 17 nt, Human
cauugucuuuauaugaa

SEQ ID NO: 2134631 - RNA, 21 nt, Human
cauugucuuuauaugaacaua

SEQ ID NO: 2134632 - RNA, 14 nt, Human
cauugucucagagc

SEQ ID NO: 2134633 - RNA, 21 nt, Human
cauuguagagcuucuggcacu

SEQ ID NO: 2134634 - RNA, 19 nt, Human
cauuguagagcuucuggca

SEQ ID NO: 2134635 - RNA, 17 nt, Human
cauuguagagcuucugg

SEQ ID NO: 2134636 - RNA, 16 nt, Human
cauuguagagcuucug

SEQ ID NO: 2134637 - RNA, 16 nt, Human
cauuguauaaaaauag

SEQ ID NO: 2134638 - RNA, 15 nt, Human
cauuguauaaaaaua

SEQ ID NO: 2134639 - RNA, 11 nt, Human
cauugcauuua

SEQ ID NO: 2134640 - RNA, 17 nt, Human
cauugccaccaggagaa

SEQ ID NO: 2134641 - RNA, 20 nt, Human
cauugccaccaggagaacca

SEQ ID NO: 2134642 - RNA, 14 nt, Human
cauugccagugucu

SEQ ID NO: 2134643 - RNA, 15 nt, Human
cauugccagugucuu

SEQ ID NO: 2134644 - RNA, 16 nt, Human
cauugccagugucuuu

SEQ ID NO: 2134645 - RNA, 17 nt, Human
cauugccagugucuuuc

SEQ ID NO: 2134646 - RNA, 18 nt, Human
cauugccagugucuuucu

SEQ ID NO: 2134647 - RNA, 19 nt, Human
cauugccagugucuuucuu

SEQ ID NO: 2134648 - RNA, 21 nt, Human
cauugccagugucuuucuuug

SEQ ID NO: 2134649 - RNA, 12 nt, Human
cauugcccuggu

SEQ ID NO: 2134650 - RNA, 15 nt, Human
cauuguagagcuucu

SEQ ID NO: 2134651 - RNA, 13 nt, Human
cauugccaccagg

SEQ ID NO: 2134652 - RNA, 14 nt, Human
cauugccaccagga

SEQ ID NO: 2134653 - RNA, 15 nt, Human
cauugccaccaggag

SEQ ID NO: 2134654 - RNA, 16 nt, Human
cauugccaccaggaga

SEQ ID NO: 2134655 - RNA, 17 nt, Human
ccaaauuuucuuuuuau

SEQ ID NO: 2134656 - RNA, 21 nt, Human
ccaaauuuuggccaaaguguu

SEQ ID NO: 2134657 - RNA, 21 nt, Human
ccaaagggugaagcuauuuau

SEQ ID NO: 2134658 - RNA, 23 nt, Human
ccaaagggugaagcuauuuaucu

SEQ ID NO: 2134659 - RNA, 20 nt, Human
ccaacacaaggugggcaggg

SEQ ID NO: 2134660 - RNA, 14 nt, Human
ccaacaagggcagu

SEQ ID NO: 2134661 - RNA, 15 nt, Human
ccaacaagggcagug

SEQ ID NO: 2134662 - RNA, 16 nt, Human
ccaacaagggcagugg

SEQ ID NO: 2134663 - RNA, 17 nt, Human
ccaacaagggcagugga

SEQ ID NO: 2134664 - RNA, 23 nt, Human
ccaacaagggcaguggaggugcu

SEQ ID NO: 2134665 - RNA, 17 nt, Human
ccaacccaaaccuggag

SEQ ID NO: 2134666 - RNA, 18 nt, Human
ccaacccaaaccuggaga

SEQ ID NO: 2134667 - RNA, 19 nt, Human
ccaacccaaaccuggagau

SEQ ID NO: 2134668 - RNA, 12 nt, Human
ccaacccaucag

SEQ ID NO: 2134669 - RNA, 14 nt, Human
ccaacccaucagaa

SEQ ID NO: 2134670 - RNA, 13 nt, Human
ccaacccccaccc

SEQ ID NO: 2134671 - RNA, 16 nt, Human
ccaacccccaccccac

SEQ ID NO: 2134672 - RNA, 17 nt, Human
ccaacccccaccccaca

SEQ ID NO: 2134673 - RNA, 18 nt, Human
ccaacccccaccccacac

SEQ ID NO: 2134674 - RNA, 19 nt, Human
ccaacccccaccccacacu

SEQ ID NO: 2134675 - RNA, 20 nt, Human
ccaacccccaccccacacuu

SEQ ID NO: 2134676 - RNA, 20 nt, Human
ccaaccaaguggcucccaca

SEQ ID NO: 2134677 - RNA, 13 nt, Human
ccaacaucaacau

SEQ ID NO: 2134678 - RNA, 15 nt, Human
ccaacaggagcuggg

SEQ ID NO: 2134679 - RNA, 23 nt, Human
ccaacaggagcugggauccuaag

SEQ ID NO: 2134680 - RNA, 19 nt, Human
ccaaagccaaagcuaggcc

SEQ ID NO: 2134681 - RNA, 17 nt, Human
ccaaagccuccuccagc

SEQ ID NO: 2134682 - RNA, 22 nt, Human
ccaaagccuccuccagccgcca

SEQ ID NO: 2134683 - RNA, 13 nt, Human
ccaaagccaccag

SEQ ID NO: 2134684 - RNA, 22 nt, Human
ccaaagccaccagacugacaaa

SEQ ID NO: 2134685 - RNA, 13 nt, Human
ccaaacucugcca

SEQ ID NO: 2134686 - RNA, 12 nt, Human
ccaaacugccua

SEQ ID NO: 2134687 - RNA, 15 nt, Human
ccaaagcuaggccug

SEQ ID NO: 2134688 - RNA, 23 nt, Human
ccaaagccccuugcucuccccug

SEQ ID NO: 2134689 - RNA, 17 nt, Human
ccaaagcuaggccuggc

SEQ ID NO: 2134690 - RNA, 16 nt, Human
ccaaagcuaggccugg

SEQ ID NO: 2134691 - RNA, 21 nt, Human
ccaaagcuaggccuggccaga

SEQ ID NO: 2134692 - RNA, 18 nt, Human
ccaaagcuaggguggccc

SEQ ID NO: 2134693 - RNA, 19 nt, Human
ccaaagcuaggguggcccu

SEQ ID NO: 2134694 - RNA, 20 nt, Human
ccaaagcugacgaggcuggg

SEQ ID NO: 2134695 - RNA, 21 nt, Human
ccaaagcugacgaggcugggc

SEQ ID NO: 2134696 - RNA, 23 nt, Human
ccaaagcuaggguggcccuugca

SEQ ID NO: 2134697 - RNA, 15 nt, Human
ccaaagccagacagc

SEQ ID NO: 2134698 - RNA, 18 nt, Human
ccaaaggaagucuaggag

SEQ ID NO: 2134699 - RNA, 21 nt, Human
ccaaagcuguuggucuguccc

SEQ ID NO: 2134700 - RNA, 14 nt, Human
ccaaaggaggaugg

SEQ ID NO: 2134701 - RNA, 12 nt, Human
ccaaaggaggcu

SEQ ID NO: 2134702 - RNA, 15 nt, Human
ccaaaggaggcuggc

SEQ ID NO: 2134703 - RNA, 16 nt, Human
ccaaaggaggcuggca

SEQ ID NO: 2134704 - RNA, 17 nt, Human
ccaaaggaggcuggcag

SEQ ID NO: 2134705 - RNA, 18 nt, Human
ccaaaggaggcuggcagg

SEQ ID NO: 2134706 - RNA, 15 nt, Human
ccaacccucagagcc

SEQ ID NO: 2134707 - RNA, 14 nt, Human
ccaacccucagagc

SEQ ID NO: 2134708 - RNA, 12 nt, Human
ccaaccccugug

SEQ ID NO: 2134709 - RNA, 15 nt, Human
ccaacccgaggcccg

SEQ ID NO: 2134710 - RNA, 15 nt, Human
ccaaccccuguggag

SEQ ID NO: 2134711 - RNA, 17 nt, Human
ccaacccgaggcccgca

SEQ ID NO: 2134712 - RNA, 18 nt, Human
ccaaccccccaccugcca

SEQ ID NO: 2134713 - RNA, 20 nt, Human
ccaagaauagaugcugacug

SEQ ID NO: 2134714 - RNA, 22 nt, Human
ccaagacagaugccccagagcu

SEQ ID NO: 2134715 - RNA, 19 nt, Human
ccaagacagaugccccaga

SEQ ID NO: 2134716 - RNA, 21 nt, Human
ccaagacagaugccccagagc

SEQ ID NO: 2134717 - RNA, 18 nt, Human
ccaagacagaugccccag

SEQ ID NO: 2134718 - RNA, 19 nt, Human
ccaagaauagaugcugacu

SEQ ID NO: 2134719 - RNA, 13 nt, Human
ccaagaaggcugg

SEQ ID NO: 2134720 - RNA, 14 nt, Human
ccaagaaggcuggg

SEQ ID NO: 2134721 - RNA, 20 nt, Human
ccaagacuugguguccuuuc

SEQ ID NO: 2134722 - RNA, 21 nt, Human
ccaagacuugguguccuuucc

SEQ ID NO: 2134723 - RNA, 19 nt, Human
ccaagacuugguguccuuu

SEQ ID NO: 2134724 - RNA, 22 nt, Human
ccaagacuugguguccuuuccc

SEQ ID NO: 2134725 - RNA, 20 nt, Human
ccaagagaaggggaagcacu

SEQ ID NO: 2134726 - RNA, 12 nt, Human
ccaagagagaaa

SEQ ID NO: 2134727 - RNA, 13 nt, Human
ccaagagagaaag

SEQ ID NO: 2134728 - RNA, 14 nt, Human
ccaagagagaaaga

SEQ ID NO: 2134729 - RNA, 21 nt, Human
ccaagaggcuguucccaccag

SEQ ID NO: 2134730 - RNA, 15 nt, Human
ccaagagagaaagaa

SEQ ID NO: 2134731 - RNA, 22 nt, Human
ccaaguccaggucgggcucagc

SEQ ID NO: 2134732 - RNA, 12 nt, Human
ccaagucccacc

SEQ ID NO: 2134733 - RNA, 23 nt, Human
ccaagucccaccgguugcuucug

SEQ ID NO: 2134734 - RNA, 14 nt, Human
ccaaguuauauaaa

SEQ ID NO: 2134735 - RNA, 20 nt, Human
ccaaguuauauaaagagaaa

SEQ ID NO: 2134736 - RNA, 22 nt, Human
ccaaguuauauaaagagaaaau

SEQ ID NO: 2134737 - RNA, 14 nt, Human
ccaaguuuauauac

SEQ ID NO: 2134738 - RNA, 22 nt, Human
ccaauaaaugugaaauucuguc

SEQ ID NO: 2134739 - RNA, 19 nt, Human
ccaauagcacuuucauugc

SEQ ID NO: 2134740 - RNA, 21 nt, Human
ccaauagcacuuucauugcca

SEQ ID NO: 2134741 - RNA, 22 nt, Human
ccaauaguuguugauuggcagg

SEQ ID NO: 2134742 - RNA, 16 nt, Human
ccaauaggaaugcuaa

SEQ ID NO: 2134743 - RNA, 20 nt, Human
ccaagucaagugaaaaagga

SEQ ID NO: 2134744 - RNA, 20 nt, Human
ccaagucagcuuugccuucc

SEQ ID NO: 2134745 - RNA, 21 nt, Human
ccaagucagcuuugccuucca

SEQ ID NO: 2134746 - RNA, 17 nt, Human
ccaaguaaauagcaaca

SEQ ID NO: 2134747 - RNA, 18 nt, Human
ccaaggugggaggauugc

SEQ ID NO: 2134748 - RNA, 13 nt, Human
ccaaggugggagg

SEQ ID NO: 2134749 - RNA, 16 nt, Human
ccaaggucuaggugga

SEQ ID NO: 2134750 - RNA, 23 nt, Human
ccaaggguauccaaguuggacug

SEQ ID NO: 2134751 - RNA, 20 nt, Human
ccaaggguucagagacucag

SEQ ID NO: 2134752 - RNA, 23 nt, Human
ccaaggguucagagacucagggc

SEQ ID NO: 2134753 - RNA, 20 nt, Human
ccaaggggcagucuggaggg

SEQ ID NO: 2134754 - RNA, 22 nt, Human
ccaaggggaauguuugccucug

SEQ ID NO: 2134755 - RNA, 15 nt, Human
ccaaggggcagucug

SEQ ID NO: 2134756 - RNA, 16 nt, Human
ccaaggggcagucugg

SEQ ID NO: 2134757 - RNA, 24 nt, Human
ccaagggaguuaggcuauucacaa

SEQ ID NO: 2134758 - RNA, 19 nt, Human
ccaaggccagaguggccug

SEQ ID NO: 2134759 - RNA, 19 nt, Human
ccaagcucacaguuccucg

SEQ ID NO: 2134760 - RNA, 22 nt, Human
ccaagcucacaguuccucgccc

SEQ ID NO: 2134761 - RNA, 15 nt, Human
ccaaggccagagugg

SEQ ID NO: 2134762 - RNA, 18 nt, Human
ccaaggccagaguggccu

SEQ ID NO: 2134763 - RNA, 13 nt, Human
ccaagccguggcu

SEQ ID NO: 2134764 - RNA, 22 nt, Human
ccaagcccacagguguccccag

SEQ ID NO: 2134765 - RNA, 22 nt, Human
ccaagccagggauggggccaca

SEQ ID NO: 2134766 - RNA, 23 nt, Human
ccaagccagggauggggccacag

SEQ ID NO: 2134767 - RNA, 14 nt, Human
ccaagccccauccu

SEQ ID NO: 2134768 - RNA, 13 nt, Human
ccaagccugacca

SEQ ID NO: 2134769 - RNA, 20 nt, Human
ccaagcgaggucaacagaga

SEQ ID NO: 2134770 - RNA, 21 nt, Human
ccaagcgaggucaacagagaa

SEQ ID NO: 2134771 - RNA, 13 nt, Human
ccaagcucacagu

SEQ ID NO: 2134772 - RNA, 17 nt, Human
ccaagcucacaguuccu

SEQ ID NO: 2134773 - RNA, 18 nt, Human
ccaagcucacaguuccuc

SEQ ID NO: 2134774 - RNA, 13 nt, Human
ccaagcauagaga

SEQ ID NO: 2134775 - RNA, 21 nt, Human
ccaagcauagagaagagucug

SEQ ID NO: 2134776 - RNA, 20 nt, Human
ccaagcaaaggugaagagac

SEQ ID NO: 2134777 - RNA, 14 nt, Human
ccaagcaaauguua

SEQ ID NO: 2134778 - RNA, 21 nt, Human
ccaagauugcgccauugcacu

SEQ ID NO: 2134779 - RNA, 20 nt, Human
ccacaguggaaccagcccag

SEQ ID NO: 2134780 - RNA, 20 nt, Human
ccacagugccuaauaauacu

SEQ ID NO: 2134781 - RNA, 22 nt, Human
ccacaucccacucacaacagcu

SEQ ID NO: 2134782 - RNA, 12 nt, Human
ccacagugucug

SEQ ID NO: 2134783 - RNA, 21 nt, Human
ccacauccccgcuggcugggg

SEQ ID NO: 2134784 - RNA, 23 nt, Human
ccacauccccgcuggcugggggc

SEQ ID NO: 2134785 - RNA, 19 nt, Human
ccacagcuuggggccaucg

SEQ ID NO: 2134786 - RNA, 19 nt, Human
ccacauccuccguccagcc

SEQ ID NO: 2134787 - RNA, 20 nt, Human
ccacauccuccguccagccg

SEQ ID NO: 2134788 - RNA, 18 nt, Human
ccacaggguucaaaaugu

SEQ ID NO: 2134789 - RNA, 22 nt, Human
ccacaggguucaaaaugucugu

SEQ ID NO: 2134790 - RNA, 20 nt, Human
ccacagggcuaagagcuagc

SEQ ID NO: 2134791 - RNA, 14 nt, Human
ccacagggcuaaga

SEQ ID NO: 2134792 - RNA, 17 nt, Human
ccacagggcuaagagcu

SEQ ID NO: 2134793 - RNA, 15 nt, Human
ccacaggugucccca

SEQ ID NO: 2134794 - RNA, 16 nt, Human
ccacagguguccccag

SEQ ID NO: 2134795 - RNA, 19 nt, Human
ccacagguguccccagccc

SEQ ID NO: 2134796 - RNA, 21 nt, Human
ccacagguguccccagcccac

SEQ ID NO: 2134797 - RNA, 22 nt, Human
ccacagguguccccagcccacu

SEQ ID NO: 2134798 - RNA, 23 nt, Human
ccacagguguuuauacagcucag

SEQ ID NO: 2134799 - RNA, 22 nt, Human
ccacagguucaugccaccaugg

SEQ ID NO: 2134800 - RNA, 16 nt, Human
ccacaugugcacaugc

SEQ ID NO: 2134801 - RNA, 17 nt, Human
ccacaucuugcucugcu

SEQ ID NO: 2134802 - RNA, 18 nt, Human
ccacaucuugcucugcug

SEQ ID NO: 2134803 - RNA, 19 nt, Human
ccacaucuugcucugcuga

SEQ ID NO: 2134804 - RNA, 20 nt, Human
ccacaucuugcucugcugac

SEQ ID NO: 2134805 - RNA, 15 nt, Human
ccaccaacccucaga

SEQ ID NO: 2134806 - RNA, 15 nt, Human
ccaccaacaucccau

SEQ ID NO: 2134807 - RNA, 12 nt, Human
ccaccaacccau

SEQ ID NO: 2134808 - RNA, 21 nt, Human
ccaccaacccaucagaaggag

SEQ ID NO: 2134809 - RNA, 15 nt, Human
ccaccaacuggcccu

SEQ ID NO: 2134810 - RNA, 16 nt, Human
ccaccaacuggcccuc

SEQ ID NO: 2134811 - RNA, 19 nt, Human
ccaccaacuggcccucuuc

SEQ ID NO: 2134812 - RNA, 17 nt, Human
ccaccaagacuuguuuu

SEQ ID NO: 2134813 - RNA, 22 nt, Human
ccaccaugcccagcucagaggg

SEQ ID NO: 2134814 - RNA, 16 nt, Human
ccaccauggccagcca

SEQ ID NO: 2134815 - RNA, 17 nt, Human
ccaccauggccagccaa

SEQ ID NO: 2134816 - RNA, 21 nt, Human
ccaccauggccagccaacuuu

SEQ ID NO: 2134817 - RNA, 17 nt, Human
ccacauguguccauccc

SEQ ID NO: 2134818 - RNA, 20 nt, Human
ccacauguguccaucccagc

SEQ ID NO: 2134819 - RNA, 16 nt, Human
ccacaggaucagucug

SEQ ID NO: 2134820 - RNA, 16 nt, Human
ccacaggcccuuccuc

SEQ ID NO: 2134821 - RNA, 15 nt, Human
ccacaggcccuuccu

SEQ ID NO: 2134822 - RNA, 22 nt, Human
ccacaggcccuuccucuccacu

SEQ ID NO: 2134823 - RNA, 19 nt, Human
ccacaggcccuuccucucc

SEQ ID NO: 2134824 - RNA, 18 nt, Human
ccacaggcccuuccucuc

SEQ ID NO: 2134825 - RNA, 17 nt, Human
ccacaggcccuuccucu

SEQ ID NO: 2134826 - RNA, 23 nt, Human
ccacaggcccuuccucuccacug

SEQ ID NO: 2134827 - RNA, 17 nt, Human
ccacagcuuccccucuc

SEQ ID NO: 2134828 - RNA, 13 nt, Human
ccacaccuggccc

SEQ ID NO: 2134829 - RNA, 14 nt, Human
ccacaccuggcccu

SEQ ID NO: 2134830 - RNA, 18 nt, Human
ccacaccuggcccugggg

SEQ ID NO: 2134831 - RNA, 20 nt, Human
ccacaccuggcccuggggcc

SEQ ID NO: 2134832 - RNA, 15 nt, Human
ccacacccucuccca

SEQ ID NO: 2134833 - RNA, 18 nt, Human
ccacacccucucccagga

SEQ ID NO: 2134834 - RNA, 16 nt, Human
ccacacuaaccugggu

SEQ ID NO: 2134835 - RNA, 22 nt, Human
ccacacuaaccuggguucccuu

SEQ ID NO: 2134836 - RNA, 23 nt, Human
ccacacuaaccuggguucccuuu

SEQ ID NO: 2134837 - RNA, 22 nt, Human
ccacacccagcccacuucugcc

SEQ ID NO: 2134838 - RNA, 21 nt, Human
ccacacccagcccacuucugc

SEQ ID NO: 2134839 - RNA, 15 nt, Human
ccacacccagcccac

SEQ ID NO: 2134840 - RNA, 20 nt, Human
ccacacccagcccacuucug

SEQ ID NO: 2134841 - RNA, 12 nt, Human
ccaauauuauaa

SEQ ID NO: 2134842 - RNA, 19 nt, Human
ccaauauccucgcucccgg

SEQ ID NO: 2134843 - RNA, 20 nt, Human
ccaauauccucgcucccggg

SEQ ID NO: 2134844 - RNA, 23 nt, Human
ccacacaucaguaauguauucua

SEQ ID NO: 2134845 - RNA, 13 nt, Human
ccaauauuauaau

SEQ ID NO: 2134846 - RNA, 13 nt, Human
ccacacagagugg

SEQ ID NO: 2134847 - RNA, 22 nt, Human
ccaccauggcuaaggcaccagc

SEQ ID NO: 2134848 - RNA, 23 nt, Human
ccaccauggcuaaggcaccagcc

SEQ ID NO: 2134849 - RNA, 14 nt, Human
ccaccaugucugcc

SEQ ID NO: 2134850 - RNA, 17 nt, Human
ccaccaugucugcccca

SEQ ID NO: 2134851 - RNA, 21 nt, Human
ccacccaggagccccgaggcc

SEQ ID NO: 2134852 - RNA, 12 nt, Human
ccacccaggagg

SEQ ID NO: 2134853 - RNA, 14 nt, Human
ccacccaggaggga

SEQ ID NO: 2134854 - RNA, 23 nt, Human
ccacccaggagccccgaggccuu

SEQ ID NO: 2134855 - RNA, 23 nt, Human
ccacccaggggaaugaucucuga

SEQ ID NO: 2134856 - RNA, 23 nt, Human
ccacccaggagggagggggcuau

SEQ ID NO: 2134857 - RNA, 17 nt, Human
ccacccaggagggaggg

SEQ ID NO: 2134858 - RNA, 18 nt, Human
ccacccaggagggagggg

SEQ ID NO: 2134859 - RNA, 11 nt, Human
ccacucagguc

SEQ ID NO: 2134860 - RNA, 16 nt, Human
ccacucaggucuguuu

SEQ ID NO: 2134861 - RNA, 20 nt, Human
ccacucaggaggcugaggca

SEQ ID NO: 2134862 - RNA, 13 nt, Human
ccacucaggccaa

SEQ ID NO: 2134863 - RNA, 20 nt, Human
ccacucaggccaacaagcca

SEQ ID NO: 2134864 - RNA, 22 nt, Human
ccacuccagaccccuggcuuuu

SEQ ID NO: 2134865 - RNA, 21 nt, Human
ccacuccagaccccuggcuuu

SEQ ID NO: 2134866 - RNA, 20 nt, Human
ccacuccagaccccuggcuu

SEQ ID NO: 2134867 - RNA, 18 nt, Human
ccacucaguccauagcag

SEQ ID NO: 2134868 - RNA, 21 nt, Human
ccacuauggucaucuuuuucu

SEQ ID NO: 2134869 - RNA, 19 nt, Human
ccacuaggacucugaggcu

SEQ ID NO: 2134870 - RNA, 20 nt, Human
ccacuaggacucugaggcuc

SEQ ID NO: 2134871 - RNA, 14 nt, Human
ccacuaggcugggu

SEQ ID NO: 2134872 - RNA, 15 nt, Human
ccacuaggcugggug

SEQ ID NO: 2134873 - RNA, 16 nt, Human
ccacuaggcugggugc

SEQ ID NO: 2134874 - RNA, 20 nt, Human
ccacuaggcugggugcccac

SEQ ID NO: 2134875 - RNA, 21 nt, Human
ccacuaggcugggugcccaca

SEQ ID NO: 2134876 - RNA, 23 nt, Human
ccacuaggcugggugcccacagc

SEQ ID NO: 2134877 - RNA, 13 nt, Human
ccacucaggaggc

SEQ ID NO: 2134878 - RNA, 20 nt, Human
ccacuacacuccagccugag

SEQ ID NO: 2134879 - RNA, 21 nt, Human
ccacuacacuccagccugagc

SEQ ID NO: 2134880 - RNA, 22 nt, Human
ccacuacacuccagccugagca

SEQ ID NO: 2134881 - RNA, 22 nt, Human
ccacuacaugcagcccaugccc

SEQ ID NO: 2134882 - RNA, 16 nt, Human
ccacuaggacucugag

SEQ ID NO: 2134883 - RNA, 18 nt, Human
ccacuaggacucugaggc

SEQ ID NO: 2134884 - RNA, 16 nt, Human
ccacgcuggagugcag

SEQ ID NO: 2134885 - RNA, 20 nt, Human
ccaccugucucagccuccca

SEQ ID NO: 2134886 - RNA, 23 nt, Human
ccaccugucucagccucccagag

SEQ ID NO: 2134887 - RNA, 12 nt, Human
ccaccugucuca

SEQ ID NO: 2134888 - RNA, 15 nt, Human
ccaccugucucagcc

SEQ ID NO: 2134889 - RNA, 16 nt, Human
ccaccugucucagccu

SEQ ID NO: 2134890 - RNA, 18 nt, Human
ccaccugucucagccucc

SEQ ID NO: 2134891 - RNA, 22 nt, Human
ccaccccagugcacccacucug

SEQ ID NO: 2134892 - RNA, 23 nt, Human
ccaccccaugucaccggauccug

SEQ ID NO: 2134893 - RNA, 15 nt, Human
ccaccugguggccuc

SEQ ID NO: 2134894 - RNA, 17 nt, Human
ccaccugguggccucug

SEQ ID NO: 2134895 - RNA, 21 nt, Human
ccaccugguuccggaauccug

SEQ ID NO: 2134896 - RNA, 19 nt, Human
ccaccugucaaacaaagcc

SEQ ID NO: 2134897 - RNA, 20 nt, Human
ccaccugucaaacaaagcca

SEQ ID NO: 2134898 - RNA, 12 nt, Human
ccaccuguccca

SEQ ID NO: 2134899 - RNA, 13 nt, Human
ccaccugucccac

SEQ ID NO: 2134900 - RNA, 14 nt, Human
ccaccugucccacc

SEQ ID NO: 2134901 - RNA, 15 nt, Human
ccaccugucccaccu

SEQ ID NO: 2134902 - RNA, 16 nt, Human
ccaccugucccaccuc

SEQ ID NO: 2134903 - RNA, 17 nt, Human
ccaccugucccaccuca

SEQ ID NO: 2134904 - RNA, 18 nt, Human
ccaccugucccaccucaa

SEQ ID NO: 2134905 - RNA, 11 nt, Human
ccaccugucuc

SEQ ID NO: 2134906 - RNA, 18 nt, Human
ccacggccaggccagagg

SEQ ID NO: 2134907 - RNA, 16 nt, Human
ccacggccaggccaga

SEQ ID NO: 2134908 - RNA, 19 nt, Human
ccacgcuggagugcaguga

SEQ ID NO: 2134909 - RNA, 18 nt, Human
ccacgcuggagugcagug

SEQ ID NO: 2134910 - RNA, 23 nt, Human
ccacggccaggccagagggagug

SEQ ID NO: 2134911 - RNA, 22 nt, Human
ccaccugucaaacaaagccaga

SEQ ID NO: 2134912 - RNA, 12 nt, Human
ccaccccacacu

SEQ ID NO: 2134913 - RNA, 14 nt, Human
ccaccccacccccu

SEQ ID NO: 2134914 - RNA, 13 nt, Human
ccaccccacacuu

SEQ ID NO: 2134915 - RNA, 12 nt, Human
ccaccccagccu

SEQ ID NO: 2134916 - RNA, 14 nt, Human
ccaccccagccuaa

SEQ ID NO: 2134917 - RNA, 13 nt, Human
ccaccccagcugc

SEQ ID NO: 2134918 - RNA, 17 nt, Human
ccaccccacccccuuca

SEQ ID NO: 2134919 - RNA, 19 nt, Human
ccaccccagaaauggugaa

SEQ ID NO: 2134920 - RNA, 18 nt, Human
ccaccccagcugcucccc

SEQ ID NO: 2134921 - RNA, 17 nt, Human
ccaccccagugcaccca

SEQ ID NO: 2134922 - RNA, 19 nt, Human
ccaccccagugcacccacu

SEQ ID NO: 2134923 - RNA, 14 nt, Human
ccacuacacuccag

SEQ ID NO: 2134924 - RNA, 18 nt, Human
ccacuacacuccagccug

SEQ ID NO: 2134925 - RNA, 19 nt, Human
ccacuacacuccagccuga

SEQ ID NO: 2134926 - RNA, 17 nt, Human
ccacguacugcagccuc

SEQ ID NO: 2134927 - RNA, 16 nt, Human
ccacguacugcagccu

SEQ ID NO: 2134928 - RNA, 13 nt, Human
ccacguacugcag

SEQ ID NO: 2134929 - RNA, 19 nt, Human
ccacuuagaaauugcauuu

SEQ ID NO: 2134930 - RNA, 13 nt, Human
ccacuuaccuuca

SEQ ID NO: 2134931 - RNA, 14 nt, Human
ccacuuaccuucaa

SEQ ID NO: 2134932 - RNA, 19 nt, Human
ccacuuaccuucaauaaag

SEQ ID NO: 2134933 - RNA, 12 nt, Human
ccacuuaccuag

SEQ ID NO: 2134934 - RNA, 21 nt, Human
ccacuuaaaaaauguccauga

SEQ ID NO: 2134935 - RNA, 14 nt, Human
ccacugcaggcccc

SEQ ID NO: 2134936 - RNA, 17 nt, Human
ccacugcaggccccgcu

SEQ ID NO: 2134937 - RNA, 17 nt, Human
ccacuuaaaaaaugucc

SEQ ID NO: 2134938 - RNA, 19 nt, Human
ccacuuaaaaaauguccau

SEQ ID NO: 2134939 - RNA, 16 nt, Human
ccacuccccaccuuca

SEQ ID NO: 2134940 - RNA, 23 nt, Human
ccacugcacuccagccuggguga

SEQ ID NO: 2134941 - RNA, 19 nt, Human
ccacugcacucuagccgga

SEQ ID NO: 2134942 - RNA, 20 nt, Human
ccacugcacucuagccggag

SEQ ID NO: 2134943 - RNA, 13 nt, Human
ccacugcaggccc

SEQ ID NO: 2134944 - RNA, 21 nt, Human
ccacuuaccuucaauaaagua

SEQ ID NO: 2134945 - RNA, 22 nt, Human
ccacuuaccuucaauaaaguau

SEQ ID NO: 2134946 - RNA, 21 nt, Human
ccacuuagaaauugcauuucc

SEQ ID NO: 2134947 - RNA, 13 nt, Human
ccacuucagcuga

SEQ ID NO: 2134948 - RNA, 14 nt, Human
ccacuucagcugac

SEQ ID NO: 2134949 - RNA, 17 nt, Human
ccagaacacacuccauc

SEQ ID NO: 2134950 - RNA, 16 nt, Human
ccagaaaucauuuuac

SEQ ID NO: 2134951 - RNA, 21 nt, Human
ccagaaauaaaguuggugaca

SEQ ID NO: 2134952 - RNA, 23 nt, Human
ccagaaauaaaguuggugacaga

SEQ ID NO: 2134953 - RNA, 21 nt, Human
ccacuucaggguucuccucuc

SEQ ID NO: 2134954 - RNA, 12 nt, Human
ccagaaagaaaa

SEQ ID NO: 2134955 - RNA, 13 nt, Human
ccacuucaauaga

SEQ ID NO: 2134956 - RNA, 14 nt, Human
ccagaaaggagacu

SEQ ID NO: 2134957 - RNA, 16 nt, Human
ccagaaaggagacuag

SEQ ID NO: 2134958 - RNA, 15 nt, Human
ccagaaaggauauuu

SEQ ID NO: 2134959 - RNA, 16 nt, Human
ccagaaaggauauuua

SEQ ID NO: 2134960 - RNA, 17 nt, Human
ccagaaaggauauuuaa

SEQ ID NO: 2134961 - RNA, 20 nt, Human
ccagaaaggauauuuaagaa

SEQ ID NO: 2134962 - RNA, 23 nt, Human
ccagaaaggauauuuaagaaaau

SEQ ID NO: 2134963 - RNA, 23 nt, Human
ccagaaguuugagaucagccugg

SEQ ID NO: 2134964 - RNA, 20 nt, Human
ccagaaguuugucaagucaa

SEQ ID NO: 2134965 - RNA, 22 nt, Human
ccagaaguuugagaucagccug

SEQ ID NO: 2134966 - RNA, 17 nt, Human
ccagaacaguuuguaca

SEQ ID NO: 2134967 - RNA, 22 nt, Human
ccagaacacacuccaucagcuu

SEQ ID NO: 2134968 - RNA, 19 nt, Human
ccagaacacacuccaucag

SEQ ID NO: 2134969 - RNA, 16 nt, Human
ccagaagccaaagacu

SEQ ID NO: 2134970 - RNA, 21 nt, Human
ccagacaccuugacagggcac

SEQ ID NO: 2134971 - RNA, 16 nt, Human
ccagaauuuaaaccua

SEQ ID NO: 2134972 - RNA, 21 nt, Human
ccagaauucccagcugucugu

SEQ ID NO: 2134973 - RNA, 21 nt, Human
ccagaaugucagauuccuuuc

SEQ ID NO: 2134974 - RNA, 22 nt, Human
ccagaaugucagauuccuuucc

SEQ ID NO: 2134975 - RNA, 23 nt, Human
ccagaaugucagauuccuuuccc

SEQ ID NO: 2134976 - RNA, 23 nt, Human
ccagaauggucuuucuaaugugu

SEQ ID NO: 2134977 - RNA, 17 nt, Human
ccagaccccuggcuuuu

SEQ ID NO: 2134978 - RNA, 12 nt, Human
ccagagcacugu

SEQ ID NO: 2134979 - RNA, 13 nt, Human
ccagagcacugua

SEQ ID NO: 2134980 - RNA, 14 nt, Human
ccagagcacuguau

SEQ ID NO: 2134981 - RNA, 16 nt, Human
ccagagcacuguauac

SEQ ID NO: 2134982 - RNA, 16 nt, Human
ccagaccccuggcuuu

SEQ ID NO: 2134983 - RNA, 15 nt, Human
ccagaccccuggcuu

SEQ ID NO: 2134984 - RNA, 24 nt, Human
ccagaccccucuggccaggaugga

SEQ ID NO: 2134985 - RNA, 14 nt, Human
ccagaccccuggcu

SEQ ID NO: 2134986 - RNA, 20 nt, Human
ccagaccccucuggccagga

SEQ ID NO: 2134987 - RNA, 21 nt, Human
ccagaccccucuggccaggau

SEQ ID NO: 2134988 - RNA, 22 nt, Human
ccagaccccucuggccaggaug

SEQ ID NO: 2134989 - RNA, 23 nt, Human
ccagaccccucuggccaggaugg

SEQ ID NO: 2134990 - RNA, 21 nt, Human
ccagacagcaacggggaggcc

SEQ ID NO: 2134991 - RNA, 19 nt, Human
ccagaccccucuggccagg

SEQ ID NO: 2134992 - RNA, 23 nt, Human
ccagacacugaccauccacucua

SEQ ID NO: 2134993 - RNA, 24 nt, Human
ccagcuggagaaauaugguacuca

SEQ ID NO: 2134994 - RNA, 13 nt, Human
ccagcuggcagca

SEQ ID NO: 2134995 - RNA, 14 nt, Human
ccagcuggcagcag

SEQ ID NO: 2134996 - RNA, 15 nt, Human
ccagcuggcagcaga

SEQ ID NO: 2134997 - RNA, 20 nt, Human
ccagcuggcagcagagugug

SEQ ID NO: 2134998 - RNA, 14 nt, Human
ccagcugcuccccu

SEQ ID NO: 2134999 - RNA, 16 nt, Human
ccagcugcuccccucc

SEQ ID NO: 2135000 - RNA, 17 nt, Human
ccagcugcuccccuccc

SEQ ID NO: 2135001 - RNA, 19 nt, Human
ccagcugcuccccucccuc

SEQ ID NO: 2135002 - RNA, 21 nt, Human
ccagcugcuccccucccuccu

SEQ ID NO: 2135003 - RNA, 12 nt, Human
ccagcugcucug

SEQ ID NO: 2135004 - RNA, 13 nt, Human
ccagcugcucugc

SEQ ID NO: 2135005 - RNA, 14 nt, Human
ccagcugcucugcc

SEQ ID NO: 2135006 - RNA, 15 nt, Human
ccagcugcucugccc

SEQ ID NO: 2135007 - RNA, 16 nt, Human
ccagcugcucugccca

SEQ ID NO: 2135008 - RNA, 17 nt, Human
ccagcugcucugcccag

SEQ ID NO: 2135009 - RNA, 18 nt, Human
ccagcugcucugcccaga

SEQ ID NO: 2135010 - RNA, 19 nt, Human
ccagcugcucugcccagag

SEQ ID NO: 2135011 - RNA, 20 nt, Human
ccagcugcucugcccagagc

SEQ ID NO: 2135012 - RNA, 21 nt, Human
ccagcugcucugcccagagcu

SEQ ID NO: 2135013 - RNA, 22 nt, Human
ccagcugcucugcccagagcug

SEQ ID NO: 2135014 - RNA, 23 nt, Human
ccagcugcucugcccagagcugg

SEQ ID NO: 2135015 - RNA, 19 nt, Human
ccagcugccgaccagagcc

SEQ ID NO: 2135016 - RNA, 20 nt, Human
ccagcugccgaccagagccc

SEQ ID NO: 2135017 - RNA, 18 nt, Human
ccagcugccgaccagagc

SEQ ID NO: 2135018 - RNA, 16 nt, Human
ccagcugccccucccu

SEQ ID NO: 2135019 - RNA, 17 nt, Human
ccagcugccccucccug

SEQ ID NO: 2135020 - RNA, 19 nt, Human
ccagcugccccucccugcc

SEQ ID NO: 2135021 - RNA, 16 nt, Human
ccagcgagcccuggug

SEQ ID NO: 2135022 - RNA, 15 nt, Human
ccagcgagcccuggu

SEQ ID NO: 2135023 - RNA, 14 nt, Human
ccagcgagcccugg

SEQ ID NO: 2135024 - RNA, 12 nt, Human
ccagcucuggcu

SEQ ID NO: 2135025 - RNA, 14 nt, Human
ccagcucuggcuuc

SEQ ID NO: 2135026 - RNA, 16 nt, Human
ccagagcccaccuugg

SEQ ID NO: 2135027 - RNA, 22 nt, Human
ccagagcccaccuuggcucaag

SEQ ID NO: 2135028 - RNA, 14 nt, Human
ccaggacaggcccg

SEQ ID NO: 2135029 - RNA, 15 nt, Human
ccaggacaggcccgg

SEQ ID NO: 2135030 - RNA, 17 nt, Human
ccaggacaggcccggcg

SEQ ID NO: 2135031 - RNA, 13 nt, Human
ccaggacaggccc

SEQ ID NO: 2135032 - RNA, 14 nt, Human
ccaggacaggacca

SEQ ID NO: 2135033 - RNA, 13 nt, Human
ccaggacaggacc

SEQ ID NO: 2135034 - RNA, 14 nt, Human
ccaggacucccucc

SEQ ID NO: 2135035 - RNA, 23 nt, Human
ccaggacucccuccucaccucug

SEQ ID NO: 2135036 - RNA, 16 nt, Human
ccaggacucccuccuc

SEQ ID NO: 2135037 - RNA, 17 nt, Human
ccaggacucccuccuca

SEQ ID NO: 2135038 - RNA, 18 nt, Human
ccaggacucccuccucac

SEQ ID NO: 2135039 - RNA, 22 nt, Human
ccaggacucccuccucaccucu

SEQ ID NO: 2135040 - RNA, 16 nt, Human
ccagcuggcagcagag

SEQ ID NO: 2135041 - RNA, 16 nt, Human
ccaggaaggggcugga

SEQ ID NO: 2135042 - RNA, 18 nt, Human
ccaggaaggggcuggacu

SEQ ID NO: 2135043 - RNA, 14 nt, Human
ccaggaagggucaa

SEQ ID NO: 2135044 - RNA, 20 nt, Human
ccaggaagccgugcccugcc

SEQ ID NO: 2135045 - RNA, 15 nt, Human
ccaggaagccgugcc

SEQ ID NO: 2135046 - RNA, 11 nt, Human
ccaggaagccg

SEQ ID NO: 2135047 - RNA, 15 nt, Human
ccaggaaugaagaua

SEQ ID NO: 2135048 - RNA, 19 nt, Human
ccaggaaugccuccucccu

SEQ ID NO: 2135049 - RNA, 20 nt, Human
ccaggaauguuaaagucagu

SEQ ID NO: 2135050 - RNA, 13 nt, Human
ccaggcauggugg

SEQ ID NO: 2135051 - RNA, 14 nt, Human
ccaggaggacugcc

SEQ ID NO: 2135052 - RNA, 15 nt, Human
ccaggagccccgagg

SEQ ID NO: 2135053 - RNA, 13 nt, Human
ccagggccacgug

SEQ ID NO: 2135054 - RNA, 17 nt, Human
ccagggccacgugccag

SEQ ID NO: 2135055 - RNA, 19 nt, Human
ccagggccacgugccaggc

SEQ ID NO: 2135056 - RNA, 21 nt, Human
ccagggccacgugccaggccc

SEQ ID NO: 2135057 - RNA, 22 nt, Human
ccagggccacgugccaggcccg

SEQ ID NO: 2135058 - RNA, 17 nt, Human
ccagggccacucugccu

SEQ ID NO: 2135059 - RNA, 19 nt, Human
ccagggccacucugccucu

SEQ ID NO: 2135060 - RNA, 20 nt, Human
ccagggccacucugccucug

SEQ ID NO: 2135061 - RNA, 17 nt, Human
ccagggaagcuggccga

SEQ ID NO: 2135062 - RNA, 18 nt, Human
ccagggaagcuggccgag

SEQ ID NO: 2135063 - RNA, 17 nt, Human
ccagggaagcugucccu

SEQ ID NO: 2135064 - RNA, 18 nt, Human
ccaggcuugccugcaggc

SEQ ID NO: 2135065 - RNA, 20 nt, Human
ccaggccccgcucauucuuu

SEQ ID NO: 2135066 - RNA, 13 nt, Human
ccaggccccugcc

SEQ ID NO: 2135067 - RNA, 16 nt, Human
ccaggccccaggaagc

SEQ ID NO: 2135068 - RNA, 17 nt, Human
ccaggccccaggaagcc

SEQ ID NO: 2135069 - RNA, 19 nt, Human
ccaggcccccaagccugca

SEQ ID NO: 2135070 - RNA, 20 nt, Human
ccaggcccccaagccugcag

SEQ ID NO: 2135071 - RNA, 19 nt, Human
ccaggcuggucucaaacuc

SEQ ID NO: 2135072 - RNA, 20 nt, Human
ccaggcuguaucccaugagc

SEQ ID NO: 2135073 - RNA, 17 nt, Human
ccaggcuugccugcagg

SEQ ID NO: 2135074 - RNA, 11 nt, Human
ccagggcucag

SEQ ID NO: 2135075 - RNA, 16 nt, Human
ccagggcucagccugg

SEQ ID NO: 2135076 - RNA, 20 nt, Human
ccagggcucagccugguggg

SEQ ID NO: 2135077 - RNA, 12 nt, Human
ccagggcucagc

SEQ ID NO: 2135078 - RNA, 13 nt, Human
ccagggcucagcc

SEQ ID NO: 2135079 - RNA, 14 nt, Human
ccagggcucagccu

SEQ ID NO: 2135080 - RNA, 15 nt, Human
ccagggcucagccug

SEQ ID NO: 2135081 - RNA, 14 nt, Human
ccaggucgggcuca

SEQ ID NO: 2135082 - RNA, 17 nt, Human
ccaggucgggcucagcu

SEQ ID NO: 2135083 - RNA, 18 nt, Human
ccaggucgggcucagcuc

SEQ ID NO: 2135084 - RNA, 20 nt, Human
ccaggucgggcucagcucug

SEQ ID NO: 2135085 - RNA, 21 nt, Human
ccaggucgggcucagcucugg

SEQ ID NO: 2135086 - RNA, 23 nt, Human
ccaggucgggcucagcucuggcu

SEQ ID NO: 2135087 - RNA, 22 nt, Human
ccaggugugguugcucacagcu

SEQ ID NO: 2135088 - RNA, 14 nt, Human
ccagguucagcuug

SEQ ID NO: 2135089 - RNA, 13 nt, Human
ccagguguuuaua

SEQ ID NO: 2135090 - RNA, 14 nt, Human
ccagugaaaacuag

SEQ ID NO: 2135091 - RNA, 15 nt, Human
ccagugaaaacuaga

SEQ ID NO: 2135092 - RNA, 12 nt, Human
ccagucuugugu

SEQ ID NO: 2135093 - RNA, 13 nt, Human
ccaggucucccgg

SEQ ID NO: 2135094 - RNA, 16 nt, Human
ccaguaccuuugucac

SEQ ID NO: 2135095 - RNA, 17 nt, Human
ccaguaccuuugucaca

SEQ ID NO: 2135096 - RNA, 16 nt, Human
ccaguacgugcuaaca

SEQ ID NO: 2135097 - RNA, 14 nt, Human
ccaguacuggagcu

SEQ ID NO: 2135098 - RNA, 17 nt, Human
ccaguauacaagauaag

SEQ ID NO: 2135099 - RNA, 14 nt, Human
ccaucuggcagggu

SEQ ID NO: 2135100 - RNA, 16 nt, Human
ccaucuggcagggugg

SEQ ID NO: 2135101 - RNA, 14 nt, Human
ccaugaacuuuguc

SEQ ID NO: 2135102 - RNA, 15 nt, Human
ccaugaacuuugucc

SEQ ID NO: 2135103 - RNA, 13 nt, Human
ccaugaagacagg

SEQ ID NO: 2135104 - RNA, 16 nt, Human
ccaugaagacaggaca

SEQ ID NO: 2135105 - RNA, 17 nt, Human
ccaugaagacaggacag

SEQ ID NO: 2135106 - RNA, 19 nt, Human
ccaugaagacaggacagug

SEQ ID NO: 2135107 - RNA, 15 nt, Human
ccaugaagccacagc

SEQ ID NO: 2135108 - RNA, 16 nt, Human
ccaugaagccacagcc

SEQ ID NO: 2135109 - RNA, 18 nt, Human
ccaugaagccacagccca

SEQ ID NO: 2135110 - RNA, 19 nt, Human
ccaugaagccacagcccag

SEQ ID NO: 2135111 - RNA, 19 nt, Human
ccaugauuaaccacuucag

SEQ ID NO: 2135112 - RNA, 21 nt, Human
ccaugauuaaccacuucagcu

SEQ ID NO: 2135113 - RNA, 21 nt, Human
ccaugcacccucauacacaga

SEQ ID NO: 2135114 - RNA, 13 nt, Human
ccaugcaaggugc

SEQ ID NO: 2135115 - RNA, 20 nt, Human
ccaugcaaggugcccacaug

SEQ ID NO: 2135116 - RNA, 14 nt, Human
ccaugauucgccca

SEQ ID NO: 2135117 - RNA, 18 nt, Human
ccaugcccagcucagagg

SEQ ID NO: 2135118 - RNA, 13 nt, Human
ccaugcccaccug

SEQ ID NO: 2135119 - RNA, 15 nt, Human
ccaugcccaccugcc

SEQ ID NO: 2135120 - RNA, 16 nt, Human
ccaugcccaccugccc

SEQ ID NO: 2135121 - RNA, 17 nt, Human
ccaugcccaccugccca

SEQ ID NO: 2135122 - RNA, 18 nt, Human
ccaugcccaccugcccau

SEQ ID NO: 2135123 - RNA, 21 nt, Human
ccaugcccaccugcccaucac

SEQ ID NO: 2135124 - RNA, 20 nt, Human
ccaugccaaagcuagggugg

SEQ ID NO: 2135125 - RNA, 19 nt, Human
ccauccacucuacccuccc

SEQ ID NO: 2135126 - RNA, 22 nt, Human
ccauccacucuacccucccacc

SEQ ID NO: 2135127 - RNA, 15 nt, Human
ccauccuccccuucc

SEQ ID NO: 2135128 - RNA, 21 nt, Human
ccauccagggaugccaucugu

SEQ ID NO: 2135129 - RNA, 17 nt, Human
ccauccuccccuucccu

SEQ ID NO: 2135130 - RNA, 18 nt, Human
ccauccuccccuucccug

SEQ ID NO: 2135131 - RNA, 21 nt, Human
ccauccuccccuucccugcaa

SEQ ID NO: 2135132 - RNA, 14 nt, Human
ccaucauaauucua

SEQ ID NO: 2135133 - RNA, 16 nt, Human
ccauccacucuacccu

SEQ ID NO: 2135134 - RNA, 19 nt, Human
ccaucagcuguaagaagag

SEQ ID NO: 2135135 - RNA, 24 nt, Human
ccaucagcuguaagaagagacugg

SEQ ID NO: 2135136 - RNA, 21 nt, Human
ccaucagcuuaggggcugcug

SEQ ID NO: 2135137 - RNA, 22 nt, Human
ccaucagaggacaccuguacug

SEQ ID NO: 2135138 - RNA, 12 nt, Human
ccaucagaggcc

SEQ ID NO: 2135139 - RNA, 18 nt, Human
ccaucuccuuucagggaa

SEQ ID NO: 2135140 - RNA, 14 nt, Human
ccaucucgccaccc

SEQ ID NO: 2135141 - RNA, 20 nt, Human
ccaucucgccaccccuccuu

SEQ ID NO: 2135142 - RNA, 22 nt, Human
ccaucucgccaccccuccuucc

SEQ ID NO: 2135143 - RNA, 23 nt, Human
ccaucucgccaccccuccuuccu

SEQ ID NO: 2135144 - RNA, 16 nt, Human
ccaucuccuugucuuu

SEQ ID NO: 2135145 - RNA, 16 nt, Human
ccaucuccuuucaggg

SEQ ID NO: 2135146 - RNA, 17 nt, Human
ccaucuccuuucaggga

SEQ ID NO: 2135147 - RNA, 14 nt, Human
ccaucucucccucc

SEQ ID NO: 2135148 - RNA, 24 nt, Human
ccaucucccucgaacccacacugc

SEQ ID NO: 2135149 - RNA, 13 nt, Human
ccaucaccagaca

SEQ ID NO: 2135150 - RNA, 20 nt, Human
ccaucacaggguugggccca

SEQ ID NO: 2135151 - RNA, 16 nt, Human
ccaucacaaacuuaaa

SEQ ID NO: 2135152 - RNA, 13 nt, Human
ccaucacaggguu

SEQ ID NO: 2135153 - RNA, 18 nt, Human
ccagucuuccaccuggaa

SEQ ID NO: 2135154 - RNA, 18 nt, Human
ccaucaaguugcacacuc

SEQ ID NO: 2135155 - RNA, 16 nt, Human
ccauaucuaaccagug

SEQ ID NO: 2135156 - RNA, 16 nt, Human
ccauacucugucuccc

SEQ ID NO: 2135157 - RNA, 17 nt, Human
ccauacucugucucccu

SEQ ID NO: 2135158 - RNA, 18 nt, Human
ccauacucugucucccua

SEQ ID NO: 2135159 - RNA, 20 nt, Human
cccaaacaaauaugcaaaag

SEQ ID NO: 2135160 - RNA, 22 nt, Human
cccaaaagucaaaaggugccug

SEQ ID NO: 2135161 - RNA, 23 nt, Human
cccaaaagucaaaaggugccugu

SEQ ID NO: 2135162 - RNA, 17 nt, Human
cccaaacaaauaugcaa

SEQ ID NO: 2135163 - RNA, 20 nt, Human
ccauuuugggguacccacug

SEQ ID NO: 2135164 - RNA, 22 nt, Human
ccauuuugggguacccacugcu

SEQ ID NO: 2135165 - RNA, 12 nt, Human
cccaaagagcug

SEQ ID NO: 2135166 - RNA, 15 nt, Human
cccaaagagcugccu

SEQ ID NO: 2135167 - RNA, 16 nt, Human
cccaaagagcugccua

SEQ ID NO: 2135168 - RNA, 12 nt, Human
cccaaagaagga

SEQ ID NO: 2135169 - RNA, 23 nt, Human
cccaaacuguugauuauuagcca

SEQ ID NO: 2135170 - RNA, 15 nt, Human
cccaaaaugaagauu

SEQ ID NO: 2135171 - RNA, 12 nt, Human
cccaaaccugga

SEQ ID NO: 2135172 - RNA, 13 nt, Human
cccaaaccuggag

SEQ ID NO: 2135173 - RNA, 15 nt, Human
cccaaaccuggagau

SEQ ID NO: 2135174 - RNA, 18 nt, Human
ccauucugccugcccagg

SEQ ID NO: 2135175 - RNA, 17 nt, Human
ccauucugccugcccag

SEQ ID NO: 2135176 - RNA, 16 nt, Human
ccauucugccugccca

SEQ ID NO: 2135177 - RNA, 20 nt, Human
ccauucugccugcccaggcc

SEQ ID NO: 2135178 - RNA, 19 nt, Human
ccauucugccugcccaggc

SEQ ID NO: 2135179 - RNA, 21 nt, Human
ccauucugccugcccaggccc

SEQ ID NO: 2135180 - RNA, 22 nt, Human
ccauggacucuacacugugaac

SEQ ID NO: 2135181 - RNA, 15 nt, Human
ccauggacucuacac

SEQ ID NO: 2135182 - RNA, 21 nt, Human
cccacaaaggagagcuagcag

SEQ ID NO: 2135183 - RNA, 21 nt, Human
cccaaauuaucaagcuaauaa

SEQ ID NO: 2135184 - RNA, 19 nt, Human
cccaaauuaucaagcuaau

SEQ ID NO: 2135185 - RNA, 20 nt, Human
cccaaauuaucaagcuaaua

SEQ ID NO: 2135186 - RNA, 18 nt, Human
cccaacacaaggugggca

SEQ ID NO: 2135187 - RNA, 12 nt, Human
cccaaggggcag

SEQ ID NO: 2135188 - RNA, 17 nt, Human
cccaauauuauaauuuu

SEQ ID NO: 2135189 - RNA, 15 nt, Human
cccaauauuauaauu

SEQ ID NO: 2135190 - RNA, 12 nt, Human
cccaauauuaua

SEQ ID NO: 2135191 - RNA, 19 nt, Human
cccaauaagauacaucaca

SEQ ID NO: 2135192 - RNA, 22 nt, Human
cccaauauccucgcucccggga

SEQ ID NO: 2135193 - RNA, 11 nt, Human
cccaauauuau

SEQ ID NO: 2135194 - RNA, 14 nt, Human
cccaauuaggaagu

SEQ ID NO: 2135195 - RNA, 15 nt, Human
cccaauuaggaagug

SEQ ID NO: 2135196 - RNA, 21 nt, Human
cccaauucuuacaaacaugug

SEQ ID NO: 2135197 - RNA, 19 nt, Human
cccaauuaggaaguguaac

SEQ ID NO: 2135198 - RNA, 14 nt, Human
cccacacaccccaa

SEQ ID NO: 2135199 - RNA, 12 nt, Human
cccacacccugg

SEQ ID NO: 2135200 - RNA, 18 nt, Human
cccagcaagugagagcug

SEQ ID NO: 2135201 - RNA, 16 nt, Human
cccagcaagugagagc

SEQ ID NO: 2135202 - RNA, 22 nt, Human
cccagauugcaacaggcugggc

SEQ ID NO: 2135203 - RNA, 21 nt, Human
cccagauugcaacaggcuggg

SEQ ID NO: 2135204 - RNA, 14 nt, Human
cccagaucccagaa

SEQ ID NO: 2135205 - RNA, 16 nt, Human
cccagaucccagaagg

SEQ ID NO: 2135206 - RNA, 18 nt, Human
cccagaucuggucccuug

SEQ ID NO: 2135207 - RNA, 19 nt, Human
cccagaucuggucccuugc

SEQ ID NO: 2135208 - RNA, 20 nt, Human
cccagaucuggucccuugca

SEQ ID NO: 2135209 - RNA, 20 nt, Human
cccagauugcaacaggcugg

SEQ ID NO: 2135210 - RNA, 16 nt, Human
cccagagugugggaag

SEQ ID NO: 2135211 - RNA, 23 nt, Human
cccagagugugggaagggagagc

SEQ ID NO: 2135212 - RNA, 14 nt, Human
cccacacuaaccug

SEQ ID NO: 2135213 - RNA, 13 nt, Human
cccacaccucagu

SEQ ID NO: 2135214 - RNA, 22 nt, Human
cccacaccucaguucccuuggc

SEQ ID NO: 2135215 - RNA, 12 nt, Human
cccacaccuggc

SEQ ID NO: 2135216 - RNA, 14 nt, Human
cccacaccuggccc

SEQ ID NO: 2135217 - RNA, 15 nt, Human
cccacaccuggcccu

SEQ ID NO: 2135218 - RNA, 16 nt, Human
cccacaccuggcccug

SEQ ID NO: 2135219 - RNA, 19 nt, Human
cccacaccuggcccugggg

SEQ ID NO: 2135220 - RNA, 22 nt, Human
cccacacggaggcaucugcacc

SEQ ID NO: 2135221 - RNA, 23 nt, Human
cccacacggaggcaucugcaccc

SEQ ID NO: 2135222 - RNA, 15 nt, Human
cccagcgagcccugg

SEQ ID NO: 2135223 - RNA, 18 nt, Human
cccagcgagcccuggugg

SEQ ID NO: 2135224 - RNA, 17 nt, Human
cccagcgagcccuggug

SEQ ID NO: 2135225 - RNA, 23 nt, Human
cccagcgagcccugguggcagug

SEQ ID NO: 2135226 - RNA, 19 nt, Human
cccagcgagcccugguggc

SEQ ID NO: 2135227 - RNA, 11 nt, Human
cccagcuccag

SEQ ID NO: 2135228 - RNA, 13 nt, Human
cccagcuccaggg

SEQ ID NO: 2135229 - RNA, 15 nt, Human
cccagcuccagggcc

SEQ ID NO: 2135230 - RNA, 16 nt, Human
cccagcuccagggcca

SEQ ID NO: 2135231 - RNA, 17 nt, Human
cccagcuccagggccag

SEQ ID NO: 2135232 - RNA, 18 nt, Human
cccagcuccagggccaga

SEQ ID NO: 2135233 - RNA, 21 nt, Human
cccagcuacucagaagccuga

SEQ ID NO: 2135234 - RNA, 22 nt, Human
cccagcuacucagaagccugag

SEQ ID NO: 2135235 - RNA, 23 nt, Human
cccagcuacucagaagccugagg

SEQ ID NO: 2135236 - RNA, 21 nt, Human
cccagcuacucaagaggcuga

SEQ ID NO: 2135237 - RNA, 18 nt, Human
cccagcucagucuucccu

SEQ ID NO: 2135238 - RNA, 15 nt, Human
cccagcucccuagga

SEQ ID NO: 2135239 - RNA, 14 nt, Human
cccagcucuagaca

SEQ ID NO: 2135240 - RNA, 23 nt, Human
cccagcucuagacaacccugcaa

SEQ ID NO: 2135241 - RNA, 15 nt, Human
cccagcggcuggugc

SEQ ID NO: 2135242 - RNA, 17 nt, Human
cccagcggcuggugcag

SEQ ID NO: 2135243 - RNA, 22 nt, Human
cccagcggcuggugcagggccu

SEQ ID NO: 2135244 - RNA, 17 nt, Human
cccagcuacucagaagc

SEQ ID NO: 2135245 - RNA, 23 nt, Human
cccagauugcaacaggcugggcu

SEQ ID NO: 2135246 - RNA, 23 nt, Human
cccagcaagugagagcugggugu

SEQ ID NO: 2135247 - RNA, 22 nt, Human
cccagcaagugagagcugggug

SEQ ID NO: 2135248 - RNA, 21 nt, Human
cccagcaagugagagcugggu

SEQ ID NO: 2135249 - RNA, 20 nt, Human
cccagcaagugagagcuggg

SEQ ID NO: 2135250 - RNA, 19 nt, Human
cccagcaagugagagcugg

SEQ ID NO: 2135251 - RNA, 12 nt, Human
cccagccugcua

SEQ ID NO: 2135252 - RNA, 16 nt, Human
cccagcccuguggaag

SEQ ID NO: 2135253 - RNA, 15 nt, Human
cccagcccuguggaa

SEQ ID NO: 2135254 - RNA, 21 nt, Human
cccagcccuuugggaggcuga

SEQ ID NO: 2135255 - RNA, 22 nt, Human
cccagcccuuugggaggcugag

SEQ ID NO: 2135256 - RNA, 16 nt, Human
cccagccccugccccu

SEQ ID NO: 2135257 - RNA, 18 nt, Human
cccagccccugccccuca

SEQ ID NO: 2135258 - RNA, 20 nt, Human
cccagccccugccccucaug

SEQ ID NO: 2135259 - RNA, 23 nt, Human
cccagccccugccccucaugcca

SEQ ID NO: 2135260 - RNA, 16 nt, Human
cccagguggcugaccc

SEQ ID NO: 2135261 - RNA, 18 nt, Human
cccagguggcugacccag

SEQ ID NO: 2135262 - RNA, 19 nt, Human
cccagguggcugacccagu

SEQ ID NO: 2135263 - RNA, 22 nt, Human
cccagguggcugacccaguccc

SEQ ID NO: 2135264 - RNA, 23 nt, Human
cccagguggcugacccagucccu

SEQ ID NO: 2135265 - RNA, 23 nt, Human
cccaguccaaauguccuccagaa

SEQ ID NO: 2135266 - RNA, 19 nt, Human
cccaguccaaauguccucc

SEQ ID NO: 2135267 - RNA, 23 nt, Human
cccaguauucuagguagugcccu

SEQ ID NO: 2135268 - RNA, 20 nt, Human
cccagucuggaaugcagugg

SEQ ID NO: 2135269 - RNA, 15 nt, Human
cccagugaaaacuag

SEQ ID NO: 2135270 - RNA, 19 nt, Human
cccagugaaaacuagagcu

SEQ ID NO: 2135271 - RNA, 12 nt, Human
cccagugacacu

SEQ ID NO: 2135272 - RNA, 13 nt, Human
cccagugacacuu

SEQ ID NO: 2135273 - RNA, 18 nt, Human
cccagugacacuucagag

SEQ ID NO: 2135274 - RNA, 13 nt, Human
cccagugcccaca

SEQ ID NO: 2135275 - RNA, 19 nt, Human
cccagugacacuucagaga

SEQ ID NO: 2135276 - RNA, 22 nt, Human
cccagugacacuucagagagcu

SEQ ID NO: 2135277 - RNA, 23 nt, Human
cccagggucuucccuaccucagg

SEQ ID NO: 2135278 - RNA, 16 nt, Human
cccagggucuucccua

SEQ ID NO: 2135279 - RNA, 18 nt, Human
cccagggucuucccuacc

SEQ ID NO: 2135280 - RNA, 15 nt, Human
cccagggucuucccu

SEQ ID NO: 2135281 - RNA, 20 nt, Human
cccaggggucccagccaccc

SEQ ID NO: 2135282 - RNA, 15 nt, Human
cccaggggucccagc

SEQ ID NO: 2135283 - RNA, 16 nt, Human
cccaggggucccagcc

SEQ ID NO: 2135284 - RNA, 18 nt, Human
cccaggggucccagccac

SEQ ID NO: 2135285 - RNA, 19 nt, Human
cccaggggucccagccacc

SEQ ID NO: 2135286 - RNA, 15 nt, Human
cccaggggagagggu

SEQ ID NO: 2135287 - RNA, 21 nt, Human
cccaggggagagggucuggag

SEQ ID NO: 2135288 - RNA, 22 nt, Human
cccaggggagagggucuggaga

SEQ ID NO: 2135289 - RNA, 23 nt, Human
cccaggggagagggucuggagaa

SEQ ID NO: 2135290 - RNA, 24 nt, Human
cccaggggagagggucuggagaag

SEQ ID NO: 2135291 - RNA, 17 nt, Human
cccaggggaccacaccu

SEQ ID NO: 2135292 - RNA, 13 nt, Human
cccaggggagagg

SEQ ID NO: 2135293 - RNA, 18 nt, Human
cccaggcgccccuucccc

SEQ ID NO: 2135294 - RNA, 16 nt, Human
cccaggccugccuguu

SEQ ID NO: 2135295 - RNA, 15 nt, Human
cccaggccugccugu

SEQ ID NO: 2135296 - RNA, 13 nt, Human
cccaggccuccag

SEQ ID NO: 2135297 - RNA, 16 nt, Human
cccaggccuccagcuc

SEQ ID NO: 2135298 - RNA, 17 nt, Human
cccaggccuccagcuca

SEQ ID NO: 2135299 - RNA, 18 nt, Human
cccaggccuccagcucag

SEQ ID NO: 2135300 - RNA, 20 nt, Human
cccaggccuccagcucagca

SEQ ID NO: 2135301 - RNA, 15 nt, Human
cccaggccguggcug

SEQ ID NO: 2135302 - RNA, 18 nt, Human
cccaggagccccgaggcc

SEQ ID NO: 2135303 - RNA, 12 nt, Human
cccagcucuccc

SEQ ID NO: 2135304 - RNA, 13 nt, Human
cccagcucucccu

SEQ ID NO: 2135305 - RNA, 14 nt, Human
cccagcucucccuc

SEQ ID NO: 2135306 - RNA, 15 nt, Human
cccagcucucccucu

SEQ ID NO: 2135307 - RNA, 16 nt, Human
cccagcucucccucug

SEQ ID NO: 2135308 - RNA, 17 nt, Human
cccagcucucccucugg

SEQ ID NO: 2135309 - RNA, 18 nt, Human
cccagcucucccucuggc

SEQ ID NO: 2135310 - RNA, 19 nt, Human
cccagcucucccucuggcc

SEQ ID NO: 2135311 - RNA, 21 nt, Human
cccagcucucccucuggcccu

SEQ ID NO: 2135312 - RNA, 21 nt, Human
cccaggagccccgaggccuuc

SEQ ID NO: 2135313 - RNA, 13 nt, Human
cccaggaggcuga

SEQ ID NO: 2135314 - RNA, 14 nt, Human
cccaggagggaggg

SEQ ID NO: 2135315 - RNA, 24 nt, Human
cccaggaguucgaggcugcaguca

SEQ ID NO: 2135316 - RNA, 18 nt, Human
cccaggagggagggggcu

SEQ ID NO: 2135317 - RNA, 23 nt, Human
cccaggagguggagguugcagug

SEQ ID NO: 2135318 - RNA, 14 nt, Human
cccaggcaggccac

SEQ ID NO: 2135319 - RNA, 13 nt, Human
cccaggcaggucu

SEQ ID NO: 2135320 - RNA, 11 nt, Human
cccaggcaggu

SEQ ID NO: 2135321 - RNA, 22 nt, Human
cccaggaguuugaggcugcagc

SEQ ID NO: 2135322 - RNA, 23 nt, Human
cccaggaguuugaggcugcagcg

SEQ ID NO: 2135323 - RNA, 22 nt, Human
cccaggccccugccacccuggg

SEQ ID NO: 2135324 - RNA, 21 nt, Human
cccaggccccugccacccugg

SEQ ID NO: 2135325 - RNA, 18 nt, Human
cccaggccccugccaccc

SEQ ID NO: 2135326 - RNA, 16 nt, Human
cccaggccccugccac

SEQ ID NO: 2135327 - RNA, 11 nt, Human
cccaggccccu

SEQ ID NO: 2135328 - RNA, 13 nt, Human
cccaggccccagg

SEQ ID NO: 2135329 - RNA, 17 nt, Human
cccaggccccaggaagc

SEQ ID NO: 2135330 - RNA, 18 nt, Human
cccaggccccaggaagcc

SEQ ID NO: 2135331 - RNA, 18 nt, Human
cccaggccaggcuccuuc

SEQ ID NO: 2135332 - RNA, 19 nt, Human
cccaggccaggcuccuucc

SEQ ID NO: 2135333 - RNA, 21 nt, Human
cccaggccaggcuccuuccug

SEQ ID NO: 2135334 - RNA, 23 nt, Human
cccaggccaggcuccuuccuguc

SEQ ID NO: 2135335 - RNA, 17 nt, Human
cccaggcaggucuugaa

SEQ ID NO: 2135336 - RNA, 13 nt, Human
cccaggcaggcug

SEQ ID NO: 2135337 - RNA, 15 nt, Human
ccccaaggagggaga

SEQ ID NO: 2135338 - RNA, 23 nt, Human
ccccaagacuugguguccuuucc

SEQ ID NO: 2135339 - RNA, 17 nt, Human
ccccacccccuccccag

SEQ ID NO: 2135340 - RNA, 23 nt, Human
ccccacccccuccccaggggaga

SEQ ID NO: 2135341 - RNA, 12 nt, Human
ccccacccccuu

SEQ ID NO: 2135342 - RNA, 17 nt, Human
ccccacccccuucagug

SEQ ID NO: 2135343 - RNA, 21 nt, Human
ccccacccccuucagugccca

SEQ ID NO: 2135344 - RNA, 13 nt, Human
cccauucugccug

SEQ ID NO: 2135345 - RNA, 17 nt, Human
cccauucucucuccugu

SEQ ID NO: 2135346 - RNA, 18 nt, Human
cccauucucucuccuguc

SEQ ID NO: 2135347 - RNA, 20 nt, Human
cccauucucucuccugucca

SEQ ID NO: 2135348 - RNA, 14 nt, Human
ccccaagaaggcug

SEQ ID NO: 2135349 - RNA, 16 nt, Human
ccccaagaaggcuggg

SEQ ID NO: 2135350 - RNA, 18 nt, Human
ccccaagaaggcuggggc

SEQ ID NO: 2135351 - RNA, 23 nt, Human
ccccaagaccucuauauuugcuc

SEQ ID NO: 2135352 - RNA, 19 nt, Human
cccauucucucuccugucc

SEQ ID NO: 2135353 - RNA, 21 nt, Human
cccauucugccuccauucuga

SEQ ID NO: 2135354 - RNA, 20 nt, Human
cccagugcccacaggaucag

SEQ ID NO: 2135355 - RNA, 15 nt, Human
cccagugcccacagg

SEQ ID NO: 2135356 - RNA, 18 nt, Human
cccagugccgagaaggaa

SEQ ID NO: 2135357 - RNA, 17 nt, Human
cccagugccgagaagga

SEQ ID NO: 2135358 - RNA, 22 nt, Human
cccagugccaagcacagugccu

SEQ ID NO: 2135359 - RNA, 14 nt, Human
cccagugcacccac

SEQ ID NO: 2135360 - RNA, 15 nt, Human
cccagugcacccacu

SEQ ID NO: 2135361 - RNA, 19 nt, Human
cccaguggccucaacccuc

SEQ ID NO: 2135362 - RNA, 21 nt, Human
cccaguggccucaacccuccc

SEQ ID NO: 2135363 - RNA, 13 nt, Human
cccaguggccuca

SEQ ID NO: 2135364 - RNA, 18 nt, Human
cccaguggccucaacccu

SEQ ID NO: 2135365 - RNA, 20 nt, Human
cccauggcaugggggccuca

SEQ ID NO: 2135366 - RNA, 14 nt, Human
cggccucccaaagu

SEQ ID NO: 2135367 - RNA, 19 nt, Human
cggccugaugcucccuccc

SEQ ID NO: 2135368 - RNA, 23 nt, Human
cggccugaugcucccuccccugc

SEQ ID NO: 2135369 - RNA, 15 nt, Human
cggccuuuggcuuca

SEQ ID NO: 2135370 - RNA, 19 nt, Human
cggccuucaacugaaaaga

SEQ ID NO: 2135371 - RNA, 17 nt, Human
cggcccccaugcaaggu

SEQ ID NO: 2135372 - RNA, 21 nt, Human
cggcaguucugggugcucccu

SEQ ID NO: 2135373 - RNA, 16 nt, Human
cggcaguucugggugc

SEQ ID NO: 2135374 - RNA, 20 nt, Human
cggcaguucugggugcuccc

SEQ ID NO: 2135375 - RNA, 17 nt, Human
cgggaggucgaggcagg

SEQ ID NO: 2135376 - RNA, 16 nt, Human
cgggaggucgaggcag

SEQ ID NO: 2135377 - RNA, 16 nt, Human
cggccuugcugggggc

SEQ ID NO: 2135378 - RNA, 20 nt, Human
cgggaggauguucugggaca

SEQ ID NO: 2135379 - RNA, 22 nt, Human
cgggaggcggagcuugcaguga

SEQ ID NO: 2135380 - RNA, 18 nt, Human
cgggaggaauuucugagu

SEQ ID NO: 2135381 - RNA, 15 nt, Human
cggcuggugcagggc

SEQ ID NO: 2135382 - RNA, 12 nt, Human
cggacgggcugu

SEQ ID NO: 2135383 - RNA, 14 nt, Human
cggauccugggugg

SEQ ID NO: 2135384 - RNA, 16 nt, Human
cggcaauuuccggcca

SEQ ID NO: 2135385 - RNA, 21 nt, Human
cgcuccugucugccagccagc

SEQ ID NO: 2135386 - RNA, 17 nt, Human
cgcuccugucugccagc

SEQ ID NO: 2135387 - RNA, 20 nt, Human
cgcuccugucugccagccag

SEQ ID NO: 2135388 - RNA, 13 nt, Human
cgcuccugugucu

SEQ ID NO: 2135389 - RNA, 16 nt, Human
cgcuccugucugccag

SEQ ID NO: 2135390 - RNA, 15 nt, Human
cggaacaagccuaaa

SEQ ID NO: 2135391 - RNA, 12 nt, Human
cggaaagcagcu

SEQ ID NO: 2135392 - RNA, 13 nt, Human
cggaaagcagcuc

SEQ ID NO: 2135393 - RNA, 17 nt, Human
cgcucuccuuucuuucu

SEQ ID NO: 2135394 - RNA, 18 nt, Human
cggacagccacggccagg

SEQ ID NO: 2135395 - RNA, 16 nt, Human
cggacagccacggcca

SEQ ID NO: 2135396 - RNA, 15 nt, Human
cggacagccacggcc

SEQ ID NO: 2135397 - RNA, 13 nt, Human
cggacaaguuuua

SEQ ID NO: 2135398 - RNA, 20 nt, Human
cggaaugaaccacaucuugc

SEQ ID NO: 2135399 - RNA, 20 nt, Human
cggaaagcagcucaaaggca

SEQ ID NO: 2135400 - RNA, 16 nt, Human
cggaacguuggacuuu

SEQ ID NO: 2135401 - RNA, 21 nt, Human
cggaauccuguccucagcuuc

SEQ ID NO: 2135402 - RNA, 20 nt, Human
cgcgugcacacaccagagcc

SEQ ID NO: 2135403 - RNA, 19 nt, Human
cgcgugcacguggagagcu

SEQ ID NO: 2135404 - RNA, 19 nt, Human
cgcgugcacacaccagagc

SEQ ID NO: 2135405 - RNA, 16 nt, Human
cgcgugcacacaccag

SEQ ID NO: 2135406 - RNA, 18 nt, Human
cgcuagaggaagcagcca

SEQ ID NO: 2135407 - RNA, 13 nt, Human
cgcccucuucccc

SEQ ID NO: 2135408 - RNA, 19 nt, Human
cgcccucuuccccucuaau

SEQ ID NO: 2135409 - RNA, 15 nt, Human
cgcccuaggccuggc

SEQ ID NO: 2135410 - RNA, 16 nt, Human
cgcccuaggccuggca

SEQ ID NO: 2135411 - RNA, 23 nt, Human
cgcccuaggccuggcauggcacc

SEQ ID NO: 2135412 - RNA, 18 nt, Human
cgcccucauuacggcucc

SEQ ID NO: 2135413 - RNA, 19 nt, Human
cgcccucauuacggcuccu

SEQ ID NO: 2135414 - RNA, 20 nt, Human
cgcccucauuacggcuccuc

SEQ ID NO: 2135415 - RNA, 22 nt, Human
cgcccucauuacggcuccucuc

SEQ ID NO: 2135416 - RNA, 23 nt, Human
cgcccccggguuuggcgggccaa

SEQ ID NO: 2135417 - RNA, 12 nt, Human
cgcccccagugu

SEQ ID NO: 2135418 - RNA, 13 nt, Human
cgcccccagugug

SEQ ID NO: 2135419 - RNA, 15 nt, Human
cgcccaggagacauc

SEQ ID NO: 2135420 - RNA, 14 nt, Human
cgccccagccucug

SEQ ID NO: 2135421 - RNA, 15 nt, Human
cgcccagcugcaccu

SEQ ID NO: 2135422 - RNA, 11 nt, Human
cgcccaggaga

SEQ ID NO: 2135423 - RNA, 23 nt, Human
cgcccagcugcaccugccagccu

SEQ ID NO: 2135424 - RNA, 18 nt, Human
cgcccagcugcaccugcc

SEQ ID NO: 2135425 - RNA, 20 nt, Human
cgcccagcugcaccugccag

SEQ ID NO: 2135426 - RNA, 12 nt, Human
cgaggacaggga

SEQ ID NO: 2135427 - RNA, 14 nt, Human
cgaggaaacucaga

SEQ ID NO: 2135428 - RNA, 22 nt, Human
cgagcuggugcauuacagagag

SEQ ID NO: 2135429 - RNA, 14 nt, Human
cgaggaaccagagc

SEQ ID NO: 2135430 - RNA, 15 nt, Human
cgaggaaccagagcc

SEQ ID NO: 2135431 - RNA, 16 nt, Human
cgaggaaccagagcca

SEQ ID NO: 2135432 - RNA, 13 nt, Human
cgaggacagggag

SEQ ID NO: 2135433 - RNA, 19 nt, Human
cgaggaaccagagccaugg

SEQ ID NO: 2135434 - RNA, 11 nt, Human
cgaggaagccc

SEQ ID NO: 2135435 - RNA, 19 nt, Human
cgaggccuucucugaagga

SEQ ID NO: 2135436 - RNA, 18 nt, Human
cgaggccuucucugaagg

SEQ ID NO: 2135437 - RNA, 20 nt, Human
cgauccaccugucucagccu

SEQ ID NO: 2135438 - RNA, 15 nt, Human
cgaggcuggagcugg

SEQ ID NO: 2135439 - RNA, 16 nt, Human
cgaggcuggagcuggc

SEQ ID NO: 2135440 - RNA, 17 nt, Human
cgagggauguggagcac

SEQ ID NO: 2135441 - RNA, 22 nt, Human
cgaggcugcccacuauggucau

SEQ ID NO: 2135442 - RNA, 13 nt, Human
cgaggcugggcca

SEQ ID NO: 2135443 - RNA, 14 nt, Human
cgaggcugggccaa

SEQ ID NO: 2135444 - RNA, 15 nt, Human
cgaggcugggccaag

SEQ ID NO: 2135445 - RNA, 16 nt, Human
cgaggcugggccaagc

SEQ ID NO: 2135446 - RNA, 17 nt, Human
cgaggcugggccaagcc

SEQ ID NO: 2135447 - RNA, 18 nt, Human
cgaggcugggccaagcca

SEQ ID NO: 2135448 - RNA, 12 nt, Human
cgagcugggggc

SEQ ID NO: 2135449 - RNA, 13 nt, Human
cgagcugggggcc

SEQ ID NO: 2135450 - RNA, 15 nt, Human
cgagcugggggccau

SEQ ID NO: 2135451 - RNA, 16 nt, Human
cgagcugggggccaug

SEQ ID NO: 2135452 - RNA, 20 nt, Human
cgagcugggggccaugagcu

SEQ ID NO: 2135453 - RNA, 23 nt, Human
cgagcugggggccaugagcucca

SEQ ID NO: 2135454 - RNA, 13 nt, Human
cgagcuggugcau

SEQ ID NO: 2135455 - RNA, 14 nt, Human
cgagcuggugcauu

SEQ ID NO: 2135456 - RNA, 15 nt, Human
cgagcuggugcauua

SEQ ID NO: 2135457 - RNA, 21 nt, Human
cgagcuggugcauuacagaga

SEQ ID NO: 2135458 - RNA, 23 nt, Human
cgagcuggugcauuacagagagg

SEQ ID NO: 2135459 - RNA, 12 nt, Human
ccuuuguaaguu

SEQ ID NO: 2135460 - RNA, 14 nt, Human
ccuuuguaaguuau

SEQ ID NO: 2135461 - RNA, 15 nt, Human
ccuuuguaaguuauu

SEQ ID NO: 2135462 - RNA, 18 nt, Human
cgcaaugugcccccagac

SEQ ID NO: 2135463 - RNA, 20 nt, Human
cgcaaugugcccccagacgc

SEQ ID NO: 2135464 - RNA, 16 nt, Human
cgcacaaggcugacca

SEQ ID NO: 2135465 - RNA, 21 nt, Human
cgcacaaggcugaccaagaga

SEQ ID NO: 2135466 - RNA, 10 nt, Human
cgcacacaca

SEQ ID NO: 2135467 - RNA, 15 nt, Human
cgcacacacacacac

SEQ ID NO: 2135468 - RNA, 13 nt, Human
cgcacacacacac

SEQ ID NO: 2135469 - RNA, 12 nt, Human
cgauuguaacuc

SEQ ID NO: 2135470 - RNA, 20 nt, Human
cgcaagccuguaaucccagc

SEQ ID NO: 2135471 - RNA, 21 nt, Human
cgcaagccuguaaucccagcu

SEQ ID NO: 2135472 - RNA, 19 nt, Human
cgauucuucugcuucagcc

SEQ ID NO: 2135473 - RNA, 13 nt, Human
cgauucuucugcu

SEQ ID NO: 2135474 - RNA, 21 nt, Human
cgauucuucugcuucagccuc

SEQ ID NO: 2135475 - RNA, 19 nt, Human
cgaucuggguucacugcaa

SEQ ID NO: 2135476 - RNA, 17 nt, Human
cgaucucuuauuuuaca

SEQ ID NO: 2135477 - RNA, 21 nt, Human
cgaugaauuuggagacucugu

SEQ ID NO: 2135478 - RNA, 22 nt, Human
cgauccaccugucucagccucc

SEQ ID NO: 2135479 - RNA, 16 nt, Human
cgaucucauucaguau

SEQ ID NO: 2135480 - RNA, 13 nt, Human
ccuuggcugcagg

SEQ ID NO: 2135481 - RNA, 12 nt, Human
ccuuggcugcag

SEQ ID NO: 2135482 - RNA, 18 nt, Human
ccuuggcucaauccucua

SEQ ID NO: 2135483 - RNA, 22 nt, Human
ccuuggcucaauccucuaagcu

SEQ ID NO: 2135484 - RNA, 17 nt, Human
ccuuggcaugccuucca

SEQ ID NO: 2135485 - RNA, 20 nt, Human
ccuuggcaugccuuccagca

SEQ ID NO: 2135486 - RNA, 21 nt, Human
ccuuggcaugccuuccagcac

SEQ ID NO: 2135487 - RNA, 16 nt, Human
ccuuucuguaccauuu

SEQ ID NO: 2135488 - RNA, 20 nt, Human
ccuuguuuugugacauuuuu

SEQ ID NO: 2135489 - RNA, 20 nt, Human
ccuuguguuuuguuuugauu

SEQ ID NO: 2135490 - RNA, 19 nt, Human
ccuuugcuuaugaauauuu

SEQ ID NO: 2135491 - RNA, 15 nt, Human
ccuuuggccauucca

SEQ ID NO: 2135492 - RNA, 21 nt, Human
ccuuugccaccaacuggcccu

SEQ ID NO: 2135493 - RNA, 14 nt, Human
ccuuugcuccaccc

SEQ ID NO: 2135494 - RNA, 19 nt, Human
ccuuugcuccaccccacuc

SEQ ID NO: 2135495 - RNA, 20 nt, Human
ccuuugcuccaccccacuca

SEQ ID NO: 2135496 - RNA, 14 nt, Human
ccuuugcucuugca

SEQ ID NO: 2135497 - RNA, 21 nt, Human
ccuuugccccaccuuuauuaa

SEQ ID NO: 2135498 - RNA, 13 nt, Human
ccuuucuuggcca

SEQ ID NO: 2135499 - RNA, 15 nt, Human
ccuuucuuggccagu

SEQ ID NO: 2135500 - RNA, 22 nt, Human
ccuuugaguuuccucaggcugc

SEQ ID NO: 2135501 - RNA, 16 nt, Human
cgucgacguagaaccu

SEQ ID NO: 2135502 - RNA, 19 nt, Human
cgucgggggcugaggggca

SEQ ID NO: 2135503 - RNA, 18 nt, Human
cgucggggggacagcucc

SEQ ID NO: 2135504 - RNA, 20 nt, Human
cguccggcaguucugggugc

SEQ ID NO: 2135505 - RNA, 13 nt, Human
cguccucccccug

SEQ ID NO: 2135506 - RNA, 15 nt, Human
cguccucccccugcc

SEQ ID NO: 2135507 - RNA, 16 nt, Human
cguccucccccugcca

SEQ ID NO: 2135508 - RNA, 17 nt, Human
cguccucccccugccag

SEQ ID NO: 2135509 - RNA, 22 nt, Human
cguccucccccugccagugccu

SEQ ID NO: 2135510 - RNA, 14 nt, Human
cgucugacaggcaa

SEQ ID NO: 2135511 - RNA, 13 nt, Human
cgucugacaggca

SEQ ID NO: 2135512 - RNA, 23 nt, Human
cgucugcuaacuuggagccccag

SEQ ID NO: 2135513 - RNA, 17 nt, Human
cgucucccaucuuaacu

SEQ ID NO: 2135514 - RNA, 18 nt, Human
cgucucccaucuuaacuc

SEQ ID NO: 2135515 - RNA, 22 nt, Human
cgucucucccucccuuugaaau

SEQ ID NO: 2135516 - RNA, 19 nt, Human
cgucuaagucaugagcuga

SEQ ID NO: 2135517 - RNA, 22 nt, Human
cgugcacacaccagagcccacc

SEQ ID NO: 2135518 - RNA, 17 nt, Human
cgugaaguauacuguau

SEQ ID NO: 2135519 - RNA, 15 nt, Human
cgugcaccuguacuc

SEQ ID NO: 2135520 - RNA, 18 nt, Human
cgugcacgcacacugucu

SEQ ID NO: 2135521 - RNA, 10 nt, Human
cgugcccucu

SEQ ID NO: 2135522 - RNA, 12 nt, Human
cgugcccucugu

SEQ ID NO: 2135523 - RNA, 17 nt, Human
cgugccguuacucucca

SEQ ID NO: 2135524 - RNA, 19 nt, Human
cgugccguuacucuccaac

SEQ ID NO: 2135525 - RNA, 21 nt, Human
cgugcacacaccagagcccac

SEQ ID NO: 2135526 - RNA, 20 nt, Human
cgugcacacaccagagccca

SEQ ID NO: 2135527 - RNA, 13 nt, Human
cgugaagcaucca

SEQ ID NO: 2135528 - RNA, 19 nt, Human
cgugaaggccgagaagcaa

SEQ ID NO: 2135529 - RNA, 12 nt, Human
cgugacaacacu

SEQ ID NO: 2135530 - RNA, 18 nt, Human
cgucugucuucacagcuc

SEQ ID NO: 2135531 - RNA, 12 nt, Human
cgugaaacacac

SEQ ID NO: 2135532 - RNA, 15 nt, Human
cgugaaacacaccag

SEQ ID NO: 2135533 - RNA, 16 nt, Human
cgugaaacacaccagg

SEQ ID NO: 2135534 - RNA, 20 nt, Human
cgugaaacacaccaggcugu

SEQ ID NO: 2135535 - RNA, 22 nt, Human
cgugaaacacaccaggcugugg

SEQ ID NO: 2135536 - RNA, 24 nt, Human
cgugaaacacaccaggcugugggc

SEQ ID NO: 2135537 - RNA, 17 nt, Human
cgucugggguucagccc

SEQ ID NO: 2135538 - RNA, 18 nt, Human
cgucugggguucagcccc

SEQ ID NO: 2135539 - RNA, 19 nt, Human
cgucugggguucagccccu

SEQ ID NO: 2135540 - RNA, 23 nt, Human
cgucugggguucagccccuccuc

SEQ ID NO: 2135541 - RNA, 14 nt, Human
cgucauaacuagaa

SEQ ID NO: 2135542 - RNA, 16 nt, Human
cgucauaacuagaacu

SEQ ID NO: 2135543 - RNA, 17 nt, Human
cgucauaacuagaacug

SEQ ID NO: 2135544 - RNA, 19 nt, Human
cgucagcuggcacugucuc

SEQ ID NO: 2135545 - RNA, 17 nt, Human
cgucaguaucaggccug

SEQ ID NO: 2135546 - RNA, 21 nt, Human
cguccagccgccauugccacc

SEQ ID NO: 2135547 - RNA, 15 nt, Human
cgucauguuccucaa

SEQ ID NO: 2135548 - RNA, 22 nt, Human
cguaguucccugaaaacccaga

SEQ ID NO: 2135549 - RNA, 22 nt, Human
cguauaugucucaggucccugc

SEQ ID NO: 2135550 - RNA, 15 nt, Human
cguauugguccagcu

SEQ ID NO: 2135551 - RNA, 17 nt, Human
cgucagaagcacccagg

SEQ ID NO: 2135552 - RNA, 20 nt, Human
cgucaccaucucaggccacc

SEQ ID NO: 2135553 - RNA, 21 nt, Human
cgucaccaucucaggccaccu

SEQ ID NO: 2135554 - RNA, 16 nt, Human
cgucaccaucucaggc

SEQ ID NO: 2135555 - RNA, 14 nt, Human
cgucaccaccucuc

SEQ ID NO: 2135556 - RNA, 18 nt, Human
cgucaccaucucaggcca

SEQ ID NO: 2135557 - RNA, 13 nt, Human
cggggccagaggc

SEQ ID NO: 2135558 - RNA, 14 nt, Human
cggggccagaggca

SEQ ID NO: 2135559 - RNA, 14 nt, Human
cggggccccagggc

SEQ ID NO: 2135560 - RNA, 19 nt, Human
cggggcagcugccagagaa

SEQ ID NO: 2135561 - RNA, 16 nt, Human
cggggcaugcuggggc

SEQ ID NO: 2135562 - RNA, 17 nt, Human
cggggcaugcuggggca

SEQ ID NO: 2135563 - RNA, 19 nt, Human
cggggcaugcuggggcaag

SEQ ID NO: 2135564 - RNA, 14 nt, Human
cggggcagcugcca

SEQ ID NO: 2135565 - RNA, 15 nt, Human
cggggccccagggcu

SEQ ID NO: 2135566 - RNA, 22 nt, Human
cguagaaucuguguagacgaag

SEQ ID NO: 2135567 - RNA, 16 nt, Human
cguagagggugcugcc

SEQ ID NO: 2135568 - RNA, 17 nt, Human
cguagagggugcugccc

SEQ ID NO: 2135569 - RNA, 14 nt, Human
cguaguucccugaa

SEQ ID NO: 2135570 - RNA, 20 nt, Human
cguaguguagauuuguuuug

SEQ ID NO: 2135571 - RNA, 21 nt, Human
cguaguguagauuuguuuugu

SEQ ID NO: 2135572 - RNA, 13 nt, Human
cguaguucccuga

SEQ ID NO: 2135573 - RNA, 17 nt, Human
cguaguagggucaggcc

SEQ ID NO: 2135574 - RNA, 19 nt, Human
cguagcuauccggacagag

SEQ ID NO: 2135575 - RNA, 20 nt, Human
cguagccaaggugggcugag

SEQ ID NO: 2135576 - RNA, 12 nt, Human
cguucucugccu

SEQ ID NO: 2135577 - RNA, 18 nt, Human
cguuccuuacugcagaau

SEQ ID NO: 2135578 - RNA, 13 nt, Human
cguucuuguucug

SEQ ID NO: 2135579 - RNA, 19 nt, Human
cguucuuguucuguuuugu

SEQ ID NO: 2135580 - RNA, 17 nt, Human
cguuucaguaauaaaac

SEQ ID NO: 2135581 - RNA, 18 nt, Human
cguuucaguaauaaaaca

SEQ ID NO: 2135582 - RNA, 20 nt, Human
cguuuccugagaagugucua

SEQ ID NO: 2135583 - RNA, 20 nt, Human
cguuuccagguguuuauagu

SEQ ID NO: 2135584 - RNA, 23 nt, Human
cguuuugugugguggcaccuccu

SEQ ID NO: 2135585 - RNA, 15 nt, Human
cguuuuggaagcucu

SEQ ID NO: 2135586 - RNA, 18 nt, Human
cgugccuucagcucuaca

SEQ ID NO: 2135587 - RNA, 16 nt, Human
cgugccuucagcucua

SEQ ID NO: 2135588 - RNA, 15 nt, Human
cgugccuucagcucu

SEQ ID NO: 2135589 - RNA, 13 nt, Human
cgugccuucagcu

SEQ ID NO: 2135590 - RNA, 22 nt, Human
cguggcuaagaguguccuagga

SEQ ID NO: 2135591 - RNA, 20 nt, Human
cguggccuuccccagccucu

SEQ ID NO: 2135592 - RNA, 14 nt, Human
cguggcugaccccc

SEQ ID NO: 2135593 - RNA, 17 nt, Human
cguggcugaccccccuc

SEQ ID NO: 2135594 - RNA, 18 nt, Human
cguggcugaccccccuca

SEQ ID NO: 2135595 - RNA, 19 nt, Human
cguggcugaccccccucag

SEQ ID NO: 2135596 - RNA, 21 nt, Human
cguggcugcccacacacccca

SEQ ID NO: 2135597 - RNA, 19 nt, Human
cguggcugcggcacccuug

SEQ ID NO: 2135598 - RNA, 11 nt, Human
cguucauuugu

SEQ ID NO: 2135599 - RNA, 12 nt, Human
cguucauuugug

SEQ ID NO: 2135600 - RNA, 13 nt, Human
cguuccaguuccc

SEQ ID NO: 2135601 - RNA, 20 nt, Human
ccuguggccaaguucuuagu

SEQ ID NO: 2135602 - RNA, 18 nt, Human
ccuguggcaucuuugccu

SEQ ID NO: 2135603 - RNA, 23 nt, Human
ccuguggcaucuuugccuugggc

SEQ ID NO: 2135604 - RNA, 23 nt, Human
ccugugcugcccgucuucagccu

SEQ ID NO: 2135605 - RNA, 16 nt, Human
ccuguggaagggacua

SEQ ID NO: 2135606 - RNA, 19 nt, Human
ccuguggaagggacuagga

SEQ ID NO: 2135607 - RNA, 20 nt, Human
ccuguggaagggacuaggag

SEQ ID NO: 2135608 - RNA, 24 nt, Human
ccuguggaagggacuaggagcacu

SEQ ID NO: 2135609 - RNA, 18 nt, Human
ccuguggcaguaaagaga

SEQ ID NO: 2135610 - RNA, 21 nt, Human
ccuguggcaguaaagagaaac

SEQ ID NO: 2135611 - RNA, 22 nt, Human
ccuguggcaguaaagagaaacu

SEQ ID NO: 2135612 - RNA, 23 nt, Human
ccuguggcaguaaagagaaacuu

SEQ ID NO: 2135613 - RNA, 20 nt, Human
ccuuaccucggugccuuccu

SEQ ID NO: 2135614 - RNA, 13 nt, Human
ccuuaccuccugc

SEQ ID NO: 2135615 - RNA, 14 nt, Human
ccuuaccuccugcc

SEQ ID NO: 2135616 - RNA, 16 nt, Human
ccuuaccuccugccca

SEQ ID NO: 2135617 - RNA, 17 nt, Human
ccuuaccuccugcccag

SEQ ID NO: 2135618 - RNA, 18 nt, Human
ccuuaccuccugcccagg

SEQ ID NO: 2135619 - RNA, 20 nt, Human
ccuuaccuccugcccaggag

SEQ ID NO: 2135620 - RNA, 14 nt, Human
ccuuaccucuuccg

SEQ ID NO: 2135621 - RNA, 19 nt, Human
ccuuacuuuguaugauauu

SEQ ID NO: 2135622 - RNA, 20 nt, Human
ccuuacuuuguaugauauuc

SEQ ID NO: 2135623 - RNA, 13 nt, Human
ccuucaacugaaa

SEQ ID NO: 2135624 - RNA, 24 nt, Human
ccuucaacugaaaagacucagugu

SEQ ID NO: 2135625 - RNA, 19 nt, Human
ccuucaagaacucugggcu

SEQ ID NO: 2135626 - RNA, 14 nt, Human
ccuucaaccauucc

SEQ ID NO: 2135627 - RNA, 16 nt, Human
ccuuauuguacguuua

SEQ ID NO: 2135628 - RNA, 12 nt, Human
ccuucaaagcug

SEQ ID NO: 2135629 - RNA, 13 nt, Human
ccuucaaagcuga

SEQ ID NO: 2135630 - RNA, 16 nt, Human
ccuuauuguaccucuc

SEQ ID NO: 2135631 - RNA, 15 nt, Human
ccuuauuguaccucu

SEQ ID NO: 2135632 - RNA, 16 nt, Human
ccuuagagacaucaaa

SEQ ID NO: 2135633 - RNA, 18 nt, Human
ccuuagaaccuuucuuac

SEQ ID NO: 2135634 - RNA, 16 nt, Human
ccuuagaaccuuucuu

SEQ ID NO: 2135635 - RNA, 15 nt, Human
ccuuagaaccuuucu

SEQ ID NO: 2135636 - RNA, 14 nt, Human
ccuuagaaccuuuc

SEQ ID NO: 2135637 - RNA, 18 nt, Human
ccuucacaccauaacuag

SEQ ID NO: 2135638 - RNA, 14 nt, Human
ccuucaauaaagua

SEQ ID NO: 2135639 - RNA, 16 nt, Human
ccuucaauaaaguauc

SEQ ID NO: 2135640 - RNA, 17 nt, Human
ccuucaaguuagcucag

SEQ ID NO: 2135641 - RNA, 19 nt, Human
ccuucaaguuagcucagga

SEQ ID NO: 2135642 - RNA, 14 nt, Human
ccuucaauuccugg

SEQ ID NO: 2135643 - RNA, 15 nt, Human
ccuucaauuccuggg

SEQ ID NO: 2135644 - RNA, 16 nt, Human
ccuucaauuccugggc

SEQ ID NO: 2135645 - RNA, 20 nt, Human
ccuucaauuccugggcccca

SEQ ID NO: 2135646 - RNA, 21 nt, Human
ccuucagucuugaauuucuaa

SEQ ID NO: 2135647 - RNA, 20 nt, Human
ccuucagucuugaauuucua

SEQ ID NO: 2135648 - RNA, 23 nt, Human
ccuucgauacaccgggccuggag

SEQ ID NO: 2135649 - RNA, 22 nt, Human
ccuucgauacaccgggccugga

SEQ ID NO: 2135650 - RNA, 20 nt, Human
ccuucgauacaccgggccug

SEQ ID NO: 2135651 - RNA, 17 nt, Human
ccuuccugccaccugcu

SEQ ID NO: 2135652 - RNA, 18 nt, Human
ccuuccugccaccugcug

SEQ ID NO: 2135653 - RNA, 15 nt, Human
ccuucgauacaccgg

SEQ ID NO: 2135654 - RNA, 14 nt, Human
ccuuccucuuucca

SEQ ID NO: 2135655 - RNA, 18 nt, Human
ccuuccacgcugucucca

SEQ ID NO: 2135656 - RNA, 19 nt, Human
ccuuccacgcugucuccag

SEQ ID NO: 2135657 - RNA, 16 nt, Human
ccuuccacggacucaa

SEQ ID NO: 2135658 - RNA, 17 nt, Human
ccuuccacggacucaag

SEQ ID NO: 2135659 - RNA, 20 nt, Human
ccuuccacggauccauguag

SEQ ID NO: 2135660 - RNA, 20 nt, Human
ccuuccacgcugucuccaga

SEQ ID NO: 2135661 - RNA, 21 nt, Human
ccuuccacggauccauguagc

SEQ ID NO: 2135662 - RNA, 23 nt, Human
ccuuccaugucgccucugcauuc

SEQ ID NO: 2135663 - RNA, 21 nt, Human
ccuuccaugucgccucugcau

SEQ ID NO: 2135664 - RNA, 20 nt, Human
ccuuccaugucgccucugca

SEQ ID NO: 2135665 - RNA, 19 nt, Human
ccuuccaugucgccucugc

SEQ ID NO: 2135666 - RNA, 16 nt, Human
ccuugaacuggguacu

SEQ ID NO: 2135667 - RNA, 14 nt, Human
ccuugaacugggua

SEQ ID NO: 2135668 - RNA, 18 nt, Human
ccuucgcuccugugucuu

SEQ ID NO: 2135669 - RNA, 15 nt, Human
ccuucgcuccugugu

SEQ ID NO: 2135670 - RNA, 14 nt, Human
ccuucgcuccugug

SEQ ID NO: 2135671 - RNA, 13 nt, Human
ccuucgcuccugu

SEQ ID NO: 2135672 - RNA, 22 nt, Human
ccuucgcguauuucaggauucu

SEQ ID NO: 2135673 - RNA, 20 nt, Human
ccuucuuucuagagagggaa

SEQ ID NO: 2135674 - RNA, 16 nt, Human
ccuucuuuuucuucuu

SEQ ID NO: 2135675 - RNA, 14 nt, Human
ccuucuuuuucuuc

SEQ ID NO: 2135676 - RNA, 17 nt, Human
ccuugacagggcacacc

SEQ ID NO: 2135677 - RNA, 15 nt, Human
ccuugacagggcaca

SEQ ID NO: 2135678 - RNA, 14 nt, Human
ccuugacagggcac

SEQ ID NO: 2135679 - RNA, 22 nt, Human
ccuugaguugauucagcucugc

SEQ ID NO: 2135680 - RNA, 23 nt, Human
ccuugaguugauucagcucugca

SEQ ID NO: 2135681 - RNA, 14 nt, Human
ccuugaucuguaua

SEQ ID NO: 2135682 - RNA, 19 nt, Human
ccuuggcaucacagggcag

SEQ ID NO: 2135683 - RNA, 15 nt, Human
ccuuggcaugccuuc

SEQ ID NO: 2135684 - RNA, 13 nt, Human
ccuugacagggca

SEQ ID NO: 2135685 - RNA, 11 nt, Human
ccuuuggcuuc

SEQ ID NO: 2135686 - RNA, 23 nt, Human
ccugucaaacaaagccagaagcu

SEQ ID NO: 2135687 - RNA, 20 nt, Human
ccugucaaacaaagccagaa

SEQ ID NO: 2135688 - RNA, 22 nt, Human
ccugucaaacaaagccagaagc

SEQ ID NO: 2135689 - RNA, 18 nt, Human
ccugucaaacaaagccag

SEQ ID NO: 2135690 - RNA, 19 nt, Human
ccugucaaacaaagccaga

SEQ ID NO: 2135691 - RNA, 13 nt, Human
ccuguagucccag

SEQ ID NO: 2135692 - RNA, 14 nt, Human
ccuguagucccagc

SEQ ID NO: 2135693 - RNA, 15 nt, Human
ccuguagucccagcu

SEQ ID NO: 2135694 - RNA, 16 nt, Human
ccuguagucccagcua

SEQ ID NO: 2135695 - RNA, 13 nt, Human
ccuguaguccuag

SEQ ID NO: 2135696 - RNA, 14 nt, Human
ccuguaguuaggaa

SEQ ID NO: 2135697 - RNA, 15 nt, Human
ccuguaguuaggaaa

SEQ ID NO: 2135698 - RNA, 23 nt, Human
ccuguaguuaggaaauaaaaccu

SEQ ID NO: 2135699 - RNA, 21 nt, Human
ccuguaguuaggaaauaaaac

SEQ ID NO: 2135700 - RNA, 22 nt, Human
ccuguaguuaggaaauaaaacc

SEQ ID NO: 2135701 - RNA, 16 nt, Human
ccuguaguuaggaaau

SEQ ID NO: 2135702 - RNA, 17 nt, Human
ccuguaguuaggaaaua

SEQ ID NO: 2135703 - RNA, 18 nt, Human
ccuguaguuaggaaauaa

SEQ ID NO: 2135704 - RNA, 19 nt, Human
ccuguaguuaggaaauaaa

SEQ ID NO: 2135705 - RNA, 21 nt, Human
ccuguagagugggagcugagu

SEQ ID NO: 2135706 - RNA, 19 nt, Human
ccuguagagugggagcuga

SEQ ID NO: 2135707 - RNA, 23 nt, Human
ccuguagagugggagcugagugg

SEQ ID NO: 2135708 - RNA, 12 nt, Human
ccuguacacuga

SEQ ID NO: 2135709 - RNA, 13 nt, Human
ccuguacucagga

SEQ ID NO: 2135710 - RNA, 14 nt, Human
ccuguacucaggag

SEQ ID NO: 2135711 - RNA, 15 nt, Human
ccuguacucaggagg

SEQ ID NO: 2135712 - RNA, 21 nt, Human
ccuguacucaggaggcugagg

SEQ ID NO: 2135713 - RNA, 22 nt, Human
ccuguacucaggaggcugaggg

SEQ ID NO: 2135714 - RNA, 13 nt, Human
ccuguacuggaga

SEQ ID NO: 2135715 - RNA, 14 nt, Human
ccuguacuggagag

SEQ ID NO: 2135716 - RNA, 23 nt, Human
ccuguacucaggaggcugagggg

SEQ ID NO: 2135717 - RNA, 15 nt, Human
ccuggugcugccaca

SEQ ID NO: 2135718 - RNA, 21 nt, Human
ccuggugcugccacacuucag

SEQ ID NO: 2135719 - RNA, 18 nt, Human
ccuggugcugccacacuu

SEQ ID NO: 2135720 - RNA, 12 nt, Human
ccuggugcugcu

SEQ ID NO: 2135721 - RNA, 17 nt, Human
ccugggcaccuggggag

SEQ ID NO: 2135722 - RNA, 13 nt, Human
ccugggcagaaag

SEQ ID NO: 2135723 - RNA, 13 nt, Human
ccuggugcugcug

SEQ ID NO: 2135724 - RNA, 13 nt, Human
ccuggugcuggau

SEQ ID NO: 2135725 - RNA, 13 nt, Human
ccugguggcagcu

SEQ ID NO: 2135726 - RNA, 12 nt, Human
ccugguggcagc

SEQ ID NO: 2135727 - RNA, 12 nt, Human
ccugguggacag

SEQ ID NO: 2135728 - RNA, 14 nt, Human
ccugguggacaguc

SEQ ID NO: 2135729 - RNA, 17 nt, Human
ccugguggacaguccug

SEQ ID NO: 2135730 - RNA, 18 nt, Human
ccugguggacaguccugg

SEQ ID NO: 2135731 - RNA, 19 nt, Human
ccugguggacaguccuggg

SEQ ID NO: 2135732 - RNA, 20 nt, Human
ccugguggacaguccuggga

SEQ ID NO: 2135733 - RNA, 15 nt, Human
ccuguaaucccagcu

SEQ ID NO: 2135734 - RNA, 16 nt, Human
ccuguaaucccagcua

SEQ ID NO: 2135735 - RNA, 18 nt, Human
ccuguaaucccagcuacu

SEQ ID NO: 2135736 - RNA, 23 nt, Human
ccuguaaucccagcuacucagga

SEQ ID NO: 2135737 - RNA, 21 nt, Human
ccuguacaaaagggacaugaa

SEQ ID NO: 2135738 - RNA, 15 nt, Human
ccuguacaauauuua

SEQ ID NO: 2135739 - RNA, 21 nt, Human
ccuguacaauauuuaaaauuu

SEQ ID NO: 2135740 - RNA, 21 nt, Human
ccuguacacugaauauuuaua

SEQ ID NO: 2135741 - RNA, 20 nt, Human
ccuguaauccuagcacuuug

SEQ ID NO: 2135742 - RNA, 23 nt, Human
ccuguaaucccagcacuuuggga

SEQ ID NO: 2135743 - RNA, 16 nt, Human
ccuguaaucccagcag

SEQ ID NO: 2135744 - RNA, 18 nt, Human
ccugugacuucagcucug

SEQ ID NO: 2135745 - RNA, 13 nt, Human
ccuguccuccucg

SEQ ID NO: 2135746 - RNA, 14 nt, Human
ccuguccuccucgg

SEQ ID NO: 2135747 - RNA, 15 nt, Human
ccuguccuccucgga

SEQ ID NO: 2135748 - RNA, 23 nt, Human
ccuguccuccucggaucaccgag

SEQ ID NO: 2135749 - RNA, 15 nt, Human
ccuguccucagcuuc

SEQ ID NO: 2135750 - RNA, 13 nt, Human
ccugugagccagu

SEQ ID NO: 2135751 - RNA, 14 nt, Human
ccugugagccaguc

SEQ ID NO: 2135752 - RNA, 15 nt, Human
ccugugagccagucu

SEQ ID NO: 2135753 - RNA, 16 nt, Human
ccugugagccagucua

SEQ ID NO: 2135754 - RNA, 23 nt, Human
ccugugagccagucuaguuccug

SEQ ID NO: 2135755 - RNA, 13 nt, Human
ccugugaggcagg

SEQ ID NO: 2135756 - RNA, 14 nt, Human
ccugugaggcaggg

SEQ ID NO: 2135757 - RNA, 22 nt, Human
ccugucccccugagaucagagu

SEQ ID NO: 2135758 - RNA, 23 nt, Human
ccugucccccugagaucagaguc

SEQ ID NO: 2135759 - RNA, 14 nt, Human
ccugucaccaagcu

SEQ ID NO: 2135760 - RNA, 19 nt, Human
ccuguccaaacugccuaag

SEQ ID NO: 2135761 - RNA, 23 nt, Human
ccuguccaaacugccuaagcccu

SEQ ID NO: 2135762 - RNA, 12 nt, Human
ccuguccaaccu

SEQ ID NO: 2135763 - RNA, 19 nt, Human
ccuguccaaccuaaccccu

SEQ ID NO: 2135764 - RNA, 23 nt, Human
ccuguccaaccuaaccccuuucc

SEQ ID NO: 2135765 - RNA, 22 nt, Human
ccuguccagccugggcagccag

SEQ ID NO: 2135766 - RNA, 22 nt, Human
ccuguccacccccgccucccuc

SEQ ID NO: 2135767 - RNA, 13 nt, Human
ccuguccagagag

SEQ ID NO: 2135768 - RNA, 12 nt, Human
ccuguccagccu

SEQ ID NO: 2135769 - RNA, 14 nt, Human
ccuguccagccugg

SEQ ID NO: 2135770 - RNA, 16 nt, Human
ccuguccagccugggc

SEQ ID NO: 2135771 - RNA, 19 nt, Human
ccugugccacccaccaggg

SEQ ID NO: 2135772 - RNA, 21 nt, Human
ccugugccacccaccagggcg

SEQ ID NO: 2135773 - RNA, 19 nt, Human
ccugugccucugggacugg

SEQ ID NO: 2135774 - RNA, 22 nt, Human
ccugugcugcccgucuucagcc

SEQ ID NO: 2135775 - RNA, 15 nt, Human
ccugugccucuggga

SEQ ID NO: 2135776 - RNA, 17 nt, Human
ccugugccucugggacu

SEQ ID NO: 2135777 - RNA, 23 nt, Human
ccugugaggugcagagugcccag

SEQ ID NO: 2135778 - RNA, 17 nt, Human
ccugugaggcaggggcg

SEQ ID NO: 2135779 - RNA, 19 nt, Human
ccugugaggugcagagugc

SEQ ID NO: 2135780 - RNA, 14 nt, Human
ccuggccaggagcu

SEQ ID NO: 2135781 - RNA, 15 nt, Human
ccuggccaggagcuc

SEQ ID NO: 2135782 - RNA, 16 nt, Human
ccuggccaggagcucu

SEQ ID NO: 2135783 - RNA, 18 nt, Human
ccuggccaggagcucuuc

SEQ ID NO: 2135784 - RNA, 19 nt, Human
ccuggccaggagcucuuca

SEQ ID NO: 2135785 - RNA, 20 nt, Human
ccuggccaggagcucuucag

SEQ ID NO: 2135786 - RNA, 21 nt, Human
ccuggccaggagcucuucagg

SEQ ID NO: 2135787 - RNA, 22 nt, Human
ccuggccaggagcucuucaggc

SEQ ID NO: 2135788 - RNA, 12 nt, Human
ccuggcccccag

SEQ ID NO: 2135789 - RNA, 14 nt, Human
ccuggcccccagcu

SEQ ID NO: 2135790 - RNA, 15 nt, Human
ccuggccccaugucu

SEQ ID NO: 2135791 - RNA, 17 nt, Human
ccuggccccaugucucu

SEQ ID NO: 2135792 - RNA, 18 nt, Human
ccuggccccaugucucuc

SEQ ID NO: 2135793 - RNA, 20 nt, Human
ccuggccccaugucucucag

SEQ ID NO: 2135794 - RNA, 21 nt, Human
ccuggccccaugucucucaga

SEQ ID NO: 2135795 - RNA, 14 nt, Human
ccuggccccauguc

SEQ ID NO: 2135796 - RNA, 14 nt, Human
ccuggccaggcaga

SEQ ID NO: 2135797 - RNA, 22 nt, Human
ccuggccaggcagaucugugcc

SEQ ID NO: 2135798 - RNA, 23 nt, Human
ccuggcuacagggcgagacucug

SEQ ID NO: 2135799 - RNA, 16 nt, Human
ccuggcucucagaagg

SEQ ID NO: 2135800 - RNA, 11 nt, Human
ccuggcucuga

SEQ ID NO: 2135801 - RNA, 20 nt, Human
ccuggcucugaccgaaacag

SEQ ID NO: 2135802 - RNA, 17 nt, Human
ccuggcucuguggcuug

SEQ ID NO: 2135803 - RNA, 20 nt, Human
ccuggcucuguggcuugcua

SEQ ID NO: 2135804 - RNA, 20 nt, Human
ccugggauguccacagaugc

SEQ ID NO: 2135805 - RNA, 22 nt, Human
ccugggauguccacagaugccu

SEQ ID NO: 2135806 - RNA, 15 nt, Human
ccugggcaccugggg

SEQ ID NO: 2135807 - RNA, 20 nt, Human
ccugggcaccuggggagugg

SEQ ID NO: 2135808 - RNA, 20 nt, Human
ccugggaggucaaggcugca

SEQ ID NO: 2135809 - RNA, 12 nt, Human
ccuggcucagcc

SEQ ID NO: 2135810 - RNA, 14 nt, Human
ccuggcagaacuga

SEQ ID NO: 2135811 - RNA, 13 nt, Human
ccuggcagaacug

SEQ ID NO: 2135812 - RNA, 19 nt, Human
ccuggcagccgugccuuca

SEQ ID NO: 2135813 - RNA, 18 nt, Human
ccuggcagccgugccuuc

SEQ ID NO: 2135814 - RNA, 12 nt, Human
ccuggcagccgu

SEQ ID NO: 2135815 - RNA, 13 nt, Human
ccuggagccccac

SEQ ID NO: 2135816 - RNA, 17 nt, Human
ccuggagccccacugcc

SEQ ID NO: 2135817 - RNA, 18 nt, Human
ccuggagccccacugccc

SEQ ID NO: 2135818 - RNA, 15 nt, Human
ccuggagauggggag

SEQ ID NO: 2135819 - RNA, 16 nt, Human
ccuggagauggggaga

SEQ ID NO: 2135820 - RNA, 17 nt, Human
ccuggacugguggcccc

SEQ ID NO: 2135821 - RNA, 22 nt, Human
ccuggacugguggccccugccu

SEQ ID NO: 2135822 - RNA, 14 nt, Human
ccuggaccaaagcu

SEQ ID NO: 2135823 - RNA, 15 nt, Human
ccuggaccaaagcug

SEQ ID NO: 2135824 - RNA, 16 nt, Human
ccuggaccaaagcuga

SEQ ID NO: 2135825 - RNA, 16 nt, Human
ccuggaccagaugcug

SEQ ID NO: 2135826 - RNA, 23 nt, Human
ccuggaaaggcucagucucagga

SEQ ID NO: 2135827 - RNA, 15 nt, Human
ccuggaaaggcucag

SEQ ID NO: 2135828 - RNA, 17 nt, Human
ccuggaaaggcucaguc

SEQ ID NO: 2135829 - RNA, 20 nt, Human
ccuggaaaggcucagucuca

SEQ ID NO: 2135830 - RNA, 21 nt, Human
ccuggaaaggcucagucucag

SEQ ID NO: 2135831 - RNA, 22 nt, Human
ccuggaaaggcucagucucagg

SEQ ID NO: 2135832 - RNA, 15 nt, Human
ccuggacucauugcu

SEQ ID NO: 2135833 - RNA, 16 nt, Human
ccuggacucauugcuu

SEQ ID NO: 2135834 - RNA, 13 nt, Human
ccuggacccugug

SEQ ID NO: 2135835 - RNA, 14 nt, Human
ccuggacccugugg

SEQ ID NO: 2135836 - RNA, 19 nt, Human
ccugcugguucaggguugg

SEQ ID NO: 2135837 - RNA, 18 nt, Human
ccugcucccccacccccu

SEQ ID NO: 2135838 - RNA, 23 nt, Human
ccugcucccccacccccucccca

SEQ ID NO: 2135839 - RNA, 14 nt, Human
ccugcucccccacc

SEQ ID NO: 2135840 - RNA, 16 nt, Human
ccugcucccccacccc

SEQ ID NO: 2135841 - RNA, 12 nt, Human
ccugcuggucaa

SEQ ID NO: 2135842 - RNA, 13 nt, Human
ccugcugguucag

SEQ ID NO: 2135843 - RNA, 21 nt, Human
ccugcuuuagaauguuuuccu

SEQ ID NO: 2135844 - RNA, 23 nt, Human
ccugcuuuagaauguuuuccuuc

SEQ ID NO: 2135845 - RNA, 15 nt, Human
ccugcuugucccugc

SEQ ID NO: 2135846 - RNA, 18 nt, Human
ccugcuugucccugccca

SEQ ID NO: 2135847 - RNA, 22 nt, Human
ccugcuuucaagaccccugucu

SEQ ID NO: 2135848 - RNA, 17 nt, Human
ccugcuuugggcugccc

SEQ ID NO: 2135849 - RNA, 18 nt, Human
ccugcuuugggcugcccu

SEQ ID NO: 2135850 - RNA, 22 nt, Human
ccugcguuuuggaagcucugaa

SEQ ID NO: 2135851 - RNA, 13 nt, Human
ccugcguggcuga

SEQ ID NO: 2135852 - RNA, 16 nt, Human
ccugcguggcugaccc

SEQ ID NO: 2135853 - RNA, 17 nt, Human
ccugcguggcugacccc

SEQ ID NO: 2135854 - RNA, 19 nt, Human
ccugcguggcugacccccc

SEQ ID NO: 2135855 - RNA, 23 nt, Human
ccugcguggcugaccccccucag

SEQ ID NO: 2135856 - RNA, 17 nt, Human
ccugcuaauuccccaga

SEQ ID NO: 2135857 - RNA, 12 nt, Human
ccugcuccagcu

SEQ ID NO: 2135858 - RNA, 13 nt, Human
ccugcuccagcug

SEQ ID NO: 2135859 - RNA, 14 nt, Human
ccugcuccagcugu

SEQ ID NO: 2135860 - RNA, 22 nt, Human
ccugcuccagcuguucagcugg

SEQ ID NO: 2135861 - RNA, 23 nt, Human
ccugcgucucauacucaccucac

SEQ ID NO: 2135862 - RNA, 13 nt, Human
ccuccugggcuaa

SEQ ID NO: 2135863 - RNA, 22 nt, Human
ccuccugugugugcgccuacag

SEQ ID NO: 2135864 - RNA, 15 nt, Human
ccuccugugugugcg

SEQ ID NO: 2135865 - RNA, 13 nt, Human
ccuccugugugug

SEQ ID NO: 2135866 - RNA, 12 nt, Human
ccuccucugcca

SEQ ID NO: 2135867 - RNA, 13 nt, Human
ccuccucugccac

SEQ ID NO: 2135868 - RNA, 14 nt, Human
ccuccucugccacc

SEQ ID NO: 2135869 - RNA, 15 nt, Human
ccuccucugccaccu

SEQ ID NO: 2135870 - RNA, 18 nt, Human
ccuccucugccaccuccc

SEQ ID NO: 2135871 - RNA, 20 nt, Human
ccuccucugccaccuccccu

SEQ ID NO: 2135872 - RNA, 12 nt, Human
ccuccugcccac

SEQ ID NO: 2135873 - RNA, 14 nt, Human
ccuccugcccaccu

SEQ ID NO: 2135874 - RNA, 17 nt, Human
ccuccugcccaccuguc

SEQ ID NO: 2135875 - RNA, 12 nt, Human
ccuccugcccag

SEQ ID NO: 2135876 - RNA, 13 nt, Human
ccuccugcccagg

SEQ ID NO: 2135877 - RNA, 21 nt, Human
ccuccucugccaccuccccua

SEQ ID NO: 2135878 - RNA, 13 nt, Human
ccuccugccucga

SEQ ID NO: 2135879 - RNA, 14 nt, Human
ccuccugcccagga

SEQ ID NO: 2135880 - RNA, 15 nt, Human
ccuccugcccaggag

SEQ ID NO: 2135881 - RNA, 16 nt, Human
ccuccugcccaggaga

SEQ ID NO: 2135882 - RNA, 19 nt, Human
ccuccugcccaggagagcc

SEQ ID NO: 2135883 - RNA, 21 nt, Human
ccuccugcccaggagagccag

SEQ ID NO: 2135884 - RNA, 23 nt, Human
ccuccugcccaggagagccagcc

SEQ ID NO: 2135885 - RNA, 13 nt, Human
ccucccggugccc

SEQ ID NO: 2135886 - RNA, 22 nt, Human
ccucagacucauacagaaggug

SEQ ID NO: 2135887 - RNA, 20 nt, Human
ccuccccuccuugccuccug

SEQ ID NO: 2135888 - RNA, 16 nt, Human
ccucccggugcccaag

SEQ ID NO: 2135889 - RNA, 13 nt, Human
ccucccuaccuca

SEQ ID NO: 2135890 - RNA, 15 nt, Human
ccucccuaccucaac

SEQ ID NO: 2135891 - RNA, 16 nt, Human
ccucccuaccucaacc

SEQ ID NO: 2135892 - RNA, 18 nt, Human
ccucccuaccucaaccug

SEQ ID NO: 2135893 - RNA, 19 nt, Human
ccucccuaccucaaccugu

SEQ ID NO: 2135894 - RNA, 22 nt, Human
ccucccuaccucaaccuguaaa

SEQ ID NO: 2135895 - RNA, 13 nt, Human
ccucccucccucu

SEQ ID NO: 2135896 - RNA, 15 nt, Human
ccucccucccucuuu

SEQ ID NO: 2135897 - RNA, 16 nt, Human
ccucccucccucuuuc

SEQ ID NO: 2135898 - RNA, 16 nt, Human
ccucccuccucugucc

SEQ ID NO: 2135899 - RNA, 20 nt, Human
ccucccugaaccaucccuga

SEQ ID NO: 2135900 - RNA, 15 nt, Human
ccucccugacccugc

SEQ ID NO: 2135901 - RNA, 17 nt, Human
ccucccugacccugcag

SEQ ID NO: 2135902 - RNA, 22 nt, Human
ccucccugacccugcagagaug

SEQ ID NO: 2135903 - RNA, 20 nt, Human
ccucccugaaaauguuuuuc

SEQ ID NO: 2135904 - RNA, 13 nt, Human
ccucccuccucug

SEQ ID NO: 2135905 - RNA, 13 nt, Human
ccucccugaacca

SEQ ID NO: 2135906 - RNA, 14 nt, Human
ccucccugauguac

SEQ ID NO: 2135907 - RNA, 18 nt, Human
ccucagggcagccugccu

SEQ ID NO: 2135908 - RNA, 19 nt, Human
ccucagggcagccugccug

SEQ ID NO: 2135909 - RNA, 20 nt, Human
ccucagggcagccugccugg

SEQ ID NO: 2135910 - RNA, 23 nt, Human
ccucagggcagccugccuggagu

SEQ ID NO: 2135911 - RNA, 14 nt, Human
ccucagcauccugg

SEQ ID NO: 2135912 - RNA, 10 nt, Human
ccucagacug

SEQ ID NO: 2135913 - RNA, 17 nt, Human
ccucagcauccuggcac

SEQ ID NO: 2135914 - RNA, 16 nt, Human
ccucagcauccuggca

SEQ ID NO: 2135915 - RNA, 19 nt, Human
ccucaggugauccacccac

SEQ ID NO: 2135916 - RNA, 17 nt, Human
ccucaggugauccaccc

SEQ ID NO: 2135917 - RNA, 22 nt, Human
ccucaggugauccacccaccuc

SEQ ID NO: 2135918 - RNA, 19 nt, Human
ccucaggucagggugagga

SEQ ID NO: 2135919 - RNA, 16 nt, Human
ccucaggugagaagca

SEQ ID NO: 2135920 - RNA, 15 nt, Human
ccucagucuggcccu

SEQ ID NO: 2135921 - RNA, 20 nt, Human
ccucaggucagggugaggau

SEQ ID NO: 2135922 - RNA, 19 nt, Human
ccucagguuugccugaggg

SEQ ID NO: 2135923 - RNA, 17 nt, Human
ccucuccugccuacuca

SEQ ID NO: 2135924 - RNA, 14 nt, Human
ccucuccugccuac

SEQ ID NO: 2135925 - RNA, 15 nt, Human
ccucuccugccuacu

SEQ ID NO: 2135926 - RNA, 16 nt, Human
ccucuccugccuacuc

SEQ ID NO: 2135927 - RNA, 16 nt, Human
ccucugacacacagcu

SEQ ID NO: 2135928 - RNA, 23 nt, Human
ccucugaaaaccaauguucucuc

SEQ ID NO: 2135929 - RNA, 20 nt, Human
ccucucuuauagaauauuua

SEQ ID NO: 2135930 - RNA, 14 nt, Human
ccucucuuccuauc

SEQ ID NO: 2135931 - RNA, 16 nt, Human
ccucucuuccuauccc

SEQ ID NO: 2135932 - RNA, 17 nt, Human
ccucucuuccuauccca

SEQ ID NO: 2135933 - RNA, 19 nt, Human
ccucucuuccuaucccauc

SEQ ID NO: 2135934 - RNA, 21 nt, Human
ccucucuuccuaucccauccc

SEQ ID NO: 2135935 - RNA, 22 nt, Human
ccucucuuccuaucccauccca

SEQ ID NO: 2135936 - RNA, 23 nt, Human
ccucucuuccuaucccaucccau

SEQ ID NO: 2135937 - RNA, 18 nt, Human
ccucucuugguuuccuuc

SEQ ID NO: 2135938 - RNA, 19 nt, Human
ccucucuugguuuccuucc

SEQ ID NO: 2135939 - RNA, 21 nt, Human
ccucucuugguuuccuuccuu

SEQ ID NO: 2135940 - RNA, 16 nt, Human
ccucuccacugccuuc

SEQ ID NO: 2135941 - RNA, 14 nt, Human
ccucuccacugccu

SEQ ID NO: 2135942 - RNA, 13 nt, Human
ccucuccacugcc

SEQ ID NO: 2135943 - RNA, 12 nt, Human
ccucuccacugc

SEQ ID NO: 2135944 - RNA, 19 nt, Human
ccucuccacugccuucgau

SEQ ID NO: 2135945 - RNA, 12 nt, Human
ccucucccauca

SEQ ID NO: 2135946 - RNA, 12 nt, Human
ccucucccaguu

SEQ ID NO: 2135947 - RNA, 13 nt, Human
ccucucccaguug

SEQ ID NO: 2135948 - RNA, 15 nt, Human
ccucucccaguuguc

SEQ ID NO: 2135949 - RNA, 14 nt, Human
ccucucacuguguc

SEQ ID NO: 2135950 - RNA, 14 nt, Human
ccucucaggcaugc

SEQ ID NO: 2135951 - RNA, 20 nt, Human
ccucucaggcaugccugugu

SEQ ID NO: 2135952 - RNA, 21 nt, Human
ccucucaggcaugccugugug

SEQ ID NO: 2135953 - RNA, 23 nt, Human
ccuccugugugugcgccuacagg

SEQ ID NO: 2135954 - RNA, 17 nt, Human
ccuccuguguagcuggg

SEQ ID NO: 2135955 - RNA, 17 nt, Human
ccucuggcccugccuuc

SEQ ID NO: 2135956 - RNA, 24 nt, Human
ccucuggcuagaggccagccccac

SEQ ID NO: 2135957 - RNA, 22 nt, Human
ccucuggcuggcuaacuggaag

SEQ ID NO: 2135958 - RNA, 23 nt, Human
ccucuggcuggcuaacuggaagc

SEQ ID NO: 2135959 - RNA, 18 nt, Human
ccucuggauugugggaau

SEQ ID NO: 2135960 - RNA, 12 nt, Human
ccucuggccagg

SEQ ID NO: 2135961 - RNA, 15 nt, Human
ccucuggccaggaug

SEQ ID NO: 2135962 - RNA, 12 nt, Human
ccucuggcccug

SEQ ID NO: 2135963 - RNA, 13 nt, Human
ccucuggcccugc

SEQ ID NO: 2135964 - RNA, 15 nt, Human
ccucuggcccugccu

SEQ ID NO: 2135965 - RNA, 18 nt, Human
ccucuggcccugccuucu

SEQ ID NO: 2135966 - RNA, 12 nt, Human
ccucuggcuaga

SEQ ID NO: 2135967 - RNA, 13 nt, Human
ccucuggcuagag

SEQ ID NO: 2135968 - RNA, 22 nt, Human
ccucuggcuagaggccagcccc

SEQ ID NO: 2135969 - RNA, 23 nt, Human
ccucuggcuagaggccagcccca

SEQ ID NO: 2135970 - RNA, 15 nt, Human
ccucugggccuccuc

SEQ ID NO: 2135971 - RNA, 17 nt, Human
ccucugggccuccucua

SEQ ID NO: 2135972 - RNA, 10 nt, Human
ccucugggcu

SEQ ID NO: 2135973 - RNA, 11 nt, Human
ccucugggcuu

SEQ ID NO: 2135974 - RNA, 19 nt, Human
ccucugguaaccucuuacu

SEQ ID NO: 2135975 - RNA, 16 nt, Human
ccucugguagacacag

SEQ ID NO: 2135976 - RNA, 12 nt, Human
ccucugggacug

SEQ ID NO: 2135977 - RNA, 16 nt, Human
ccucugggcaggaccu

SEQ ID NO: 2135978 - RNA, 18 nt, Human
ccucuggacuggcuagag

SEQ ID NO: 2135979 - RNA, 15 nt, Human
ccucuggaggccucu

SEQ ID NO: 2135980 - RNA, 16 nt, Human
ccucuggaggccucug

SEQ ID NO: 2135981 - RNA, 18 nt, Human
ccucuggaggccucuggg

SEQ ID NO: 2135982 - RNA, 19 nt, Human
ccucuggaggccucugggc

SEQ ID NO: 2135983 - RNA, 20 nt, Human
ccucuggaggccucugggcc

SEQ ID NO: 2135984 - RNA, 21 nt, Human
ccucuggaggccucugggccu

SEQ ID NO: 2135985 - RNA, 22 nt, Human
ccucuggaggccucugggccuc

SEQ ID NO: 2135986 - RNA, 14 nt, Human
ccucuggacuggcu

SEQ ID NO: 2135987 - RNA, 15 nt, Human
ccucuggacuggcua

SEQ ID NO: 2135988 - RNA, 16 nt, Human
ccucuggacuggcuag

SEQ ID NO: 2135989 - RNA, 17 nt, Human
ccucuggacuggcuaga

SEQ ID NO: 2135990 - RNA, 16 nt, Human
ccucuggaauugcuca

SEQ ID NO: 2135991 - RNA, 12 nt, Human
ccucugccaccu

SEQ ID NO: 2135992 - RNA, 11 nt, Human
ccucugccacc

SEQ ID NO: 2135993 - RNA, 18 nt, Human
ccucugacacacagcucu

SEQ ID NO: 2135994 - RNA, 17 nt, Human
ccucugacacacagcuc

SEQ ID NO: 2135995 - RNA, 11 nt, Human
ccucugcacaa

SEQ ID NO: 2135996 - RNA, 15 nt, Human
ccucugcacaagcug

SEQ ID NO: 2135997 - RNA, 20 nt, Human
ccucugcacaagcugcaccc

SEQ ID NO: 2135998 - RNA, 17 nt, Human
ccucugcacaagcugca

SEQ ID NO: 2135999 - RNA, 19 nt, Human
ccucugcacaagcugcacc

SEQ ID NO: 2136000 - RNA, 14 nt, Human
ccucuuagaaaaac

SEQ ID NO: 2136001 - RNA, 18 nt, Human
ccucuuaaauaaaccuuu

SEQ ID NO: 2136002 - RNA, 17 nt, Human
ccucuuaaauaaaccuu

SEQ ID NO: 2136003 - RNA, 23 nt, Human
ccucuuaaagcugccuguaguua

SEQ ID NO: 2136004 - RNA, 17 nt, Human
ccucuuaaaaaauaaaa

SEQ ID NO: 2136005 - RNA, 18 nt, Human
ccucuuaaaaaauaaaaa

SEQ ID NO: 2136006 - RNA, 19 nt, Human
ccucuuaaaaaauaaaaac

SEQ ID NO: 2136007 - RNA, 17 nt, Human
ccucuuaaagcugccug

SEQ ID NO: 2136008 - RNA, 19 nt, Human
ccucuuaaagcugccugua

SEQ ID NO: 2136009 - RNA, 20 nt, Human
ccucuuaaagcugccuguag

SEQ ID NO: 2136010 - RNA, 21 nt, Human
ccucuuaaagcugccuguagu

SEQ ID NO: 2136011 - RNA, 22 nt, Human
ccucuuaaagcugccuguaguu

SEQ ID NO: 2136012 - RNA, 17 nt, Human
ccucuguccaggcacug

SEQ ID NO: 2136013 - RNA, 14 nt, Human
ccucuguccagggc

SEQ ID NO: 2136014 - RNA, 15 nt, Human
ccucuguccagggcc

SEQ ID NO: 2136015 - RNA, 16 nt, Human
ccucugucauaucuuc

SEQ ID NO: 2136016 - RNA, 19 nt, Human
ccucugucauaucuucaca

SEQ ID NO: 2136017 - RNA, 23 nt, Human
ccucuguauuugaaucagccuac

SEQ ID NO: 2136018 - RNA, 18 nt, Human
ccucuguccagggcccug

SEQ ID NO: 2136019 - RNA, 20 nt, Human
ccucuguccagggcccugag

SEQ ID NO: 2136020 - RNA, 21 nt, Human
ccucuguccagggcccugagc

SEQ ID NO: 2136021 - RNA, 23 nt, Human
ccucuguccagggcccugagcuc

SEQ ID NO: 2136022 - RNA, 19 nt, Human
ccucugguucuucauuuau

SEQ ID NO: 2136023 - RNA, 13 nt, Human
ccugaaugaaaua

SEQ ID NO: 2136024 - RNA, 23 nt, Human
ccugaauguauugaacuuggaaa

SEQ ID NO: 2136025 - RNA, 17 nt, Human
ccugaagucacacagug

SEQ ID NO: 2136026 - RNA, 16 nt, Human
ccugaagucacacagu

SEQ ID NO: 2136027 - RNA, 15 nt, Human
ccugaagucacacag

SEQ ID NO: 2136028 - RNA, 21 nt, Human
ccugaagacucauucuucugu

SEQ ID NO: 2136029 - RNA, 18 nt, Human
ccugaacacuuauugcuu

SEQ ID NO: 2136030 - RNA, 19 nt, Human
ccugaacacuuauugcuuu

SEQ ID NO: 2136031 - RNA, 14 nt, Human
ccugaagaacagua

SEQ ID NO: 2136032 - RNA, 17 nt, Human
ccucuuuuagucauuuu

SEQ ID NO: 2136033 - RNA, 15 nt, Human
ccucuuuguuuuguu

SEQ ID NO: 2136034 - RNA, 19 nt, Human
ccucuuuguuuuguuuuaa

SEQ ID NO: 2136035 - RNA, 20 nt, Human
ccucuuuuuccaucauaauu

SEQ ID NO: 2136036 - RNA, 19 nt, Human
ccucuuccucccucauucc

SEQ ID NO: 2136037 - RNA, 16 nt, Human
ccucuuccucccucau

SEQ ID NO: 2136038 - RNA, 15 nt, Human
ccucuuccucccuca

SEQ ID NO: 2136039 - RNA, 18 nt, Human
ccucuuauguaccucuuu

SEQ ID NO: 2136040 - RNA, 20 nt, Human
ccucuuauguaccucuuuua

SEQ ID NO: 2136041 - RNA, 20 nt, Human
ccucuuccggagauguagca

SEQ ID NO: 2136042 - RNA, 19 nt, Human
ccucuuccggagauguagc

SEQ ID NO: 2136043 - RNA, 16 nt, Human
ccugauguuaaaauuc

SEQ ID NO: 2136044 - RNA, 17 nt, Human
ccugauguuaaaauucc

SEQ ID NO: 2136045 - RNA, 16 nt, Human
ccugaugcucccuccc

SEQ ID NO: 2136046 - RNA, 19 nt, Human
ccugaugcucccuccccug

SEQ ID NO: 2136047 - RNA, 20 nt, Human
ccugaugcucccuccccugc

SEQ ID NO: 2136048 - RNA, 23 nt, Human
ccugaugcucccuccccugcccu

SEQ ID NO: 2136049 - RNA, 14 nt, Human
ccugaugacccagg

SEQ ID NO: 2136050 - RNA, 17 nt, Human
ccugaugacccaggcug

SEQ ID NO: 2136051 - RNA, 19 nt, Human
ccugaugacccaggcugcc

SEQ ID NO: 2136052 - RNA, 21 nt, Human
ccugaugacccaggcugccug

SEQ ID NO: 2136053 - RNA, 13 nt, Human
ccugaugcucccu

SEQ ID NO: 2136054 - RNA, 14 nt, Human
ccugaugcucccuc

SEQ ID NO: 2136055 - RNA, 14 nt, Human
ccugaggcugagac

SEQ ID NO: 2136056 - RNA, 23 nt, Human
ccugaucgccaaccuuuccccca

SEQ ID NO: 2136057 - RNA, 15 nt, Human
ccccagcccugugga

SEQ ID NO: 2136058 - RNA, 13 nt, Human
ccccagcccugug

SEQ ID NO: 2136059 - RNA, 14 nt, Human
ccccagcccugugg

SEQ ID NO: 2136060 - RNA, 12 nt, Human
ccccagcccugu

SEQ ID NO: 2136061 - RNA, 19 nt, Human
ccccagccuaagaugaaga

SEQ ID NO: 2136062 - RNA, 21 nt, Human
ccccagccuaagaugaagagg

SEQ ID NO: 2136063 - RNA, 13 nt, Human
ccccagccucucu

SEQ ID NO: 2136064 - RNA, 16 nt, Human
ccccagccucucuucc

SEQ ID NO: 2136065 - RNA, 21 nt, Human
ccccacugacagccucccacc

SEQ ID NO: 2136066 - RNA, 15 nt, Human
ccccacugacagccu

SEQ ID NO: 2136067 - RNA, 13 nt, Human
ccccaccccuucc

SEQ ID NO: 2136068 - RNA, 15 nt, Human
ccccaccccuucccc

SEQ ID NO: 2136069 - RNA, 17 nt, Human
ccccaccccuuccccac

SEQ ID NO: 2136070 - RNA, 18 nt, Human
ccccaccccuuccccacu

SEQ ID NO: 2136071 - RNA, 22 nt, Human
ccccaccccuuccccacugccu

SEQ ID NO: 2136072 - RNA, 12 nt, Human
ccccacugcagg

SEQ ID NO: 2136073 - RNA, 16 nt, Human
ccccacugcaggcccc

SEQ ID NO: 2136074 - RNA, 18 nt, Human
ccccacugcaggccccgc

SEQ ID NO: 2136075 - RNA, 14 nt, Human
ccccacugcccuuc

SEQ ID NO: 2136076 - RNA, 12 nt, Human
ccccacugccug

SEQ ID NO: 2136077 - RNA, 15 nt, Human
ccccacugccugccc

SEQ ID NO: 2136078 - RNA, 16 nt, Human
ccccacugccugccca

SEQ ID NO: 2136079 - RNA, 17 nt, Human
ccccacugccugcccac

SEQ ID NO: 2136080 - RNA, 12 nt, Human
ccccacuggcug

SEQ ID NO: 2136081 - RNA, 14 nt, Human
ccccacuggcugug

SEQ ID NO: 2136082 - RNA, 20 nt, Human
ccccacuggcugugggcucc

SEQ ID NO: 2136083 - RNA, 21 nt, Human
ccccacuggcugugggcuccc

SEQ ID NO: 2136084 - RNA, 22 nt, Human
ccccacuggcugugggcucccu

SEQ ID NO: 2136085 - RNA, 23 nt, Human
ccccacuggcugugggcucccuu

SEQ ID NO: 2136086 - RNA, 14 nt, Human
ccccacuggggaaa

SEQ ID NO: 2136087 - RNA, 22 nt, Human
ccccacuggggaaauaacagcu

SEQ ID NO: 2136088 - RNA, 12 nt, Human
ccccaggaagcc

SEQ ID NO: 2136089 - RNA, 23 nt, Human
ccccaggaagccgugcccugccc

SEQ ID NO: 2136090 - RNA, 13 nt, Human
ccccagcucugcu

SEQ ID NO: 2136091 - RNA, 14 nt, Human
ccccagcucugcuu

SEQ ID NO: 2136092 - RNA, 16 nt, Human
ccccagcucugcuugc

SEQ ID NO: 2136093 - RNA, 23 nt, Human
cccccaaccaaguggcucccaca

SEQ ID NO: 2136094 - RNA, 13 nt, Human
cccccaagccugc

SEQ ID NO: 2136095 - RNA, 14 nt, Human
cccccaagccugca

SEQ ID NO: 2136096 - RNA, 11 nt, Human
ccccaggcagg

SEQ ID NO: 2136097 - RNA, 14 nt, Human
ccccaggcaggcug

SEQ ID NO: 2136098 - RNA, 18 nt, Human
ccccaggcaggcugugcg

SEQ ID NO: 2136099 - RNA, 23 nt, Human
ccccaggcaggcugugcgcugac

SEQ ID NO: 2136100 - RNA, 12 nt, Human
cccccagcccug

SEQ ID NO: 2136101 - RNA, 14 nt, Human
cccccagcccugug

SEQ ID NO: 2136102 - RNA, 13 nt, Human
cccccagcccugu

SEQ ID NO: 2136103 - RNA, 11 nt, Human
cccccagcugu

SEQ ID NO: 2136104 - RNA, 14 nt, Human
cccccagcuguggg

SEQ ID NO: 2136105 - RNA, 16 nt, Human
cccccaaggggcaguc

SEQ ID NO: 2136106 - RNA, 23 nt, Human
cccccaaggggcagucuggaggg

SEQ ID NO: 2136107 - RNA, 19 nt, Human
cccccauccuccccuuccc

SEQ ID NO: 2136108 - RNA, 16 nt, Human
cccccaggcugcugga

SEQ ID NO: 2136109 - RNA, 12 nt, Human
ccccccacucuc

SEQ ID NO: 2136110 - RNA, 12 nt, Human
ccccccacugca

SEQ ID NO: 2136111 - RNA, 18 nt, Human
ccccccagaaccuguccu

SEQ ID NO: 2136112 - RNA, 11 nt, Human
ccccccacucu

SEQ ID NO: 2136113 - RNA, 21 nt, Human
ccccgucaccaucucaggcca

SEQ ID NO: 2136114 - RNA, 14 nt, Human
ccccgucucuacua

SEQ ID NO: 2136115 - RNA, 10 nt, Human
cccccugggc

SEQ ID NO: 2136116 - RNA, 11 nt, Human
cccccugggcu

SEQ ID NO: 2136117 - RNA, 18 nt, Human
ccccggugugcggugcau

SEQ ID NO: 2136118 - RNA, 19 nt, Human
cccccugccccuucuacac

SEQ ID NO: 2136119 - RNA, 23 nt, Human
cccccugccccuucuacacucuc

SEQ ID NO: 2136120 - RNA, 14 nt, Human
cccccucucccagu

SEQ ID NO: 2136121 - RNA, 12 nt, Human
cccccuccuucc

SEQ ID NO: 2136122 - RNA, 18 nt, Human
cccccuccuucccagcug

SEQ ID NO: 2136123 - RNA, 19 nt, Human
cccccuccuucccagcugc

SEQ ID NO: 2136124 - RNA, 21 nt, Human
cccccuccuucccagcugccc

SEQ ID NO: 2136125 - RNA, 13 nt, Human
cccccgagcuggg

SEQ ID NO: 2136126 - RNA, 15 nt, Human
cccccgagcuggggg

SEQ ID NO: 2136127 - RNA, 11 nt, Human
cccccgccccg

SEQ ID NO: 2136128 - RNA, 18 nt, Human
cccccgccccgccccaca

SEQ ID NO: 2136129 - RNA, 21 nt, Human
cccccgagcugggggccauga

SEQ ID NO: 2136130 - RNA, 22 nt, Human
cccugugguuuccaaggagcug

SEQ ID NO: 2136131 - RNA, 17 nt, Human
cccuguacaauauuuaa

SEQ ID NO: 2136132 - RNA, 18 nt, Human
cccuguacaauauuuaaa

SEQ ID NO: 2136133 - RNA, 20 nt, Human
cccuguccccucccccuucc

SEQ ID NO: 2136134 - RNA, 21 nt, Human
ccccucccccaacccccaccc

SEQ ID NO: 2136135 - RNA, 16 nt, Human
ccccucccccaacccc

SEQ ID NO: 2136136 - RNA, 18 nt, Human
ccccucccccaaccccca

SEQ ID NO: 2136137 - RNA, 19 nt, Human
ccccuccccuaaugccugc

SEQ ID NO: 2136138 - RNA, 15 nt, Human
ccccucccccaaccc

SEQ ID NO: 2136139 - RNA, 15 nt, Human
ccccuccccagggga

SEQ ID NO: 2136140 - RNA, 11 nt, Human
cccccagugug

SEQ ID NO: 2136141 - RNA, 14 nt, Human
ccccucccagggcc

SEQ ID NO: 2136142 - RNA, 19 nt, Human
cccugguggcagugggagc

SEQ ID NO: 2136143 - RNA, 16 nt, Human
cccugguggcaguggg

SEQ ID NO: 2136144 - RNA, 15 nt, Human
cccugguggcagugg

SEQ ID NO: 2136145 - RNA, 21 nt, Human
cccugguggcagugggagcug

SEQ ID NO: 2136146 - RNA, 17 nt, Human
ccccgugggccauggca

SEQ ID NO: 2136147 - RNA, 20 nt, Human
ccccgucugggguucagccc

SEQ ID NO: 2136148 - RNA, 21 nt, Human
ccccgucugggguucagcccc

SEQ ID NO: 2136149 - RNA, 22 nt, Human
ccccgucugggguucagccccu

SEQ ID NO: 2136150 - RNA, 15 nt, Human
ccccgugcagacugg

SEQ ID NO: 2136151 - RNA, 19 nt, Human
ccccgugcagacuggaggg

SEQ ID NO: 2136152 - RNA, 18 nt, Human
ccccuaaugccugcggag

SEQ ID NO: 2136153 - RNA, 12 nt, Human
ccccucccuacc

SEQ ID NO: 2136154 - RNA, 14 nt, Human
ccccucccuaccuc

SEQ ID NO: 2136155 - RNA, 15 nt, Human
ccccucccuaccuca

SEQ ID NO: 2136156 - RNA, 21 nt, Human
ccgaguggauagaugcccugc

SEQ ID NO: 2136157 - RNA, 22 nt, Human
ccgaguggauagaugcccugcu

SEQ ID NO: 2136158 - RNA, 22 nt, Human
ccgagucucuucuccacuggau

SEQ ID NO: 2136159 - RNA, 16 nt, Human
ccgaggguccuggcuc

SEQ ID NO: 2136160 - RNA, 17 nt, Human
ccgaggguccuggcucc

SEQ ID NO: 2136161 - RNA, 21 nt, Human
ccgagucucuucuccacugga

SEQ ID NO: 2136162 - RNA, 14 nt, Human
ccgccccgccccac

SEQ ID NO: 2136163 - RNA, 19 nt, Human
ccgaugcuccagccaaccc

SEQ ID NO: 2136164 - RNA, 22 nt, Human
ccgaugcuccagccaaccccug

SEQ ID NO: 2136165 - RNA, 14 nt, Human
ccgaugcuccagcc

SEQ ID NO: 2136166 - RNA, 15 nt, Human
ccgaugcuccagcca

SEQ ID NO: 2136167 - RNA, 19 nt, Human
ccgcccgagguggcugccu

SEQ ID NO: 2136168 - RNA, 18 nt, Human
ccgagaucacgccacugc

SEQ ID NO: 2136169 - RNA, 13 nt, Human
ccgagagccugcu

SEQ ID NO: 2136170 - RNA, 17 nt, Human
ccgagcccuacuuccag

SEQ ID NO: 2136171 - RNA, 17 nt, Human
ccgaggccuucucugaa

SEQ ID NO: 2136172 - RNA, 17 nt, Human
ccgaggcuggagcuggc

SEQ ID NO: 2136173 - RNA, 14 nt, Human
ccgaggcuggagcu

SEQ ID NO: 2136174 - RNA, 13 nt, Human
ccgagaagaacag

SEQ ID NO: 2136175 - RNA, 13 nt, Human
ccgagaagcaaga

SEQ ID NO: 2136176 - RNA, 17 nt, Human
ccgagaaggaagccucc

SEQ ID NO: 2136177 - RNA, 19 nt, Human
ccgagaagcaagaaagaaa

SEQ ID NO: 2136178 - RNA, 16 nt, Human
cccuuuuguuccccag

SEQ ID NO: 2136179 - RNA, 21 nt, Human
cccuuuuguuccccagcccua

SEQ ID NO: 2136180 - RNA, 20 nt, Human
cccuuuuggguuucugcccu

SEQ ID NO: 2136181 - RNA, 16 nt, Human
cccuuuuuacuccccu

SEQ ID NO: 2136182 - RNA, 23 nt, Human
cccuuuuuacuccccuugagcug

SEQ ID NO: 2136183 - RNA, 18 nt, Human
cccuuuuuacuccccuug

SEQ ID NO: 2136184 - RNA, 16 nt, Human
cccuuuucuacaguua

SEQ ID NO: 2136185 - RNA, 16 nt, Human
cccuuuuggguuucug

SEQ ID NO: 2136186 - RNA, 22 nt, Human
cccuuuuggcccccgagcuggg

SEQ ID NO: 2136187 - RNA, 14 nt, Human
cccuuuuggccccc

SEQ ID NO: 2136188 - RNA, 20 nt, Human
cccuuuuggcccccgagcug

SEQ ID NO: 2136189 - RNA, 13 nt, Human
cccuuugcuccac

SEQ ID NO: 2136190 - RNA, 16 nt, Human
cccuuucuuggccagu

SEQ ID NO: 2136191 - RNA, 16 nt, Human
cccuuugggaggcuga

SEQ ID NO: 2136192 - RNA, 20 nt, Human
cccuuugggaggcugaggcg

SEQ ID NO: 2136193 - RNA, 14 nt, Human
cccuuucuuggcca

SEQ ID NO: 2136194 - RNA, 15 nt, Human
cccuuucuuggccag

SEQ ID NO: 2136195 - RNA, 17 nt, Human
cccuuucuuggccaguu

SEQ ID NO: 2136196 - RNA, 23 nt, Human
cccuugugcgugggugaagccgc

SEQ ID NO: 2136197 - RNA, 13 nt, Human
cccuuuccuucca

SEQ ID NO: 2136198 - RNA, 15 nt, Human
cccuuuccuuccauc

SEQ ID NO: 2136199 - RNA, 18 nt, Human
cccuuuccuuccaucccu

SEQ ID NO: 2136200 - RNA, 18 nt, Human
cccuuuccuuccuucccu

SEQ ID NO: 2136201 - RNA, 21 nt, Human
cccuuuccuuccuucccuggc

SEQ ID NO: 2136202 - RNA, 13 nt, Human
cccuuuccugcgg

SEQ ID NO: 2136203 - RNA, 19 nt, Human
cccuuggccugucucaucc

SEQ ID NO: 2136204 - RNA, 15 nt, Human
cccuuggcucaaucc

SEQ ID NO: 2136205 - RNA, 16 nt, Human
cccuugcagcuaguuu

SEQ ID NO: 2136206 - RNA, 19 nt, Human
cccuugcagcuaguuuucu

SEQ ID NO: 2136207 - RNA, 19 nt, Human
cccuugcaguucagcacca

SEQ ID NO: 2136208 - RNA, 21 nt, Human
cccuugcaguucagcaccacc

SEQ ID NO: 2136209 - RNA, 23 nt, Human
cccuugcaguucagcaccacccu

SEQ ID NO: 2136210 - RNA, 20 nt, Human
cccuuccucuccacugccuu

SEQ ID NO: 2136211 - RNA, 17 nt, Human
cccuuccucuccacugc

SEQ ID NO: 2136212 - RNA, 16 nt, Human
cccuuccucuccacug

SEQ ID NO: 2136213 - RNA, 13 nt, Human
cccuuccucucca

SEQ ID NO: 2136214 - RNA, 17 nt, Human
cccuuaccccuuagccu

SEQ ID NO: 2136215 - RNA, 22 nt, Human
cccuuaccccuuagccucccug

SEQ ID NO: 2136216 - RNA, 19 nt, Human
cccuuaccucggugccuuc

SEQ ID NO: 2136217 - RNA, 12 nt, Human
ccuaccugguaa

SEQ ID NO: 2136218 - RNA, 21 nt, Human
ccuaccugauuggugcaaccc

SEQ ID NO: 2136219 - RNA, 15 nt, Human
ccuaccuucaaagcu

SEQ ID NO: 2136220 - RNA, 16 nt, Human
ccuaccuucaaagcug

SEQ ID NO: 2136221 - RNA, 14 nt, Human
ccuaccccaccacg

SEQ ID NO: 2136222 - RNA, 13 nt, Human
ccuaccccaccac

SEQ ID NO: 2136223 - RNA, 11 nt, Human
ccuaccccacc

SEQ ID NO: 2136224 - RNA, 12 nt, Human
ccuaaagagaua

SEQ ID NO: 2136225 - RNA, 19 nt, Human
ccuaaaguagacuucauuu

SEQ ID NO: 2136226 - RNA, 23 nt, Human
ccguggcuucccgcucagcccuc

SEQ ID NO: 2136227 - RNA, 19 nt, Human
ccgugggcacugaaggcuu

SEQ ID NO: 2136228 - RNA, 15 nt, Human
ccgugggccauggca

SEQ ID NO: 2136229 - RNA, 21 nt, Human
ccguggcuucccgcucagccc

SEQ ID NO: 2136230 - RNA, 15 nt, Human
ccguggcuucccgcu

SEQ ID NO: 2136231 - RNA, 15 nt, Human
ccguggcuuugguuu

SEQ ID NO: 2136232 - RNA, 17 nt, Human
ccgggcacagcuguggu

SEQ ID NO: 2136233 - RNA, 19 nt, Human
ccguuuccagguguuuaua

SEQ ID NO: 2136234 - RNA, 14 nt, Human
ccuaaaaacacaga

SEQ ID NO: 2136235 - RNA, 12 nt, Human
ccuaaaacaaau

SEQ ID NO: 2136236 - RNA, 17 nt, Human
ccgugccuucagcucua

SEQ ID NO: 2136237 - RNA, 16 nt, Human
ccgugccuucagcucu

SEQ ID NO: 2136238 - RNA, 15 nt, Human
ccgugccuucagcuc

SEQ ID NO: 2136239 - RNA, 14 nt, Human
ccgugccuucagcu

SEQ ID NO: 2136240 - RNA, 19 nt, Human
ccgggccuggagaacuaga

SEQ ID NO: 2136241 - RNA, 20 nt, Human
ccgggcacucagaagacacu

SEQ ID NO: 2136242 - RNA, 22 nt, Human
ccggcugcuuuucccuaagcca

SEQ ID NO: 2136243 - RNA, 17 nt, Human
ccggcucuggcucuccc

SEQ ID NO: 2136244 - RNA, 15 nt, Human
ccgggcacucagaag

SEQ ID NO: 2136245 - RNA, 23 nt, Human
ccgcuuucuacccagcgagcccu

SEQ ID NO: 2136246 - RNA, 13 nt, Human
ccggaagcuccug

SEQ ID NO: 2136247 - RNA, 15 nt, Human
ccggaagcuccuggu

SEQ ID NO: 2136248 - RNA, 19 nt, Human
ccggaauccuguccucagc

SEQ ID NO: 2136249 - RNA, 20 nt, Human
ccggaauccuguccucagcu

SEQ ID NO: 2136250 - RNA, 22 nt, Human
ccggaauccuguccucagcuuc

SEQ ID NO: 2136251 - RNA, 15 nt, Human
ccgcuucugccugca

SEQ ID NO: 2136252 - RNA, 18 nt, Human
ccgcuguucacccacagg

SEQ ID NO: 2136253 - RNA, 19 nt, Human
ccgcuguucacccacaggg

SEQ ID NO: 2136254 - RNA, 21 nt, Human
ccgcuguucacccacagggcu

SEQ ID NO: 2136255 - RNA, 14 nt, Human
ccgcuguucaccca

SEQ ID NO: 2136256 - RNA, 15 nt, Human
ccgcuguucacccac

SEQ ID NO: 2136257 - RNA, 16 nt, Human
ccgcuguucacccaca

SEQ ID NO: 2136258 - RNA, 16 nt, Human
ccgcccuguacccucu

SEQ ID NO: 2136259 - RNA, 17 nt, Human
ccuaucagaaguuucuc

SEQ ID NO: 2136260 - RNA, 17 nt, Human
ccuaucaccuccccucc

SEQ ID NO: 2136261 - RNA, 18 nt, Human
ccuaucaccuccccuccu

SEQ ID NO: 2136262 - RNA, 17 nt, Human
ccuauggggauggucca

SEQ ID NO: 2136263 - RNA, 12 nt, Human
ccuauccaccca

SEQ ID NO: 2136264 - RNA, 13 nt, Human
ccuauccacccag

SEQ ID NO: 2136265 - RNA, 14 nt, Human
ccuauccacccagc

SEQ ID NO: 2136266 - RNA, 15 nt, Human
ccuagagcacacugu

SEQ ID NO: 2136267 - RNA, 15 nt, Human
ccuaucaccuccccu

SEQ ID NO: 2136268 - RNA, 16 nt, Human
ccuaucaccuccccuc

SEQ ID NO: 2136269 - RNA, 20 nt, Human
ccucaaugugaaucagaccc

SEQ ID NO: 2136270 - RNA, 21 nt, Human
ccucaaugugaaucagacccu

SEQ ID NO: 2136271 - RNA, 22 nt, Human
ccucaaugugaaucagacccua

SEQ ID NO: 2136272 - RNA, 23 nt, Human
ccucacacacaaugugucugaga

SEQ ID NO: 2136273 - RNA, 22 nt, Human
ccuaugguauaaugguugacug

SEQ ID NO: 2136274 - RNA, 15 nt, Human
ccucaccccacugug

SEQ ID NO: 2136275 - RNA, 16 nt, Human
ccucaccccugcccug

SEQ ID NO: 2136276 - RNA, 17 nt, Human
ccucaccccugcccugg

SEQ ID NO: 2136277 - RNA, 17 nt, Human
ccucaccccgucugggg

SEQ ID NO: 2136278 - RNA, 13 nt, Human
ccucaccccugcc

SEQ ID NO: 2136279 - RNA, 14 nt, Human
ccucaccccugccc

SEQ ID NO: 2136280 - RNA, 16 nt, Human
ccucaccccgucuggg

SEQ ID NO: 2136281 - RNA, 12 nt, Human
ccucaccccacu

SEQ ID NO: 2136282 - RNA, 14 nt, Human
ccucacgcaccucc

SEQ ID NO: 2136283 - RNA, 22 nt, Human
ccucaccuugcaacacacagac

SEQ ID NO: 2136284 - RNA, 17 nt, Human
ccucacgcaccucccau

SEQ ID NO: 2136285 - RNA, 17 nt, Human
ccucaccuuucccaucu

SEQ ID NO: 2136286 - RNA, 19 nt, Human
ccucaccuugcaacacaca

SEQ ID NO: 2136287 - RNA, 21 nt, Human
ccucaccuugcaacacacaga

SEQ ID NO: 2136288 - RNA, 18 nt, Human
ccucaccugggcaccugg

SEQ ID NO: 2136289 - RNA, 19 nt, Human
ccucaccugggcaccuggg

SEQ ID NO: 2136290 - RNA, 22 nt, Human
ccucaccugggcaccuggggag

SEQ ID NO: 2136291 - RNA, 17 nt, Human
ccucaccuugcaacaca

SEQ ID NO: 2136292 - RNA, 18 nt, Human
ccucaccuugcaacacac

SEQ ID NO: 2136293 - RNA, 18 nt, Human
ccucaccccugcccuggg

SEQ ID NO: 2136294 - RNA, 19 nt, Human
ccucacccgaggcugccca

SEQ ID NO: 2136295 - RNA, 21 nt, Human
ccucacccgaggcugcccacu

SEQ ID NO: 2136296 - RNA, 17 nt, Human
ccucaccucugccauuu

SEQ ID NO: 2136297 - RNA, 12 nt, Human
ccucaccucugg

SEQ ID NO: 2136298 - RNA, 13 nt, Human
ccucaccucugga

SEQ ID NO: 2136299 - RNA, 18 nt, Human
ccucaccucuggacuggc

SEQ ID NO: 2136300 - RNA, 20 nt, Human
ccucaccucuggacuggcua

SEQ ID NO: 2136301 - RNA, 22 nt, Human
ccucaccucuggacuggcuaga

SEQ ID NO: 2136302 - RNA, 14 nt, Human
ccucaccugggcac

SEQ ID NO: 2136303 - RNA, 18 nt, Human
cuggucucaaacuccuga

SEQ ID NO: 2136304 - RNA, 14 nt, Human
cuggugcugcugcu

SEQ ID NO: 2136305 - RNA, 20 nt, Human
cuggugcuggauauuuucaa

SEQ ID NO: 2136306 - RNA, 12 nt, Human
cugguggacagu

SEQ ID NO: 2136307 - RNA, 23 nt, Human
cugguggcagugggagcugccug

SEQ ID NO: 2136308 - RNA, 19 nt, Human
cugguggcagugggagcug

SEQ ID NO: 2136309 - RNA, 19 nt, Human
cugguggacaguccuggga

SEQ ID NO: 2136310 - RNA, 21 nt, Human
cugguggacaguccugggaga

SEQ ID NO: 2136311 - RNA, 15 nt, Human
cugguggacaguccu

SEQ ID NO: 2136312 - RNA, 16 nt, Human
cugguggacaguccug

SEQ ID NO: 2136313 - RNA, 17 nt, Human
cugguggacaguccugg

SEQ ID NO: 2136314 - RNA, 18 nt, Human
cugguggacaguccuggg

SEQ ID NO: 2136315 - RNA, 17 nt, Human
cuggugggugaaagaaa

SEQ ID NO: 2136316 - RNA, 19 nt, Human
cuggugggugaaagaaauc

SEQ ID NO: 2136317 - RNA, 20 nt, Human
cuggugggugaaagaaauca

SEQ ID NO: 2136318 - RNA, 22 nt, Human
cuggugggugaaagaaaucaug

SEQ ID NO: 2136319 - RNA, 12 nt, Human
cuggugggccuc

SEQ ID NO: 2136320 - RNA, 17 nt, Human
cuggugggcaccaagag

SEQ ID NO: 2136321 - RNA, 21 nt, Human
cuggugggcaccaagagccaa

SEQ ID NO: 2136322 - RNA, 22 nt, Human
cuggugggcaccaagagccaau

SEQ ID NO: 2136323 - RNA, 17 nt, Human
cuggugggccuccucug

SEQ ID NO: 2136324 - RNA, 15 nt, Human
cugguggccccugcc

SEQ ID NO: 2136325 - RNA, 16 nt, Human
cugguggccccugccu

SEQ ID NO: 2136326 - RNA, 24 nt, Human
cuggugggaucugugcccagagau

SEQ ID NO: 2136327 - RNA, 19 nt, Human
cugguccuuccaggccccc

SEQ ID NO: 2136328 - RNA, 16 nt, Human
cugguccuuccaggcc

SEQ ID NO: 2136329 - RNA, 17 nt, Human
cugguccuuccaggccc

SEQ ID NO: 2136330 - RNA, 18 nt, Human
cuggucccacucagucca

SEQ ID NO: 2136331 - RNA, 15 nt, Human
cuggucccacucagu

SEQ ID NO: 2136332 - RNA, 15 nt, Human
cuggguucugggugg

SEQ ID NO: 2136333 - RNA, 16 nt, Human
cuggguucuggguggu

SEQ ID NO: 2136334 - RNA, 18 nt, Human
cuggguuggaaaacagua

SEQ ID NO: 2136335 - RNA, 13 nt, Human
cuggguuggaaaa

SEQ ID NO: 2136336 - RNA, 13 nt, Human
cuggguuggaggg

SEQ ID NO: 2136337 - RNA, 20 nt, Human
cugggggccaugagcuccag

SEQ ID NO: 2136338 - RNA, 13 nt, Human
cugggcucaagca

SEQ ID NO: 2136339 - RNA, 23 nt, Human
cugggcuucaguggcagcugcuu

SEQ ID NO: 2136340 - RNA, 22 nt, Human
cugggcuucaguggcagcugcu

SEQ ID NO: 2136341 - RNA, 21 nt, Human
cugggcuucaguggcagcugc

SEQ ID NO: 2136342 - RNA, 20 nt, Human
cugggcuucaguggcagcug

SEQ ID NO: 2136343 - RNA, 19 nt, Human
cugggcuucaguggcagcu

SEQ ID NO: 2136344 - RNA, 17 nt, Human
cugggcuucaguggcag

SEQ ID NO: 2136345 - RNA, 18 nt, Human
cugggcuucaguggcagc

SEQ ID NO: 2136346 - RNA, 23 nt, Human
cugggcguaguggcucacaccug

SEQ ID NO: 2136347 - RNA, 24 nt, Human
cugggcucaagcaauccuccugag

SEQ ID NO: 2136348 - RNA, 17 nt, Human
cugggcucaagcagucu

SEQ ID NO: 2136349 - RNA, 13 nt, Human
cugggcgacagag

SEQ ID NO: 2136350 - RNA, 18 nt, Human
cugggggccucagugcca

SEQ ID NO: 2136351 - RNA, 22 nt, Human
cugggggccaugagcuccagac

SEQ ID NO: 2136352 - RNA, 23 nt, Human
cugggggccaugagcuccagacc

SEQ ID NO: 2136353 - RNA, 12 nt, Human
cugggggccuca

SEQ ID NO: 2136354 - RNA, 13 nt, Human
cugggggccucac

SEQ ID NO: 2136355 - RNA, 14 nt, Human
cugggggccucacu

SEQ ID NO: 2136356 - RNA, 16 nt, Human
cugggggccucacucc

SEQ ID NO: 2136357 - RNA, 17 nt, Human
cugggggccucagugcc

SEQ ID NO: 2136358 - RNA, 13 nt, Human
cugggggccucag

SEQ ID NO: 2136359 - RNA, 20 nt, Human
cuggguacuuguggacacag

SEQ ID NO: 2136360 - RNA, 23 nt, Human
cuggguacuuguggacacagcuc

SEQ ID NO: 2136361 - RNA, 21 nt, Human
cuggguacuuguggacacagc

SEQ ID NO: 2136362 - RNA, 12 nt, Human
cugggccccucc

SEQ ID NO: 2136363 - RNA, 16 nt, Human
cugggccccucccuac

SEQ ID NO: 2136364 - RNA, 19 nt, Human
cugggccccucccuaccuc

SEQ ID NO: 2136365 - RNA, 20 nt, Human
cugggccccucccuaccuca

SEQ ID NO: 2136366 - RNA, 22 nt, Human
cugggccccucccuaccucaac

SEQ ID NO: 2136367 - RNA, 20 nt, Human
cugggcaaugugauaaaacc

SEQ ID NO: 2136368 - RNA, 15 nt, Human
cugggauagaggggu

SEQ ID NO: 2136369 - RNA, 12 nt, Human
cugggagugagc

SEQ ID NO: 2136370 - RNA, 13 nt, Human
cugggagugagcu

SEQ ID NO: 2136371 - RNA, 16 nt, Human
cugggagugagcuggu

SEQ ID NO: 2136372 - RNA, 20 nt, Human
cugggagggcccacuucagg

SEQ ID NO: 2136373 - RNA, 22 nt, Human
cugggagggguuuucgaagcuc

SEQ ID NO: 2136374 - RNA, 13 nt, Human
cugggagggccca

SEQ ID NO: 2136375 - RNA, 23 nt, Human
cugggagggauagaggggggcug

SEQ ID NO: 2136376 - RNA, 18 nt, Human
cugggaggucaaggcugc

SEQ ID NO: 2136377 - RNA, 15 nt, Human
cugggaggaagcagg

SEQ ID NO: 2136378 - RNA, 13 nt, Human
cugggaggaagca

SEQ ID NO: 2136379 - RNA, 14 nt, Human
cugggaggaagcag

SEQ ID NO: 2136380 - RNA, 23 nt, Human
cugggaaauggcuugaagccaag

SEQ ID NO: 2136381 - RNA, 19 nt, Human
cugggaaccuuccugucuu

SEQ ID NO: 2136382 - RNA, 18 nt, Human
cugggaacucccaagaac

SEQ ID NO: 2136383 - RNA, 19 nt, Human
cugggaacucccaagaaca

SEQ ID NO: 2136384 - RNA, 21 nt, Human
cugggaacucccaagaacagc

SEQ ID NO: 2136385 - RNA, 23 nt, Human
cugggaacucccaagaacagcag

SEQ ID NO: 2136386 - RNA, 17 nt, Human
cugggaagauaggcucu

SEQ ID NO: 2136387 - RNA, 13 nt, Human
cugggagcucugc

SEQ ID NO: 2136388 - RNA, 19 nt, Human
cugggaaggcuacucaccu

SEQ ID NO: 2136389 - RNA, 20 nt, Human
cugggaaggcuacucaccuu

SEQ ID NO: 2136390 - RNA, 22 nt, Human
cugggaaggcuacucaccuuga

SEQ ID NO: 2136391 - RNA, 24 nt, Human
cugggaagauaggcucugcacaga

SEQ ID NO: 2136392 - RNA, 18 nt, Human
cugggaagauaggcucug

SEQ ID NO: 2136393 - RNA, 20 nt, Human
cugggaagauaggcucugca

SEQ ID NO: 2136394 - RNA, 21 nt, Human
cugggaagauaggcucugcac

SEQ ID NO: 2136395 - RNA, 22 nt, Human
cugggaagauaggcucugcaca

SEQ ID NO: 2136396 - RNA, 15 nt, Human
cugggagcucugcag

SEQ ID NO: 2136397 - RNA, 14 nt, Human
cugggagcucugca

SEQ ID NO: 2136398 - RNA, 12 nt, Human
cugggaaggggu

SEQ ID NO: 2136399 - RNA, 13 nt, Human
cugggaggaaaag

SEQ ID NO: 2136400 - RNA, 22 nt, Human
cugggaggaaaagaaaagaggg

SEQ ID NO: 2136401 - RNA, 14 nt, Human
cuggcugggcaugg

SEQ ID NO: 2136402 - RNA, 15 nt, Human
cuggcugggcaugga

SEQ ID NO: 2136403 - RNA, 17 nt, Human
cuggcugggcauggacg

SEQ ID NO: 2136404 - RNA, 19 nt, Human
cuggcugccuuagaaccuu

SEQ ID NO: 2136405 - RNA, 14 nt, Human
cuggcugccuuaga

SEQ ID NO: 2136406 - RNA, 19 nt, Human
cuggcuguuggcugggggc

SEQ ID NO: 2136407 - RNA, 22 nt, Human
cuggcuggguggcaccagcagc

SEQ ID NO: 2136408 - RNA, 21 nt, Human
cuggcuggguggcaccagcag

SEQ ID NO: 2136409 - RNA, 16 nt, Human
cuggcugggggccuca

SEQ ID NO: 2136410 - RNA, 19 nt, Human
cuggcugggggccucacuc

SEQ ID NO: 2136411 - RNA, 22 nt, Human
cuggcugggggccucacuccag

SEQ ID NO: 2136412 - RNA, 14 nt, Human
cuggcuucacagau

SEQ ID NO: 2136413 - RNA, 20 nt, Human
cuggcuguuggcugggggcc

SEQ ID NO: 2136414 - RNA, 22 nt, Human
cuggcuuuucacugcuggcugc

SEQ ID NO: 2136415 - RNA, 20 nt, Human
cuggcuuuucacugcuggcu

SEQ ID NO: 2136416 - RNA, 19 nt, Human
cuggcuuuucacugcuggc

SEQ ID NO: 2136417 - RNA, 17 nt, Human
cuggcuuuucacugcug

SEQ ID NO: 2136418 - RNA, 16 nt, Human
cugggaaauaagagag

SEQ ID NO: 2136419 - RNA, 17 nt, Human
cugggaaauaagagaga

SEQ ID NO: 2136420 - RNA, 16 nt, Human
cuggcuuuucacugcu

SEQ ID NO: 2136421 - RNA, 15 nt, Human
cuggcuuuucacugc

SEQ ID NO: 2136422 - RNA, 14 nt, Human
cuggcuucuggagc

SEQ ID NO: 2136423 - RNA, 15 nt, Human
cuggcuucuggagcc

SEQ ID NO: 2136424 - RNA, 16 nt, Human
cuggcuucuggagccc

SEQ ID NO: 2136425 - RNA, 20 nt, Human
cuggcuucuggagcccuugg

SEQ ID NO: 2136426 - RNA, 20 nt, Human
cuggcacugacugggcauag

SEQ ID NO: 2136427 - RNA, 16 nt, Human
cuggccagaugcacca

SEQ ID NO: 2136428 - RNA, 20 nt, Human
cuggccagaugcaccagccc

SEQ ID NO: 2136429 - RNA, 19 nt, Human
cuggccagaugcaccagcc

SEQ ID NO: 2136430 - RNA, 18 nt, Human
cuggccagaugcaccagc

SEQ ID NO: 2136431 - RNA, 17 nt, Human
cuggccagaugcaccag

SEQ ID NO: 2136432 - RNA, 21 nt, Human
cuggccagaugcaccagcccu

SEQ ID NO: 2136433 - RNA, 22 nt, Human
cuggccagaugcaccagcccuu

SEQ ID NO: 2136434 - RNA, 17 nt, Human
cuggccaacaugguaaa

SEQ ID NO: 2136435 - RNA, 22 nt, Human
cuggccucaagugauucuccug

SEQ ID NO: 2136436 - RNA, 11 nt, Human
cuggccucugu

SEQ ID NO: 2136437 - RNA, 14 nt, Human
cuggccucugucau

SEQ ID NO: 2136438 - RNA, 17 nt, Human
cuggccucugucauauc

SEQ ID NO: 2136439 - RNA, 12 nt, Human
cuggcccacugc

SEQ ID NO: 2136440 - RNA, 13 nt, Human
cuggcccacugca

SEQ ID NO: 2136441 - RNA, 21 nt, Human
cuggcaaugaaaaauucucag

SEQ ID NO: 2136442 - RNA, 22 nt, Human
cuggcaaugaaaaauucucagu

SEQ ID NO: 2136443 - RNA, 18 nt, Human
cuggcaaagacagaagcc

SEQ ID NO: 2136444 - RNA, 21 nt, Human
cuggcaaagcagaaaauugua

SEQ ID NO: 2136445 - RNA, 16 nt, Human
cuggcaaacaugaaaa

SEQ ID NO: 2136446 - RNA, 22 nt, Human
cuggcaaacaugaaaaaucggc

SEQ ID NO: 2136447 - RNA, 19 nt, Human
cuggcaaacuucagacuga

SEQ ID NO: 2136448 - RNA, 12 nt, Human
cuggcacagucu

SEQ ID NO: 2136449 - RNA, 17 nt, Human
cuggcacagggcagugg

SEQ ID NO: 2136450 - RNA, 23 nt, Human
cuggcacuauaauguaagcucua

SEQ ID NO: 2136451 - RNA, 21 nt, Human
cuggaggccgggugcucaggg

SEQ ID NO: 2136452 - RNA, 12 nt, Human
cuggaggccucu

SEQ ID NO: 2136453 - RNA, 13 nt, Human
cuggaggccucug

SEQ ID NO: 2136454 - RNA, 14 nt, Human
cuggaggccucugg

SEQ ID NO: 2136455 - RNA, 15 nt, Human
cuggaggccucuggg

SEQ ID NO: 2136456 - RNA, 16 nt, Human
cuggaggccucugggc

SEQ ID NO: 2136457 - RNA, 17 nt, Human
cuggaggccucugggcc

SEQ ID NO: 2136458 - RNA, 18 nt, Human
cuggaggccucugggccu

SEQ ID NO: 2136459 - RNA, 21 nt, Human
cuggaggccucugggccuccu

SEQ ID NO: 2136460 - RNA, 22 nt, Human
cuggaggccucugggccuccuc

SEQ ID NO: 2136461 - RNA, 21 nt, Human
cuggauggaggaaaaccaagc

SEQ ID NO: 2136462 - RNA, 20 nt, Human
cuggauguuuuuucccuguu

SEQ ID NO: 2136463 - RNA, 15 nt, Human
cuggaaugcaguggu

SEQ ID NO: 2136464 - RNA, 14 nt, Human
cuggaaugcagugg

SEQ ID NO: 2136465 - RNA, 16 nt, Human
cuggaaguuauuuauu

SEQ ID NO: 2136466 - RNA, 23 nt, Human
cuggaaguuauuuauuuuuuaau

SEQ ID NO: 2136467 - RNA, 17 nt, Human
cuggaaguuuugcauuu

SEQ ID NO: 2136468 - RNA, 20 nt, Human
cuggaaguuuugcauuuaug

SEQ ID NO: 2136469 - RNA, 23 nt, Human
cuggaagcauguaggagaaucca

SEQ ID NO: 2136470 - RNA, 18 nt, Human
cuggaagcacagcuucau

SEQ ID NO: 2136471 - RNA, 15 nt, Human
cuggaagcacagcuu

SEQ ID NO: 2136472 - RNA, 21 nt, Human
cugcuuuuccuuggggcaggc

SEQ ID NO: 2136473 - RNA, 22 nt, Human
cugcuuuuccuuggggcaggca

SEQ ID NO: 2136474 - RNA, 23 nt, Human
cugcuuuuccuuggggcaggcag

SEQ ID NO: 2136475 - RNA, 18 nt, Human
cugcuuugggcugcccug

SEQ ID NO: 2136476 - RNA, 20 nt, Human
cugcuuugggcugcccuggu

SEQ ID NO: 2136477 - RNA, 19 nt, Human
cugcuuugggcugcccugg

SEQ ID NO: 2136478 - RNA, 18 nt, Human
cugcuuuucccuaagcca

SEQ ID NO: 2136479 - RNA, 21 nt, Human
cugcuuuucccuaagccaagg

SEQ ID NO: 2136480 - RNA, 15 nt, Human
cugcuuuucccuaag

SEQ ID NO: 2136481 - RNA, 23 nt, Human
cugcuuugggcugcccuggugcu

SEQ ID NO: 2136482 - RNA, 22 nt, Human
cugcuuugggcugcccuggugc

SEQ ID NO: 2136483 - RNA, 21 nt, Human
cugcuuugggcugcccuggug

SEQ ID NO: 2136484 - RNA, 19 nt, Human
cuggaggaaaacugagacu

SEQ ID NO: 2136485 - RNA, 13 nt, Human
cuggagagcaaca

SEQ ID NO: 2136486 - RNA, 22 nt, Human
cuggaggaagggggguugcagu

SEQ ID NO: 2136487 - RNA, 13 nt, Human
cuggagcuucucu

SEQ ID NO: 2136488 - RNA, 14 nt, Human
cuggagcuucucuu

SEQ ID NO: 2136489 - RNA, 14 nt, Human
cuggaggaaaacug

SEQ ID NO: 2136490 - RNA, 17 nt, Human
cuggaggaaaacugaga

SEQ ID NO: 2136491 - RNA, 19 nt, Human
cuggagcuggcgucugucu

SEQ ID NO: 2136492 - RNA, 13 nt, Human
cuggagcuccugg

SEQ ID NO: 2136493 - RNA, 14 nt, Human
cuggagcuccuggg

SEQ ID NO: 2136494 - RNA, 15 nt, Human
cuggagcuccuggga

SEQ ID NO: 2136495 - RNA, 16 nt, Human
cuggagcuccugggaa

SEQ ID NO: 2136496 - RNA, 18 nt, Human
cuggagcuccugggaagg

SEQ ID NO: 2136497 - RNA, 13 nt, Human
cuggagccaccug

SEQ ID NO: 2136498 - RNA, 14 nt, Human
cuggagccaccugu

SEQ ID NO: 2136499 - RNA, 15 nt, Human
cuggagccaccuguc

SEQ ID NO: 2136500 - RNA, 16 nt, Human
cuggagccaccugucc

SEQ ID NO: 2136501 - RNA, 18 nt, Human
cuggagccaccuguccca

SEQ ID NO: 2136502 - RNA, 19 nt, Human
cuggagccaccugucccac

SEQ ID NO: 2136503 - RNA, 20 nt, Human
cuggagccaccugucccacc

SEQ ID NO: 2136504 - RNA, 21 nt, Human
cuggagccaccugucccaccu

SEQ ID NO: 2136505 - RNA, 22 nt, Human
cuggagccaccugucccaccuc

SEQ ID NO: 2136506 - RNA, 23 nt, Human
cuggagccaccugucccaccuca

SEQ ID NO: 2136507 - RNA, 13 nt, Human
cuggacucaggau

SEQ ID NO: 2136508 - RNA, 19 nt, Human
cuggacucaggaugcccag

SEQ ID NO: 2136509 - RNA, 20 nt, Human
cuggacucaggaugcccagg

SEQ ID NO: 2136510 - RNA, 22 nt, Human
cuggacucaggaugcccagggc

SEQ ID NO: 2136511 - RNA, 13 nt, Human
cuggaccagaugc

SEQ ID NO: 2136512 - RNA, 14 nt, Human
cuggaccagaugcu

SEQ ID NO: 2136513 - RNA, 15 nt, Human
cuggaccagaugcug

SEQ ID NO: 2136514 - RNA, 15 nt, Human
cuggacggcauuccu

SEQ ID NO: 2136515 - RNA, 17 nt, Human
cuggacggcauuccugc

SEQ ID NO: 2136516 - RNA, 19 nt, Human
cuggacggcauuccugcuu

SEQ ID NO: 2136517 - RNA, 20 nt, Human
cuggacggcauuccugcuua

SEQ ID NO: 2136518 - RNA, 18 nt, Human
cuggacauucagaacacc

SEQ ID NO: 2136519 - RNA, 13 nt, Human
cuggaccaaagcu

SEQ ID NO: 2136520 - RNA, 14 nt, Human
cuggaccaaagcug

SEQ ID NO: 2136521 - RNA, 15 nt, Human
cuggaccaaagcuga

SEQ ID NO: 2136522 - RNA, 22 nt, Human
cuggaccaaagcugacgaggcu

SEQ ID NO: 2136523 - RNA, 15 nt, Human
cuggacuccagaucu

SEQ ID NO: 2136524 - RNA, 16 nt, Human
cuggacuccagaucug

SEQ ID NO: 2136525 - RNA, 18 nt, Human
cuggacuccagaucugca

SEQ ID NO: 2136526 - RNA, 19 nt, Human
cuggacuccagaucugcac

SEQ ID NO: 2136527 - RNA, 21 nt, Human
cuggacuccagaucugcaccg

SEQ ID NO: 2136528 - RNA, 23 nt, Human
cuggagaggagggaugcugccug

SEQ ID NO: 2136529 - RNA, 21 nt, Human
cuggagagguuauaggucacu

SEQ ID NO: 2136530 - RNA, 13 nt, Human
cuggagcaccagg

SEQ ID NO: 2136531 - RNA, 16 nt, Human
cuggagagucucacuc

SEQ ID NO: 2136532 - RNA, 23 nt, Human
cuggagagucucacuccccuccu

SEQ ID NO: 2136533 - RNA, 14 nt, Human
cuggagcaccaggc

SEQ ID NO: 2136534 - RNA, 15 nt, Human
cuggagcaccaggca

SEQ ID NO: 2136535 - RNA, 23 nt, Human
cuggagcaccaggcacgaaccca

SEQ ID NO: 2136536 - RNA, 22 nt, Human
cugccacacuucaggcucuucu

SEQ ID NO: 2136537 - RNA, 17 nt, Human
cugccacacuucaggcu

SEQ ID NO: 2136538 - RNA, 13 nt, Human
cugccacacuuca

SEQ ID NO: 2136539 - RNA, 20 nt, Human
cugccacccuggggagaaag

SEQ ID NO: 2136540 - RNA, 16 nt, Human
cugccacccuggggag

SEQ ID NO: 2136541 - RNA, 15 nt, Human
cugccacccugggga

SEQ ID NO: 2136542 - RNA, 16 nt, Human
cugccagcacccccac

SEQ ID NO: 2136543 - RNA, 12 nt, Human
cugccagccaca

SEQ ID NO: 2136544 - RNA, 12 nt, Human
cugccagccagc

SEQ ID NO: 2136545 - RNA, 13 nt, Human
cugccagccagca

SEQ ID NO: 2136546 - RNA, 14 nt, Human
cugccagccagcag

SEQ ID NO: 2136547 - RNA, 15 nt, Human
cugccagccagcagc

SEQ ID NO: 2136548 - RNA, 16 nt, Human
cugccagccagcagcc

SEQ ID NO: 2136549 - RNA, 18 nt, Human
cugccagccagcagccag

SEQ ID NO: 2136550 - RNA, 19 nt, Human
cugccagccagcagccagc

SEQ ID NO: 2136551 - RNA, 22 nt, Human
cugccagccuggcuucuggagc

SEQ ID NO: 2136552 - RNA, 23 nt, Human
cugccagccuggcuucuggagcc

SEQ ID NO: 2136553 - RNA, 17 nt, Human
cugccaugccagcuuau

SEQ ID NO: 2136554 - RNA, 19 nt, Human
cugccaugccagcuuaucu

SEQ ID NO: 2136555 - RNA, 20 nt, Human
cugccagccagcagccagcu

SEQ ID NO: 2136556 - RNA, 23 nt, Human
cugccagccagcagccagcucuc

SEQ ID NO: 2136557 - RNA, 12 nt, Human
cugccagccugg

SEQ ID NO: 2136558 - RNA, 13 nt, Human
cugccagccuggc

SEQ ID NO: 2136559 - RNA, 14 nt, Human
cugccagccuggcu

SEQ ID NO: 2136560 - RNA, 15 nt, Human
cugccagccuggcuu

SEQ ID NO: 2136561 - RNA, 16 nt, Human
cugccagccuggcuuc

SEQ ID NO: 2136562 - RNA, 19 nt, Human
cugccagccuggcuucugg

SEQ ID NO: 2136563 - RNA, 20 nt, Human
cugccagccuggcuucugga

SEQ ID NO: 2136564 - RNA, 20 nt, Human
cugccauggaggcacacagc

SEQ ID NO: 2136565 - RNA, 19 nt, Human
cugccauuugcacccuccg

SEQ ID NO: 2136566 - RNA, 17 nt, Human
cugccauggaggcacac

SEQ ID NO: 2136567 - RNA, 16 nt, Human
cugccauuucugagau

SEQ ID NO: 2136568 - RNA, 17 nt, Human
cugcccaaccugcucuc

SEQ ID NO: 2136569 - RNA, 13 nt, Human
cugcccaaagcag

SEQ ID NO: 2136570 - RNA, 23 nt, Human
cugcccaaagcagcacuuauaaa

SEQ ID NO: 2136571 - RNA, 20 nt, Human
cugccauuugcacccuccgc

SEQ ID NO: 2136572 - RNA, 21 nt, Human
cugccauuugcacccuccgcc

SEQ ID NO: 2136573 - RNA, 11 nt, Human
cugcccaggag

SEQ ID NO: 2136574 - RNA, 19 nt, Human
cugcccaaccugcucuccu

SEQ ID NO: 2136575 - RNA, 13 nt, Human
cugcccaggcccc

SEQ ID NO: 2136576 - RNA, 23 nt, Human
cugcccaggagagccagcccucc

SEQ ID NO: 2136577 - RNA, 21 nt, Human
cugcccaggagagccagcccu

SEQ ID NO: 2136578 - RNA, 22 nt, Human
cugcccaggagagccagcccuc

SEQ ID NO: 2136579 - RNA, 12 nt, Human
cugcccaggaga

SEQ ID NO: 2136580 - RNA, 17 nt, Human
cugcccaggagagccag

SEQ ID NO: 2136581 - RNA, 18 nt, Human
cugcccaggagagccagc

SEQ ID NO: 2136582 - RNA, 19 nt, Human
cugcccaggagagccagcc

SEQ ID NO: 2136583 - RNA, 18 nt, Human
cugcccaggccugccugu

SEQ ID NO: 2136584 - RNA, 19 nt, Human
cugcccaggccugccuguu

SEQ ID NO: 2136585 - RNA, 15 nt, Human
cugcccggcugcgga

SEQ ID NO: 2136586 - RNA, 11 nt, Human
cugccccuggc

SEQ ID NO: 2136587 - RNA, 11 nt, Human
cugcccggcug

SEQ ID NO: 2136588 - RNA, 14 nt, Human
cugcccuccauccc

SEQ ID NO: 2136589 - RNA, 15 nt, Human
cugcccuccaucccg

SEQ ID NO: 2136590 - RNA, 17 nt, Human
cugcccucccuccuucc

SEQ ID NO: 2136591 - RNA, 18 nt, Human
cugcccucccuccuuccu

SEQ ID NO: 2136592 - RNA, 16 nt, Human
cugcccucccuggagc

SEQ ID NO: 2136593 - RNA, 13 nt, Human
cugcccugcccac

SEQ ID NO: 2136594 - RNA, 11 nt, Human
cugcccugccc

SEQ ID NO: 2136595 - RNA, 13 nt, Human
cugcccugccacu

SEQ ID NO: 2136596 - RNA, 13 nt, Human
cugcccucuguuc

SEQ ID NO: 2136597 - RNA, 19 nt, Human
cugcccucuguucaguaac

SEQ ID NO: 2136598 - RNA, 13 nt, Human
cugcuccccuccc

SEQ ID NO: 2136599 - RNA, 17 nt, Human
cugcuccccucccuccu

SEQ ID NO: 2136600 - RNA, 15 nt, Human
cugcuccagcuguuc

SEQ ID NO: 2136601 - RNA, 17 nt, Human
cugcuccucuccccagc

SEQ ID NO: 2136602 - RNA, 16 nt, Human
cugcuccucuccccag

SEQ ID NO: 2136603 - RNA, 16 nt, Human
cugcucugaacacgaa

SEQ ID NO: 2136604 - RNA, 19 nt, Human
cugcucugaacacgaagcu

SEQ ID NO: 2136605 - RNA, 14 nt, Human
cugcucucuaccca

SEQ ID NO: 2136606 - RNA, 16 nt, Human
cugcucucuacccagc

SEQ ID NO: 2136607 - RNA, 17 nt, Human
cugcucucuacccagcc

SEQ ID NO: 2136608 - RNA, 20 nt, Human
cugcucucuacccagcccau

SEQ ID NO: 2136609 - RNA, 22 nt, Human
cugcucucuacccagcccaucu

SEQ ID NO: 2136610 - RNA, 17 nt, Human
cugcuccuuagcugcca

SEQ ID NO: 2136611 - RNA, 20 nt, Human
cugcuccuuagcugccaagc

SEQ ID NO: 2136612 - RNA, 18 nt, Human
cugcuccucuccccagca

SEQ ID NO: 2136613 - RNA, 23 nt, Human
cugcuaacuuggagccccagugc

SEQ ID NO: 2136614 - RNA, 21 nt, Human
cugcuaacuuggagccccagu

SEQ ID NO: 2136615 - RNA, 20 nt, Human
cugcuaacuuggagccccag

SEQ ID NO: 2136616 - RNA, 14 nt, Human
cugcuccagcuguu

SEQ ID NO: 2136617 - RNA, 20 nt, Human
cugcguuuuggaagcucuga

SEQ ID NO: 2136618 - RNA, 12 nt, Human
cugcuaaaucuc

SEQ ID NO: 2136619 - RNA, 17 nt, Human
cugcuaaaucuccuauu

SEQ ID NO: 2136620 - RNA, 18 nt, Human
cugcuaaaucuccuauuu

SEQ ID NO: 2136621 - RNA, 19 nt, Human
cugcuaaaucuccuauuuu

SEQ ID NO: 2136622 - RNA, 20 nt, Human
cugcuaaaucuccuauuuuu

SEQ ID NO: 2136623 - RNA, 16 nt, Human
cugcgguccacccagg

SEQ ID NO: 2136624 - RNA, 17 nt, Human
cugcgguccacccagga

SEQ ID NO: 2136625 - RNA, 15 nt, Human
cugcggucaaggcca

SEQ ID NO: 2136626 - RNA, 16 nt, Human
cugcggucaaggccag

SEQ ID NO: 2136627 - RNA, 17 nt, Human
cugcggucaaggccagc

SEQ ID NO: 2136628 - RNA, 21 nt, Human
cugcggaaugaaccacaucuu

SEQ ID NO: 2136629 - RNA, 15 nt, Human
cugcgguccacccag

SEQ ID NO: 2136630 - RNA, 20 nt, Human
cugcggaaugaaccacaucu

SEQ ID NO: 2136631 - RNA, 13 nt, Human
cugccucagccuc

SEQ ID NO: 2136632 - RNA, 14 nt, Human
cugccucacuuccu

SEQ ID NO: 2136633 - RNA, 23 nt, Human
cugccucacuuccuacaagagca

SEQ ID NO: 2136634 - RNA, 12 nt, Human
cugccucagccu

SEQ ID NO: 2136635 - RNA, 14 nt, Human
cugccucagccucc

SEQ ID NO: 2136636 - RNA, 19 nt, Human
cugccucucccuggcccuc

SEQ ID NO: 2136637 - RNA, 17 nt, Human
cugccucucccuggccc

SEQ ID NO: 2136638 - RNA, 18 nt, Human
cugccucucccuggcccu

SEQ ID NO: 2136639 - RNA, 19 nt, Human
cugcccugggauguccaca

SEQ ID NO: 2136640 - RNA, 11 nt, Human
cugcccuggga

SEQ ID NO: 2136641 - RNA, 16 nt, Human
cugcccugccacuuug

SEQ ID NO: 2136642 - RNA, 18 nt, Human
cugccuaaguggcugcug

SEQ ID NO: 2136643 - RNA, 21 nt, Human
cugccucaaugugaaucagac

SEQ ID NO: 2136644 - RNA, 24 nt, Human
cugccucaaugugaaucagacccu

SEQ ID NO: 2136645 - RNA, 21 nt, Human
cugcccugggauguccacaga

SEQ ID NO: 2136646 - RNA, 14 nt, Human
cugccuaaguggcu

SEQ ID NO: 2136647 - RNA, 15 nt, Human
cugccuaaguggcug

SEQ ID NO: 2136648 - RNA, 16 nt, Human
cugccuaaguggcugc

SEQ ID NO: 2136649 - RNA, 13 nt, Human
cugccugagcacc

SEQ ID NO: 2136650 - RNA, 20 nt, Human
cugccugagcaccucccagc

SEQ ID NO: 2136651 - RNA, 21 nt, Human
cugccugagcaccucccagcc

SEQ ID NO: 2136652 - RNA, 13 nt, Human
cugccugcccacc

SEQ ID NO: 2136653 - RNA, 14 nt, Human
cugccugcccaccc

SEQ ID NO: 2136654 - RNA, 15 nt, Human
cugccugcccaggcc

SEQ ID NO: 2136655 - RNA, 15 nt, Human
cugccugcccacccg

SEQ ID NO: 2136656 - RNA, 16 nt, Human
cugccugcccacccgu

SEQ ID NO: 2136657 - RNA, 14 nt, Human
cugccugcccaggc

SEQ ID NO: 2136658 - RNA, 13 nt, Human
cugccugcccagg

SEQ ID NO: 2136659 - RNA, 18 nt, Human
cugccucucgguggccag

SEQ ID NO: 2136660 - RNA, 12 nt, Human
cugccucuuccu

SEQ ID NO: 2136661 - RNA, 19 nt, Human
cugccucuuaaauaaaccu

SEQ ID NO: 2136662 - RNA, 13 nt, Human
cugccucuucucu

SEQ ID NO: 2136663 - RNA, 23 nt, Human
cugccugaagucacacagugagu

SEQ ID NO: 2136664 - RNA, 14 nt, Human
cugccucuucucua

SEQ ID NO: 2136665 - RNA, 17 nt, Human
cugcagggacugccagu

SEQ ID NO: 2136666 - RNA, 15 nt, Human
cugcagggacugcca

SEQ ID NO: 2136667 - RNA, 16 nt, Human
cugcagggccaagcac

SEQ ID NO: 2136668 - RNA, 22 nt, Human
cugcagggaguccgaaagggac

SEQ ID NO: 2136669 - RNA, 20 nt, Human
cugcagccucaaccuccugg

SEQ ID NO: 2136670 - RNA, 19 nt, Human
cugcagccucaaccuccug

SEQ ID NO: 2136671 - RNA, 22 nt, Human
cugcagccucaaccuccugggc

SEQ ID NO: 2136672 - RNA, 11 nt, Human
cugcagccuca

SEQ ID NO: 2136673 - RNA, 19 nt, Human
cugcagaggggcuuucugg

SEQ ID NO: 2136674 - RNA, 20 nt, Human
cugcagaggggcuuucugga

SEQ ID NO: 2136675 - RNA, 22 nt, Human
cugcagaggggcuuucuggaga

SEQ ID NO: 2136676 - RNA, 23 nt, Human
cugcagaggggcuuucuggagag

SEQ ID NO: 2136677 - RNA, 17 nt, Human
cugcagagacagagagg

SEQ ID NO: 2136678 - RNA, 20 nt, Human
cugcagaacguauuggucca

SEQ ID NO: 2136679 - RNA, 21 nt, Human
cugcagaacguauugguccag

SEQ ID NO: 2136680 - RNA, 23 nt, Human
cugcagaacguauugguccagcu

SEQ ID NO: 2136681 - RNA, 20 nt, Human
cugcagagcaggaaacauga

SEQ ID NO: 2136682 - RNA, 17 nt, Human
cugcacuugcagacucu

SEQ ID NO: 2136683 - RNA, 16 nt, Human
cugcacuugcagacuc

SEQ ID NO: 2136684 - RNA, 14 nt, Human
cugcacuugcagac

SEQ ID NO: 2136685 - RNA, 18 nt, Human
cugcacagugcaucucag

SEQ ID NO: 2136686 - RNA, 18 nt, Human
cugcacaagcugcacccu

SEQ ID NO: 2136687 - RNA, 13 nt, Human
cugcacaagcugc

SEQ ID NO: 2136688 - RNA, 14 nt, Human
cugcacaagcugca

SEQ ID NO: 2136689 - RNA, 15 nt, Human
cugcacaagcugcac

SEQ ID NO: 2136690 - RNA, 16 nt, Human
cugcacaagcugcacc

SEQ ID NO: 2136691 - RNA, 17 nt, Human
cugcacccucaggcagg

SEQ ID NO: 2136692 - RNA, 16 nt, Human
cugcaccccccugggc

SEQ ID NO: 2136693 - RNA, 17 nt, Human
cugcaccccccugggcu

SEQ ID NO: 2136694 - RNA, 18 nt, Human
cugcacccucaggcaggu

SEQ ID NO: 2136695 - RNA, 21 nt, Human
cugcacagugcaucucagccc

SEQ ID NO: 2136696 - RNA, 11 nt, Human
cugcaccagga

SEQ ID NO: 2136697 - RNA, 13 nt, Human
cugcaccaggaga

SEQ ID NO: 2136698 - RNA, 14 nt, Human
cugcaccaggagac

SEQ ID NO: 2136699 - RNA, 15 nt, Human
cugcaccaggagaca

SEQ ID NO: 2136700 - RNA, 17 nt, Human
cugcaccaggagacaga

SEQ ID NO: 2136701 - RNA, 14 nt, Human
cugcaccauugcug

SEQ ID NO: 2136702 - RNA, 16 nt, Human
cugcaccauugcugcu

SEQ ID NO: 2136703 - RNA, 17 nt, Human
cugcaccauugcugcuc

SEQ ID NO: 2136704 - RNA, 14 nt, Human
cugcaccccccugg

SEQ ID NO: 2136705 - RNA, 15 nt, Human
cugcaccccccuggg

SEQ ID NO: 2136706 - RNA, 13 nt, Human
cugcacaaagccc

SEQ ID NO: 2136707 - RNA, 20 nt, Human
cugcacaaagcccuuccaug

SEQ ID NO: 2136708 - RNA, 18 nt, Human
cugcacaaagcccuucca

SEQ ID NO: 2136709 - RNA, 21 nt, Human
cugcacaaagcccuuccaugu

SEQ ID NO: 2136710 - RNA, 16 nt, Human
cugcaauagagacugu

SEQ ID NO: 2136711 - RNA, 18 nt, Human
cugcaauagagacuguag

SEQ ID NO: 2136712 - RNA, 19 nt, Human
cugcaauagagacuguaga

SEQ ID NO: 2136713 - RNA, 20 nt, Human
cugcaauagagacuguagau

SEQ ID NO: 2136714 - RNA, 21 nt, Human
cugcaauagagacuguagauu

SEQ ID NO: 2136715 - RNA, 23 nt, Human
cugcaaacaugggguuggcuggg

SEQ ID NO: 2136716 - RNA, 11 nt, Human
cugcaaaauuu

SEQ ID NO: 2136717 - RNA, 13 nt, Human
cugcaaaauuuua

SEQ ID NO: 2136718 - RNA, 14 nt, Human
cugcaaaaugagac

SEQ ID NO: 2136719 - RNA, 15 nt, Human
cugauucccaagcuc

SEQ ID NO: 2136720 - RNA, 18 nt, Human
cugauucccaagcucugc

SEQ ID NO: 2136721 - RNA, 17 nt, Human
cugauucccaagcucug

SEQ ID NO: 2136722 - RNA, 20 nt, Human
cugauucccaagcucugcuc

SEQ ID NO: 2136723 - RNA, 19 nt, Human
cugauucccaagcucugcu

SEQ ID NO: 2136724 - RNA, 22 nt, Human
cugauucccaagcucugcuccu

SEQ ID NO: 2136725 - RNA, 22 nt, Human
cugauucauaauaaauaucugu

SEQ ID NO: 2136726 - RNA, 19 nt, Human
cugauuagaaaugaccaau

SEQ ID NO: 2136727 - RNA, 13 nt, Human
cugauuagaaaug

SEQ ID NO: 2136728 - RNA, 18 nt, Human
cugauguacaguugggaa

SEQ ID NO: 2136729 - RNA, 13 nt, Human
cugauuacuguca

SEQ ID NO: 2136730 - RNA, 14 nt, Human
cugauuacugucaa

SEQ ID NO: 2136731 - RNA, 16 nt, Human
cugauuacugucaaua

SEQ ID NO: 2136732 - RNA, 17 nt, Human
cugauuacugucaauaa

SEQ ID NO: 2136733 - RNA, 19 nt, Human
cugauuacugucaauaaac

SEQ ID NO: 2136734 - RNA, 20 nt, Human
cugauuacugucaauaaaca

SEQ ID NO: 2136735 - RNA, 23 nt, Human
cugauuacugucaauaaacagcu

SEQ ID NO: 2136736 - RNA, 11 nt, Human
cugauuagaaa

SEQ ID NO: 2136737 - RNA, 23 nt, Human
cugauuagaaaugaccaauauua

SEQ ID NO: 2136738 - RNA, 19 nt, Human
cugauuaaugcuaaaugua

SEQ ID NO: 2136739 - RNA, 22 nt, Human
cugauguugagggaacagacag

SEQ ID NO: 2136740 - RNA, 15 nt, Human
cugauguuaggcugg

SEQ ID NO: 2136741 - RNA, 16 nt, Human
cugauguuaggcuggg

SEQ ID NO: 2136742 - RNA, 17 nt, Human
cugauguuaggcugggc

SEQ ID NO: 2136743 - RNA, 18 nt, Human
cugauguuaggcugggcc

SEQ ID NO: 2136744 - RNA, 19 nt, Human
cugauguuaggcugggccc

SEQ ID NO: 2136745 - RNA, 21 nt, Human
cugauguuaggcugggcccag

SEQ ID NO: 2136746 - RNA, 22 nt, Human
cugauguuaggcugggcccaga

SEQ ID NO: 2136747 - RNA, 23 nt, Human
cugauguuaggcugggcccagag

SEQ ID NO: 2136748 - RNA, 20 nt, Human
cugaucgccaaccuuucccc

SEQ ID NO: 2136749 - RNA, 15 nt, Human
cugaucgugcuaaau

SEQ ID NO: 2136750 - RNA, 17 nt, Human
cugaucgugcuaaauuu

SEQ ID NO: 2136751 - RNA, 19 nt, Human
cugaucgugcuaaauuuuc

SEQ ID NO: 2136752 - RNA, 15 nt, Human
cugaucguucuuucu

SEQ ID NO: 2136753 - RNA, 12 nt, Human
cugaucucaggg

SEQ ID NO: 2136754 - RNA, 13 nt, Human
cugaucucaggga

SEQ ID NO: 2136755 - RNA, 15 nt, Human
cugaucucagggaag

SEQ ID NO: 2136756 - RNA, 20 nt, Human
cugaucucagggaagcccag

SEQ ID NO: 2136757 - RNA, 21 nt, Human
cugaucucagggaagcccagc

SEQ ID NO: 2136758 - RNA, 22 nt, Human
cugaucucagggaagcccagcu

SEQ ID NO: 2136759 - RNA, 23 nt, Human
cugaucucagggaagcccagcuc

SEQ ID NO: 2136760 - RNA, 21 nt, Human
cugaucgugcuaaauuuucag

SEQ ID NO: 2136761 - RNA, 16 nt, Human
cugauagcguuggaau

SEQ ID NO: 2136762 - RNA, 23 nt, Human
cugauagcguuggaauuaaaaca

SEQ ID NO: 2136763 - RNA, 22 nt, Human
cugaguuuuuaaaaauggacaa

SEQ ID NO: 2136764 - RNA, 12 nt, Human
cugauaccucaa

SEQ ID NO: 2136765 - RNA, 16 nt, Human
cugaucaugcauuguu

SEQ ID NO: 2136766 - RNA, 12 nt, Human
cugaucccacuc

SEQ ID NO: 2136767 - RNA, 15 nt, Human
cugaucccacuccua

SEQ ID NO: 2136768 - RNA, 16 nt, Human
cugaucccacuccuag

SEQ ID NO: 2136769 - RNA, 17 nt, Human
cugaucccacuccuagg

SEQ ID NO: 2136770 - RNA, 18 nt, Human
cugaucccacuccuagga

SEQ ID NO: 2136771 - RNA, 19 nt, Human
cugaucagucuaagauggg

SEQ ID NO: 2136772 - RNA, 12 nt, Human
cugaucaugcau

SEQ ID NO: 2136773 - RNA, 14 nt, Human
cugaucaugcauug

SEQ ID NO: 2136774 - RNA, 15 nt, Human
cugaucaugcauugu

SEQ ID NO: 2136775 - RNA, 17 nt, Human
cugaucaugcauuguug

SEQ ID NO: 2136776 - RNA, 22 nt, Human
cugagugggggaucacagccuc

SEQ ID NO: 2136777 - RNA, 16 nt, Human
cugagugagcugaaga

SEQ ID NO: 2136778 - RNA, 16 nt, Human
cugagggcgaggggag

SEQ ID NO: 2136779 - RNA, 19 nt, Human
cugagggaccaacugggcc

SEQ ID NO: 2136780 - RNA, 20 nt, Human
cugagggaccaacugggccc

SEQ ID NO: 2136781 - RNA, 21 nt, Human
cugagggaccaacugggccca

SEQ ID NO: 2136782 - RNA, 13 nt, Human
cugagggaccagc

SEQ ID NO: 2136783 - RNA, 15 nt, Human
cugagggaccagcca

SEQ ID NO: 2136784 - RNA, 12 nt, Human
cugagggaccaa

SEQ ID NO: 2136785 - RNA, 16 nt, Human
cugagggaccaacugg

SEQ ID NO: 2136786 - RNA, 18 nt, Human
cugagggaccaacugggc

SEQ ID NO: 2136787 - RNA, 18 nt, Human
cugacccagucccugggg

SEQ ID NO: 2136788 - RNA, 12 nt, Human
cugacccagucc

SEQ ID NO: 2136789 - RNA, 13 nt, Human
cugacccaguccc

SEQ ID NO: 2136790 - RNA, 14 nt, Human
cugacccagucccu

SEQ ID NO: 2136791 - RNA, 15 nt, Human
cugacccagucccug

SEQ ID NO: 2136792 - RNA, 16 nt, Human
cugacccagucccugg

SEQ ID NO: 2136793 - RNA, 17 nt, Human
cugacccagucccuggg

SEQ ID NO: 2136794 - RNA, 18 nt, Human
cugaccauuucagggguc

SEQ ID NO: 2136795 - RNA, 21 nt, Human
cuccugaguagcuggauuaca

SEQ ID NO: 2136796 - RNA, 19 nt, Human
cuccugaggaucagaaagu

SEQ ID NO: 2136797 - RNA, 20 nt, Human
cuccugaggaucagaaagua

SEQ ID NO: 2136798 - RNA, 23 nt, Human
cuccugaggaucagaaaguaauu

SEQ ID NO: 2136799 - RNA, 16 nt, Human
cuccugaggggcaucu

SEQ ID NO: 2136800 - RNA, 19 nt, Human
cuccugaggggcaucugcc

SEQ ID NO: 2136801 - RNA, 20 nt, Human
cuccugaggggcaucugccc

SEQ ID NO: 2136802 - RNA, 21 nt, Human
cuccugaggggcaucugcccc

SEQ ID NO: 2136803 - RNA, 22 nt, Human
cuccugaggggcaucugccccu

SEQ ID NO: 2136804 - RNA, 16 nt, Human
cuccucuuuguuuugu

SEQ ID NO: 2136805 - RNA, 20 nt, Human
cuccucuuuguuuuguuuua

SEQ ID NO: 2136806 - RNA, 21 nt, Human
cuccucuuuguuuuguuuuaa

SEQ ID NO: 2136807 - RNA, 16 nt, Human
cuccugaccugucacc

SEQ ID NO: 2136808 - RNA, 21 nt, Human
cucccuucuccuugauaacag

SEQ ID NO: 2136809 - RNA, 11 nt, Human
cuccucagacu

SEQ ID NO: 2136810 - RNA, 19 nt, Human
cuccuaucaccuccccucc

SEQ ID NO: 2136811 - RNA, 21 nt, Human
cuccucacucccuucccauaa

SEQ ID NO: 2136812 - RNA, 15 nt, Human
cuccucccugaugua

SEQ ID NO: 2136813 - RNA, 16 nt, Human
cuccucccugauguac

SEQ ID NO: 2136814 - RNA, 19 nt, Human
cuccucccugauguacagu

SEQ ID NO: 2136815 - RNA, 21 nt, Human
cuccucccucccucugccggc

SEQ ID NO: 2136816 - RNA, 17 nt, Human
cuccucuaacaggggcu

SEQ ID NO: 2136817 - RNA, 21 nt, Human
cuccucuaacaggggcuggug

SEQ ID NO: 2136818 - RNA, 19 nt, Human
cuccucgcaagcuggguaa

SEQ ID NO: 2136819 - RNA, 19 nt, Human
cuccucuugccacugccuc

SEQ ID NO: 2136820 - RNA, 17 nt, Human
cucccuucuacugcuuc

SEQ ID NO: 2136821 - RNA, 14 nt, Human
cucccuuccucuuu

SEQ ID NO: 2136822 - RNA, 13 nt, Human
cucccuuccuccc

SEQ ID NO: 2136823 - RNA, 14 nt, Human
cucccuuccuccca

SEQ ID NO: 2136824 - RNA, 13 nt, Human
cucccuuccucuu

SEQ ID NO: 2136825 - RNA, 17 nt, Human
cucccuucccauaagcu

SEQ ID NO: 2136826 - RNA, 21 nt, Human
cuccuaguucuucaucccacu

SEQ ID NO: 2136827 - RNA, 17 nt, Human
cuccuaucaccuccccu

SEQ ID NO: 2136828 - RNA, 18 nt, Human
cuccuaucaccuccccuc

SEQ ID NO: 2136829 - RNA, 20 nt, Human
cuccuagggaaaaguucaua

SEQ ID NO: 2136830 - RNA, 19 nt, Human
cuccuaggacauguucccu

SEQ ID NO: 2136831 - RNA, 22 nt, Human
cuccuaggacauguucccuucu

SEQ ID NO: 2136832 - RNA, 20 nt, Human
cucccuucaaccauucccca

SEQ ID NO: 2136833 - RNA, 19 nt, Human
cucccuucaaccauucccc

SEQ ID NO: 2136834 - RNA, 18 nt, Human
cucccuucaaccauuccc

SEQ ID NO: 2136835 - RNA, 12 nt, Human
cucccuucaacc

SEQ ID NO: 2136836 - RNA, 10 nt, Human
cucccuuccu

SEQ ID NO: 2136837 - RNA, 19 nt, Human
cucccuguugaagcucugg

SEQ ID NO: 2136838 - RNA, 14 nt, Human
cucccuggcuccca

SEQ ID NO: 2136839 - RNA, 15 nt, Human
cucccuggcucccau

SEQ ID NO: 2136840 - RNA, 15 nt, Human
cucccuggcucucag

SEQ ID NO: 2136841 - RNA, 16 nt, Human
cucccuggcucucaga

SEQ ID NO: 2136842 - RNA, 18 nt, Human
cucccuggcucucagaag

SEQ ID NO: 2136843 - RNA, 20 nt, Human
cucccuggcucucagaaggu

SEQ ID NO: 2136844 - RNA, 18 nt, Human
cucccaguucucuaggga

SEQ ID NO: 2136845 - RNA, 20 nt, Human
cucccaguucucuagggaag

SEQ ID NO: 2136846 - RNA, 21 nt, Human
cucccaguucucuagggaagg

SEQ ID NO: 2136847 - RNA, 20 nt, Human
cucccaguccaaauguccuc

SEQ ID NO: 2136848 - RNA, 15 nt, Human
cucccuggccuguuc

SEQ ID NO: 2136849 - RNA, 16 nt, Human
cucccuggccuguucu

SEQ ID NO: 2136850 - RNA, 19 nt, Human
cucccuggccuguucuguu

SEQ ID NO: 2136851 - RNA, 21 nt, Human
cucccuggccuguucuguuuu

SEQ ID NO: 2136852 - RNA, 11 nt, Human
cucccuggcuc

SEQ ID NO: 2136853 - RNA, 12 nt, Human
cucccuggcucc

SEQ ID NO: 2136854 - RNA, 17 nt, Human
cucgagguuucucaaag

SEQ ID NO: 2136855 - RNA, 17 nt, Human
cucgaagcgcgccacuc

SEQ ID NO: 2136856 - RNA, 20 nt, Human
cucgaagcgcgccacucgcu

SEQ ID NO: 2136857 - RNA, 17 nt, Human
cuccuugggaggcccca

SEQ ID NO: 2136858 - RNA, 21 nt, Human
cuccuugggaggccccacugg

SEQ ID NO: 2136859 - RNA, 22 nt, Human
cuccuugggaggccccacuggg

SEQ ID NO: 2136860 - RNA, 12 nt, Human
cucgaagcgcgc

SEQ ID NO: 2136861 - RNA, 13 nt, Human
cucgaagcgcgcc

SEQ ID NO: 2136862 - RNA, 21 nt, Human
cucgcauuugucaaugacagu

SEQ ID NO: 2136863 - RNA, 19 nt, Human
cucgccaccccuccuuccu

SEQ ID NO: 2136864 - RNA, 22 nt, Human
cucgcauuugucaaugacaguu

SEQ ID NO: 2136865 - RNA, 21 nt, Human
cucggccgucuucacucgccc

SEQ ID NO: 2136866 - RNA, 12 nt, Human
cucggagccuca

SEQ ID NO: 2136867 - RNA, 22 nt, Human
cucuaaaugaggggccucaggu

SEQ ID NO: 2136868 - RNA, 14 nt, Human
cucuaagcacacgg

SEQ ID NO: 2136869 - RNA, 17 nt, Human
cucgcuuuguugcccag

SEQ ID NO: 2136870 - RNA, 16 nt, Human
cucggaaggcuggcug

SEQ ID NO: 2136871 - RNA, 20 nt, Human
cucggaaggcuggcugggca

SEQ ID NO: 2136872 - RNA, 20 nt, Human
cuccuucuguccuacucugu

SEQ ID NO: 2136873 - RNA, 15 nt, Human
cuccuucuguccuac

SEQ ID NO: 2136874 - RNA, 14 nt, Human
cuccuucuguccua

SEQ ID NO: 2136875 - RNA, 13 nt, Human
cuccuucucccuu

SEQ ID NO: 2136876 - RNA, 18 nt, Human
cuccuuccaacaggagcu

SEQ ID NO: 2136877 - RNA, 14 nt, Human
cuccuuccaacagg

SEQ ID NO: 2136878 - RNA, 14 nt, Human
cuccuuccaacugc

SEQ ID NO: 2136879 - RNA, 15 nt, Human
cuccuuccaacugcu

SEQ ID NO: 2136880 - RNA, 18 nt, Human
cuccuuccaacugcugcc

SEQ ID NO: 2136881 - RNA, 19 nt, Human
cuccuuccaacugcugccc

SEQ ID NO: 2136882 - RNA, 17 nt, Human
cuccuugccuccugugu

SEQ ID NO: 2136883 - RNA, 17 nt, Human
cuccuugauaacagcua

SEQ ID NO: 2136884 - RNA, 18 nt, Human
cuccuugauaacagcuac

SEQ ID NO: 2136885 - RNA, 18 nt, Human
cuccuugccuccugugua

SEQ ID NO: 2136886 - RNA, 16 nt, Human
cucgaacuggcugcaa

SEQ ID NO: 2136887 - RNA, 13 nt, Human
cuccuugggaggc

SEQ ID NO: 2136888 - RNA, 16 nt, Human
cuccuugggaggcccc

SEQ ID NO: 2136889 - RNA, 22 nt, Human
cuccuugagggcaagagccaca

SEQ ID NO: 2136890 - RNA, 11 nt, Human
cuccugugugu

SEQ ID NO: 2136891 - RNA, 23 nt, Human
cuccugugucuugcaauggcagc

SEQ ID NO: 2136892 - RNA, 14 nt, Human
cuccugcccaccug

SEQ ID NO: 2136893 - RNA, 15 nt, Human
cuccugugucuugca

SEQ ID NO: 2136894 - RNA, 12 nt, Human
cuccugcaugca

SEQ ID NO: 2136895 - RNA, 13 nt, Human
cuccugcaugcag

SEQ ID NO: 2136896 - RNA, 23 nt, Human
cuccugaggggcaucugccccuc

SEQ ID NO: 2136897 - RNA, 14 nt, Human
cuccugugugugcg

SEQ ID NO: 2136898 - RNA, 15 nt, Human
cucaggucuguuuuc

SEQ ID NO: 2136899 - RNA, 19 nt, Human
cucaggucagggugaggau

SEQ ID NO: 2136900 - RNA, 20 nt, Human
cucaggucagggugaggaug

SEQ ID NO: 2136901 - RNA, 18 nt, Human
cucaggucccugcagggc

SEQ ID NO: 2136902 - RNA, 17 nt, Human
cucaggucccugcaggg

SEQ ID NO: 2136903 - RNA, 16 nt, Human
cucagguacagagaag

SEQ ID NO: 2136904 - RNA, 18 nt, Human
cucagguacagagaagga

SEQ ID NO: 2136905 - RNA, 19 nt, Human
cucagguacagagaaggaa

SEQ ID NO: 2136906 - RNA, 21 nt, Human
cucagguacagagaaggaaug

SEQ ID NO: 2136907 - RNA, 16 nt, Human
cucaggugucccugca

SEQ ID NO: 2136908 - RNA, 15 nt, Human
cucaggugucccugc

SEQ ID NO: 2136909 - RNA, 15 nt, Human
cguuuuuuucauucc

SEQ ID NO: 2136910 - RNA, 14 nt, Human
cguuuuguuugaaa

SEQ ID NO: 2136911 - RNA, 23 nt, Human
cuaaaagguaugcaaucaaaucu

SEQ ID NO: 2136912 - RNA, 17 nt, Human
cucaggggcguguggcu

SEQ ID NO: 2136913 - RNA, 19 nt, Human
cucauaguaugguggcugg

SEQ ID NO: 2136914 - RNA, 18 nt, Human
cucauaguaugguggcug

SEQ ID NO: 2136915 - RNA, 20 nt, Human
cucauaguaugguggcuggg

SEQ ID NO: 2136916 - RNA, 19 nt, Human
cucauagggaagaccugcu

SEQ ID NO: 2136917 - RNA, 14 nt, Human
cucauagggaagac

SEQ ID NO: 2136918 - RNA, 20 nt, Human
cucauaagcuacugaugaga

SEQ ID NO: 2136919 - RNA, 19 nt, Human
cucaggugucccugcacuu

SEQ ID NO: 2136920 - RNA, 14 nt, Human
cucaggugagaagc

SEQ ID NO: 2136921 - RNA, 18 nt, Human
cucaggugucccugcacu

SEQ ID NO: 2136922 - RNA, 17 nt, Human
cucaggugucccugcac

SEQ ID NO: 2136923 - RNA, 14 nt, Human
cucaguucccuugg

SEQ ID NO: 2136924 - RNA, 15 nt, Human
cucaguucccuuggc

SEQ ID NO: 2136925 - RNA, 16 nt, Human
cucaguucccuuggcc

SEQ ID NO: 2136926 - RNA, 17 nt, Human
cucaguucccuuggccu

SEQ ID NO: 2136927 - RNA, 18 nt, Human
cucaguucccuuggccuc

SEQ ID NO: 2136928 - RNA, 19 nt, Human
cucaguucccuuggccuca

SEQ ID NO: 2136929 - RNA, 22 nt, Human
cucauugcuucacaacccaucu

SEQ ID NO: 2136930 - RNA, 15 nt, Human
cucauuguaaacaaa

SEQ ID NO: 2136931 - RNA, 23 nt, Human
cucauucuucuguacgucugaca

SEQ ID NO: 2136932 - RNA, 17 nt, Human
cucauuccugccugucu

SEQ ID NO: 2136933 - RNA, 18 nt, Human
cucauuccugccugucuc

SEQ ID NO: 2136934 - RNA, 14 nt, Human
cucauuccccaggu

SEQ ID NO: 2136935 - RNA, 12 nt, Human
cucauuccugcc

SEQ ID NO: 2136936 - RNA, 13 nt, Human
cucauuccugccu

SEQ ID NO: 2136937 - RNA, 16 nt, Human
cucauuccugccuguc

SEQ ID NO: 2136938 - RNA, 20 nt, Human
cucauuccugccugucuccu

SEQ ID NO: 2136939 - RNA, 14 nt, Human
cucauucuucugua

SEQ ID NO: 2136940 - RNA, 13 nt, Human
cucauucuucugu

SEQ ID NO: 2136941 - RNA, 22 nt, Human
cucauucaggaaaacugacaga

SEQ ID NO: 2136942 - RNA, 14 nt, Human
cucauucaguauua

SEQ ID NO: 2136943 - RNA, 15 nt, Human
cucauucaguauuaa

SEQ ID NO: 2136944 - RNA, 17 nt, Human
cucauucaguauuaaag

SEQ ID NO: 2136945 - RNA, 19 nt, Human
cucauucaguauuaaaggg

SEQ ID NO: 2136946 - RNA, 18 nt, Human
cucauuccaccuucccau

SEQ ID NO: 2136947 - RNA, 21 nt, Human
cucauuccaccuucccaugcc

SEQ ID NO: 2136948 - RNA, 13 nt, Human
cucauuccccagg

SEQ ID NO: 2136949 - RNA, 12 nt, Human
cucauuccccag

SEQ ID NO: 2136950 - RNA, 15 nt, Human
cucauccuuuucucc

SEQ ID NO: 2136951 - RNA, 17 nt, Human
cucauccuuuucuccua

SEQ ID NO: 2136952 - RNA, 14 nt, Human
cucauccugcaggc

SEQ ID NO: 2136953 - RNA, 21 nt, Human
cucauuagcauuuugcuaaau

SEQ ID NO: 2136954 - RNA, 19 nt, Human
cucauucaaaaguugaaau

SEQ ID NO: 2136955 - RNA, 21 nt, Human
cucauuaucgccuuuugacag

SEQ ID NO: 2136956 - RNA, 15 nt, Human
cucauucaaaaguug

SEQ ID NO: 2136957 - RNA, 22 nt, Human
cucauauuccugcagccuggag

SEQ ID NO: 2136958 - RNA, 24 nt, Human
cucauauuccugcagccuggaggc

SEQ ID NO: 2136959 - RNA, 15 nt, Human
cucauauuccugcag

SEQ ID NO: 2136960 - RNA, 20 nt, Human
cucauauuccugcagccugg

SEQ ID NO: 2136961 - RNA, 13 nt, Human
cucauccugcagg

SEQ ID NO: 2136962 - RNA, 22 nt, Human
cucauccccaggggucccagcc

SEQ ID NO: 2136963 - RNA, 23 nt, Human
cucauccccaggggucccagcca

SEQ ID NO: 2136964 - RNA, 13 nt, Human
cucauccccaggg

SEQ ID NO: 2136965 - RNA, 14 nt, Human
cucauccccagggg

SEQ ID NO: 2136966 - RNA, 24 nt, Human
cuccauucccguggaacguuuuuc

SEQ ID NO: 2136967 - RNA, 14 nt, Human
cuccaugugggcua

SEQ ID NO: 2136968 - RNA, 16 nt, Human
cuccauuccuggagcc

SEQ ID NO: 2136969 - RNA, 17 nt, Human
cuccauuccuggagccc

SEQ ID NO: 2136970 - RNA, 19 nt, Human
cuccauuccuggagcccga

SEQ ID NO: 2136971 - RNA, 20 nt, Human
cuccauuccuggagcccgag

SEQ ID NO: 2136972 - RNA, 21 nt, Human
cuccauuccuggagcccgagg

SEQ ID NO: 2136973 - RNA, 14 nt, Human
cuccauucugacca

SEQ ID NO: 2136974 - RNA, 20 nt, Human
cuccauucugaccauuucag

SEQ ID NO: 2136975 - RNA, 16 nt, Human
cuccauuguuuugccu

SEQ ID NO: 2136976 - RNA, 21 nt, Human
cucccaaggggcccaaauucu

SEQ ID NO: 2136977 - RNA, 22 nt, Human
cucccaaggggcccaaauucuu

SEQ ID NO: 2136978 - RNA, 14 nt, Human
cucccaggcgcccc

SEQ ID NO: 2136979 - RNA, 22 nt, Human
cucccaggccaggcuccuuccu

SEQ ID NO: 2136980 - RNA, 17 nt, Human
cucccaggccaggcucc

SEQ ID NO: 2136981 - RNA, 21 nt, Human
cucccaggccaggcuccuucc

SEQ ID NO: 2136982 - RNA, 11 nt, Human
cuccaggcucc

SEQ ID NO: 2136983 - RNA, 13 nt, Human
cuccaucuccacu

SEQ ID NO: 2136984 - RNA, 20 nt, Human
cuccaucgcugucaucucag

SEQ ID NO: 2136985 - RNA, 18 nt, Human
cuccagcuguucagcugg

SEQ ID NO: 2136986 - RNA, 19 nt, Human
cuccagcuguucagcuggu

SEQ ID NO: 2136987 - RNA, 13 nt, Human
cuccagcucagca

SEQ ID NO: 2136988 - RNA, 14 nt, Human
cuccagcucagcag

SEQ ID NO: 2136989 - RNA, 14 nt, Human
cuccagccugagca

SEQ ID NO: 2136990 - RNA, 19 nt, Human
cuccagcuggguuggaaaa

SEQ ID NO: 2136991 - RNA, 13 nt, Human
cuccagcuguuca

SEQ ID NO: 2136992 - RNA, 12 nt, Human
cuccacccugcu

SEQ ID NO: 2136993 - RNA, 15 nt, Human
cuccaccucagccuu

SEQ ID NO: 2136994 - RNA, 16 nt, Human
cuccaccucagccuug

SEQ ID NO: 2136995 - RNA, 17 nt, Human
cuccaccucagccuugg

SEQ ID NO: 2136996 - RNA, 15 nt, Human
cuccacagcuaccuc

SEQ ID NO: 2136997 - RNA, 11 nt, Human
cuccacccugc

SEQ ID NO: 2136998 - RNA, 16 nt, Human
cuccaccccccagaac

SEQ ID NO: 2136999 - RNA, 21 nt, Human
cuccaccccccagaaccuguc

SEQ ID NO: 2137000 - RNA, 22 nt, Human
cuccaccccccagaaccugucc

SEQ ID NO: 2137001 - RNA, 23 nt, Human
cuccaccccccagaaccuguccu

SEQ ID NO: 2137002 - RNA, 14 nt, Human
cuccacagccgcag

SEQ ID NO: 2137003 - RNA, 15 nt, Human
cuccacagccgcagc

SEQ ID NO: 2137004 - RNA, 13 nt, Human
cuccagccaaccc

SEQ ID NO: 2137005 - RNA, 14 nt, Human
cuccagccaacccc

SEQ ID NO: 2137006 - RNA, 17 nt, Human
cuccagccaaccccugu

SEQ ID NO: 2137007 - RNA, 18 nt, Human
cuccagccaaccccugug

SEQ ID NO: 2137008 - RNA, 19 nt, Human
cuccagccaaccccugugg

SEQ ID NO: 2137009 - RNA, 20 nt, Human
cuccagccaaccccugugga

SEQ ID NO: 2137010 - RNA, 21 nt, Human
cuccagccaaccccuguggag

SEQ ID NO: 2137011 - RNA, 20 nt, Human
cuccagcucaccagccccag

SEQ ID NO: 2137012 - RNA, 19 nt, Human
cuccagcucaccagcccca

SEQ ID NO: 2137013 - RNA, 13 nt, Human
cuccagccugagc

SEQ ID NO: 2137014 - RNA, 20 nt, Human
cuccagaccccuggcuuuuc

SEQ ID NO: 2137015 - RNA, 19 nt, Human
cuccagaccccuggcuuuu

SEQ ID NO: 2137016 - RNA, 19 nt, Human
cuccacucugacuggcaca

SEQ ID NO: 2137017 - RNA, 16 nt, Human
cuccacugccucugga

SEQ ID NO: 2137018 - RNA, 18 nt, Human
cuccagaccccuggcuuu

SEQ ID NO: 2137019 - RNA, 17 nt, Human
cuccagaccccuggcuu

SEQ ID NO: 2137020 - RNA, 15 nt, Human
cuccagaccccuggc

SEQ ID NO: 2137021 - RNA, 14 nt, Human
cuccagaccccugg

SEQ ID NO: 2137022 - RNA, 11 nt, Human
cuccacugccu

SEQ ID NO: 2137023 - RNA, 12 nt, Human
cuccacugcccu

SEQ ID NO: 2137024 - RNA, 13 nt, Human
cuccacugcccuc

SEQ ID NO: 2137025 - RNA, 14 nt, Human
cuccacugcccucu

SEQ ID NO: 2137026 - RNA, 15 nt, Human
cuccacugcccucug

SEQ ID NO: 2137027 - RNA, 18 nt, Human
cuccaccucagccuugga

SEQ ID NO: 2137028 - RNA, 21 nt, Human
cucuccauucccguggaacgu

SEQ ID NO: 2137029 - RNA, 16 nt, Human
cucuccagucuuccac

SEQ ID NO: 2137030 - RNA, 18 nt, Human
cucuccagucuuccaccu

SEQ ID NO: 2137031 - RNA, 21 nt, Human
cucuccagucuuccaccugga

SEQ ID NO: 2137032 - RNA, 22 nt, Human
cucuccagucuuccaccuggaa

SEQ ID NO: 2137033 - RNA, 20 nt, Human
cucuccaccucagccuugga

SEQ ID NO: 2137034 - RNA, 13 nt, Human
cucucccaucacu

SEQ ID NO: 2137035 - RNA, 12 nt, Human
cucucccaggac

SEQ ID NO: 2137036 - RNA, 13 nt, Human
cucucccaggacc

SEQ ID NO: 2137037 - RNA, 20 nt, Human
cucucccaucacuucccuac

SEQ ID NO: 2137038 - RNA, 12 nt, Human
cucucccaguug

SEQ ID NO: 2137039 - RNA, 14 nt, Human
cucucccaucacuu

SEQ ID NO: 2137040 - RNA, 18 nt, Human
cucucccaucacuucccu

SEQ ID NO: 2137041 - RNA, 23 nt, Human
cucuaaggccgaagaaggguccu

SEQ ID NO: 2137042 - RNA, 14 nt, Human
cucuaacaggggcu

SEQ ID NO: 2137043 - RNA, 23 nt, Human
cucuaauagcgaggcucuaacca

SEQ ID NO: 2137044 - RNA, 18 nt, Human
cucuaaugcucacgcucc

SEQ ID NO: 2137045 - RNA, 16 nt, Human
cucuccacugccuucg

SEQ ID NO: 2137046 - RNA, 12 nt, Human
cucuccaccuca

SEQ ID NO: 2137047 - RNA, 13 nt, Human
cucuccaccucag

SEQ ID NO: 2137048 - RNA, 14 nt, Human
cucuccaccucagc

SEQ ID NO: 2137049 - RNA, 15 nt, Human
cucuccaccucagcc

SEQ ID NO: 2137050 - RNA, 16 nt, Human
cucuccaccucagccu

SEQ ID NO: 2137051 - RNA, 17 nt, Human
cucuccaccucagccuu

SEQ ID NO: 2137052 - RNA, 18 nt, Human
cucuccaccucagccuug

SEQ ID NO: 2137053 - RNA, 10 nt, Human
cucuccaccu

SEQ ID NO: 2137054 - RNA, 15 nt, Human
cucucaucccccauu

SEQ ID NO: 2137055 - RNA, 18 nt, Human
cucucauccuuuucuccu

SEQ ID NO: 2137056 - RNA, 19 nt, Human
cucucauccuuuucuccua

SEQ ID NO: 2137057 - RNA, 12 nt, Human
cucucaguuuuu

SEQ ID NO: 2137058 - RNA, 13 nt, Human
cucuccccagcaa

SEQ ID NO: 2137059 - RNA, 13 nt, Human
cucuccccacacu

SEQ ID NO: 2137060 - RNA, 14 nt, Human
cucuccccacacua

SEQ ID NO: 2137061 - RNA, 15 nt, Human
cucuccccacacuaa

SEQ ID NO: 2137062 - RNA, 20 nt, Human
cucuccccaauauccucgcu

SEQ ID NO: 2137063 - RNA, 21 nt, Human
cucuccccaauauccucgcuc

SEQ ID NO: 2137064 - RNA, 12 nt, Human
cucuccccacac

SEQ ID NO: 2137065 - RNA, 13 nt, Human
cucuccugggccc

SEQ ID NO: 2137066 - RNA, 15 nt, Human
cucuccugggccccu

SEQ ID NO: 2137067 - RNA, 17 nt, Human
cucuccugggccccucc

SEQ ID NO: 2137068 - RNA, 18 nt, Human
cucuccugggccccuccc

SEQ ID NO: 2137069 - RNA, 19 nt, Human
cucuccugggccccucccu

SEQ ID NO: 2137070 - RNA, 20 nt, Human
cucuccugggccccucccua

SEQ ID NO: 2137071 - RNA, 21 nt, Human
cucuccugggccccucccuac

SEQ ID NO: 2137072 - RNA, 22 nt, Human
cucuccugggccccucccuacc

SEQ ID NO: 2137073 - RNA, 23 nt, Human
cucuccugggccccucccuaccu

SEQ ID NO: 2137074 - RNA, 18 nt, Human
cucuccuguacuuuuucc

SEQ ID NO: 2137075 - RNA, 12 nt, Human
cucuccugucca

SEQ ID NO: 2137076 - RNA, 19 nt, Human
cucuccuuuggccauucca

SEQ ID NO: 2137077 - RNA, 16 nt, Human
cucucggaaggcuggc

SEQ ID NO: 2137078 - RNA, 18 nt, Human
cucucggaaggcuggcug

SEQ ID NO: 2137079 - RNA, 19 nt, Human
cucucggaaggcuggcugg

SEQ ID NO: 2137080 - RNA, 22 nt, Human
cucucggaaggcuggcugggca

SEQ ID NO: 2137081 - RNA, 16 nt, Human
cucucugcagccagcc

SEQ ID NO: 2137082 - RNA, 17 nt, Human
cucucugcagccagccc

SEQ ID NO: 2137083 - RNA, 18 nt, Human
cucucugcagccagccca

SEQ ID NO: 2137084 - RNA, 19 nt, Human
cucucugcagccagcccag

SEQ ID NO: 2137085 - RNA, 20 nt, Human
cucucugcagccagcccagc

SEQ ID NO: 2137086 - RNA, 13 nt, Human
cucucuacccagc

SEQ ID NO: 2137087 - RNA, 16 nt, Human
cucucuacccagccca

SEQ ID NO: 2137088 - RNA, 17 nt, Human
cucucuacccagcccau

SEQ ID NO: 2137089 - RNA, 15 nt, Human
cucucuaaccuccuu

SEQ ID NO: 2137090 - RNA, 16 nt, Human
cucucuaaccuccuuu

SEQ ID NO: 2137091 - RNA, 18 nt, Human
cucucuaaccuccuuuac

SEQ ID NO: 2137092 - RNA, 19 nt, Human
cucucggaguaucugggaa

SEQ ID NO: 2137093 - RNA, 20 nt, Human
cucucggaguaucugggaac

SEQ ID NO: 2137094 - RNA, 19 nt, Human
cucugccccagcucuggcu

SEQ ID NO: 2137095 - RNA, 21 nt, Human
cucugccccagcucuggcuuc

SEQ ID NO: 2137096 - RNA, 13 nt, Human
cucugccccagcu

SEQ ID NO: 2137097 - RNA, 16 nt, Human
cucugccccagcucug

SEQ ID NO: 2137098 - RNA, 17 nt, Human
cucugccccagcucugg

SEQ ID NO: 2137099 - RNA, 18 nt, Human
cucugccccagcucuggc

SEQ ID NO: 2137100 - RNA, 12 nt, Human
cucugccccagc

SEQ ID NO: 2137101 - RNA, 14 nt, Human
cucugcccauuccc

SEQ ID NO: 2137102 - RNA, 15 nt, Human
cucugcccauucccc

SEQ ID NO: 2137103 - RNA, 18 nt, Human
cucugcccauuccccagc

SEQ ID NO: 2137104 - RNA, 19 nt, Human
cucugcccauuccccagcc

SEQ ID NO: 2137105 - RNA, 13 nt, Human
cucugcccagagc

SEQ ID NO: 2137106 - RNA, 14 nt, Human
cucugcccagagcu

SEQ ID NO: 2137107 - RNA, 15 nt, Human
cucugcccagagcug

SEQ ID NO: 2137108 - RNA, 16 nt, Human
cucugcccagagcugg

SEQ ID NO: 2137109 - RNA, 17 nt, Human
cucugcccagagcuggg

SEQ ID NO: 2137110 - RNA, 19 nt, Human
cucugcccagagcugggug

SEQ ID NO: 2137111 - RNA, 20 nt, Human
cucugcccagagcuggguga

SEQ ID NO: 2137112 - RNA, 18 nt, Human
cucugccaccuccccuau

SEQ ID NO: 2137113 - RNA, 14 nt, Human
cucugccagccaca

SEQ ID NO: 2137114 - RNA, 10 nt, Human
cucugccacc

SEQ ID NO: 2137115 - RNA, 12 nt, Human
cucugccaccuc

SEQ ID NO: 2137116 - RNA, 13 nt, Human
cucugccaccucc

SEQ ID NO: 2137117 - RNA, 14 nt, Human
cucugccaccuccc

SEQ ID NO: 2137118 - RNA, 20 nt, Human
cucugcccucccuccuuccu

SEQ ID NO: 2137119 - RNA, 15 nt, Human
cucugcccugcccua

SEQ ID NO: 2137120 - RNA, 16 nt, Human
cucugcccugcccuag

SEQ ID NO: 2137121 - RNA, 17 nt, Human
cucugcccugcccuagc

SEQ ID NO: 2137122 - RNA, 19 nt, Human
cucugcccugcccuagcuc

SEQ ID NO: 2137123 - RNA, 20 nt, Human
cucugcccugcccuagcucc

SEQ ID NO: 2137124 - RNA, 23 nt, Human
cucugcccugcccuagcuccaca

SEQ ID NO: 2137125 - RNA, 14 nt, Human
cucugccuccucuu

SEQ ID NO: 2137126 - RNA, 13 nt, Human
cucugccuguccc

SEQ ID NO: 2137127 - RNA, 14 nt, Human
cucugccugucccu

SEQ ID NO: 2137128 - RNA, 16 nt, Human
cucugccugucccucu

SEQ ID NO: 2137129 - RNA, 18 nt, Human
cucugccugucccucuca

SEQ ID NO: 2137130 - RNA, 19 nt, Human
cucugccugucccucucag

SEQ ID NO: 2137131 - RNA, 20 nt, Human
cucugccugucccucucagg

SEQ ID NO: 2137132 - RNA, 16 nt, Human
cucugccugugagcca

SEQ ID NO: 2137133 - RNA, 17 nt, Human
cucugccugugagccag

SEQ ID NO: 2137134 - RNA, 19 nt, Human
cucugccugugagccaguc

SEQ ID NO: 2137135 - RNA, 20 nt, Human
cucugccugugagccagucu

SEQ ID NO: 2137136 - RNA, 16 nt, Human
cucugccuccucuuca

SEQ ID NO: 2137137 - RNA, 15 nt, Human
cucugccuccucuuc

SEQ ID NO: 2137138 - RNA, 14 nt, Human
cucugccucugaca

SEQ ID NO: 2137139 - RNA, 21 nt, Human
cucugccugucccucucaggc

SEQ ID NO: 2137140 - RNA, 15 nt, Human
cucugcuuuggaaau

SEQ ID NO: 2137141 - RNA, 14 nt, Human
cucuggacaggcau

SEQ ID NO: 2137142 - RNA, 16 nt, Human
cucuggacaaagcguu

SEQ ID NO: 2137143 - RNA, 23 nt, Human
cucuggaaaggaggaaggagccu

SEQ ID NO: 2137144 - RNA, 21 nt, Human
cucuggaagagaggaaugccu

SEQ ID NO: 2137145 - RNA, 13 nt, Human
cucuggacuggcu

SEQ ID NO: 2137146 - RNA, 14 nt, Human
cucuggacuggcua

SEQ ID NO: 2137147 - RNA, 15 nt, Human
cucuggacuggcuag

SEQ ID NO: 2137148 - RNA, 16 nt, Human
cucuggacuggcuaga

SEQ ID NO: 2137149 - RNA, 19 nt, Human
cucuggacuggcuagaguc

SEQ ID NO: 2137150 - RNA, 10 nt, Human
cucugcacaa

SEQ ID NO: 2137151 - RNA, 19 nt, Human
cucugauauuccaugaaug

SEQ ID NO: 2137152 - RNA, 20 nt, Human
cucugauauuccaugaaugu

SEQ ID NO: 2137153 - RNA, 23 nt, Human
cucugauauuccaugaauguauc

SEQ ID NO: 2137154 - RNA, 15 nt, Human
cucugaucaaguauu

SEQ ID NO: 2137155 - RNA, 15 nt, Human
cucugauguaaauga

SEQ ID NO: 2137156 - RNA, 18 nt, Human
cucugauguaaaugaagu

SEQ ID NO: 2137157 - RNA, 22 nt, Human
cucugcaagaauugaagcagga

SEQ ID NO: 2137158 - RNA, 13 nt, Human
cucugagccccug

SEQ ID NO: 2137159 - RNA, 22 nt, Human
cucugagccccugggacugcug

SEQ ID NO: 2137160 - RNA, 16 nt, Human
cucugagcaaaugugg

SEQ ID NO: 2137161 - RNA, 17 nt, Human
cucugaggacugcacca

SEQ ID NO: 2137162 - RNA, 19 nt, Human
cucugaggcucuuucuggg

SEQ ID NO: 2137163 - RNA, 20 nt, Human
cucugaggcucuuucugggc

SEQ ID NO: 2137164 - RNA, 21 nt, Human
cucucugcagccagcccagcc

SEQ ID NO: 2137165 - RNA, 13 nt, Human
cucucugcuguac

SEQ ID NO: 2137166 - RNA, 16 nt, Human
cucucuggaaaggagg

SEQ ID NO: 2137167 - RNA, 14 nt, Human
cucucugccuguga

SEQ ID NO: 2137168 - RNA, 15 nt, Human
cucucugccugugag

SEQ ID NO: 2137169 - RNA, 18 nt, Human
cucucugccugugagcca

SEQ ID NO: 2137170 - RNA, 20 nt, Human
cucucugccugugagccagu

SEQ ID NO: 2137171 - RNA, 22 nt, Human
cucucugccugugagccagucu

SEQ ID NO: 2137172 - RNA, 23 nt, Human
cucugagaaggggaggaccucug

SEQ ID NO: 2137173 - RNA, 11 nt, Human
cugacccacug

SEQ ID NO: 2137174 - RNA, 23 nt, Human
cugaccauccacucuacccuccc

SEQ ID NO: 2137175 - RNA, 19 nt, Human
cugaccauccacucuaccc

SEQ ID NO: 2137176 - RNA, 22 nt, Human
cugaccauccacucuacccucc

SEQ ID NO: 2137177 - RNA, 15 nt, Human
cugaccauccacucu

SEQ ID NO: 2137178 - RNA, 16 nt, Human
cugaccauccacucua

SEQ ID NO: 2137179 - RNA, 22 nt, Human
cugaccacgcuuucuagcuguu

SEQ ID NO: 2137180 - RNA, 21 nt, Human
cugaccacacuuccuguccag

SEQ ID NO: 2137181 - RNA, 19 nt, Human
cugacaggcaaugcuggcu

SEQ ID NO: 2137182 - RNA, 18 nt, Human
cugacaggcaaugcuggc

SEQ ID NO: 2137183 - RNA, 17 nt, Human
cugacaggcaaugcugg

SEQ ID NO: 2137184 - RNA, 16 nt, Human
cugacaggcaaugcug

SEQ ID NO: 2137185 - RNA, 20 nt, Human
cugacaggcaaugcuggcug

SEQ ID NO: 2137186 - RNA, 23 nt, Human
cugacauuaacaguuuuccauga

SEQ ID NO: 2137187 - RNA, 17 nt, Human
cugacauuguuggccaa

SEQ ID NO: 2137188 - RNA, 21 nt, Human
cugacagacacaggcccggcu

SEQ ID NO: 2137189 - RNA, 11 nt, Human
cugacaggcaa

SEQ ID NO: 2137190 - RNA, 12 nt, Human
cugacagaggag

SEQ ID NO: 2137191 - RNA, 19 nt, Human
cugacagacacaggcccgg

SEQ ID NO: 2137192 - RNA, 16 nt, Human
cugaauuguccccagu

SEQ ID NO: 2137193 - RNA, 15 nt, Human
cugaauuguccccag

SEQ ID NO: 2137194 - RNA, 21 nt, Human
cugaauaugaacggugagcau

SEQ ID NO: 2137195 - RNA, 16 nt, Human
cugaauauuuauauuu

SEQ ID NO: 2137196 - RNA, 20 nt, Human
cugaauauuuauauuucacu

SEQ ID NO: 2137197 - RNA, 21 nt, Human
cugaauauuuauauuucacua

SEQ ID NO: 2137198 - RNA, 16 nt, Human
cugaauagcucccaga

SEQ ID NO: 2137199 - RNA, 23 nt, Human
cugaauagcucccagauuucagu

SEQ ID NO: 2137200 - RNA, 19 nt, Human
cugaauagucuucagagau

SEQ ID NO: 2137201 - RNA, 18 nt, Human
cugaauaccucuuugaaa

SEQ ID NO: 2137202 - RNA, 20 nt, Human
cugaauaccucuuugaaaga

SEQ ID NO: 2137203 - RNA, 17 nt, Human
cugaaugaaauaucaga

SEQ ID NO: 2137204 - RNA, 20 nt, Human
cugaaugaacaaccucggcu

SEQ ID NO: 2137205 - RNA, 22 nt, Human
cugaaugaacaaccucggcucc

SEQ ID NO: 2137206 - RNA, 16 nt, Human
cugaagucacacagug

SEQ ID NO: 2137207 - RNA, 15 nt, Human
cugaagucacacagu

SEQ ID NO: 2137208 - RNA, 14 nt, Human
cugaagucacacag

SEQ ID NO: 2137209 - RNA, 22 nt, Human
cugaagucacugcacagugcau

SEQ ID NO: 2137210 - RNA, 16 nt, Human
cugaagucacugcaca

SEQ ID NO: 2137211 - RNA, 17 nt, Human
cugaagucacugcacag

SEQ ID NO: 2137212 - RNA, 16 nt, Human
cugaauacauucugcu

SEQ ID NO: 2137213 - RNA, 18 nt, Human
cugaauacauucugcuuu

SEQ ID NO: 2137214 - RNA, 11 nt, Human
cugaauaauaa

SEQ ID NO: 2137215 - RNA, 16 nt, Human
cugaauacagaggcaa

SEQ ID NO: 2137216 - RNA, 21 nt, Human
cugaagacucauucuucugua

SEQ ID NO: 2137217 - RNA, 16 nt, Human
cugaaccuuccaucuc

SEQ ID NO: 2137218 - RNA, 13 nt, Human
cugaacuucagcu

SEQ ID NO: 2137219 - RNA, 20 nt, Human
cugaagagcuauuauauaaa

SEQ ID NO: 2137220 - RNA, 19 nt, Human
cugaagaggaacugggccu

SEQ ID NO: 2137221 - RNA, 14 nt, Human
cugaaccuuccauc

SEQ ID NO: 2137222 - RNA, 13 nt, Human
cugaacggggaga

SEQ ID NO: 2137223 - RNA, 21 nt, Human
cugaaccuggguaacuaggga

SEQ ID NO: 2137224 - RNA, 14 nt, Human
cucuucuccacugg

SEQ ID NO: 2137225 - RNA, 17 nt, Human
cucuucuccacuggaug

SEQ ID NO: 2137226 - RNA, 15 nt, Human
cucuucuccacugga

SEQ ID NO: 2137227 - RNA, 19 nt, Human
cucuucuccacuggaugga

SEQ ID NO: 2137228 - RNA, 12 nt, Human
cucuucuccagg

SEQ ID NO: 2137229 - RNA, 16 nt, Human
cucuucuccuuucaca

SEQ ID NO: 2137230 - RNA, 15 nt, Human
cucuucuccuuucac

SEQ ID NO: 2137231 - RNA, 13 nt, Human
cucuucuccuuuc

SEQ ID NO: 2137232 - RNA, 21 nt, Human
cucuucugcuccacccuuggc

SEQ ID NO: 2137233 - RNA, 19 nt, Human
cucuucugcuccacccuug

SEQ ID NO: 2137234 - RNA, 20 nt, Human
cucuucugcuccacccuugg

SEQ ID NO: 2137235 - RNA, 14 nt, Human
cucuucugcuccac

SEQ ID NO: 2137236 - RNA, 15 nt, Human
cucuucugcuccacc

SEQ ID NO: 2137237 - RNA, 16 nt, Human
cucuucugcuccaccc

SEQ ID NO: 2137238 - RNA, 18 nt, Human
cucuucugcuccacccuu

SEQ ID NO: 2137239 - RNA, 14 nt, Human
cucuggagccaccu

SEQ ID NO: 2137240 - RNA, 15 nt, Human
cucuggagccaccug

SEQ ID NO: 2137241 - RNA, 16 nt, Human
cucuggagccaccugu

SEQ ID NO: 2137242 - RNA, 20 nt, Human
cucuggagccaccuguccca

SEQ ID NO: 2137243 - RNA, 22 nt, Human
cucuggagccaccugucccacc

SEQ ID NO: 2137244 - RNA, 22 nt, Human
cucuguuccuucacauccugug

SEQ ID NO: 2137245 - RNA, 14 nt, Human
cucuguuccuggcu

SEQ ID NO: 2137246 - RNA, 15 nt, Human
cucuguuccuggcuc

SEQ ID NO: 2137247 - RNA, 22 nt, Human
cucuguuccuggcucagccuca

SEQ ID NO: 2137248 - RNA, 16 nt, Human
cucuguuccuucacau

SEQ ID NO: 2137249 - RNA, 13 nt, Human
cucuuaaaaccca

SEQ ID NO: 2137250 - RNA, 24 nt, Human
cucuuaaaacccaagugccuuagc

SEQ ID NO: 2137251 - RNA, 21 nt, Human
cucuggaaugacaugugucaa

SEQ ID NO: 2137252 - RNA, 20 nt, Human
cucuuaaagcugccuguagu

SEQ ID NO: 2137253 - RNA, 22 nt, Human
cucuucagguucuuagugucac

SEQ ID NO: 2137254 - RNA, 14 nt, Human
cucuucagguucuu

SEQ ID NO: 2137255 - RNA, 15 nt, Human
cucuucagguucuua

SEQ ID NO: 2137256 - RNA, 18 nt, Human
cucuucaggccucccucu

SEQ ID NO: 2137257 - RNA, 19 nt, Human
cucuucaggccucccucuc

SEQ ID NO: 2137258 - RNA, 20 nt, Human
cucuucaggccucccucucu

SEQ ID NO: 2137259 - RNA, 18 nt, Human
cucuuucuccuuagucuu

SEQ ID NO: 2137260 - RNA, 15 nt, Human
cucuuuggacacuca

SEQ ID NO: 2137261 - RNA, 18 nt, Human
cucuuuggacacucacac

SEQ ID NO: 2137262 - RNA, 17 nt, Human
cucuuucuggccugccu

SEQ ID NO: 2137263 - RNA, 12 nt, Human
cucuuucugggc

SEQ ID NO: 2137264 - RNA, 15 nt, Human
cucuuucagaaaaca

SEQ ID NO: 2137265 - RNA, 21 nt, Human
cucuuucagaaaacagaaaaa

SEQ ID NO: 2137266 - RNA, 17 nt, Human
cucuuuccaucuacccu

SEQ ID NO: 2137267 - RNA, 12 nt, Human
cucuuguaagau

SEQ ID NO: 2137268 - RNA, 13 nt, Human
cucuuguaagauu

SEQ ID NO: 2137269 - RNA, 14 nt, Human
cucuuguaagauuu

SEQ ID NO: 2137270 - RNA, 15 nt, Human
cucuuguaagauuuu

SEQ ID NO: 2137271 - RNA, 17 nt, Human
cucuuguaagauuuuga

SEQ ID NO: 2137272 - RNA, 18 nt, Human
cucuuguaagauuuugaa

SEQ ID NO: 2137273 - RNA, 19 nt, Human
cucuuguaagauuuugaaa

SEQ ID NO: 2137274 - RNA, 20 nt, Human
cucuuguaagauuuugaaaa

SEQ ID NO: 2137275 - RNA, 23 nt, Human
cucuuguaagauuuugaaaacua

SEQ ID NO: 2137276 - RNA, 15 nt, Human
cucuugaccucaggu

SEQ ID NO: 2137277 - RNA, 13 nt, Human
cucuugaccucag

SEQ ID NO: 2137278 - RNA, 16 nt, Human
cucuugaccucaggug

SEQ ID NO: 2137279 - RNA, 20 nt, Human
cucuugaagaugcugaaaca

SEQ ID NO: 2137280 - RNA, 21 nt, Human
cucuugaagacacugaaauau

SEQ ID NO: 2137281 - RNA, 20 nt, Human
cucuugaagacacugaaaua

SEQ ID NO: 2137282 - RNA, 20 nt, Human
cucuugguuuccuuccuugg

SEQ ID NO: 2137283 - RNA, 18 nt, Human
cucuugggcugagacugg

SEQ ID NO: 2137284 - RNA, 17 nt, Human
cucuugggcugagacug

SEQ ID NO: 2137285 - RNA, 15 nt, Human
cucuugggcugagac

SEQ ID NO: 2137286 - RNA, 16 nt, Human
cucuugggcugagacu

SEQ ID NO: 2137287 - RNA, 15 nt, Human
cucuuggcuggcuuc

SEQ ID NO: 2137288 - RNA, 14 nt, Human
cuuacuuaguguua

SEQ ID NO: 2137289 - RNA, 18 nt, Human
cuuacuuauuaucuucag

SEQ ID NO: 2137290 - RNA, 13 nt, Human
cuuacuuacagca

SEQ ID NO: 2137291 - RNA, 18 nt, Human
cuuacuuagcaugcacaa

SEQ ID NO: 2137292 - RNA, 14 nt, Human
cuuacuccaggaga

SEQ ID NO: 2137293 - RNA, 20 nt, Human
cuuacuacaugugggagcuu

SEQ ID NO: 2137294 - RNA, 18 nt, Human
cuuacuacaugugggagc

SEQ ID NO: 2137295 - RNA, 19 nt, Human
cuuacuauuaagcaguaaa

SEQ ID NO: 2137296 - RNA, 21 nt, Human
cuuaaugauccguuccauugc

SEQ ID NO: 2137297 - RNA, 15 nt, Human
cuuagaagucacaca

SEQ ID NO: 2137298 - RNA, 13 nt, Human
cuuacuuuguaug

SEQ ID NO: 2137299 - RNA, 14 nt, Human
cuuacuuuguauga

SEQ ID NO: 2137300 - RNA, 15 nt, Human
cuuacuuuguaugau

SEQ ID NO: 2137301 - RNA, 18 nt, Human
cuuacuuuguaugauauu

SEQ ID NO: 2137302 - RNA, 19 nt, Human
cuuacuuuguaugauauuc

SEQ ID NO: 2137303 - RNA, 17 nt, Human
cuuagaaauugcauuuc

SEQ ID NO: 2137304 - RNA, 15 nt, Human
cuuagaaccuuucuu

SEQ ID NO: 2137305 - RNA, 13 nt, Human
cuuagauaucuuu

SEQ ID NO: 2137306 - RNA, 14 nt, Human
cuuagauaucuuuu

SEQ ID NO: 2137307 - RNA, 17 nt, Human
cuuagauaucuuuuuau

SEQ ID NO: 2137308 - RNA, 20 nt, Human
cuuagauaucuuuuuauuga

SEQ ID NO: 2137309 - RNA, 15 nt, Human
cuuauacauuugaua

SEQ ID NO: 2137310 - RNA, 23 nt, Human
cuuauagucaauguuucuuuuau

SEQ ID NO: 2137311 - RNA, 18 nt, Human
cuuagguacuuauuccag

SEQ ID NO: 2137312 - RNA, 17 nt, Human
cuuagguuggcaaaaag

SEQ ID NO: 2137313 - RNA, 19 nt, Human
cuuauauuuuuaauaaaag

SEQ ID NO: 2137314 - RNA, 17 nt, Human
cuuaucugugcgugaaa

SEQ ID NO: 2137315 - RNA, 19 nt, Human
cuuaucugugcgugaaaca

SEQ ID NO: 2137316 - RNA, 20 nt, Human
cuuaucugugcgugaaacac

SEQ ID NO: 2137317 - RNA, 21 nt, Human
cuuaucugugcgugaaacaca

SEQ ID NO: 2137318 - RNA, 16 nt, Human
cuuaucuuacaaagug

SEQ ID NO: 2137319 - RNA, 17 nt, Human
cuuaucuuacaaagugu

SEQ ID NO: 2137320 - RNA, 18 nt, Human
cuuaugaauauuuauaac

SEQ ID NO: 2137321 - RNA, 12 nt, Human
cuuauuguucca

SEQ ID NO: 2137322 - RNA, 13 nt, Human
cuuauuguuccaa

SEQ ID NO: 2137323 - RNA, 14 nt, Human
cuuauuguuccaag

SEQ ID NO: 2137324 - RNA, 15 nt, Human
cuuauuguuccaaga

SEQ ID NO: 2137325 - RNA, 17 nt, Human
cuuauuguuccaagaca

SEQ ID NO: 2137326 - RNA, 15 nt, Human
cuuauuuaaugaaag

SEQ ID NO: 2137327 - RNA, 22 nt, Human
cuuauuguuccaagacauuguc

SEQ ID NO: 2137328 - RNA, 19 nt, Human
cuuauuguuccaagacauu

SEQ ID NO: 2137329 - RNA, 20 nt, Human
cuuauuguuccaagacauug

SEQ ID NO: 2137330 - RNA, 13 nt, Human
cuguuuauggccu

SEQ ID NO: 2137331 - RNA, 14 nt, Human
cuguuuauggccuc

SEQ ID NO: 2137332 - RNA, 15 nt, Human
cuguuuauggccuca

SEQ ID NO: 2137333 - RNA, 16 nt, Human
cuguuuauggccucag

SEQ ID NO: 2137334 - RNA, 18 nt, Human
cuguuuacaagaaaaaau

SEQ ID NO: 2137335 - RNA, 20 nt, Human
cuguuuacaagaaaaaauga

SEQ ID NO: 2137336 - RNA, 20 nt, Human
cugguucuuguguuggcugu

SEQ ID NO: 2137337 - RNA, 22 nt, Human
cugguucuucauuuauugagca

SEQ ID NO: 2137338 - RNA, 14 nt, Human
cuguuuacaagaaa

SEQ ID NO: 2137339 - RNA, 15 nt, Human
cuguuuacaagaaaa

SEQ ID NO: 2137340 - RNA, 16 nt, Human
cuguuuacaagaaaaa

SEQ ID NO: 2137341 - RNA, 17 nt, Human
cuguuuacaagaaaaaa

SEQ ID NO: 2137342 - RNA, 13 nt, Human
cuguuuccuuuua

SEQ ID NO: 2137343 - RNA, 15 nt, Human
cuguuuccuuuuaug

SEQ ID NO: 2137344 - RNA, 13 nt, Human
cuguuucucugcu

SEQ ID NO: 2137345 - RNA, 14 nt, Human
cuguuucucugcug

SEQ ID NO: 2137346 - RNA, 22 nt, Human
cuguuuauggccucagcugccu

SEQ ID NO: 2137347 - RNA, 17 nt, Human
cuguuuauggccucagc

SEQ ID NO: 2137348 - RNA, 18 nt, Human
cuguuuauggccucagcu

SEQ ID NO: 2137349 - RNA, 19 nt, Human
cuguuuauggccucagcug

SEQ ID NO: 2137350 - RNA, 21 nt, Human
cuguuuauggccucagcugcc

SEQ ID NO: 2137351 - RNA, 17 nt, Human
cuguuuucucuugagag

SEQ ID NO: 2137352 - RNA, 14 nt, Human
cuguuuuauacugu

SEQ ID NO: 2137353 - RNA, 12 nt, Human
cuguuuugaauu

SEQ ID NO: 2137354 - RNA, 22 nt, Human
cuguuuugccugaaguuggagu

SEQ ID NO: 2137355 - RNA, 21 nt, Human
cuguuuuucagggagguggcu

SEQ ID NO: 2137356 - RNA, 13 nt, Human
cuguuuucucuug

SEQ ID NO: 2137357 - RNA, 14 nt, Human
cuguuuucucuuga

SEQ ID NO: 2137358 - RNA, 12 nt, Human
cuguuuuaaauu

SEQ ID NO: 2137359 - RNA, 22 nt, Human
cuguuuuaaauuuauuucaaaa

SEQ ID NO: 2137360 - RNA, 17 nt, Human
cuguuucugcuugcucu

SEQ ID NO: 2137361 - RNA, 20 nt, Human
cuguuucuauucucuccuca

SEQ ID NO: 2137362 - RNA, 20 nt, Human
cuguuuguuugacaaagaaa

SEQ ID NO: 2137363 - RNA, 14 nt, Human
cuuaaguaucagaa

SEQ ID NO: 2137364 - RNA, 15 nt, Human
cuuaaguaucagaaa

SEQ ID NO: 2137365 - RNA, 11 nt, Human
cuuaagaacac

SEQ ID NO: 2137366 - RNA, 17 nt, Human
cuuaagaacacaaagcg

SEQ ID NO: 2137367 - RNA, 12 nt, Human
cuuaauaaauuc

SEQ ID NO: 2137368 - RNA, 17 nt, Human
cuuaauaaauucagaua

SEQ ID NO: 2137369 - RNA, 18 nt, Human
cuuaauaaauucagauau

SEQ ID NO: 2137370 - RNA, 14 nt, Human
cuuaaugagauagu

SEQ ID NO: 2137371 - RNA, 12 nt, Human
cuuaaugagaua

SEQ ID NO: 2137372 - RNA, 16 nt, Human
cuuaaccgcaucagaa

SEQ ID NO: 2137373 - RNA, 16 nt, Human
cuuaaauuuuaauuua

SEQ ID NO: 2137374 - RNA, 17 nt, Human
cuuaaauuuuaauuuau

SEQ ID NO: 2137375 - RNA, 20 nt, Human
cuuaaccccaguaagccacu

SEQ ID NO: 2137376 - RNA, 11 nt, Human
cuuaaauuaaa

SEQ ID NO: 2137377 - RNA, 12 nt, Human
cuuaaauuaaac

SEQ ID NO: 2137378 - RNA, 14 nt, Human
cuuaaauuaaacaa

SEQ ID NO: 2137379 - RNA, 15 nt, Human
cuuaaauuaaacaau

SEQ ID NO: 2137380 - RNA, 17 nt, Human
cuuaaauuaaacaauuu

SEQ ID NO: 2137381 - RNA, 19 nt, Human
cuuaaauuaaacaauuuau

SEQ ID NO: 2137382 - RNA, 20 nt, Human
cuuaaauuaaacaauuuauu

SEQ ID NO: 2137383 - RNA, 21 nt, Human
cuuaaauuaaacaauuuauuu

SEQ ID NO: 2137384 - RNA, 22 nt, Human
cuuaaauuaaacaauuuauuuu

SEQ ID NO: 2137385 - RNA, 17 nt, Human
cuuaaaaaaaugacaga

SEQ ID NO: 2137386 - RNA, 12 nt, Human
cuuaaaaaacuu

SEQ ID NO: 2137387 - RNA, 18 nt, Human
cuuaaaaaacuuguaaau

SEQ ID NO: 2137388 - RNA, 17 nt, Human
cuguuuuuuccugagcu

SEQ ID NO: 2137389 - RNA, 18 nt, Human
cuguuuuuuccugagcuu

SEQ ID NO: 2137390 - RNA, 14 nt, Human
cuuaaaaaaauaaa

SEQ ID NO: 2137391 - RNA, 15 nt, Human
cuuaaaaaaaugaca

SEQ ID NO: 2137392 - RNA, 19 nt, Human
cuguuuuuuaaacuaggaa

SEQ ID NO: 2137393 - RNA, 13 nt, Human
cuguuuuuuaguu

SEQ ID NO: 2137394 - RNA, 16 nt, Human
cuuaaaugagaaggaa

SEQ ID NO: 2137395 - RNA, 15 nt, Human
cuuaaaaaaaacuca

SEQ ID NO: 2137396 - RNA, 17 nt, Human
cuuaaaaaauaaaaacu

SEQ ID NO: 2137397 - RNA, 13 nt, Human
cuuaaaaaauguc

SEQ ID NO: 2137398 - RNA, 14 nt, Human
cuuaaaaaaugucc

SEQ ID NO: 2137399 - RNA, 13 nt, Human
cuuaaauaucaau

SEQ ID NO: 2137400 - RNA, 18 nt, Human
cuuaaauaucaaucauuu

SEQ ID NO: 2137401 - RNA, 21 nt, Human
cuuaaaugaaagcauguggca

SEQ ID NO: 2137402 - RNA, 16 nt, Human
cuuaacuggagcccca

SEQ ID NO: 2137403 - RNA, 22 nt, Human
cuuaacuuaaauuuuaauuuau

SEQ ID NO: 2137404 - RNA, 11 nt, Human
cuuaacucuuu

SEQ ID NO: 2137405 - RNA, 13 nt, Human
cuuaacucuuugc

SEQ ID NO: 2137406 - RNA, 21 nt, Human
cuuaacucuuugccuuugcca

SEQ ID NO: 2137407 - RNA, 19 nt, Human
cuuaacugcauuuuuagac

SEQ ID NO: 2137408 - RNA, 15 nt, Human
cuuccagcacccugc

SEQ ID NO: 2137409 - RNA, 16 nt, Human
cuuccagcacccugca

SEQ ID NO: 2137410 - RNA, 15 nt, Human
cuuccacauuuuccc

SEQ ID NO: 2137411 - RNA, 13 nt, Human
cuuccaccagccu

SEQ ID NO: 2137412 - RNA, 14 nt, Human
cuuccaccagccug

SEQ ID NO: 2137413 - RNA, 15 nt, Human
cuuccaccagccugc

SEQ ID NO: 2137414 - RNA, 16 nt, Human
cuuccaccagccugca

SEQ ID NO: 2137415 - RNA, 14 nt, Human
cuuccagcacccug

SEQ ID NO: 2137416 - RNA, 23 nt, Human
cuuccaccaaguuggaacauccu

SEQ ID NO: 2137417 - RNA, 12 nt, Human
cuuccaccagcc

SEQ ID NO: 2137418 - RNA, 17 nt, Human
cuuccacaggucucaga

SEQ ID NO: 2137419 - RNA, 21 nt, Human
cuuccacaggucucagaaucu

SEQ ID NO: 2137420 - RNA, 16 nt, Human
cuuccaggaaaaagga

SEQ ID NO: 2137421 - RNA, 19 nt, Human
cuuccaggaaaaaggacag

SEQ ID NO: 2137422 - RNA, 20 nt, Human
cuuccaggaaaaaggacagg

SEQ ID NO: 2137423 - RNA, 23 nt, Human
cuuccagguucugguuagcucag

SEQ ID NO: 2137424 - RNA, 14 nt, Human
cuucccagcucucc

SEQ ID NO: 2137425 - RNA, 15 nt, Human
cuucccagcucuccc

SEQ ID NO: 2137426 - RNA, 18 nt, Human
cuucccagcucucccucu

SEQ ID NO: 2137427 - RNA, 20 nt, Human
cuucccagcucucccucugg

SEQ ID NO: 2137428 - RNA, 21 nt, Human
cuuccuacaagagcagccugu

SEQ ID NO: 2137429 - RNA, 22 nt, Human
cuuccuacaagagcagccugug

SEQ ID NO: 2137430 - RNA, 24 nt, Human
cuuccuacaagagcagccuguggc

SEQ ID NO: 2137431 - RNA, 18 nt, Human
cuuccuacaagagcagcc

SEQ ID NO: 2137432 - RNA, 15 nt, Human
cuuccggagauguag

SEQ ID NO: 2137433 - RNA, 14 nt, Human
cuuccggagaugua

SEQ ID NO: 2137434 - RNA, 14 nt, Human
cuucccuuuuacau

SEQ ID NO: 2137435 - RNA, 11 nt, Human
cuucccucugc

SEQ ID NO: 2137436 - RNA, 13 nt, Human
cuucccucugccu

SEQ ID NO: 2137437 - RNA, 15 nt, Human
cuucccucugccugu

SEQ ID NO: 2137438 - RNA, 16 nt, Human
cuucccucugccuguc

SEQ ID NO: 2137439 - RNA, 17 nt, Human
cuucccucugccugucc

SEQ ID NO: 2137440 - RNA, 18 nt, Human
cuucccucugccuguccc

SEQ ID NO: 2137441 - RNA, 19 nt, Human
cuucccucugccugucccu

SEQ ID NO: 2137442 - RNA, 12 nt, Human
cuucccagcugc

SEQ ID NO: 2137443 - RNA, 15 nt, Human
cuucccagcugcccc

SEQ ID NO: 2137444 - RNA, 16 nt, Human
cuucccagcugccccu

SEQ ID NO: 2137445 - RNA, 18 nt, Human
cuucccagcugccccucc

SEQ ID NO: 2137446 - RNA, 21 nt, Human
cuucccagcugccccucccug

SEQ ID NO: 2137447 - RNA, 22 nt, Human
cuucccagcugccccucccugc

SEQ ID NO: 2137448 - RNA, 11 nt, Human
cuucccagcuu

SEQ ID NO: 2137449 - RNA, 21 nt, Human
cuucccagcucucccucuggc

SEQ ID NO: 2137450 - RNA, 22 nt, Human
cuucccagcucucccucuggcc

SEQ ID NO: 2137451 - RNA, 13 nt, Human
cuuccccuuuccc

SEQ ID NO: 2137452 - RNA, 15 nt, Human
cuucccgcucagccc

SEQ ID NO: 2137453 - RNA, 19 nt, Human
cuuccccuugcccagggcu

SEQ ID NO: 2137454 - RNA, 23 nt, Human
cuuccccuugcccagggcucagc

SEQ ID NO: 2137455 - RNA, 17 nt, Human
cuucccgcucagcccuc

SEQ ID NO: 2137456 - RNA, 16 nt, Human
cuucccgcucagcccu

SEQ ID NO: 2137457 - RNA, 21 nt, Human
cuucccucaaagcuuccauuc

SEQ ID NO: 2137458 - RNA, 23 nt, Human
cuucccucaaagcuuccauucca

SEQ ID NO: 2137459 - RNA, 24 nt, Human
cuucccucaaagcuuccauuccac

SEQ ID NO: 2137460 - RNA, 15 nt, Human
cuucccucacaccgc

SEQ ID NO: 2137461 - RNA, 16 nt, Human
cuucccucuccccaag

SEQ ID NO: 2137462 - RNA, 18 nt, Human
cuucauuuccugugucuu

SEQ ID NO: 2137463 - RNA, 18 nt, Human
cuucaggucaggaguucg

SEQ ID NO: 2137464 - RNA, 23 nt, Human
cuucaggguucuccucuccccuc

SEQ ID NO: 2137465 - RNA, 14 nt, Human
cuucaggguucucc

SEQ ID NO: 2137466 - RNA, 18 nt, Human
cuucaggguucuccucuc

SEQ ID NO: 2137467 - RNA, 20 nt, Human
cuucaggguucuccucuccc

SEQ ID NO: 2137468 - RNA, 21 nt, Human
cuucaggguucuccucucccc

SEQ ID NO: 2137469 - RNA, 14 nt, Human
cuucagggggccag

SEQ ID NO: 2137470 - RNA, 15 nt, Human
cuucagggggccagg

SEQ ID NO: 2137471 - RNA, 23 nt, Human
cuucagggggccaggugcacaga

SEQ ID NO: 2137472 - RNA, 19 nt, Human
cuucauuucugauauagaa

SEQ ID NO: 2137473 - RNA, 20 nt, Human
cuucauuucugauauagaau

SEQ ID NO: 2137474 - RNA, 21 nt, Human
cuucauuucugauauagaauu

SEQ ID NO: 2137475 - RNA, 14 nt, Human
cuucauuuggagau

SEQ ID NO: 2137476 - RNA, 13 nt, Human
cuucauuuggaga

SEQ ID NO: 2137477 - RNA, 18 nt, Human
cuuccaacaggagcuggg

SEQ ID NO: 2137478 - RNA, 14 nt, Human
cuuccaacugcugc

SEQ ID NO: 2137479 - RNA, 15 nt, Human
cuuccaacugcugcc

SEQ ID NO: 2137480 - RNA, 17 nt, Human
cuuccaacugcugcccc

SEQ ID NO: 2137481 - RNA, 18 nt, Human
cuuccaacugcugcccca

SEQ ID NO: 2137482 - RNA, 19 nt, Human
cuuccaacugcugccccaa

SEQ ID NO: 2137483 - RNA, 13 nt, Human
cuuccaagaccug

SEQ ID NO: 2137484 - RNA, 14 nt, Human
cuuccaagaccuga

SEQ ID NO: 2137485 - RNA, 16 nt, Human
cuuccaagaccugacu

SEQ ID NO: 2137486 - RNA, 17 nt, Human
cuuccaagaccugacuc

SEQ ID NO: 2137487 - RNA, 18 nt, Human
cuuccaagaccugacuca

SEQ ID NO: 2137488 - RNA, 19 nt, Human
cuuccaagacuccagcccu

SEQ ID NO: 2137489 - RNA, 16 nt, Human
cuuccaagcaaaggug

SEQ ID NO: 2137490 - RNA, 18 nt, Human
cuucaggcucuucuccuu

SEQ ID NO: 2137491 - RNA, 17 nt, Human
cuucaggcucuucuccu

SEQ ID NO: 2137492 - RNA, 16 nt, Human
cuucaggcucuucucc

SEQ ID NO: 2137493 - RNA, 15 nt, Human
cuucaggcucuucuc

SEQ ID NO: 2137494 - RNA, 20 nt, Human
cuucaggccucccucucucu

SEQ ID NO: 2137495 - RNA, 21 nt, Human
cuucaggggagucccgucagg

SEQ ID NO: 2137496 - RNA, 22 nt, Human
cuucaggggagucccgucagga

SEQ ID NO: 2137497 - RNA, 23 nt, Human
cuucaggggagucccgucaggac

SEQ ID NO: 2137498 - RNA, 14 nt, Human
cuucaggcucuucu

SEQ ID NO: 2137499 - RNA, 12 nt, Human
cuucaggccucc

SEQ ID NO: 2137500 - RNA, 15 nt, Human
cuucaggccucccuc

SEQ ID NO: 2137501 - RNA, 11 nt, Human
cuucagcugac

SEQ ID NO: 2137502 - RNA, 23 nt, Human
cuucagccuagccgaccucagcc

SEQ ID NO: 2137503 - RNA, 21 nt, Human
cuucaaaaacugucaaagaau

SEQ ID NO: 2137504 - RNA, 17 nt, Human
cuucagccaggagcugg

SEQ ID NO: 2137505 - RNA, 15 nt, Human
cuucagccaggagcu

SEQ ID NO: 2137506 - RNA, 15 nt, Human
cuucagccaccucuc

SEQ ID NO: 2137507 - RNA, 17 nt, Human
cuucagccaccucucuu

SEQ ID NO: 2137508 - RNA, 16 nt, Human
cuuauuuuuagauggu

SEQ ID NO: 2137509 - RNA, 22 nt, Human
cuuauuuuuagaugguuacacu

SEQ ID NO: 2137510 - RNA, 23 nt, Human
cuuauuuuuagaugguuacacug

SEQ ID NO: 2137511 - RNA, 16 nt, Human
cuuauuuucauguaua

SEQ ID NO: 2137512 - RNA, 21 nt, Human
cuuauuguuccaagacauugu

SEQ ID NO: 2137513 - RNA, 19 nt, Human
cuucagccaggagcugggc

SEQ ID NO: 2137514 - RNA, 18 nt, Human
cuucagccaggagcuggg

SEQ ID NO: 2137515 - RNA, 13 nt, Human
cuucagccuagcc

SEQ ID NO: 2137516 - RNA, 20 nt, Human
cuucagccuagccgaccuca

SEQ ID NO: 2137517 - RNA, 21 nt, Human
cuucagccuagccgaccucag

SEQ ID NO: 2137518 - RNA, 22 nt, Human
cuucagccuagccgaccucagc

SEQ ID NO: 2137519 - RNA, 13 nt, Human
cuucguuuugguu

SEQ ID NO: 2137520 - RNA, 19 nt, Human
cuucuaaaaaaaaacaaaa

SEQ ID NO: 2137521 - RNA, 22 nt, Human
cuucucauagcauuaacuaauc

SEQ ID NO: 2137522 - RNA, 22 nt, Human
cuucucaggcucugcccugccc

SEQ ID NO: 2137523 - RNA, 13 nt, Human
cuucucauagcau

SEQ ID NO: 2137524 - RNA, 15 nt, Human
cuucucauagcauua

SEQ ID NO: 2137525 - RNA, 13 nt, Human
cuucucaggcucu

SEQ ID NO: 2137526 - RNA, 15 nt, Human
cuucucaggcucugc

SEQ ID NO: 2137527 - RNA, 16 nt, Human
cuucucaggcucugcc

SEQ ID NO: 2137528 - RNA, 19 nt, Human
cuucucaggcucugcccug

SEQ ID NO: 2137529 - RNA, 20 nt, Human
cuucucaggcucugcccugc

SEQ ID NO: 2137530 - RNA, 21 nt, Human
cuucucaggcucugcccugcc

SEQ ID NO: 2137531 - RNA, 23 nt, Human
cuucgagguggaucacagaggcu

SEQ ID NO: 2137532 - RNA, 20 nt, Human
cuucgggaggucgaggcagg

SEQ ID NO: 2137533 - RNA, 21 nt, Human
cuucgggaggucgaggcagga

SEQ ID NO: 2137534 - RNA, 13 nt, Human
cuucgcuccugug

SEQ ID NO: 2137535 - RNA, 13 nt, Human
cuucgacugugac

SEQ ID NO: 2137536 - RNA, 15 nt, Human
cuucgcuccuguguc

SEQ ID NO: 2137537 - RNA, 14 nt, Human
cuucgcuccugugu

SEQ ID NO: 2137538 - RNA, 19 nt, Human
cuuccuugcuguccuaggc

SEQ ID NO: 2137539 - RNA, 20 nt, Human
cuuccuugcuguccuaggcc

SEQ ID NO: 2137540 - RNA, 20 nt, Human
cuucgaaagcaucauuauuu

SEQ ID NO: 2137541 - RNA, 14 nt, Human
cuuccuucccuggc

SEQ ID NO: 2137542 - RNA, 13 nt, Human
cuuccuucccugg

SEQ ID NO: 2137543 - RNA, 15 nt, Human
cuuccuucccuggcu

SEQ ID NO: 2137544 - RNA, 17 nt, Human
cuuccuucccuggcuug

SEQ ID NO: 2137545 - RNA, 14 nt, Human
cuuccuugaccagc

SEQ ID NO: 2137546 - RNA, 15 nt, Human
cuuccuugaccagca

SEQ ID NO: 2137547 - RNA, 16 nt, Human
cuuccuugaccagcag

SEQ ID NO: 2137548 - RNA, 22 nt, Human
cuuccuugaccagcagauccca

SEQ ID NO: 2137549 - RNA, 17 nt, Human
cuuccuugcuguccuag

SEQ ID NO: 2137550 - RNA, 17 nt, Human
cuucugccauauucugu

SEQ ID NO: 2137551 - RNA, 15 nt, Human
cuucugccauauucu

SEQ ID NO: 2137552 - RNA, 14 nt, Human
cuucucucaccucc

SEQ ID NO: 2137553 - RNA, 15 nt, Human
cuucucuacagacuu

SEQ ID NO: 2137554 - RNA, 15 nt, Human
cuucucucaccuccu

SEQ ID NO: 2137555 - RNA, 16 nt, Human
cuucucucaccuccua

SEQ ID NO: 2137556 - RNA, 18 nt, Human
cuucucucaccuccuaaa

SEQ ID NO: 2137557 - RNA, 21 nt, Human
cuucugccauauucuguuggc

SEQ ID NO: 2137558 - RNA, 20 nt, Human
cuucugccauuucugagauc

SEQ ID NO: 2137559 - RNA, 17 nt, Human
cuucugcuucagccucc

SEQ ID NO: 2137560 - RNA, 16 nt, Human
cuucugcuucagccuc

SEQ ID NO: 2137561 - RNA, 10 nt, Human
cuucugcucc

SEQ ID NO: 2137562 - RNA, 12 nt, Human
cuucugcuccac

SEQ ID NO: 2137563 - RNA, 14 nt, Human
cuucugcuccaccc

SEQ ID NO: 2137564 - RNA, 18 nt, Human
cuucugcuucagccuccc

SEQ ID NO: 2137565 - RNA, 13 nt, Human
cuucugcuccacc

SEQ ID NO: 2137566 - RNA, 11 nt, Human
cuucuggagcc

SEQ ID NO: 2137567 - RNA, 13 nt, Human
cuucuggagcccu

SEQ ID NO: 2137568 - RNA, 17 nt, Human
cuucuccuuucacaacc

SEQ ID NO: 2137569 - RNA, 14 nt, Human
cuucuccuuucaca

SEQ ID NO: 2137570 - RNA, 18 nt, Human
cuucuccuuccaacugcu

SEQ ID NO: 2137571 - RNA, 20 nt, Human
cuucuccuuccaacugcugc

SEQ ID NO: 2137572 - RNA, 16 nt, Human
cuucuccuugauaaca

SEQ ID NO: 2137573 - RNA, 19 nt, Human
cuucuccuugauaacagcu

SEQ ID NO: 2137574 - RNA, 20 nt, Human
cuucuccuugauaacagcua

SEQ ID NO: 2137575 - RNA, 22 nt, Human
cuucuccuuucacaaccuucug

SEQ ID NO: 2137576 - RNA, 20 nt, Human
cuucuccuuucacaaccuuc

SEQ ID NO: 2137577 - RNA, 13 nt, Human
cuucucuacagac

SEQ ID NO: 2137578 - RNA, 11 nt, Human
cuucucuacag

SEQ ID NO: 2137579 - RNA, 20 nt, Human
cuucucuaaaugaggggccu

SEQ ID NO: 2137580 - RNA, 16 nt, Human
cuucucccacacugcu

SEQ ID NO: 2137581 - RNA, 17 nt, Human
cuucuccaucuggcagg

SEQ ID NO: 2137582 - RNA, 14 nt, Human
cuucucccacacug

SEQ ID NO: 2137583 - RNA, 15 nt, Human
cuucuccacccugcu

SEQ ID NO: 2137584 - RNA, 14 nt, Human
cuucuccacccugc

SEQ ID NO: 2137585 - RNA, 14 nt, Human
cuucuccaggcugu

SEQ ID NO: 2137586 - RNA, 16 nt, Human
cuucuccacccugcuc

SEQ ID NO: 2137587 - RNA, 17 nt, Human
cuucuccaggcuguauc

SEQ ID NO: 2137588 - RNA, 15 nt, Human
cuucucccaauucau

SEQ ID NO: 2137589 - RNA, 13 nt, Human
cuucucccacacu

SEQ ID NO: 2137590 - RNA, 14 nt, Human
cuucuccaucuggc

SEQ ID NO: 2137591 - RNA, 15 nt, Human
cuuucugcagaaaca

SEQ ID NO: 2137592 - RNA, 16 nt, Human
cuuucuuccucugcug

SEQ ID NO: 2137593 - RNA, 15 nt, Human
cuuucuucuauuuua

SEQ ID NO: 2137594 - RNA, 19 nt, Human
cuuucuguccuuuuggcac

SEQ ID NO: 2137595 - RNA, 15 nt, Human
cuuugaaacuagacu

SEQ ID NO: 2137596 - RNA, 16 nt, Human
cuuucuugcugguugu

SEQ ID NO: 2137597 - RNA, 21 nt, Human
cuuucuugcugguugucauuu

SEQ ID NO: 2137598 - RNA, 13 nt, Human
cuuucuuggccag

SEQ ID NO: 2137599 - RNA, 14 nt, Human
cuuucuuggccagu

SEQ ID NO: 2137600 - RNA, 16 nt, Human
cuuucuucuauuuuau

SEQ ID NO: 2137601 - RNA, 20 nt, Human
cuuucucuuuuccucuacca

SEQ ID NO: 2137602 - RNA, 15 nt, Human
cuuuagucgcugagg

SEQ ID NO: 2137603 - RNA, 18 nt, Human
cuuuaggcagcagcuuuu

SEQ ID NO: 2137604 - RNA, 13 nt, Human
cuuuagaguagca

SEQ ID NO: 2137605 - RNA, 23 nt, Human
cuuugcuucauucaagucagcuc

SEQ ID NO: 2137606 - RNA, 23 nt, Human
cuuugcuuaugaauauuuauaac

SEQ ID NO: 2137607 - RNA, 14 nt, Human
cuuugcuugaacac

SEQ ID NO: 2137608 - RNA, 15 nt, Human
cuuugcuugaacaca

SEQ ID NO: 2137609 - RNA, 16 nt, Human
cuuugcuugaacacag

SEQ ID NO: 2137610 - RNA, 17 nt, Human
cuuugcuugaacacagu

SEQ ID NO: 2137611 - RNA, 19 nt, Human
cuuugcuugaacacaguau

SEQ ID NO: 2137612 - RNA, 20 nt, Human
cuuugcuugaacacaguauu

SEQ ID NO: 2137613 - RNA, 21 nt, Human
cuuugcuugaacacaguauuu

SEQ ID NO: 2137614 - RNA, 22 nt, Human
cuuugcuugaacacaguauuuu

SEQ ID NO: 2137615 - RNA, 23 nt, Human
cuuugcuugaacacaguauuuuc

SEQ ID NO: 2137616 - RNA, 17 nt, Human
cuuugaccucaaccugu

SEQ ID NO: 2137617 - RNA, 18 nt, Human
cuuugaccucaaccugug

SEQ ID NO: 2137618 - RNA, 21 nt, Human
cuuugacaauuccuagauaaa

SEQ ID NO: 2137619 - RNA, 12 nt, Human
cuuugcuucauu

SEQ ID NO: 2137620 - RNA, 21 nt, Human
cuuugcauggagacuugagga

SEQ ID NO: 2137621 - RNA, 21 nt, Human
cuuugaccucaaccugugaug

SEQ ID NO: 2137622 - RNA, 13 nt, Human
cuuuguggcuucc

SEQ ID NO: 2137623 - RNA, 23 nt, Human
cuuugggaggccaaggugggagg

SEQ ID NO: 2137624 - RNA, 17 nt, Human
cuuuggaaacaggacca

SEQ ID NO: 2137625 - RNA, 13 nt, Human
cuuuggauagcau

SEQ ID NO: 2137626 - RNA, 17 nt, Human
cuuuggccauuccaaca

SEQ ID NO: 2137627 - RNA, 14 nt, Human
cuuugggaggcuga

SEQ ID NO: 2137628 - RNA, 17 nt, Human
cuuugggaggcugaggc

SEQ ID NO: 2137629 - RNA, 18 nt, Human
cuuugggaggcugaggcg

SEQ ID NO: 2137630 - RNA, 17 nt, Human
cuuugggaggcugaggu

SEQ ID NO: 2137631 - RNA, 18 nt, Human
gaaaagggaacugaacau

SEQ ID NO: 2137632 - RNA, 17 nt, Human
gaaaacgguuaaaacug

SEQ ID NO: 2137633 - RNA, 21 nt, Human
gaaaagggagauucagacugu

SEQ ID NO: 2137634 - RNA, 20 nt, Human
gaaaagguucuuacugcuug

SEQ ID NO: 2137635 - RNA, 14 nt, Human
gaaaacccagagag

SEQ ID NO: 2137636 - RNA, 15 nt, Human
gaaaacccagagagg

SEQ ID NO: 2137637 - RNA, 22 nt, Human
gaaaacccagagaggaaucaga

SEQ ID NO: 2137638 - RNA, 14 nt, Human
gaaaaccccagcau

SEQ ID NO: 2137639 - RNA, 15 nt, Human
gaaaacauguaauaa

SEQ ID NO: 2137640 - RNA, 19 nt, Human
gaaaaauuuaagcauuguu

SEQ ID NO: 2137641 - RNA, 20 nt, Human
gaaaaauuuaagcauuguuu

SEQ ID NO: 2137642 - RNA, 22 nt, Human
gaaaaauuuaagcauuguuugc

SEQ ID NO: 2137643 - RNA, 14 nt, Human
gaaaacaacaaaaa

SEQ ID NO: 2137644 - RNA, 15 nt, Human
gaaaacaacaaaaaa

SEQ ID NO: 2137645 - RNA, 18 nt, Human
gaaaacaacaaaaaauaa

SEQ ID NO: 2137646 - RNA, 13 nt, Human
gaaaaauauuuaa

SEQ ID NO: 2137647 - RNA, 14 nt, Human
gaaaaauauuuaag

SEQ ID NO: 2137648 - RNA, 15 nt, Human
gaaaaauaugauauu

SEQ ID NO: 2137649 - RNA, 17 nt, Human
gaaaaauccagaaagaa

SEQ ID NO: 2137650 - RNA, 18 nt, Human
gaaaaauccagaaagaaa

SEQ ID NO: 2137651 - RNA, 16 nt, Human
gaaaaauuuaagcauu

SEQ ID NO: 2137652 - RNA, 17 nt, Human
gaaaaauuuaagcauug

SEQ ID NO: 2137653 - RNA, 18 nt, Human
gaaaaauuuaagcauugu

SEQ ID NO: 2137654 - RNA, 10 nt, Human
gaaaaauaug

SEQ ID NO: 2137655 - RNA, 11 nt, Human
gaaaaauauga

SEQ ID NO: 2137656 - RNA, 15 nt, Human
cuuuuuuaaauuuuc

SEQ ID NO: 2137657 - RNA, 18 nt, Human
cuuuuuuaaauuuucuuc

SEQ ID NO: 2137658 - RNA, 20 nt, Human
cuuuuuuaaauuuucuucag

SEQ ID NO: 2137659 - RNA, 21 nt, Human
cuuuuuuaaauuuucuucagu

SEQ ID NO: 2137660 - RNA, 15 nt, Human
cuuuuuuacacaaau

SEQ ID NO: 2137661 - RNA, 19 nt, Human
cuuuguuuugauguuugug

SEQ ID NO: 2137662 - RNA, 23 nt, Human
cuuuguuuugauguuuguggccu

SEQ ID NO: 2137663 - RNA, 20 nt, Human
cuuuguugcucagcaagggg

SEQ ID NO: 2137664 - RNA, 11 nt, Human
cuuuguuuugu

SEQ ID NO: 2137665 - RNA, 24 nt, Human
cuuuguuuugauguuuguggccuc

SEQ ID NO: 2137666 - RNA, 16 nt, Human
cuuuguugcccaggcu

SEQ ID NO: 2137667 - RNA, 21 nt, Human
cuuuguugcaaguacugcugu

SEQ ID NO: 2137668 - RNA, 21 nt, Human
cuuuguuuguugucagcugaa

SEQ ID NO: 2137669 - RNA, 12 nt, Human
cuuuucugcaga

SEQ ID NO: 2137670 - RNA, 15 nt, Human
cuuuucugcagaggg

SEQ ID NO: 2137671 - RNA, 23 nt, Human
cuuuucugcaucaucuguagaua

SEQ ID NO: 2137672 - RNA, 14 nt, Human
cuuuugaacccagg

SEQ ID NO: 2137673 - RNA, 13 nt, Human
cuuuugaacccag

SEQ ID NO: 2137674 - RNA, 21 nt, Human
cuuuucuugacuauuggagga

SEQ ID NO: 2137675 - RNA, 19 nt, Human
cuuuugaauccaugcuugg

SEQ ID NO: 2137676 - RNA, 20 nt, Human
cuuuugaauccaugcuuggg

SEQ ID NO: 2137677 - RNA, 21 nt, Human
cuuuugaauccaugcuugggu

SEQ ID NO: 2137678 - RNA, 23 nt, Human
cuuuugaauccaugcuugggugu

SEQ ID NO: 2137679 - RNA, 20 nt, Human
cuuuugaacccaggaguuca

SEQ ID NO: 2137680 - RNA, 18 nt, Human
cuuuugaacccaggaguu

SEQ ID NO: 2137681 - RNA, 18 nt, Human
cuuuuuauuuuuuaauua

SEQ ID NO: 2137682 - RNA, 21 nt, Human
cuuuuuauuuuuuaauuauug

SEQ ID NO: 2137683 - RNA, 22 nt, Human
cuuggagccaauggagacuguc

SEQ ID NO: 2137684 - RNA, 18 nt, Human
cuuggagccccagugcca

SEQ ID NO: 2137685 - RNA, 13 nt, Human
cuuggagccccag

SEQ ID NO: 2137686 - RNA, 14 nt, Human
cuugggaggcccca

SEQ ID NO: 2137687 - RNA, 15 nt, Human
cuugggaggccccac

SEQ ID NO: 2137688 - RNA, 19 nt, Human
cuugggaggccccacuggg

SEQ ID NO: 2137689 - RNA, 21 nt, Human
cuugggaggccccacugggga

SEQ ID NO: 2137690 - RNA, 22 nt, Human
cuugggaggccccacuggggaa

SEQ ID NO: 2137691 - RNA, 15 nt, Human
cuugggaggcuuccc

SEQ ID NO: 2137692 - RNA, 16 nt, Human
cuugggaggcuucccc

SEQ ID NO: 2137693 - RNA, 16 nt, Human
cuugcugcccuaggcu

SEQ ID NO: 2137694 - RNA, 18 nt, Human
cuuggaauaucugcugua

SEQ ID NO: 2137695 - RNA, 19 nt, Human
cuuggaauaucugcuguau

SEQ ID NO: 2137696 - RNA, 22 nt, Human
cuuggacuauuauaauuuaaug

SEQ ID NO: 2137697 - RNA, 14 nt, Human
cuuggacuauuaua

SEQ ID NO: 2137698 - RNA, 20 nt, Human
cuugggaugaugccucauga

SEQ ID NO: 2137699 - RNA, 18 nt, Human
cuugggccacugugaaga

SEQ ID NO: 2137700 - RNA, 20 nt, Human
cuugggccacugugaagaga

SEQ ID NO: 2137701 - RNA, 13 nt, Human
cuugggcccuccu

SEQ ID NO: 2137702 - RNA, 14 nt, Human
cuugggcccuccug

SEQ ID NO: 2137703 - RNA, 12 nt, Human
cuugggcccucc

SEQ ID NO: 2137704 - RNA, 14 nt, Human
cuugggcugcuccu

SEQ ID NO: 2137705 - RNA, 17 nt, Human
cuugguuggguccucac

SEQ ID NO: 2137706 - RNA, 14 nt, Human
cuuggggcuuccua

SEQ ID NO: 2137707 - RNA, 14 nt, Human
cuugggcugagacu

SEQ ID NO: 2137708 - RNA, 17 nt, Human
cuugggcugagacugga

SEQ ID NO: 2137709 - RNA, 20 nt, Human
cuuguugcucaaaaaaugag

SEQ ID NO: 2137710 - RNA, 16 nt, Human
cuuuaaaaaaaauccu

SEQ ID NO: 2137711 - RNA, 20 nt, Human
cuuuaaaaaaaauccuucua

SEQ ID NO: 2137712 - RNA, 17 nt, Human
cuuguuugcuucaacug

SEQ ID NO: 2137713 - RNA, 20 nt, Human
cuuguuugcucaccuggggu

SEQ ID NO: 2137714 - RNA, 18 nt, Human
cuuguuugcucaccuggg

SEQ ID NO: 2137715 - RNA, 19 nt, Human
cuuguuugcucaccugggg

SEQ ID NO: 2137716 - RNA, 20 nt, Human
cuuguuugauuuuagcugca

SEQ ID NO: 2137717 - RNA, 22 nt, Human
cuuguuugauuuuagcugcaga

SEQ ID NO: 2137718 - RNA, 23 nt, Human
cuuguuugauuuuagcugcagaa

SEQ ID NO: 2137719 - RNA, 16 nt, Human
cuuguuugcucaccug

SEQ ID NO: 2137720 - RNA, 14 nt, Human
cuuguuuaucagca

SEQ ID NO: 2137721 - RNA, 17 nt, Human
cuuuagaauguuuuccu

SEQ ID NO: 2137722 - RNA, 21 nt, Human
cuuuagaauguuuuccuucua

SEQ ID NO: 2137723 - RNA, 23 nt, Human
cuuuagaauguuuuccuucuacu

SEQ ID NO: 2137724 - RNA, 22 nt, Human
cuuuagaaugagagugugaaau

SEQ ID NO: 2137725 - RNA, 18 nt, Human
cuuuagaaugagagugug

SEQ ID NO: 2137726 - RNA, 16 nt, Human
cuuguuaagauaguua

SEQ ID NO: 2137727 - RNA, 12 nt, Human
cuuguucuguuu

SEQ ID NO: 2137728 - RNA, 13 nt, Human
cuuguucuguuuu

SEQ ID NO: 2137729 - RNA, 14 nt, Human
cuuguucuguuuug

SEQ ID NO: 2137730 - RNA, 15 nt, Human
cuuguucuguuuugu

SEQ ID NO: 2137731 - RNA, 16 nt, Human
cuuguucuguuuuguu

SEQ ID NO: 2137732 - RNA, 13 nt, Human
cuuguuaauauuc

SEQ ID NO: 2137733 - RNA, 14 nt, Human
cuuguuaauauucu

SEQ ID NO: 2137734 - RNA, 16 nt, Human
cuuguuaauauucuuu

SEQ ID NO: 2137735 - RNA, 22 nt, Human
cuuguguuuuuaacucaauauu

SEQ ID NO: 2137736 - RNA, 15 nt, Human
cuuguguuuuugucu

SEQ ID NO: 2137737 - RNA, 18 nt, Human
cuuguccuagcuugggag

SEQ ID NO: 2137738 - RNA, 23 nt, Human
cuuguccuuuuguaccauggugu

SEQ ID NO: 2137739 - RNA, 15 nt, Human
cuugucccugcccag

SEQ ID NO: 2137740 - RNA, 16 nt, Human
cuugucccugcccaga

SEQ ID NO: 2137741 - RNA, 20 nt, Human
cuuguccccuccucacuccc

SEQ ID NO: 2137742 - RNA, 21 nt, Human
cuuguccccuccucacucccu

SEQ ID NO: 2137743 - RNA, 14 nt, Human
cuuggaagcuccgc

SEQ ID NO: 2137744 - RNA, 20 nt, Human
cuuggaagcuccgcuuucua

SEQ ID NO: 2137745 - RNA, 23 nt, Human
cuugcugcccuaggcuccgucag

SEQ ID NO: 2137746 - RNA, 12 nt, Human
cuugcugcaccc

SEQ ID NO: 2137747 - RNA, 20 nt, Human
cuugcugaaucggaaucucu

SEQ ID NO: 2137748 - RNA, 22 nt, Human
cuugcucugcugacagacacag

SEQ ID NO: 2137749 - RNA, 19 nt, Human
cuugcucuucagugggaga

SEQ ID NO: 2137750 - RNA, 15 nt, Human
cuugccacugcacuc

SEQ ID NO: 2137751 - RNA, 17 nt, Human
cuugccacugcacucca

SEQ ID NO: 2137752 - RNA, 14 nt, Human
cuugccacagcucu

SEQ ID NO: 2137753 - RNA, 20 nt, Human
cuugccacagcucuugagga

SEQ ID NO: 2137754 - RNA, 22 nt, Human
cuugccaaugaggucugaaaug

SEQ ID NO: 2137755 - RNA, 23 nt, Human
cuugccaaugaggucugaaaugg

SEQ ID NO: 2137756 - RNA, 20 nt, Human
cuugcccagggcucagccug

SEQ ID NO: 2137757 - RNA, 21 nt, Human
cuugcccagggcucagccugg

SEQ ID NO: 2137758 - RNA, 23 nt, Human
cuugcccagggcucagccuggug

SEQ ID NO: 2137759 - RNA, 13 nt, Human
cuugcccagggcu

SEQ ID NO: 2137760 - RNA, 14 nt, Human
cuugcccagggcuc

SEQ ID NO: 2137761 - RNA, 15 nt, Human
cuugcccagggcuca

SEQ ID NO: 2137762 - RNA, 16 nt, Human
cuugcccagggcucag

SEQ ID NO: 2137763 - RNA, 18 nt, Human
cuugcccagggcucagcc

SEQ ID NO: 2137764 - RNA, 19 nt, Human
cuugcccagggcucagccu

SEQ ID NO: 2137765 - RNA, 17 nt, Human
cuugaggguugggcugg

SEQ ID NO: 2137766 - RNA, 15 nt, Human
cuugaggguugggcu

SEQ ID NO: 2137767 - RNA, 12 nt, Human
cuugagccuggg

SEQ ID NO: 2137768 - RNA, 15 nt, Human
cuugagccugggagg

SEQ ID NO: 2137769 - RNA, 13 nt, Human
cuugagcccagga

SEQ ID NO: 2137770 - RNA, 18 nt, Human
cuugagaccucagccaug

SEQ ID NO: 2137771 - RNA, 17 nt, Human
cuugagacuguuuugaa

SEQ ID NO: 2137772 - RNA, 22 nt, Human
cuugagacuguuuugaauuugg

SEQ ID NO: 2137773 - RNA, 15 nt, Human
cuugagcccaggagu

SEQ ID NO: 2137774 - RNA, 14 nt, Human
cuugagcccaggag

SEQ ID NO: 2137775 - RNA, 17 nt, Human
cuucuggcacuuggaga

SEQ ID NO: 2137776 - RNA, 14 nt, Human
cuucuggagcccuu

SEQ ID NO: 2137777 - RNA, 14 nt, Human
cuugagaccucagc

SEQ ID NO: 2137778 - RNA, 15 nt, Human
cuugagaccucagcc

SEQ ID NO: 2137779 - RNA, 16 nt, Human
cuugagaccucagcca

SEQ ID NO: 2137780 - RNA, 11 nt, Human
cuugagaacuu

SEQ ID NO: 2137781 - RNA, 11 nt, Human
cuugagaaacc

SEQ ID NO: 2137782 - RNA, 13 nt, Human
cuugagaaaccuu

SEQ ID NO: 2137783 - RNA, 12 nt, Human
cuugagaaaccu

SEQ ID NO: 2137784 - RNA, 21 nt, Human
cuucugggaagacaacuagga

SEQ ID NO: 2137785 - RNA, 22 nt, Human
cuucugggaagggguuucuaac

SEQ ID NO: 2137786 - RNA, 23 nt, Human
cuugcacacuccccugcacugga

SEQ ID NO: 2137787 - RNA, 19 nt, Human
cuugcacacuccccugcac

SEQ ID NO: 2137788 - RNA, 22 nt, Human
cuugcacacuccccugcacugg

SEQ ID NO: 2137789 - RNA, 20 nt, Human
cuugcagacucuacagaggc

SEQ ID NO: 2137790 - RNA, 21 nt, Human
cuugcagacucuacagaggcc

SEQ ID NO: 2137791 - RNA, 13 nt, Human
cuugcagagaagc

SEQ ID NO: 2137792 - RNA, 15 nt, Human
cuugcagagaagccu

SEQ ID NO: 2137793 - RNA, 18 nt, Human
cuugcagagaagccuugg

SEQ ID NO: 2137794 - RNA, 20 nt, Human
cuugcagagaagccuuggua

SEQ ID NO: 2137795 - RNA, 13 nt, Human
cuugcagagcuug

SEQ ID NO: 2137796 - RNA, 22 nt, Human
cuugcagcucuccccuucucug

SEQ ID NO: 2137797 - RNA, 18 nt, Human
cuugcaauggcagccuug

SEQ ID NO: 2137798 - RNA, 17 nt, Human
cuugcaauggcagccuu

SEQ ID NO: 2137799 - RNA, 16 nt, Human
cuugcaauggcagccu

SEQ ID NO: 2137800 - RNA, 15 nt, Human
cuugcaauggcagcc

SEQ ID NO: 2137801 - RNA, 21 nt, Human
cuugaguugauucagcucugc

SEQ ID NO: 2137802 - RNA, 20 nt, Human
cuugaguugauucagcucug

SEQ ID NO: 2137803 - RNA, 18 nt, Human
cuugaguugauucagcuc

SEQ ID NO: 2137804 - RNA, 19 nt, Human
cuugaguugauucagcucu

SEQ ID NO: 2137805 - RNA, 17 nt, Human
gaccaauauuguacagu

SEQ ID NO: 2137806 - RNA, 18 nt, Human
gaccaauauuguacaguu

SEQ ID NO: 2137807 - RNA, 19 nt, Human
gaccaauauuguacaguuu

SEQ ID NO: 2137808 - RNA, 21 nt, Human
gaccaauauuguacaguuuuu

SEQ ID NO: 2137809 - RNA, 12 nt, Human
gaccacaccucc

SEQ ID NO: 2137810 - RNA, 13 nt, Human
gaccaauucaacc

SEQ ID NO: 2137811 - RNA, 18 nt, Human
gaccacaaaacuuuucua

SEQ ID NO: 2137812 - RNA, 17 nt, Human
gaccacaccucccugaa

SEQ ID NO: 2137813 - RNA, 20 nt, Human
gaccacaccucccugaacca

SEQ ID NO: 2137814 - RNA, 17 nt, Human
gaccacacuuccugucc

SEQ ID NO: 2137815 - RNA, 18 nt, Human
gaccacacuuccugucca

SEQ ID NO: 2137816 - RNA, 20 nt, Human
gaccacacuuccuguccaga

SEQ ID NO: 2137817 - RNA, 22 nt, Human
gaccacacuuccuguccagaga

SEQ ID NO: 2137818 - RNA, 23 nt, Human
gaccacacuuccuguccagagag

SEQ ID NO: 2137819 - RNA, 13 nt, Human
gacaucaguggca

SEQ ID NO: 2137820 - RNA, 20 nt, Human
gacaucaguggcauggcucc

SEQ ID NO: 2137821 - RNA, 13 nt, Human
gacaucagcauca

SEQ ID NO: 2137822 - RNA, 18 nt, Human
gacaucagcaucaccuag

SEQ ID NO: 2137823 - RNA, 19 nt, Human
gacaucaguggcauggcuc

SEQ ID NO: 2137824 - RNA, 17 nt, Human
gacauccaagcuuccuu

SEQ ID NO: 2137825 - RNA, 15 nt, Human
gacauccaagcuucc

SEQ ID NO: 2137826 - RNA, 16 nt, Human
gacauccaagcuuccu

SEQ ID NO: 2137827 - RNA, 16 nt, Human
gaccaaggagaugaag

SEQ ID NO: 2137828 - RNA, 17 nt, Human
gaccaaggaccccucac

SEQ ID NO: 2137829 - RNA, 19 nt, Human
gaccaaggaccccucaccu

SEQ ID NO: 2137830 - RNA, 14 nt, Human
gaccaaguuauaaa

SEQ ID NO: 2137831 - RNA, 20 nt, Human
gaccaauauuauacuaagaa

SEQ ID NO: 2137832 - RNA, 21 nt, Human
gaccaaguuauaaaucaaugu

SEQ ID NO: 2137833 - RNA, 15 nt, Human
gaccaagcaggaagc

SEQ ID NO: 2137834 - RNA, 16 nt, Human
gaccaagcaggaagcu

SEQ ID NO: 2137835 - RNA, 17 nt, Human
gaccaagcaggaagcuc

SEQ ID NO: 2137836 - RNA, 19 nt, Human
gaccaagcaggaagcucag

SEQ ID NO: 2137837 - RNA, 20 nt, Human
gaccaagcaggaagcucaga

SEQ ID NO: 2137838 - RNA, 13 nt, Human
gaccaaggacccc

SEQ ID NO: 2137839 - RNA, 16 nt, Human
gaccaaggaccccuca

SEQ ID NO: 2137840 - RNA, 23 nt, Human
gaccacaggguucaaaaugucug

SEQ ID NO: 2137841 - RNA, 21 nt, Human
gaccacaggguucaaaauguc

SEQ ID NO: 2137842 - RNA, 21 nt, Human
gaccagacaccuugacagggc

SEQ ID NO: 2137843 - RNA, 22 nt, Human
gaccagacaccuugacagggca

SEQ ID NO: 2137844 - RNA, 24 nt, Human
gaccagacaccuugacagggcaca

SEQ ID NO: 2137845 - RNA, 23 nt, Human
gaccagacaccuugacagggcac

SEQ ID NO: 2137846 - RNA, 17 nt, Human
gaccagcacugucucag

SEQ ID NO: 2137847 - RNA, 20 nt, Human
gaccagcaacuugucuuuuu

SEQ ID NO: 2137848 - RNA, 16 nt, Human
gaccagcagaucccag

SEQ ID NO: 2137849 - RNA, 17 nt, Human
gaccagcagaucccagc

SEQ ID NO: 2137850 - RNA, 18 nt, Human
gaccagcagaucccagcu

SEQ ID NO: 2137851 - RNA, 20 nt, Human
gaccagcagaucccagcuca

SEQ ID NO: 2137852 - RNA, 17 nt, Human
gacccaucacgccugug

SEQ ID NO: 2137853 - RNA, 18 nt, Human
gaccccagcggcugaguc

SEQ ID NO: 2137854 - RNA, 16 nt, Human
gaccccccucaggacc

SEQ ID NO: 2137855 - RNA, 18 nt, Human
gaccccccucaggacccu

SEQ ID NO: 2137856 - RNA, 19 nt, Human
gaccagcauccuuaaguau

SEQ ID NO: 2137857 - RNA, 23 nt, Human
gacccacuucacacacaggcaac

SEQ ID NO: 2137858 - RNA, 22 nt, Human
gacccagccccuugagaaaccu

SEQ ID NO: 2137859 - RNA, 23 nt, Human
gacccagccccuugagaaaccuu

SEQ ID NO: 2137860 - RNA, 16 nt, Human
gacccagucccugggg

SEQ ID NO: 2137861 - RNA, 22 nt, Human
gacagacacaggcccggcucca

SEQ ID NO: 2137862 - RNA, 20 nt, Human
gacagacacaggcccggcuc

SEQ ID NO: 2137863 - RNA, 17 nt, Human
gacagacacaggcccgg

SEQ ID NO: 2137864 - RNA, 16 nt, Human
gacacuagaagauuuu

SEQ ID NO: 2137865 - RNA, 23 nt, Human
gacacgcucccucccccugcccc

SEQ ID NO: 2137866 - RNA, 15 nt, Human
gacacuaacgacuuc

SEQ ID NO: 2137867 - RNA, 17 nt, Human
gaauuucccacauaccc

SEQ ID NO: 2137868 - RNA, 16 nt, Human
gacagagugagacucu

SEQ ID NO: 2137869 - RNA, 21 nt, Human
gacagagucucacuguugccc

SEQ ID NO: 2137870 - RNA, 19 nt, Human
gacagagugagacucuguc

SEQ ID NO: 2137871 - RNA, 15 nt, Human
gacagagucugggug

SEQ ID NO: 2137872 - RNA, 20 nt, Human
gacagaugccccagagcugu

SEQ ID NO: 2137873 - RNA, 20 nt, Human
gacagagggaaacacagcag

SEQ ID NO: 2137874 - RNA, 13 nt, Human
gacagagggaaga

SEQ ID NO: 2137875 - RNA, 16 nt, Human
gacagagggaagaaaa

SEQ ID NO: 2137876 - RNA, 13 nt, Human
gacagagucuggg

SEQ ID NO: 2137877 - RNA, 23 nt, Human
gacagaggcagccccauucugcc

SEQ ID NO: 2137878 - RNA, 19 nt, Human
gacagagggaagaaaagag

SEQ ID NO: 2137879 - RNA, 21 nt, Human
gacagagccccacccucagau

SEQ ID NO: 2137880 - RNA, 20 nt, Human
gacagagcugguugggaaga

SEQ ID NO: 2137881 - RNA, 12 nt, Human
gacagaggaggg

SEQ ID NO: 2137882 - RNA, 12 nt, Human
gacagaggcagc

SEQ ID NO: 2137883 - RNA, 23 nt, Human
gacagacacuucuaaaugaagug

SEQ ID NO: 2137884 - RNA, 15 nt, Human
gacagacuugagaac

SEQ ID NO: 2137885 - RNA, 18 nt, Human
gacagacuugagaacuug

SEQ ID NO: 2137886 - RNA, 17 nt, Human
gacagagaaggcagcag

SEQ ID NO: 2137887 - RNA, 15 nt, Human
gacagagacaccugc

SEQ ID NO: 2137888 - RNA, 16 nt, Human
gacagagacaccugca

SEQ ID NO: 2137889 - RNA, 17 nt, Human
gacagagacaccugcac

SEQ ID NO: 2137890 - RNA, 18 nt, Human
gacagagacaccugcacc

SEQ ID NO: 2137891 - RNA, 21 nt, Human
gacagagacaccugcaccucc

SEQ ID NO: 2137892 - RNA, 22 nt, Human
gacagagacaccugcaccuccc

SEQ ID NO: 2137893 - RNA, 21 nt, Human
gacaguuauacugucgguuuu

SEQ ID NO: 2137894 - RNA, 14 nt, Human
gacaggcccaagag

SEQ ID NO: 2137895 - RNA, 22 nt, Human
gacagggcauggccagguggcc

SEQ ID NO: 2137896 - RNA, 15 nt, Human
gacaggcccaagaga

SEQ ID NO: 2137897 - RNA, 20 nt, Human
gacagggcauggccaggugg

SEQ ID NO: 2137898 - RNA, 15 nt, Human
gacagggcauggcca

SEQ ID NO: 2137899 - RNA, 22 nt, Human
gacaggcauguucucugaggac

SEQ ID NO: 2137900 - RNA, 14 nt, Human
gacagggcauggcc

SEQ ID NO: 2137901 - RNA, 11 nt, Human
gacaggcccaa

SEQ ID NO: 2137902 - RNA, 22 nt, Human
gacaguuuuccuucucaucugu

SEQ ID NO: 2137903 - RNA, 19 nt, Human
gacaucaagcacagaagga

SEQ ID NO: 2137904 - RNA, 17 nt, Human
gacauaaccacugcuuc

SEQ ID NO: 2137905 - RNA, 18 nt, Human
gacaggcaagcaccuccu

SEQ ID NO: 2137906 - RNA, 17 nt, Human
gacaggcaagcaccucc

SEQ ID NO: 2137907 - RNA, 13 nt, Human
gacaggcaagcac

SEQ ID NO: 2137908 - RNA, 19 nt, Human
gacagcaacggggaggcca

SEQ ID NO: 2137909 - RNA, 16 nt, Human
gacagcaaaaccauug

SEQ ID NO: 2137910 - RNA, 19 nt, Human
gacagcaaaaccauugcuu

SEQ ID NO: 2137911 - RNA, 20 nt, Human
gacagcaaaaccauugcuuc

SEQ ID NO: 2137912 - RNA, 21 nt, Human
gacagcaaaaccauugcuuca

SEQ ID NO: 2137913 - RNA, 22 nt, Human
gacagcaaaaccauugcuucac

SEQ ID NO: 2137914 - RNA, 22 nt, Human
gacagcaacggggaggccaagu

SEQ ID NO: 2137915 - RNA, 13 nt, Human
gacagcagcucag

SEQ ID NO: 2137916 - RNA, 14 nt, Human
gacagcagcucagg

SEQ ID NO: 2137917 - RNA, 15 nt, Human
gacagcagcucaggc

SEQ ID NO: 2137918 - RNA, 16 nt, Human
gacagcagcucaggca

SEQ ID NO: 2137919 - RNA, 18 nt, Human
gacagcagcucaggcaca

SEQ ID NO: 2137920 - RNA, 20 nt, Human
gacagcagcucaggcacacu

SEQ ID NO: 2137921 - RNA, 19 nt, Human
gacaggcaaugcuggcugu

SEQ ID NO: 2137922 - RNA, 18 nt, Human
gacaggcaaugcuggcug

SEQ ID NO: 2137923 - RNA, 21 nt, Human
gacaggcaagcaccuccugcc

SEQ ID NO: 2137924 - RNA, 20 nt, Human
gacaggcaagcaccuccugc

SEQ ID NO: 2137925 - RNA, 21 nt, Human
gacaggcauguucucugagga

SEQ ID NO: 2137926 - RNA, 20 nt, Human
gacaggcauguucucugagg

SEQ ID NO: 2137927 - RNA, 23 nt, Human
gacaggcaaugcuggcuguuggc

SEQ ID NO: 2137928 - RNA, 18 nt, Human
gacaggauguuugcucag

SEQ ID NO: 2137929 - RNA, 21 nt, Human
gacugaccaauauuguacagu

SEQ ID NO: 2137930 - RNA, 22 nt, Human
gacugaccaauauuguacaguu

SEQ ID NO: 2137931 - RNA, 16 nt, Human
gacugacccugaucag

SEQ ID NO: 2137932 - RNA, 15 nt, Human
gacucuacagaggcc

SEQ ID NO: 2137933 - RNA, 16 nt, Human
gacucuacacugugaa

SEQ ID NO: 2137934 - RNA, 21 nt, Human
gacucuacagaggccaugggc

SEQ ID NO: 2137935 - RNA, 15 nt, Human
gacuacaggcaccca

SEQ ID NO: 2137936 - RNA, 13 nt, Human
gacuacaggcacc

SEQ ID NO: 2137937 - RNA, 18 nt, Human
gacuacaggcacccacca

SEQ ID NO: 2137938 - RNA, 20 nt, Human
gacugcauuuuacuguacag

SEQ ID NO: 2137939 - RNA, 20 nt, Human
gacugccagucccccugccc

SEQ ID NO: 2137940 - RNA, 17 nt, Human
gacugcaagugagcaaa

SEQ ID NO: 2137941 - RNA, 21 nt, Human
gacugcaagugagcaaaccug

SEQ ID NO: 2137942 - RNA, 19 nt, Human
gacugcaccauugcugcuc

SEQ ID NO: 2137943 - RNA, 20 nt, Human
gacugauguuaggcugggcc

SEQ ID NO: 2137944 - RNA, 21 nt, Human
gacugauguuaggcugggccc

SEQ ID NO: 2137945 - RNA, 23 nt, Human
gacugauguuaggcugggcccag

SEQ ID NO: 2137946 - RNA, 21 nt, Human
gacugauguugagggaacaga

SEQ ID NO: 2137947 - RNA, 18 nt, Human
gacugagcaagacccugu

SEQ ID NO: 2137948 - RNA, 21 nt, Human
gacugagcaagacccugucuc

SEQ ID NO: 2137949 - RNA, 13 nt, Human
gacugagcucaag

SEQ ID NO: 2137950 - RNA, 14 nt, Human
gacugagcagacug

SEQ ID NO: 2137951 - RNA, 15 nt, Human
gacugagcagacugg

SEQ ID NO: 2137952 - RNA, 19 nt, Human
gacugagcagacuggugag

SEQ ID NO: 2137953 - RNA, 16 nt, Human
gacuuauuuauauaaa

SEQ ID NO: 2137954 - RNA, 13 nt, Human
gacuuaugggccc

SEQ ID NO: 2137955 - RNA, 13 nt, Human
gacuucacacugc

SEQ ID NO: 2137956 - RNA, 14 nt, Human
gacuucacacugca

SEQ ID NO: 2137957 - RNA, 16 nt, Human
gacuucacacugcaag

SEQ ID NO: 2137958 - RNA, 22 nt, Human
gacuucacacugcaagagccuu

SEQ ID NO: 2137959 - RNA, 17 nt, Human
gacuuaguauauuuucu

SEQ ID NO: 2137960 - RNA, 14 nt, Human
gacuucagggcagg

SEQ ID NO: 2137961 - RNA, 14 nt, Human
gacuucagcucugu

SEQ ID NO: 2137962 - RNA, 18 nt, Human
gacuucagggcagggcuc

SEQ ID NO: 2137963 - RNA, 22 nt, Human
gacuucagggcagggcucugau

SEQ ID NO: 2137964 - RNA, 17 nt, Human
gacuggauaguccgucu

SEQ ID NO: 2137965 - RNA, 18 nt, Human
gacugccccaacuccugg

SEQ ID NO: 2137966 - RNA, 15 nt, Human
gacugccccgugcag

SEQ ID NO: 2137967 - RNA, 21 nt, Human
gacugcgggaugguccugggg

SEQ ID NO: 2137968 - RNA, 22 nt, Human
gacugcgggaugguccuggggc

SEQ ID NO: 2137969 - RNA, 19 nt, Human
gacuggcuuugucccacag

SEQ ID NO: 2137970 - RNA, 20 nt, Human
gacuggcuuugucccacagc

SEQ ID NO: 2137971 - RNA, 21 nt, Human
gacuggcuuugucccacagcu

SEQ ID NO: 2137972 - RNA, 20 nt, Human
gacugggaagauaggcucug

SEQ ID NO: 2137973 - RNA, 22 nt, Human
gacugggaagauaggcucugca

SEQ ID NO: 2137974 - RNA, 23 nt, Human
gacugggaagauaggcucugcac

SEQ ID NO: 2137975 - RNA, 17 nt, Human
gacuggcuggcugcagu

SEQ ID NO: 2137976 - RNA, 14 nt, Human
gacuggcuggcugc

SEQ ID NO: 2137977 - RNA, 16 nt, Human
gacuggcuggcugcag

SEQ ID NO: 2137978 - RNA, 22 nt, Human
gacuggauaguccgucucugcu

SEQ ID NO: 2137979 - RNA, 14 nt, Human
gacuggccugagga

SEQ ID NO: 2137980 - RNA, 18 nt, Human
gacuggccugaggagcag

SEQ ID NO: 2137981 - RNA, 17 nt, Human
gacuggcuagaguccuc

SEQ ID NO: 2137982 - RNA, 20 nt, Human
gacuggcuagaguccucacu

SEQ ID NO: 2137983 - RNA, 21 nt, Human
gacuggcuagaguccucacuc

SEQ ID NO: 2137984 - RNA, 23 nt, Human
gacuggcuagaguccucacuccc

SEQ ID NO: 2137985 - RNA, 19 nt, Human
gaccuguggccaaguucuu

SEQ ID NO: 2137986 - RNA, 20 nt, Human
gaccuguggggauuucuccc

SEQ ID NO: 2137987 - RNA, 21 nt, Human
gaccuguggggauuucuccca

SEQ ID NO: 2137988 - RNA, 15 nt, Human
gaccugugaccagca

SEQ ID NO: 2137989 - RNA, 17 nt, Human
gaccugugaccagcacu

SEQ ID NO: 2137990 - RNA, 19 nt, Human
gaccugugucacuacguga

SEQ ID NO: 2137991 - RNA, 22 nt, Human
gaccuguggggauuucucccag

SEQ ID NO: 2137992 - RNA, 23 nt, Human
gaccuguggggauuucucccagc

SEQ ID NO: 2137993 - RNA, 17 nt, Human
gaccuguaacuuuugua

SEQ ID NO: 2137994 - RNA, 12 nt, Human
gaccugugacca

SEQ ID NO: 2137995 - RNA, 21 nt, Human
gacccugcgaaggggcccugg

SEQ ID NO: 2137996 - RNA, 18 nt, Human
gaccuggcacuggaugca

SEQ ID NO: 2137997 - RNA, 22 nt, Human
gaccuggcacuggaugcagaaa

SEQ ID NO: 2137998 - RNA, 20 nt, Human
gacccugcgaaggggcccug

SEQ ID NO: 2137999 - RNA, 14 nt, Human
gaccuugaacuggg

SEQ ID NO: 2138000 - RNA, 15 nt, Human
gaccuucuaggaagc

SEQ ID NO: 2138001 - RNA, 18 nt, Human
gaccuucuccaaaugaga

SEQ ID NO: 2138002 - RNA, 12 nt, Human
gaccuucuggga

SEQ ID NO: 2138003 - RNA, 17 nt, Human
gaccuugaacuccuggg

SEQ ID NO: 2138004 - RNA, 12 nt, Human
gaccuuaucugu

SEQ ID NO: 2138005 - RNA, 14 nt, Human
gaccuuaucugugc

SEQ ID NO: 2138006 - RNA, 21 nt, Human
gaccuuaucugugcgugaaac

SEQ ID NO: 2138007 - RNA, 22 nt, Human
gaccuuaucugugcgugaaaca

SEQ ID NO: 2138008 - RNA, 17 nt, Human
gacgugauuuugcugua

SEQ ID NO: 2138009 - RNA, 18 nt, Human
gacgugcaccuguacuca

SEQ ID NO: 2138010 - RNA, 16 nt, Human
gacgugauuuugcugu

SEQ ID NO: 2138011 - RNA, 21 nt, Human
gacguccugccaccuggggca

SEQ ID NO: 2138012 - RNA, 14 nt, Human
gacguccugccacc

SEQ ID NO: 2138013 - RNA, 18 nt, Human
gacguccugccaccuggg

SEQ ID NO: 2138014 - RNA, 17 nt, Human
gacggcgcccccagugu

SEQ ID NO: 2138015 - RNA, 18 nt, Human
gacgucccuuuuuucucu

SEQ ID NO: 2138016 - RNA, 13 nt, Human
gacguccugccac

SEQ ID NO: 2138017 - RNA, 19 nt, Human
gacggcacccacccagcac

SEQ ID NO: 2138018 - RNA, 15 nt, Human
gacggagagaaaaaa

SEQ ID NO: 2138019 - RNA, 15 nt, Human
gacggccugaugcuc

SEQ ID NO: 2138020 - RNA, 20 nt, Human
gacggccugaugcucccucc

SEQ ID NO: 2138021 - RNA, 22 nt, Human
gacggccugaugcucccucccc

SEQ ID NO: 2138022 - RNA, 23 nt, Human
gacggccugaugcucccuccccu

SEQ ID NO: 2138023 - RNA, 13 nt, Human
gacggagucccac

SEQ ID NO: 2138024 - RNA, 19 nt, Human
gacguguguuucuagagcc

SEQ ID NO: 2138025 - RNA, 21 nt, Human
gacguucggggcaugcugggg

SEQ ID NO: 2138026 - RNA, 18 nt, Human
gacuaaaaauauuauaac

SEQ ID NO: 2138027 - RNA, 18 nt, Human
gacuaaagagagaaugua

SEQ ID NO: 2138028 - RNA, 14 nt, Human
gacuaaagagagaa

SEQ ID NO: 2138029 - RNA, 17 nt, Human
gacuaaagagagaaugu

SEQ ID NO: 2138030 - RNA, 10 nt, Human
gacuaaagag

SEQ ID NO: 2138031 - RNA, 13 nt, Human
gacuaaagagaga

SEQ ID NO: 2138032 - RNA, 12 nt, Human
gaacguuuuucc

SEQ ID NO: 2138033 - RNA, 15 nt, Human
gaacguuuuuccugu

SEQ ID NO: 2138034 - RNA, 21 nt, Human
gaacgacaauagcuuuacccu

SEQ ID NO: 2138035 - RNA, 17 nt, Human
gaaccucuuccccagaa

SEQ ID NO: 2138036 - RNA, 18 nt, Human
gaacgauuuagaaagaag

SEQ ID NO: 2138037 - RNA, 16 nt, Human
gaacauugauugcugu

SEQ ID NO: 2138038 - RNA, 19 nt, Human
gaacuagacugccuggguu

SEQ ID NO: 2138039 - RNA, 18 nt, Human
gaacuagagguuuuauga

SEQ ID NO: 2138040 - RNA, 22 nt, Human
gaacuagagguuuuaugauauu

SEQ ID NO: 2138041 - RNA, 15 nt, Human
gaacuaauaaaagca

SEQ ID NO: 2138042 - RNA, 13 nt, Human
gaacauugcaaua

SEQ ID NO: 2138043 - RNA, 15 nt, Human
gaacauugcaauaga

SEQ ID NO: 2138044 - RNA, 17 nt, Human
gaacauugcaauagaaa

SEQ ID NO: 2138045 - RNA, 20 nt, Human
gaacauccaaggagaaacag

SEQ ID NO: 2138046 - RNA, 23 nt, Human
gaacauccaaggagaaacagaga

SEQ ID NO: 2138047 - RNA, 20 nt, Human
gaacauguugguauuuaucu

SEQ ID NO: 2138048 - RNA, 15 nt, Human
gaaccaaaacauucc

SEQ ID NO: 2138049 - RNA, 16 nt, Human
gaaccaaaacauuccg

SEQ ID NO: 2138050 - RNA, 20 nt, Human
gaaccaaaacauuccguuua

SEQ ID NO: 2138051 - RNA, 16 nt, Human
gaaccucacgcaccuc

SEQ ID NO: 2138052 - RNA, 17 nt, Human
gaaccucacgcaccucc

SEQ ID NO: 2138053 - RNA, 18 nt, Human
gaaccucacgcaccuccc

SEQ ID NO: 2138054 - RNA, 19 nt, Human
gaaccucacgcaccuccca

SEQ ID NO: 2138055 - RNA, 20 nt, Human
gaaccucacgcaccucccau

SEQ ID NO: 2138056 - RNA, 21 nt, Human
gaaccucacgcaccucccauc

SEQ ID NO: 2138057 - RNA, 13 nt, Human
gaaccucuucccc

SEQ ID NO: 2138058 - RNA, 14 nt, Human
gaaccucuucccca

SEQ ID NO: 2138059 - RNA, 11 nt, Human
gaaccucaggc

SEQ ID NO: 2138060 - RNA, 14 nt, Human
gaaccucaggcuuc

SEQ ID NO: 2138061 - RNA, 18 nt, Human
gaaccucaggcuuccuug

SEQ ID NO: 2138062 - RNA, 13 nt, Human
gaaaauacaauaa

SEQ ID NO: 2138063 - RNA, 14 nt, Human
gaaaauacaauaaa

SEQ ID NO: 2138064 - RNA, 15 nt, Human
gaaaauacaauaaac

SEQ ID NO: 2138065 - RNA, 16 nt, Human
gaaaauacaauaaacu

SEQ ID NO: 2138066 - RNA, 23 nt, Human
gaaaauaaaucaaugcuauaacu

SEQ ID NO: 2138067 - RNA, 19 nt, Human
gaaaauacaacuuaaauaa

SEQ ID NO: 2138068 - RNA, 12 nt, Human
gaaaauaaaauu

SEQ ID NO: 2138069 - RNA, 13 nt, Human
gaaaauaaaauua

SEQ ID NO: 2138070 - RNA, 14 nt, Human
gaaaauaaaauuaa

SEQ ID NO: 2138071 - RNA, 17 nt, Human
gaaaauaaaauuaagaa

SEQ ID NO: 2138072 - RNA, 20 nt, Human
gaaaauaaaauuaagaaugu

SEQ ID NO: 2138073 - RNA, 13 nt, Human
gaacagcaggccc

SEQ ID NO: 2138074 - RNA, 14 nt, Human
gaacagcaggccca

SEQ ID NO: 2138075 - RNA, 15 nt, Human
gaacagcaggcccac

SEQ ID NO: 2138076 - RNA, 20 nt, Human
gaacagcaggcccaccuacc

SEQ ID NO: 2138077 - RNA, 21 nt, Human
gaacagcaggcccaccuaccu

SEQ ID NO: 2138078 - RNA, 18 nt, Human
gaacagauaaucccugua

SEQ ID NO: 2138079 - RNA, 18 nt, Human
gaacagaucuccaaagcu

SEQ ID NO: 2138080 - RNA, 19 nt, Human
gaacagaucuccaaagcuu

SEQ ID NO: 2138081 - RNA, 17 nt, Human
gaacagauaaucccugu

SEQ ID NO: 2138082 - RNA, 23 nt, Human
gaacacugcacucuuaagcuucc

SEQ ID NO: 2138083 - RNA, 18 nt, Human
gaacagccgcuccugucu

SEQ ID NO: 2138084 - RNA, 21 nt, Human
gaacagcuaugggagccccag

SEQ ID NO: 2138085 - RNA, 22 nt, Human
gaacagcuaugggagccccagg

SEQ ID NO: 2138086 - RNA, 23 nt, Human
gaacagcuaugggagccccaggg

SEQ ID NO: 2138087 - RNA, 19 nt, Human
gaacagugauuuuuuuuua

SEQ ID NO: 2138088 - RNA, 21 nt, Human
gaacagugauuuuuuuuuaga

SEQ ID NO: 2138089 - RNA, 14 nt, Human
gaacaguguuuccc

SEQ ID NO: 2138090 - RNA, 18 nt, Human
gaacauagacuagagaaa

SEQ ID NO: 2138091 - RNA, 19 nt, Human
gaacauagacuagagaaac

SEQ ID NO: 2138092 - RNA, 21 nt, Human
gaacauagacuagagaaaccg

SEQ ID NO: 2138093 - RNA, 12 nt, Human
gaacauccaagg

SEQ ID NO: 2138094 - RNA, 13 nt, Human
gaacauacuucag

SEQ ID NO: 2138095 - RNA, 14 nt, Human
gaacaucacagcuu

SEQ ID NO: 2138096 - RNA, 13 nt, Human
gaagauagaagaa

SEQ ID NO: 2138097 - RNA, 14 nt, Human
gaagauagaagaaa

SEQ ID NO: 2138098 - RNA, 15 nt, Human
gaagauaggcucugc

SEQ ID NO: 2138099 - RNA, 16 nt, Human
gaagauaggcucugca

SEQ ID NO: 2138100 - RNA, 17 nt, Human
gaagauaggcucugcac

SEQ ID NO: 2138101 - RNA, 18 nt, Human
gaagauaggcucugcaca

SEQ ID NO: 2138102 - RNA, 16 nt, Human
gaagauaccaucagca

SEQ ID NO: 2138103 - RNA, 13 nt, Human
gaagauaggcucu

SEQ ID NO: 2138104 - RNA, 20 nt, Human
gaagauaauauuaaggaaga

SEQ ID NO: 2138105 - RNA, 20 nt, Human
gaagagggagaagcaugaaa

SEQ ID NO: 2138106 - RNA, 18 nt, Human
gaagcauuuacuuugugu

SEQ ID NO: 2138107 - RNA, 15 nt, Human
gaagccacagcccag

SEQ ID NO: 2138108 - RNA, 17 nt, Human
gaagccacagcccaggc

SEQ ID NO: 2138109 - RNA, 18 nt, Human
gaagccacagcccaggcc

SEQ ID NO: 2138110 - RNA, 19 nt, Human
gaagccacagcccaggccu

SEQ ID NO: 2138111 - RNA, 15 nt, Human
gaagauuauuuuuua

SEQ ID NO: 2138112 - RNA, 18 nt, Human
gaagauuauuuuuuauga

SEQ ID NO: 2138113 - RNA, 15 nt, Human
gaagauguuucaaaa

SEQ ID NO: 2138114 - RNA, 19 nt, Human
gaagaugucaucccauugu

SEQ ID NO: 2138115 - RNA, 17 nt, Human
gaagcauuuacuuugug

SEQ ID NO: 2138116 - RNA, 11 nt, Human
gaagcccugga

SEQ ID NO: 2138117 - RNA, 18 nt, Human
gaagcccuggauuucaga

SEQ ID NO: 2138118 - RNA, 19 nt, Human
gaagcccuggauuucagaa

SEQ ID NO: 2138119 - RNA, 22 nt, Human
gaagcccuggauuucagaaaga

SEQ ID NO: 2138120 - RNA, 18 nt, Human
gaagcccuaacucagcca

SEQ ID NO: 2138121 - RNA, 11 nt, Human
gaagcccuccu

SEQ ID NO: 2138122 - RNA, 12 nt, Human
gaagcccuccuu

SEQ ID NO: 2138123 - RNA, 14 nt, Human
gaagcccuccuucc

SEQ ID NO: 2138124 - RNA, 15 nt, Human
gaagcccuccuucca

SEQ ID NO: 2138125 - RNA, 16 nt, Human
gaagcccuccuuccac

SEQ ID NO: 2138126 - RNA, 19 nt, Human
gaagcccuccuuccacgga

SEQ ID NO: 2138127 - RNA, 20 nt, Human
gaagcccagcuccagggcca

SEQ ID NO: 2138128 - RNA, 12 nt, Human
gaagccacccuc

SEQ ID NO: 2138129 - RNA, 17 nt, Human
gaagccacccucccagc

SEQ ID NO: 2138130 - RNA, 18 nt, Human
gaagccacccucccagcu

SEQ ID NO: 2138131 - RNA, 19 nt, Human
gaagccacccucccagcuc

SEQ ID NO: 2138132 - RNA, 20 nt, Human
gaagccacccucccagcucu

SEQ ID NO: 2138133 - RNA, 22 nt, Human
gaagccacccucccagcucuga

SEQ ID NO: 2138134 - RNA, 12 nt, Human
gaagagaaacca

SEQ ID NO: 2138135 - RNA, 13 nt, Human
gaagacuguggcu

SEQ ID NO: 2138136 - RNA, 15 nt, Human
gaagacuucccagcu

SEQ ID NO: 2138137 - RNA, 16 nt, Human
gaagagacugggaaga

SEQ ID NO: 2138138 - RNA, 15 nt, Human
gaagagagagcugag

SEQ ID NO: 2138139 - RNA, 12 nt, Human
gaagagaaacag

SEQ ID NO: 2138140 - RNA, 13 nt, Human
gaagagaaacagg

SEQ ID NO: 2138141 - RNA, 16 nt, Human
gaagaggcagauucaa

SEQ ID NO: 2138142 - RNA, 12 nt, Human
gaagagcagccc

SEQ ID NO: 2138143 - RNA, 18 nt, Human
gaagagcaggcacaugga

SEQ ID NO: 2138144 - RNA, 23 nt, Human
gaagagcaggcacauggaggagc

SEQ ID NO: 2138145 - RNA, 15 nt, Human
gaagagcaggcacau

SEQ ID NO: 2138146 - RNA, 21 nt, Human
gaagagaguccauauuucaau

SEQ ID NO: 2138147 - RNA, 18 nt, Human
gaagagaugggcuuguuu

SEQ ID NO: 2138148 - RNA, 13 nt, Human
gaagaaaaaauac

SEQ ID NO: 2138149 - RNA, 18 nt, Human
gaagaaaaaauacauuuu

SEQ ID NO: 2138150 - RNA, 16 nt, Human
gaagaaaaaaaauaac

SEQ ID NO: 2138151 - RNA, 17 nt, Human
gaagaaaaaaaauaaca

SEQ ID NO: 2138152 - RNA, 18 nt, Human
gaagaaaaaaaauaacac

SEQ ID NO: 2138153 - RNA, 20 nt, Human
gaagacugucagcuuccaaa

SEQ ID NO: 2138154 - RNA, 11 nt, Human
gaagacugugg

SEQ ID NO: 2138155 - RNA, 12 nt, Human
gaagacuguggc

SEQ ID NO: 2138156 - RNA, 23 nt, Human
gaaguaguggagccccugcucug

SEQ ID NO: 2138157 - RNA, 23 nt, Human
gaaguaggaagugaaaauaggua

SEQ ID NO: 2138158 - RNA, 19 nt, Human
gaagucaugaagcccaagu

SEQ ID NO: 2138159 - RNA, 15 nt, Human
gaagucaugaagccc

SEQ ID NO: 2138160 - RNA, 15 nt, Human
gaagucuuagaugua

SEQ ID NO: 2138161 - RNA, 18 nt, Human
gaagucucuagguucuga

SEQ ID NO: 2138162 - RNA, 20 nt, Human
gaagucuaggagcugggagg

SEQ ID NO: 2138163 - RNA, 22 nt, Human
gaagucuaggagcugggaggaa

SEQ ID NO: 2138164 - RNA, 15 nt, Human
gaagucuaggagcug

SEQ ID NO: 2138165 - RNA, 16 nt, Human
gaagucuaggagcugg

SEQ ID NO: 2138166 - RNA, 23 nt, Human
gaagguggggguuggcuggguac

SEQ ID NO: 2138167 - RNA, 13 nt, Human
gaaguaaugaauu

SEQ ID NO: 2138168 - RNA, 15 nt, Human
gaaguaaugaauuuu

SEQ ID NO: 2138169 - RNA, 22 nt, Human
gaaggugucuggacauucagaa

SEQ ID NO: 2138170 - RNA, 22 nt, Human
gaaggugccccaaaaugcaaga

SEQ ID NO: 2138171 - RNA, 18 nt, Human
gaagggggguugcagugg

SEQ ID NO: 2138172 - RNA, 23 nt, Human
gaagggggguugcaguggagagg

SEQ ID NO: 2138173 - RNA, 17 nt, Human
gaagggggucaaagcaa

SEQ ID NO: 2138174 - RNA, 20 nt, Human
gaagggggucaaagcaagga

SEQ ID NO: 2138175 - RNA, 14 nt, Human
gaagcggcuggcag

SEQ ID NO: 2138176 - RNA, 21 nt, Human
gaagcccuggauuucagaaag

SEQ ID NO: 2138177 - RNA, 13 nt, Human
gaagcguauguuu

SEQ ID NO: 2138178 - RNA, 14 nt, Human
gaagcguauguuuu

SEQ ID NO: 2138179 - RNA, 22 nt, Human
gaauagcugggacuacaggugu

SEQ ID NO: 2138180 - RNA, 23 nt, Human
gaauagcugggacuacaggugug

SEQ ID NO: 2138181 - RNA, 20 nt, Human
gaauacaguguuauuuucuu

SEQ ID NO: 2138182 - RNA, 19 nt, Human
gaauaccucuuugaaagaa

SEQ ID NO: 2138183 - RNA, 13 nt, Human
gaauaaaaauuaa

SEQ ID NO: 2138184 - RNA, 20 nt, Human
gaauauuugucgauauuucc

SEQ ID NO: 2138185 - RNA, 12 nt, Human
gaauauuuuauu

SEQ ID NO: 2138186 - RNA, 14 nt, Human
gaauauuuuauuca

SEQ ID NO: 2138187 - RNA, 15 nt, Human
gaauauuuuauucaa

SEQ ID NO: 2138188 - RNA, 16 nt, Human
gaauauuuuauucaag

SEQ ID NO: 2138189 - RNA, 18 nt, Human
gaauauuuuauucaaggu

SEQ ID NO: 2138190 - RNA, 20 nt, Human
gaauauuuuauucaagguaa

SEQ ID NO: 2138191 - RNA, 13 nt, Human
gaaucaaaacucu

SEQ ID NO: 2138192 - RNA, 14 nt, Human
gaaucaaaacucuc

SEQ ID NO: 2138193 - RNA, 23 nt, Human
gaauauuuuguuuugugcagaga

SEQ ID NO: 2138194 - RNA, 15 nt, Human
gaaucaaaacucucc

SEQ ID NO: 2138195 - RNA, 14 nt, Human
gaaucaacagggca

SEQ ID NO: 2138196 - RNA, 15 nt, Human
gaaucaacagggcag

SEQ ID NO: 2138197 - RNA, 17 nt, Human
gaaucaacagggcagca

SEQ ID NO: 2138198 - RNA, 20 nt, Human
gaaucaagaugucagacugg

SEQ ID NO: 2138199 - RNA, 21 nt, Human
gaaucaagaugucagacuggc

SEQ ID NO: 2138200 - RNA, 21 nt, Human
gaauacagaggcaacugcauu

SEQ ID NO: 2138201 - RNA, 16 nt, Human
gaauacaaacauauuu

SEQ ID NO: 2138202 - RNA, 14 nt, Human
gaauacagaaagau

SEQ ID NO: 2138203 - RNA, 23 nt, Human
gaauacagggcaugcauuuugca

SEQ ID NO: 2138204 - RNA, 13 nt, Human
gaauacaguguua

SEQ ID NO: 2138205 - RNA, 14 nt, Human
gaauaauuucccaa

SEQ ID NO: 2138206 - RNA, 21 nt, Human
gaauaauuucccaauuaggaa

SEQ ID NO: 2138207 - RNA, 23 nt, Human
gaauaauuucccaauuaggaagu

SEQ ID NO: 2138208 - RNA, 22 nt, Human
gaauaauaauuauccagaguuu

SEQ ID NO: 2138209 - RNA, 12 nt, Human
gaauaauagaag

SEQ ID NO: 2138210 - RNA, 15 nt, Human
gaauaauagaagaac

SEQ ID NO: 2138211 - RNA, 19 nt, Human
gaauaauaugcugccaaau

SEQ ID NO: 2138212 - RNA, 17 nt, Human
gaauaauacaguaucuc

SEQ ID NO: 2138213 - RNA, 21 nt, Human
gaauaacucuguggcauuauu

SEQ ID NO: 2138214 - RNA, 22 nt, Human
gaauaaccacuuaaaaaauguc

SEQ ID NO: 2138215 - RNA, 23 nt, Human
gaauaaccacuuaaaaaaugucc

SEQ ID NO: 2138216 - RNA, 20 nt, Human
gaaguuugagaucagccugg

SEQ ID NO: 2138217 - RNA, 21 nt, Human
gaaguuuguguucuguuuguu

SEQ ID NO: 2138218 - RNA, 18 nt, Human
gaauaacauguaauuaag

SEQ ID NO: 2138219 - RNA, 19 nt, Human
gaauaacauguaauuaagu

SEQ ID NO: 2138220 - RNA, 23 nt, Human
gaaguuuucaggacuuggucuga

SEQ ID NO: 2138221 - RNA, 13 nt, Human
gaaguuuucagga

SEQ ID NO: 2138222 - RNA, 12 nt, Human
gaaguuuugcau

SEQ ID NO: 2138223 - RNA, 17 nt, Human
gaaguuuugcauuuaug

SEQ ID NO: 2138224 - RNA, 15 nt, Human
gaaugaaaaaacagu

SEQ ID NO: 2138225 - RNA, 15 nt, Human
gaaugaaaaauuuaa

SEQ ID NO: 2138226 - RNA, 19 nt, Human
gaaugaaaaauuuaagcau

SEQ ID NO: 2138227 - RNA, 20 nt, Human
gaaugaaaaauuuaagcauu

SEQ ID NO: 2138228 - RNA, 22 nt, Human
gaaugaaaaauuuaagcauugu

SEQ ID NO: 2138229 - RNA, 23 nt, Human
gaaugaaaaauuuaagcauuguu

SEQ ID NO: 2138230 - RNA, 23 nt, Human
gaaugaaccacaucuugcucugc

SEQ ID NO: 2138231 - RNA, 18 nt, Human
gaaugaaccacaucuugc

SEQ ID NO: 2138232 - RNA, 22 nt, Human
gaaugaaccacaucuugcucug

SEQ ID NO: 2138233 - RNA, 17 nt, Human
gaaugcccacaggcaaa

SEQ ID NO: 2138234 - RNA, 22 nt, Human
gaaugcccacaggcaaaugcau

SEQ ID NO: 2138235 - RNA, 21 nt, Human
gaaugaagauaccaucagcaa

SEQ ID NO: 2138236 - RNA, 14 nt, Human
gaaugcauaaaaug

SEQ ID NO: 2138237 - RNA, 11 nt, Human
gaaugcagugg

SEQ ID NO: 2138238 - RNA, 17 nt, Human
gaaugaaggugucagaa

SEQ ID NO: 2138239 - RNA, 16 nt, Human
gaauguauuauucugc

SEQ ID NO: 2138240 - RNA, 17 nt, Human
gaauguauuauucugca

SEQ ID NO: 2138241 - RNA, 18 nt, Human
gaauguauuauucugcag

SEQ ID NO: 2138242 - RNA, 19 nt, Human
gaauguauuauucugcagc

SEQ ID NO: 2138243 - RNA, 21 nt, Human
gaauguauuauucugcagcau

SEQ ID NO: 2138244 - RNA, 22 nt, Human
gaaugguuuucaaaauaaaaau

SEQ ID NO: 2138245 - RNA, 13 nt, Human
gaaugguagucua

SEQ ID NO: 2138246 - RNA, 18 nt, Human
gaaugguagucuaaccaa

SEQ ID NO: 2138247 - RNA, 19 nt, Human
gaaugguagucuaaccaaa

SEQ ID NO: 2138248 - RNA, 20 nt, Human
gaaugguagucuaaccaaau

SEQ ID NO: 2138249 - RNA, 23 nt, Human
gaaugguagucuaaccaaaugca

SEQ ID NO: 2138250 - RNA, 17 nt, Human
gaauucucagaaucuca

SEQ ID NO: 2138251 - RNA, 16 nt, Human
gaauucauucuggucu

SEQ ID NO: 2138252 - RNA, 21 nt, Human
gaauucauucuggucucucua

SEQ ID NO: 2138253 - RNA, 22 nt, Human
gaauucauucuggucucucuau

SEQ ID NO: 2138254 - RNA, 14 nt, Human
gaauucagcugccc

SEQ ID NO: 2138255 - RNA, 23 nt, Human
gaauucuaggcaucccaggggac

SEQ ID NO: 2138256 - RNA, 18 nt, Human
gaauucugcuaccucacu

SEQ ID NO: 2138257 - RNA, 19 nt, Human
gaauucugcuaccucacug

SEQ ID NO: 2138258 - RNA, 14 nt, Human
gaauugaagcagga

SEQ ID NO: 2138259 - RNA, 15 nt, Human
gaauugaacccagga

SEQ ID NO: 2138260 - RNA, 16 nt, Human
gaauugaacccaggag

SEQ ID NO: 2138261 - RNA, 18 nt, Human
gaauugaacccaggaggu

SEQ ID NO: 2138262 - RNA, 15 nt, Human
gaauugaggucugcu

SEQ ID NO: 2138263 - RNA, 14 nt, Human
gaauugauaauaaa

SEQ ID NO: 2138264 - RNA, 15 nt, Human
gaauugauaauaaac

SEQ ID NO: 2138265 - RNA, 23 nt, Human
gaauugauaauaaacuguccucu

SEQ ID NO: 2138266 - RNA, 20 nt, Human
gaauugaucauuuucccccc

SEQ ID NO: 2138267 - RNA, 23 nt, Human
gaauuuauucaauuccucuggga

SEQ ID NO: 2138268 - RNA, 11 nt, Human
gaauuuaacaa

SEQ ID NO: 2138269 - RNA, 12 nt, Human
gaauuuaacaau

SEQ ID NO: 2138270 - RNA, 16 nt, Human
gaauuuaacaaugcga

SEQ ID NO: 2138271 - RNA, 17 nt, Human
gaauuuaacaaugcgaa

SEQ ID NO: 2138272 - RNA, 18 nt, Human
gaauuuaacaaugcgaau

SEQ ID NO: 2138273 - RNA, 22 nt, Human
gaauuuaacaaugcgaauggua

SEQ ID NO: 2138274 - RNA, 22 nt, Human
gaauuuaucacacuucugugag

SEQ ID NO: 2138275 - RNA, 17 nt, Human
gaauuuauucaauuccu

SEQ ID NO: 2138276 - RNA, 13 nt, Human
gaauuuauucaau

SEQ ID NO: 2138277 - RNA, 20 nt, Human
gaauuuaucacacuucugug

SEQ ID NO: 2138278 - RNA, 14 nt, Human
gaauuguaucauuu

SEQ ID NO: 2138279 - RNA, 14 nt, Human
gaauuguccccagu

SEQ ID NO: 2138280 - RNA, 23 nt, Human
gaauuguccccaguuugcagaaa

SEQ ID NO: 2138281 - RNA, 18 nt, Human
gaauugugaccaaguuau

SEQ ID NO: 2138282 - RNA, 20 nt, Human
gaauugauuucccuucuucu

SEQ ID NO: 2138283 - RNA, 21 nt, Human
gaauugaucauuuucccccca

SEQ ID NO: 2138284 - RNA, 18 nt, Human
gauauaaaagacugacca

SEQ ID NO: 2138285 - RNA, 13 nt, Human
gauauaaauaaaa

SEQ ID NO: 2138286 - RNA, 13 nt, Human
gauaggcucugca

SEQ ID NO: 2138287 - RNA, 14 nt, Human
gauaggcucugcac

SEQ ID NO: 2138288 - RNA, 17 nt, Human
gauaggcucugcacaga

SEQ ID NO: 2138289 - RNA, 20 nt, Human
gauaggcucugcacagaugg

SEQ ID NO: 2138290 - RNA, 18 nt, Human
gauauaugcucugcaugu

SEQ ID NO: 2138291 - RNA, 15 nt, Human
gauauaaauaaaaca

SEQ ID NO: 2138292 - RNA, 18 nt, Human
gauauagaucacauaaca

SEQ ID NO: 2138293 - RNA, 20 nt, Human
gauauagaucacauaacaga

SEQ ID NO: 2138294 - RNA, 12 nt, Human
gauaauuuugca

SEQ ID NO: 2138295 - RNA, 17 nt, Human
gauaauuuugcauaaaa

SEQ ID NO: 2138296 - RNA, 18 nt, Human
gauaauucuagcuuugag

SEQ ID NO: 2138297 - RNA, 17 nt, Human
gauaauaugagaaucag

SEQ ID NO: 2138298 - RNA, 23 nt, Human
gauaggccugugggccagauugc

SEQ ID NO: 2138299 - RNA, 16 nt, Human
gauaggccuucuugug

SEQ ID NO: 2138300 - RNA, 12 nt, Human
gauaggcucugc

SEQ ID NO: 2138301 - RNA, 17 nt, Human
gaucagcuguuugucau

SEQ ID NO: 2138302 - RNA, 18 nt, Human
gaucagcuguuugucaua

SEQ ID NO: 2138303 - RNA, 17 nt, Human
gaucacuggagcccagg

SEQ ID NO: 2138304 - RNA, 14 nt, Human
gaucacuggagccc

SEQ ID NO: 2138305 - RNA, 16 nt, Human
gaucagcuguuuguca

SEQ ID NO: 2138306 - RNA, 20 nt, Human
gauaggcacauagagaggga

SEQ ID NO: 2138307 - RNA, 18 nt, Human
gaucacuaugcauuuuaa

SEQ ID NO: 2138308 - RNA, 14 nt, Human
gaucaccugagguc

SEQ ID NO: 2138309 - RNA, 14 nt, Human
gaucaccugagguu

SEQ ID NO: 2138310 - RNA, 12 nt, Human
gaucacuggagc

SEQ ID NO: 2138311 - RNA, 13 nt, Human
gaucacuggagcc

SEQ ID NO: 2138312 - RNA, 20 nt, Human
gaucacggcucacugcagcc

SEQ ID NO: 2138313 - RNA, 23 nt, Human
gaucacggcucacugcagccuca

SEQ ID NO: 2138314 - RNA, 13 nt, Human
gaucacagggccc

SEQ ID NO: 2138315 - RNA, 20 nt, Human
gaucacagggccccagaagg

SEQ ID NO: 2138316 - RNA, 18 nt, Human
gaucacauaacagaaugc

SEQ ID NO: 2138317 - RNA, 19 nt, Human
gaucacauaacagaaugca

SEQ ID NO: 2138318 - RNA, 14 nt, Human
gaucacagccucug

SEQ ID NO: 2138319 - RNA, 21 nt, Human
gaucacagcuucagccaggag

SEQ ID NO: 2138320 - RNA, 19 nt, Human
gaucacagcuucagccagg

SEQ ID NO: 2138321 - RNA, 17 nt, Human
gauauauuuuucacagu

SEQ ID NO: 2138322 - RNA, 15 nt, Human
gauauauuuuucaca

SEQ ID NO: 2138323 - RNA, 23 nt, Human
gauauaggucagugaggcccagg

SEQ ID NO: 2138324 - RNA, 17 nt, Human
gauaucccuaugcugcc

SEQ ID NO: 2138325 - RNA, 22 nt, Human
gauaucccuaugcugccuaggc

SEQ ID NO: 2138326 - RNA, 23 nt, Human
gauaucccuaugcugccuaggcu

SEQ ID NO: 2138327 - RNA, 16 nt, Human
gaguguguauuguucc

SEQ ID NO: 2138328 - RNA, 17 nt, Human
gaguguguauuguuccc

SEQ ID NO: 2138329 - RNA, 18 nt, Human
gaguguguauuguuccca

SEQ ID NO: 2138330 - RNA, 13 nt, Human
gacuucccagcuu

SEQ ID NO: 2138331 - RNA, 20 nt, Human
gacuuccccgcauuccaggc

SEQ ID NO: 2138332 - RNA, 22 nt, Human
gacuuccccgcauuccaggcuc

SEQ ID NO: 2138333 - RNA, 23 nt, Human
gacuuccccgcauuccaggcucc

SEQ ID NO: 2138334 - RNA, 15 nt, Human
gacuucccaacugca

SEQ ID NO: 2138335 - RNA, 21 nt, Human
gacuucauagauuuccuuccc

SEQ ID NO: 2138336 - RNA, 15 nt, Human
gacuucauuuuuccu

SEQ ID NO: 2138337 - RNA, 16 nt, Human
gacuucauuuuuccua

SEQ ID NO: 2138338 - RNA, 18 nt, Human
gaguucgagaccagccug

SEQ ID NO: 2138339 - RNA, 15 nt, Human
gaguucagcugcuuc

SEQ ID NO: 2138340 - RNA, 16 nt, Human
gaguucagcugcuucu

SEQ ID NO: 2138341 - RNA, 19 nt, Human
gaguucagguagcugcccc

SEQ ID NO: 2138342 - RNA, 21 nt, Human
gaguucagguagcugccccug

SEQ ID NO: 2138343 - RNA, 22 nt, Human
gaguucagguagcugccccugg

SEQ ID NO: 2138344 - RNA, 19 nt, Human
gaguucgagaccagccugg

SEQ ID NO: 2138345 - RNA, 20 nt, Human
gaguucgagaccagccuggc

SEQ ID NO: 2138346 - RNA, 21 nt, Human
gaguucgagaccagccuggcc

SEQ ID NO: 2138347 - RNA, 19 nt, Human
gaguucgaggcugcaguca

SEQ ID NO: 2138348 - RNA, 19 nt, Human
gaguucaagaccagccugg

SEQ ID NO: 2138349 - RNA, 20 nt, Human
gaguucaagaccagccuggc

SEQ ID NO: 2138350 - RNA, 11 nt, Human
gagugugugca

SEQ ID NO: 2138351 - RNA, 19 nt, Human
gaguguguauuguucccag

SEQ ID NO: 2138352 - RNA, 21 nt, Human
gaguguguccaagugugugug

SEQ ID NO: 2138353 - RNA, 19 nt, Human
gagugugugcaugugugug

SEQ ID NO: 2138354 - RNA, 17 nt, Human
gaguguguuugucaccg

SEQ ID NO: 2138355 - RNA, 19 nt, Human
gaguguguguuugugcuga

SEQ ID NO: 2138356 - RNA, 18 nt, Human
gauaaaaugagguucaac

SEQ ID NO: 2138357 - RNA, 15 nt, Human
gauaaacuuuuagaa

SEQ ID NO: 2138358 - RNA, 18 nt, Human
gauaaacuuuuagaaacu

SEQ ID NO: 2138359 - RNA, 14 nt, Human
gauaaagaaaagaa

SEQ ID NO: 2138360 - RNA, 15 nt, Human
gauaacaagaucuuu

SEQ ID NO: 2138361 - RNA, 13 nt, Human
gauaaauuauaag

SEQ ID NO: 2138362 - RNA, 12 nt, Human
gauaaauuauaa

SEQ ID NO: 2138363 - RNA, 16 nt, Human
gauaaauuccacugga

SEQ ID NO: 2138364 - RNA, 11 nt, Human
gauaacagcua

SEQ ID NO: 2138365 - RNA, 15 nt, Human
gauaacagcuaccau

SEQ ID NO: 2138366 - RNA, 20 nt, Human
gauaacagcuaccaugacaa

SEQ ID NO: 2138367 - RNA, 21 nt, Human
gauaaccuguacuucaaguua

SEQ ID NO: 2138368 - RNA, 22 nt, Human
gauaaccuguacuucaaguuaa

SEQ ID NO: 2138369 - RNA, 16 nt, Human
gaugaaauguaaauac

SEQ ID NO: 2138370 - RNA, 20 nt, Human
gaucuugcucuaucucacag

SEQ ID NO: 2138371 - RNA, 19 nt, Human
gaucuuggcuuacugcagc

SEQ ID NO: 2138372 - RNA, 19 nt, Human
gaugaaugaggucccaggc

SEQ ID NO: 2138373 - RNA, 23 nt, Human
gaugaaugaggucccaggcagag

SEQ ID NO: 2138374 - RNA, 13 nt, Human
gaugaaucuugcg

SEQ ID NO: 2138375 - RNA, 23 nt, Human
gaugacccugcgaaggggcccug

SEQ ID NO: 2138376 - RNA, 19 nt, Human
gaugaccuaaccuaagcaa

SEQ ID NO: 2138377 - RNA, 13 nt, Human
gaugacccaggcu

SEQ ID NO: 2138378 - RNA, 21 nt, Human
gaugacccaggcugccugagc

SEQ ID NO: 2138379 - RNA, 12 nt, Human
gaugaccccucc

SEQ ID NO: 2138380 - RNA, 16 nt, Human
gaugaccccuccccua

SEQ ID NO: 2138381 - RNA, 17 nt, Human
gaugaccccuccccuaa

SEQ ID NO: 2138382 - RNA, 16 nt, Human
gaugaauuaaauuuaa

SEQ ID NO: 2138383 - RNA, 21 nt, Human
gaugaaaugaggucagagccu

SEQ ID NO: 2138384 - RNA, 15 nt, Human
gaugaaaugagguca

SEQ ID NO: 2138385 - RNA, 19 nt, Human
gaucuucuuuauaauucua

SEQ ID NO: 2138386 - RNA, 15 nt, Human
gaucuguauauacaa

SEQ ID NO: 2138387 - RNA, 20 nt, Human
gaucuguauauacaauaaca

SEQ ID NO: 2138388 - RNA, 23 nt, Human
gaucuguauauuuuuuucuaaga

SEQ ID NO: 2138389 - RNA, 23 nt, Human
gaugcaccagcccuuagcaggga

SEQ ID NO: 2138390 - RNA, 15 nt, Human
gaugcaccagcccuu

SEQ ID NO: 2138391 - RNA, 14 nt, Human
gaugcaccagcccu

SEQ ID NO: 2138392 - RNA, 23 nt, Human
gaugagaaauaaaguuucuguug

SEQ ID NO: 2138393 - RNA, 18 nt, Human
gaugagaauucagcugcc

SEQ ID NO: 2138394 - RNA, 20 nt, Human
gaugagaauucagcugcccc

SEQ ID NO: 2138395 - RNA, 16 nt, Human
gaugccugguggcagc

SEQ ID NO: 2138396 - RNA, 15 nt, Human
gaugccugguggcag

SEQ ID NO: 2138397 - RNA, 14 nt, Human
gaugccugguggca

SEQ ID NO: 2138398 - RNA, 14 nt, Human
gaugcagugcuucc

SEQ ID NO: 2138399 - RNA, 16 nt, Human
gauccugucuuuaagg

SEQ ID NO: 2138400 - RNA, 19 nt, Human
gauccugucuuuaaggaaa

SEQ ID NO: 2138401 - RNA, 20 nt, Human
gauccugucuuuaaggaaaa

SEQ ID NO: 2138402 - RNA, 17 nt, Human
gaucuaagccuuuccau

SEQ ID NO: 2138403 - RNA, 23 nt, Human
gauccuggguggucugcaggcag

SEQ ID NO: 2138404 - RNA, 18 nt, Human
gaucuaagccuuuccaua

SEQ ID NO: 2138405 - RNA, 18 nt, Human
gaucuaccagcauaaaua

SEQ ID NO: 2138406 - RNA, 15 nt, Human
gaucuaggugaggau

SEQ ID NO: 2138407 - RNA, 16 nt, Human
gaucauagauuucuga

SEQ ID NO: 2138408 - RNA, 18 nt, Human
gaucauagauuucugauu

SEQ ID NO: 2138409 - RNA, 19 nt, Human
gaucauagauuucugauuu

SEQ ID NO: 2138410 - RNA, 22 nt, Human
gaucauagauuucugauuuuau

SEQ ID NO: 2138411 - RNA, 23 nt, Human
gaucauagauuucugauuuuaug

SEQ ID NO: 2138412 - RNA, 13 nt, Human
gaucauccacugu

SEQ ID NO: 2138413 - RNA, 17 nt, Human
gauccucccaccucagc

SEQ ID NO: 2138414 - RNA, 16 nt, Human
gauccucccaccucag

SEQ ID NO: 2138415 - RNA, 23 nt, Human
gauccuaaugaaugcauaaaaug

SEQ ID NO: 2138416 - RNA, 18 nt, Human
gauccuaagggcucaccg

SEQ ID NO: 2138417 - RNA, 14 nt, Human
gauccuaccccuga

SEQ ID NO: 2138418 - RNA, 18 nt, Human
gauccuaggcauuugcug

SEQ ID NO: 2138419 - RNA, 13 nt, Human
gcaaaccugcccc

SEQ ID NO: 2138420 - RNA, 14 nt, Human
gcaaaccugcccca

SEQ ID NO: 2138421 - RNA, 17 nt, Human
gcaaaccugccccaucc

SEQ ID NO: 2138422 - RNA, 18 nt, Human
gcaaaccugccccauccc

SEQ ID NO: 2138423 - RNA, 17 nt, Human
gauuuuaacaauaacua

SEQ ID NO: 2138424 - RNA, 23 nt, Human
gauuuuaacaauaacuacugugu

SEQ ID NO: 2138425 - RNA, 20 nt, Human
gcaaacuuaagaaacacuga

SEQ ID NO: 2138426 - RNA, 21 nt, Human
gauuuuaaauucacaauagaa

SEQ ID NO: 2138427 - RNA, 12 nt, Human
gauuuuaacaau

SEQ ID NO: 2138428 - RNA, 14 nt, Human
gauuuuaacaauaa

SEQ ID NO: 2138429 - RNA, 15 nt, Human
gauuuuaacaauaac

SEQ ID NO: 2138430 - RNA, 23 nt, Human
gcaaaguucccuacuuccuguga

SEQ ID NO: 2138431 - RNA, 17 nt, Human
gcaaauagaaaacagga

SEQ ID NO: 2138432 - RNA, 21 nt, Human
gcaaauagaaaacaggaaaaa

SEQ ID NO: 2138433 - RNA, 20 nt, Human
gcaaagugaagacacuggcu

SEQ ID NO: 2138434 - RNA, 18 nt, Human
gcaaagaggcaagaggcu

SEQ ID NO: 2138435 - RNA, 14 nt, Human
gcaaagaggcaaga

SEQ ID NO: 2138436 - RNA, 13 nt, Human
gcaaagaggcaag

SEQ ID NO: 2138437 - RNA, 22 nt, Human
gcaaagacuauucccuucuaac

SEQ ID NO: 2138438 - RNA, 21 nt, Human
gcaaagacuauucccuucuaa

SEQ ID NO: 2138439 - RNA, 22 nt, Human
gcaaagaauuucaauuuguuca

SEQ ID NO: 2138440 - RNA, 15 nt, Human
gcaaagacagaagcc

SEQ ID NO: 2138441 - RNA, 16 nt, Human
gcaaagacagaagccu

SEQ ID NO: 2138442 - RNA, 17 nt, Human
gcaaagacagaagccuc

SEQ ID NO: 2138443 - RNA, 18 nt, Human
gcaacugcauuggcuuug

SEQ ID NO: 2138444 - RNA, 19 nt, Human
gcaacugaggcagacagca

SEQ ID NO: 2138445 - RNA, 21 nt, Human
gcaacugaggcagacagcagc

SEQ ID NO: 2138446 - RNA, 22 nt, Human
gcaacugaggcagacagcagcu

SEQ ID NO: 2138447 - RNA, 20 nt, Human
gcaacugcugaugcucaugg

SEQ ID NO: 2138448 - RNA, 21 nt, Human
gcaacugcugaugcucauggu

SEQ ID NO: 2138449 - RNA, 15 nt, Human
gcaacugaacaaaaa

SEQ ID NO: 2138450 - RNA, 16 nt, Human
gcaacugaacaaaaaa

SEQ ID NO: 2138451 - RNA, 13 nt, Human
gcaacugaggcag

SEQ ID NO: 2138452 - RNA, 14 nt, Human
gcaacugaggcaga

SEQ ID NO: 2138453 - RNA, 15 nt, Human
gcaacugaggcagac

SEQ ID NO: 2138454 - RNA, 23 nt, Human
gcaaauggugguuguuucuucca

SEQ ID NO: 2138455 - RNA, 15 nt, Human
gcaaugaaaaauucu

SEQ ID NO: 2138456 - RNA, 23 nt, Human
gcaaucuggggauacuggcaaag

SEQ ID NO: 2138457 - RNA, 16 nt, Human
gcaaugaaaaauucuc

SEQ ID NO: 2138458 - RNA, 13 nt, Human
gcaagguggagug

SEQ ID NO: 2138459 - RNA, 18 nt, Human
gcaagguggaguggaugc

SEQ ID NO: 2138460 - RNA, 23 nt, Human
gcaagguggaguggaugccucag

SEQ ID NO: 2138461 - RNA, 14 nt, Human
gcaaguaugugagu

SEQ ID NO: 2138462 - RNA, 12 nt, Human
gcaauccuccug

SEQ ID NO: 2138463 - RNA, 13 nt, Human
gcaauccuccuga

SEQ ID NO: 2138464 - RNA, 14 nt, Human
gcaauccuccugag

SEQ ID NO: 2138465 - RNA, 18 nt, Human
gcaaguaugugagugugu

SEQ ID NO: 2138466 - RNA, 23 nt, Human
gcaaguauguuuuagcauguguu

SEQ ID NO: 2138467 - RNA, 20 nt, Human
gcaaggaccaggacucccuc

SEQ ID NO: 2138468 - RNA, 19 nt, Human
gcaagcuuuuuuauuuuuu

SEQ ID NO: 2138469 - RNA, 15 nt, Human
gcaaggaaggaaaga

SEQ ID NO: 2138470 - RNA, 13 nt, Human
gcaaggaaggaaa

SEQ ID NO: 2138471 - RNA, 14 nt, Human
gcaaggaaggaaag

SEQ ID NO: 2138472 - RNA, 14 nt, Human
gcaaggaccaggac

SEQ ID NO: 2138473 - RNA, 15 nt, Human
gcaaggaccaggacu

SEQ ID NO: 2138474 - RNA, 21 nt, Human
gcaaggaccaggacucccucc

SEQ ID NO: 2138475 - RNA, 17 nt, Human
gcaagcuuggcuguaga

SEQ ID NO: 2138476 - RNA, 21 nt, Human
gcaagcuuggcuguagaagga

SEQ ID NO: 2138477 - RNA, 22 nt, Human
gcaagcuuggcuguagaaggag

SEQ ID NO: 2138478 - RNA, 13 nt, Human
gcaagcuggguaa

SEQ ID NO: 2138479 - RNA, 21 nt, Human
gcaagcacugcaugggcaagc

SEQ ID NO: 2138480 - RNA, 20 nt, Human
gcaagcaccuccugccucga

SEQ ID NO: 2138481 - RNA, 18 nt, Human
gcaagcaccuccugccuc

SEQ ID NO: 2138482 - RNA, 14 nt, Human
gcaagcacaucugc

SEQ ID NO: 2138483 - RNA, 18 nt, Human
gcaagcaagaaacacugg

SEQ ID NO: 2138484 - RNA, 14 nt, Human
gcaagauugcuuaa

SEQ ID NO: 2138485 - RNA, 16 nt, Human
gcaagcaccuccugcc

SEQ ID NO: 2138486 - RNA, 15 nt, Human
gcaagcaccuccugc

SEQ ID NO: 2138487 - RNA, 13 nt, Human
gcaagauugcuua

SEQ ID NO: 2138488 - RNA, 22 nt, Human
gcaagauuuuccacaagauucc

SEQ ID NO: 2138489 - RNA, 21 nt, Human
gcaacuugucuuuuucuggac

SEQ ID NO: 2138490 - RNA, 22 nt, Human
gcaacuugucuuuuucuggacu

SEQ ID NO: 2138491 - RNA, 23 nt, Human
gcaacuugucuuuuucuggacug

SEQ ID NO: 2138492 - RNA, 19 nt, Human
gcaacuugucuuuuucugg

SEQ ID NO: 2138493 - RNA, 14 nt, Human
gauuuguuuuagaa

SEQ ID NO: 2138494 - RNA, 17 nt, Human
gauuuguuuuagaauga

SEQ ID NO: 2138495 - RNA, 19 nt, Human
gauuuguuaaugauagcua

SEQ ID NO: 2138496 - RNA, 21 nt, Human
gauuguuaagucuaaauauuu

SEQ ID NO: 2138497 - RNA, 17 nt, Human
gauuguuugcucugaga

SEQ ID NO: 2138498 - RNA, 16 nt, Human
gauugcaacaggcugg

SEQ ID NO: 2138499 - RNA, 17 nt, Human
gauucccaagcucugcu

SEQ ID NO: 2138500 - RNA, 16 nt, Human
gauucccaagcucugc

SEQ ID NO: 2138501 - RNA, 14 nt, Human
gauugcuuaaaaua

SEQ ID NO: 2138502 - RNA, 18 nt, Human
gauugcuguguccaacuc

SEQ ID NO: 2138503 - RNA, 19 nt, Human
gauugcuguguccaacucc

SEQ ID NO: 2138504 - RNA, 21 nt, Human
gauugcuguguccaacuccag

SEQ ID NO: 2138505 - RNA, 22 nt, Human
gauugcuguguccaacuccagu

SEQ ID NO: 2138506 - RNA, 23 nt, Human
gauugcuguguccaacuccagua

SEQ ID NO: 2138507 - RNA, 17 nt, Human
gauugcuuaaaauagca

SEQ ID NO: 2138508 - RNA, 18 nt, Human
gauugcuuaaaauagcaa

SEQ ID NO: 2138509 - RNA, 14 nt, Human
gauugcuucuguag

SEQ ID NO: 2138510 - RNA, 16 nt, Human
gauugcuucuguagua

SEQ ID NO: 2138511 - RNA, 16 nt, Human
gauugcuugagcccag

SEQ ID NO: 2138512 - RNA, 19 nt, Human
gauugcuugagcccaggag

SEQ ID NO: 2138513 - RNA, 18 nt, Human
gauugcaacaggcugggc

SEQ ID NO: 2138514 - RNA, 17 nt, Human
gauugcaacaggcuggg

SEQ ID NO: 2138515 - RNA, 15 nt, Human
gauugcuaugaauga

SEQ ID NO: 2138516 - RNA, 17 nt, Human
gaugccugguggcagcu

SEQ ID NO: 2138517 - RNA, 14 nt, Human
gauguucuggcccu

SEQ ID NO: 2138518 - RNA, 13 nt, Human
gauguuuguggcc

SEQ ID NO: 2138519 - RNA, 14 nt, Human
gauguuuguggccu

SEQ ID NO: 2138520 - RNA, 15 nt, Human
gauguuuguggccuc

SEQ ID NO: 2138521 - RNA, 16 nt, Human
gauguuuguggccuca

SEQ ID NO: 2138522 - RNA, 17 nt, Human
gauguuuguggccucag

SEQ ID NO: 2138523 - RNA, 18 nt, Human
gauguuuguggccucaga

SEQ ID NO: 2138524 - RNA, 16 nt, Human
gauuaaggucucucuu

SEQ ID NO: 2138525 - RNA, 17 nt, Human
gauuaaggucucucuuu

SEQ ID NO: 2138526 - RNA, 18 nt, Human
gauuaaggucucucuuug

SEQ ID NO: 2138527 - RNA, 19 nt, Human
gauuaaggucucucuuugg

SEQ ID NO: 2138528 - RNA, 20 nt, Human
gauuaaggucucucuuugga

SEQ ID NO: 2138529 - RNA, 18 nt, Human
gauuaauauggggaugca

SEQ ID NO: 2138530 - RNA, 21 nt, Human
gauuacaagcgugagccacug

SEQ ID NO: 2138531 - RNA, 13 nt, Human
gauuacaagcgug

SEQ ID NO: 2138532 - RNA, 15 nt, Human
gauuaauuaaaugca

SEQ ID NO: 2138533 - RNA, 15 nt, Human
gauucccaagcucug

SEQ ID NO: 2138534 - RNA, 11 nt, Human
gauucaugugg

SEQ ID NO: 2138535 - RNA, 12 nt, Human
gauucaggcugc

SEQ ID NO: 2138536 - RNA, 13 nt, Human
gauucaggcugcu

SEQ ID NO: 2138537 - RNA, 16 nt, Human
gauucaggcugcuugg

SEQ ID NO: 2138538 - RNA, 14 nt, Human
gcagccuggacccu

SEQ ID NO: 2138539 - RNA, 13 nt, Human
gcagccugcgugg

SEQ ID NO: 2138540 - RNA, 15 nt, Human
gcagccugcguggcu

SEQ ID NO: 2138541 - RNA, 19 nt, Human
gcagccugcguggcugacc

SEQ ID NO: 2138542 - RNA, 12 nt, Human
gcagccuggagg

SEQ ID NO: 2138543 - RNA, 13 nt, Human
gcagccuggaggc

SEQ ID NO: 2138544 - RNA, 22 nt, Human
gcagccucaaccuccugggcua

SEQ ID NO: 2138545 - RNA, 21 nt, Human
gcagccucaaccuccugggcu

SEQ ID NO: 2138546 - RNA, 16 nt, Human
gcagccuacuagggac

SEQ ID NO: 2138547 - RNA, 23 nt, Human
gcagccuacuagggaccugggga

SEQ ID NO: 2138548 - RNA, 13 nt, Human
gcagccugccugg

SEQ ID NO: 2138549 - RNA, 14 nt, Human
gcagccugccugga

SEQ ID NO: 2138550 - RNA, 15 nt, Human
gcagccugccuggag

SEQ ID NO: 2138551 - RNA, 16 nt, Human
gcagccugccuggagu

SEQ ID NO: 2138552 - RNA, 18 nt, Human
gcagccgugccuucagcu

SEQ ID NO: 2138553 - RNA, 20 nt, Human
gcagccucaaccuccugggc

SEQ ID NO: 2138554 - RNA, 19 nt, Human
gcagccucaaccuccuggg

SEQ ID NO: 2138555 - RNA, 17 nt, Human
gcagccgugccuucagc

SEQ ID NO: 2138556 - RNA, 15 nt, Human
gcagccgugccuuca

SEQ ID NO: 2138557 - RNA, 14 nt, Human
gcagccgugccuuc

SEQ ID NO: 2138558 - RNA, 20 nt, Human
gcagcagguggcagaauggg

SEQ ID NO: 2138559 - RNA, 14 nt, Human
gcaggagccugagc

SEQ ID NO: 2138560 - RNA, 13 nt, Human
gcaggagcucaga

SEQ ID NO: 2138561 - RNA, 14 nt, Human
gcaggagcucagau

SEQ ID NO: 2138562 - RNA, 16 nt, Human
gcaggagcucagauga

SEQ ID NO: 2138563 - RNA, 18 nt, Human
gcaggagcucagaugaag

SEQ ID NO: 2138564 - RNA, 18 nt, Human
gcaggagggcccuaccug

SEQ ID NO: 2138565 - RNA, 22 nt, Human
gcaggagggcccuaccugauug

SEQ ID NO: 2138566 - RNA, 11 nt, Human
gcaggaccuca

SEQ ID NO: 2138567 - RNA, 14 nt, Human
gcaggaccucagag

SEQ ID NO: 2138568 - RNA, 15 nt, Human
gcaggaccucagagu

SEQ ID NO: 2138569 - RNA, 16 nt, Human
gcaggaccucagaguc

SEQ ID NO: 2138570 - RNA, 22 nt, Human
gcaggaccucagaguccaggcc

SEQ ID NO: 2138571 - RNA, 23 nt, Human
gcaggaccucagaguccaggccc

SEQ ID NO: 2138572 - RNA, 22 nt, Human
gcagcgagcuaugaucgcgcca

SEQ ID NO: 2138573 - RNA, 24 nt, Human
gcagcgaguuguggaaagccucug

SEQ ID NO: 2138574 - RNA, 15 nt, Human
gcagcaaccagagca

SEQ ID NO: 2138575 - RNA, 16 nt, Human
gcagcaaccagagcac

SEQ ID NO: 2138576 - RNA, 17 nt, Human
gcagcaaccagagcacu

SEQ ID NO: 2138577 - RNA, 18 nt, Human
gcagcaaccagagcacug

SEQ ID NO: 2138578 - RNA, 19 nt, Human
gcagcaaccagagcacugu

SEQ ID NO: 2138579 - RNA, 20 nt, Human
gcagcaaccagagcacugua

SEQ ID NO: 2138580 - RNA, 19 nt, Human
gcagcaacacaauguuauu

SEQ ID NO: 2138581 - RNA, 18 nt, Human
gcagaugcaaagaggcaa

SEQ ID NO: 2138582 - RNA, 13 nt, Human
gcagaugccagag

SEQ ID NO: 2138583 - RNA, 14 nt, Human
gcagaugccagagc

SEQ ID NO: 2138584 - RNA, 19 nt, Human
gcagaugcaaagaggcaag

SEQ ID NO: 2138585 - RNA, 22 nt, Human
gcagaugcaaagaggcaagagg

SEQ ID NO: 2138586 - RNA, 13 nt, Human
gcagagucagcag

SEQ ID NO: 2138587 - RNA, 14 nt, Human
gcagagucagcaga

SEQ ID NO: 2138588 - RNA, 12 nt, Human
gcagagucagca

SEQ ID NO: 2138589 - RNA, 14 nt, Human
gcagagugccccac

SEQ ID NO: 2138590 - RNA, 17 nt, Human
gcagagugccccaccug

SEQ ID NO: 2138591 - RNA, 21 nt, Human
gcagagugccccaccugccac

SEQ ID NO: 2138592 - RNA, 15 nt, Human
gcagagacagagagg

SEQ ID NO: 2138593 - RNA, 17 nt, Human
gcagagacaggaccuga

SEQ ID NO: 2138594 - RNA, 23 nt, Human
gcagagaaugaaagggcccagag

SEQ ID NO: 2138595 - RNA, 22 nt, Human
gcagagaaugaaagggcccaga

SEQ ID NO: 2138596 - RNA, 20 nt, Human
gcagagaaucauacuuagca

SEQ ID NO: 2138597 - RNA, 13 nt, Human
gcagagacacuaa

SEQ ID NO: 2138598 - RNA, 21 nt, Human
gcagagaauucucuuauccaa

SEQ ID NO: 2138599 - RNA, 21 nt, Human
gcagagaaugaaagggcccag

SEQ ID NO: 2138600 - RNA, 20 nt, Human
gcagagaaugaaagggccca

SEQ ID NO: 2138601 - RNA, 19 nt, Human
gcagagaaugaaagggccc

SEQ ID NO: 2138602 - RNA, 13 nt, Human
gcagaagcucucg

SEQ ID NO: 2138603 - RNA, 23 nt, Human
gcagaagcucucgauggacaaug

SEQ ID NO: 2138604 - RNA, 12 nt, Human
gcacaugugugc

SEQ ID NO: 2138605 - RNA, 23 nt, Human
gcaccacccuagucccuuccccu

SEQ ID NO: 2138606 - RNA, 19 nt, Human
gcaccacugcacuccagcc

SEQ ID NO: 2138607 - RNA, 11 nt, Human
gcaccacccua

SEQ ID NO: 2138608 - RNA, 14 nt, Human
gcaccaccaggucu

SEQ ID NO: 2138609 - RNA, 15 nt, Human
gcaccaccaggucuc

SEQ ID NO: 2138610 - RNA, 16 nt, Human
gcaccaccaggucucc

SEQ ID NO: 2138611 - RNA, 20 nt, Human
gcaccaccaggucucccggg

SEQ ID NO: 2138612 - RNA, 20 nt, Human
gcaccacccuagucccuucc

SEQ ID NO: 2138613 - RNA, 22 nt, Human
gcaccacccuagucccuucccc

SEQ ID NO: 2138614 - RNA, 22 nt, Human
gcacauggaggagcuuggggga

SEQ ID NO: 2138615 - RNA, 15 nt, Human
gcaccuccugccucg

SEQ ID NO: 2138616 - RNA, 14 nt, Human
gcaccuccugccuc

SEQ ID NO: 2138617 - RNA, 17 nt, Human
gcacccggccccugcug

SEQ ID NO: 2138618 - RNA, 15 nt, Human
gcacccggccccugc

SEQ ID NO: 2138619 - RNA, 14 nt, Human
gcacccacucugcu

SEQ ID NO: 2138620 - RNA, 14 nt, Human
gcacccggccccug

SEQ ID NO: 2138621 - RNA, 15 nt, Human
gcacccauccuagag

SEQ ID NO: 2138622 - RNA, 16 nt, Human
gcacccauccuagaga

SEQ ID NO: 2138623 - RNA, 19 nt, Human
gcacaugccuguaguccca

SEQ ID NO: 2138624 - RNA, 16 nt, Human
gcacagcuucauuucc

SEQ ID NO: 2138625 - RNA, 12 nt, Human
gcacagcugugg

SEQ ID NO: 2138626 - RNA, 14 nt, Human
gcacagcuguggug

SEQ ID NO: 2138627 - RNA, 16 nt, Human
gcaaugacaucuucaa

SEQ ID NO: 2138628 - RNA, 21 nt, Human
gcacagcggggccccagggcu

SEQ ID NO: 2138629 - RNA, 13 nt, Human
gcaaugaaggaaa

SEQ ID NO: 2138630 - RNA, 18 nt, Human
gcacccggccccugcugg

SEQ ID NO: 2138631 - RNA, 14 nt, Human
gcaccacucuccuu

SEQ ID NO: 2138632 - RNA, 15 nt, Human
gcaccccaaguccag

SEQ ID NO: 2138633 - RNA, 22 nt, Human
gcaccugcauccguaguucccu

SEQ ID NO: 2138634 - RNA, 13 nt, Human
gcaccugccagcc

SEQ ID NO: 2138635 - RNA, 14 nt, Human
gcaccugccagccu

SEQ ID NO: 2138636 - RNA, 15 nt, Human
gcaccugccagccug

SEQ ID NO: 2138637 - RNA, 16 nt, Human
gcaccugccagccugg

SEQ ID NO: 2138638 - RNA, 17 nt, Human
gcaccugccagccuggc

SEQ ID NO: 2138639 - RNA, 22 nt, Human
gcaccugccagccuggcuucug

SEQ ID NO: 2138640 - RNA, 15 nt, Human
gcaccugcccccugg

SEQ ID NO: 2138641 - RNA, 16 nt, Human
gcaccugcccccuggu

SEQ ID NO: 2138642 - RNA, 17 nt, Human
gcaccugcccccuggug

SEQ ID NO: 2138643 - RNA, 18 nt, Human
gcaccugcccccuggugg

SEQ ID NO: 2138644 - RNA, 17 nt, Human
gcacuaaggugugcucu

SEQ ID NO: 2138645 - RNA, 23 nt, Human
gcaccugcauccguaguucccug

SEQ ID NO: 2138646 - RNA, 21 nt, Human
gcaccugccgaccucguccuc

SEQ ID NO: 2138647 - RNA, 19 nt, Human
gcaccugccgaccucgucc

SEQ ID NO: 2138648 - RNA, 22 nt, Human
gcaccugcccccugguggacag

SEQ ID NO: 2138649 - RNA, 18 nt, Human
gcacuaaggugugcucug

SEQ ID NO: 2138650 - RNA, 19 nt, Human
gcacuaaggugugcucuga

SEQ ID NO: 2138651 - RNA, 21 nt, Human
gcacuacucccucaaagcaca

SEQ ID NO: 2138652 - RNA, 17 nt, Human
gcacugaggaccagcca

SEQ ID NO: 2138653 - RNA, 15 nt, Human
gcacuguaugcugga

SEQ ID NO: 2138654 - RNA, 16 nt, Human
gcacuguaugcuggac

SEQ ID NO: 2138655 - RNA, 21 nt, Human
gcagaagaauugaacccagga

SEQ ID NO: 2138656 - RNA, 23 nt, Human
gcagaagaauugaacccaggagg

SEQ ID NO: 2138657 - RNA, 12 nt, Human
gcauugcauuua

SEQ ID NO: 2138658 - RNA, 15 nt, Human
gcauugcuuuccacu

SEQ ID NO: 2138659 - RNA, 12 nt, Human
gcauugcuuucc

SEQ ID NO: 2138660 - RNA, 12 nt, Human
gcauugcuuucu

SEQ ID NO: 2138661 - RNA, 14 nt, Human
gcauucucugaaga

SEQ ID NO: 2138662 - RNA, 16 nt, Human
gcauugauggggaagg

SEQ ID NO: 2138663 - RNA, 17 nt, Human
gcauugauggggaagga

SEQ ID NO: 2138664 - RNA, 18 nt, Human
gcauugauggggaaggag

SEQ ID NO: 2138665 - RNA, 18 nt, Human
gcauucucacuccuaccu

SEQ ID NO: 2138666 - RNA, 15 nt, Human
gcauucucacuccua

SEQ ID NO: 2138667 - RNA, 13 nt, Human
gcauucucacucc

SEQ ID NO: 2138668 - RNA, 12 nt, Human
gcauuccccacu

SEQ ID NO: 2138669 - RNA, 23 nt, Human
gcauuugcugaauacagaggcaa

SEQ ID NO: 2138670 - RNA, 20 nt, Human
gcauugcuuucugaaauuag

SEQ ID NO: 2138671 - RNA, 13 nt, Human
gcauugcuuucug

SEQ ID NO: 2138672 - RNA, 17 nt, Human
gcauuuuacuguacaga

SEQ ID NO: 2138673 - RNA, 22 nt, Human
gcauuuugcuaaaugugaauga

SEQ ID NO: 2138674 - RNA, 18 nt, Human
gcauuuucaccccacccu

SEQ ID NO: 2138675 - RNA, 13 nt, Human
gcauuuucugaaa

SEQ ID NO: 2138676 - RNA, 17 nt, Human
gcauuuucugaaacuaa

SEQ ID NO: 2138677 - RNA, 21 nt, Human
gcauuuucugaaacuaaugaa

SEQ ID NO: 2138678 - RNA, 23 nt, Human
gcauuuucugaaacuaaugaaag

SEQ ID NO: 2138679 - RNA, 22 nt, Human
gcauuuucuggguucugggugg

SEQ ID NO: 2138680 - RNA, 11 nt, Human
gccaaaauaau

SEQ ID NO: 2138681 - RNA, 19 nt, Human
gccaaaauaaugucuuguu

SEQ ID NO: 2138682 - RNA, 21 nt, Human
gccaaaauaaugucuuguuaa

SEQ ID NO: 2138683 - RNA, 23 nt, Human
gccaaaauaaugucuuguuaaua

SEQ ID NO: 2138684 - RNA, 18 nt, Human
gccaaacucugccagcca

SEQ ID NO: 2138685 - RNA, 15 nt, Human
gccaaacagccacac

SEQ ID NO: 2138686 - RNA, 17 nt, Human
gccaaagaaugccuuga

SEQ ID NO: 2138687 - RNA, 17 nt, Human
gccaaacucugccagcc

SEQ ID NO: 2138688 - RNA, 13 nt, Human
gcaucaauccugu

SEQ ID NO: 2138689 - RNA, 17 nt, Human
gcaucaauccugugugg

SEQ ID NO: 2138690 - RNA, 19 nt, Human
gcaucaauccugugugguu

SEQ ID NO: 2138691 - RNA, 14 nt, Human
gcaucacagggcag

SEQ ID NO: 2138692 - RNA, 15 nt, Human
gcaucacagggcaga

SEQ ID NO: 2138693 - RNA, 16 nt, Human
gcaucacagggcagag

SEQ ID NO: 2138694 - RNA, 17 nt, Human
gcaucacagggcagagc

SEQ ID NO: 2138695 - RNA, 21 nt, Human
gcaucacagggcagagccggg

SEQ ID NO: 2138696 - RNA, 22 nt, Human
gcaucacagggcagagccggga

SEQ ID NO: 2138697 - RNA, 21 nt, Human
gcaucaccuagaaacuuguua

SEQ ID NO: 2138698 - RNA, 13 nt, Human
gcaucaccucagg

SEQ ID NO: 2138699 - RNA, 15 nt, Human
gcaugacaagcccca

SEQ ID NO: 2138700 - RNA, 16 nt, Human
gcaugacaagccccag

SEQ ID NO: 2138701 - RNA, 17 nt, Human
gcaugacaagccccagg

SEQ ID NO: 2138702 - RNA, 18 nt, Human
gcaugacaagccccaggc

SEQ ID NO: 2138703 - RNA, 19 nt, Human
gcaugacaagccccaggca

SEQ ID NO: 2138704 - RNA, 21 nt, Human
gcaugacaagccccaggcagg

SEQ ID NO: 2138705 - RNA, 13 nt, Human
gcaugcagaaagg

SEQ ID NO: 2138706 - RNA, 14 nt, Human
gcaugcagaaaggg

SEQ ID NO: 2138707 - RNA, 18 nt, Human
gcaugcagaaagggagca

SEQ ID NO: 2138708 - RNA, 12 nt, Human
gcaugcagcagc

SEQ ID NO: 2138709 - RNA, 13 nt, Human
gcaugcagcagcu

SEQ ID NO: 2138710 - RNA, 15 nt, Human
gcaugcagcagcuug

SEQ ID NO: 2138711 - RNA, 17 nt, Human
gcaugcagcagcuugcu

SEQ ID NO: 2138712 - RNA, 22 nt, Human
gcaugcagcagcuugcugcacc

SEQ ID NO: 2138713 - RNA, 15 nt, Human
gcaugcauuuugcag

SEQ ID NO: 2138714 - RNA, 14 nt, Human
gcaugcacagcugu

SEQ ID NO: 2138715 - RNA, 14 nt, Human
gcaugcauuuugca

SEQ ID NO: 2138716 - RNA, 21 nt, Human
gcaugcauuuugcagcaguga

SEQ ID NO: 2138717 - RNA, 13 nt, Human
gcauuaaaacuua

SEQ ID NO: 2138718 - RNA, 14 nt, Human
gcauuacucuugua

SEQ ID NO: 2138719 - RNA, 15 nt, Human
gcauuacucuuguaa

SEQ ID NO: 2138720 - RNA, 16 nt, Human
gcauuacucuuguaag

SEQ ID NO: 2138721 - RNA, 17 nt, Human
gcauuacucuuguaaga

SEQ ID NO: 2138722 - RNA, 18 nt, Human
gcauuacucuuguaagau

SEQ ID NO: 2138723 - RNA, 19 nt, Human
gcauuacucuuguaagauu

SEQ ID NO: 2138724 - RNA, 21 nt, Human
gcauuacucuuguaagauuuu

SEQ ID NO: 2138725 - RNA, 24 nt, Human
gcauuacucuuguaagauuuugaa

SEQ ID NO: 2138726 - RNA, 16 nt, Human
gcauuagaaauagaca

SEQ ID NO: 2138727 - RNA, 21 nt, Human
gcauuagaaauagacaguaua

SEQ ID NO: 2138728 - RNA, 12 nt, Human
gcauuccaggcu

SEQ ID NO: 2138729 - RNA, 13 nt, Human
gcauuccaggcuc

SEQ ID NO: 2138730 - RNA, 14 nt, Human
gcauuccaggcucc

SEQ ID NO: 2138731 - RNA, 13 nt, Human
gcauuagaaauua

SEQ ID NO: 2138732 - RNA, 18 nt, Human
gcauguugagccaggccu

SEQ ID NO: 2138733 - RNA, 16 nt, Human
gcauggaccuaacauu

SEQ ID NO: 2138734 - RNA, 17 nt, Human
gcauggaccuaacauuc

SEQ ID NO: 2138735 - RNA, 18 nt, Human
gcauggaccuaacauucg

SEQ ID NO: 2138736 - RNA, 14 nt, Human
gcauggagaacagu

SEQ ID NO: 2138737 - RNA, 17 nt, Human
gcaugcuggugagccaa

SEQ ID NO: 2138738 - RNA, 21 nt, Human
gcaugccuuccagcacccugc

SEQ ID NO: 2138739 - RNA, 16 nt, Human
gcaugccuuccagcac

SEQ ID NO: 2138740 - RNA, 14 nt, Human
gcaugcgcacaagg

SEQ ID NO: 2138741 - RNA, 21 nt, Human
gcaugcgcacaaggcugacca

SEQ ID NO: 2138742 - RNA, 13 nt, Human
gcaugccugugug

SEQ ID NO: 2138743 - RNA, 15 nt, Human
gcaugccugugugac

SEQ ID NO: 2138744 - RNA, 23 nt, Human
gcauaggccugggugcuggcugc

SEQ ID NO: 2138745 - RNA, 17 nt, Human
gcauaggccugggugcu

SEQ ID NO: 2138746 - RNA, 22 nt, Human
gcauaggccugggugcuggcug

SEQ ID NO: 2138747 - RNA, 12 nt, Human
gcauaggccugg

SEQ ID NO: 2138748 - RNA, 16 nt, Human
gcauaggccugggugc

SEQ ID NO: 2138749 - RNA, 16 nt, Human
gcauagcaagacacau

SEQ ID NO: 2138750 - RNA, 19 nt, Human
gcaguuagagaugccuccc

SEQ ID NO: 2138751 - RNA, 18 nt, Human
gcagugggagcugccugu

SEQ ID NO: 2138752 - RNA, 17 nt, Human
gcagugggagcugccug

SEQ ID NO: 2138753 - RNA, 16 nt, Human
gcagugugucuccugc

SEQ ID NO: 2138754 - RNA, 18 nt, Human
gcagugugucuccugcau

SEQ ID NO: 2138755 - RNA, 20 nt, Human
gcagugugucuccugcaugc

SEQ ID NO: 2138756 - RNA, 16 nt, Human
gcauauucuuauguau

SEQ ID NO: 2138757 - RNA, 15 nt, Human
gcauauuguuauuau

SEQ ID NO: 2138758 - RNA, 19 nt, Human
gcauauuguuauuauauaa

SEQ ID NO: 2138759 - RNA, 21 nt, Human
gcauauguuucgcugauauau

SEQ ID NO: 2138760 - RNA, 15 nt, Human
gcauauguaugacuc

SEQ ID NO: 2138761 - RNA, 12 nt, Human
gcagggcucagc

SEQ ID NO: 2138762 - RNA, 16 nt, Human
gcagggagggcuucug

SEQ ID NO: 2138763 - RNA, 13 nt, Human
gcaggaggggagu

SEQ ID NO: 2138764 - RNA, 12 nt, Human
gcagggagggga

SEQ ID NO: 2138765 - RNA, 14 nt, Human
gcagggaggggacu

SEQ ID NO: 2138766 - RNA, 13 nt, Human
gcagggaggggac

SEQ ID NO: 2138767 - RNA, 18 nt, Human
gcagggccuugcccagag

SEQ ID NO: 2138768 - RNA, 19 nt, Human
gcagggccuugcccagaga

SEQ ID NO: 2138769 - RNA, 21 nt, Human
gcagggccuugcccagagaug

SEQ ID NO: 2138770 - RNA, 20 nt, Human
gcaggauucuuccucccucc

SEQ ID NO: 2138771 - RNA, 21 nt, Human
gcaggauaguugcuccgccuc

SEQ ID NO: 2138772 - RNA, 22 nt, Human
gcaggauaguugcuccgccucu

SEQ ID NO: 2138773 - RNA, 18 nt, Human
gcaggaugauuguacaga

SEQ ID NO: 2138774 - RNA, 16 nt, Human
gcagugggagcugccu

SEQ ID NO: 2138775 - RNA, 16 nt, Human
gcagugcuucucuaca

SEQ ID NO: 2138776 - RNA, 23 nt, Human
gcagugcuuccaaggauggacca

SEQ ID NO: 2138777 - RNA, 22 nt, Human
gcagugccuuccauaauuauga

SEQ ID NO: 2138778 - RNA, 17 nt, Human
gcagguggggagggggu

SEQ ID NO: 2138779 - RNA, 16 nt, Human
gcagugccuuccauaa

SEQ ID NO: 2138780 - RNA, 22 nt, Human
gcagugcgcgugcacguggaga

SEQ ID NO: 2138781 - RNA, 13 nt, Human
gcagguggggagg

SEQ ID NO: 2138782 - RNA, 16 nt, Human
gcaggugggagcuuga

SEQ ID NO: 2138783 - RNA, 23 nt, Human
gcagggguggaggagagccuggu

SEQ ID NO: 2138784 - RNA, 21 nt, Human
gcaggugccccucucuccauc

SEQ ID NO: 2138785 - RNA, 19 nt, Human
gcccaaagugguauagaaa

SEQ ID NO: 2138786 - RNA, 16 nt, Human
gcccaaagccagacag

SEQ ID NO: 2138787 - RNA, 17 nt, Human
gcccaaagccagacagc

SEQ ID NO: 2138788 - RNA, 17 nt, Human
gcccaaauuaucaagcu

SEQ ID NO: 2138789 - RNA, 14 nt, Human
gcccaaaucugccu

SEQ ID NO: 2138790 - RNA, 19 nt, Human
gcccaaauuaucaagcuaa

SEQ ID NO: 2138791 - RNA, 20 nt, Human
gcccaaauuaucaagcuaau

SEQ ID NO: 2138792 - RNA, 13 nt, Human
gcccacacacccc

SEQ ID NO: 2138793 - RNA, 14 nt, Human
gcccacagcuccca

SEQ ID NO: 2138794 - RNA, 14 nt, Human
gcccacagcccgca

SEQ ID NO: 2138795 - RNA, 17 nt, Human
gcccacagcccgcaugc

SEQ ID NO: 2138796 - RNA, 22 nt, Human
gcccacagcccgcaugcagcag

SEQ ID NO: 2138797 - RNA, 13 nt, Human
gcccacagcuccc

SEQ ID NO: 2138798 - RNA, 16 nt, Human
gcccacagcucccacc

SEQ ID NO: 2138799 - RNA, 17 nt, Human
gcccacagcucccaccc

SEQ ID NO: 2138800 - RNA, 19 nt, Human
gcccacccguggagauggg

SEQ ID NO: 2138801 - RNA, 15 nt, Human
gcccaccccucaaca

SEQ ID NO: 2138802 - RNA, 18 nt, Human
gcccacaggaucagucug

SEQ ID NO: 2138803 - RNA, 13 nt, Human
gcccacaggauca

SEQ ID NO: 2138804 - RNA, 19 nt, Human
gcccacaggaucagucuga

SEQ ID NO: 2138805 - RNA, 19 nt, Human
gcccacagcucccacccca

SEQ ID NO: 2138806 - RNA, 17 nt, Human
gcccacaggugucccca

SEQ ID NO: 2138807 - RNA, 15 nt, Human
gcccaccccccucau

SEQ ID NO: 2138808 - RNA, 21 nt, Human
gccauuuaugugagugugugu

SEQ ID NO: 2138809 - RNA, 12 nt, Human
gccauugucuuu

SEQ ID NO: 2138810 - RNA, 13 nt, Human
gccauugucuuua

SEQ ID NO: 2138811 - RNA, 14 nt, Human
gccauugucuuuau

SEQ ID NO: 2138812 - RNA, 15 nt, Human
gccauugucuuuaua

SEQ ID NO: 2138813 - RNA, 18 nt, Human
gccauugucuuuauauga

SEQ ID NO: 2138814 - RNA, 20 nt, Human
gccauuugcacccuccgccu

SEQ ID NO: 2138815 - RNA, 23 nt, Human
gccauuugcacccuccgccuuca

SEQ ID NO: 2138816 - RNA, 21 nt, Human
gccauggaggcacacagcugc

SEQ ID NO: 2138817 - RNA, 16 nt, Human
gccauggcgugucccu

SEQ ID NO: 2138818 - RNA, 17 nt, Human
gccauggcgugucccuc

SEQ ID NO: 2138819 - RNA, 22 nt, Human
gccauggcgugucccucucgga

SEQ ID NO: 2138820 - RNA, 15 nt, Human
gccauggaggcacac

SEQ ID NO: 2138821 - RNA, 16 nt, Human
gccauggaggcacaca

SEQ ID NO: 2138822 - RNA, 18 nt, Human
gccauggaggcacacagc

SEQ ID NO: 2138823 - RNA, 20 nt, Human
gccauccagguucagcuugu

SEQ ID NO: 2138824 - RNA, 19 nt, Human
gccauccagguucagcuug

SEQ ID NO: 2138825 - RNA, 18 nt, Human
gccagagcaaagggccag

SEQ ID NO: 2138826 - RNA, 11 nt, Human
gccagucuuaa

SEQ ID NO: 2138827 - RNA, 13 nt, Human
gccagucuugugu

SEQ ID NO: 2138828 - RNA, 13 nt, Human
gccaggugcagug

SEQ ID NO: 2138829 - RNA, 14 nt, Human
gccaggugcagugg

SEQ ID NO: 2138830 - RNA, 18 nt, Human
gccaguccugccuggcca

SEQ ID NO: 2138831 - RNA, 19 nt, Human
gccaguccugccuggccag

SEQ ID NO: 2138832 - RNA, 20 nt, Human
gccaguccugccuggccagg

SEQ ID NO: 2138833 - RNA, 15 nt, Human
gccagucuaguuccu

SEQ ID NO: 2138834 - RNA, 17 nt, Human
gccaggggaaaaucagc

SEQ ID NO: 2138835 - RNA, 21 nt, Human
gccaggggaaaaucagccugc

SEQ ID NO: 2138836 - RNA, 22 nt, Human
gccaggggaaaaucagccugcu

SEQ ID NO: 2138837 - RNA, 23 nt, Human
gccaggggaaaaucagccugcuc

SEQ ID NO: 2138838 - RNA, 21 nt, Human
gccagguaaugugaauaaauu

SEQ ID NO: 2138839 - RNA, 15 nt, Human
gccagguaaugugaa

SEQ ID NO: 2138840 - RNA, 19 nt, Human
gccagggcccugcagaggg

SEQ ID NO: 2138841 - RNA, 16 nt, Human
gccagggcccugcaga

SEQ ID NO: 2138842 - RNA, 17 nt, Human
gccagggcccugcagag

SEQ ID NO: 2138843 - RNA, 13 nt, Human
gccagggcccugc

SEQ ID NO: 2138844 - RNA, 15 nt, Human
gccagggcccugcag

SEQ ID NO: 2138845 - RNA, 15 nt, Human
gccagcucucagcca

SEQ ID NO: 2138846 - RNA, 16 nt, Human
gccagcucagucccau

SEQ ID NO: 2138847 - RNA, 13 nt, Human
gccagcucucagc

SEQ ID NO: 2138848 - RNA, 14 nt, Human
gccagcucucagcc

SEQ ID NO: 2138849 - RNA, 18 nt, Human
gccagcuuguuauuuaua

SEQ ID NO: 2138850 - RNA, 16 nt, Human
gccagcugggaucuga

SEQ ID NO: 2138851 - RNA, 19 nt, Human
gccagcugggaucugacug

SEQ ID NO: 2138852 - RNA, 21 nt, Human
gccagcugggaucugacugca

SEQ ID NO: 2138853 - RNA, 14 nt, Human
gccagcuggcagca

SEQ ID NO: 2138854 - RNA, 17 nt, Human
gccagcuggcagcagag

SEQ ID NO: 2138855 - RNA, 20 nt, Human
gccagcugugguuuucuuuu

SEQ ID NO: 2138856 - RNA, 18 nt, Human
gccagcuggcagcagagu

SEQ ID NO: 2138857 - RNA, 20 nt, Human
gccagagggagugacagagg

SEQ ID NO: 2138858 - RNA, 19 nt, Human
gccagagggagugacagag

SEQ ID NO: 2138859 - RNA, 19 nt, Human
gccagccccacccaggagg

SEQ ID NO: 2138860 - RNA, 18 nt, Human
gccagccccacccaggag

SEQ ID NO: 2138861 - RNA, 11 nt, Human
gccagccccuc

SEQ ID NO: 2138862 - RNA, 12 nt, Human
gccagccccucc

SEQ ID NO: 2138863 - RNA, 16 nt, Human
gccagccccucccacc

SEQ ID NO: 2138864 - RNA, 17 nt, Human
gccagccccucccacca

SEQ ID NO: 2138865 - RNA, 20 nt, Human
gccagccccucccaccacag

SEQ ID NO: 2138866 - RNA, 21 nt, Human
gccagccccucccaccacagc

SEQ ID NO: 2138867 - RNA, 22 nt, Human
gccagcccucccuguccuccuc

SEQ ID NO: 2138868 - RNA, 23 nt, Human
gccagcccucccuguccuccucg

SEQ ID NO: 2138869 - RNA, 10 nt, Human
gccagcccuc

SEQ ID NO: 2138870 - RNA, 13 nt, Human
gccagcccucccu

SEQ ID NO: 2138871 - RNA, 14 nt, Human
gccagcccucccug

SEQ ID NO: 2138872 - RNA, 15 nt, Human
gccagcccucccugu

SEQ ID NO: 2138873 - RNA, 17 nt, Human
gccagcccucccugucc

SEQ ID NO: 2138874 - RNA, 20 nt, Human
gccagcccucccuguccucc

SEQ ID NO: 2138875 - RNA, 21 nt, Human
gccagcccucccuguccuccu

SEQ ID NO: 2138876 - RNA, 18 nt, Human
gccacuccagaccccugg

SEQ ID NO: 2138877 - RNA, 16 nt, Human
gccacuccagaccccu

SEQ ID NO: 2138878 - RNA, 19 nt, Human
gccacuccagaccccuggc

SEQ ID NO: 2138879 - RNA, 19 nt, Human
gccacugaagcugggauuc

SEQ ID NO: 2138880 - RNA, 20 nt, Human
gccacucaggaggcugaggc

SEQ ID NO: 2138881 - RNA, 21 nt, Human
gccacucaggaggcugaggca

SEQ ID NO: 2138882 - RNA, 18 nt, Human
gccacugcaccgggccac

SEQ ID NO: 2138883 - RNA, 17 nt, Human
gccacugcaccgggcca

SEQ ID NO: 2138884 - RNA, 18 nt, Human
gccagagggagugacaga

SEQ ID NO: 2138885 - RNA, 16 nt, Human
gccacggccaggccag

SEQ ID NO: 2138886 - RNA, 21 nt, Human
gccacgugggcaaacaggcag

SEQ ID NO: 2138887 - RNA, 18 nt, Human
gccacgugccaggcccgg

SEQ ID NO: 2138888 - RNA, 16 nt, Human
gccacgugccaggccc

SEQ ID NO: 2138889 - RNA, 17 nt, Human
gccacgugccaggcccg

SEQ ID NO: 2138890 - RNA, 22 nt, Human
gccacguuccuuacugcagaau

SEQ ID NO: 2138891 - RNA, 16 nt, Human
gccacguuccuuacug

SEQ ID NO: 2138892 - RNA, 21 nt, Human
gccacguuccuuacugcagaa

SEQ ID NO: 2138893 - RNA, 15 nt, Human
gccacggccaggcca

SEQ ID NO: 2138894 - RNA, 14 nt, Human
gccacggccaggcc

SEQ ID NO: 2138895 - RNA, 16 nt, Human
gccaaauguaauugaa

SEQ ID NO: 2138896 - RNA, 18 nt, Human
gccaaauguaauugaaua

SEQ ID NO: 2138897 - RNA, 15 nt, Human
gccaaauauauucuc

SEQ ID NO: 2138898 - RNA, 16 nt, Human
gccaaauauauucucu

SEQ ID NO: 2138899 - RNA, 17 nt, Human
gccaaauauauucucuu

SEQ ID NO: 2138900 - RNA, 12 nt, Human
gccaaaguguua

SEQ ID NO: 2138901 - RNA, 19 nt, Human
gccaaagggaaauaucauu

SEQ ID NO: 2138902 - RNA, 19 nt, Human
gccaaagacuuaguauauu

SEQ ID NO: 2138903 - RNA, 16 nt, Human
gccaaagauaaucucu

SEQ ID NO: 2138904 - RNA, 23 nt, Human
gccaaaggagggucaggaaggau

SEQ ID NO: 2138905 - RNA, 22 nt, Human
gcccagucuggaaugcaguggu

SEQ ID NO: 2138906 - RNA, 15 nt, Human
gcccaguuaaucuug

SEQ ID NO: 2138907 - RNA, 17 nt, Human
gcccagugcccuggggc

SEQ ID NO: 2138908 - RNA, 18 nt, Human
gcccagugcccuggggcu

SEQ ID NO: 2138909 - RNA, 14 nt, Human
gcccaguuaaucuu

SEQ ID NO: 2138910 - RNA, 17 nt, Human
gcccaguguuguuugua

SEQ ID NO: 2138911 - RNA, 18 nt, Human
gcccaguguuguuuguaa

SEQ ID NO: 2138912 - RNA, 19 nt, Human
gcccaguguuguuuguaaa

SEQ ID NO: 2138913 - RNA, 23 nt, Human
gcccaguguuguuuguaaauaag

SEQ ID NO: 2138914 - RNA, 15 nt, Human
gcccaggcuggcgug

SEQ ID NO: 2138915 - RNA, 14 nt, Human
gcccaggcuggcgu

SEQ ID NO: 2138916 - RNA, 16 nt, Human
gcccaggcuggcgugc

SEQ ID NO: 2138917 - RNA, 12 nt, Human
gcccagggcuca

SEQ ID NO: 2138918 - RNA, 13 nt, Human
gcccagggcucag

SEQ ID NO: 2138919 - RNA, 14 nt, Human
gcccagggcucagc

SEQ ID NO: 2138920 - RNA, 15 nt, Human
gcccagggcucagcc

SEQ ID NO: 2138921 - RNA, 16 nt, Human
gcccagggcucagccu

SEQ ID NO: 2138922 - RNA, 17 nt, Human
gcccagggcucagccug

SEQ ID NO: 2138923 - RNA, 18 nt, Human
gcccagggcucagccugg

SEQ ID NO: 2138924 - RNA, 17 nt, Human
gcccaggguucccccag

SEQ ID NO: 2138925 - RNA, 19 nt, Human
gcccaggguucccccagcc

SEQ ID NO: 2138926 - RNA, 20 nt, Human
gcccaggguucccccagccc

SEQ ID NO: 2138927 - RNA, 21 nt, Human
gcccaggguucccccagcccu

SEQ ID NO: 2138928 - RNA, 22 nt, Human
gcccaggguucccccagcccug

SEQ ID NO: 2138929 - RNA, 23 nt, Human
gcccaggguucccccagcccugu

SEQ ID NO: 2138930 - RNA, 17 nt, Human
gcccaggccugccuguu

SEQ ID NO: 2138931 - RNA, 11 nt, Human
gcccaggcugg

SEQ ID NO: 2138932 - RNA, 15 nt, Human
gcccaccuaccuuca

SEQ ID NO: 2138933 - RNA, 21 nt, Human
gcccaccuaccuucaaagcug

SEQ ID NO: 2138934 - RNA, 22 nt, Human
gcccaccuaccuucaaagcuga

SEQ ID NO: 2138935 - RNA, 15 nt, Human
gcccagcucagaggg

SEQ ID NO: 2138936 - RNA, 12 nt, Human
gcccagcucagu

SEQ ID NO: 2138937 - RNA, 14 nt, Human
gcccagcucagucu

SEQ ID NO: 2138938 - RNA, 13 nt, Human
gcccaccugccca

SEQ ID NO: 2138939 - RNA, 14 nt, Human
gcccaccugcccau

SEQ ID NO: 2138940 - RNA, 15 nt, Human
gcccaccugcccauc

SEQ ID NO: 2138941 - RNA, 20 nt, Human
gcccaccugcccaucacagg

SEQ ID NO: 2138942 - RNA, 12 nt, Human
gcccagcuccag

SEQ ID NO: 2138943 - RNA, 14 nt, Human
gcccagcuccaggg

SEQ ID NO: 2138944 - RNA, 15 nt, Human
gcccagcuccagggc

SEQ ID NO: 2138945 - RNA, 16 nt, Human
gcccagcuccagggcc

SEQ ID NO: 2138946 - RNA, 18 nt, Human
gcccagcuccagggccag

SEQ ID NO: 2138947 - RNA, 13 nt, Human
gcccagcugcacc

SEQ ID NO: 2138948 - RNA, 14 nt, Human
gcccagcugcaccu

SEQ ID NO: 2138949 - RNA, 15 nt, Human
gcccagcugcaccug

SEQ ID NO: 2138950 - RNA, 18 nt, Human
gcccagcugcaccugcca

SEQ ID NO: 2138951 - RNA, 23 nt, Human
gcccagcugcaccugccagccug

SEQ ID NO: 2138952 - RNA, 24 nt, Human
gcccagcugcaccugccagccugg

SEQ ID NO: 2138953 - RNA, 11 nt, Human
gcccagcugcu

SEQ ID NO: 2138954 - RNA, 13 nt, Human
gcccagcugcucu

SEQ ID NO: 2138955 - RNA, 14 nt, Human
gcccagcugcucug

SEQ ID NO: 2138956 - RNA, 15 nt, Human
gcccagcugcucugc

SEQ ID NO: 2138957 - RNA, 21 nt, Human
gccccauucugccugcccagg

SEQ ID NO: 2138958 - RNA, 20 nt, Human
gccccauucugccugcccag

SEQ ID NO: 2138959 - RNA, 18 nt, Human
gccccauucugccugccc

SEQ ID NO: 2138960 - RNA, 17 nt, Human
gccccauucugccugcc

SEQ ID NO: 2138961 - RNA, 14 nt, Human
gccccaugaagcca

SEQ ID NO: 2138962 - RNA, 19 nt, Human
gccccaugaagccacagcc

SEQ ID NO: 2138963 - RNA, 14 nt, Human
gccccaugccuguc

SEQ ID NO: 2138964 - RNA, 16 nt, Human
gccccaugccugucca

SEQ ID NO: 2138965 - RNA, 23 nt, Human
gccccaugccuguccagccuggg

SEQ ID NO: 2138966 - RNA, 17 nt, Human
gccccaugccuguccag

SEQ ID NO: 2138967 - RNA, 20 nt, Human
gccccaugccuguccagccu

SEQ ID NO: 2138968 - RNA, 21 nt, Human
gccccagugcccacaggauca

SEQ ID NO: 2138969 - RNA, 17 nt, Human
gccccagugcccacagg

SEQ ID NO: 2138970 - RNA, 16 nt, Human
gccccagugcccacag

SEQ ID NO: 2138971 - RNA, 15 nt, Human
gccccagugcccaca

SEQ ID NO: 2138972 - RNA, 19 nt, Human
gccccaggcaggcugugcg

SEQ ID NO: 2138973 - RNA, 20 nt, Human
gccccaggcaggcugugcgc

SEQ ID NO: 2138974 - RNA, 12 nt, Human
gccccaggcagg

SEQ ID NO: 2138975 - RNA, 15 nt, Human
gccccaggcaggcug

SEQ ID NO: 2138976 - RNA, 22 nt, Human
gcccaucuaugucccuugcugu

SEQ ID NO: 2138977 - RNA, 18 nt, Human
gcccauccugucuguuca

SEQ ID NO: 2138978 - RNA, 16 nt, Human
gcccaucuugccucca

SEQ ID NO: 2138979 - RNA, 20 nt, Human
gcccaucuugccuccauggu

SEQ ID NO: 2138980 - RNA, 21 nt, Human
gcccaucuugccuccauggug

SEQ ID NO: 2138981 - RNA, 13 nt, Human
gcccaugcccacc

SEQ ID NO: 2138982 - RNA, 14 nt, Human
gcccaugcccaccu

SEQ ID NO: 2138983 - RNA, 15 nt, Human
gcccaugcccaccug

SEQ ID NO: 2138984 - RNA, 19 nt, Human
gcccaugcccaccugccca

SEQ ID NO: 2138985 - RNA, 13 nt, Human
gccccagcucugg

SEQ ID NO: 2138986 - RNA, 14 nt, Human
gccccaggaagccg

SEQ ID NO: 2138987 - RNA, 14 nt, Human
gccccagcucuggc

SEQ ID NO: 2138988 - RNA, 14 nt, Human
gccccagcccagcc

SEQ ID NO: 2138989 - RNA, 23 nt, Human
gccccgucaccaucucaggccac

SEQ ID NO: 2138990 - RNA, 21 nt, Human
gccccgucaccaucucaggcc

SEQ ID NO: 2138991 - RNA, 22 nt, Human
gccccgucaccaucucaggcca

SEQ ID NO: 2138992 - RNA, 17 nt, Human
gccccgucaccaucuca

SEQ ID NO: 2138993 - RNA, 18 nt, Human
gccccgucaccaucucag

SEQ ID NO: 2138994 - RNA, 20 nt, Human
gccccgucaccaucucaggc

SEQ ID NO: 2138995 - RNA, 20 nt, Human
gccccgucucaugaggggcc

SEQ ID NO: 2138996 - RNA, 16 nt, Human
gccccggugugcggug

SEQ ID NO: 2138997 - RNA, 15 nt, Human
gccccgucaccaucu

SEQ ID NO: 2138998 - RNA, 17 nt, Human
gccccgcgccuccuucc

SEQ ID NO: 2138999 - RNA, 14 nt, Human
gccccgcuugucca

SEQ ID NO: 2139000 - RNA, 16 nt, Human
gccccgcuuguccagc

SEQ ID NO: 2139001 - RNA, 18 nt, Human
gccccgcuuguccagcgc

SEQ ID NO: 2139002 - RNA, 19 nt, Human
gccccgcuuguccagcgcc

SEQ ID NO: 2139003 - RNA, 20 nt, Human
gccccgcuuguccagcgccu

SEQ ID NO: 2139004 - RNA, 23 nt, Human
gccccgaggccuucucugaagga

SEQ ID NO: 2139005 - RNA, 23 nt, Human
gccccauucugccugcccaggcc

SEQ ID NO: 2139006 - RNA, 22 nt, Human
gccccauucugccugcccaggc

SEQ ID NO: 2139007 - RNA, 22 nt, Human
gccccgaggccuucucugaagg

SEQ ID NO: 2139008 - RNA, 20 nt, Human
gccccgcaaaacccacugac

SEQ ID NO: 2139009 - RNA, 15 nt, Human
gccccgccccacauu

SEQ ID NO: 2139010 - RNA, 22 nt, Human
gccccgccccacauuccgacaa

SEQ ID NO: 2139011 - RNA, 13 nt, Human
gccccgccccaca

SEQ ID NO: 2139012 - RNA, 14 nt, Human
gccccgccccacau

SEQ ID NO: 2139013 - RNA, 15 nt, Human
gccccgugcagacug

SEQ ID NO: 2139014 - RNA, 19 nt, Human
gccccgugcagacuggagg

SEQ ID NO: 2139015 - RNA, 20 nt, Human
gccccgugcagacuggaggg

SEQ ID NO: 2139016 - RNA, 22 nt, Human
gccccgugcagacuggagggga

SEQ ID NO: 2139017 - RNA, 17 nt, Human
gccccuagaagggaagg

SEQ ID NO: 2139018 - RNA, 17 nt, Human
gccccuagaaucagccu

SEQ ID NO: 2139019 - RNA, 20 nt, Human
gccccuagaaucagccuagg

SEQ ID NO: 2139020 - RNA, 17 nt, Human
gccccuucccccuccaa

SEQ ID NO: 2139021 - RNA, 13 nt, Human
gccccugcacaaa

SEQ ID NO: 2139022 - RNA, 15 nt, Human
gcccucccugccccu

SEQ ID NO: 2139023 - RNA, 13 nt, Human
gcccuccucaccc

SEQ ID NO: 2139024 - RNA, 14 nt, Human
gcccuccucacccc

SEQ ID NO: 2139025 - RNA, 21 nt, Human
gcccuccucaccccgucuggg

SEQ ID NO: 2139026 - RNA, 22 nt, Human
gcccggagauuggacggccuga

SEQ ID NO: 2139027 - RNA, 19 nt, Human
gcccggagauuggacggcc

SEQ ID NO: 2139028 - RNA, 21 nt, Human
gcccggagauuggacggccug

SEQ ID NO: 2139029 - RNA, 23 nt, Human
gcccuccugaaacuuacacacaa

SEQ ID NO: 2139030 - RNA, 10 nt, Human
gcccuccuuc

SEQ ID NO: 2139031 - RNA, 15 nt, Human
gcccggcuccaggcu

SEQ ID NO: 2139032 - RNA, 14 nt, Human
gcccggcuccaggc

SEQ ID NO: 2139033 - RNA, 13 nt, Human
gcccggcuccagg

SEQ ID NO: 2139034 - RNA, 18 nt, Human
gccccuucuacacucucc

SEQ ID NO: 2139035 - RNA, 19 nt, Human
gccccuucuacacucuccu

SEQ ID NO: 2139036 - RNA, 20 nt, Human
gccccuucuacacucuccug

SEQ ID NO: 2139037 - RNA, 21 nt, Human
gccccuucuacacucuccugg

SEQ ID NO: 2139038 - RNA, 22 nt, Human
gccccuucuacacucuccuggg

SEQ ID NO: 2139039 - RNA, 23 nt, Human
gccccuucuacacucuccugggc

SEQ ID NO: 2139040 - RNA, 12 nt, Human
gcccggcuccag

SEQ ID NO: 2139041 - RNA, 12 nt, Human
gccgggguggau

SEQ ID NO: 2139042 - RNA, 23 nt, Human
gccggggaagacuugaaagaaag

SEQ ID NO: 2139043 - RNA, 17 nt, Human
gccggggccugccuagc

SEQ ID NO: 2139044 - RNA, 12 nt, Human
gccgggcacagc

SEQ ID NO: 2139045 - RNA, 13 nt, Human
gccgggcacagcu

SEQ ID NO: 2139046 - RNA, 16 nt, Human
gccgggcacagcugug

SEQ ID NO: 2139047 - RNA, 17 nt, Human
gccgggcacagcugugg

SEQ ID NO: 2139048 - RNA, 23 nt, Human
gccgggcaugguggcgcaagccu

SEQ ID NO: 2139049 - RNA, 18 nt, Human
gccgaggguccuggcucc

SEQ ID NO: 2139050 - RNA, 20 nt, Human
gccgaggguccuggcuccug

SEQ ID NO: 2139051 - RNA, 21 nt, Human
gccgaguggauagaugcccug

SEQ ID NO: 2139052 - RNA, 18 nt, Human
gcccuugagcuccccaaa

SEQ ID NO: 2139053 - RNA, 12 nt, Human
gccgaccucagc

SEQ ID NO: 2139054 - RNA, 13 nt, Human
gccgaccucagcc

SEQ ID NO: 2139055 - RNA, 14 nt, Human
gccgaccucagccu

SEQ ID NO: 2139056 - RNA, 15 nt, Human
gccgaccucagccuu

SEQ ID NO: 2139057 - RNA, 17 nt, Human
gccgaccucagccuucc

SEQ ID NO: 2139058 - RNA, 13 nt, Human
gccgaccucgucc

SEQ ID NO: 2139059 - RNA, 19 nt, Human
gccgaccucguccuccccc

SEQ ID NO: 2139060 - RNA, 21 nt, Human
gccgaccucguccucccccug

SEQ ID NO: 2139061 - RNA, 17 nt, Human
gcccuugagcuccccaa

SEQ ID NO: 2139062 - RNA, 22 nt, Human
gcccuugagcuccccaaaaacc

SEQ ID NO: 2139063 - RNA, 19 nt, Human
gcccuugcaguucagcacc

SEQ ID NO: 2139064 - RNA, 20 nt, Human
gcccuugcaguucagcacca

SEQ ID NO: 2139065 - RNA, 21 nt, Human
gcccuugcaguucagcaccac

SEQ ID NO: 2139066 - RNA, 22 nt, Human
gcccuugcaguucagcaccacc

SEQ ID NO: 2139067 - RNA, 17 nt, Human
gccgagagccugcuccc

SEQ ID NO: 2139068 - RNA, 19 nt, Human
gccgagagccugcuccccc

SEQ ID NO: 2139069 - RNA, 20 nt, Human
gccgagagccugcuccccca

SEQ ID NO: 2139070 - RNA, 22 nt, Human
gccgagagccugcucccccacc

SEQ ID NO: 2139071 - RNA, 20 nt, Human
gccgaccucguccucccccu

SEQ ID NO: 2139072 - RNA, 13 nt, Human
gccgagaagcaag

SEQ ID NO: 2139073 - RNA, 14 nt, Human
gccgagaagcaaga

SEQ ID NO: 2139074 - RNA, 22 nt, Human
gccgagacauggcuugccacag

SEQ ID NO: 2139075 - RNA, 12 nt, Human
gccgagagccug

SEQ ID NO: 2139076 - RNA, 15 nt, Human
gccgagagccugcuc

SEQ ID NO: 2139077 - RNA, 16 nt, Human
gccgagagccugcucc

SEQ ID NO: 2139078 - RNA, 22 nt, Human
gcccuuccucuccacugccuuc

SEQ ID NO: 2139079 - RNA, 21 nt, Human
gcccucuuccccucuaaugcu

SEQ ID NO: 2139080 - RNA, 13 nt, Human
gccguggcuuccc

SEQ ID NO: 2139081 - RNA, 12 nt, Human
gccguggcuucc

SEQ ID NO: 2139082 - RNA, 11 nt, Human
gccguggcuuc

SEQ ID NO: 2139083 - RNA, 18 nt, Human
gccguggcugcggcaccc

SEQ ID NO: 2139084 - RNA, 14 nt, Human
gccguggcugcggc

SEQ ID NO: 2139085 - RNA, 15 nt, Human
gccguggcugcggca

SEQ ID NO: 2139086 - RNA, 20 nt, Human
gccguugccaagaacugaaa

SEQ ID NO: 2139087 - RNA, 23 nt, Human
gccguugccaagaacugaaaaca

SEQ ID NO: 2139088 - RNA, 14 nt, Human
gccuaaaaaugcaa

SEQ ID NO: 2139089 - RNA, 17 nt, Human
gccuaaaaaugcaacuu

SEQ ID NO: 2139090 - RNA, 21 nt, Human
gccgucuucacucgcccccgg

SEQ ID NO: 2139091 - RNA, 22 nt, Human
gccgucuucacucgcccccggg

SEQ ID NO: 2139092 - RNA, 15 nt, Human
gccgugaugccuccc

SEQ ID NO: 2139093 - RNA, 16 nt, Human
gccgggugcucagggc

SEQ ID NO: 2139094 - RNA, 17 nt, Human
gccgggugcucagggcu

SEQ ID NO: 2139095 - RNA, 11 nt, Human
gccgucucaac

SEQ ID NO: 2139096 - RNA, 19 nt, Human
gccgucuucacucgccccc

SEQ ID NO: 2139097 - RNA, 20 nt, Human
gccgucuucacucgcccccg

SEQ ID NO: 2139098 - RNA, 18 nt, Human
gccuauuguaaauacaag

SEQ ID NO: 2139099 - RNA, 21 nt, Human
gccucagcauccuggcacccg

SEQ ID NO: 2139100 - RNA, 15 nt, Human
gccucacagaagaau

SEQ ID NO: 2139101 - RNA, 17 nt, Human
gccucagcauccuggca

SEQ ID NO: 2139102 - RNA, 18 nt, Human
gccucagcauccuggcac

SEQ ID NO: 2139103 - RNA, 13 nt, Human
gccucaaaugcag

SEQ ID NO: 2139104 - RNA, 14 nt, Human
gccucaacccuccc

SEQ ID NO: 2139105 - RNA, 15 nt, Human
gccucaacccucccu

SEQ ID NO: 2139106 - RNA, 21 nt, Human
gccucaaugugguugcaaggc

SEQ ID NO: 2139107 - RNA, 13 nt, Human
gccucacagaaga

SEQ ID NO: 2139108 - RNA, 21 nt, Human
gccucaaugugaaucagaccc

SEQ ID NO: 2139109 - RNA, 22 nt, Human
gccucaaugugaaucagacccu

SEQ ID NO: 2139110 - RNA, 24 nt, Human
gccucaagugauucuccugccuca

SEQ ID NO: 2139111 - RNA, 22 nt, Human
gccucaagugauucuccugccu

SEQ ID NO: 2139112 - RNA, 15 nt, Human
gccucugacacacag

SEQ ID NO: 2139113 - RNA, 18 nt, Human
gccucugaaguuggacag

SEQ ID NO: 2139114 - RNA, 19 nt, Human
gccucugaaguuggacagc

SEQ ID NO: 2139115 - RNA, 15 nt, Human
gccucucuuccuauc

SEQ ID NO: 2139116 - RNA, 17 nt, Human
gccucucuuccuauccc

SEQ ID NO: 2139117 - RNA, 18 nt, Human
gccucucuuccuauccca

SEQ ID NO: 2139118 - RNA, 21 nt, Human
gccucucuuccuaucccaucc

SEQ ID NO: 2139119 - RNA, 22 nt, Human
gccucucuuccuaucccauccc

SEQ ID NO: 2139120 - RNA, 23 nt, Human
gccucucuuccuaucccauccca

SEQ ID NO: 2139121 - RNA, 19 nt, Human
gccucucuugguuuccuuc

SEQ ID NO: 2139122 - RNA, 16 nt, Human
gccucugacacacagc

SEQ ID NO: 2139123 - RNA, 15 nt, Human
gccugaagucacaca

SEQ ID NO: 2139124 - RNA, 15 nt, Human
gccugaaccuuccau

SEQ ID NO: 2139125 - RNA, 17 nt, Human
gccucaacccucccuca

SEQ ID NO: 2139126 - RNA, 14 nt, Human
gccugaaccuucca

SEQ ID NO: 2139127 - RNA, 13 nt, Human
gccugagaguauu

SEQ ID NO: 2139128 - RNA, 21 nt, Human
gccugagaguauuuaggcaga

SEQ ID NO: 2139129 - RNA, 12 nt, Human
gccucugcauuc

SEQ ID NO: 2139130 - RNA, 12 nt, Human
gccugcccaggc

SEQ ID NO: 2139131 - RNA, 11 nt, Human
gccugcccagg

SEQ ID NO: 2139132 - RNA, 13 nt, Human
gccugcuggaucu

SEQ ID NO: 2139133 - RNA, 22 nt, Human
gccugcuggaucucccagggcu

SEQ ID NO: 2139134 - RNA, 10 nt, Human
gccugcccac

SEQ ID NO: 2139135 - RNA, 13 nt, Human
gccugcccacccg

SEQ ID NO: 2139136 - RNA, 14 nt, Human
gccugcccacccgu

SEQ ID NO: 2139137 - RNA, 14 nt, Human
gccuggacccugug

SEQ ID NO: 2139138 - RNA, 13 nt, Human
gccugcugggcuc

SEQ ID NO: 2139139 - RNA, 16 nt, Human
gccugcugggcucucc

SEQ ID NO: 2139140 - RNA, 17 nt, Human
gccugcugggcucucca

SEQ ID NO: 2139141 - RNA, 18 nt, Human
gccugcugggcucuccac

SEQ ID NO: 2139142 - RNA, 19 nt, Human
gccugcugggcucuccacc

SEQ ID NO: 2139143 - RNA, 20 nt, Human
gccugcugggcucuccaccu

SEQ ID NO: 2139144 - RNA, 21 nt, Human
gccugcugggcucuccaccuc

SEQ ID NO: 2139145 - RNA, 22 nt, Human
gccugcugggcucuccaccuca

SEQ ID NO: 2139146 - RNA, 23 nt, Human
gccugcugggcucuccaccucag

SEQ ID NO: 2139147 - RNA, 24 nt, Human
gccugcugggcucuccaccucagc

SEQ ID NO: 2139148 - RNA, 10 nt, Human
gccugcagcc

SEQ ID NO: 2139149 - RNA, 17 nt, Human
gccugagcaccucccag

SEQ ID NO: 2139150 - RNA, 18 nt, Human
gccugagcaccucccagc

SEQ ID NO: 2139151 - RNA, 19 nt, Human
gccugagcaccucccagcc

SEQ ID NO: 2139152 - RNA, 20 nt, Human
gccugagcaccucccagccc

SEQ ID NO: 2139153 - RNA, 23 nt, Human
gccugagcaccucccagccccug

SEQ ID NO: 2139154 - RNA, 22 nt, Human
gccugagcaacagagugagacc

SEQ ID NO: 2139155 - RNA, 11 nt, Human
gccugcagccc

SEQ ID NO: 2139156 - RNA, 20 nt, Human
gccucccgaauagcugggac

SEQ ID NO: 2139157 - RNA, 23 nt, Human
gccucccgaguagcugggacuac

SEQ ID NO: 2139158 - RNA, 21 nt, Human
gccucccgaguagcugggacu

SEQ ID NO: 2139159 - RNA, 19 nt, Human
gccucccgaauagcuggga

SEQ ID NO: 2139160 - RNA, 18 nt, Human
gccucccgaauagcuggg

SEQ ID NO: 2139161 - RNA, 22 nt, Human
gccucagccucccaaagugcug

SEQ ID NO: 2139162 - RNA, 14 nt, Human
gccucagccuccca

SEQ ID NO: 2139163 - RNA, 12 nt, Human
gccucagccucc

SEQ ID NO: 2139164 - RNA, 17 nt, Human
gccuccccaacccugcc

SEQ ID NO: 2139165 - RNA, 19 nt, Human
gccuccccaacccugcccc

SEQ ID NO: 2139166 - RNA, 20 nt, Human
gccuccccaacccugccccu

SEQ ID NO: 2139167 - RNA, 21 nt, Human
gccuccccaacccugccccug

SEQ ID NO: 2139168 - RNA, 22 nt, Human
gccuccccaacccugccccugc

SEQ ID NO: 2139169 - RNA, 12 nt, Human
gccuccccaccu

SEQ ID NO: 2139170 - RNA, 15 nt, Human
gccucucccaucacu

SEQ ID NO: 2139171 - RNA, 19 nt, Human
gccucccugacccugcaga

SEQ ID NO: 2139172 - RNA, 23 nt, Human
gccucccugacccugcagagaug

SEQ ID NO: 2139173 - RNA, 11 nt, Human
gccucccugaa

SEQ ID NO: 2139174 - RNA, 22 nt, Human
gccucccugaaaauguuuuucu

SEQ ID NO: 2139175 - RNA, 13 nt, Human
gccucccucaacc

SEQ ID NO: 2139176 - RNA, 14 nt, Human
gccucccucaaccc

SEQ ID NO: 2139177 - RNA, 16 nt, Human
gccucccuccccugcc

SEQ ID NO: 2139178 - RNA, 18 nt, Human
gccucccuccccugcccu

SEQ ID NO: 2139179 - RNA, 19 nt, Human
gccucccuccccugcccuc

SEQ ID NO: 2139180 - RNA, 16 nt, Human
gccucccucucucuuc

SEQ ID NO: 2139181 - RNA, 21 nt, Human
gccucccucucucuucugcuc

SEQ ID NO: 2139182 - RNA, 22 nt, Human
gccucccucucucuucugcucc

SEQ ID NO: 2139183 - RNA, 23 nt, Human
gccucccucucucuucugcucca

SEQ ID NO: 2139184 - RNA, 12 nt, Human
gccucccucuga

SEQ ID NO: 2139185 - RNA, 14 nt, Human
gccucccucugacc

SEQ ID NO: 2139186 - RNA, 20 nt, Human
gccucccucugaccugcagg

SEQ ID NO: 2139187 - RNA, 21 nt, Human
gccucccucugaccugcaggc

SEQ ID NO: 2139188 - RNA, 18 nt, Human
gcgccuacaggagugagc

SEQ ID NO: 2139189 - RNA, 16 nt, Human
gcgccauugcacucca

SEQ ID NO: 2139190 - RNA, 20 nt, Human
gcgccauugcacuccagccu

SEQ ID NO: 2139191 - RNA, 21 nt, Human
gcgacucuauagacucuagga

SEQ ID NO: 2139192 - RNA, 16 nt, Human
gcgacggagagaaaaa

SEQ ID NO: 2139193 - RNA, 17 nt, Human
gcgacggagagaaaaaa

SEQ ID NO: 2139194 - RNA, 23 nt, Human
gcgcugacaaccaccgcucccca

SEQ ID NO: 2139195 - RNA, 16 nt, Human
gcgcucuagccugggc

SEQ ID NO: 2139196 - RNA, 19 nt, Human
gcgcugacaaccaccgcuc

SEQ ID NO: 2139197 - RNA, 21 nt, Human
gcgccuacaggagugagcacu

SEQ ID NO: 2139198 - RNA, 20 nt, Human
gcgccuacaggagugagcac

SEQ ID NO: 2139199 - RNA, 21 nt, Human
gcgccuaguggggucucccuc

SEQ ID NO: 2139200 - RNA, 20 nt, Human
gcgccuaguggggucucccu

SEQ ID NO: 2139201 - RNA, 23 nt, Human
gcgguccacccaggagccccgag

SEQ ID NO: 2139202 - RNA, 16 nt, Human
gcggggaguacaaggc

SEQ ID NO: 2139203 - RNA, 20 nt, Human
gcgguccacccaggagcccc

SEQ ID NO: 2139204 - RNA, 23 nt, Human
gcggggacagcuccuucuguccu

SEQ ID NO: 2139205 - RNA, 19 nt, Human
gcguccugucggagcccug

SEQ ID NO: 2139206 - RNA, 17 nt, Human
gcguccugacggcgccc

SEQ ID NO: 2139207 - RNA, 19 nt, Human
gcgguccccuccgccaggc

SEQ ID NO: 2139208 - RNA, 22 nt, Human
gcgguccccuccgccaggcgag

SEQ ID NO: 2139209 - RNA, 19 nt, Human
gcggggacagcuccuucug

SEQ ID NO: 2139210 - RNA, 18 nt, Human
gcggggacagcuccuucu

SEQ ID NO: 2139211 - RNA, 23 nt, Human
gcggacagccacggccaggccag

SEQ ID NO: 2139212 - RNA, 17 nt, Human
gcgcuuuugcuggucac

SEQ ID NO: 2139213 - RNA, 15 nt, Human
gcggaaagcagcuca

SEQ ID NO: 2139214 - RNA, 19 nt, Human
gcggacagccacggccagg

SEQ ID NO: 2139215 - RNA, 16 nt, Human
gcggacagccacggcc

SEQ ID NO: 2139216 - RNA, 19 nt, Human
gcggaaugaaccacaucuu

SEQ ID NO: 2139217 - RNA, 23 nt, Human
gcuacaugacgacaaagcugcua

SEQ ID NO: 2139218 - RNA, 17 nt, Human
gcuacccacuucuaaau

SEQ ID NO: 2139219 - RNA, 21 nt, Human
gcuacccaggaggcugaggug

SEQ ID NO: 2139220 - RNA, 13 nt, Human
gcuaccucaaggg

SEQ ID NO: 2139221 - RNA, 17 nt, Human
gcuaccucaagggggac

SEQ ID NO: 2139222 - RNA, 14 nt, Human
gcuaccucacuggg

SEQ ID NO: 2139223 - RNA, 20 nt, Human
gcuagagauauggcagcgaa

SEQ ID NO: 2139224 - RNA, 21 nt, Human
gcuagagauauggcagcgaaa

SEQ ID NO: 2139225 - RNA, 22 nt, Human
gcuagagcuucaagucugugcc

SEQ ID NO: 2139226 - RNA, 20 nt, Human
gcuagaggaaccaaccccca

SEQ ID NO: 2139227 - RNA, 15 nt, Human
gcgugagccacugca

SEQ ID NO: 2139228 - RNA, 16 nt, Human
gcgugagccacugcac

SEQ ID NO: 2139229 - RNA, 14 nt, Human
gcgugagccacugc

SEQ ID NO: 2139230 - RNA, 22 nt, Human
gcguccugucggagcccugucu

SEQ ID NO: 2139231 - RNA, 22 nt, Human
gcuaacccccuucuacugagcc

SEQ ID NO: 2139232 - RNA, 13 nt, Human
gcuaacuggaagc

SEQ ID NO: 2139233 - RNA, 20 nt, Human
gcuaacuuggagccccagug

SEQ ID NO: 2139234 - RNA, 21 nt, Human
gcuaacuagcuuggaaacugg

SEQ ID NO: 2139235 - RNA, 21 nt, Human
gcuaacccccuucuacugagc

SEQ ID NO: 2139236 - RNA, 12 nt, Human
gcuaacuggaag

SEQ ID NO: 2139237 - RNA, 18 nt, Human
gcuaacuuggagccccag

SEQ ID NO: 2139238 - RNA, 16 nt, Human
gccuugggcugcuccu

SEQ ID NO: 2139239 - RNA, 18 nt, Human
gccuugggcugcuccuca

SEQ ID NO: 2139240 - RNA, 22 nt, Human
gccuugggcugcuccucauggu

SEQ ID NO: 2139241 - RNA, 14 nt, Human
gccuugggcugcuc

SEQ ID NO: 2139242 - RNA, 15 nt, Human
gccuugggcugcucc

SEQ ID NO: 2139243 - RNA, 19 nt, Human
gccuucggacaacucaguc

SEQ ID NO: 2139244 - RNA, 16 nt, Human
gccuucagcucuacag

SEQ ID NO: 2139245 - RNA, 13 nt, Human
gccuuccauaauu

SEQ ID NO: 2139246 - RNA, 14 nt, Human
gccuuccauaauua

SEQ ID NO: 2139247 - RNA, 15 nt, Human
gccuuccauaauuau

SEQ ID NO: 2139248 - RNA, 16 nt, Human
gccuuccauaauuaug

SEQ ID NO: 2139249 - RNA, 21 nt, Human
gccuuccauaauuaugacagu

SEQ ID NO: 2139250 - RNA, 13 nt, Human
gccuucagcucua

SEQ ID NO: 2139251 - RNA, 20 nt, Human
gccuucacuccggugugccu

SEQ ID NO: 2139252 - RNA, 16 nt, Human
gccuuccccuugccca

SEQ ID NO: 2139253 - RNA, 14 nt, Human
gccuuccccagccu

SEQ ID NO: 2139254 - RNA, 15 nt, Human
gccuuccccagccuc

SEQ ID NO: 2139255 - RNA, 16 nt, Human
gccuuccccagccucu

SEQ ID NO: 2139256 - RNA, 17 nt, Human
gccuuccccagccucuu

SEQ ID NO: 2139257 - RNA, 18 nt, Human
gccuucccccucccaggg

SEQ ID NO: 2139258 - RNA, 23 nt, Human
gccuucccccucccagggccagg

SEQ ID NO: 2139259 - RNA, 11 nt, Human
gccuuuguaag

SEQ ID NO: 2139260 - RNA, 15 nt, Human
gccuuuguaaguuau

SEQ ID NO: 2139261 - RNA, 13 nt, Human
gccuuuugacagc

SEQ ID NO: 2139262 - RNA, 16 nt, Human
gccuuuuauuucuuaa

SEQ ID NO: 2139263 - RNA, 15 nt, Human
gccuuuguugcucag

SEQ ID NO: 2139264 - RNA, 17 nt, Human
gccugguggcagcugcg

SEQ ID NO: 2139265 - RNA, 16 nt, Human
gccugguggcagcugc

SEQ ID NO: 2139266 - RNA, 14 nt, Human
gccugguuagaggc

SEQ ID NO: 2139267 - RNA, 18 nt, Human
gccuguaaucccagcacu

SEQ ID NO: 2139268 - RNA, 16 nt, Human
gccuguaaucccagca

SEQ ID NO: 2139269 - RNA, 17 nt, Human
gccuguaaucccagcac

SEQ ID NO: 2139270 - RNA, 19 nt, Human
gccuguaaucccagcacuu

SEQ ID NO: 2139271 - RNA, 17 nt, Human
gccuguaaucccagcag

SEQ ID NO: 2139272 - RNA, 18 nt, Human
gccuguaaucccagcagu

SEQ ID NO: 2139273 - RNA, 15 nt, Human
gccuguaaucccagc

SEQ ID NO: 2139274 - RNA, 16 nt, Human
gccuguaaucccagcu

SEQ ID NO: 2139275 - RNA, 12 nt, Human
gccuguccagcc

SEQ ID NO: 2139276 - RNA, 13 nt, Human
gccuguccagccu

SEQ ID NO: 2139277 - RNA, 14 nt, Human
gccuguccagccug

SEQ ID NO: 2139278 - RNA, 15 nt, Human
gccugguggcagcug

SEQ ID NO: 2139279 - RNA, 12 nt, Human
gccuggagcucc

SEQ ID NO: 2139280 - RNA, 14 nt, Human
gccuggagcuccug

SEQ ID NO: 2139281 - RNA, 15 nt, Human
gccuggagcuccugg

SEQ ID NO: 2139282 - RNA, 16 nt, Human
gccuggagcuccuggg

SEQ ID NO: 2139283 - RNA, 20 nt, Human
gccuggagcuccugggaagg

SEQ ID NO: 2139284 - RNA, 11 nt, Human
gccuggagccc

SEQ ID NO: 2139285 - RNA, 13 nt, Human
gccuggagcccca

SEQ ID NO: 2139286 - RNA, 14 nt, Human
gccuggagccccac

SEQ ID NO: 2139287 - RNA, 18 nt, Human
gccuggagccccacugcc

SEQ ID NO: 2139288 - RNA, 19 nt, Human
gccuggagccccacugccc

SEQ ID NO: 2139289 - RNA, 20 nt, Human
gccuggagccccacugcccu

SEQ ID NO: 2139290 - RNA, 16 nt, Human
gccuuagaaccuuucu

SEQ ID NO: 2139291 - RNA, 13 nt, Human
gccuuacuuugua

SEQ ID NO: 2139292 - RNA, 15 nt, Human
gccuuacuuuguaug

SEQ ID NO: 2139293 - RNA, 16 nt, Human
gccuuacuuuguauga

SEQ ID NO: 2139294 - RNA, 19 nt, Human
gccuuacuuuguaugauau

SEQ ID NO: 2139295 - RNA, 20 nt, Human
gccuuacuuuguaugauauu

SEQ ID NO: 2139296 - RNA, 15 nt, Human
gccuuaccuccugcc

SEQ ID NO: 2139297 - RNA, 16 nt, Human
gccuuaccuccugccc

SEQ ID NO: 2139298 - RNA, 17 nt, Human
gccuuaccuccugccca

SEQ ID NO: 2139299 - RNA, 18 nt, Human
gccuuaccuccugcccag

SEQ ID NO: 2139300 - RNA, 19 nt, Human
gccuuaccuccugcccagg

SEQ ID NO: 2139301 - RNA, 20 nt, Human
gccuuaccuccugcccagga

SEQ ID NO: 2139302 - RNA, 21 nt, Human
gccuuaccuccugcccaggag

SEQ ID NO: 2139303 - RNA, 22 nt, Human
gccuuaccuccugcccaggaga

SEQ ID NO: 2139304 - RNA, 20 nt, Human
gccuuagaagucacacagua

SEQ ID NO: 2139305 - RNA, 20 nt, Human
gccuguccugaccugucuca

SEQ ID NO: 2139306 - RNA, 12 nt, Human
gccuuaccuccu

SEQ ID NO: 2139307 - RNA, 13 nt, Human
gccuuaccuccug

SEQ ID NO: 2139308 - RNA, 14 nt, Human
gccuuaccuccugc

SEQ ID NO: 2139309 - RNA, 13 nt, Human
gccugucccuggc

SEQ ID NO: 2139310 - RNA, 18 nt, Human
gccugucccuggccaucu

SEQ ID NO: 2139311 - RNA, 20 nt, Human
gccugucccuggccaucucu

SEQ ID NO: 2139312 - RNA, 21 nt, Human
gccugucccuggccaucucug

SEQ ID NO: 2139313 - RNA, 13 nt, Human
gccugucccccug

SEQ ID NO: 2139314 - RNA, 14 nt, Human
gccugucccucuca

SEQ ID NO: 2139315 - RNA, 18 nt, Human
gccugucccucucaggca

SEQ ID NO: 2139316 - RNA, 15 nt, Human
gccuguccagccugg

SEQ ID NO: 2139317 - RNA, 17 nt, Human
gccuguccagccugggc

SEQ ID NO: 2139318 - RNA, 17 nt, Human
ggucucaaacuccugac

SEQ ID NO: 2139319 - RNA, 21 nt, Human
ggucucaaacuccugggcuca

SEQ ID NO: 2139320 - RNA, 23 nt, Human
ggucucaaacuccugggcucagg

SEQ ID NO: 2139321 - RNA, 18 nt, Human
ggucucacaguguugccc

SEQ ID NO: 2139322 - RNA, 23 nt, Human
ggucucacucugucgcccagucu

SEQ ID NO: 2139323 - RNA, 22 nt, Human
ggucucacucugucgcccaguc

SEQ ID NO: 2139324 - RNA, 21 nt, Human
ggucucacaguguugcccagg

SEQ ID NO: 2139325 - RNA, 19 nt, Human
ggucucacaguguugccca

SEQ ID NO: 2139326 - RNA, 20 nt, Human
ggucucacaguguugcccag

SEQ ID NO: 2139327 - RNA, 21 nt, Human
ggucucgcuuuguugcccagg

SEQ ID NO: 2139328 - RNA, 19 nt, Human
ggucucgcuuuguugccca

SEQ ID NO: 2139329 - RNA, 20 nt, Human
ggucucgcuuuguugcccag

SEQ ID NO: 2139330 - RNA, 18 nt, Human
ggucucagaaucuuuccu

SEQ ID NO: 2139331 - RNA, 22 nt, Human
ggucucccgggaagccacccuc

SEQ ID NO: 2139332 - RNA, 14 nt, Human
ggucucccucuccu

SEQ ID NO: 2139333 - RNA, 15 nt, Human
ggucucccucuccug

SEQ ID NO: 2139334 - RNA, 20 nt, Human
ggucagguuauacuccuccu

SEQ ID NO: 2139335 - RNA, 12 nt, Human
ggucucucuuug

SEQ ID NO: 2139336 - RNA, 13 nt, Human
ggucucucuuugg

SEQ ID NO: 2139337 - RNA, 15 nt, Human
ggucucucuuuggac

SEQ ID NO: 2139338 - RNA, 21 nt, Human
ggucucugccaugaacuggag

SEQ ID NO: 2139339 - RNA, 23 nt, Human
ggucucugccaugaacuggaggc

SEQ ID NO: 2139340 - RNA, 21 nt, Human
ggucucuugagggagcuuagc

SEQ ID NO: 2139341 - RNA, 15 nt, Human
ggucucuugagggag

SEQ ID NO: 2139342 - RNA, 12 nt, Human
ggucugaaaugg

SEQ ID NO: 2139343 - RNA, 13 nt, Human
ggucugaaaugga

SEQ ID NO: 2139344 - RNA, 11 nt, Human
ggucugaaugu

SEQ ID NO: 2139345 - RNA, 12 nt, Human
ggucugaauguu

SEQ ID NO: 2139346 - RNA, 14 nt, Human
ggucugaauguucu

SEQ ID NO: 2139347 - RNA, 21 nt, Human
ggugaccucugccugaaguca

SEQ ID NO: 2139348 - RNA, 15 nt, Human
ggugaccuucuggga

SEQ ID NO: 2139349 - RNA, 17 nt, Human
ggucugaauguucugac

SEQ ID NO: 2139350 - RNA, 21 nt, Human
ggucugaauguucugacauua

SEQ ID NO: 2139351 - RNA, 22 nt, Human
ggucugaauguucugacauuaa

SEQ ID NO: 2139352 - RNA, 14 nt, Human
ggucugacccacug

SEQ ID NO: 2139353 - RNA, 13 nt, Human
ggucugcaggcag

SEQ ID NO: 2139354 - RNA, 14 nt, Human
ggucugcaggcagg

SEQ ID NO: 2139355 - RNA, 23 nt, Human
ggucugcaggcagggcugacucu

SEQ ID NO: 2139356 - RNA, 21 nt, Human
ggugacagagugagacucugu

SEQ ID NO: 2139357 - RNA, 17 nt, Human
ggugaggaagcuccagu

SEQ ID NO: 2139358 - RNA, 15 nt, Human
ggugaggaccacucc

SEQ ID NO: 2139359 - RNA, 18 nt, Human
ggugagcagacugguggg

SEQ ID NO: 2139360 - RNA, 18 nt, Human
ggugaggaccacuccugu

SEQ ID NO: 2139361 - RNA, 13 nt, Human
ggugaggagcaca

SEQ ID NO: 2139362 - RNA, 18 nt, Human
ggugccuggguggggcug

SEQ ID NO: 2139363 - RNA, 19 nt, Human
ggugccuggguggggcugc

SEQ ID NO: 2139364 - RNA, 22 nt, Human
ggugccuggguggggcugcucc

SEQ ID NO: 2139365 - RNA, 23 nt, Human
ggugccuggguggggcugcuccu

SEQ ID NO: 2139366 - RNA, 17 nt, Human
ggugccugugaggcagg

SEQ ID NO: 2139367 - RNA, 18 nt, Human
ggugccugugaggcaggg

SEQ ID NO: 2139368 - RNA, 19 nt, Human
ggugccugugaggcagggg

SEQ ID NO: 2139369 - RNA, 23 nt, Human
ggugccuucuuauucucacucca

SEQ ID NO: 2139370 - RNA, 12 nt, Human
ggugccuuuccu

SEQ ID NO: 2139371 - RNA, 16 nt, Human
ggugccuuuccuguuc

SEQ ID NO: 2139372 - RNA, 17 nt, Human
ggugccuuuccuguuca

SEQ ID NO: 2139373 - RNA, 18 nt, Human
ggugccuuuccuguucag

SEQ ID NO: 2139374 - RNA, 19 nt, Human
ggugccuuuccuguucagc

SEQ ID NO: 2139375 - RNA, 22 nt, Human
ggugccuuuccuguucagcauu

SEQ ID NO: 2139376 - RNA, 16 nt, Human
ggugagaggggaacag

SEQ ID NO: 2139377 - RNA, 15 nt, Human
ggugagaagcagagg

SEQ ID NO: 2139378 - RNA, 21 nt, Human
ggugccugugaggcaggggcg

SEQ ID NO: 2139379 - RNA, 13 nt, Human
gguggcaucccag

SEQ ID NO: 2139380 - RNA, 15 nt, Human
gguggcauacgccug

SEQ ID NO: 2139381 - RNA, 22 nt, Human
gguggcagugggagcugccugu

SEQ ID NO: 2139382 - RNA, 19 nt, Human
gguggcagugggagcugcc

SEQ ID NO: 2139383 - RNA, 21 nt, Human
ggugcugccauccagguucag

SEQ ID NO: 2139384 - RNA, 15 nt, Human
ggugcugccauccag

SEQ ID NO: 2139385 - RNA, 23 nt, Human
ggugacagugagguccugggggc

SEQ ID NO: 2139386 - RNA, 21 nt, Human
gguggcgacucuauagacucu

SEQ ID NO: 2139387 - RNA, 19 nt, Human
gguggcgggcaccuauagu

SEQ ID NO: 2139388 - RNA, 14 nt, Human
gguggcuaaagguc

SEQ ID NO: 2139389 - RNA, 22 nt, Human
gguggccacuccagaccccugg

SEQ ID NO: 2139390 - RNA, 21 nt, Human
gguggccacuccagaccccug

SEQ ID NO: 2139391 - RNA, 20 nt, Human
gguggccacuccagaccccu

SEQ ID NO: 2139392 - RNA, 17 nt, Human
gguggcaucccaguggc

SEQ ID NO: 2139393 - RNA, 19 nt, Human
gguggcaugugccuauagu

SEQ ID NO: 2139394 - RNA, 23 nt, Human
gguggcaugugccuauaguccca

SEQ ID NO: 2139395 - RNA, 23 nt, Human
gguggccacuccagaccccuggc

SEQ ID NO: 2139396 - RNA, 16 nt, Human
gguugacuuucaggua

SEQ ID NO: 2139397 - RNA, 13 nt, Human
gguugagaaauga

SEQ ID NO: 2139398 - RNA, 18 nt, Human
gguugaggggcuccugga

SEQ ID NO: 2139399 - RNA, 19 nt, Human
gguugaggggcuccuggaa

SEQ ID NO: 2139400 - RNA, 13 nt, Human
gguugagguuuca

SEQ ID NO: 2139401 - RNA, 19 nt, Human
gguugagguggaagcccuc

SEQ ID NO: 2139402 - RNA, 16 nt, Human
gguucuuucuuccucu

SEQ ID NO: 2139403 - RNA, 14 nt, Human
gguucuuucuuccu

SEQ ID NO: 2139404 - RNA, 13 nt, Human
gguucuucccuuu

SEQ ID NO: 2139405 - RNA, 18 nt, Human
gguucugguuagcucagc

SEQ ID NO: 2139406 - RNA, 20 nt, Human
gguucugguuagcucagccc

SEQ ID NO: 2139407 - RNA, 22 nt, Human
gguucugguuagcucagcccca

SEQ ID NO: 2139408 - RNA, 16 nt, Human
gguucuuagugucacu

SEQ ID NO: 2139409 - RNA, 12 nt, Human
gguucaccagcc

SEQ ID NO: 2139410 - RNA, 13 nt, Human
gguucaccagccu

SEQ ID NO: 2139411 - RNA, 14 nt, Human
gguucaccagccuc

SEQ ID NO: 2139412 - RNA, 15 nt, Human
gguucaccagccucu

SEQ ID NO: 2139413 - RNA, 21 nt, Human
gguucacgccuguaaucccag

SEQ ID NO: 2139414 - RNA, 22 nt, Human
gguucacgccuguaaucccagc

SEQ ID NO: 2139415 - RNA, 15 nt, Human
gguucacuaaagcag

SEQ ID NO: 2139416 - RNA, 20 nt, Human
gguuauuuagggaacugcuu

SEQ ID NO: 2139417 - RNA, 22 nt, Human
gguuauguguaugugccauuua

SEQ ID NO: 2139418 - RNA, 12 nt, Human
gguuauuuuuau

SEQ ID NO: 2139419 - RNA, 11 nt, Human
gguuaaaacug

SEQ ID NO: 2139420 - RNA, 13 nt, Human
gguuaaaacuguc

SEQ ID NO: 2139421 - RNA, 14 nt, Human
gguguuuucaugua

SEQ ID NO: 2139422 - RNA, 17 nt, Human
gguguccuuucccucca

SEQ ID NO: 2139423 - RNA, 17 nt, Human
gguuaacuauguacaau

SEQ ID NO: 2139424 - RNA, 15 nt, Human
gguuaaggcugagga

SEQ ID NO: 2139425 - RNA, 22 nt, Human
gguuaaggcugaggaaaggcca

SEQ ID NO: 2139426 - RNA, 21 nt, Human
gguuacccaguuagcucucaa

SEQ ID NO: 2139427 - RNA, 14 nt, Human
gguuacaaacugca

SEQ ID NO: 2139428 - RNA, 15 nt, Human
gguuacaaacugcaa

SEQ ID NO: 2139429 - RNA, 13 nt, Human
gguuaauaaguuu

SEQ ID NO: 2139430 - RNA, 13 nt, Human
gguuacacuguua

SEQ ID NO: 2139431 - RNA, 15 nt, Human
gguuacacuguuaga

SEQ ID NO: 2139432 - RNA, 20 nt, Human
gguuacacuguuagaacacu

SEQ ID NO: 2139433 - RNA, 21 nt, Human
gguuacacuguuagaacacua

SEQ ID NO: 2139434 - RNA, 17 nt, Human
gguuagcagagcuggac

SEQ ID NO: 2139435 - RNA, 22 nt, Human
gguuagcucagccccagcccag

SEQ ID NO: 2139436 - RNA, 20 nt, Human
gguuaggaguucgagaccag

SEQ ID NO: 2139437 - RNA, 13 nt, Human
gguuagggagggg

SEQ ID NO: 2139438 - RNA, 15 nt, Human
gguuagggaggggua

SEQ ID NO: 2139439 - RNA, 21 nt, Human
gguuauauuuuacuacugugg

SEQ ID NO: 2139440 - RNA, 12 nt, Human
gguuauacauga

SEQ ID NO: 2139441 - RNA, 14 nt, Human
gguuauacaugaca

SEQ ID NO: 2139442 - RNA, 23 nt, Human
gguuauacaugacacugaaaugc

SEQ ID NO: 2139443 - RNA, 13 nt, Human
gguuauggagagg

SEQ ID NO: 2139444 - RNA, 17 nt, Human
ggugucaagagggucug

SEQ ID NO: 2139445 - RNA, 19 nt, Human
ggugucaagagggucugag

SEQ ID NO: 2139446 - RNA, 17 nt, Human
gguguauuuauuuuccu

SEQ ID NO: 2139447 - RNA, 22 nt, Human
gguguauuuauuuuccucccca

SEQ ID NO: 2139448 - RNA, 23 nt, Human
gguguauuuauuuuccuccccag

SEQ ID NO: 2139449 - RNA, 16 nt, Human
gguguccccagcccac

SEQ ID NO: 2139450 - RNA, 17 nt, Human
gguguccccagcccacu

SEQ ID NO: 2139451 - RNA, 19 nt, Human
ggugucaccugaagacuca

SEQ ID NO: 2139452 - RNA, 21 nt, Human
ggugguuauggagaggguguc

SEQ ID NO: 2139453 - RNA, 16 nt, Human
gguguaaccugagaug

SEQ ID NO: 2139454 - RNA, 15 nt, Human
gguggugaccucugc

SEQ ID NO: 2139455 - RNA, 14 nt, Human
gguggugaccucug

SEQ ID NO: 2139456 - RNA, 19 nt, Human
ggugguccugacucaacau

SEQ ID NO: 2139457 - RNA, 15 nt, Human
gguggucugaauguu

SEQ ID NO: 2139458 - RNA, 18 nt, Human
gguggucugaauguucug

SEQ ID NO: 2139459 - RNA, 19 nt, Human
gguggucugaauguucuga

SEQ ID NO: 2139460 - RNA, 16 nt, Human
gguggucugcaggcag

SEQ ID NO: 2139461 - RNA, 17 nt, Human
gguggucugcaggcagg

SEQ ID NO: 2139462 - RNA, 18 nt, Human
gguggucugcaggcaggg

SEQ ID NO: 2139463 - RNA, 16 nt, Human
gguggugaccucugcc

SEQ ID NO: 2139464 - RNA, 17 nt, Human
gguggguuuucuuccca

SEQ ID NO: 2139465 - RNA, 16 nt, Human
gguggguuuucuuccc

SEQ ID NO: 2139466 - RNA, 14 nt, Human
ggugguaugugugu

SEQ ID NO: 2139467 - RNA, 12 nt, Human
ggugggugaaag

SEQ ID NO: 2139468 - RNA, 15 nt, Human
gguggcuagucagag

SEQ ID NO: 2139469 - RNA, 16 nt, Human
gguggcuagucagaga

SEQ ID NO: 2139470 - RNA, 17 nt, Human
gguggcuagucagagag

SEQ ID NO: 2139471 - RNA, 14 nt, Human
gguggcucacgccu

SEQ ID NO: 2139472 - RNA, 19 nt, Human
gguggcucacgccuguaau

SEQ ID NO: 2139473 - RNA, 13 nt, Human
gguggcucugaga

SEQ ID NO: 2139474 - RNA, 14 nt, Human
gguggcucuggaau

SEQ ID NO: 2139475 - RNA, 13 nt, Human
gguggcugaccca

SEQ ID NO: 2139476 - RNA, 15 nt, Human
gguggcugacccagu

SEQ ID NO: 2139477 - RNA, 18 nt, Human
gguggcugacccaguccc

SEQ ID NO: 2139478 - RNA, 19 nt, Human
gguggcugacccagucccu

SEQ ID NO: 2139479 - RNA, 21 nt, Human
gguggcugacccagucccugg

SEQ ID NO: 2139480 - RNA, 22 nt, Human
gguggcugacccagucccuggg

SEQ ID NO: 2139481 - RNA, 23 nt, Human
gguggcugacccagucccugggg

SEQ ID NO: 2139482 - RNA, 22 nt, Human
ggucagcuugcugcccuaggcu

SEQ ID NO: 2139483 - RNA, 22 nt, Human
ggucaggagaggggcagaacag

SEQ ID NO: 2139484 - RNA, 21 nt, Human
ggucaggaguuccuaaccagc

SEQ ID NO: 2139485 - RNA, 22 nt, Human
ggucaggaaggaugagcauuua

SEQ ID NO: 2139486 - RNA, 15 nt, Human
ggucaggaggcaggg

SEQ ID NO: 2139487 - RNA, 21 nt, Human
ggucaggaguuagaggccagc

SEQ ID NO: 2139488 - RNA, 11 nt, Human
ggucagagccu

SEQ ID NO: 2139489 - RNA, 22 nt, Human
ggucaggaguuagaggccagcc

SEQ ID NO: 2139490 - RNA, 16 nt, Human
ggucaggccacggcag

SEQ ID NO: 2139491 - RNA, 19 nt, Human
ggucagguguucaagacca

SEQ ID NO: 2139492 - RNA, 17 nt, Human
ggucagggaccaaggac

SEQ ID NO: 2139493 - RNA, 14 nt, Human
ggucaacagagaag

SEQ ID NO: 2139494 - RNA, 20 nt, Human
ggucaacagagaaggcagga

SEQ ID NO: 2139495 - RNA, 18 nt, Human
ggucacaggacucugccu

SEQ ID NO: 2139496 - RNA, 16 nt, Human
ggucacaggacucugc

SEQ ID NO: 2139497 - RNA, 19 nt, Human
ggucaacauggugaaaccc

SEQ ID NO: 2139498 - RNA, 23 nt, Human
ggucaacaucuuuuacauucugc

SEQ ID NO: 2139499 - RNA, 22 nt, Human
ggucaacuugagcauguuacug

SEQ ID NO: 2139500 - RNA, 13 nt, Human
ggucacuccuggg

SEQ ID NO: 2139501 - RNA, 15 nt, Human
ggucacugccaugga

SEQ ID NO: 2139502 - RNA, 17 nt, Human
gguacuuguggacacag

SEQ ID NO: 2139503 - RNA, 16 nt, Human
gguacuuguggacaca

SEQ ID NO: 2139504 - RNA, 20 nt, Human
gguacuuguggacacagcuc

SEQ ID NO: 2139505 - RNA, 22 nt, Human
gguagaaauaucugaaaaugua

SEQ ID NO: 2139506 - RNA, 13 nt, Human
gguacccacugcu

SEQ ID NO: 2139507 - RNA, 16 nt, Human
gguacccacugcucug

SEQ ID NO: 2139508 - RNA, 11 nt, Human
gguacccacug

SEQ ID NO: 2139509 - RNA, 23 nt, Human
gguagaaauaucugaaaauguau

SEQ ID NO: 2139510 - RNA, 11 nt, Human
gguagaacaca

SEQ ID NO: 2139511 - RNA, 16 nt, Human
gguagccaucauggau

SEQ ID NO: 2139512 - RNA, 20 nt, Human
gguauuuaucuauuguaaga

SEQ ID NO: 2139513 - RNA, 21 nt, Human
gguauuuaucuauuguaagau

SEQ ID NO: 2139514 - RNA, 18 nt, Human
gguagaucacgagaucaa

SEQ ID NO: 2139515 - RNA, 19 nt, Human
gggugacagagcaagugag

SEQ ID NO: 2139516 - RNA, 13 nt, Human
gggugaagggaga

SEQ ID NO: 2139517 - RNA, 14 nt, Human
gggugaagggagag

SEQ ID NO: 2139518 - RNA, 23 nt, Human
gggucuucccuaccucaggcagg

SEQ ID NO: 2139519 - RNA, 13 nt, Human
gggugaaagaaau

SEQ ID NO: 2139520 - RNA, 14 nt, Human
gggugaaagaaauc

SEQ ID NO: 2139521 - RNA, 20 nt, Human
gggucuucagggggccaggu

SEQ ID NO: 2139522 - RNA, 15 nt, Human
gggucugugucucuu

SEQ ID NO: 2139523 - RNA, 18 nt, Human
gggugaggaccacuccug

SEQ ID NO: 2139524 - RNA, 15 nt, Human
gggugaggaccacuc

SEQ ID NO: 2139525 - RNA, 16 nt, Human
gggugcucccuaccac

SEQ ID NO: 2139526 - RNA, 21 nt, Human
gggugcugcuucccucugccu

SEQ ID NO: 2139527 - RNA, 23 nt, Human
gggugcugcuucccucugccugu

SEQ ID NO: 2139528 - RNA, 19 nt, Human
gggugcuggcugcccagac

SEQ ID NO: 2139529 - RNA, 14 nt, Human
gggugcagcaguga

SEQ ID NO: 2139530 - RNA, 14 nt, Human
gggugaggauaaca

SEQ ID NO: 2139531 - RNA, 15 nt, Human
gggugcagcugagaa

SEQ ID NO: 2139532 - RNA, 13 nt, Human
gggugcccacagc

SEQ ID NO: 2139533 - RNA, 21 nt, Human
gggugccccccuugccagaca

SEQ ID NO: 2139534 - RNA, 18 nt, Human
gggugcccuccacugccc

SEQ ID NO: 2139535 - RNA, 20 nt, Human
gggugcccuccacugcccuc

SEQ ID NO: 2139536 - RNA, 16 nt, Human
ggguucuuucuuccuc

SEQ ID NO: 2139537 - RNA, 17 nt, Human
ggguucuuucuuccucu

SEQ ID NO: 2139538 - RNA, 18 nt, Human
ggguucguggaaagggug

SEQ ID NO: 2139539 - RNA, 19 nt, Human
ggguucuuucuuccucugc

SEQ ID NO: 2139540 - RNA, 20 nt, Human
ggguugcguccugacggcgc

SEQ ID NO: 2139541 - RNA, 21 nt, Human
gggugcugccccaugaagcca

SEQ ID NO: 2139542 - RNA, 18 nt, Human
ggguugcaguggagaggg

SEQ ID NO: 2139543 - RNA, 19 nt, Human
ggguugcaguggagaggga

SEQ ID NO: 2139544 - RNA, 18 nt, Human
ggguugcaucagaaaugu

SEQ ID NO: 2139545 - RNA, 22 nt, Human
ggguucagccccuccucugcca

SEQ ID NO: 2139546 - RNA, 13 nt, Human
ggguucauuauug

SEQ ID NO: 2139547 - RNA, 17 nt, Human
ggguucauuauuggaau

SEQ ID NO: 2139548 - RNA, 23 nt, Human
ggguucaagcgauucuucugcuu

SEQ ID NO: 2139549 - RNA, 20 nt, Human
ggguucaccugggcugaggc

SEQ ID NO: 2139550 - RNA, 20 nt, Human
ggguuauguguaugugccau

SEQ ID NO: 2139551 - RNA, 16 nt, Human
ggguucaaaaugucug

SEQ ID NO: 2139552 - RNA, 19 nt, Human
ggguucagagacucagggc

SEQ ID NO: 2139553 - RNA, 13 nt, Human
ggguucagccccu

SEQ ID NO: 2139554 - RNA, 16 nt, Human
ggguucagccccuccu

SEQ ID NO: 2139555 - RNA, 17 nt, Human
ggguucagccccuccuc

SEQ ID NO: 2139556 - RNA, 19 nt, Human
ggguucagccccuccucug

SEQ ID NO: 2139557 - RNA, 20 nt, Human
ggguucagccccuccucugc

SEQ ID NO: 2139558 - RNA, 21 nt, Human
ggguucagccccuccucugcc

SEQ ID NO: 2139559 - RNA, 13 nt, Human
ggguucaggggac

SEQ ID NO: 2139560 - RNA, 12 nt, Human
ggguuacaaacu

SEQ ID NO: 2139561 - RNA, 16 nt, Human
ggguuacaaacugcaa

SEQ ID NO: 2139562 - RNA, 22 nt, Human
ggguucaagcgauucuucugcu

SEQ ID NO: 2139563 - RNA, 14 nt, Human
ggguguguguuugu

SEQ ID NO: 2139564 - RNA, 22 nt, Human
ggguguguguuugugugagaga

SEQ ID NO: 2139565 - RNA, 14 nt, Human
gggucucacucugu

SEQ ID NO: 2139566 - RNA, 13 nt, Human
ggguaaauuauuc

SEQ ID NO: 2139567 - RNA, 18 nt, Human
gggucuccaggaggagac

SEQ ID NO: 2139568 - RNA, 19 nt, Human
gggucuccaggaggagacu

SEQ ID NO: 2139569 - RNA, 15 nt, Human
gggucucccucuccu

SEQ ID NO: 2139570 - RNA, 16 nt, Human
gggucucccucuccug

SEQ ID NO: 2139571 - RNA, 18 nt, Human
gggucucccucuccugcc

SEQ ID NO: 2139572 - RNA, 19 nt, Human
gggucucccucuccugccu

SEQ ID NO: 2139573 - RNA, 23 nt, Human
gggguuuucgaagcucagcccac

SEQ ID NO: 2139574 - RNA, 22 nt, Human
ggguaaaauuccuuagcuuaga

SEQ ID NO: 2139575 - RNA, 13 nt, Human
ggguaaggugccu

SEQ ID NO: 2139576 - RNA, 14 nt, Human
ggguaaggugccuu

SEQ ID NO: 2139577 - RNA, 14 nt, Human
gggggagggggagg

SEQ ID NO: 2139578 - RNA, 13 nt, Human
gggguuacaaacu

SEQ ID NO: 2139579 - RNA, 17 nt, Human
gggguuacaaacugcaa

SEQ ID NO: 2139580 - RNA, 13 nt, Human
gggguuggcuggg

SEQ ID NO: 2139581 - RNA, 20 nt, Human
gggucucccucuccugccua

SEQ ID NO: 2139582 - RNA, 21 nt, Human
gggucugaggaauccagaccc

SEQ ID NO: 2139583 - RNA, 12 nt, Human
gggucugaggaa

SEQ ID NO: 2139584 - RNA, 17 nt, Human
gggggagucugaagcag

SEQ ID NO: 2139585 - RNA, 22 nt, Human
gggggagucugaagcagaugca

SEQ ID NO: 2139586 - RNA, 15 nt, Human
ggggugggagagguc

SEQ ID NO: 2139587 - RNA, 14 nt, Human
ggggcugaggggca

SEQ ID NO: 2139588 - RNA, 20 nt, Human
ggggcugaucucagggaagc

SEQ ID NO: 2139589 - RNA, 18 nt, Human
ggggcugaacggggagaa

SEQ ID NO: 2139590 - RNA, 19 nt, Human
ggggcugaggugggaggau

SEQ ID NO: 2139591 - RNA, 14 nt, Human
ggggauuucuccca

SEQ ID NO: 2139592 - RNA, 15 nt, Human
ggggauuucucccag

SEQ ID NO: 2139593 - RNA, 19 nt, Human
ggggaggaucacuggagcc

SEQ ID NO: 2139594 - RNA, 14 nt, Human
ggggaggcagccgg

SEQ ID NO: 2139595 - RNA, 13 nt, Human
ggggaggccaagu

SEQ ID NO: 2139596 - RNA, 21 nt, Human
ggggaggccaagugcaggcug

SEQ ID NO: 2139597 - RNA, 21 nt, Human
ggggaaaaucagccugcucca

SEQ ID NO: 2139598 - RNA, 16 nt, Human
gggccuggucccuggg

SEQ ID NO: 2139599 - RNA, 14 nt, Human
gggcuuucuggaga

SEQ ID NO: 2139600 - RNA, 20 nt, Human
gggcuuugauuccaucuccu

SEQ ID NO: 2139601 - RNA, 15 nt, Human
gggcuuucuggagag

SEQ ID NO: 2139602 - RNA, 16 nt, Human
ggggaaaaucagccug

SEQ ID NO: 2139603 - RNA, 17 nt, Human
ggggaaaaucagccugc

SEQ ID NO: 2139604 - RNA, 19 nt, Human
ggggaaaaucagccugcuc

SEQ ID NO: 2139605 - RNA, 17 nt, Human
ggggcugaggugggagg

SEQ ID NO: 2139606 - RNA, 12 nt, Human
ggggcucuggga

SEQ ID NO: 2139607 - RNA, 21 nt, Human
ggggcuccuggaaaggcucag

SEQ ID NO: 2139608 - RNA, 23 nt, Human
ggggcucugcccucccuccuucc

SEQ ID NO: 2139609 - RNA, 11 nt, Human
ggggcuccugg

SEQ ID NO: 2139610 - RNA, 12 nt, Human
ggggcuccugga

SEQ ID NO: 2139611 - RNA, 13 nt, Human
ggggcuccuggaa

SEQ ID NO: 2139612 - RNA, 15 nt, Human
ggggcaaacaccugc

SEQ ID NO: 2139613 - RNA, 13 nt, Human
ggggcagaacagc

SEQ ID NO: 2139614 - RNA, 17 nt, Human
ggggcagucuggagggg

SEQ ID NO: 2139615 - RNA, 17 nt, Human
ggggcagaacagccgcu

SEQ ID NO: 2139616 - RNA, 13 nt, Human
ggggcaguggcaa

SEQ ID NO: 2139617 - RNA, 14 nt, Human
ggggcaucugcccc

SEQ ID NO: 2139618 - RNA, 20 nt, Human
ggggcaucugccccuccccc

SEQ ID NO: 2139619 - RNA, 17 nt, Human
gggcccagagagggugg

SEQ ID NO: 2139620 - RNA, 18 nt, Human
gggccacgugccaggccc

SEQ ID NO: 2139621 - RNA, 19 nt, Human
gggccacgugccaggcccg

SEQ ID NO: 2139622 - RNA, 15 nt, Human
gggccacucugccuc

SEQ ID NO: 2139623 - RNA, 16 nt, Human
gggccacucugccucu

SEQ ID NO: 2139624 - RNA, 19 nt, Human
gggcccaagacagaugccc

SEQ ID NO: 2139625 - RNA, 23 nt, Human
gggcccaagacagaugccccaga

SEQ ID NO: 2139626 - RNA, 13 nt, Human
gggcccagaucug

SEQ ID NO: 2139627 - RNA, 14 nt, Human
gggcccagauucua

SEQ ID NO: 2139628 - RNA, 23 nt, Human
gggccaaauauauucucuuuggu

SEQ ID NO: 2139629 - RNA, 18 nt, Human
gggcauugauggggaagg

SEQ ID NO: 2139630 - RNA, 23 nt, Human
gggcauugauggggaaggaggcu

SEQ ID NO: 2139631 - RNA, 14 nt, Human
gggcauugcuuucc

SEQ ID NO: 2139632 - RNA, 13 nt, Human
gggccaagaaaga

SEQ ID NO: 2139633 - RNA, 11 nt, Human
gggccaacacc

SEQ ID NO: 2139634 - RNA, 15 nt, Human
gggccaacaccaggg

SEQ ID NO: 2139635 - RNA, 16 nt, Human
gggccaacaccaggga

SEQ ID NO: 2139636 - RNA, 16 nt, Human
gggccacagagaaagu

SEQ ID NO: 2139637 - RNA, 13 nt, Human
gggccaaggacug

SEQ ID NO: 2139638 - RNA, 15 nt, Human
gggccaagucccacc

SEQ ID NO: 2139639 - RNA, 23 nt, Human
gggccacagagaaaguacuucuc

SEQ ID NO: 2139640 - RNA, 14 nt, Human
gggccacagccaga

SEQ ID NO: 2139641 - RNA, 14 nt, Human
gggccacgugccag

SEQ ID NO: 2139642 - RNA, 19 nt, Human
gggccaccuccccaggccg

SEQ ID NO: 2139643 - RNA, 22 nt, Human
gggccaccuccccaggccgugg

SEQ ID NO: 2139644 - RNA, 15 nt, Human
gggccaccuccccag

SEQ ID NO: 2139645 - RNA, 16 nt, Human
gggccaccuccccagg

SEQ ID NO: 2139646 - RNA, 17 nt, Human
gggccaccuccccaggc

SEQ ID NO: 2139647 - RNA, 19 nt, Human
gggcaugguauuugagaca

SEQ ID NO: 2139648 - RNA, 16 nt, Human
gggcauggccagcagc

SEQ ID NO: 2139649 - RNA, 20 nt, Human
gggcauggccagguggccac

SEQ ID NO: 2139650 - RNA, 17 nt, Human
gggcauggccagguggc

SEQ ID NO: 2139651 - RNA, 15 nt, Human
gggcauggccaggug

SEQ ID NO: 2139652 - RNA, 20 nt, Human
gggcauggacguucggggca

SEQ ID NO: 2139653 - RNA, 22 nt, Human
gggcauggacguucggggcaug

SEQ ID NO: 2139654 - RNA, 14 nt, Human
gggcaucugccccu

SEQ ID NO: 2139655 - RNA, 17 nt, Human
gggcaucugccccuccc

SEQ ID NO: 2139656 - RNA, 19 nt, Human
gggcaucugccccuccccc

SEQ ID NO: 2139657 - RNA, 13 nt, Human
gggcaucuggccu

SEQ ID NO: 2139658 - RNA, 18 nt, Human
gggcaucuggccuuacac

SEQ ID NO: 2139659 - RNA, 20 nt, Human
gggcaucugccccuccccca

SEQ ID NO: 2139660 - RNA, 14 nt, Human
gggcaugcuggggc

SEQ ID NO: 2139661 - RNA, 17 nt, Human
gggcaugcuggggcaag

SEQ ID NO: 2139662 - RNA, 13 nt, Human
gggcaucaugcau

SEQ ID NO: 2139663 - RNA, 15 nt, Human
gggcagucuggaggg

SEQ ID NO: 2139664 - RNA, 14 nt, Human
gggcaguggaggug

SEQ ID NO: 2139665 - RNA, 14 nt, Human
gggcagucuggagg

SEQ ID NO: 2139666 - RNA, 17 nt, Human
gggcagucuggaggggc

SEQ ID NO: 2139667 - RNA, 12 nt, Human
gggcccugagcu

SEQ ID NO: 2139668 - RNA, 18 nt, Human
gggccccuuuuuacuccc

SEQ ID NO: 2139669 - RNA, 16 nt, Human
gggcccgccuggcaga

SEQ ID NO: 2139670 - RNA, 20 nt, Human
gggcccgccuggcagaacug

SEQ ID NO: 2139671 - RNA, 13 nt, Human
gggcccugagcuc

SEQ ID NO: 2139672 - RNA, 22 nt, Human
gggcccugagcucgguggaccc

SEQ ID NO: 2139673 - RNA, 23 nt, Human
gggcccgccuggcagaacugagc

SEQ ID NO: 2139674 - RNA, 15 nt, Human
gggcccugcagaggg

SEQ ID NO: 2139675 - RNA, 18 nt, Human
gggccaagccagggaugg

SEQ ID NO: 2139676 - RNA, 18 nt, Human
gggccccagaaggcaggg

SEQ ID NO: 2139677 - RNA, 15 nt, Human
gggccccaccaccua

SEQ ID NO: 2139678 - RNA, 22 nt, Human
gggccccaaacgggcugcccug

SEQ ID NO: 2139679 - RNA, 13 nt, Human
gggcccaggcagg

SEQ ID NO: 2139680 - RNA, 10 nt, Human
gggccccucc

SEQ ID NO: 2139681 - RNA, 18 nt, Human
gggccccucccuaccuca

SEQ ID NO: 2139682 - RNA, 19 nt, Human
gggccccucccuaccucaa

SEQ ID NO: 2139683 - RNA, 20 nt, Human
gggccccucccuaccucaac

SEQ ID NO: 2139684 - RNA, 14 nt, Human
gggcagggcaugac

SEQ ID NO: 2139685 - RNA, 20 nt, Human
gggcagggcaucuccugugc

SEQ ID NO: 2139686 - RNA, 17 nt, Human
gggcagguugguggggg

SEQ ID NO: 2139687 - RNA, 13 nt, Human
gggcaggugggag

SEQ ID NO: 2139688 - RNA, 17 nt, Human
gggcaggugggagcuug

SEQ ID NO: 2139689 - RNA, 16 nt, Human
gggcacugguggcccg

SEQ ID NO: 2139690 - RNA, 13 nt, Human
gggcacugguggc

SEQ ID NO: 2139691 - RNA, 18 nt, Human
gggcacgcugugggcagg

SEQ ID NO: 2139692 - RNA, 17 nt, Human
gggcacgcugugggcag

SEQ ID NO: 2139693 - RNA, 18 nt, Human
gggcaccuggggaguggg

SEQ ID NO: 2139694 - RNA, 20 nt, Human
gggcacucagaagacacuga

SEQ ID NO: 2139695 - RNA, 20 nt, Human
gggcacuuuaaaugaagcua

SEQ ID NO: 2139696 - RNA, 15 nt, Human
gggcagaaaguggcc

SEQ ID NO: 2139697 - RNA, 22 nt, Human
gggcagaacagccgcuccuguc

SEQ ID NO: 2139698 - RNA, 17 nt, Human
gggcaccaagcccacag

SEQ ID NO: 2139699 - RNA, 13 nt, Human
gggcacagggucu

SEQ ID NO: 2139700 - RNA, 16 nt, Human
gggcacagggucucua

SEQ ID NO: 2139701 - RNA, 18 nt, Human
gggcaccuauaauaccag

SEQ ID NO: 2139702 - RNA, 19 nt, Human
gggcaccuauagucccagc

SEQ ID NO: 2139703 - RNA, 19 nt, Human
gggcacucagaagacacug

SEQ ID NO: 2139704 - RNA, 16 nt, Human
gggcacucagaagaca

SEQ ID NO: 2139705 - RNA, 23 nt, Human
gggcacaccgggcacucagaaga

SEQ ID NO: 2139706 - RNA, 21 nt, Human
gggcaauauaaccaauguuua

SEQ ID NO: 2139707 - RNA, 14 nt, Human
gggagugagcuggu

SEQ ID NO: 2139708 - RNA, 11 nt, Human
gggagugagcu

SEQ ID NO: 2139709 - RNA, 18 nt, Human
gggagugacagaggcagc

SEQ ID NO: 2139710 - RNA, 14 nt, Human
gggagguggcuggg

SEQ ID NO: 2139711 - RNA, 21 nt, Human
gggagugggacagagucuggg

SEQ ID NO: 2139712 - RNA, 20 nt, Human
gggaguucgagaccaaccug

SEQ ID NO: 2139713 - RNA, 22 nt, Human
gggaguugucaagucucugcug

SEQ ID NO: 2139714 - RNA, 16 nt, Human
gggaggugaccccagg

SEQ ID NO: 2139715 - RNA, 16 nt, Human
gggaggucgagguagg

SEQ ID NO: 2139716 - RNA, 16 nt, Human
gggacucagcccugag

SEQ ID NO: 2139717 - RNA, 17 nt, Human
gggacucagcccugagg

SEQ ID NO: 2139718 - RNA, 17 nt, Human
gggacuaaaugcccugc

SEQ ID NO: 2139719 - RNA, 18 nt, Human
gggacuagccuggcuugg

SEQ ID NO: 2139720 - RNA, 16 nt, Human
gggacucacuggcagc

SEQ ID NO: 2139721 - RNA, 18 nt, Human
gggacucacuggcagccc

SEQ ID NO: 2139722 - RNA, 21 nt, Human
gggacucacuggcagccccag

SEQ ID NO: 2139723 - RNA, 23 nt, Human
gggacucacuggcagccccagca

SEQ ID NO: 2139724 - RNA, 13 nt, Human
gggauagagagag

SEQ ID NO: 2139725 - RNA, 23 nt, Human
gggaguucgagaccaaccugacc

SEQ ID NO: 2139726 - RNA, 21 nt, Human
gggauaugauuuaaaucagcc

SEQ ID NO: 2139727 - RNA, 16 nt, Human
gggauagcacugagca

SEQ ID NO: 2139728 - RNA, 19 nt, Human
gggauagucaccuuuuaaa

SEQ ID NO: 2139729 - RNA, 14 nt, Human
gggaucacagggcc

SEQ ID NO: 2139730 - RNA, 20 nt, Human
gggcaacccccagccugcua

SEQ ID NO: 2139731 - RNA, 13 nt, Human
gggcaaggagacc

SEQ ID NO: 2139732 - RNA, 17 nt, Human
gggaucugugcccagag

SEQ ID NO: 2139733 - RNA, 14 nt, Human
gggcaacgaagaaa

SEQ ID NO: 2139734 - RNA, 15 nt, Human
gggcaacgaagaaaa

SEQ ID NO: 2139735 - RNA, 17 nt, Human
gggcaacgaagaaaaaa

SEQ ID NO: 2139736 - RNA, 23 nt, Human
gggcaacgaagaaaaaaaauaac

SEQ ID NO: 2139737 - RNA, 24 nt, Human
gggcaagucccugacucucuguga

SEQ ID NO: 2139738 - RNA, 23 nt, Human
ggcuugcaaguauguuuuagcau

SEQ ID NO: 2139739 - RNA, 15 nt, Human
ggcuugucagagcug

SEQ ID NO: 2139740 - RNA, 16 nt, Human
ggcuugucagagcugg

SEQ ID NO: 2139741 - RNA, 17 nt, Human
ggcuugucagagcuggg

SEQ ID NO: 2139742 - RNA, 21 nt, Human
ggcuucaauuuauugcacaaa

SEQ ID NO: 2139743 - RNA, 17 nt, Human
ggcuuguaacuccacca

SEQ ID NO: 2139744 - RNA, 18 nt, Human
ggcuuguaacuccaccaa

SEQ ID NO: 2139745 - RNA, 15 nt, Human
ggcuuggggcuuccu

SEQ ID NO: 2139746 - RNA, 21 nt, Human
ggcuugguggcucacgccugu

SEQ ID NO: 2139747 - RNA, 15 nt, Human
ggcuuguaacuccac

SEQ ID NO: 2139748 - RNA, 16 nt, Human
ggcuuucaugaggagg

SEQ ID NO: 2139749 - RNA, 20 nt, Human
ggcuuucaugaggaggcaga

SEQ ID NO: 2139750 - RNA, 17 nt, Human
ggcuuuucacugcuggc

SEQ ID NO: 2139751 - RNA, 15 nt, Human
ggcuuuucacugcug

SEQ ID NO: 2139752 - RNA, 13 nt, Human
ggcuuuucacugc

SEQ ID NO: 2139753 - RNA, 14 nt, Human
ggcuuuucacugcu

SEQ ID NO: 2139754 - RNA, 22 nt, Human
ggcuuuucacugcuggcugccu

SEQ ID NO: 2139755 - RNA, 19 nt, Human
ggcuuuucacugcuggcug

SEQ ID NO: 2139756 - RNA, 12 nt, Human
ggcugggcuuca

SEQ ID NO: 2139757 - RNA, 14 nt, Human
ggcugggcccagag

SEQ ID NO: 2139758 - RNA, 15 nt, Human
ggcugggcccagagg

SEQ ID NO: 2139759 - RNA, 16 nt, Human
ggcugggcccagaggc

SEQ ID NO: 2139760 - RNA, 17 nt, Human
ggcugggcccagaggca

SEQ ID NO: 2139761 - RNA, 13 nt, Human
ggcugggcccaga

SEQ ID NO: 2139762 - RNA, 14 nt, Human
ggcugggcccagaa

SEQ ID NO: 2139763 - RNA, 17 nt, Human
ggcugggcuucaguggc

SEQ ID NO: 2139764 - RNA, 13 nt, Human
ggcugggcuucag

SEQ ID NO: 2139765 - RNA, 22 nt, Human
ggcuuacuacaugugggagcuu

SEQ ID NO: 2139766 - RNA, 17 nt, Human
ggcuuacacguggagga

SEQ ID NO: 2139767 - RNA, 13 nt, Human
ggcuuacacccac

SEQ ID NO: 2139768 - RNA, 16 nt, Human
gggacucaaugcacug

SEQ ID NO: 2139769 - RNA, 17 nt, Human
gggacuacaggcaccca

SEQ ID NO: 2139770 - RNA, 18 nt, Human
gggaccgguacagaaagg

SEQ ID NO: 2139771 - RNA, 18 nt, Human
gggacaaauuuaaaacaa

SEQ ID NO: 2139772 - RNA, 19 nt, Human
gggacaaauuuaaaacaaa

SEQ ID NO: 2139773 - RNA, 22 nt, Human
gggacaaauuuaaaacaaacaa

SEQ ID NO: 2139774 - RNA, 20 nt, Human
gggaauguauuauucugcag

SEQ ID NO: 2139775 - RNA, 22 nt, Human
gggaauugaggucugcucggcc

SEQ ID NO: 2139776 - RNA, 21 nt, Human
gggaauguauuauucugcagc

SEQ ID NO: 2139777 - RNA, 16 nt, Human
gggacccuuuccuucc

SEQ ID NO: 2139778 - RNA, 19 nt, Human
gggaaggccccacagacaa

SEQ ID NO: 2139779 - RNA, 13 nt, Human
gggaagggagagc

SEQ ID NO: 2139780 - RNA, 16 nt, Human
gggaagggagagcggg

SEQ ID NO: 2139781 - RNA, 15 nt, Human
gggaaggccaccugc

SEQ ID NO: 2139782 - RNA, 18 nt, Human
gggaaggccaccugcagg

SEQ ID NO: 2139783 - RNA, 12 nt, Human
ggcuuucuggag

SEQ ID NO: 2139784 - RNA, 14 nt, Human
gggaaguccccagg

SEQ ID NO: 2139785 - RNA, 12 nt, Human
gggaaggucacc

SEQ ID NO: 2139786 - RNA, 16 nt, Human
gggaauggcacagccc

SEQ ID NO: 2139787 - RNA, 22 nt, Human
gggaauggcacagcccaaagaa

SEQ ID NO: 2139788 - RNA, 18 nt, Human
ggcugcaaaggguaucag

SEQ ID NO: 2139789 - RNA, 23 nt, Human
ggcugcaaaggguaucaggugcu

SEQ ID NO: 2139790 - RNA, 22 nt, Human
ggcugcaaaggguaucaggugc

SEQ ID NO: 2139791 - RNA, 22 nt, Human
ggcugagucaugaucucccugc

SEQ ID NO: 2139792 - RNA, 23 nt, Human
ggcugagucaugaucucccugcc

SEQ ID NO: 2139793 - RNA, 13 nt, Human
ggcugaucucagg

SEQ ID NO: 2139794 - RNA, 14 nt, Human
ggcugaucucaggg

SEQ ID NO: 2139795 - RNA, 15 nt, Human
ggcugaucucaggga

SEQ ID NO: 2139796 - RNA, 19 nt, Human
ggcugaucucagggaagcc

SEQ ID NO: 2139797 - RNA, 22 nt, Human
ggcugaucucagggaagcccag

SEQ ID NO: 2139798 - RNA, 15 nt, Human
ggcugauggaguaaa

SEQ ID NO: 2139799 - RNA, 24 nt, Human
ggcugcaaaggguaucaggugcug

SEQ ID NO: 2139800 - RNA, 13 nt, Human
ggcugagguggga

SEQ ID NO: 2139801 - RNA, 15 nt, Human
ggcugaggugggagg

SEQ ID NO: 2139802 - RNA, 19 nt, Human
ggcugaggggcaacgaaga

SEQ ID NO: 2139803 - RNA, 15 nt, Human
ggcugagcccuggca

SEQ ID NO: 2139804 - RNA, 16 nt, Human
ggcugagcccuggcag

SEQ ID NO: 2139805 - RNA, 12 nt, Human
ggcugagcccug

SEQ ID NO: 2139806 - RNA, 13 nt, Human
ggcugagcccugg

SEQ ID NO: 2139807 - RNA, 14 nt, Human
ggcugagcccuggc

SEQ ID NO: 2139808 - RNA, 12 nt, Human
ggcugagacugg

SEQ ID NO: 2139809 - RNA, 13 nt, Human
ggcugagacugga

SEQ ID NO: 2139810 - RNA, 21 nt, Human
ggcugagacuggauacugccc

SEQ ID NO: 2139811 - RNA, 17 nt, Human
ggccccugcccggcugc

SEQ ID NO: 2139812 - RNA, 16 nt, Human
ggccccugcccggcug

SEQ ID NO: 2139813 - RNA, 20 nt, Human
ggccccugcccggcugcgga

SEQ ID NO: 2139814 - RNA, 13 nt, Human
ggcugcagggagu

SEQ ID NO: 2139815 - RNA, 12 nt, Human
ggcugcagggag

SEQ ID NO: 2139816 - RNA, 16 nt, Human
ggcugcugaccuccac

SEQ ID NO: 2139817 - RNA, 21 nt, Human
ggcugcugaccuccacagcuu

SEQ ID NO: 2139818 - RNA, 12 nt, Human
ggcugcuggagg

SEQ ID NO: 2139819 - RNA, 13 nt, Human
ggcugcuggagga

SEQ ID NO: 2139820 - RNA, 14 nt, Human
ggcugcuggaggaa

SEQ ID NO: 2139821 - RNA, 15 nt, Human
ggcugcuggaggaaa

SEQ ID NO: 2139822 - RNA, 16 nt, Human
ggcugcuggaggaaaa

SEQ ID NO: 2139823 - RNA, 15 nt, Human
ggcuggacguggugg

SEQ ID NO: 2139824 - RNA, 18 nt, Human
ggcugggccaagccaggg

SEQ ID NO: 2139825 - RNA, 22 nt, Human
ggcugggccaagccagggaugg

SEQ ID NO: 2139826 - RNA, 13 nt, Human
ggcugggcagcug

SEQ ID NO: 2139827 - RNA, 14 nt, Human
ggcugggcagcugu

SEQ ID NO: 2139828 - RNA, 19 nt, Human
ggaaaaaccacccccaaau

SEQ ID NO: 2139829 - RNA, 21 nt, Human
ggaaaaacaucugaaagccac

SEQ ID NO: 2139830 - RNA, 13 nt, Human
ggaaaaauagccu

SEQ ID NO: 2139831 - RNA, 12 nt, Human
ggaaaaaggaca

SEQ ID NO: 2139832 - RNA, 22 nt, Human
ggaaaaaggacaggcagaaaga

SEQ ID NO: 2139833 - RNA, 23 nt, Human
ggaaaaaggacaggcagaaagag

SEQ ID NO: 2139834 - RNA, 21 nt, Human
ggaaaaaguaucauggaaaua

SEQ ID NO: 2139835 - RNA, 22 nt, Human
ggaaaaccaagccguggcuucc

SEQ ID NO: 2139836 - RNA, 15 nt, Human
ggaaaaauagccugc

SEQ ID NO: 2139837 - RNA, 16 nt, Human
ggaaaacugacagagg

SEQ ID NO: 2139838 - RNA, 21 nt, Human
ggaaaacugagacucagacag

SEQ ID NO: 2139839 - RNA, 22 nt, Human
ggaaaaccagacuacuugggag

SEQ ID NO: 2139840 - RNA, 12 nt, Human
ggaaaaccagac

SEQ ID NO: 2139841 - RNA, 11 nt, Human
ggaaaaauauu

SEQ ID NO: 2139842 - RNA, 17 nt, Human
gcuuuuaacuucugaua

SEQ ID NO: 2139843 - RNA, 16 nt, Human
gcuuugggcugcccug

SEQ ID NO: 2139844 - RNA, 15 nt, Human
gcuuugggcugcccu

SEQ ID NO: 2139845 - RNA, 14 nt, Human
gcuuuuacuuaaac

SEQ ID NO: 2139846 - RNA, 14 nt, Human
gcuuuacaaaaaga

SEQ ID NO: 2139847 - RNA, 15 nt, Human
gcuuuacaaaaagac

SEQ ID NO: 2139848 - RNA, 16 nt, Human
gcuuuaauugugaauu

SEQ ID NO: 2139849 - RNA, 14 nt, Human
gcuuugggcugccc

SEQ ID NO: 2139850 - RNA, 18 nt, Human
gcuuuggacgcacacagc

SEQ ID NO: 2139851 - RNA, 19 nt, Human
gcuuuggacgcacacagcu

SEQ ID NO: 2139852 - RNA, 15 nt, Human
gcuuuauguaauaau

SEQ ID NO: 2139853 - RNA, 13 nt, Human
gcuuuauuuuuua

SEQ ID NO: 2139854 - RNA, 17 nt, Human
gcuuuauuuuuuaagua

SEQ ID NO: 2139855 - RNA, 13 nt, Human
gcuuggccagaag

SEQ ID NO: 2139856 - RNA, 13 nt, Human
gcuuggcagcuga

SEQ ID NO: 2139857 - RNA, 18 nt, Human
gcuuggccagaagggggc

SEQ ID NO: 2139858 - RNA, 19 nt, Human
gcuugcagugagccgagau

SEQ ID NO: 2139859 - RNA, 23 nt, Human
gcuugcauaauaagcuaaagagg

SEQ ID NO: 2139860 - RNA, 15 nt, Human
gcuugcauaauaagc

SEQ ID NO: 2139861 - RNA, 23 nt, Human
gcuugcaaguauguuuuagcaug

SEQ ID NO: 2139862 - RNA, 19 nt, Human
gcuugaguuuggggaaugc

SEQ ID NO: 2139863 - RNA, 20 nt, Human
gcuucuguaguacuccuuaa

SEQ ID NO: 2139864 - RNA, 22 nt, Human
gcuugaggguugggcugguguc

SEQ ID NO: 2139865 - RNA, 15 nt, Human
gcuugccacagcucu

SEQ ID NO: 2139866 - RNA, 17 nt, Human
gcuucucacugccaugc

SEQ ID NO: 2139867 - RNA, 14 nt, Human
gcuucucuacagac

SEQ ID NO: 2139868 - RNA, 20 nt, Human
gcuguucacccacagggcua

SEQ ID NO: 2139869 - RNA, 19 nt, Human
gcuucucugugaacgauuu

SEQ ID NO: 2139870 - RNA, 12 nt, Human
gcuucugggaag

SEQ ID NO: 2139871 - RNA, 23 nt, Human
gcuguguccuugcaccugcaucc

SEQ ID NO: 2139872 - RNA, 22 nt, Human
gcuguucacccacagggcuaag

SEQ ID NO: 2139873 - RNA, 17 nt, Human
ggaagcacagcuucauu

SEQ ID NO: 2139874 - RNA, 18 nt, Human
ggaagauuuuaaauucac

SEQ ID NO: 2139875 - RNA, 20 nt, Human
ggaagauuugcccauuuaca

SEQ ID NO: 2139876 - RNA, 22 nt, Human
ggaagcaaaaacgaaagcuggg

SEQ ID NO: 2139877 - RNA, 16 nt, Human
ggaagcacagaaaacu

SEQ ID NO: 2139878 - RNA, 19 nt, Human
ggaagcacagaaaacuaga

SEQ ID NO: 2139879 - RNA, 18 nt, Human
ggaagauaggcucugcac

SEQ ID NO: 2139880 - RNA, 17 nt, Human
ggaagauaggcucugca

SEQ ID NO: 2139881 - RNA, 21 nt, Human
ggaagauaggcucugcacaga

SEQ ID NO: 2139882 - RNA, 13 nt, Human
ggaagagccuugc

SEQ ID NO: 2139883 - RNA, 21 nt, Human
ggaagagcaggcacauggagg

SEQ ID NO: 2139884 - RNA, 15 nt, Human
ggaagagcaggcaca

SEQ ID NO: 2139885 - RNA, 14 nt, Human
ggaagagcaggcac

SEQ ID NO: 2139886 - RNA, 22 nt, Human
ggaacucauuccugccugucuc

SEQ ID NO: 2139887 - RNA, 15 nt, Human
ggaacuccuggaaau

SEQ ID NO: 2139888 - RNA, 19 nt, Human
ggaagcagugccuuccaua

SEQ ID NO: 2139889 - RNA, 20 nt, Human
ggaagcagugccuuccauaa

SEQ ID NO: 2139890 - RNA, 21 nt, Human
ggaagcagugccuuccauaau

SEQ ID NO: 2139891 - RNA, 12 nt, Human
ggaagcagugcc

SEQ ID NO: 2139892 - RNA, 11 nt, Human
ggaagcagugc

SEQ ID NO: 2139893 - RNA, 22 nt, Human
ggaagcaccccaugccaaagcu

SEQ ID NO: 2139894 - RNA, 13 nt, Human
ggaagcaccccau

SEQ ID NO: 2139895 - RNA, 15 nt, Human
ggaagcaccccaugc

SEQ ID NO: 2139896 - RNA, 20 nt, Human
ggaagcauauuguuauuaua

SEQ ID NO: 2139897 - RNA, 17 nt, Human
ggaagcauguaggagaa

SEQ ID NO: 2139898 - RNA, 20 nt, Human
ggaagcauguaggagaaucc

SEQ ID NO: 2139899 - RNA, 21 nt, Human
ggaagcauguaggagaaucca

SEQ ID NO: 2139900 - RNA, 20 nt, Human
ggaacagacuggaagcacag

SEQ ID NO: 2139901 - RNA, 19 nt, Human
ggaacagacuggaagcaca

SEQ ID NO: 2139902 - RNA, 19 nt, Human
ggaacagcuaugggagccc

SEQ ID NO: 2139903 - RNA, 20 nt, Human
ggaacagcuaugggagcccc

SEQ ID NO: 2139904 - RNA, 17 nt, Human
ggaaccgcaggaagcug

SEQ ID NO: 2139905 - RNA, 15 nt, Human
ggaaccgcaggaagc

SEQ ID NO: 2139906 - RNA, 16 nt, Human
ggaaccgcaggaagcu

SEQ ID NO: 2139907 - RNA, 18 nt, Human
ggaaccgcaggaagcugc

SEQ ID NO: 2139908 - RNA, 15 nt, Human
ggaaccgaaaggcca

SEQ ID NO: 2139909 - RNA, 16 nt, Human
ggaacgugacugcccc

SEQ ID NO: 2139910 - RNA, 23 nt, Human
ggaacuagacucccaagcuggac

SEQ ID NO: 2139911 - RNA, 15 nt, Human
ggaacguuggacuuu

SEQ ID NO: 2139912 - RNA, 17 nt, Human
ggaacgugacugcccca

SEQ ID NO: 2139913 - RNA, 18 nt, Human
ggaacuagacugccuggg

SEQ ID NO: 2139914 - RNA, 20 nt, Human
ggaacuagacugccuggguu

SEQ ID NO: 2139915 - RNA, 21 nt, Human
ggaacuagagggauacacuga

SEQ ID NO: 2139916 - RNA, 22 nt, Human
ggaacuagagggauacacugaa

SEQ ID NO: 2139917 - RNA, 21 nt, Human
ggaacucauuccugccugucu

SEQ ID NO: 2139918 - RNA, 15 nt, Human
ggaacucccaagaac

SEQ ID NO: 2139919 - RNA, 23 nt, Human
ggaacucccaagaacagcaggcc

SEQ ID NO: 2139920 - RNA, 18 nt, Human
ggaacgggguccuucaag

SEQ ID NO: 2139921 - RNA, 20 nt, Human
ggaacgguaaauuucugugg

SEQ ID NO: 2139922 - RNA, 13 nt, Human
ggaaagugaauuu

SEQ ID NO: 2139923 - RNA, 14 nt, Human
ggaaagugaauuug

SEQ ID NO: 2139924 - RNA, 18 nt, Human
ggaaagugaauuugaaug

SEQ ID NO: 2139925 - RNA, 19 nt, Human
ggaaagugaauuugaauga

SEQ ID NO: 2139926 - RNA, 22 nt, Human
ggaaagugaauuugaaugaaaa

SEQ ID NO: 2139927 - RNA, 15 nt, Human
ggaaaaucagccugc

SEQ ID NO: 2139928 - RNA, 20 nt, Human
ggaaagggugcugcuucccu

SEQ ID NO: 2139929 - RNA, 15 nt, Human
ggaaagggugcugcu

SEQ ID NO: 2139930 - RNA, 14 nt, Human
ggaaaagaauacag

SEQ ID NO: 2139931 - RNA, 18 nt, Human
ggaaaagaauacagaaag

SEQ ID NO: 2139932 - RNA, 22 nt, Human
ggaaaagagcgcaucaggccug

SEQ ID NO: 2139933 - RNA, 14 nt, Human
ggaaaauaaauuau

SEQ ID NO: 2139934 - RNA, 22 nt, Human
ggaaauauuaugcaaauuccca

SEQ ID NO: 2139935 - RNA, 17 nt, Human
ggaacagacuggaagca

SEQ ID NO: 2139936 - RNA, 16 nt, Human
gcuggauuacaggcau

SEQ ID NO: 2139937 - RNA, 15 nt, Human
gcuggcaaagacaga

SEQ ID NO: 2139938 - RNA, 19 nt, Human
gcuggcaaagacagaagcc

SEQ ID NO: 2139939 - RNA, 23 nt, Human
gcuggcacauuuccccagaccug

SEQ ID NO: 2139940 - RNA, 11 nt, Human
gcuggccccuc

SEQ ID NO: 2139941 - RNA, 12 nt, Human
gcuggccccuca

SEQ ID NO: 2139942 - RNA, 14 nt, Human
gcuggccccucacc

SEQ ID NO: 2139943 - RNA, 19 nt, Human
gcuggccccucaccugggc

SEQ ID NO: 2139944 - RNA, 23 nt, Human
gcuggccccucaccugggcaccu

SEQ ID NO: 2139945 - RNA, 12 nt, Human
gcuggcccccac

SEQ ID NO: 2139946 - RNA, 14 nt, Human
gcuggcccccacug

SEQ ID NO: 2139947 - RNA, 15 nt, Human
gcuggcccccacugg

SEQ ID NO: 2139948 - RNA, 17 nt, Human
gcuggcccccacuggcu

SEQ ID NO: 2139949 - RNA, 19 nt, Human
gcuggcccccacuggcugu

SEQ ID NO: 2139950 - RNA, 20 nt, Human
gcuggcccccacuggcugug

SEQ ID NO: 2139951 - RNA, 21 nt, Human
gcuggcccccacuggcugugg

SEQ ID NO: 2139952 - RNA, 22 nt, Human
gcuggcccccacuggcuguggg

SEQ ID NO: 2139953 - RNA, 24 nt, Human
gcuggcccccacuggcugugggcu

SEQ ID NO: 2139954 - RNA, 22 nt, Human
gcuggaccuugaacuggguacu

SEQ ID NO: 2139955 - RNA, 21 nt, Human
gcuggaccuugaacuggguac

SEQ ID NO: 2139956 - RNA, 23 nt, Human
gcugcuuggaccucgugcuuuaa

SEQ ID NO: 2139957 - RNA, 21 nt, Human
gcuggaugcuccuuccaacag

SEQ ID NO: 2139958 - RNA, 22 nt, Human
gcuggaugcuccuuccaacagg

SEQ ID NO: 2139959 - RNA, 18 nt, Human
gcuggaccuugaacuggg

SEQ ID NO: 2139960 - RNA, 21 nt, Human
gcugcuucuuaaccccaguaa

SEQ ID NO: 2139961 - RNA, 16 nt, Human
gcuggaccuugaacug

SEQ ID NO: 2139962 - RNA, 20 nt, Human
gcugggacuacaggcaccca

SEQ ID NO: 2139963 - RNA, 19 nt, Human
gcugggacuacaggcaccc

SEQ ID NO: 2139964 - RNA, 18 nt, Human
gcugggacuacaggcacc

SEQ ID NO: 2139965 - RNA, 13 nt, Human
gcugggacuacag

SEQ ID NO: 2139966 - RNA, 19 nt, Human
gcugggacuacagguguga

SEQ ID NO: 2139967 - RNA, 14 nt, Human
gcugggacuggcca

SEQ ID NO: 2139968 - RNA, 20 nt, Human
gcuggccccucaccugggca

SEQ ID NO: 2139969 - RNA, 15 nt, Human
gcuggccgggcacag

SEQ ID NO: 2139970 - RNA, 17 nt, Human
gcuggccgggcacagcu

SEQ ID NO: 2139971 - RNA, 18 nt, Human
gcuggccgggcacagcug

SEQ ID NO: 2139972 - RNA, 19 nt, Human
gcuggccgggcacagcugu

SEQ ID NO: 2139973 - RNA, 21 nt, Human
gcuggccgggcacagcugugg

SEQ ID NO: 2139974 - RNA, 12 nt, Human
gcuggccucaga

SEQ ID NO: 2139975 - RNA, 13 nt, Human
gcuggccucagac

SEQ ID NO: 2139976 - RNA, 16 nt, Human
gcuggccucagacuca

SEQ ID NO: 2139977 - RNA, 16 nt, Human
gcugccgaccagagcc

SEQ ID NO: 2139978 - RNA, 17 nt, Human
gcugccgaccagagccc

SEQ ID NO: 2139979 - RNA, 23 nt, Human
gcugcccuggugcugccacacuu

SEQ ID NO: 2139980 - RNA, 16 nt, Human
gcugcgguccacccag

SEQ ID NO: 2139981 - RNA, 15 nt, Human
gcugcgauacuggca

SEQ ID NO: 2139982 - RNA, 20 nt, Human
gcugccuuuagucgcugagg

SEQ ID NO: 2139983 - RNA, 14 nt, Human
gcugccgcacccca

SEQ ID NO: 2139984 - RNA, 21 nt, Human
gcuagaggccagccccaccca

SEQ ID NO: 2139985 - RNA, 18 nt, Human
gcuagaggaagcagccaa

SEQ ID NO: 2139986 - RNA, 18 nt, Human
gcuagaggccagccccac

SEQ ID NO: 2139987 - RNA, 19 nt, Human
gcuagaggccagccccacc

SEQ ID NO: 2139988 - RNA, 20 nt, Human
gcuagaggccagccccaccc

SEQ ID NO: 2139989 - RNA, 17 nt, Human
gcuagcaaaagaaguaa

SEQ ID NO: 2139990 - RNA, 22 nt, Human
gcuagcaaaagaaguaacaaga

SEQ ID NO: 2139991 - RNA, 22 nt, Human
gcugcccuggugcugccacacu

SEQ ID NO: 2139992 - RNA, 20 nt, Human
gcugcccuggugcugccaca

SEQ ID NO: 2139993 - RNA, 19 nt, Human
gcugcccuggugcugccac

SEQ ID NO: 2139994 - RNA, 18 nt, Human
gcugcccuggugcugcca

SEQ ID NO: 2139995 - RNA, 22 nt, Human
gcuagcagcagggagggcuucu

SEQ ID NO: 2139996 - RNA, 17 nt, Human
gcuagcacuuggagcca

SEQ ID NO: 2139997 - RNA, 23 nt, Human
gcuagcagaaaucuagaagacug

SEQ ID NO: 2139998 - RNA, 18 nt, Human
gcugcgguccacccagga

SEQ ID NO: 2139999 - RNA, 17 nt, Human
gcugcgguccacccagg

SEQ ID NO: 2140000 - RNA, 19 nt, Human
gcugcgguccacccaggag

SEQ ID NO: 2140001 - RNA, 19 nt, Human
gcugcuagcacuuggagcc

SEQ ID NO: 2140002 - RNA, 20 nt, Human
gcugcuguggccaucaaccu

SEQ ID NO: 2140003 - RNA, 20 nt, Human
gcugcuagcacuuggagcca

SEQ ID NO: 2140004 - RNA, 23 nt, Human
gcugcuagcacuuggagccaagg

SEQ ID NO: 2140005 - RNA, 12 nt, Human
gcugcuucccuc

SEQ ID NO: 2140006 - RNA, 14 nt, Human
gcugcuucccucug

SEQ ID NO: 2140007 - RNA, 15 nt, Human
gcugcuucccucugc

SEQ ID NO: 2140008 - RNA, 20 nt, Human
gcugcuucccucugccuguc

SEQ ID NO: 2140009 - RNA, 21 nt, Human
gcugcuucccucugccugucc

SEQ ID NO: 2140010 - RNA, 22 nt, Human
gcugcuucccucugccuguccc

SEQ ID NO: 2140011 - RNA, 23 nt, Human
gcugcuucccucugccugucccu

SEQ ID NO: 2140012 - RNA, 20 nt, Human
gcuggucccacucaguccau

SEQ ID NO: 2140013 - RNA, 22 nt, Human
gcugggagaagggggucaaagc

SEQ ID NO: 2140014 - RNA, 18 nt, Human
gcuggugucaccugaaga

SEQ ID NO: 2140015 - RNA, 16 nt, Human
gcuggugucaccugaa

SEQ ID NO: 2140016 - RNA, 17 nt, Human
gcugguggcuaauggug

SEQ ID NO: 2140017 - RNA, 21 nt, Human
gcuggugggaagcgucugucc

SEQ ID NO: 2140018 - RNA, 13 nt, Human
gcuggugggcacc

SEQ ID NO: 2140019 - RNA, 15 nt, Human
gcuggugggcaccaa

SEQ ID NO: 2140020 - RNA, 19 nt, Human
gcuggugggcaccaagagc

SEQ ID NO: 2140021 - RNA, 21 nt, Human
gcuggugggcaccaagagcca

SEQ ID NO: 2140022 - RNA, 19 nt, Human
gcuggugggugaaagaaau

SEQ ID NO: 2140023 - RNA, 22 nt, Human
gcugguucaggguuggccccug

SEQ ID NO: 2140024 - RNA, 15 nt, Human
gcugguucaggguug

SEQ ID NO: 2140025 - RNA, 16 nt, Human
gcugugguuccugggg

SEQ ID NO: 2140026 - RNA, 13 nt, Human
gcugugguuuucu

SEQ ID NO: 2140027 - RNA, 14 nt, Human
gcugugguuuucuu

SEQ ID NO: 2140028 - RNA, 15 nt, Human
gcugugguuuucuuu

SEQ ID NO: 2140029 - RNA, 23 nt, Human
gcugugguuuucuuuugccauga

SEQ ID NO: 2140030 - RNA, 22 nt, Human
gcugugguuuucuuuugccaug

SEQ ID NO: 2140031 - RNA, 17 nt, Human
gcuguguccaacuccag

SEQ ID NO: 2140032 - RNA, 18 nt, Human
gcuguguccaacuccagu

SEQ ID NO: 2140033 - RNA, 19 nt, Human
gcuguguccaacuccagua

SEQ ID NO: 2140034 - RNA, 14 nt, Human
gcuguguccuugca

SEQ ID NO: 2140035 - RNA, 18 nt, Human
gcuguguccuugcaccug

SEQ ID NO: 2140036 - RNA, 19 nt, Human
gcuguguccuugcaccugc

SEQ ID NO: 2140037 - RNA, 20 nt, Human
gcuguguccuugcaccugca

SEQ ID NO: 2140038 - RNA, 21 nt, Human
gcuguguccuugcaccugcau

SEQ ID NO: 2140039 - RNA, 20 nt, Human
gcugucuucucaggcucugc

SEQ ID NO: 2140040 - RNA, 22 nt, Human
gcugucuucucaggcucugccc

SEQ ID NO: 2140041 - RNA, 17 nt, Human
gcugucuccauguuuga

SEQ ID NO: 2140042 - RNA, 15 nt, Human
gcugucccugucacc

SEQ ID NO: 2140043 - RNA, 18 nt, Human
gcugucccugucaccaag

SEQ ID NO: 2140044 - RNA, 14 nt, Human
gcugucccugucac

SEQ ID NO: 2140045 - RNA, 17 nt, Human
gcugggcuucaguggca

SEQ ID NO: 2140046 - RNA, 15 nt, Human
gcugggagcucugca

SEQ ID NO: 2140047 - RNA, 16 nt, Human
gcugggagcucugcag

SEQ ID NO: 2140048 - RNA, 15 nt, Human
gcugggacuggccag

SEQ ID NO: 2140049 - RNA, 16 nt, Human
gcugggacuggccagg

SEQ ID NO: 2140050 - RNA, 20 nt, Human
gcugggggcagccugcgugg

SEQ ID NO: 2140051 - RNA, 21 nt, Human
gcugggggcagccugcguggc

SEQ ID NO: 2140052 - RNA, 22 nt, Human
gcugggggcagccugcguggcu

SEQ ID NO: 2140053 - RNA, 13 nt, Human
gcugggggcagga

SEQ ID NO: 2140054 - RNA, 20 nt, Human
gcugggggcaggagggcccu

SEQ ID NO: 2140055 - RNA, 23 nt, Human
gcugggggcaggagggcccuacc

SEQ ID NO: 2140056 - RNA, 16 nt, Human
gcugggggccaugagc

SEQ ID NO: 2140057 - RNA, 23 nt, Human
gcugggggccaugagcuccagac

SEQ ID NO: 2140058 - RNA, 20 nt, Human
gcugggggccucagugccac

SEQ ID NO: 2140059 - RNA, 19 nt, Human
gcugggggccucagugcca

SEQ ID NO: 2140060 - RNA, 19 nt, Human
gcuggucccacucagucca

SEQ ID NO: 2140061 - RNA, 15 nt, Human
gcuggucccacucag

SEQ ID NO: 2140062 - RNA, 13 nt, Human
gcugggggccuca

SEQ ID NO: 2140063 - RNA, 19 nt, Human
gcugggcuucaguggcagc

SEQ ID NO: 2140064 - RNA, 18 nt, Human
gcugggcuucaguggcag

SEQ ID NO: 2140065 - RNA, 23 nt, Human
gcugggggaagaagcucucuccu

SEQ ID NO: 2140066 - RNA, 12 nt, Human
ggccaaguucuu

SEQ ID NO: 2140067 - RNA, 14 nt, Human
ggccaccugccccc

SEQ ID NO: 2140068 - RNA, 22 nt, Human
ggccaccugcccccuucuccca

SEQ ID NO: 2140069 - RNA, 23 nt, Human
ggcauguucucugaggacacuaa

SEQ ID NO: 2140070 - RNA, 16 nt, Human
ggcagugcagcaacca

SEQ ID NO: 2140071 - RNA, 21 nt, Human
ggcagugcagcaaccagagca

SEQ ID NO: 2140072 - RNA, 22 nt, Human
ggcagugcagcaaccagagcac

SEQ ID NO: 2140073 - RNA, 18 nt, Human
ggcagugaugcuggaugc

SEQ ID NO: 2140074 - RNA, 17 nt, Human
ggcagugcgggaggaau

SEQ ID NO: 2140075 - RNA, 15 nt, Human
ggcagguuggugggg

SEQ ID NO: 2140076 - RNA, 12 nt, Human
ggcaggugggag

SEQ ID NO: 2140077 - RNA, 16 nt, Human
ggcaggugggagcuug

SEQ ID NO: 2140078 - RNA, 17 nt, Human
ggcaggugggagcuuga

SEQ ID NO: 2140079 - RNA, 13 nt, Human
ggcagucuggagg

SEQ ID NO: 2140080 - RNA, 14 nt, Human
ggcagucuggaggg

SEQ ID NO: 2140081 - RNA, 16 nt, Human
ggcagucuggaggggc

SEQ ID NO: 2140082 - RNA, 21 nt, Human
ggcagucuggaggggcauggc

SEQ ID NO: 2140083 - RNA, 11 nt, Human
ggccacuguga

SEQ ID NO: 2140084 - RNA, 22 nt, Human
ggccacucugccucugccugca

SEQ ID NO: 2140085 - RNA, 23 nt, Human
ggccaccugcccccuucucccac

SEQ ID NO: 2140086 - RNA, 16 nt, Human
ggccacucugccucug

SEQ ID NO: 2140087 - RNA, 20 nt, Human
ggccacucugccucugccug

SEQ ID NO: 2140088 - RNA, 21 nt, Human
ggccacucugccucugccugc

SEQ ID NO: 2140089 - RNA, 23 nt, Human
ggccaggaguuuaagaccagccu

SEQ ID NO: 2140090 - RNA, 19 nt, Human
ggccaggaguuugagacca

SEQ ID NO: 2140091 - RNA, 13 nt, Human
ggccaggagcucu

SEQ ID NO: 2140092 - RNA, 16 nt, Human
ggccacugugaagaga

SEQ ID NO: 2140093 - RNA, 11 nt, Human
ggccaggcugg

SEQ ID NO: 2140094 - RNA, 16 nt, Human
ggccaggccagaggga

SEQ ID NO: 2140095 - RNA, 14 nt, Human
ggccaggccagagg

SEQ ID NO: 2140096 - RNA, 22 nt, Human
ggccaggcagaucugugcccca

SEQ ID NO: 2140097 - RNA, 16 nt, Human
ggccaggauggagggg

SEQ ID NO: 2140098 - RNA, 15 nt, Human
ggccaggcagaucug

SEQ ID NO: 2140099 - RNA, 15 nt, Human
ggccaggagcucuuc

SEQ ID NO: 2140100 - RNA, 20 nt, Human
ggccaggaguuugagaccag

SEQ ID NO: 2140101 - RNA, 12 nt, Human
ggcccccacugg

SEQ ID NO: 2140102 - RNA, 16 nt, Human
ggcccccacuggcugu

SEQ ID NO: 2140103 - RNA, 17 nt, Human
ggcccccacuggcugug

SEQ ID NO: 2140104 - RNA, 18 nt, Human
ggcccccacuggcugugg

SEQ ID NO: 2140105 - RNA, 13 nt, Human
ggccaugggccuc

SEQ ID NO: 2140106 - RNA, 13 nt, Human
ggccauggcagaa

SEQ ID NO: 2140107 - RNA, 12 nt, Human
ggccaggcuggu

SEQ ID NO: 2140108 - RNA, 21 nt, Human
ggccccgcuuguccagcgccu

SEQ ID NO: 2140109 - RNA, 19 nt, Human
ggccccgcuuguccagcgc

SEQ ID NO: 2140110 - RNA, 15 nt, Human
ggcccccagcugugg

SEQ ID NO: 2140111 - RNA, 12 nt, Human
ggcccccagcug

SEQ ID NO: 2140112 - RNA, 13 nt, Human
ggcccccgagcug

SEQ ID NO: 2140113 - RNA, 15 nt, Human
ggcccccgagcuggg

SEQ ID NO: 2140114 - RNA, 12 nt, Human
ggccccugccac

SEQ ID NO: 2140115 - RNA, 16 nt, Human
ggccccugccacccug

SEQ ID NO: 2140116 - RNA, 13 nt, Human
ggccccugccacc

SEQ ID NO: 2140117 - RNA, 13 nt, Human
ggccccugcccgg

SEQ ID NO: 2140118 - RNA, 18 nt, Human
ggccccugccacccuggg

SEQ ID NO: 2140119 - RNA, 17 nt, Human
ggccccugccacccugg

SEQ ID NO: 2140120 - RNA, 14 nt, Human
ggccccucccuacc

SEQ ID NO: 2140121 - RNA, 16 nt, Human
ggccccucccuaccuc

SEQ ID NO: 2140122 - RNA, 17 nt, Human
ggccccucccuaccuca

SEQ ID NO: 2140123 - RNA, 20 nt, Human
ggccccucccuaccucaacc

SEQ ID NO: 2140124 - RNA, 21 nt, Human
ggccccucccuaccucaaccu

SEQ ID NO: 2140125 - RNA, 24 nt, Human
ggccccucugacucccaaagagcu

SEQ ID NO: 2140126 - RNA, 22 nt, Human
ggcaccuauagucccagcuacu

SEQ ID NO: 2140127 - RNA, 23 nt, Human
ggcaccuccuacgucaaacauga

SEQ ID NO: 2140128 - RNA, 17 nt, Human
ggcaccuauaaaacagg

SEQ ID NO: 2140129 - RNA, 18 nt, Human
ggagugaggcaggugaca

SEQ ID NO: 2140130 - RNA, 18 nt, Human
ggcaccuauagucccagc

SEQ ID NO: 2140131 - RNA, 19 nt, Human
ggcaccuauagucccagcu

SEQ ID NO: 2140132 - RNA, 16 nt, Human
ggcacccggccccugc

SEQ ID NO: 2140133 - RNA, 15 nt, Human
ggcacccggccccug

SEQ ID NO: 2140134 - RNA, 17 nt, Human
ggcacccggccccugcu

SEQ ID NO: 2140135 - RNA, 23 nt, Human
ggcaagucccugacucucuguga

SEQ ID NO: 2140136 - RNA, 15 nt, Human
ggcaaggggugccug

SEQ ID NO: 2140137 - RNA, 17 nt, Human
ggcaaggggugccuggg

SEQ ID NO: 2140138 - RNA, 22 nt, Human
ggcaagucccugacucucugug

SEQ ID NO: 2140139 - RNA, 19 nt, Human
ggcaacccccagccugcua

SEQ ID NO: 2140140 - RNA, 21 nt, Human
ggaucagucugauucccaagc

SEQ ID NO: 2140141 - RNA, 16 nt, Human
ggcaacgcacaaaaca

SEQ ID NO: 2140142 - RNA, 15 nt, Human
ggcaacgaagaaaaa

SEQ ID NO: 2140143 - RNA, 16 nt, Human
ggcaacgaagaaaaaa

SEQ ID NO: 2140144 - RNA, 17 nt, Human
ggcaacgaagaaaaaaa

SEQ ID NO: 2140145 - RNA, 20 nt, Human
ggcaacgaagaaaaaaaaua

SEQ ID NO: 2140146 - RNA, 15 nt, Human
ggcaaccuugucucu

SEQ ID NO: 2140147 - RNA, 19 nt, Human
ggcaaccuugucucuaugc

SEQ ID NO: 2140148 - RNA, 18 nt, Human
ggcaacugcauuggcuuu

SEQ ID NO: 2140149 - RNA, 14 nt, Human
ggcaacugaacaaa

SEQ ID NO: 2140150 - RNA, 16 nt, Human
ggcaacugaacaaaaa

SEQ ID NO: 2140151 - RNA, 19 nt, Human
ggcaacugaacaaaaaaau

SEQ ID NO: 2140152 - RNA, 13 nt, Human
ggcaacugaggca

SEQ ID NO: 2140153 - RNA, 14 nt, Human
ggcaacugaggcag

SEQ ID NO: 2140154 - RNA, 15 nt, Human
ggcaacugaggcaga

SEQ ID NO: 2140155 - RNA, 23 nt, Human
ggcaacuugggaacuagacuccc

SEQ ID NO: 2140156 - RNA, 18 nt, Human
ggcaacuugggaacuaga

SEQ ID NO: 2140157 - RNA, 19 nt, Human
ggcaacugcauuggcuuug

SEQ ID NO: 2140158 - RNA, 19 nt, Human
ggcaacugaggcagacagc

SEQ ID NO: 2140159 - RNA, 20 nt, Human
ggcaacugaggcagacagca

SEQ ID NO: 2140160 - RNA, 23 nt, Human
ggcaacugaggcagacagcagcu

SEQ ID NO: 2140161 - RNA, 13 nt, Human
ggcaacugcugau

SEQ ID NO: 2140162 - RNA, 22 nt, Human
ggcaacugcugaugcucauggu

SEQ ID NO: 2140163 - RNA, 23 nt, Human
ggcagauacaggaaaagcugcug

SEQ ID NO: 2140164 - RNA, 15 nt, Human
ggcagauaaucagcc

SEQ ID NO: 2140165 - RNA, 18 nt, Human
ggcagauaaucagccucu

SEQ ID NO: 2140166 - RNA, 19 nt, Human
ggcagauaaucagccucuu

SEQ ID NO: 2140167 - RNA, 20 nt, Human
ggcagauaaucagccucuua

SEQ ID NO: 2140168 - RNA, 12 nt, Human
ggcagaggcugg

SEQ ID NO: 2140169 - RNA, 13 nt, Human
ggcagaggcugga

SEQ ID NO: 2140170 - RNA, 19 nt, Human
ggcagaggcuggaggcagg

SEQ ID NO: 2140171 - RNA, 21 nt, Human
ggcagcacagagacccccgga

SEQ ID NO: 2140172 - RNA, 14 nt, Human
ggcagcacagagac

SEQ ID NO: 2140173 - RNA, 24 nt, Human
ggcagauuuagugaaagcuagaga

SEQ ID NO: 2140174 - RNA, 20 nt, Human
ggcagaucugugccccaugc

SEQ ID NO: 2140175 - RNA, 16 nt, Human
ggcagauuuuacaaaa

SEQ ID NO: 2140176 - RNA, 21 nt, Human
ggcagauuuuacaaaagaugu

SEQ ID NO: 2140177 - RNA, 13 nt, Human
ggcagauugaaaa

SEQ ID NO: 2140178 - RNA, 18 nt, Human
ggcagaucaccagagguc

SEQ ID NO: 2140179 - RNA, 15 nt, Human
ggcagaucugugccc

SEQ ID NO: 2140180 - RNA, 16 nt, Human
ggcagaucugugcccc

SEQ ID NO: 2140181 - RNA, 17 nt, Human
ggcagaucugugcccca

SEQ ID NO: 2140182 - RNA, 18 nt, Human
ggcagaucugugccccau

SEQ ID NO: 2140183 - RNA, 14 nt, Human
ggcaggaaggcuga

SEQ ID NO: 2140184 - RNA, 23 nt, Human
ggcaggaaggagagccugcugca

SEQ ID NO: 2140185 - RNA, 13 nt, Human
ggcagguccaggg

SEQ ID NO: 2140186 - RNA, 15 nt, Human
ggcaggaaggagagc

SEQ ID NO: 2140187 - RNA, 16 nt, Human
ggcaggaaggagagcc

SEQ ID NO: 2140188 - RNA, 23 nt, Human
ggcaggucuugaacuccuggccu

SEQ ID NO: 2140189 - RNA, 16 nt, Human
ggcaggugacagugag

SEQ ID NO: 2140190 - RNA, 17 nt, Human
ggcaggugacagugagg

SEQ ID NO: 2140191 - RNA, 19 nt, Human
ggcaggugacagugagguc

SEQ ID NO: 2140192 - RNA, 21 nt, Human
ggcaggugacagugagguccu

SEQ ID NO: 2140193 - RNA, 16 nt, Human
ggcaggugaccuucug

SEQ ID NO: 2140194 - RNA, 19 nt, Human
ggcagcugcgguccaccca

SEQ ID NO: 2140195 - RNA, 21 nt, Human
ggcagcuugaggguugggcug

SEQ ID NO: 2140196 - RNA, 20 nt, Human
ggagauggaaguugcaguga

SEQ ID NO: 2140197 - RNA, 20 nt, Human
ggagagggucuggagaagca

SEQ ID NO: 2140198 - RNA, 21 nt, Human
ggagagggucuggagaagcag

SEQ ID NO: 2140199 - RNA, 14 nt, Human
ggagagggucugga

SEQ ID NO: 2140200 - RNA, 17 nt, Human
ggagagggucuggagaa

SEQ ID NO: 2140201 - RNA, 18 nt, Human
ggagagggucuggagaag

SEQ ID NO: 2140202 - RNA, 15 nt, Human
ggagaggggcacagg

SEQ ID NO: 2140203 - RNA, 24 nt, Human
ggagagggaugaggugcugggagg

SEQ ID NO: 2140204 - RNA, 14 nt, Human
ggagaggggcagaa

SEQ ID NO: 2140205 - RNA, 17 nt, Human
ggagauuggacggccug

SEQ ID NO: 2140206 - RNA, 14 nt, Human
ggagauucagacug

SEQ ID NO: 2140207 - RNA, 18 nt, Human
ggagaugggccuuuugga

SEQ ID NO: 2140208 - RNA, 13 nt, Human
ggagauggggaga

SEQ ID NO: 2140209 - RNA, 16 nt, Human
ggagauggggagaaac

SEQ ID NO: 2140210 - RNA, 17 nt, Human
ggagauggggagaaacc

SEQ ID NO: 2140211 - RNA, 13 nt, Human
ggagauguaagag

SEQ ID NO: 2140212 - RNA, 14 nt, Human
ggagauguaagagc

SEQ ID NO: 2140213 - RNA, 16 nt, Human
ggagauguagcaaaac

SEQ ID NO: 2140214 - RNA, 20 nt, Human
ggagcccgcacccccacccu

SEQ ID NO: 2140215 - RNA, 21 nt, Human
ggagcccgcacccccacccuu

SEQ ID NO: 2140216 - RNA, 21 nt, Human
ggagcccgaggcaccaguguc

SEQ ID NO: 2140217 - RNA, 14 nt, Human
ggagcccgcacccc

SEQ ID NO: 2140218 - RNA, 16 nt, Human
ggagcccgcaccccca

SEQ ID NO: 2140219 - RNA, 18 nt, Human
ggagcccgcacccccacc

SEQ ID NO: 2140220 - RNA, 20 nt, Human
ggagcaaaaucgaugcagug

SEQ ID NO: 2140221 - RNA, 17 nt, Human
ggagagcuagcagcagg

SEQ ID NO: 2140222 - RNA, 21 nt, Human
ggagagcuagcagcagggagg

SEQ ID NO: 2140223 - RNA, 10 nt, Human
ggagacuaga

SEQ ID NO: 2140224 - RNA, 14 nt, Human
ggagagggaugagg

SEQ ID NO: 2140225 - RNA, 21 nt, Human
ggagagggaugaggugcuggg

SEQ ID NO: 2140226 - RNA, 19 nt, Human
ggagagggacagcccacug

SEQ ID NO: 2140227 - RNA, 22 nt, Human
ggagagggacagcccacugaga

SEQ ID NO: 2140228 - RNA, 15 nt, Human
ggagagcuggugccc

SEQ ID NO: 2140229 - RNA, 17 nt, Human
ggagagcuggugcccgg

SEQ ID NO: 2140230 - RNA, 18 nt, Human
ggagagcuggugcccgga

SEQ ID NO: 2140231 - RNA, 23 nt, Human
ggagagggaaacgugcccucugu

SEQ ID NO: 2140232 - RNA, 22 nt, Human
ggagacuagauuuaugaauaca

SEQ ID NO: 2140233 - RNA, 14 nt, Human
ggagacuagauugc

SEQ ID NO: 2140234 - RNA, 19 nt, Human
ggagacuagauugccuuug

SEQ ID NO: 2140235 - RNA, 20 nt, Human
ggacugucuuucagauacau

SEQ ID NO: 2140236 - RNA, 19 nt, Human
ggacugguggccccugccu

SEQ ID NO: 2140237 - RNA, 13 nt, Human
ggacuguacacac

SEQ ID NO: 2140238 - RNA, 19 nt, Human
ggacuguacacacuuuauu

SEQ ID NO: 2140239 - RNA, 22 nt, Human
ggacuguacacacuuuauuuac

SEQ ID NO: 2140240 - RNA, 18 nt, Human
ggacugccccgugcagac

SEQ ID NO: 2140241 - RNA, 21 nt, Human
ggacugccagucccccugccc

SEQ ID NO: 2140242 - RNA, 21 nt, Human
ggacugccccgugcagacugg

SEQ ID NO: 2140243 - RNA, 20 nt, Human
ggacuggguugcguccugac

SEQ ID NO: 2140244 - RNA, 10 nt, Human
ggacugcaug

SEQ ID NO: 2140245 - RNA, 19 nt, Human
ggacugcaugguaauuuau

SEQ ID NO: 2140246 - RNA, 11 nt, Human
ggacucugccu

SEQ ID NO: 2140247 - RNA, 11 nt, Human
ggacucucccc

SEQ ID NO: 2140248 - RNA, 21 nt, Human
ggacucugaggcucuuucugg

SEQ ID NO: 2140249 - RNA, 11 nt, Human
ggacucugagg

SEQ ID NO: 2140250 - RNA, 13 nt, Human
ggacucugaggcu

SEQ ID NO: 2140251 - RNA, 12 nt, Human
ggacuccucugu

SEQ ID NO: 2140252 - RNA, 14 nt, Human
ggacuccucugucc

SEQ ID NO: 2140253 - RNA, 15 nt, Human
ggacuccucugucca

SEQ ID NO: 2140254 - RNA, 15 nt, Human
ggaccuuaucugugc

SEQ ID NO: 2140255 - RNA, 22 nt, Human
ggaccuuaucugugcgugaaac

SEQ ID NO: 2140256 - RNA, 12 nt, Human
ggaccucugggc

SEQ ID NO: 2140257 - RNA, 14 nt, Human
ggaccucugggcuu

SEQ ID NO: 2140258 - RNA, 14 nt, Human
ggaaggagagccug

SEQ ID NO: 2140259 - RNA, 15 nt, Human
ggaaggagagccugc

SEQ ID NO: 2140260 - RNA, 16 nt, Human
ggaaggagagccugcu

SEQ ID NO: 2140261 - RNA, 17 nt, Human
ggaaggagagccugcug

SEQ ID NO: 2140262 - RNA, 21 nt, Human
ggaagccacccucccagcucu

SEQ ID NO: 2140263 - RNA, 22 nt, Human
ggaagccacccucccagcucug

SEQ ID NO: 2140264 - RNA, 23 nt, Human
ggaagccacccucccagcucuga

SEQ ID NO: 2140265 - RNA, 14 nt, Human
ggaccaggacagga

SEQ ID NO: 2140266 - RNA, 13 nt, Human
ggaaggagggagg

SEQ ID NO: 2140267 - RNA, 20 nt, Human
ggaaggaggguuagggaggg

SEQ ID NO: 2140268 - RNA, 16 nt, Human
ggaccucgugcuuuaa

SEQ ID NO: 2140269 - RNA, 19 nt, Human
ggacccaucacgccugugc

SEQ ID NO: 2140270 - RNA, 17 nt, Human
ggaccaggacucccucc

SEQ ID NO: 2140271 - RNA, 17 nt, Human
ggaccaggacaggacca

SEQ ID NO: 2140272 - RNA, 15 nt, Human
ggaccaggacucccu

SEQ ID NO: 2140273 - RNA, 14 nt, Human
ggacccagggauga

SEQ ID NO: 2140274 - RNA, 21 nt, Human
ggaggacugccccgugcagac

SEQ ID NO: 2140275 - RNA, 11 nt, Human
ggaggagagcc

SEQ ID NO: 2140276 - RNA, 14 nt, Human
ggaggagagccugg

SEQ ID NO: 2140277 - RNA, 15 nt, Human
ggaggagagccuggu

SEQ ID NO: 2140278 - RNA, 21 nt, Human
ggagccgagaucacgccacug

SEQ ID NO: 2140279 - RNA, 13 nt, Human
ggagcccuugggu

SEQ ID NO: 2140280 - RNA, 13 nt, Human
ggaggaggaggca

SEQ ID NO: 2140281 - RNA, 14 nt, Human
ggaggaggaggcaa

SEQ ID NO: 2140282 - RNA, 17 nt, Human
ggaggagcuugggggau

SEQ ID NO: 2140283 - RNA, 19 nt, Human
ggaggagggcggggggcac

SEQ ID NO: 2140284 - RNA, 20 nt, Human
ggaggagguggcagcccugu

SEQ ID NO: 2140285 - RNA, 23 nt, Human
ggaggagguuuaggucaagaaga

SEQ ID NO: 2140286 - RNA, 16 nt, Human
ggaggaucacuggagc

SEQ ID NO: 2140287 - RNA, 17 nt, Human
ggaggaucacuggagcc

SEQ ID NO: 2140288 - RNA, 19 nt, Human
ggaggaucacuggagccca

SEQ ID NO: 2140289 - RNA, 20 nt, Human
ggaggaucacuggagcccag

SEQ ID NO: 2140290 - RNA, 21 nt, Human
ggaggaucacuggagcccagg

SEQ ID NO: 2140291 - RNA, 15 nt, Human
ggaggauguucuggg

SEQ ID NO: 2140292 - RNA, 14 nt, Human
ggaggauggagaga

SEQ ID NO: 2140293 - RNA, 21 nt, Human
ggaggauggagagaggggaau

SEQ ID NO: 2140294 - RNA, 15 nt, Human
ggagggaauugaggu

SEQ ID NO: 2140295 - RNA, 17 nt, Human
ggagggaauugaggucu

SEQ ID NO: 2140296 - RNA, 19 nt, Human
ggagggaauugaggucugc

SEQ ID NO: 2140297 - RNA, 23 nt, Human
ggaggaucacuugaguccagaag

SEQ ID NO: 2140298 - RNA, 17 nt, Human
ggaggaucucuugagcc

SEQ ID NO: 2140299 - RNA, 21 nt, Human
ggaggaucucuugagccuggg

SEQ ID NO: 2140300 - RNA, 20 nt, Human
ggaggaucuuuugaacccag

SEQ ID NO: 2140301 - RNA, 12 nt, Human
ggaggauggaga

SEQ ID NO: 2140302 - RNA, 13 nt, Human
ggaggauggagag

SEQ ID NO: 2140303 - RNA, 22 nt, Human
ggaggaucacuggagcccagga

SEQ ID NO: 2140304 - RNA, 13 nt, Human
ggagggagaugga

SEQ ID NO: 2140305 - RNA, 14 nt, Human
ggagugagcugguu

SEQ ID NO: 2140306 - RNA, 12 nt, Human
ggagugagcugg

SEQ ID NO: 2140307 - RNA, 21 nt, Human
ggagugacagaggcagcccca

SEQ ID NO: 2140308 - RNA, 19 nt, Human
ggagugacagaggcagccc

SEQ ID NO: 2140309 - RNA, 18 nt, Human
ggagugacagaggcagcc

SEQ ID NO: 2140310 - RNA, 17 nt, Human
ggagugacagaggcagc

SEQ ID NO: 2140311 - RNA, 16 nt, Human
ggaucacagccucuga

SEQ ID NO: 2140312 - RNA, 13 nt, Human
ggaucacagggcc

SEQ ID NO: 2140313 - RNA, 14 nt, Human
ggaucacagggccc

SEQ ID NO: 2140314 - RNA, 17 nt, Human
ggaucacagggccccag

SEQ ID NO: 2140315 - RNA, 13 nt, Human
ggaucacuggagc

SEQ ID NO: 2140316 - RNA, 17 nt, Human
ggaucagaacagcagag

SEQ ID NO: 2140317 - RNA, 17 nt, Human
ggaucacuugagcccag

SEQ ID NO: 2140318 - RNA, 22 nt, Human
ggaucagaaagaguucaguaag

SEQ ID NO: 2140319 - RNA, 12 nt, Human
ggaucagaaagu

SEQ ID NO: 2140320 - RNA, 16 nt, Human
ggaucagaacagcaga

SEQ ID NO: 2140321 - RNA, 14 nt, Human
ggaucacuggagcc

SEQ ID NO: 2140322 - RNA, 17 nt, Human
ggaucacuggagcccag

SEQ ID NO: 2140323 - RNA, 18 nt, Human
ggaucacuggagcccagg

SEQ ID NO: 2140324 - RNA, 19 nt, Human
ggaucacuggagcccagga

SEQ ID NO: 2140325 - RNA, 21 nt, Human
ggagugaguguggcuccccuc

SEQ ID NO: 2140326 - RNA, 16 nt, Human
ggagucccaaggaaag

SEQ ID NO: 2140327 - RNA, 17 nt, Human
ggagucccaaggaaagc

SEQ ID NO: 2140328 - RNA, 17 nt, Human
ggagucaucucaaccau

SEQ ID NO: 2140329 - RNA, 23 nt, Human
ggagucaucucaaccauccccuc

SEQ ID NO: 2140330 - RNA, 13 nt, Human
ggaggggacgcug

SEQ ID NO: 2140331 - RNA, 20 nt, Human
ggaggggacuauuuaugaag

SEQ ID NO: 2140332 - RNA, 21 nt, Human
ggaggggacuauuuaugaagg

SEQ ID NO: 2140333 - RNA, 21 nt, Human
ggagucccaccuuggcugcag

SEQ ID NO: 2140334 - RNA, 20 nt, Human
ggagucccaccuuggcugca

SEQ ID NO: 2140335 - RNA, 16 nt, Human
ggagucccgucaggac

SEQ ID NO: 2140336 - RNA, 14 nt, Human
ggagucugaagcag

SEQ ID NO: 2140337 - RNA, 15 nt, Human
ggagucugaagcaga

SEQ ID NO: 2140338 - RNA, 16 nt, Human
ggagugacagaggcag

SEQ ID NO: 2140339 - RNA, 11 nt, Human
ggagugacaga

SEQ ID NO: 2140340 - RNA, 17 nt, Human
uauaaauuuuuuuuguu

SEQ ID NO: 2140341 - RNA, 21 nt, Human
uauaaauuuuuuuuguuucau

SEQ ID NO: 2140342 - RNA, 20 nt, Human
uauaaaucaaugucacuuaa

SEQ ID NO: 2140343 - RNA, 16 nt, Human
uauaaaucaaugucac

SEQ ID NO: 2140344 - RNA, 20 nt, Human
uauaaugaaugaaacauuuu

SEQ ID NO: 2140345 - RNA, 18 nt, Human
uauaaugaaugaaacauu

SEQ ID NO: 2140346 - RNA, 15 nt, Human
uauaaaucaauguca

SEQ ID NO: 2140347 - RNA, 14 nt, Human
uaguuuuaguugca

SEQ ID NO: 2140348 - RNA, 16 nt, Human
uaguuuuaguugcaga

SEQ ID NO: 2140349 - RNA, 17 nt, Human
uaguuuuaguugcagaa

SEQ ID NO: 2140350 - RNA, 13 nt, Human
uauaauucccuau

SEQ ID NO: 2140351 - RNA, 20 nt, Human
uauaccccgugaagcaucca

SEQ ID NO: 2140352 - RNA, 21 nt, Human
uauaccccgugaagcauccag

SEQ ID NO: 2140353 - RNA, 22 nt, Human
uauaccccgugaagcauccagg

SEQ ID NO: 2140354 - RNA, 19 nt, Human
uauaccccuuacuuagcau

SEQ ID NO: 2140355 - RNA, 22 nt, Human
uauaccccuuacuuagcaugca

SEQ ID NO: 2140356 - RNA, 15 nt, Human
uauaaugguugacug

SEQ ID NO: 2140357 - RNA, 15 nt, Human
uauaaugcuggagcg

SEQ ID NO: 2140358 - RNA, 14 nt, Human
uauaauguaagcuc

SEQ ID NO: 2140359 - RNA, 19 nt, Human
uauaauguaagcucuacug

SEQ ID NO: 2140360 - RNA, 20 nt, Human
uauaauguaagcucuacuga

SEQ ID NO: 2140361 - RNA, 17 nt, Human
uauaauucuacuuugag

SEQ ID NO: 2140362 - RNA, 18 nt, Human
uagugaugguuccccugu

SEQ ID NO: 2140363 - RNA, 14 nt, Human
uagugaugguuccc

SEQ ID NO: 2140364 - RNA, 21 nt, Human
uagugcuuaaaaaucauugau

SEQ ID NO: 2140365 - RNA, 19 nt, Human
uagugcugaagcuuauuaa

SEQ ID NO: 2140366 - RNA, 17 nt, Human
uagugcugaagcuuauu

SEQ ID NO: 2140367 - RNA, 18 nt, Human
uagugcugaagcuuauua

SEQ ID NO: 2140368 - RNA, 22 nt, Human
uagugcugaagcuuauuaaugc

SEQ ID NO: 2140369 - RNA, 12 nt, Human
uagugcugaagc

SEQ ID NO: 2140370 - RNA, 14 nt, Human
uagugcugaagcuu

SEQ ID NO: 2140371 - RNA, 15 nt, Human
uagugcugaagcuua

SEQ ID NO: 2140372 - RNA, 15 nt, Human
uagucaagauugugu

SEQ ID NO: 2140373 - RNA, 13 nt, Human
uagugaugguucc

SEQ ID NO: 2140374 - RNA, 16 nt, Human
uaggcgggaaggaggg

SEQ ID NO: 2140375 - RNA, 16 nt, Human
uaggcgugagaagcau

SEQ ID NO: 2140376 - RNA, 14 nt, Human
uaguguaggcuuua

SEQ ID NO: 2140377 - RNA, 15 nt, Human
uaguguaggcuuuac

SEQ ID NO: 2140378 - RNA, 18 nt, Human
uaguguaggcuuuacuua

SEQ ID NO: 2140379 - RNA, 21 nt, Human
uaguguaggcuuuacuuagcu

SEQ ID NO: 2140380 - RNA, 23 nt, Human
uaguguaggcuuuacuuagcuua

SEQ ID NO: 2140381 - RNA, 16 nt, Human
uaguugcuccgccucu

SEQ ID NO: 2140382 - RNA, 17 nt, Human
uagugucacuuaccuag

SEQ ID NO: 2140383 - RNA, 15 nt, Human
uaguugcuccgccuc

SEQ ID NO: 2140384 - RNA, 13 nt, Human
uagugguggcucu

SEQ ID NO: 2140385 - RNA, 17 nt, Human
uagugguggcucugaga

SEQ ID NO: 2140386 - RNA, 14 nt, Human
uagugguguuuuaa

SEQ ID NO: 2140387 - RNA, 22 nt, Human
uagugguguuuuaaagagaaug

SEQ ID NO: 2140388 - RNA, 18 nt, Human
uagugguucuuggaaaaa

SEQ ID NO: 2140389 - RNA, 13 nt, Human
uaguguaaaaaug

SEQ ID NO: 2140390 - RNA, 14 nt, Human
uaguguaaaaauga

SEQ ID NO: 2140391 - RNA, 16 nt, Human
uaguguaaaaaugaga

SEQ ID NO: 2140392 - RNA, 17 nt, Human
uaguguaaaaaugagaa

SEQ ID NO: 2140393 - RNA, 18 nt, Human
uaguguaaaaaugagaac

SEQ ID NO: 2140394 - RNA, 22 nt, Human
uaguguaaaaaugagaacaugu

SEQ ID NO: 2140395 - RNA, 15 nt, Human
uaguggauguucuga

SEQ ID NO: 2140396 - RNA, 12 nt, Human
uaguuugcaguu

SEQ ID NO: 2140397 - RNA, 18 nt, Human
uaguuuauacaguuuuaa

SEQ ID NO: 2140398 - RNA, 21 nt, Human
uaguuuauacaguuuuaaaga

SEQ ID NO: 2140399 - RNA, 18 nt, Human
uaguuguguacucuggcc

SEQ ID NO: 2140400 - RNA, 15 nt, Human
uaguuuacuauuuua

SEQ ID NO: 2140401 - RNA, 22 nt, Human
uauccugcuucugauaugcagu

SEQ ID NO: 2140402 - RNA, 17 nt, Human
uauccuggcuuugccca

SEQ ID NO: 2140403 - RNA, 19 nt, Human
uauccuggcuuugcccaac

SEQ ID NO: 2140404 - RNA, 21 nt, Human
uauccuggcuuugcccaaccu

SEQ ID NO: 2140405 - RNA, 21 nt, Human
uaucaugucaaacgugaaaau

SEQ ID NO: 2140406 - RNA, 18 nt, Human
uauccugccaaaaucauu

SEQ ID NO: 2140407 - RNA, 10 nt, Human
uauccugccc

SEQ ID NO: 2140408 - RNA, 15 nt, Human
uauccugcccagugu

SEQ ID NO: 2140409 - RNA, 16 nt, Human
uauccugcccaguguu

SEQ ID NO: 2140410 - RNA, 17 nt, Human
uaucgccuuuugacagc

SEQ ID NO: 2140411 - RNA, 16 nt, Human
uaucgaucucuuauuu

SEQ ID NO: 2140412 - RNA, 16 nt, Human
uaucggagacagugau

SEQ ID NO: 2140413 - RNA, 14 nt, Human
uaucggaagcagug

SEQ ID NO: 2140414 - RNA, 15 nt, Human
uaucggaagcagugc

SEQ ID NO: 2140415 - RNA, 15 nt, Human
uaucuaaauguugaa

SEQ ID NO: 2140416 - RNA, 16 nt, Human
uaucgggaacaguguu

SEQ ID NO: 2140417 - RNA, 14 nt, Human
uaucgggaacagug

SEQ ID NO: 2140418 - RNA, 22 nt, Human
uaucucuuuugaauccaugcuu

SEQ ID NO: 2140419 - RNA, 16 nt, Human
uaucaugucaaacgug

SEQ ID NO: 2140420 - RNA, 15 nt, Human
uaucaguuacucagc

SEQ ID NO: 2140421 - RNA, 20 nt, Human
uaucagugacagaguucacu

SEQ ID NO: 2140422 - RNA, 22 nt, Human
uaucagugacagaguucacuau

SEQ ID NO: 2140423 - RNA, 15 nt, Human
uaucagugacagagu

SEQ ID NO: 2140424 - RNA, 16 nt, Human
uaucagugacagaguu

SEQ ID NO: 2140425 - RNA, 17 nt, Human
uaucagugacagaguuc

SEQ ID NO: 2140426 - RNA, 21 nt, Human
uaucaguuacucagcccuggg

SEQ ID NO: 2140427 - RNA, 16 nt, Human
uaucaguuacucagcc

SEQ ID NO: 2140428 - RNA, 17 nt, Human
uaucaguuacucagccc

SEQ ID NO: 2140429 - RNA, 18 nt, Human
uaucaguuacucagcccu

SEQ ID NO: 2140430 - RNA, 19 nt, Human
uaucaguuacucagcccug

SEQ ID NO: 2140431 - RNA, 20 nt, Human
uaucaguuacucagcccugg

SEQ ID NO: 2140432 - RNA, 21 nt, Human
uaucaguugagcuucauauac

SEQ ID NO: 2140433 - RNA, 19 nt, Human
uauauuuuuuaauuugaug

SEQ ID NO: 2140434 - RNA, 22 nt, Human
uauauuuuuuaauuugaugaaa

SEQ ID NO: 2140435 - RNA, 17 nt, Human
uaucaggugcugccauc

SEQ ID NO: 2140436 - RNA, 15 nt, Human
uauauuuuuguuugu

SEQ ID NO: 2140437 - RNA, 16 nt, Human
uauauuuuuguuuguu

SEQ ID NO: 2140438 - RNA, 17 nt, Human
uauauuuuuguuuguuu

SEQ ID NO: 2140439 - RNA, 20 nt, Human
uauauuuuuguuuguuuugu

SEQ ID NO: 2140440 - RNA, 21 nt, Human
uauauuuuuguuuguuuugug

SEQ ID NO: 2140441 - RNA, 15 nt, Human
uauauuuuucacagu

SEQ ID NO: 2140442 - RNA, 21 nt, Human
uauauuuuauacauuaacuuc

SEQ ID NO: 2140443 - RNA, 15 nt, Human
uauauguauccagua

SEQ ID NO: 2140444 - RNA, 11 nt, Human
uauauguaugu

SEQ ID NO: 2140445 - RNA, 12 nt, Human
uauauguaugua

SEQ ID NO: 2140446 - RNA, 16 nt, Human
uauauguauguaaaaa

SEQ ID NO: 2140447 - RNA, 12 nt, Human
uauauguaugug

SEQ ID NO: 2140448 - RNA, 16 nt, Human
uauauuucacuauuuu

SEQ ID NO: 2140449 - RNA, 14 nt, Human
uauauuuuaauuug

SEQ ID NO: 2140450 - RNA, 20 nt, Human
uauaugcucugcauguuaca

SEQ ID NO: 2140451 - RNA, 15 nt, Human
uauauacauauauau

SEQ ID NO: 2140452 - RNA, 22 nt, Human
uauauacaauaacauaauuugu

SEQ ID NO: 2140453 - RNA, 18 nt, Human
uauauacacacacaaaga

SEQ ID NO: 2140454 - RNA, 21 nt, Human
uauauacacacacaaagagag

SEQ ID NO: 2140455 - RNA, 22 nt, Human
uauauacacacacaaagagagu

SEQ ID NO: 2140456 - RNA, 16 nt, Human
uauacuguacuuaaua

SEQ ID NO: 2140457 - RNA, 22 nt, Human
uauauaauuuuuuuauguuuug

SEQ ID NO: 2140458 - RNA, 16 nt, Human
uauauacaauaacaua

SEQ ID NO: 2140459 - RNA, 17 nt, Human
uauauacaauaacauaa

SEQ ID NO: 2140460 - RNA, 14 nt, Human
uauauaauaaagua

SEQ ID NO: 2140461 - RNA, 14 nt, Human
uauauaauuauguu

SEQ ID NO: 2140462 - RNA, 17 nt, Human
uauauaauuauguuauu

SEQ ID NO: 2140463 - RNA, 22 nt, Human
uauauaauuacauauuugcaua

SEQ ID NO: 2140464 - RNA, 23 nt, Human
uagcagagaaugaaagggcccag

SEQ ID NO: 2140465 - RNA, 19 nt, Human
uagcagagaaugaaagggc

SEQ ID NO: 2140466 - RNA, 20 nt, Human
uagcagauuuuaauuuugaa

SEQ ID NO: 2140467 - RNA, 14 nt, Human
uagcagauuuuaau

SEQ ID NO: 2140468 - RNA, 20 nt, Human
uagcagaaucaaaaugaccu

SEQ ID NO: 2140469 - RNA, 18 nt, Human
uagcagauuuuaauuuug

SEQ ID NO: 2140470 - RNA, 17 nt, Human
uagcagguaccacugau

SEQ ID NO: 2140471 - RNA, 16 nt, Human
uagcacuuugggaggc

SEQ ID NO: 2140472 - RNA, 16 nt, Human
uagauugcuucuguag

SEQ ID NO: 2140473 - RNA, 16 nt, Human
uagauuguuaaaauaa

SEQ ID NO: 2140474 - RNA, 18 nt, Human
uagauuaagagauggguu

SEQ ID NO: 2140475 - RNA, 20 nt, Human
uagauucuacauauucuuua

SEQ ID NO: 2140476 - RNA, 13 nt, Human
uagauaacucuuu

SEQ ID NO: 2140477 - RNA, 14 nt, Human
uagauaacucuuug

SEQ ID NO: 2140478 - RNA, 15 nt, Human
uagauaacucuuugg

SEQ ID NO: 2140479 - RNA, 16 nt, Human
uagauaacucuuugga

SEQ ID NO: 2140480 - RNA, 15 nt, Human
uagauaaacucagaa

SEQ ID NO: 2140481 - RNA, 12 nt, Human
uagauguauaua

SEQ ID NO: 2140482 - RNA, 20 nt, Human
uagauguagauaaacucaga

SEQ ID NO: 2140483 - RNA, 14 nt, Human
uagaugguuacacu

SEQ ID NO: 2140484 - RNA, 16 nt, Human
uagaugguuacacugu

SEQ ID NO: 2140485 - RNA, 17 nt, Human
uagaugguuacacuguu

SEQ ID NO: 2140486 - RNA, 18 nt, Human
uagaugguuacacuguua

SEQ ID NO: 2140487 - RNA, 20 nt, Human
uagaugguuacacuguuaga

SEQ ID NO: 2140488 - RNA, 21 nt, Human
uagaugguuacacuguuagaa

SEQ ID NO: 2140489 - RNA, 19 nt, Human
uagaugguuugagccugag

SEQ ID NO: 2140490 - RNA, 21 nt, Human
uagaugucuuuaggcagcagc

SEQ ID NO: 2140491 - RNA, 22 nt, Human
uagaugugcauuuuugugaaau

SEQ ID NO: 2140492 - RNA, 23 nt, Human
uagauguagauaaacucagaaau

SEQ ID NO: 2140493 - RNA, 18 nt, Human
uagaugucccuuucuugg

SEQ ID NO: 2140494 - RNA, 21 nt, Human
uagaugucccuuucuuggcca

SEQ ID NO: 2140495 - RNA, 22 nt, Human
uagaugucccuuucuuggccag

SEQ ID NO: 2140496 - RNA, 23 nt, Human
uagaugucccuuucuuggccagu

SEQ ID NO: 2140497 - RNA, 15 nt, Human
uagacuugaaauacu

SEQ ID NO: 2140498 - RNA, 18 nt, Human
uagacuugugcugaucgu

SEQ ID NO: 2140499 - RNA, 17 nt, Human
uagacuuuagaaauaaa

SEQ ID NO: 2140500 - RNA, 18 nt, Human
uagacuuuagaaauaaau

SEQ ID NO: 2140501 - RNA, 19 nt, Human
uagacuuuagaaauaaaug

SEQ ID NO: 2140502 - RNA, 19 nt, Human
uagagaaaccguccucuuu

SEQ ID NO: 2140503 - RNA, 21 nt, Human
uagagaaaccguccucuuuuu

SEQ ID NO: 2140504 - RNA, 22 nt, Human
uagagaaaccguccucuuuuuc

SEQ ID NO: 2140505 - RNA, 17 nt, Human
uagacugccuggguucc

SEQ ID NO: 2140506 - RNA, 21 nt, Human
uagaccucagccugugcugcc

SEQ ID NO: 2140507 - RNA, 22 nt, Human
uagaccucagccugugcugccc

SEQ ID NO: 2140508 - RNA, 14 nt, Human
uagaccucagccug

SEQ ID NO: 2140509 - RNA, 15 nt, Human
uagaccucagccugu

SEQ ID NO: 2140510 - RNA, 16 nt, Human
uagaccucagccugug

SEQ ID NO: 2140511 - RNA, 20 nt, Human
uagaccucagccugugcugc

SEQ ID NO: 2140512 - RNA, 19 nt, Human
uagaccuagggaggaccuu

SEQ ID NO: 2140513 - RNA, 22 nt, Human
uagaccuagggaggaccuuauc

SEQ ID NO: 2140514 - RNA, 11 nt, Human
uagaccucagc

SEQ ID NO: 2140515 - RNA, 12 nt, Human
uagaccucagcc

SEQ ID NO: 2140516 - RNA, 13 nt, Human
uagaccucagccu

SEQ ID NO: 2140517 - RNA, 23 nt, Human
uagaaccaggcaacuugggaacu

SEQ ID NO: 2140518 - RNA, 16 nt, Human
uagaaccacuaugaag

SEQ ID NO: 2140519 - RNA, 12 nt, Human
uagaaccaggca

SEQ ID NO: 2140520 - RNA, 15 nt, Human
uagaaccacuaugaa

SEQ ID NO: 2140521 - RNA, 16 nt, Human
uagagagagaccacuu

SEQ ID NO: 2140522 - RNA, 14 nt, Human
uagagacuguagau

SEQ ID NO: 2140523 - RNA, 15 nt, Human
uagagacuguagauu

SEQ ID NO: 2140524 - RNA, 19 nt, Human
uagagacuguagauugcuu

SEQ ID NO: 2140525 - RNA, 16 nt, Human
uagacuugaggaaacc

SEQ ID NO: 2140526 - RNA, 14 nt, Human
uagagguuuuauga

SEQ ID NO: 2140527 - RNA, 21 nt, Human
uagagucaucuccaucagcug

SEQ ID NO: 2140528 - RNA, 22 nt, Human
uagagucaucuccaucagcugu

SEQ ID NO: 2140529 - RNA, 23 nt, Human
uagagucaucuccaucagcugua

SEQ ID NO: 2140530 - RNA, 19 nt, Human
uagaguccaacguggggca

SEQ ID NO: 2140531 - RNA, 22 nt, Human
uagaguccaacguggggcagca

SEQ ID NO: 2140532 - RNA, 14 nt, Human
uagaguauaugcac

SEQ ID NO: 2140533 - RNA, 13 nt, Human
uagagucagccuu

SEQ ID NO: 2140534 - RNA, 14 nt, Human
uagagucagccuuc

SEQ ID NO: 2140535 - RNA, 15 nt, Human
uagauaaaaagaugg

SEQ ID NO: 2140536 - RNA, 12 nt, Human
uagauaaacuca

SEQ ID NO: 2140537 - RNA, 17 nt, Human
uagccugccucuucucu

SEQ ID NO: 2140538 - RNA, 21 nt, Human
uagcuccccgcuucugccugc

SEQ ID NO: 2140539 - RNA, 20 nt, Human
uagccucgccgucugugaau

SEQ ID NO: 2140540 - RNA, 20 nt, Human
uagcuccacacccucuccca

SEQ ID NO: 2140541 - RNA, 21 nt, Human
uagcucuaggagggcuggcaa

SEQ ID NO: 2140542 - RNA, 20 nt, Human
uagcugggacuacaggcacc

SEQ ID NO: 2140543 - RNA, 23 nt, Human
uagcuggaauuuuuuauucuugu

SEQ ID NO: 2140544 - RNA, 18 nt, Human
uagcugggacuacaggug

SEQ ID NO: 2140545 - RNA, 13 nt, Human
uagcucuuuccuu

SEQ ID NO: 2140546 - RNA, 11 nt, Human
uagcugggacu

SEQ ID NO: 2140547 - RNA, 14 nt, Human
uagcccaaaaccaa

SEQ ID NO: 2140548 - RNA, 21 nt, Human
uagcauacauuuauaauguuu

SEQ ID NO: 2140549 - RNA, 13 nt, Human
uagcagugauuuu

SEQ ID NO: 2140550 - RNA, 15 nt, Human
uagcagugauuuuua

SEQ ID NO: 2140551 - RNA, 21 nt, Human
uagcagugauuuuuauccaau

SEQ ID NO: 2140552 - RNA, 15 nt, Human
uagcauacauuuaua

SEQ ID NO: 2140553 - RNA, 14 nt, Human
uagcaguucugcaa

SEQ ID NO: 2140554 - RNA, 16 nt, Human
uagcaguucugcaaau

SEQ ID NO: 2140555 - RNA, 17 nt, Human
uagcaguucugcaaaua

SEQ ID NO: 2140556 - RNA, 20 nt, Human
uagcaguucugcaaauagaa

SEQ ID NO: 2140557 - RNA, 16 nt, Human
uagcccuggccagagg

SEQ ID NO: 2140558 - RNA, 18 nt, Human
uagcccuggccagaggcu

SEQ ID NO: 2140559 - RNA, 13 nt, Human
uagccccauaauu

SEQ ID NO: 2140560 - RNA, 21 nt, Human
uagccccaacccaaaccugga

SEQ ID NO: 2140561 - RNA, 22 nt, Human
uagccccaacccaaaccuggag

SEQ ID NO: 2140562 - RNA, 18 nt, Human
uagccccaagaaggcugg

SEQ ID NO: 2140563 - RNA, 19 nt, Human
uagccccaagaaggcuggg

SEQ ID NO: 2140564 - RNA, 20 nt, Human
uagccccaagaaggcugggg

SEQ ID NO: 2140565 - RNA, 22 nt, Human
uagccccaagaaggcuggggcu

SEQ ID NO: 2140566 - RNA, 12 nt, Human
uagccucccuga

SEQ ID NO: 2140567 - RNA, 13 nt, Human
uagccucccugaa

SEQ ID NO: 2140568 - RNA, 14 nt, Human
uagccgaccucagc

SEQ ID NO: 2140569 - RNA, 15 nt, Human
uagccgaccucagcc

SEQ ID NO: 2140570 - RNA, 13 nt, Human
uagccgaccucag

SEQ ID NO: 2140571 - RNA, 22 nt, Human
uaggaaguguaacagcugaggu

SEQ ID NO: 2140572 - RNA, 18 nt, Human
uaggaaguguaacagcug

SEQ ID NO: 2140573 - RNA, 19 nt, Human
uaggaaguguaacagcuga

SEQ ID NO: 2140574 - RNA, 20 nt, Human
uaggaaguguaacagcugag

SEQ ID NO: 2140575 - RNA, 21 nt, Human
uaggaaguguaacagcugagg

SEQ ID NO: 2140576 - RNA, 17 nt, Human
uaggaaguguaacagcu

SEQ ID NO: 2140577 - RNA, 15 nt, Human
uaggaagguuaaugu

SEQ ID NO: 2140578 - RNA, 13 nt, Human
uaggccuggccag

SEQ ID NO: 2140579 - RNA, 14 nt, Human
uaggccuggccaga

SEQ ID NO: 2140580 - RNA, 13 nt, Human
uaggccacuccuc

SEQ ID NO: 2140581 - RNA, 14 nt, Human
uaggccacuccucc

SEQ ID NO: 2140582 - RNA, 15 nt, Human
uaggccacuccucca

SEQ ID NO: 2140583 - RNA, 12 nt, Human
uaggaauaaaua

SEQ ID NO: 2140584 - RNA, 20 nt, Human
uaggaacgguaaauuucugu

SEQ ID NO: 2140585 - RNA, 16 nt, Human
uaggaacauaugaaaa

SEQ ID NO: 2140586 - RNA, 19 nt, Human
uaggaagagaaaccaggga

SEQ ID NO: 2140587 - RNA, 15 nt, Human
uaggaagagaaacca

SEQ ID NO: 2140588 - RNA, 14 nt, Human
uaggaagagaaacc

SEQ ID NO: 2140589 - RNA, 13 nt, Human
uacaguguacagu

SEQ ID NO: 2140590 - RNA, 14 nt, Human
uacaggcaccgaga

SEQ ID NO: 2140591 - RNA, 19 nt, Human
uacaggcaccgagaauguu

SEQ ID NO: 2140592 - RNA, 15 nt, Human
uacaggcagcacaga

SEQ ID NO: 2140593 - RNA, 22 nt, Human
uacaguguacagucuuguauua

SEQ ID NO: 2140594 - RNA, 20 nt, Human
uacaggcaccgagaauguug

SEQ ID NO: 2140595 - RNA, 15 nt, Human
uacaguguacagucu

SEQ ID NO: 2140596 - RNA, 16 nt, Human
uacaguguacagucuu

SEQ ID NO: 2140597 - RNA, 16 nt, Human
uacaggcacccaccau

SEQ ID NO: 2140598 - RNA, 19 nt, Human
uacaggaaaagcugcugac

SEQ ID NO: 2140599 - RNA, 21 nt, Human
uacaggaagcaccccaugcca

SEQ ID NO: 2140600 - RNA, 18 nt, Human
uacaggaaaagcugcuga

SEQ ID NO: 2140601 - RNA, 17 nt, Human
uacaggaaaagcugcug

SEQ ID NO: 2140602 - RNA, 18 nt, Human
uacagcuuucaugauuag

SEQ ID NO: 2140603 - RNA, 22 nt, Human
uacagccaaagauaaucucuca

SEQ ID NO: 2140604 - RNA, 18 nt, Human
uacagccaaagauaaucu

SEQ ID NO: 2140605 - RNA, 15 nt, Human
uacacugucaaacau

SEQ ID NO: 2140606 - RNA, 13 nt, Human
uacacuuuaugca

SEQ ID NO: 2140607 - RNA, 21 nt, Human
uacagaaagauggaugugcuu

SEQ ID NO: 2140608 - RNA, 21 nt, Human
uacagaauucugcuaccucac

SEQ ID NO: 2140609 - RNA, 18 nt, Human
uacagaauucugcuaccu

SEQ ID NO: 2140610 - RNA, 11 nt, Human
uacagaaucau

SEQ ID NO: 2140611 - RNA, 16 nt, Human
uacagaaucauugcuu

SEQ ID NO: 2140612 - RNA, 17 nt, Human
uacagaaucauugcuua

SEQ ID NO: 2140613 - RNA, 18 nt, Human
uacagaaucauugcuuau

SEQ ID NO: 2140614 - RNA, 13 nt, Human
uacagaauacuag

SEQ ID NO: 2140615 - RNA, 17 nt, Human
uacagaaauuagccggg

SEQ ID NO: 2140616 - RNA, 18 nt, Human
uacagaaauuagccgggc

SEQ ID NO: 2140617 - RNA, 18 nt, Human
uacacaccuuauauuuac

SEQ ID NO: 2140618 - RNA, 15 nt, Human
uacacacacauacac

SEQ ID NO: 2140619 - RNA, 21 nt, Human
uacacacacacgcgugcacac

SEQ ID NO: 2140620 - RNA, 17 nt, Human
uacacagacuauugaca

SEQ ID NO: 2140621 - RNA, 21 nt, Human
uacacagacuauugacaucag

SEQ ID NO: 2140622 - RNA, 22 nt, Human
uacacagacuauugacaucagc

SEQ ID NO: 2140623 - RNA, 22 nt, Human
uacacagaucacagcuucagcc

SEQ ID NO: 2140624 - RNA, 17 nt, Human
uacacacuuuauuuacu

SEQ ID NO: 2140625 - RNA, 21 nt, Human
uacacugguuugagcuuagug

SEQ ID NO: 2140626 - RNA, 16 nt, Human
uacacuguauuacaua

SEQ ID NO: 2140627 - RNA, 22 nt, Human
uacacuguauuacauaaauaaa

SEQ ID NO: 2140628 - RNA, 12 nt, Human
uacacugugaac

SEQ ID NO: 2140629 - RNA, 19 nt, Human
uacacaaauacuuauucau

SEQ ID NO: 2140630 - RNA, 20 nt, Human
uacacaaauacuuauucauu

SEQ ID NO: 2140631 - RNA, 22 nt, Human
uacacaagacuuuccccauacu

SEQ ID NO: 2140632 - RNA, 16 nt, Human
uacaagagcagccugu

SEQ ID NO: 2140633 - RNA, 19 nt, Human
uacaagagcagccuguggc

SEQ ID NO: 2140634 - RNA, 20 nt, Human
uacaagagcagccuguggca

SEQ ID NO: 2140635 - RNA, 23 nt, Human
uacaagagcagccuguggcaucu

SEQ ID NO: 2140636 - RNA, 15 nt, Human
uaauuuugcauaaaa

SEQ ID NO: 2140637 - RNA, 15 nt, Human
uacaagauaagcuuc

SEQ ID NO: 2140638 - RNA, 14 nt, Human
uaauuuuguaucuu

SEQ ID NO: 2140639 - RNA, 16 nt, Human
uaauuuuguaaaggug

SEQ ID NO: 2140640 - RNA, 19 nt, Human
uaauuuuguaaaggugaaa

SEQ ID NO: 2140641 - RNA, 15 nt, Human
uaauuuugaauaaau

SEQ ID NO: 2140642 - RNA, 14 nt, Human
uaauuuucuucaug

SEQ ID NO: 2140643 - RNA, 23 nt, Human
uaauuuucuucaugcaaugacau

SEQ ID NO: 2140644 - RNA, 12 nt, Human
uaauuuucuuga

SEQ ID NO: 2140645 - RNA, 13 nt, Human
uaauuuucuugau

SEQ ID NO: 2140646 - RNA, 14 nt, Human
uaauuuucuugaug

SEQ ID NO: 2140647 - RNA, 17 nt, Human
uaauuuucuugaugacu

SEQ ID NO: 2140648 - RNA, 23 nt, Human
uaauuuucuugaugacuggaauu

SEQ ID NO: 2140649 - RNA, 21 nt, Human
uacauuuuguauauuuguauu

SEQ ID NO: 2140650 - RNA, 18 nt, Human
uaccaaaauuauuucaga

SEQ ID NO: 2140651 - RNA, 18 nt, Human
uaccaaaauguccaccaa

SEQ ID NO: 2140652 - RNA, 17 nt, Human
uaccaaaauuauuucag

SEQ ID NO: 2140653 - RNA, 12 nt, Human
uacauuuuaaca

SEQ ID NO: 2140654 - RNA, 13 nt, Human
uacauuuuaacau

SEQ ID NO: 2140655 - RNA, 14 nt, Human
uacauuuuaacaug

SEQ ID NO: 2140656 - RNA, 16 nt, Human
uacauuuuaacaugga

SEQ ID NO: 2140657 - RNA, 16 nt, Human
uacauuuguauguugu

SEQ ID NO: 2140658 - RNA, 17 nt, Human
uacauuuguauguugug

SEQ ID NO: 2140659 - RNA, 23 nt, Human
uacauuuguauguugugaagaug

SEQ ID NO: 2140660 - RNA, 16 nt, Human
uacauuuuagacagua

SEQ ID NO: 2140661 - RNA, 14 nt, Human
uacauuuuauauua

SEQ ID NO: 2140662 - RNA, 14 nt, Human
uaccaacuggaagc

SEQ ID NO: 2140663 - RNA, 13 nt, Human
uaccaaaggauag

SEQ ID NO: 2140664 - RNA, 23 nt, Human
uaccaaaauuauuucagaaaugu

SEQ ID NO: 2140665 - RNA, 22 nt, Human
uacauaagauaaaugugcugaa

SEQ ID NO: 2140666 - RNA, 12 nt, Human
uacauccuugug

SEQ ID NO: 2140667 - RNA, 13 nt, Human
uacauccuugugg

SEQ ID NO: 2140668 - RNA, 20 nt, Human
uacauccuuguggcacauuu

SEQ ID NO: 2140669 - RNA, 21 nt, Human
uacauccuuguggcacauuuu

SEQ ID NO: 2140670 - RNA, 14 nt, Human
uacaucgcccucca

SEQ ID NO: 2140671 - RNA, 15 nt, Human
uacaucgcccuccac

SEQ ID NO: 2140672 - RNA, 13 nt, Human
uacaugagaacag

SEQ ID NO: 2140673 - RNA, 17 nt, Human
uacaugagaacagacug

SEQ ID NO: 2140674 - RNA, 22 nt, Human
uacaugagaacagacuggccug

SEQ ID NO: 2140675 - RNA, 18 nt, Human
uacaugacgacaaagcug

SEQ ID NO: 2140676 - RNA, 23 nt, Human
uacaugacgacaaagcugcuaaa

SEQ ID NO: 2140677 - RNA, 14 nt, Human
uacaucuuucacau

SEQ ID NO: 2140678 - RNA, 13 nt, Human
uacaucugucaug

SEQ ID NO: 2140679 - RNA, 15 nt, Human
uacaucuuucacauu

SEQ ID NO: 2140680 - RNA, 15 nt, Human
uacaugacacugaaa

SEQ ID NO: 2140681 - RNA, 17 nt, Human
uacaugacacugaaaug

SEQ ID NO: 2140682 - RNA, 18 nt, Human
uacaugacacugaaaugc

SEQ ID NO: 2140683 - RNA, 19 nt, Human
uacaugacacugaaaugcc

SEQ ID NO: 2140684 - RNA, 20 nt, Human
uacaugacacugaaaugccu

SEQ ID NO: 2140685 - RNA, 16 nt, Human
uacaguguuauuuucu

SEQ ID NO: 2140686 - RNA, 19 nt, Human
uacaguguuauuuucuuug

SEQ ID NO: 2140687 - RNA, 18 nt, Human
uacauaagauaaaugugc

SEQ ID NO: 2140688 - RNA, 19 nt, Human
uacauaagauaaaugugcu

SEQ ID NO: 2140689 - RNA, 21 nt, Human
uaccaagaugccaucuguguc

SEQ ID NO: 2140690 - RNA, 16 nt, Human
uaccaaguuauauaaa

SEQ ID NO: 2140691 - RNA, 18 nt, Human
uaccaaguuauauaaaga

SEQ ID NO: 2140692 - RNA, 18 nt, Human
uaccacaaugcagugccu

SEQ ID NO: 2140693 - RNA, 13 nt, Human
uaccacagugucu

SEQ ID NO: 2140694 - RNA, 14 nt, Human
uaccacagugucug

SEQ ID NO: 2140695 - RNA, 13 nt, Human
uaccauuuguaau

SEQ ID NO: 2140696 - RNA, 14 nt, Human
uaccauuuguaaua

SEQ ID NO: 2140697 - RNA, 17 nt, Human
uaccauuuguaauaaag

SEQ ID NO: 2140698 - RNA, 18 nt, Human
uaccauuuguaauaaagu

SEQ ID NO: 2140699 - RNA, 20 nt, Human
uaccauuuguaauaaaguau

SEQ ID NO: 2140700 - RNA, 22 nt, Human
uaccauuuguaauaaaguauau

SEQ ID NO: 2140701 - RNA, 23 nt, Human
uaccauuuguaauaaaguauaua

SEQ ID NO: 2140702 - RNA, 15 nt, Human
uaccauuuucugguu

SEQ ID NO: 2140703 - RNA, 16 nt, Human
uaccauuuucugguuc

SEQ ID NO: 2140704 - RNA, 23 nt, Human
uaccauuuugggguacccacugc

SEQ ID NO: 2140705 - RNA, 18 nt, Human
uacccagcgagcccuggu

SEQ ID NO: 2140706 - RNA, 16 nt, Human
uacccagcgagcccug

SEQ ID NO: 2140707 - RNA, 14 nt, Human
uacccacugcucug

SEQ ID NO: 2140708 - RNA, 13 nt, Human
uacccacugcucu

SEQ ID NO: 2140709 - RNA, 12 nt, Human
uacccacugcuc

SEQ ID NO: 2140710 - RNA, 11 nt, Human
uacccacugcu

SEQ ID NO: 2140711 - RNA, 11 nt, Human
uacccaccuga

SEQ ID NO: 2140712 - RNA, 14 nt, Human
uacccaccugagcu

SEQ ID NO: 2140713 - RNA, 15 nt, Human
uacccaccugagcuu

SEQ ID NO: 2140714 - RNA, 18 nt, Human
uacccaccugagcuuugg

SEQ ID NO: 2140715 - RNA, 23 nt, Human
uacccaccugagcuuuggacaca

SEQ ID NO: 2140716 - RNA, 23 nt, Human
uacccaccugagcuuuggacgca

SEQ ID NO: 2140717 - RNA, 14 nt, Human
uacgacaacuugca

SEQ ID NO: 2140718 - RNA, 15 nt, Human
uacgacaacuugcac

SEQ ID NO: 2140719 - RNA, 14 nt, Human
uacgacuuuauuuu

SEQ ID NO: 2140720 - RNA, 15 nt, Human
uacgacuuuauuuuc

SEQ ID NO: 2140721 - RNA, 17 nt, Human
uacgacuuuauuuucug

SEQ ID NO: 2140722 - RNA, 13 nt, Human
uacuaacuuuccu

SEQ ID NO: 2140723 - RNA, 13 nt, Human
uacuacaaaauuu

SEQ ID NO: 2140724 - RNA, 18 nt, Human
uacuacaaaauuugaaau

SEQ ID NO: 2140725 - RNA, 18 nt, Human
uacuacacauucaauaag

SEQ ID NO: 2140726 - RNA, 18 nt, Human
uacccaucgguguccauu

SEQ ID NO: 2140727 - RNA, 20 nt, Human
uacccaucgguguccauuua

SEQ ID NO: 2140728 - RNA, 21 nt, Human
uacccaucgguguccauuuau

SEQ ID NO: 2140729 - RNA, 14 nt, Human
uacccaccucagcc

SEQ ID NO: 2140730 - RNA, 15 nt, Human
uacccaccucagccu

SEQ ID NO: 2140731 - RNA, 15 nt, Human
uaccuugaggucuuu

SEQ ID NO: 2140732 - RNA, 17 nt, Human
uaccuugcaucucacag

SEQ ID NO: 2140733 - RNA, 18 nt, Human
uaccuugaacacuggggg

SEQ ID NO: 2140734 - RNA, 19 nt, Human
uacccaugucuacacagau

SEQ ID NO: 2140735 - RNA, 21 nt, Human
uacccauucguggugaucaau

SEQ ID NO: 2140736 - RNA, 12 nt, Human
uaccuuugucac

SEQ ID NO: 2140737 - RNA, 22 nt, Human
uaccuuguguuuuguuuugauu

SEQ ID NO: 2140738 - RNA, 14 nt, Human
uaccuuuaugguuu

SEQ ID NO: 2140739 - RNA, 16 nt, Human
uaccuuuaugguuucu

SEQ ID NO: 2140740 - RNA, 14 nt, Human
uacuccuuaagaac

SEQ ID NO: 2140741 - RNA, 21 nt, Human
uacuccuuaagaacacaaagc

SEQ ID NO: 2140742 - RNA, 22 nt, Human
uacuccuuaagaacacaaagcg

SEQ ID NO: 2140743 - RNA, 15 nt, Human
uacugaggugcuaug

SEQ ID NO: 2140744 - RNA, 17 nt, Human
uacugagcuucucugug

SEQ ID NO: 2140745 - RNA, 14 nt, Human
uacugagcuucucu

SEQ ID NO: 2140746 - RNA, 18 nt, Human
uacugaucaugcauuguu

SEQ ID NO: 2140747 - RNA, 18 nt, Human
uacugagcuucucuguga

SEQ ID NO: 2140748 - RNA, 23 nt, Human
uacugagggaccaacugggccca

SEQ ID NO: 2140749 - RNA, 20 nt, Human
uacugaguauguggaaggca

SEQ ID NO: 2140750 - RNA, 16 nt, Human
uacugaucaugcauug

SEQ ID NO: 2140751 - RNA, 17 nt, Human
uacugaucaugcauugu

SEQ ID NO: 2140752 - RNA, 12 nt, Human
uacuccugcaaa

SEQ ID NO: 2140753 - RNA, 14 nt, Human
uacuccugcaaaau

SEQ ID NO: 2140754 - RNA, 16 nt, Human
uacuccugcaaaauuu

SEQ ID NO: 2140755 - RNA, 17 nt, Human
uacuccugcaaaauuuu

SEQ ID NO: 2140756 - RNA, 22 nt, Human
uacuccugcaaaauuuuauagc

SEQ ID NO: 2140757 - RNA, 17 nt, Human
uacuccucuuuacacug

SEQ ID NO: 2140758 - RNA, 14 nt, Human
uacucagcagcccu

SEQ ID NO: 2140759 - RNA, 15 nt, Human
uacucagcagcccuc

SEQ ID NO: 2140760 - RNA, 16 nt, Human
uacucagcagcccucc

SEQ ID NO: 2140761 - RNA, 17 nt, Human
uacucagcagcccuccu

SEQ ID NO: 2140762 - RNA, 18 nt, Human
uacucagcagcccuccuc

SEQ ID NO: 2140763 - RNA, 19 nt, Human
uacucagaagccugaggcu

SEQ ID NO: 2140764 - RNA, 16 nt, Human
uacucagaagccugag

SEQ ID NO: 2140765 - RNA, 17 nt, Human
uacucagaagccugagg

SEQ ID NO: 2140766 - RNA, 15 nt, Human
uacucaggaggcuga

SEQ ID NO: 2140767 - RNA, 19 nt, Human
uacucauauauaucuaucu

SEQ ID NO: 2140768 - RNA, 21 nt, Human
uacucauauauaucuaucuua

SEQ ID NO: 2140769 - RNA, 23 nt, Human
uacucauauauaucuaucuuaua

SEQ ID NO: 2140770 - RNA, 16 nt, Human
uacucaugaucuugug

SEQ ID NO: 2140771 - RNA, 17 nt, Human
uacucaugaucuuguga

SEQ ID NO: 2140772 - RNA, 12 nt, Human
uacucaggaggc

SEQ ID NO: 2140773 - RNA, 22 nt, Human
uacucaggaggcugaggcagaa

SEQ ID NO: 2140774 - RNA, 22 nt, Human
uacucagcccugggccccacca

SEQ ID NO: 2140775 - RNA, 23 nt, Human
uacucagcccugggccccaccac

SEQ ID NO: 2140776 - RNA, 19 nt, Human
uacucagcagcccuccuca

SEQ ID NO: 2140777 - RNA, 20 nt, Human
uacucagcagcccuccucac

SEQ ID NO: 2140778 - RNA, 23 nt, Human
uacucagcagcccuccucacccc

SEQ ID NO: 2140779 - RNA, 12 nt, Human
uacucagcccug

SEQ ID NO: 2140780 - RNA, 13 nt, Human
uacucagcccugg

SEQ ID NO: 2140781 - RNA, 14 nt, Human
uacucagcccuggg

SEQ ID NO: 2140782 - RNA, 15 nt, Human
uacucagcccugggc

SEQ ID NO: 2140783 - RNA, 16 nt, Human
uacucagcccugggcc

SEQ ID NO: 2140784 - RNA, 14 nt, Human
uacucaccucaccc

SEQ ID NO: 2140785 - RNA, 21 nt, Human
uacucacagucucuuuaaucu

SEQ ID NO: 2140786 - RNA, 17 nt, Human
uacuacuagaugucuuu

SEQ ID NO: 2140787 - RNA, 18 nt, Human
uacuacuagaugucuuua

SEQ ID NO: 2140788 - RNA, 24 nt, Human
uacucaccuugaacaccacgcuug

SEQ ID NO: 2140789 - RNA, 20 nt, Human
uacucacucaaguucaagga

SEQ ID NO: 2140790 - RNA, 23 nt, Human
uacucacucaaguucaaggacca

SEQ ID NO: 2140791 - RNA, 12 nt, Human
uacucaccucac

SEQ ID NO: 2140792 - RNA, 15 nt, Human
uacucacagucucuu

SEQ ID NO: 2140793 - RNA, 18 nt, Human
uacuacaugugggagcuu

SEQ ID NO: 2140794 - RNA, 16 nt, Human
uaccuuugcucuugca

SEQ ID NO: 2140795 - RNA, 17 nt, Human
uacuacaucgcccucca

SEQ ID NO: 2140796 - RNA, 15 nt, Human
uagaaagaagaugaa

SEQ ID NO: 2140797 - RNA, 14 nt, Human
uagaaagaagccca

SEQ ID NO: 2140798 - RNA, 23 nt, Human
uagaaagaagcccaauauuauaa

SEQ ID NO: 2140799 - RNA, 21 nt, Human
uagaaagaagcccaauauuau

SEQ ID NO: 2140800 - RNA, 22 nt, Human
uagaaacuuaucuuacaaagug

SEQ ID NO: 2140801 - RNA, 23 nt, Human
uagaaacuuaucuuacaaagugu

SEQ ID NO: 2140802 - RNA, 17 nt, Human
uagaaagacagagcugg

SEQ ID NO: 2140803 - RNA, 18 nt, Human
uagaaagagauacagagg

SEQ ID NO: 2140804 - RNA, 17 nt, Human
uagaaagagauacagag

SEQ ID NO: 2140805 - RNA, 17 nt, Human
uacuuuacauaugcuuu

SEQ ID NO: 2140806 - RNA, 23 nt, Human
uacuuuacauaugcuuuaagaau

SEQ ID NO: 2140807 - RNA, 22 nt, Human
uagaaagccaaaucaaaauaug

SEQ ID NO: 2140808 - RNA, 20 nt, Human
uagaaaguucaaaaagucua

SEQ ID NO: 2140809 - RNA, 16 nt, Human
uagaaauaaagcaucu

SEQ ID NO: 2140810 - RNA, 17 nt, Human
uagaaagugaauaaaaa

SEQ ID NO: 2140811 - RNA, 20 nt, Human
uagaaagugaauaaaaauua

SEQ ID NO: 2140812 - RNA, 21 nt, Human
uagaaagugaauaaaaauuaa

SEQ ID NO: 2140813 - RNA, 19 nt, Human
uagaaauaaauagcuauau

SEQ ID NO: 2140814 - RNA, 16 nt, Human
uagaaauaaauagcua

SEQ ID NO: 2140815 - RNA, 16 nt, Human
uagaaauaauaugcau

SEQ ID NO: 2140816 - RNA, 15 nt, Human
uagaaauaauaugca

SEQ ID NO: 2140817 - RNA, 15 nt, Human
uagaaauauaauuga

SEQ ID NO: 2140818 - RNA, 20 nt, Human
uagaaauaucugaaaaugua

SEQ ID NO: 2140819 - RNA, 21 nt, Human
uagaaauaucugaaaauguau

SEQ ID NO: 2140820 - RNA, 23 nt, Human
uagaaauaucugaaaauguaugu

SEQ ID NO: 2140821 - RNA, 19 nt, Human
uagaaaugaugauguggaa

SEQ ID NO: 2140822 - RNA, 22 nt, Human
uagaaaucccccuuucucuaau

SEQ ID NO: 2140823 - RNA, 18 nt, Human
uagaaaugaccaauauua

SEQ ID NO: 2140824 - RNA, 19 nt, Human
uagaaauuuuucagaugcu

SEQ ID NO: 2140825 - RNA, 22 nt, Human
uagaaauuuuucagaugcuucu

SEQ ID NO: 2140826 - RNA, 18 nt, Human
uagaaauuagcuguguga

SEQ ID NO: 2140827 - RNA, 14 nt, Human
uagaaauuuuacaa

SEQ ID NO: 2140828 - RNA, 17 nt, Human
uagaaauuuuacaauag

SEQ ID NO: 2140829 - RNA, 22 nt, Human
uagaaauuuuacaauaggugcu

SEQ ID NO: 2140830 - RNA, 14 nt, Human
uagaacaucccugc

SEQ ID NO: 2140831 - RNA, 18 nt, Human
uagaacaucccugccagc

SEQ ID NO: 2140832 - RNA, 18 nt, Human
uagaacauugauugcugu

SEQ ID NO: 2140833 - RNA, 12 nt, Human
uagaacacuauu

SEQ ID NO: 2140834 - RNA, 13 nt, Human
uagaacacuauuu

SEQ ID NO: 2140835 - RNA, 14 nt, Human
uagaacacuauuuu

SEQ ID NO: 2140836 - RNA, 16 nt, Human
uagaacacuauuuuca

SEQ ID NO: 2140837 - RNA, 17 nt, Human
uagaacacuauuuucag

SEQ ID NO: 2140838 - RNA, 18 nt, Human
uagaacacuauuuucaga

SEQ ID NO: 2140839 - RNA, 19 nt, Human
uagaacacuauuuucagaa

SEQ ID NO: 2140840 - RNA, 20 nt, Human
uagaacacuauuuucagaau

SEQ ID NO: 2140841 - RNA, 21 nt, Human
uagaacacuauuuucagaauc

SEQ ID NO: 2140842 - RNA, 22 nt, Human
uagaacacuauuuucagaaucu

SEQ ID NO: 2140843 - RNA, 23 nt, Human
uagaacacuauuuucagaaucug

SEQ ID NO: 2140844 - RNA, 12 nt, Human
uagaacagaaaa

SEQ ID NO: 2140845 - RNA, 13 nt, Human
uagaacagaaaac

SEQ ID NO: 2140846 - RNA, 14 nt, Human
uagaacagaaaaca

SEQ ID NO: 2140847 - RNA, 15 nt, Human
uagaacagaaaacaa

SEQ ID NO: 2140848 - RNA, 16 nt, Human
uagaacagaaaacaac

SEQ ID NO: 2140849 - RNA, 21 nt, Human
uagaacagaaaacaacaaaaa

SEQ ID NO: 2140850 - RNA, 22 nt, Human
uagaacagaaaacaacaaaaaa

SEQ ID NO: 2140851 - RNA, 23 nt, Human
uagaacagaaaacaacaaaaaau

SEQ ID NO: 2140852 - RNA, 12 nt, Human
uacuugggaggc

SEQ ID NO: 2140853 - RNA, 15 nt, Human
uacuugcugcuauuu

SEQ ID NO: 2140854 - RNA, 18 nt, Human
uacuuguggacacagcuc

SEQ ID NO: 2140855 - RNA, 15 nt, Human
uacuuguggacacag

SEQ ID NO: 2140856 - RNA, 19 nt, Human
uacuuguggacacagcucu

SEQ ID NO: 2140857 - RNA, 22 nt, Human
uacuugaugaguguaacaagaa

SEQ ID NO: 2140858 - RNA, 23 nt, Human
uacuugaugaguguaacaagaaa

SEQ ID NO: 2140859 - RNA, 15 nt, Human
uacuuagcuuaucaa

SEQ ID NO: 2140860 - RNA, 16 nt, Human
uacuuagcuuaucaau

SEQ ID NO: 2140861 - RNA, 18 nt, Human
uacuuagcuuaucaauuu

SEQ ID NO: 2140862 - RNA, 19 nt, Human
uacuuagcuuaucaauuug

SEQ ID NO: 2140863 - RNA, 20 nt, Human
uacuuagcuuaucaauuugu

SEQ ID NO: 2140864 - RNA, 18 nt, Human
uacuuagcaaaguuuuac

SEQ ID NO: 2140865 - RNA, 18 nt, Human
uacuuagcaauguuaucu

SEQ ID NO: 2140866 - RNA, 15 nt, Human
uacuuagcagcuauc

SEQ ID NO: 2140867 - RNA, 17 nt, Human
uacuuaccauaugugcu

SEQ ID NO: 2140868 - RNA, 14 nt, Human
uacuuaauaaauuc

SEQ ID NO: 2140869 - RNA, 17 nt, Human
uacuuaauaaauucaga

SEQ ID NO: 2140870 - RNA, 19 nt, Human
uacuuaauaaauucagaua

SEQ ID NO: 2140871 - RNA, 22 nt, Human
uacuguguacagaauucugcua

SEQ ID NO: 2140872 - RNA, 23 nt, Human
uacuguguacagaauucugcuac

SEQ ID NO: 2140873 - RNA, 22 nt, Human
uacuguauuuuuaccuuuuucc

SEQ ID NO: 2140874 - RNA, 17 nt, Human
uacugcauaugaaagga

SEQ ID NO: 2140875 - RNA, 14 nt, Human
uacugauuguuuca

SEQ ID NO: 2140876 - RNA, 15 nt, Human
uacugauuguuucau

SEQ ID NO: 2140877 - RNA, 13 nt, Human
uaauaaagacagg

SEQ ID NO: 2140878 - RNA, 13 nt, Human
uaaguggcugcug

SEQ ID NO: 2140879 - RNA, 20 nt, Human
uaagugguacuaacuuuccu

SEQ ID NO: 2140880 - RNA, 13 nt, Human
uaagugcuuugua

SEQ ID NO: 2140881 - RNA, 15 nt, Human
uaagugcuuuguaau

SEQ ID NO: 2140882 - RNA, 16 nt, Human
uaaggccgaagaaggg

SEQ ID NO: 2140883 - RNA, 20 nt, Human
uaaggccgaagaaggguccu

SEQ ID NO: 2140884 - RNA, 16 nt, Human
uaauaaauugcaugcu

SEQ ID NO: 2140885 - RNA, 21 nt, Human
uaauaaauugcaugcugcuuu

SEQ ID NO: 2140886 - RNA, 23 nt, Human
uaauaaauugcaugcugcuuuaa

SEQ ID NO: 2140887 - RNA, 13 nt, Human
uaauaaauucaga

SEQ ID NO: 2140888 - RNA, 13 nt, Human
uaauaacauaaca

SEQ ID NO: 2140889 - RNA, 17 nt, Human
uaauaaagaugcucuuu

SEQ ID NO: 2140890 - RNA, 15 nt, Human
uaauaaaucugguag

SEQ ID NO: 2140891 - RNA, 15 nt, Human
uaauaaauucagaua

SEQ ID NO: 2140892 - RNA, 14 nt, Human
uaauaaagaugcuc

SEQ ID NO: 2140893 - RNA, 16 nt, Human
uaauaaagaugcucuu

SEQ ID NO: 2140894 - RNA, 14 nt, Human
uaauaauaauguuu

SEQ ID NO: 2140895 - RNA, 11 nt, Human
uaauaauacaa

SEQ ID NO: 2140896 - RNA, 12 nt, Human
uaauaauacaag

SEQ ID NO: 2140897 - RNA, 21 nt, Human
uaauaguucagguaacaggca

SEQ ID NO: 2140898 - RNA, 16 nt, Human
uaauaauuuuuuaauu

SEQ ID NO: 2140899 - RNA, 14 nt, Human
uaauacaaaggcuu

SEQ ID NO: 2140900 - RNA, 22 nt, Human
uaauaauuuuaggcacccaucc

SEQ ID NO: 2140901 - RNA, 14 nt, Human
uaauauaaaguugg

SEQ ID NO: 2140902 - RNA, 19 nt, Human
uaauauaaaguuggaugcg

SEQ ID NO: 2140903 - RNA, 16 nt, Human
uaauauaacugccuua

SEQ ID NO: 2140904 - RNA, 21 nt, Human
uaauauaacugccuuaaaacu

SEQ ID NO: 2140905 - RNA, 22 nt, Human
uaauauaacugccuuaaaacuu

SEQ ID NO: 2140906 - RNA, 23 nt, Human
uaauauaacugccuuaaaacuuu

SEQ ID NO: 2140907 - RNA, 23 nt, Human
uaauauguuaaccucagugucau

SEQ ID NO: 2140908 - RNA, 22 nt, Human
uaaucggcccacagcucccacc

SEQ ID NO: 2140909 - RNA, 15 nt, Human
uaaucguuaugugug

SEQ ID NO: 2140910 - RNA, 16 nt, Human
uaaucguuaugugugu

SEQ ID NO: 2140911 - RNA, 15 nt, Human
uaaucggcccacagc

SEQ ID NO: 2140912 - RNA, 16 nt, Human
uaaucggcccacagcu

SEQ ID NO: 2140913 - RNA, 16 nt, Human
uaauauauguuuuaaa

SEQ ID NO: 2140914 - RNA, 16 nt, Human
uaauauggggaugcag

SEQ ID NO: 2140915 - RNA, 15 nt, Human
uaauauguauuuuau

SEQ ID NO: 2140916 - RNA, 19 nt, Human
uaauauguauuuuauguau

SEQ ID NO: 2140917 - RNA, 21 nt, Human
uaauauguauuuuauguaugu

SEQ ID NO: 2140918 - RNA, 20 nt, Human
uaauauguuaaccucagugu

SEQ ID NO: 2140919 - RNA, 21 nt, Human
uaauauguuaaccucaguguc

SEQ ID NO: 2140920 - RNA, 11 nt, Human
uaaugauguuu

SEQ ID NO: 2140921 - RNA, 23 nt, Human
uaaugaugucguuugaaucacag

SEQ ID NO: 2140922 - RNA, 17 nt, Human
uaaugaugucguuugaa

SEQ ID NO: 2140923 - RNA, 16 nt, Human
uaaugcauguuaggaa

SEQ ID NO: 2140924 - RNA, 17 nt, Human
uaaugcauguuaggaaa

SEQ ID NO: 2140925 - RNA, 20 nt, Human
uaaucuucaguuuuaucuuu

SEQ ID NO: 2140926 - RNA, 13 nt, Human
uaaucuucaguuu

SEQ ID NO: 2140927 - RNA, 16 nt, Human
uaaucuucaguuuuau

SEQ ID NO: 2140928 - RNA, 17 nt, Human
uaaucguuaugugugua

SEQ ID NO: 2140929 - RNA, 18 nt, Human
uaaucguuauguguguau

SEQ ID NO: 2140930 - RNA, 19 nt, Human
uaaucguuauguguguaua

SEQ ID NO: 2140931 - RNA, 19 nt, Human
uaaucuauuggguucauua

SEQ ID NO: 2140932 - RNA, 20 nt, Human
uaaucuauuggguucauuau

SEQ ID NO: 2140933 - RNA, 22 nt, Human
uaaucuauuggguucauuauug

SEQ ID NO: 2140934 - RNA, 18 nt, Human
uaaucuccucuuuuaucu

SEQ ID NO: 2140935 - RNA, 20 nt, Human
uaaucugaucguucuuucua

SEQ ID NO: 2140936 - RNA, 19 nt, Human
uaaucuuaggggagagcuu

SEQ ID NO: 2140937 - RNA, 20 nt, Human
uaaucuuaggggagagcuuu

SEQ ID NO: 2140938 - RNA, 21 nt, Human
uaauugugaaaaaguuaaaca

SEQ ID NO: 2140939 - RNA, 14 nt, Human
uaauugugaauuga

SEQ ID NO: 2140940 - RNA, 12 nt, Human
uaauuguaaacu

SEQ ID NO: 2140941 - RNA, 13 nt, Human
uaauuguaaacug

SEQ ID NO: 2140942 - RNA, 14 nt, Human
uaauuguaaacugu

SEQ ID NO: 2140943 - RNA, 15 nt, Human
uaauuguaaacugua

SEQ ID NO: 2140944 - RNA, 16 nt, Human
uaauuguaaacuguac

SEQ ID NO: 2140945 - RNA, 18 nt, Human
uaauuguaaacuguacua

SEQ ID NO: 2140946 - RNA, 20 nt, Human
uaauuguuaagauaugaugu

SEQ ID NO: 2140947 - RNA, 23 nt, Human
uaauugccacugagagaucugcu

SEQ ID NO: 2140948 - RNA, 11 nt, Human
uaauugccaug

SEQ ID NO: 2140949 - RNA, 12 nt, Human
uaauugccaugu

SEQ ID NO: 2140950 - RNA, 22 nt, Human
uaauugaauuuucaagcaucuc

SEQ ID NO: 2140951 - RNA, 14 nt, Human
uaauugauuucaag

SEQ ID NO: 2140952 - RNA, 19 nt, Human
uaauugauuucaagaccuu

SEQ ID NO: 2140953 - RNA, 20 nt, Human
uaauuuuaugaacugcaugu

SEQ ID NO: 2140954 - RNA, 18 nt, Human
uaauuuuaugaaugucuu

SEQ ID NO: 2140955 - RNA, 13 nt, Human
uaauuuuaaauaa

SEQ ID NO: 2140956 - RNA, 19 nt, Human
uaauuuuaagauuccuuuu

SEQ ID NO: 2140957 - RNA, 19 nt, Human
uaauuuuaggcacccaucc

SEQ ID NO: 2140958 - RNA, 21 nt, Human
uaauuuguacauauguaaaau

SEQ ID NO: 2140959 - RNA, 13 nt, Human
uaauuuguguaau

SEQ ID NO: 2140960 - RNA, 14 nt, Human
uaauuuguguaaua

SEQ ID NO: 2140961 - RNA, 20 nt, Human
uaauuuguguaauaaagugu

SEQ ID NO: 2140962 - RNA, 21 nt, Human
uaauuuguguaauaaaguguu

SEQ ID NO: 2140963 - RNA, 17 nt, Human
uaauuacauauuugcau

SEQ ID NO: 2140964 - RNA, 12 nt, Human
uaauuagagcag

SEQ ID NO: 2140965 - RNA, 13 nt, Human
uaauugaaggaaa

SEQ ID NO: 2140966 - RNA, 14 nt, Human
uaauugaaggaaag

SEQ ID NO: 2140967 - RNA, 15 nt, Human
uaauugaaggaaaga

SEQ ID NO: 2140968 - RNA, 22 nt, Human
uaauugaaggaaagauuuguac

SEQ ID NO: 2140969 - RNA, 12 nt, Human
uaauugagaagc

SEQ ID NO: 2140970 - RNA, 21 nt, Human
uaauugagaagcguauguuuu

SEQ ID NO: 2140971 - RNA, 22 nt, Human
uaauugacaggauuauuggaaa

SEQ ID NO: 2140972 - RNA, 20 nt, Human
uaauugacaggauuauugga

SEQ ID NO: 2140973 - RNA, 15 nt, Human
uaauucuuguauauu

SEQ ID NO: 2140974 - RNA, 16 nt, Human
uaauucuuguauauua

SEQ ID NO: 2140975 - RNA, 12 nt, Human
uaauucuuugau

SEQ ID NO: 2140976 - RNA, 15 nt, Human
uaauguuuaugagcc

SEQ ID NO: 2140977 - RNA, 16 nt, Human
uaauguuuaugagcca

SEQ ID NO: 2140978 - RNA, 17 nt, Human
uaauguuuaugagccag

SEQ ID NO: 2140979 - RNA, 22 nt, Human
uaauguuuaugagccagacaaa

SEQ ID NO: 2140980 - RNA, 21 nt, Human
uaaugcauguuaggaaaauuu

SEQ ID NO: 2140981 - RNA, 21 nt, Human
uaauuaaauaaaaaucugugg

SEQ ID NO: 2140982 - RNA, 18 nt, Human
uaauguuuaugagccaga

SEQ ID NO: 2140983 - RNA, 14 nt, Human
uaauuaacauauaa

SEQ ID NO: 2140984 - RNA, 20 nt, Human
uaauuaacauauaauauaug

SEQ ID NO: 2140985 - RNA, 18 nt, Human
uaagaucguucucugccu

SEQ ID NO: 2140986 - RNA, 16 nt, Human
uaagauaaaugugcug

SEQ ID NO: 2140987 - RNA, 17 nt, Human
uaagauaaaugugcuga

SEQ ID NO: 2140988 - RNA, 21 nt, Human
uaagaguuaguuucuuuggga

SEQ ID NO: 2140989 - RNA, 13 nt, Human
uaagauaaaaaag

SEQ ID NO: 2140990 - RNA, 16 nt, Human
uaagauaaaaaagcug

SEQ ID NO: 2140991 - RNA, 14 nt, Human
uaagauaaaugugc

SEQ ID NO: 2140992 - RNA, 22 nt, Human
uaagaggcagggucucacucug

SEQ ID NO: 2140993 - RNA, 14 nt, Human
uaagagcugguguc

SEQ ID NO: 2140994 - RNA, 17 nt, Human
uaagagcuggugucuga

SEQ ID NO: 2140995 - RNA, 12 nt, Human
uaagagcuauac

SEQ ID NO: 2140996 - RNA, 14 nt, Human
uaagagcuauacag

SEQ ID NO: 2140997 - RNA, 18 nt, Human
uaagagcuagcgcugccg

SEQ ID NO: 2140998 - RNA, 20 nt, Human
uaagagcuagcgcugccgca

SEQ ID NO: 2140999 - RNA, 22 nt, Human
uaagagccauuuaggggccacu

SEQ ID NO: 2141000 - RNA, 16 nt, Human
uaagagcuagcgcugc

SEQ ID NO: 2141001 - RNA, 14 nt, Human
uaagaagagacugg

SEQ ID NO: 2141002 - RNA, 19 nt, Human
uaagaagagacugggaaga

SEQ ID NO: 2141003 - RNA, 14 nt, Human
uaagaagaugacuu

SEQ ID NO: 2141004 - RNA, 23 nt, Human
uaagaagcacgugguaaaacacu

SEQ ID NO: 2141005 - RNA, 14 nt, Human
uaagaagacaugaa

SEQ ID NO: 2141006 - RNA, 15 nt, Human
uaagaagacaugaac

SEQ ID NO: 2141007 - RNA, 12 nt, Human
uaagaagagacu

SEQ ID NO: 2141008 - RNA, 15 nt, Human
uaagaaagugaagca

SEQ ID NO: 2141009 - RNA, 18 nt, Human
uaagaaagugaagcaaau

SEQ ID NO: 2141010 - RNA, 22 nt, Human
uaagaaagugaagcaaaucaga

SEQ ID NO: 2141011 - RNA, 20 nt, Human
uaacuuuuguaaauacacau

SEQ ID NO: 2141012 - RNA, 24 nt, Human
uaagaaagacuaucuaaauguuga

SEQ ID NO: 2141013 - RNA, 15 nt, Human
uaagcaucaaacucu

SEQ ID NO: 2141014 - RNA, 16 nt, Human
uaagcaucaaacucuu

SEQ ID NO: 2141015 - RNA, 16 nt, Human
uaagcauuacucuugu

SEQ ID NO: 2141016 - RNA, 17 nt, Human
uaagcauuacucuugua

SEQ ID NO: 2141017 - RNA, 18 nt, Human
uaagcauuacucuuguaa

SEQ ID NO: 2141018 - RNA, 19 nt, Human
uaagcauuacucuuguaag

SEQ ID NO: 2141019 - RNA, 20 nt, Human
uaagcauuacucuuguaaga

SEQ ID NO: 2141020 - RNA, 21 nt, Human
uaagcauuacucuuguaagau

SEQ ID NO: 2141021 - RNA, 22 nt, Human
uaagcauuacucuuguaagauu

SEQ ID NO: 2141022 - RNA, 10 nt, Human
uaagccaagg

SEQ ID NO: 2141023 - RNA, 14 nt, Human
uaagccaagggccu

SEQ ID NO: 2141024 - RNA, 23 nt, Human
uaagcauuguuugcuuauuguuc

SEQ ID NO: 2141025 - RNA, 18 nt, Human
uaagcauuguuugcuuau

SEQ ID NO: 2141026 - RNA, 19 nt, Human
uaagcauuguuugcuuauu

SEQ ID NO: 2141027 - RNA, 20 nt, Human
uaagcauuguuugcuuauug

SEQ ID NO: 2141028 - RNA, 21 nt, Human
uaagcauuguuugcuuauugu

SEQ ID NO: 2141029 - RNA, 18 nt, Human
uaagcauuggguggguaa

SEQ ID NO: 2141030 - RNA, 13 nt, Human
uaagcaucacaaa

SEQ ID NO: 2141031 - RNA, 12 nt, Human
uaagcauuguuu

SEQ ID NO: 2141032 - RNA, 15 nt, Human
uaagcauuguuugcu

SEQ ID NO: 2141033 - RNA, 17 nt, Human
uaagcauuguuugcuua

SEQ ID NO: 2141034 - RNA, 14 nt, Human
uaagccuccauuua

SEQ ID NO: 2141035 - RNA, 17 nt, Human
uaagccuccauuuaguu

SEQ ID NO: 2141036 - RNA, 19 nt, Human
uaagccuccauuuaguucu

SEQ ID NO: 2141037 - RNA, 20 nt, Human
uaagccuccauuuaguucuu

SEQ ID NO: 2141038 - RNA, 21 nt, Human
uaagccuccauuuaguucuuu

SEQ ID NO: 2141039 - RNA, 16 nt, Human
uaagccuuuccauaag

SEQ ID NO: 2141040 - RNA, 15 nt, Human
uaagccuuuccauaa

SEQ ID NO: 2141041 - RNA, 18 nt, Human
uaaggaugggaaggaggg

SEQ ID NO: 2141042 - RNA, 12 nt, Human
uaaggaugggaa

SEQ ID NO: 2141043 - RNA, 16 nt, Human
uaaggaugggaaggag

SEQ ID NO: 2141044 - RNA, 15 nt, Human
uaaauugcaugcugc

SEQ ID NO: 2141045 - RNA, 18 nt, Human
uaaauugcaugcugcuuu

SEQ ID NO: 2141046 - RNA, 19 nt, Human
uaaauugcaugcugcuuua

SEQ ID NO: 2141047 - RNA, 20 nt, Human
uaaauugcaugcugcuuuaa

SEQ ID NO: 2141048 - RNA, 15 nt, Human
uaaauugcuccuuga

SEQ ID NO: 2141049 - RNA, 12 nt, Human
uaacaaugucuu

SEQ ID NO: 2141050 - RNA, 12 nt, Human
uaacacagagag

SEQ ID NO: 2141051 - RNA, 16 nt, Human
uaacacagagagacag

SEQ ID NO: 2141052 - RNA, 17 nt, Human
uaacacagcauguguau

SEQ ID NO: 2141053 - RNA, 16 nt, Human
uaacacacauaaagga

SEQ ID NO: 2141054 - RNA, 20 nt, Human
uaacacacauaaaggauaaa

SEQ ID NO: 2141055 - RNA, 11 nt, Human
uaacacauuau

SEQ ID NO: 2141056 - RNA, 21 nt, Human
uaacagaugcaaugugcuacu

SEQ ID NO: 2141057 - RNA, 22 nt, Human
uaacagcauucuugucacaaua

SEQ ID NO: 2141058 - RNA, 23 nt, Human
uaacagcauucuugucacaauaa

SEQ ID NO: 2141059 - RNA, 18 nt, Human
uaacagauaagcaagaga

SEQ ID NO: 2141060 - RNA, 12 nt, Human
uaacagaugcaa

SEQ ID NO: 2141061 - RNA, 15 nt, Human
uaacagaugcaaugu

SEQ ID NO: 2141062 - RNA, 24 nt, Human
uaacaauggaagauuugcccauuu

SEQ ID NO: 2141063 - RNA, 16 nt, Human
uaacaggauuagacag

SEQ ID NO: 2141064 - RNA, 15 nt, Human
uaacagcugaggucu

SEQ ID NO: 2141065 - RNA, 12 nt, Human
uaacagcugagg

SEQ ID NO: 2141066 - RNA, 12 nt, Human
uaacagcugugg

SEQ ID NO: 2141067 - RNA, 19 nt, Human
uaacaggcagauacaggaa

SEQ ID NO: 2141068 - RNA, 22 nt, Human
uaacaggcucaauauuccugaa

SEQ ID NO: 2141069 - RNA, 23 nt, Human
uaacaggcucaauauuccugaau

SEQ ID NO: 2141070 - RNA, 13 nt, Human
uaacauuauauug

SEQ ID NO: 2141071 - RNA, 16 nt, Human
uaacauuauauugcaa

SEQ ID NO: 2141072 - RNA, 17 nt, Human
uaacauuauauugcaau

SEQ ID NO: 2141073 - RNA, 13 nt, Human
uaaccaaaugcau

SEQ ID NO: 2141074 - RNA, 14 nt, Human
uaaccaaaugcauc

SEQ ID NO: 2141075 - RNA, 21 nt, Human
uaaccaaaugcaucaauccug

SEQ ID NO: 2141076 - RNA, 22 nt, Human
uaaccaaaugcaucaauccugu

SEQ ID NO: 2141077 - RNA, 18 nt, Human
uaacagcuaccaugacaa

SEQ ID NO: 2141078 - RNA, 13 nt, Human
uaaccacggaaaa

SEQ ID NO: 2141079 - RNA, 12 nt, Human
uaaccaauguuu

SEQ ID NO: 2141080 - RNA, 14 nt, Human
uaaccaauguuuaa

SEQ ID NO: 2141081 - RNA, 17 nt, Human
uaaccaauguuuaaaaa

SEQ ID NO: 2141082 - RNA, 22 nt, Human
uaaccaauguuuaaaaaaguuu

SEQ ID NO: 2141083 - RNA, 11 nt, Human
uaacuccacca

SEQ ID NO: 2141084 - RNA, 16 nt, Human
uaacuccaccaaccca

SEQ ID NO: 2141085 - RNA, 22 nt, Human
uaacuccaccaacccaucagaa

SEQ ID NO: 2141086 - RNA, 17 nt, Human
uaacucaucauaaaaua

SEQ ID NO: 2141087 - RNA, 15 nt, Human
uaacucaucauaaaa

SEQ ID NO: 2141088 - RNA, 16 nt, Human
uaacucaucauaaaau

SEQ ID NO: 2141089 - RNA, 15 nt, Human
uaacucaggacucca

SEQ ID NO: 2141090 - RNA, 16 nt, Human
uaacucaggacuccag

SEQ ID NO: 2141091 - RNA, 17 nt, Human
uaacucaggacuccagc

SEQ ID NO: 2141092 - RNA, 18 nt, Human
uaacucaggacuccagcc

SEQ ID NO: 2141093 - RNA, 20 nt, Human
uaacucaggacuccagccca

SEQ ID NO: 2141094 - RNA, 21 nt, Human
uaacucaggacuccagcccau

SEQ ID NO: 2141095 - RNA, 14 nt, Human
uaacucaucauaaa

SEQ ID NO: 2141096 - RNA, 22 nt, Human
uaacucagaaacaucaguuacu

SEQ ID NO: 2141097 - RNA, 21 nt, Human
uaaccagggcaccaagcccac

SEQ ID NO: 2141098 - RNA, 19 nt, Human
uaaccucagugucauuuau

SEQ ID NO: 2141099 - RNA, 20 nt, Human
uaaccucagugucauuuaug

SEQ ID NO: 2141100 - RNA, 14 nt, Human
uaacuccagugaag

SEQ ID NO: 2141101 - RNA, 17 nt, Human
uaacugcauugagaacu

SEQ ID NO: 2141102 - RNA, 16 nt, Human
uaacugcauuuuuaga

SEQ ID NO: 2141103 - RNA, 23 nt, Human
uaacugccaucaagaugagagaa

SEQ ID NO: 2141104 - RNA, 17 nt, Human
uaacugcccaaagcagc

SEQ ID NO: 2141105 - RNA, 21 nt, Human
uaacugcccaaagcagcacuu

SEQ ID NO: 2141106 - RNA, 24 nt, Human
uaacuggcaguuuuccauugguuu

SEQ ID NO: 2141107 - RNA, 18 nt, Human
uaacugccuuaaaacuuu

SEQ ID NO: 2141108 - RNA, 23 nt, Human
uaacuggcaguuuuccauugguu

SEQ ID NO: 2141109 - RNA, 14 nt, Human
uaaagcuagaaaug

SEQ ID NO: 2141110 - RNA, 17 nt, Human
uaaaggagaaggcauga

SEQ ID NO: 2141111 - RNA, 22 nt, Human
uaaaggagaaggcaugaaauug

SEQ ID NO: 2141112 - RNA, 14 nt, Human
uaaaggacagugaa

SEQ ID NO: 2141113 - RNA, 15 nt, Human
uaaagcuagaaauga

SEQ ID NO: 2141114 - RNA, 21 nt, Human
uaaagccugcuuuuuaagugu

SEQ ID NO: 2141115 - RNA, 16 nt, Human
uaaagccugcuuuuua

SEQ ID NO: 2141116 - RNA, 23 nt, Human
uaaagcauucaauuuauucaaga

SEQ ID NO: 2141117 - RNA, 22 nt, Human
uaaagcaugaaugguauggaac

SEQ ID NO: 2141118 - RNA, 19 nt, Human
uaaagcaguggacaccagg

SEQ ID NO: 2141119 - RNA, 14 nt, Human
uaaagcaucuaaac

SEQ ID NO: 2141120 - RNA, 15 nt, Human
uaaagcaucuaaacu

SEQ ID NO: 2141121 - RNA, 16 nt, Human
uaaagcaucuaaacuu

SEQ ID NO: 2141122 - RNA, 18 nt, Human
uaaagcaucuaaacuuua

SEQ ID NO: 2141123 - RNA, 14 nt, Human
uaaacuuuuagaaa

SEQ ID NO: 2141124 - RNA, 17 nt, Human
uaaacuuuuagaaacuu

SEQ ID NO: 2141125 - RNA, 19 nt, Human
uaaagcagucacuuuuccu

SEQ ID NO: 2141126 - RNA, 13 nt, Human
uaaagcaguggac

SEQ ID NO: 2141127 - RNA, 22 nt, Human
uaaauaaaacauuuucacacaa

SEQ ID NO: 2141128 - RNA, 21 nt, Human
uaaauaaaacauuuucacaca

SEQ ID NO: 2141129 - RNA, 20 nt, Human
uaaauaaaaaauaauaauac

SEQ ID NO: 2141130 - RNA, 21 nt, Human
uaaauaaaaaauaauaauaca

SEQ ID NO: 2141131 - RNA, 22 nt, Human
uaaauaaaaaauaauaauacaa

SEQ ID NO: 2141132 - RNA, 23 nt, Human
uaaauaaaaaauaauaauacaag

SEQ ID NO: 2141133 - RNA, 14 nt, Human
uaaauaaaaaugga

SEQ ID NO: 2141134 - RNA, 12 nt, Human
uaaaguucugug

SEQ ID NO: 2141135 - RNA, 13 nt, Human
uaaaguucugugu

SEQ ID NO: 2141136 - RNA, 14 nt, Human
uaaaguucugugua

SEQ ID NO: 2141137 - RNA, 23 nt, Human
uaaaguucuguguauuuaauugu

SEQ ID NO: 2141138 - RNA, 20 nt, Human
uaaaguugaagcuaagauuu

SEQ ID NO: 2141139 - RNA, 13 nt, Human
uaaaguuucuguu

SEQ ID NO: 2141140 - RNA, 20 nt, Human
uaaauaaacacauagauuca

SEQ ID NO: 2141141 - RNA, 23 nt, Human
uaaauaaacacauagauucaccu

SEQ ID NO: 2141142 - RNA, 11 nt, Human
uaaauaaaaua

SEQ ID NO: 2141143 - RNA, 12 nt, Human
uaaauaaaauaa

SEQ ID NO: 2141144 - RNA, 14 nt, Human
uaaauaaaauaacc

SEQ ID NO: 2141145 - RNA, 17 nt, Human
uaaauaaaauauaauug

SEQ ID NO: 2141146 - RNA, 17 nt, Human
uaaauaaaagugaucaa

SEQ ID NO: 2141147 - RNA, 20 nt, Human
uaaauaaaagaaaugcacaa

SEQ ID NO: 2141148 - RNA, 21 nt, Human
uaaauaaaagaaaugcacaau

SEQ ID NO: 2141149 - RNA, 14 nt, Human
uaaauaaaagcagc

SEQ ID NO: 2141150 - RNA, 15 nt, Human
uaaauaaaagcagca

SEQ ID NO: 2141151 - RNA, 19 nt, Human
uaaauaaaagcagcaucug

SEQ ID NO: 2141152 - RNA, 20 nt, Human
uaaauaaaagcagcaucugc

SEQ ID NO: 2141153 - RNA, 19 nt, Human
uaaauaaaagugaucaaua

SEQ ID NO: 2141154 - RNA, 13 nt, Human
uaaauauauguau

SEQ ID NO: 2141155 - RNA, 14 nt, Human
uaaauauauguaug

SEQ ID NO: 2141156 - RNA, 15 nt, Human
uaaauauauguaugu

SEQ ID NO: 2141157 - RNA, 16 nt, Human
uaaauauauguaugua

SEQ ID NO: 2141158 - RNA, 19 nt, Human
uaaauauauguauguaaaa

SEQ ID NO: 2141159 - RNA, 20 nt, Human
uaaauauauguauguaaaaa

SEQ ID NO: 2141160 - RNA, 15 nt, Human
uaaauauauuuucaa

SEQ ID NO: 2141161 - RNA, 14 nt, Human
uaaauaucaaucau

SEQ ID NO: 2141162 - RNA, 16 nt, Human
uaaauaucaaucauuu

SEQ ID NO: 2141163 - RNA, 17 nt, Human
uaaauaucuucugauuu

SEQ ID NO: 2141164 - RNA, 18 nt, Human
uaaauaucuucugauuug

SEQ ID NO: 2141165 - RNA, 22 nt, Human
uaaauaucuguacuucuucgau

SEQ ID NO: 2141166 - RNA, 11 nt, Human
uaaaucagugg

SEQ ID NO: 2141167 - RNA, 21 nt, Human
uaaaucauguuaauccuagcu

SEQ ID NO: 2141168 - RNA, 22 nt, Human
uaaaucauguuaauccuagcug

SEQ ID NO: 2141169 - RNA, 19 nt, Human
uaaaucaaguuggcuucua

SEQ ID NO: 2141170 - RNA, 23 nt, Human
uaaaucaaugucacuuaaaggcu

SEQ ID NO: 2141171 - RNA, 14 nt, Human
uaaaucaaugucac

SEQ ID NO: 2141172 - RNA, 19 nt, Human
uaaaucagccguguaacca

SEQ ID NO: 2141173 - RNA, 21 nt, Human
uaaauauguuagcaaagaguu

SEQ ID NO: 2141174 - RNA, 18 nt, Human
uaaauauguuagcaaaga

SEQ ID NO: 2141175 - RNA, 10 nt, Human
uaaauauuua

SEQ ID NO: 2141176 - RNA, 11 nt, Human
uaaauauuuac

SEQ ID NO: 2141177 - RNA, 17 nt, Human
uaaauauuuacauauga

SEQ ID NO: 2141178 - RNA, 18 nt, Human
uaaauauuuacauaugaa

SEQ ID NO: 2141179 - RNA, 19 nt, Human
uaaauauuuacauaugaaa

SEQ ID NO: 2141180 - RNA, 21 nt, Human
uaaauauuuacauaugaaauu

SEQ ID NO: 2141181 - RNA, 16 nt, Human
uaaauauuuauguaga

SEQ ID NO: 2141182 - RNA, 17 nt, Human
uaaauauuuauguagau

SEQ ID NO: 2141183 - RNA, 12 nt, Human
uaaauauuuccu

SEQ ID NO: 2141184 - RNA, 13 nt, Human
uaaauauuuccuu

SEQ ID NO: 2141185 - RNA, 14 nt, Human
uaaauauuuccuua

SEQ ID NO: 2141186 - RNA, 15 nt, Human
uaaauauuuccuuaa

SEQ ID NO: 2141187 - RNA, 14 nt, Human
uaaaaugaaauuac

SEQ ID NO: 2141188 - RNA, 20 nt, Human
uaaaaugagguucaacuguu

SEQ ID NO: 2141189 - RNA, 11 nt, Human
uaaaaucacua

SEQ ID NO: 2141190 - RNA, 16 nt, Human
uaaaaucacuaacauu

SEQ ID NO: 2141191 - RNA, 17 nt, Human
uaaaaucacuaacauua

SEQ ID NO: 2141192 - RNA, 18 nt, Human
uaaaaucacuaacauuau

SEQ ID NO: 2141193 - RNA, 19 nt, Human
uaaaaucacuaacauuaua

SEQ ID NO: 2141194 - RNA, 20 nt, Human
uaaaaucacuaacauuauau

SEQ ID NO: 2141195 - RNA, 18 nt, Human
uaaaaucacucucagugc

SEQ ID NO: 2141196 - RNA, 20 nt, Human
uaaaauccugcuuaaaacuu

SEQ ID NO: 2141197 - RNA, 13 nt, Human
uaaaagaucgcag

SEQ ID NO: 2141198 - RNA, 15 nt, Human
uaaaaaugguaaaau

SEQ ID NO: 2141199 - RNA, 16 nt, Human
uaaaaaugguaaaauu

SEQ ID NO: 2141200 - RNA, 17 nt, Human
uaaaaaugguaaaauug

SEQ ID NO: 2141201 - RNA, 18 nt, Human
uaaaaaugguaaaauugc

SEQ ID NO: 2141202 - RNA, 15 nt, Human
uaaaagcauaaaugc

SEQ ID NO: 2141203 - RNA, 15 nt, Human
uaaaagccaucaugu

SEQ ID NO: 2141204 - RNA, 18 nt, Human
uaaaagccaucauguaaa

SEQ ID NO: 2141205 - RNA, 20 nt, Human
uaaaagccaucauguaaauu

SEQ ID NO: 2141206 - RNA, 17 nt, Human
uaaaagcauaaaugcaa

SEQ ID NO: 2141207 - RNA, 18 nt, Human
uaaaagcauaaaugcaaa

SEQ ID NO: 2141208 - RNA, 12 nt, Human
uaaacuuuaaua

SEQ ID NO: 2141209 - RNA, 15 nt, Human
uaaacuuuaauaugu

SEQ ID NO: 2141210 - RNA, 16 nt, Human
uaaacuuuaauaugua

SEQ ID NO: 2141211 - RNA, 17 nt, Human
uaaacuuuaauauguau

SEQ ID NO: 2141212 - RNA, 18 nt, Human
uaaacuuuagaguagcau

SEQ ID NO: 2141213 - RNA, 20 nt, Human
uaaacauaauucuuguauau

SEQ ID NO: 2141214 - RNA, 15 nt, Human
uaaacauaauucuug

SEQ ID NO: 2141215 - RNA, 13 nt, Human
uaaacugcccugu

SEQ ID NO: 2141216 - RNA, 15 nt, Human
uaaacugcccugucu

SEQ ID NO: 2141217 - RNA, 16 nt, Human
uaaacugcccugucua

SEQ ID NO: 2141218 - RNA, 18 nt, Human
uaaacagcuucaugccuu

SEQ ID NO: 2141219 - RNA, 23 nt, Human
uaaacagcuucaugccuuuguaa

SEQ ID NO: 2141220 - RNA, 13 nt, Human
uaaacagugccug

SEQ ID NO: 2141221 - RNA, 17 nt, Human
uaaacagugccugcuga

SEQ ID NO: 2141222 - RNA, 18 nt, Human
uaaacagugccugcugaa

SEQ ID NO: 2141223 - RNA, 12 nt, Human
uaaacagugccu

SEQ ID NO: 2141224 - RNA, 19 nt, Human
uaaacaaauguaugauuac

SEQ ID NO: 2141225 - RNA, 12 nt, Human
uaaacaaaugua

SEQ ID NO: 2141226 - RNA, 15 nt, Human
uaaaaauggacaaaa

SEQ ID NO: 2141227 - RNA, 18 nt, Human
uaaacaauuuauuuuauu

SEQ ID NO: 2141228 - RNA, 24 nt, Human
uaaacaauuuauuuuauuuuagca

SEQ ID NO: 2141229 - RNA, 13 nt, Human
uaaacacauagau

SEQ ID NO: 2141230 - RNA, 16 nt, Human
uaaacacauagauuca

SEQ ID NO: 2141231 - RNA, 20 nt, Human
uaaacacauagauucaccug

SEQ ID NO: 2141232 - RNA, 12 nt, Human
guuuuucaguuu

SEQ ID NO: 2141233 - RNA, 16 nt, Human
guuuuuauuccuugug

SEQ ID NO: 2141234 - RNA, 21 nt, Human
guuuuuaugaagaaaaaauac

SEQ ID NO: 2141235 - RNA, 16 nt, Human
guuuuuauggggcuga

SEQ ID NO: 2141236 - RNA, 18 nt, Human
guuuuuauggggcugaac

SEQ ID NO: 2141237 - RNA, 20 nt, Human
uaaaaaaauaauaauaaugu

SEQ ID NO: 2141238 - RNA, 22 nt, Human
uaaaaaaauacaguauucugua

SEQ ID NO: 2141239 - RNA, 13 nt, Human
uaaaaaaaugaca

SEQ ID NO: 2141240 - RNA, 16 nt, Human
uaaaaaaaauaauaaa

SEQ ID NO: 2141241 - RNA, 17 nt, Human
uaaaaaaaauaauaaau

SEQ ID NO: 2141242 - RNA, 19 nt, Human
uaaaaaaaauccuucuaau

SEQ ID NO: 2141243 - RNA, 20 nt, Human
uaaaaaaaauccuucuaauc

SEQ ID NO: 2141244 - RNA, 13 nt, Human
uaaaaaaaaugaa

SEQ ID NO: 2141245 - RNA, 17 nt, Human
uaaaaaaaaugaaaugu

SEQ ID NO: 2141246 - RNA, 20 nt, Human
uaaaaaaaaugaaauguuuu

SEQ ID NO: 2141247 - RNA, 14 nt, Human
uaaaaaacaaagaa

SEQ ID NO: 2141248 - RNA, 19 nt, Human
uaaaaaacaaagaagacaa

SEQ ID NO: 2141249 - RNA, 20 nt, Human
uaaaaaacugcugacuguuu

SEQ ID NO: 2141250 - RNA, 23 nt, Human
uaaaaaacugcugacuguuuucu

SEQ ID NO: 2141251 - RNA, 15 nt, Human
uaaaaaacuuguaaa

SEQ ID NO: 2141252 - RNA, 12 nt, Human
uaaaaaagucuc

SEQ ID NO: 2141253 - RNA, 13 nt, Human
uaaaaaagucucu

SEQ ID NO: 2141254 - RNA, 14 nt, Human
uaaaaaagucucua

SEQ ID NO: 2141255 - RNA, 16 nt, Human
uaaaaaagucucuauu

SEQ ID NO: 2141256 - RNA, 17 nt, Human
uaaaaaagucucuauuu

SEQ ID NO: 2141257 - RNA, 18 nt, Human
uaaaaaagucucuauuua

SEQ ID NO: 2141258 - RNA, 19 nt, Human
uaaaaaagucucuauuuaa

SEQ ID NO: 2141259 - RNA, 20 nt, Human
uaaaaaagucucuauuuaaa

SEQ ID NO: 2141260 - RNA, 21 nt, Human
uaaaaaagucucuauuuaaau

SEQ ID NO: 2141261 - RNA, 22 nt, Human
uaaaaaagucucuauuuaaauu

SEQ ID NO: 2141262 - RNA, 17 nt, Human
uaaaaaaguuuaaaaug

SEQ ID NO: 2141263 - RNA, 18 nt, Human
uaaaaaaguuuaaaaugu

SEQ ID NO: 2141264 - RNA, 20 nt, Human
uaaaaaaguuuaaaauguau

SEQ ID NO: 2141265 - RNA, 17 nt, Human
uaaaaaauaauaauaca

SEQ ID NO: 2141266 - RNA, 19 nt, Human
uaaaaaauaauaauacaag

SEQ ID NO: 2141267 - RNA, 15 nt, Human
uaaaaaauuuuguaa

SEQ ID NO: 2141268 - RNA, 17 nt, Human
uaaaaaauuuuguaauu

SEQ ID NO: 2141269 - RNA, 13 nt, Human
uaaaaaaugucca

SEQ ID NO: 2141270 - RNA, 18 nt, Human
uaaaaacagcauugcuuu

SEQ ID NO: 2141271 - RNA, 19 nt, Human
uaaaaacagcauugcuuuc

SEQ ID NO: 2141272 - RNA, 17 nt, Human
uaaaaacagcauugcuu

SEQ ID NO: 2141273 - RNA, 11 nt, Human
uaaaaaugcaa

SEQ ID NO: 2141274 - RNA, 16 nt, Human
uaaaaacugacuccuu

SEQ ID NO: 2141275 - RNA, 17 nt, Human
uaaaaacugacuccuua

SEQ ID NO: 2141276 - RNA, 20 nt, Human
uaaaaacagcauugcuuucu

SEQ ID NO: 2141277 - RNA, 22 nt, Human
uaaaaacagcauugcuuucuga

SEQ ID NO: 2141278 - RNA, 14 nt, Human
uaaaaaccaagaag

SEQ ID NO: 2141279 - RNA, 20 nt, Human
guuuucuccugccugugcug

SEQ ID NO: 2141280 - RNA, 15 nt, Human
guuuuguagguacuu

SEQ ID NO: 2141281 - RNA, 18 nt, Human
guuuuguagguacuuuug

SEQ ID NO: 2141282 - RNA, 12 nt, Human
guuuucucuuga

SEQ ID NO: 2141283 - RNA, 19 nt, Human
guuuucucuugagagggug

SEQ ID NO: 2141284 - RNA, 23 nt, Human
guuuucucaacaaauggaaugcc

SEQ ID NO: 2141285 - RNA, 14 nt, Human
guuuuguuuuuuag

SEQ ID NO: 2141286 - RNA, 20 nt, Human
guuuuguuuuuuaguuccca

SEQ ID NO: 2141287 - RNA, 17 nt, Human
guuuuguuuuaaaauua

SEQ ID NO: 2141288 - RNA, 17 nt, Human
guuuugucaaacuguag

SEQ ID NO: 2141289 - RNA, 24 nt, Human
guuuugucaaacuguagaaaugau

SEQ ID NO: 2141290 - RNA, 19 nt, Human
guuuuguggaggagcucag

SEQ ID NO: 2141291 - RNA, 18 nt, Human
guuuugugauguuugucc

SEQ ID NO: 2141292 - RNA, 17 nt, Human
guuuuuacuuucuguug

SEQ ID NO: 2141293 - RNA, 16 nt, Human
guuuuuagagacaggg

SEQ ID NO: 2141294 - RNA, 15 nt, Human
guuuuuaacucaaua

SEQ ID NO: 2141295 - RNA, 15 nt, Human
guuuuuaaauauauu

SEQ ID NO: 2141296 - RNA, 19 nt, Human
guuuuuaacucaauauuuu

SEQ ID NO: 2141297 - RNA, 21 nt, Human
guuuuuaccuaccacaguguc

SEQ ID NO: 2141298 - RNA, 22 nt, Human
guuuuuaccuaccacagugucu

SEQ ID NO: 2141299 - RNA, 16 nt, Human
guuuuuacuacaguug

SEQ ID NO: 2141300 - RNA, 18 nt, Human
guuuguuucucccccugg

SEQ ID NO: 2141301 - RNA, 21 nt, Human
guuuguuucucccccugggcu

SEQ ID NO: 2141302 - RNA, 19 nt, Human
guuuguuucucccccuggg

SEQ ID NO: 2141303 - RNA, 20 nt, Human
guuuguuucucccccugggc

SEQ ID NO: 2141304 - RNA, 15 nt, Human
guuuguggccucaga

SEQ ID NO: 2141305 - RNA, 14 nt, Human
guuuucauaauaaa

SEQ ID NO: 2141306 - RNA, 22 nt, Human
guuuucauaauaaaacuuuaaa

SEQ ID NO: 2141307 - RNA, 17 nt, Human
guuuucaguguacaugg

SEQ ID NO: 2141308 - RNA, 16 nt, Human
guuuucaguguacaug

SEQ ID NO: 2141309 - RNA, 20 nt, Human
guuuucgaagcucagcccac

SEQ ID NO: 2141310 - RNA, 23 nt, Human
guuuucgaagcucagcccacccc

SEQ ID NO: 2141311 - RNA, 17 nt, Human
guuuucgaagcucagcc

SEQ ID NO: 2141312 - RNA, 18 nt, Human
guuuucgaagcucagccc

SEQ ID NO: 2141313 - RNA, 19 nt, Human
guuuucgaagcucagccca

SEQ ID NO: 2141314 - RNA, 19 nt, Human
guuuucuccugccugugcu

SEQ ID NO: 2141315 - RNA, 14 nt, Human
guuuuccacccugg

SEQ ID NO: 2141316 - RNA, 16 nt, Human
guuuuccacccuggaa

SEQ ID NO: 2141317 - RNA, 16 nt, Human
guuuucauguaaauaa

SEQ ID NO: 2141318 - RNA, 14 nt, Human
guuuccuucagugc

SEQ ID NO: 2141319 - RNA, 20 nt, Human
guuucgugaaguauacugua

SEQ ID NO: 2141320 - RNA, 13 nt, Human
guuugaauauaaa

SEQ ID NO: 2141321 - RNA, 19 nt, Human
guuugaauauaaacacuau

SEQ ID NO: 2141322 - RNA, 17 nt, Human
guuugaauauaaacacu

SEQ ID NO: 2141323 - RNA, 14 nt, Human
guuugguucugggg

SEQ ID NO: 2141324 - RNA, 14 nt, Human
guuugauccuuguu

SEQ ID NO: 2141325 - RNA, 16 nt, Human
guuugaggcugcagcg

SEQ ID NO: 2141326 - RNA, 13 nt, Human
guuugagcucaga

SEQ ID NO: 2141327 - RNA, 15 nt, Human
guuugagcucagacc

SEQ ID NO: 2141328 - RNA, 16 nt, Human
guuugagcucagaccc

SEQ ID NO: 2141329 - RNA, 15 nt, Human
guuuguaaauaagag

SEQ ID NO: 2141330 - RNA, 17 nt, Human
guuuguaaauaagagau

SEQ ID NO: 2141331 - RNA, 18 nt, Human
guuuguaaauaagagauu

SEQ ID NO: 2141332 - RNA, 19 nt, Human
guuuguggaaaaugaaaau

SEQ ID NO: 2141333 - RNA, 12 nt, Human
guuuguggccuc

SEQ ID NO: 2141334 - RNA, 13 nt, Human
guuuguggccuca

SEQ ID NO: 2141335 - RNA, 14 nt, Human
guuuguggccucag

SEQ ID NO: 2141336 - RNA, 15 nt, Human
guuugucugucuuca

SEQ ID NO: 2141337 - RNA, 18 nt, Human
guuugucugucuucauag

SEQ ID NO: 2141338 - RNA, 19 nt, Human
gguuggcugggcccagaag

SEQ ID NO: 2141339 - RNA, 15 nt, Human
gguuggcugggccca

SEQ ID NO: 2141340 - RNA, 21 nt, Human
gguuggccccugcccggcugc

SEQ ID NO: 2141341 - RNA, 13 nt, Human
gguugcagggagc

SEQ ID NO: 2141342 - RNA, 16 nt, Human
gguugcaaggccgcug

SEQ ID NO: 2141343 - RNA, 16 nt, Human
guuuacuuguuucaga

SEQ ID NO: 2141344 - RNA, 11 nt, Human
guuucauugac

SEQ ID NO: 2141345 - RNA, 20 nt, Human
guuucauugcgaaucuuuuu

SEQ ID NO: 2141346 - RNA, 14 nt, Human
guuuccaagcaaau

SEQ ID NO: 2141347 - RNA, 14 nt, Human
guuuccaaggagcu

SEQ ID NO: 2141348 - RNA, 15 nt, Human
guuuccaaggagcug

SEQ ID NO: 2141349 - RNA, 19 nt, Human
guuuccaaggagcugagaa

SEQ ID NO: 2141350 - RNA, 20 nt, Human
guuuccaaggagcugagaau

SEQ ID NO: 2141351 - RNA, 18 nt, Human
guuuccauuuuuuguucc

SEQ ID NO: 2141352 - RNA, 18 nt, Human
guuucauuuaugauacaa

SEQ ID NO: 2141353 - RNA, 22 nt, Human
guuuccacgaugaaaaacuucc

SEQ ID NO: 2141354 - RNA, 13 nt, Human
guuucccauaauu

SEQ ID NO: 2141355 - RNA, 15 nt, Human
ucaaaaacauucuua

SEQ ID NO: 2141356 - RNA, 23 nt, Human
uauuuuuuucuaccuugaggucu

SEQ ID NO: 2141357 - RNA, 22 nt, Human
ucaaaaacugucaaagaaucaa

SEQ ID NO: 2141358 - RNA, 23 nt, Human
ucaaaaagucuacgcucuccuuu

SEQ ID NO: 2141359 - RNA, 14 nt, Human
uauuuuuuucucuc

SEQ ID NO: 2141360 - RNA, 13 nt, Human
ucaaaaaaugagc

SEQ ID NO: 2141361 - RNA, 14 nt, Human
uauuuuuuucuacc

SEQ ID NO: 2141362 - RNA, 15 nt, Human
uauuuuuuucuaccu

SEQ ID NO: 2141363 - RNA, 18 nt, Human
ucaaaacucauuuccuau

SEQ ID NO: 2141364 - RNA, 22 nt, Human
ucaaaacgguuuuacugcagcu

SEQ ID NO: 2141365 - RNA, 18 nt, Human
ucaaaacggggcagccaa

SEQ ID NO: 2141366 - RNA, 16 nt, Human
ucaaacgugaaaaugc

SEQ ID NO: 2141367 - RNA, 15 nt, Human
ucaaacgugaaaaug

SEQ ID NO: 2141368 - RNA, 14 nt, Human
ucaaacucuuaaaa

SEQ ID NO: 2141369 - RNA, 23 nt, Human
uauuuuuguuggagccacucugu

SEQ ID NO: 2141370 - RNA, 19 nt, Human
uauuuuuguuguguucugu

SEQ ID NO: 2141371 - RNA, 20 nt, Human
uauuuuuguuucuuccaaag

SEQ ID NO: 2141372 - RNA, 13 nt, Human
uauuuuuuaagua

SEQ ID NO: 2141373 - RNA, 14 nt, Human
uauuuuuguuuguu

SEQ ID NO: 2141374 - RNA, 18 nt, Human
uauuuuuguuuguuuugu

SEQ ID NO: 2141375 - RNA, 12 nt, Human
uauuuuuuaauu

SEQ ID NO: 2141376 - RNA, 15 nt, Human
uauuuuuuaauuauu

SEQ ID NO: 2141377 - RNA, 15 nt, Human
uauuuuuuaaguauu

SEQ ID NO: 2141378 - RNA, 21 nt, Human
uauuuuuuaaguauuuauaua

SEQ ID NO: 2141379 - RNA, 16 nt, Human
uauuuuuuaauuauug

SEQ ID NO: 2141380 - RNA, 16 nt, Human
uauuuuuuaauuugau

SEQ ID NO: 2141381 - RNA, 23 nt, Human
uauuuuuuaauuugaugaaagcu

SEQ ID NO: 2141382 - RNA, 13 nt, Human
uauuuuuuauaca

SEQ ID NO: 2141383 - RNA, 14 nt, Human
uauuuuuuauacag

SEQ ID NO: 2141384 - RNA, 12 nt, Human
uauuuuuuauga

SEQ ID NO: 2141385 - RNA, 16 nt, Human
uauuuucuuuuguaaa

SEQ ID NO: 2141386 - RNA, 14 nt, Human
uauuuucuuugaaa

SEQ ID NO: 2141387 - RNA, 21 nt, Human
uauuuucaacgcagcccugcu

SEQ ID NO: 2141388 - RNA, 21 nt, Human
uauuuucaauucaaaaaugua

SEQ ID NO: 2141389 - RNA, 22 nt, Human
uauuuucaauucaaaaauguac

SEQ ID NO: 2141390 - RNA, 12 nt, Human
uauuuucagaau

SEQ ID NO: 2141391 - RNA, 13 nt, Human
uauuuucagaauc

SEQ ID NO: 2141392 - RNA, 14 nt, Human
uauuuucagaaucu

SEQ ID NO: 2141393 - RNA, 20 nt, Human
uauuuucagaaucugaaugu

SEQ ID NO: 2141394 - RNA, 21 nt, Human
uauuuucagaaucugaaugua

SEQ ID NO: 2141395 - RNA, 22 nt, Human
uauuuucagaaucugaauguaa

SEQ ID NO: 2141396 - RNA, 23 nt, Human
uauuuucagaaucugaauguaau

SEQ ID NO: 2141397 - RNA, 15 nt, Human
uauuuuauauaauaa

SEQ ID NO: 2141398 - RNA, 20 nt, Human
uauuuuauauaauaaaguau

SEQ ID NO: 2141399 - RNA, 21 nt, Human
uauuuuauauaauaaaguauu

SEQ ID NO: 2141400 - RNA, 16 nt, Human
uauuuuauacauuaac

SEQ ID NO: 2141401 - RNA, 21 nt, Human
uauuuuauaaaauuaaagaaa

SEQ ID NO: 2141402 - RNA, 14 nt, Human
uauuuuauguaugu

SEQ ID NO: 2141403 - RNA, 14 nt, Human
uaucugaaaaugua

SEQ ID NO: 2141404 - RNA, 15 nt, Human
uaucugaaaauguau

SEQ ID NO: 2141405 - RNA, 23 nt, Human
uaucucuuuugaauccaugcuug

SEQ ID NO: 2141406 - RNA, 20 nt, Human
uaucugaaaauguaugugua

SEQ ID NO: 2141407 - RNA, 15 nt, Human
uauuuauuaaauuuu

SEQ ID NO: 2141408 - RNA, 13 nt, Human
uauuuauuaaauu

SEQ ID NO: 2141409 - RNA, 14 nt, Human
uauuuauuaaauuu

SEQ ID NO: 2141410 - RNA, 17 nt, Human
uauuuauugcuacuucc

SEQ ID NO: 2141411 - RNA, 21 nt, Human
uauuuauugcuacuuccugcc

SEQ ID NO: 2141412 - RNA, 13 nt, Human
uauuuauuguauu

SEQ ID NO: 2141413 - RNA, 16 nt, Human
uauuuauuguuuauuu

SEQ ID NO: 2141414 - RNA, 11 nt, Human
uauuuauuuaa

SEQ ID NO: 2141415 - RNA, 22 nt, Human
uauuuauuguuuauuuaucagu

SEQ ID NO: 2141416 - RNA, 13 nt, Human
uauuuauuaagau

SEQ ID NO: 2141417 - RNA, 13 nt, Human
uauuuauuaccuc

SEQ ID NO: 2141418 - RNA, 16 nt, Human
uauuuauuaccucuga

SEQ ID NO: 2141419 - RNA, 15 nt, Human
uauuuauuaccucug

SEQ ID NO: 2141420 - RNA, 21 nt, Human
uauuuuagacaaaucuaaggg

SEQ ID NO: 2141421 - RNA, 13 nt, Human
uauuuuagcaguu

SEQ ID NO: 2141422 - RNA, 20 nt, Human
uauuuuagcaguucugcaaa

SEQ ID NO: 2141423 - RNA, 21 nt, Human
uauuuuagcaguucugcaaau

SEQ ID NO: 2141424 - RNA, 22 nt, Human
uauuuuagcaguucugcaaaua

SEQ ID NO: 2141425 - RNA, 11 nt, Human
uauuucugaga

SEQ ID NO: 2141426 - RNA, 16 nt, Human
uauuucugagaagguc

SEQ ID NO: 2141427 - RNA, 21 nt, Human
uauuucugagaagguccuuaa

SEQ ID NO: 2141428 - RNA, 20 nt, Human
uauuucuuaaacaaauguau

SEQ ID NO: 2141429 - RNA, 14 nt, Human
uauuugagacauuc

SEQ ID NO: 2141430 - RNA, 16 nt, Human
uauuugagacuaguuu

SEQ ID NO: 2141431 - RNA, 17 nt, Human
ucaagcgauucuucugc

SEQ ID NO: 2141432 - RNA, 13 nt, Human
ucaagcuaauaaa

SEQ ID NO: 2141433 - RNA, 19 nt, Human
ucaagcuaauaaaauauca

SEQ ID NO: 2141434 - RNA, 20 nt, Human
ucaagcuaauaaaauaucau

SEQ ID NO: 2141435 - RNA, 22 nt, Human
ucaagcuaauaaaauaucauuc

SEQ ID NO: 2141436 - RNA, 23 nt, Human
ucaagcuaauaaaauaucauuca

SEQ ID NO: 2141437 - RNA, 16 nt, Human
ucaagcgauucuucug

SEQ ID NO: 2141438 - RNA, 14 nt, Human
ucaagccugccuag

SEQ ID NO: 2141439 - RNA, 17 nt, Human
ucaagccaagcagccaa

SEQ ID NO: 2141440 - RNA, 12 nt, Human
ucaagcccugca

SEQ ID NO: 2141441 - RNA, 13 nt, Human
ucaagcccugcag

SEQ ID NO: 2141442 - RNA, 15 nt, Human
ucaagccaagcagcc

SEQ ID NO: 2141443 - RNA, 16 nt, Human
ucaagccaagcagcca

SEQ ID NO: 2141444 - RNA, 19 nt, Human
ucaagccaagcagccaagc

SEQ ID NO: 2141445 - RNA, 19 nt, Human
ucaagcccaggaggacugc

SEQ ID NO: 2141446 - RNA, 19 nt, Human
ucaagcagucuacccaccu

SEQ ID NO: 2141447 - RNA, 20 nt, Human
ucaagcagucuacccaccuc

SEQ ID NO: 2141448 - RNA, 14 nt, Human
ucaagcaucuccug

SEQ ID NO: 2141449 - RNA, 18 nt, Human
ucaagcaucuccugagga

SEQ ID NO: 2141450 - RNA, 22 nt, Human
ucaagcaucuccugaggaucag

SEQ ID NO: 2141451 - RNA, 23 nt, Human
ucaagcaucuccugaggaucaga

SEQ ID NO: 2141452 - RNA, 14 nt, Human
ucaagccaagcagc

SEQ ID NO: 2141453 - RNA, 22 nt, Human
ucaagugauucuccugccucag

SEQ ID NO: 2141454 - RNA, 17 nt, Human
ucaagccgcaucccaga

SEQ ID NO: 2141455 - RNA, 19 nt, Human
ucaagugcaugcucucugc

SEQ ID NO: 2141456 - RNA, 20 nt, Human
ucaagugcaugcucucugca

SEQ ID NO: 2141457 - RNA, 21 nt, Human
ucaagugcaugcucucugcag

SEQ ID NO: 2141458 - RNA, 22 nt, Human
ucaagugcaugcucucugcagc

SEQ ID NO: 2141459 - RNA, 14 nt, Human
ucaagcugcuugga

SEQ ID NO: 2141460 - RNA, 16 nt, Human
ucaacucaccuaaugu

SEQ ID NO: 2141461 - RNA, 19 nt, Human
ucaacucaccuaauguuua

SEQ ID NO: 2141462 - RNA, 14 nt, Human
ucaaccuccugggc

SEQ ID NO: 2141463 - RNA, 13 nt, Human
ucaaccuccuggg

SEQ ID NO: 2141464 - RNA, 16 nt, Human
ucaaacugaagccaga

SEQ ID NO: 2141465 - RNA, 22 nt, Human
ucaaacucuugaccucagguga

SEQ ID NO: 2141466 - RNA, 11 nt, Human
ucacaggcagg

SEQ ID NO: 2141467 - RNA, 23 nt, Human
ucacacagugagucgaggacagg

SEQ ID NO: 2141468 - RNA, 22 nt, Human
ucacacagugagucgaggacag

SEQ ID NO: 2141469 - RNA, 14 nt, Human
ucacacaaagcaga

SEQ ID NO: 2141470 - RNA, 13 nt, Human
ucacacagugagu

SEQ ID NO: 2141471 - RNA, 22 nt, Human
ucacacaguauuacuucugcua

SEQ ID NO: 2141472 - RNA, 21 nt, Human
ucacacaguauuacuucugcu

SEQ ID NO: 2141473 - RNA, 19 nt, Human
ucacacaauacaauaaguu

SEQ ID NO: 2141474 - RNA, 10 nt, Human
ucacacacac

SEQ ID NO: 2141475 - RNA, 13 nt, Human
ucacacaaagcag

SEQ ID NO: 2141476 - RNA, 16 nt, Human
ucacaauagaaacuca

SEQ ID NO: 2141477 - RNA, 23 nt, Human
ucacaaugaaaugcucuccuuuc

SEQ ID NO: 2141478 - RNA, 20 nt, Human
ucacaaguuguguuugauau

SEQ ID NO: 2141479 - RNA, 22 nt, Human
ucacaaugaaaugcucuccuuu

SEQ ID NO: 2141480 - RNA, 18 nt, Human
ucacaauaaauguauuca

SEQ ID NO: 2141481 - RNA, 14 nt, Human
ucacaauagaaacu

SEQ ID NO: 2141482 - RNA, 21 nt, Human
ucacaauggugcucauuucau

SEQ ID NO: 2141483 - RNA, 17 nt, Human
ucaaugcuauaacuaug

SEQ ID NO: 2141484 - RNA, 18 nt, Human
ucaaugcacugacauugu

SEQ ID NO: 2141485 - RNA, 17 nt, Human
ucaaugguuugcaagga

SEQ ID NO: 2141486 - RNA, 16 nt, Human
ucaauuaaauguaggu

SEQ ID NO: 2141487 - RNA, 14 nt, Human
ucaaugcacugaca

SEQ ID NO: 2141488 - RNA, 21 nt, Human
ucaaguuauugacaaacucuc

SEQ ID NO: 2141489 - RNA, 15 nt, Human
ucaaguuagcucagg

SEQ ID NO: 2141490 - RNA, 16 nt, Human
ucaagugucucagucc

SEQ ID NO: 2141491 - RNA, 21 nt, Human
ucaagugucucaguccaccug

SEQ ID NO: 2141492 - RNA, 14 nt, Human
ucaaguuaaaguga

SEQ ID NO: 2141493 - RNA, 17 nt, Human
ucaauacaguacaggca

SEQ ID NO: 2141494 - RNA, 18 nt, Human
ucaauacaguacaggcag

SEQ ID NO: 2141495 - RNA, 19 nt, Human
ucaauacaguacaggcagc

SEQ ID NO: 2141496 - RNA, 20 nt, Human
ucaauacaguacaggcagca

SEQ ID NO: 2141497 - RNA, 12 nt, Human
ucacuuugcucu

SEQ ID NO: 2141498 - RNA, 14 nt, Human
ucacuuugcucuga

SEQ ID NO: 2141499 - RNA, 13 nt, Human
ucacuuuucugua

SEQ ID NO: 2141500 - RNA, 21 nt, Human
ucacuuuucuguaacgccugc

SEQ ID NO: 2141501 - RNA, 16 nt, Human
ucagaaaaacaauaag

SEQ ID NO: 2141502 - RNA, 11 nt, Human
ucagaaaacag

SEQ ID NO: 2141503 - RNA, 12 nt, Human
ucagaaaacaga

SEQ ID NO: 2141504 - RNA, 16 nt, Human
ucagaaaacagaaaaa

SEQ ID NO: 2141505 - RNA, 17 nt, Human
ucagaaaacagaaaaaa

SEQ ID NO: 2141506 - RNA, 20 nt, Human
ucagaaaacagaaaaaaaac

SEQ ID NO: 2141507 - RNA, 14 nt, Human
ucagaaagagcaag

SEQ ID NO: 2141508 - RNA, 23 nt, Human
ucagaaagagcaagucuggaucu

SEQ ID NO: 2141509 - RNA, 16 nt, Human
ucagaaaguaauuucu

SEQ ID NO: 2141510 - RNA, 16 nt, Human
ucacuggcaaugaaaa

SEQ ID NO: 2141511 - RNA, 15 nt, Human
ucacuggcagcccca

SEQ ID NO: 2141512 - RNA, 18 nt, Human
ucacuggcagccccagca

SEQ ID NO: 2141513 - RNA, 19 nt, Human
ucacuggcagccccagcac

SEQ ID NO: 2141514 - RNA, 15 nt, Human
ucacuggcaucuuug

SEQ ID NO: 2141515 - RNA, 16 nt, Human
ucacuggcaucuuugc

SEQ ID NO: 2141516 - RNA, 11 nt, Human
ucacuugcagu

SEQ ID NO: 2141517 - RNA, 16 nt, Human
ucacucugucgcccag

SEQ ID NO: 2141518 - RNA, 12 nt, Human
ucacucugucgc

SEQ ID NO: 2141519 - RNA, 19 nt, Human
ucacucugucgcccagucu

SEQ ID NO: 2141520 - RNA, 22 nt, Human
ucacucugucgcccagucugga

SEQ ID NO: 2141521 - RNA, 18 nt, Human
ucagaggcacaaaagggu

SEQ ID NO: 2141522 - RNA, 15 nt, Human
ucagagcugggaggg

SEQ ID NO: 2141523 - RNA, 15 nt, Human
ucagaggcugaggug

SEQ ID NO: 2141524 - RNA, 21 nt, Human
ucagagggaaaguaaauauuu

SEQ ID NO: 2141525 - RNA, 17 nt, Human
ucagaguccaggcccca

SEQ ID NO: 2141526 - RNA, 14 nt, Human
ucagagggaggaau

SEQ ID NO: 2141527 - RNA, 14 nt, Human
ucagagggcccaaa

SEQ ID NO: 2141528 - RNA, 20 nt, Human
ucagagggcccaaauggcag

SEQ ID NO: 2141529 - RNA, 14 nt, Human
ucagaguccaggcc

SEQ ID NO: 2141530 - RNA, 16 nt, Human
ucagaguccaggcccc

SEQ ID NO: 2141531 - RNA, 23 nt, Human
ucagcacuugggggaucuguugu

SEQ ID NO: 2141532 - RNA, 13 nt, Human
ucagcaauauuua

SEQ ID NO: 2141533 - RNA, 19 nt, Human
ucagcaauauuuaaggaga

SEQ ID NO: 2141534 - RNA, 12 nt, Human
ucagaaauaugu

SEQ ID NO: 2141535 - RNA, 14 nt, Human
ucagacuagugaca

SEQ ID NO: 2141536 - RNA, 14 nt, Human
ucagacugaacaug

SEQ ID NO: 2141537 - RNA, 19 nt, Human
ucagacugaacauguacac

SEQ ID NO: 2141538 - RNA, 13 nt, Human
ucagacugcuggg

SEQ ID NO: 2141539 - RNA, 14 nt, Human
ucagacugcuggga

SEQ ID NO: 2141540 - RNA, 15 nt, Human
ucagacugcugggac

SEQ ID NO: 2141541 - RNA, 16 nt, Human
ucagacugcugggacu

SEQ ID NO: 2141542 - RNA, 17 nt, Human
ucagacugcugggacug

SEQ ID NO: 2141543 - RNA, 21 nt, Human
ucagacugcugggacuggcca

SEQ ID NO: 2141544 - RNA, 23 nt, Human
ucagaggacaccuguacuggaga

SEQ ID NO: 2141545 - RNA, 18 nt, Human
ucacuccuaccugguaau

SEQ ID NO: 2141546 - RNA, 22 nt, Human
ucacgggagauuucuuguugcu

SEQ ID NO: 2141547 - RNA, 18 nt, Human
ucacgggcaguagcugug

SEQ ID NO: 2141548 - RNA, 23 nt, Human
ucacggcaggacaacgaggaagc

SEQ ID NO: 2141549 - RNA, 11 nt, Human
ucacuccuggg

SEQ ID NO: 2141550 - RNA, 12 nt, Human
ucacuccugggg

SEQ ID NO: 2141551 - RNA, 13 nt, Human
ucacuccuggggc

SEQ ID NO: 2141552 - RNA, 15 nt, Human
ucacucgcccccggg

SEQ ID NO: 2141553 - RNA, 20 nt, Human
ucacuccuggggccucuugg

SEQ ID NO: 2141554 - RNA, 20 nt, Human
ucacggcucacugcagccuc

SEQ ID NO: 2141555 - RNA, 15 nt, Human
ucacggcucacugca

SEQ ID NO: 2141556 - RNA, 13 nt, Human
ucacggcucacug

SEQ ID NO: 2141557 - RNA, 22 nt, Human
ucacggcaggacaacgaggaag

SEQ ID NO: 2141558 - RNA, 14 nt, Human
ucacggaagagccu

SEQ ID NO: 2141559 - RNA, 16 nt, Human
ucacggaagagccuug

SEQ ID NO: 2141560 - RNA, 17 nt, Human
ucacggaagagccuugc

SEQ ID NO: 2141561 - RNA, 13 nt, Human
ucacucucagugc

SEQ ID NO: 2141562 - RNA, 20 nt, Human
ucacucuacuuagcaugucc

SEQ ID NO: 2141563 - RNA, 19 nt, Human
ucacucuacuuagcauguc

SEQ ID NO: 2141564 - RNA, 18 nt, Human
ucaccuugcaacacacag

SEQ ID NO: 2141565 - RNA, 19 nt, Human
ucaccuugcaacacacaga

SEQ ID NO: 2141566 - RNA, 21 nt, Human
ucaccuugcaacacacagaca

SEQ ID NO: 2141567 - RNA, 14 nt, Human
ucaccuuucccauc

SEQ ID NO: 2141568 - RNA, 18 nt, Human
ucaccucaggccaggugc

SEQ ID NO: 2141569 - RNA, 15 nt, Human
ucacaggcaggucca

SEQ ID NO: 2141570 - RNA, 12 nt, Human
ucacaggcaggu

SEQ ID NO: 2141571 - RNA, 18 nt, Human
ucacagggcagagccggg

SEQ ID NO: 2141572 - RNA, 19 nt, Human
ucacagggcagagccggga

SEQ ID NO: 2141573 - RNA, 15 nt, Human
ucacagggcagagcc

SEQ ID NO: 2141574 - RNA, 15 nt, Human
ucaccuacuuuguaa

SEQ ID NO: 2141575 - RNA, 14 nt, Human
ucaccuagaaacuu

SEQ ID NO: 2141576 - RNA, 18 nt, Human
ucaccuagaaacuuguua

SEQ ID NO: 2141577 - RNA, 16 nt, Human
ucacagggccccagaa

SEQ ID NO: 2141578 - RNA, 17 nt, Human
ucacagggccccagaag

SEQ ID NO: 2141579 - RNA, 15 nt, Human
ucacgcaccucccau

SEQ ID NO: 2141580 - RNA, 16 nt, Human
ucacgcaccucccauc

SEQ ID NO: 2141581 - RNA, 17 nt, Human
ucaccuuucccuaaaga

SEQ ID NO: 2141582 - RNA, 12 nt, Human
ucaccuuuuaaa

SEQ ID NO: 2141583 - RNA, 16 nt, Human
ucaccuuuuaaauccu

SEQ ID NO: 2141584 - RNA, 18 nt, Human
ucaccuuuuaaauccugu

SEQ ID NO: 2141585 - RNA, 19 nt, Human
ucaccuuuuaaauccuguu

SEQ ID NO: 2141586 - RNA, 22 nt, Human
ucaccuuuuaaauccuguugaa

SEQ ID NO: 2141587 - RNA, 23 nt, Human
ucaccuuuuaaauccuguugaaa

SEQ ID NO: 2141588 - RNA, 14 nt, Human
ucacgccacugcac

SEQ ID NO: 2141589 - RNA, 13 nt, Human
ucacgccacugca

SEQ ID NO: 2141590 - RNA, 16 nt, Human
ucacgccacugcacua

SEQ ID NO: 2141591 - RNA, 17 nt, Human
ucacgcaccucccaucc

SEQ ID NO: 2141592 - RNA, 16 nt, Human
ucacgccacugcacuc

SEQ ID NO: 2141593 - RNA, 17 nt, Human
ucacgccacugcacucc

SEQ ID NO: 2141594 - RNA, 22 nt, Human
ucacgccacugcacuccagccu

SEQ ID NO: 2141595 - RNA, 19 nt, Human
ucacgccuguaauccuagc

SEQ ID NO: 2141596 - RNA, 19 nt, Human
ucacgccuguaaucccagc

SEQ ID NO: 2141597 - RNA, 20 nt, Human
ucacgccuguaaucccagca

SEQ ID NO: 2141598 - RNA, 19 nt, Human
ucacgccuaugaucccagc

SEQ ID NO: 2141599 - RNA, 21 nt, Human
ucacgccuaugaucccagcac

SEQ ID NO: 2141600 - RNA, 23 nt, Human
ucacgcucccaacacaagguggg

SEQ ID NO: 2141601 - RNA, 21 nt, Human
ucacgccuguaaucccagcag

SEQ ID NO: 2141602 - RNA, 13 nt, Human
ucacgccugugca

SEQ ID NO: 2141603 - RNA, 16 nt, Human
ucacgccugugcagug

SEQ ID NO: 2141604 - RNA, 20 nt, Human
ucacgccuguaauccuagca

SEQ ID NO: 2141605 - RNA, 15 nt, Human
uccccagcuguuuau

SEQ ID NO: 2141606 - RNA, 12 nt, Human
ucccccagcccu

SEQ ID NO: 2141607 - RNA, 13 nt, Human
ucccccagcccug

SEQ ID NO: 2141608 - RNA, 14 nt, Human
ucccccagcccugu

SEQ ID NO: 2141609 - RNA, 15 nt, Human
ucccccagcccugug

SEQ ID NO: 2141610 - RNA, 12 nt, Human
ucccccauagcc

SEQ ID NO: 2141611 - RNA, 16 nt, Human
ucccccagcccugugg

SEQ ID NO: 2141612 - RNA, 17 nt, Human
ucccccagcccugugga

SEQ ID NO: 2141613 - RNA, 14 nt, Human
ucccccauagccac

SEQ ID NO: 2141614 - RNA, 15 nt, Human
ucccccauagccacc

SEQ ID NO: 2141615 - RNA, 17 nt, Human
ucccccauccuccccuu

SEQ ID NO: 2141616 - RNA, 18 nt, Human
ucccccauccuccccuuc

SEQ ID NO: 2141617 - RNA, 21 nt, Human
ucccccauccuccccuucccu

SEQ ID NO: 2141618 - RNA, 14 nt, Human
uccccagcuguuua

SEQ ID NO: 2141619 - RNA, 23 nt, Human
uccccagccuuugaucagguggg

SEQ ID NO: 2141620 - RNA, 14 nt, Human
uccccagccucucu

SEQ ID NO: 2141621 - RNA, 16 nt, Human
uccccagccucucuuc

SEQ ID NO: 2141622 - RNA, 17 nt, Human
uccccagccucucuucc

SEQ ID NO: 2141623 - RNA, 18 nt, Human
uccccagccucucuuccu

SEQ ID NO: 2141624 - RNA, 22 nt, Human
uccccagccucucuuccuaucc

SEQ ID NO: 2141625 - RNA, 13 nt, Human
ucccccugcccca

SEQ ID NO: 2141626 - RNA, 16 nt, Human
ucccccugccagugcc

SEQ ID NO: 2141627 - RNA, 17 nt, Human
ucccccugccagugccu

SEQ ID NO: 2141628 - RNA, 18 nt, Human
ucccccugccagugccuu

SEQ ID NO: 2141629 - RNA, 11 nt, Human
ucccccuccuu

SEQ ID NO: 2141630 - RNA, 12 nt, Human
ucccccuccuuc

SEQ ID NO: 2141631 - RNA, 18 nt, Human
ucccccuccuucccagcu

SEQ ID NO: 2141632 - RNA, 19 nt, Human
ucccccuccuucccagcug

SEQ ID NO: 2141633 - RNA, 20 nt, Human
ucccccuccuucccagcugc

SEQ ID NO: 2141634 - RNA, 21 nt, Human
ucccccuccuucccagcugcc

SEQ ID NO: 2141635 - RNA, 19 nt, Human
ucccccauccuccccuucc

SEQ ID NO: 2141636 - RNA, 20 nt, Human
ucccccgcaaugugccccca

SEQ ID NO: 2141637 - RNA, 21 nt, Human
ucccccgcaaugugcccccag

SEQ ID NO: 2141638 - RNA, 21 nt, Human
ucccccguagaaaucccccuu

SEQ ID NO: 2141639 - RNA, 17 nt, Human
ucccccucccagggcca

SEQ ID NO: 2141640 - RNA, 18 nt, Human
ucccccucccagggccag

SEQ ID NO: 2141641 - RNA, 19 nt, Human
ucccccucccagggccagg

SEQ ID NO: 2141642 - RNA, 23 nt, Human
uccccugcccccagaccuuuuau

SEQ ID NO: 2141643 - RNA, 13 nt, Human
uccccugccauuu

SEQ ID NO: 2141644 - RNA, 16 nt, Human
uccccgcauuccaggc

SEQ ID NO: 2141645 - RNA, 18 nt, Human
uccccgcauuccaggcuc

SEQ ID NO: 2141646 - RNA, 19 nt, Human
uccccgcauuccaggcucc

SEQ ID NO: 2141647 - RNA, 15 nt, Human
uccccuucccugcaa

SEQ ID NO: 2141648 - RNA, 13 nt, Human
uccccuucccugc

SEQ ID NO: 2141649 - RNA, 10 nt, Human
ucccccuggg

SEQ ID NO: 2141650 - RNA, 19 nt, Human
uccccuucgcguauuucag

SEQ ID NO: 2141651 - RNA, 22 nt, Human
uccccuucgcguauuucaggau

SEQ ID NO: 2141652 - RNA, 15 nt, Human
ucccuaagccaaggg

SEQ ID NO: 2141653 - RNA, 20 nt, Human
ucccuaagccaagggccucu

SEQ ID NO: 2141654 - RNA, 11 nt, Human
ucccuaccuca

SEQ ID NO: 2141655 - RNA, 15 nt, Human
ucccuaccucaaccu

SEQ ID NO: 2141656 - RNA, 16 nt, Human
ucccuaccucaaccug

SEQ ID NO: 2141657 - RNA, 20 nt, Human
ucccuaccucaaccuguaaa

SEQ ID NO: 2141658 - RNA, 21 nt, Human
ucccuaccucaaccuguaaau

SEQ ID NO: 2141659 - RNA, 22 nt, Human
ucccuaccucaaccuguaaauu

SEQ ID NO: 2141660 - RNA, 13 nt, Human
ucccuaccucagg

SEQ ID NO: 2141661 - RNA, 19 nt, Human
ucccuaccuugaaagaaga

SEQ ID NO: 2141662 - RNA, 15 nt, Human
ucccuaccucaggca

SEQ ID NO: 2141663 - RNA, 17 nt, Human
ucccuaccucaggcagg

SEQ ID NO: 2141664 - RNA, 14 nt, Human
ucccucccucugcc

SEQ ID NO: 2141665 - RNA, 16 nt, Human
ucccucccucugccgg

SEQ ID NO: 2141666 - RNA, 17 nt, Human
ucccucccucuuucccu

SEQ ID NO: 2141667 - RNA, 16 nt, Human
ucccuacuuccuguga

SEQ ID NO: 2141668 - RNA, 15 nt, Human
ucccuacuuccugug

SEQ ID NO: 2141669 - RNA, 15 nt, Human
ucccucccucuuucc

SEQ ID NO: 2141670 - RNA, 19 nt, Human
uccccuguagagugggagc

SEQ ID NO: 2141671 - RNA, 15 nt, Human
uccccuguucacucu

SEQ ID NO: 2141672 - RNA, 22 nt, Human
uccccuguagagugggagcuga

SEQ ID NO: 2141673 - RNA, 17 nt, Human
uccccugcccuggucca

SEQ ID NO: 2141674 - RNA, 24 nt, Human
uccccugcccugguccagggaagc

SEQ ID NO: 2141675 - RNA, 12 nt, Human
uccccugcccug

SEQ ID NO: 2141676 - RNA, 15 nt, Human
uccccugcccugcug

SEQ ID NO: 2141677 - RNA, 16 nt, Human
uccccugcccugcugc

SEQ ID NO: 2141678 - RNA, 23 nt, Human
uccccugcccugcugccgccucc

SEQ ID NO: 2141679 - RNA, 13 nt, Human
uccccugcccugg

SEQ ID NO: 2141680 - RNA, 15 nt, Human
uccccugcccugguc

SEQ ID NO: 2141681 - RNA, 21 nt, Human
ucccaaagugcugggauuaca

SEQ ID NO: 2141682 - RNA, 14 nt, Human
uccauguacuguag

SEQ ID NO: 2141683 - RNA, 16 nt, Human
uccauguacuguaguu

SEQ ID NO: 2141684 - RNA, 20 nt, Human
uccauguacuguaguuuuuc

SEQ ID NO: 2141685 - RNA, 21 nt, Human
uccauguacuguaguuuuucu

SEQ ID NO: 2141686 - RNA, 14 nt, Human
uccauguagcagga

SEQ ID NO: 2141687 - RNA, 15 nt, Human
uccauguagcaggac

SEQ ID NO: 2141688 - RNA, 13 nt, Human
uccauggugccuc

SEQ ID NO: 2141689 - RNA, 15 nt, Human
uccauggugccucug

SEQ ID NO: 2141690 - RNA, 16 nt, Human
uccauggugccucugg

SEQ ID NO: 2141691 - RNA, 17 nt, Human
uccauggugccucugga

SEQ ID NO: 2141692 - RNA, 13 nt, Human
uccauguacugua

SEQ ID NO: 2141693 - RNA, 15 nt, Human
uccaugggggcaggg

SEQ ID NO: 2141694 - RNA, 17 nt, Human
uccaugggggcagggca

SEQ ID NO: 2141695 - RNA, 18 nt, Human
uccaucccuacccccuaa

SEQ ID NO: 2141696 - RNA, 14 nt, Human
uccauggauuuugg

SEQ ID NO: 2141697 - RNA, 15 nt, Human
uccaucccagcggcu

SEQ ID NO: 2141698 - RNA, 14 nt, Human
uccaucccaucauc

SEQ ID NO: 2141699 - RNA, 14 nt, Human
uccaucccuacccc

SEQ ID NO: 2141700 - RNA, 23 nt, Human
uccagcucaccagccccagugcc

SEQ ID NO: 2141701 - RNA, 13 nt, Human
uccagcucagcag

SEQ ID NO: 2141702 - RNA, 15 nt, Human
ucccaagcucugcuc

SEQ ID NO: 2141703 - RNA, 14 nt, Human
ucccaagcucugcu

SEQ ID NO: 2141704 - RNA, 13 nt, Human
ucccaagcucugc

SEQ ID NO: 2141705 - RNA, 12 nt, Human
ucccaagcucug

SEQ ID NO: 2141706 - RNA, 18 nt, Human
ucccaaggcucugagcaa

SEQ ID NO: 2141707 - RNA, 22 nt, Human
ucccaaggaaagccccagcacu

SEQ ID NO: 2141708 - RNA, 12 nt, Human
ucccaaggaaag

SEQ ID NO: 2141709 - RNA, 13 nt, Human
ucccaaggaaagc

SEQ ID NO: 2141710 - RNA, 17 nt, Human
ucccaagcucugcuccu

SEQ ID NO: 2141711 - RNA, 12 nt, Human
ucccaagcugga

SEQ ID NO: 2141712 - RNA, 20 nt, Human
ucccaagcuggagugcagug

SEQ ID NO: 2141713 - RNA, 22 nt, Human
ucccaagcuggagugcaguggu

SEQ ID NO: 2141714 - RNA, 17 nt, Human
uccauguagcaggacug

SEQ ID NO: 2141715 - RNA, 22 nt, Human
uccccacuugagaauuacccuu

SEQ ID NO: 2141716 - RNA, 14 nt, Human
ucccauugcccugg

SEQ ID NO: 2141717 - RNA, 15 nt, Human
ucccauugcccuggu

SEQ ID NO: 2141718 - RNA, 14 nt, Human
ucccauugaaaaug

SEQ ID NO: 2141719 - RNA, 20 nt, Human
ucccauugaaaauguaagua

SEQ ID NO: 2141720 - RNA, 13 nt, Human
ucccauugcccug

SEQ ID NO: 2141721 - RNA, 13 nt, Human
uccccagaccuga

SEQ ID NO: 2141722 - RNA, 17 nt, Human
uccccagaaaggagacu

SEQ ID NO: 2141723 - RNA, 16 nt, Human
uccccagaccugagcu

SEQ ID NO: 2141724 - RNA, 12 nt, Human
ucccaugcccug

SEQ ID NO: 2141725 - RNA, 15 nt, Human
ucccaccucagccuc

SEQ ID NO: 2141726 - RNA, 14 nt, Human
ucccaccucagccu

SEQ ID NO: 2141727 - RNA, 23 nt, Human
ucccaaggcaaggggugccuggg

SEQ ID NO: 2141728 - RNA, 22 nt, Human
ucccaccucaaaugggucuggg

SEQ ID NO: 2141729 - RNA, 22 nt, Human
ucccaaggcucugagcaaaugu

SEQ ID NO: 2141730 - RNA, 18 nt, Human
ucccaaggaaagccccag

SEQ ID NO: 2141731 - RNA, 13 nt, Human
ucccaccucagcc

SEQ ID NO: 2141732 - RNA, 21 nt, Human
ucccaggcgccccuucccccu

SEQ ID NO: 2141733 - RNA, 18 nt, Human
ucccaggcgccccuuccc

SEQ ID NO: 2141734 - RNA, 20 nt, Human
ucccaggcgccccuuccccc

SEQ ID NO: 2141735 - RNA, 24 nt, Human
ucagucugauucccaagcucugcu

SEQ ID NO: 2141736 - RNA, 16 nt, Human
ucagcagcccuccuca

SEQ ID NO: 2141737 - RNA, 17 nt, Human
ucagcagcccuccucac

SEQ ID NO: 2141738 - RNA, 18 nt, Human
ucagcagcccuccucacc

SEQ ID NO: 2141739 - RNA, 20 nt, Human
ucagcaaggggcucugcccu

SEQ ID NO: 2141740 - RNA, 12 nt, Human
ucagcagcccuc

SEQ ID NO: 2141741 - RNA, 14 nt, Human
ucagcagcccuccu

SEQ ID NO: 2141742 - RNA, 15 nt, Human
ucagcagcccuccuc

SEQ ID NO: 2141743 - RNA, 15 nt, Human
ucagucuggcccuuc

SEQ ID NO: 2141744 - RNA, 17 nt, Human
ucagcaggaagcaacga

SEQ ID NO: 2141745 - RNA, 17 nt, Human
ucagucugcacuuaaau

SEQ ID NO: 2141746 - RNA, 20 nt, Human
ucagucugcacuuaaauauc

SEQ ID NO: 2141747 - RNA, 23 nt, Human
ucagucugcacuuaaauaucaau

SEQ ID NO: 2141748 - RNA, 14 nt, Human
ucagcaggaagcaa

SEQ ID NO: 2141749 - RNA, 20 nt, Human
ucagugguuauuuagggaac

SEQ ID NO: 2141750 - RNA, 11 nt, Human
ucaguguacau

SEQ ID NO: 2141751 - RNA, 20 nt, Human
ucagugucauuuaugaaaag

SEQ ID NO: 2141752 - RNA, 15 nt, Human
ucaguuacucagccc

SEQ ID NO: 2141753 - RNA, 16 nt, Human
ucaguuacucagcccu

SEQ ID NO: 2141754 - RNA, 17 nt, Human
ucaguuacucagcccug

SEQ ID NO: 2141755 - RNA, 18 nt, Human
ucaguuacucagcccugg

SEQ ID NO: 2141756 - RNA, 23 nt, Human
ucauacaaugacaaguaugauga

SEQ ID NO: 2141757 - RNA, 13 nt, Human
ucauacacagaaa

SEQ ID NO: 2141758 - RNA, 15 nt, Human
ucaguucccuuggcc

SEQ ID NO: 2141759 - RNA, 23 nt, Human
ucaguugagcuucauauaccagc

SEQ ID NO: 2141760 - RNA, 19 nt, Human
ucaguuacucagcccuggg

SEQ ID NO: 2141761 - RNA, 16 nt, Human
ucaguuacucugaagg

SEQ ID NO: 2141762 - RNA, 17 nt, Human
ucaguuacucugaaggg

SEQ ID NO: 2141763 - RNA, 15 nt, Human
ucaguugguaagcuu

SEQ ID NO: 2141764 - RNA, 16 nt, Human
ucaguugguaagcuuc

SEQ ID NO: 2141765 - RNA, 20 nt, Human
ucaguugguguguuuuuggg

SEQ ID NO: 2141766 - RNA, 14 nt, Human
ucaguuggcugacu

SEQ ID NO: 2141767 - RNA, 14 nt, Human
ucauuauuuauuaa

SEQ ID NO: 2141768 - RNA, 18 nt, Human
ucauuauuuauuaaauuu

SEQ ID NO: 2141769 - RNA, 16 nt, Human
ucauuauuugcagaga

SEQ ID NO: 2141770 - RNA, 20 nt, Human
ucauguaacuucccugaaaa

SEQ ID NO: 2141771 - RNA, 13 nt, Human
ucauguaaauuac

SEQ ID NO: 2141772 - RNA, 14 nt, Human
ucauguaaauaaau

SEQ ID NO: 2141773 - RNA, 15 nt, Human
ucauguaaauaaaua

SEQ ID NO: 2141774 - RNA, 13 nt, Human
ucaugccuuugua

SEQ ID NO: 2141775 - RNA, 14 nt, Human
ucaugccuuuguaa

SEQ ID NO: 2141776 - RNA, 16 nt, Human
ucaugccuuuguaagu

SEQ ID NO: 2141777 - RNA, 17 nt, Human
ucaugccuuuguaaguu

SEQ ID NO: 2141778 - RNA, 20 nt, Human
ucauaccaacuuuagcagaa

SEQ ID NO: 2141779 - RNA, 20 nt, Human
ucauaguacucuuuguagca

SEQ ID NO: 2141780 - RNA, 22 nt, Human
ucauaccaggccgccccagccu

SEQ ID NO: 2141781 - RNA, 17 nt, Human
ucauagggucucuucag

SEQ ID NO: 2141782 - RNA, 18 nt, Human
ucauagggucucuucagg

SEQ ID NO: 2141783 - RNA, 20 nt, Human
ucauagggucucuucagguu

SEQ ID NO: 2141784 - RNA, 21 nt, Human
ucauagggucucuucagguuc

SEQ ID NO: 2141785 - RNA, 13 nt, Human
ucaucuguagaua

SEQ ID NO: 2141786 - RNA, 17 nt, Human
ucaucuguagauacuag

SEQ ID NO: 2141787 - RNA, 22 nt, Human
ucauaguacucuuuguagcaaa

SEQ ID NO: 2141788 - RNA, 16 nt, Human
ucaucucucuuuaaua

SEQ ID NO: 2141789 - RNA, 16 nt, Human
ucauacagaagguggg

SEQ ID NO: 2141790 - RNA, 17 nt, Human
uccaccugagcugccau

SEQ ID NO: 2141791 - RNA, 16 nt, Human
uccagaagccucuggc

SEQ ID NO: 2141792 - RNA, 14 nt, Human
uccaccugagcugc

SEQ ID NO: 2141793 - RNA, 15 nt, Human
uccagaucugcaccg

SEQ ID NO: 2141794 - RNA, 23 nt, Human
uccagccaaagccuccuccagcc

SEQ ID NO: 2141795 - RNA, 19 nt, Human
uccagaagccucuggcuag

SEQ ID NO: 2141796 - RNA, 17 nt, Human
uccagaagccucuggcu

SEQ ID NO: 2141797 - RNA, 18 nt, Human
uccagaagccucuggcua

SEQ ID NO: 2141798 - RNA, 11 nt, Human
uccaagcaaag

SEQ ID NO: 2141799 - RNA, 13 nt, Human
uccacccuuggcc

SEQ ID NO: 2141800 - RNA, 14 nt, Human
uccacccuuggccu

SEQ ID NO: 2141801 - RNA, 15 nt, Human
uccacccuuggccug

SEQ ID NO: 2141802 - RNA, 16 nt, Human
uccacccuuggccugu

SEQ ID NO: 2141803 - RNA, 17 nt, Human
uccacccuuggccuguc

SEQ ID NO: 2141804 - RNA, 19 nt, Human
uccacccuuggccugucuc

SEQ ID NO: 2141805 - RNA, 17 nt, Human
uccaccucagccuugga

SEQ ID NO: 2141806 - RNA, 11 nt, Human
uccaccucagc

SEQ ID NO: 2141807 - RNA, 12 nt, Human
uccaccucagcc

SEQ ID NO: 2141808 - RNA, 13 nt, Human
uccaccucagccu

SEQ ID NO: 2141809 - RNA, 14 nt, Human
uccaccucagccuu

SEQ ID NO: 2141810 - RNA, 16 nt, Human
uccaccucagccuugg

SEQ ID NO: 2141811 - RNA, 15 nt, Human
uccaccgcugccuaa

SEQ ID NO: 2141812 - RNA, 13 nt, Human
uccaccgcugccu

SEQ ID NO: 2141813 - RNA, 14 nt, Human
uccaccgcugccua

SEQ ID NO: 2141814 - RNA, 19 nt, Human
uccaccgcugccuaagugg

SEQ ID NO: 2141815 - RNA, 20 nt, Human
uccacccuuggccugucuca

SEQ ID NO: 2141816 - RNA, 13 nt, Human
ucauuucuugggc

SEQ ID NO: 2141817 - RNA, 16 nt, Human
ucauuugaacaacuag

SEQ ID NO: 2141818 - RNA, 17 nt, Human
ucauucaguauuaaagg

SEQ ID NO: 2141819 - RNA, 12 nt, Human
ucauucaggaaa

SEQ ID NO: 2141820 - RNA, 13 nt, Human
ucauucaggaaaa

SEQ ID NO: 2141821 - RNA, 10 nt, Human
ucauucagca

SEQ ID NO: 2141822 - RNA, 19 nt, Human
uccaaacuaccuuccaguu

SEQ ID NO: 2141823 - RNA, 20 nt, Human
uccaaacugccuaagcccuc

SEQ ID NO: 2141824 - RNA, 19 nt, Human
uccaaagcacauugaaaga

SEQ ID NO: 2141825 - RNA, 16 nt, Human
uccaagacauugucaa

SEQ ID NO: 2141826 - RNA, 11 nt, Human
uccaagacauu

SEQ ID NO: 2141827 - RNA, 15 nt, Human
uccaagacauuguca

SEQ ID NO: 2141828 - RNA, 17 nt, Human
uccaagacauugucaau

SEQ ID NO: 2141829 - RNA, 18 nt, Human
uccaagacagaauaauga

SEQ ID NO: 2141830 - RNA, 23 nt, Human
uccaaaggaaucuccaguuuuca

SEQ ID NO: 2141831 - RNA, 22 nt, Human
uccaaaggaggauggcauauaa

SEQ ID NO: 2141832 - RNA, 13 nt, Human
uccaaaggaggcu

SEQ ID NO: 2141833 - RNA, 15 nt, Human
uccaaaggaggcugg

SEQ ID NO: 2141834 - RNA, 19 nt, Human
uccaaaggaggcuggcagg

SEQ ID NO: 2141835 - RNA, 15 nt, Human
uccaaagcuuuccug

SEQ ID NO: 2141836 - RNA, 17 nt, Human
uccaaagcuuuccugga

SEQ ID NO: 2141837 - RNA, 19 nt, Human
uccaaagcuuuccuggaga

SEQ ID NO: 2141838 - RNA, 23 nt, Human
uccaaaggaagucuaggagcugg

SEQ ID NO: 2141839 - RNA, 17 nt, Human
ucucuuuguucuaaaga

SEQ ID NO: 2141840 - RNA, 15 nt, Human
ucucuuuggacucuc

SEQ ID NO: 2141841 - RNA, 21 nt, Human
ucucuuuggacucuccccucu

SEQ ID NO: 2141842 - RNA, 15 nt, Human
ucucuuuucaaaaca

SEQ ID NO: 2141843 - RNA, 16 nt, Human
ucucuuuucaaaacau

SEQ ID NO: 2141844 - RNA, 13 nt, Human
ucucuuuuucagu

SEQ ID NO: 2141845 - RNA, 16 nt, Human
ucugaaaauguaugug

SEQ ID NO: 2141846 - RNA, 12 nt, Human
ucucuuuucucu

SEQ ID NO: 2141847 - RNA, 16 nt, Human
ucucuuuucucuuucu

SEQ ID NO: 2141848 - RNA, 20 nt, Human
ucucuuuugaauccaugcuu

SEQ ID NO: 2141849 - RNA, 22 nt, Human
ucucuuuugaauccaugcuugg

SEQ ID NO: 2141850 - RNA, 23 nt, Human
ucucuuuugaauccaugcuuggg

SEQ ID NO: 2141851 - RNA, 23 nt, Human
ucugaaaauguauguguaaguau

SEQ ID NO: 2141852 - RNA, 14 nt, Human
ucugaaaauguaug

SEQ ID NO: 2141853 - RNA, 17 nt, Human
ucugaaaauuaacacug

SEQ ID NO: 2141854 - RNA, 18 nt, Human
ucugaaaauuaacacugc

SEQ ID NO: 2141855 - RNA, 19 nt, Human
ucugaaaauuaacacugcu

SEQ ID NO: 2141856 - RNA, 22 nt, Human
ucugaaaauuccagaaaggaua

SEQ ID NO: 2141857 - RNA, 14 nt, Human
ucugaaagccacgu

SEQ ID NO: 2141858 - RNA, 17 nt, Human
ucugaacucgcuucucu

SEQ ID NO: 2141859 - RNA, 21 nt, Human
ucugaacucgcuucucuguga

SEQ ID NO: 2141860 - RNA, 11 nt, Human
ucucuucucca

SEQ ID NO: 2141861 - RNA, 13 nt, Human
ucucuuccuaucc

SEQ ID NO: 2141862 - RNA, 15 nt, Human
ucucuuccuauccca

SEQ ID NO: 2141863 - RNA, 16 nt, Human
ucucuuccuaucccau

SEQ ID NO: 2141864 - RNA, 20 nt, Human
ucucuuccuaucccauccca

SEQ ID NO: 2141865 - RNA, 16 nt, Human
ucucuucuccacugga

SEQ ID NO: 2141866 - RNA, 15 nt, Human
ucucuucuccacugg

SEQ ID NO: 2141867 - RNA, 14 nt, Human
ucucuucuccacug

SEQ ID NO: 2141868 - RNA, 13 nt, Human
ucucuucuccacu

SEQ ID NO: 2141869 - RNA, 23 nt, Human
ucucuucagguucuuagugucac

SEQ ID NO: 2141870 - RNA, 15 nt, Human
ucucuucagguucuu

SEQ ID NO: 2141871 - RNA, 16 nt, Human
ucucuucagguucuua

SEQ ID NO: 2141872 - RNA, 13 nt, Human
ucucuucagguuc

SEQ ID NO: 2141873 - RNA, 14 nt, Human
ucucuucagguucu

SEQ ID NO: 2141874 - RNA, 20 nt, Human
ucucugcagccagcccagcc

SEQ ID NO: 2141875 - RNA, 11 nt, Human
ucucugcagcc

SEQ ID NO: 2141876 - RNA, 15 nt, Human
ucucugcagccagcc

SEQ ID NO: 2141877 - RNA, 16 nt, Human
ucucugcagccagccc

SEQ ID NO: 2141878 - RNA, 17 nt, Human
ucucugcagccagccca

SEQ ID NO: 2141879 - RNA, 18 nt, Human
ucucugcagccagcccag

SEQ ID NO: 2141880 - RNA, 19 nt, Human
ucucugcagccagcccagc

SEQ ID NO: 2141881 - RNA, 19 nt, Human
ucugcacaagcugcacccu

SEQ ID NO: 2141882 - RNA, 14 nt, Human
ucugcacaagcugc

SEQ ID NO: 2141883 - RNA, 21 nt, Human
ucugaggaaucaacagggcag

SEQ ID NO: 2141884 - RNA, 22 nt, Human
ucugaggaaucaacagggcagc

SEQ ID NO: 2141885 - RNA, 23 nt, Human
ucugauucccaagcucugcuccu

SEQ ID NO: 2141886 - RNA, 23 nt, Human
ucugaggacacuaaccacgcugg

SEQ ID NO: 2141887 - RNA, 20 nt, Human
ucugaggacacuaaccacgc

SEQ ID NO: 2141888 - RNA, 17 nt, Human
ucugaggaauccagacc

SEQ ID NO: 2141889 - RNA, 16 nt, Human
ucugaggaauccagac

SEQ ID NO: 2141890 - RNA, 18 nt, Human
ucugagccaaagagaaug

SEQ ID NO: 2141891 - RNA, 20 nt, Human
ucugagauuauuuuaaucua

SEQ ID NO: 2141892 - RNA, 22 nt, Human
ucugaccacacuuccuguccag

SEQ ID NO: 2141893 - RNA, 12 nt, Human
ucugaccacacu

SEQ ID NO: 2141894 - RNA, 13 nt, Human
ucugaccacacuu

SEQ ID NO: 2141895 - RNA, 18 nt, Human
ucugaccacacuuccugu

SEQ ID NO: 2141896 - RNA, 14 nt, Human
ucugaacuucagcu

SEQ ID NO: 2141897 - RNA, 15 nt, Human
ucugaacuucagcua

SEQ ID NO: 2141898 - RNA, 15 nt, Human
ucugacauuaacagu

SEQ ID NO: 2141899 - RNA, 16 nt, Human
ucugacauuaacaguu

SEQ ID NO: 2141900 - RNA, 23 nt, Human
ucugacauuaacaguuuuccaug

SEQ ID NO: 2141901 - RNA, 18 nt, Human
ucugacauuaacaguuuu

SEQ ID NO: 2141902 - RNA, 19 nt, Human
ucugacauuaacaguuuuc

SEQ ID NO: 2141903 - RNA, 21 nt, Human
ucugacauuaacaguuuucca

SEQ ID NO: 2141904 - RNA, 22 nt, Human
ucugacauuaacaguuuuccau

SEQ ID NO: 2141905 - RNA, 21 nt, Human
ucucuacugucucaguuuaca

SEQ ID NO: 2141906 - RNA, 13 nt, Human
ucucuagaauuuu

SEQ ID NO: 2141907 - RNA, 17 nt, Human
ucucuagaauuuuaagu

SEQ ID NO: 2141908 - RNA, 22 nt, Human
ucucuacuaaaaauacaaacaa

SEQ ID NO: 2141909 - RNA, 19 nt, Human
ucucuacuccuaccucagc

SEQ ID NO: 2141910 - RNA, 20 nt, Human
ucucuacuccuaccucagcc

SEQ ID NO: 2141911 - RNA, 21 nt, Human
ucucuacuccuaccucagccu

SEQ ID NO: 2141912 - RNA, 19 nt, Human
ucucuacagaugucccauu

SEQ ID NO: 2141913 - RNA, 20 nt, Human
ucucuacagaugucccauuu

SEQ ID NO: 2141914 - RNA, 12 nt, Human
ucucuacccagc

SEQ ID NO: 2141915 - RNA, 18 nt, Human
ucucuacccagcccaucu

SEQ ID NO: 2141916 - RNA, 20 nt, Human
ucucuacccagcccaucuug

SEQ ID NO: 2141917 - RNA, 20 nt, Human
ucucuacagacuucuccaga

SEQ ID NO: 2141918 - RNA, 15 nt, Human
ucucuacaaaaagca

SEQ ID NO: 2141919 - RNA, 13 nt, Human
ucuccugggcccc

SEQ ID NO: 2141920 - RNA, 15 nt, Human
ucuccugggccccuc

SEQ ID NO: 2141921 - RNA, 19 nt, Human
ucuccugggccccucccua

SEQ ID NO: 2141922 - RNA, 20 nt, Human
ucuccugggccccucccuac

SEQ ID NO: 2141923 - RNA, 22 nt, Human
ucuccugggccccucccuaccu

SEQ ID NO: 2141924 - RNA, 23 nt, Human
ucuccugggccccucccuaccuc

SEQ ID NO: 2141925 - RNA, 22 nt, Human
ucucuagaauuuuaagugcuuu

SEQ ID NO: 2141926 - RNA, 13 nt, Human
ucucugaggacac

SEQ ID NO: 2141927 - RNA, 19 nt, Human
ucucugagcuccaguggaa

SEQ ID NO: 2141928 - RNA, 23 nt, Human
ucucugagcuccaguggaagaag

SEQ ID NO: 2141929 - RNA, 12 nt, Human
ucucucuuugga

SEQ ID NO: 2141930 - RNA, 13 nt, Human
ucucucuuuggac

SEQ ID NO: 2141931 - RNA, 16 nt, Human
ucucucuuuggacucu

SEQ ID NO: 2141932 - RNA, 13 nt, Human
ucucucuguugug

SEQ ID NO: 2141933 - RNA, 11 nt, Human
ucucucuucug

SEQ ID NO: 2141934 - RNA, 14 nt, Human
ucucucuucugcuc

SEQ ID NO: 2141935 - RNA, 16 nt, Human
ucucucuucugcucca

SEQ ID NO: 2141936 - RNA, 17 nt, Human
ucucucuucugcuccac

SEQ ID NO: 2141937 - RNA, 19 nt, Human
ucucucuucugcuccaccc

SEQ ID NO: 2141938 - RNA, 20 nt, Human
ucucucuucugcuccacccu

SEQ ID NO: 2141939 - RNA, 23 nt, Human
ucucucggaguaucugggaacug

SEQ ID NO: 2141940 - RNA, 22 nt, Human
ucucuaugguaaagauauuauu

SEQ ID NO: 2141941 - RNA, 14 nt, Human
ucucuauuuaaauu

SEQ ID NO: 2141942 - RNA, 15 nt, Human
ucucuauuuaaauuc

SEQ ID NO: 2141943 - RNA, 16 nt, Human
ucucuauuuaaauucu

SEQ ID NO: 2141944 - RNA, 17 nt, Human
ucucuauuuaaauucuu

SEQ ID NO: 2141945 - RNA, 18 nt, Human
ucucuauuuaaauucuuu

SEQ ID NO: 2141946 - RNA, 23 nt, Human
ucucuauuuaaauucuuuuuuaa

SEQ ID NO: 2141947 - RNA, 14 nt, Human
ucucucuauuacca

SEQ ID NO: 2141948 - RNA, 16 nt, Human
ucucucuauuaccacu

SEQ ID NO: 2141949 - RNA, 22 nt, Human
ucucucuacuccuaccucagcc

SEQ ID NO: 2141950 - RNA, 13 nt, Human
ucucucuuacccu

SEQ ID NO: 2141951 - RNA, 21 nt, Human
ucucuauuaccacugaagaua

SEQ ID NO: 2141952 - RNA, 19 nt, Human
ucucucuacuccuaccuca

SEQ ID NO: 2141953 - RNA, 20 nt, Human
ucucucuacuccuaccucag

SEQ ID NO: 2141954 - RNA, 20 nt, Human
ucuccugccugugcugugac

SEQ ID NO: 2141955 - RNA, 22 nt, Human
ucuccugccucagccucccaaa

SEQ ID NO: 2141956 - RNA, 16 nt, Human
ucuccugcccccacac

SEQ ID NO: 2141957 - RNA, 21 nt, Human
ucuccugcccccacaccuggc

SEQ ID NO: 2141958 - RNA, 11 nt, Human
ucuccugccua

SEQ ID NO: 2141959 - RNA, 12 nt, Human
ucuccugccuac

SEQ ID NO: 2141960 - RNA, 14 nt, Human
ucuccugccuacuc

SEQ ID NO: 2141961 - RNA, 15 nt, Human
ucuccugccuacuca

SEQ ID NO: 2141962 - RNA, 17 nt, Human
ucuccugccuacucacg

SEQ ID NO: 2141963 - RNA, 20 nt, Human
ucucccgggaagccacccuc

SEQ ID NO: 2141964 - RNA, 18 nt, Human
ucucccuauaaugcugga

SEQ ID NO: 2141965 - RNA, 21 nt, Human
ucucccuauaaugcuggagcg

SEQ ID NO: 2141966 - RNA, 19 nt, Human
ucucccucgaacccacacu

SEQ ID NO: 2141967 - RNA, 14 nt, Human
ucucccucuccugc

SEQ ID NO: 2141968 - RNA, 15 nt, Human
ucucccucuccugcc

SEQ ID NO: 2141969 - RNA, 16 nt, Human
ucucccucuccugccu

SEQ ID NO: 2141970 - RNA, 17 nt, Human
ucucccucuccugccua

SEQ ID NO: 2141971 - RNA, 18 nt, Human
ucucccucuccugccuac

SEQ ID NO: 2141972 - RNA, 21 nt, Human
ucucccucuccugccuacuca

SEQ ID NO: 2141973 - RNA, 12 nt, Human
ucucccucuggc

SEQ ID NO: 2141974 - RNA, 14 nt, Human
ucucccucuggccc

SEQ ID NO: 2141975 - RNA, 15 nt, Human
ucucccucuggcccu

SEQ ID NO: 2141976 - RNA, 16 nt, Human
ucucccucuggcccug

SEQ ID NO: 2141977 - RNA, 17 nt, Human
ucucccucuggcccugc

SEQ ID NO: 2141978 - RNA, 18 nt, Human
ucucccucuggcccugcc

SEQ ID NO: 2141979 - RNA, 20 nt, Human
ucucccucuggcccugccuu

SEQ ID NO: 2141980 - RNA, 22 nt, Human
ucuccucuugccacugccucuu

SEQ ID NO: 2141981 - RNA, 19 nt, Human
ucucccucuggcccugccu

SEQ ID NO: 2141982 - RNA, 18 nt, Human
ucuccugaggaucagaaa

SEQ ID NO: 2141983 - RNA, 20 nt, Human
ucuccugaggaucagaaagu

SEQ ID NO: 2141984 - RNA, 15 nt, Human
ucuccugauuauuua

SEQ ID NO: 2141985 - RNA, 16 nt, Human
ucuccugauuauuuau

SEQ ID NO: 2141986 - RNA, 13 nt, Human
ucuccugcaugca

SEQ ID NO: 2141987 - RNA, 17 nt, Human
ucuccucuuuguuuugu

SEQ ID NO: 2141988 - RNA, 16 nt, Human
ucuccucuuuuaucuu

SEQ ID NO: 2141989 - RNA, 14 nt, Human
ucuccccugcccug

SEQ ID NO: 2141990 - RNA, 15 nt, Human
ucuccccugcccugc

SEQ ID NO: 2141991 - RNA, 17 nt, Human
ucuccccugcccugcug

SEQ ID NO: 2141992 - RNA, 12 nt, Human
ucucccccuggg

SEQ ID NO: 2141993 - RNA, 13 nt, Human
ucucccccugggc

SEQ ID NO: 2141994 - RNA, 14 nt, Human
ucucccccugggcu

SEQ ID NO: 2141995 - RNA, 15 nt, Human
ucucaggucccugca

SEQ ID NO: 2141996 - RNA, 16 nt, Human
ucucagaaucuuuccu

SEQ ID NO: 2141997 - RNA, 15 nt, Human
ucucagucaguaauu

SEQ ID NO: 2141998 - RNA, 23 nt, Human
ucucagugcuucuuacuauuaag

SEQ ID NO: 2141999 - RNA, 14 nt, Human
ucucaaacuccuga

SEQ ID NO: 2142000 - RNA, 13 nt, Human
ucucaaaccucca

SEQ ID NO: 2142001 - RNA, 18 nt, Human
ucucaaaccuccaaaagc

SEQ ID NO: 2142002 - RNA, 20 nt, Human
ucucaaacgguacacagacu

SEQ ID NO: 2142003 - RNA, 22 nt, Human
ucucaaacgguacacagacuau

SEQ ID NO: 2142004 - RNA, 23 nt, Human
ucuagggauagucaccuuuuaaa

SEQ ID NO: 2142005 - RNA, 17 nt, Human
ucuagggagagacccuu

SEQ ID NO: 2142006 - RNA, 17 nt, Human
ucucaaagaaauuucca

SEQ ID NO: 2142007 - RNA, 22 nt, Human
ucucaaacucuugaccucaggu

SEQ ID NO: 2142008 - RNA, 21 nt, Human
ucucaaacucuugaccucagg

SEQ ID NO: 2142009 - RNA, 13 nt, Human
ucucaaacucuug

SEQ ID NO: 2142010 - RNA, 13 nt, Human
ucucaaccauccc

SEQ ID NO: 2142011 - RNA, 17 nt, Human
ucucacucugucgccca

SEQ ID NO: 2142012 - RNA, 16 nt, Human
ucucacucugucgccc

SEQ ID NO: 2142013 - RNA, 22 nt, Human
ucucacucugucgcccagucug

SEQ ID NO: 2142014 - RNA, 18 nt, Human
ucucacucugucgcccag

SEQ ID NO: 2142015 - RNA, 21 nt, Human
ucucacuguugcccaggcugg

SEQ ID NO: 2142016 - RNA, 20 nt, Human
ucucacuguugcccaggcug

SEQ ID NO: 2142017 - RNA, 19 nt, Human
ucucacuguugcccaggcu

SEQ ID NO: 2142018 - RNA, 18 nt, Human
ucucacuguugcccaggc

SEQ ID NO: 2142019 - RNA, 17 nt, Human
ucucagaaucucaaaua

SEQ ID NO: 2142020 - RNA, 21 nt, Human
ucucagaaucucaaauaacua

SEQ ID NO: 2142021 - RNA, 19 nt, Human
ucucagaagguauuccuuu

SEQ ID NO: 2142022 - RNA, 20 nt, Human
ucucacuuuucuccaugagu

SEQ ID NO: 2142023 - RNA, 15 nt, Human
ucucacuuuucucca

SEQ ID NO: 2142024 - RNA, 17 nt, Human
ucucacuuuucuccaug

SEQ ID NO: 2142025 - RNA, 17 nt, Human
ucucacuguugcccagg

SEQ ID NO: 2142026 - RNA, 13 nt, Human
ucuaaaugaagug

SEQ ID NO: 2142027 - RNA, 14 nt, Human
ucuaaaugcauauc

SEQ ID NO: 2142028 - RNA, 23 nt, Human
ucuaaaugcauauccugagccau

SEQ ID NO: 2142029 - RNA, 13 nt, Human
ucuaaccagugau

SEQ ID NO: 2142030 - RNA, 13 nt, Human
ucuaaccuccuuu

SEQ ID NO: 2142031 - RNA, 19 nt, Human
ucuaacuagaaaucugcca

SEQ ID NO: 2142032 - RNA, 15 nt, Human
ucuaacucagaaaca

SEQ ID NO: 2142033 - RNA, 15 nt, Human
ucuacucuuuuuguu

SEQ ID NO: 2142034 - RNA, 13 nt, Human
ucuacacugugaa

SEQ ID NO: 2142035 - RNA, 14 nt, Human
ucuacacugugaac

SEQ ID NO: 2142036 - RNA, 22 nt, Human
ucuacugaggugcuauguucuu

SEQ ID NO: 2142037 - RNA, 19 nt, Human
ucuagaacaucccugccag

SEQ ID NO: 2142038 - RNA, 20 nt, Human
ucuagaacaucccugccagc

SEQ ID NO: 2142039 - RNA, 18 nt, Human
ucuagaacuugacccccu

SEQ ID NO: 2142040 - RNA, 14 nt, Human
ucuagaagaaauga

SEQ ID NO: 2142041 - RNA, 15 nt, Human
ucuagaagaaaugaa

SEQ ID NO: 2142042 - RNA, 16 nt, Human
ucuagaagaaaugaaa

SEQ ID NO: 2142043 - RNA, 17 nt, Human
ucuagaagaaaugaaau

SEQ ID NO: 2142044 - RNA, 18 nt, Human
ucuagaagaaaugaaauu

SEQ ID NO: 2142045 - RNA, 19 nt, Human
ucuagaagaaaugaaauuu

SEQ ID NO: 2142046 - RNA, 23 nt, Human
ucuagaagaaaugaaauuuuacc

SEQ ID NO: 2142047 - RNA, 20 nt, Human
ucuagaagacugucagcuuc

SEQ ID NO: 2142048 - RNA, 21 nt, Human
ucuagaagacugucagcuucc

SEQ ID NO: 2142049 - RNA, 21 nt, Human
ucuagaacaucccugccagcu

SEQ ID NO: 2142050 - RNA, 17 nt, Human
ucuagggaaaugaaaga

SEQ ID NO: 2142051 - RNA, 19 nt, Human
ucuagggaaggccaccugc

SEQ ID NO: 2142052 - RNA, 20 nt, Human
ucuagggaaggccaccugca

SEQ ID NO: 2142053 - RNA, 22 nt, Human
ucuagggaaggccaccugcagg

SEQ ID NO: 2142054 - RNA, 23 nt, Human
ucuagggaaggccaccugcaggu

SEQ ID NO: 2142055 - RNA, 19 nt, Human
ucuagggaaaaaccagcgu

SEQ ID NO: 2142056 - RNA, 19 nt, Human
ucuagaauuuaucacacuu

SEQ ID NO: 2142057 - RNA, 13 nt, Human
ucuagggaaauga

SEQ ID NO: 2142058 - RNA, 22 nt, Human
ucuagggaaaaaccagcgugug

SEQ ID NO: 2142059 - RNA, 11 nt, Human
ucuacacucuc

SEQ ID NO: 2142060 - RNA, 12 nt, Human
ucuacacucucc

SEQ ID NO: 2142061 - RNA, 14 nt, Human
ucuacacucuccug

SEQ ID NO: 2142062 - RNA, 15 nt, Human
ucuacacucuccugg

SEQ ID NO: 2142063 - RNA, 16 nt, Human
ucuacacucuccuggg

SEQ ID NO: 2142064 - RNA, 17 nt, Human
ucuacacucuccugggc

SEQ ID NO: 2142065 - RNA, 18 nt, Human
ucuacacucuccugggcc

SEQ ID NO: 2142066 - RNA, 18 nt, Human
ucuacugaggugcuaugu

SEQ ID NO: 2142067 - RNA, 19 nt, Human
ucuacugaggugcuauguu

SEQ ID NO: 2142068 - RNA, 16 nt, Human
ucuaacucugauguaa

SEQ ID NO: 2142069 - RNA, 17 nt, Human
ucuaacucugauguaaa

SEQ ID NO: 2142070 - RNA, 20 nt, Human
ucuaacucugauguaaauga

SEQ ID NO: 2142071 - RNA, 21 nt, Human
ucuaacucugauguaaaugaa

SEQ ID NO: 2142072 - RNA, 17 nt, Human
ucuaacugugcucaaga

SEQ ID NO: 2142073 - RNA, 21 nt, Human
ucuaacugugcucaagagguu

SEQ ID NO: 2142074 - RNA, 15 nt, Human
ucuacacucaucuua

SEQ ID NO: 2142075 - RNA, 10 nt, Human
ucccucccuu

SEQ ID NO: 2142076 - RNA, 17 nt, Human
uccuggcccacugcauc

SEQ ID NO: 2142077 - RNA, 17 nt, Human
uccuggucuugagaugu

SEQ ID NO: 2142078 - RNA, 20 nt, Human
uccuggucuugagaugucuu

SEQ ID NO: 2142079 - RNA, 16 nt, Human
uccuugaucuguauau

SEQ ID NO: 2142080 - RNA, 22 nt, Human
uccuugaucuguauauacaaua

SEQ ID NO: 2142081 - RNA, 21 nt, Human
uccuugcacacuccccugcac

SEQ ID NO: 2142082 - RNA, 22 nt, Human
uccuugauuuaucacacaaagc

SEQ ID NO: 2142083 - RNA, 22 nt, Human
uccuugcacacuccccugcacu

SEQ ID NO: 2142084 - RNA, 14 nt, Human
uccuugcaccugca

SEQ ID NO: 2142085 - RNA, 19 nt, Human
uccuucuguccuacucugu

SEQ ID NO: 2142086 - RNA, 12 nt, Human
uccuucuguccu

SEQ ID NO: 2142087 - RNA, 18 nt, Human
uccuucaaguuagcucag

SEQ ID NO: 2142088 - RNA, 19 nt, Human
uccuucaaguuagcucagg

SEQ ID NO: 2142089 - RNA, 20 nt, Human
uccuucaaguuagcucagga

SEQ ID NO: 2142090 - RNA, 23 nt, Human
uccuucaaguuagcucaggaggc

SEQ ID NO: 2142091 - RNA, 19 nt, Human
uccuucaagaacucugggc

SEQ ID NO: 2142092 - RNA, 20 nt, Human
uccuucaagaacucugggcu

SEQ ID NO: 2142093 - RNA, 21 nt, Human
uccuucaagaacucugggcug

SEQ ID NO: 2142094 - RNA, 23 nt, Human
uccuucaagaacucugggcugcu

SEQ ID NO: 2142095 - RNA, 22 nt, Human
uccuuauguauauuuaaaagaa

SEQ ID NO: 2142096 - RNA, 14 nt, Human
uccuuaaugauccg

SEQ ID NO: 2142097 - RNA, 18 nt, Human
uccuuuuguguacagugu

SEQ ID NO: 2142098 - RNA, 17 nt, Human
uccuuuuguguacagug

SEQ ID NO: 2142099 - RNA, 14 nt, Human
uccuuggggcaggc

SEQ ID NO: 2142100 - RNA, 15 nt, Human
uccuuggggcaggca

SEQ ID NO: 2142101 - RNA, 16 nt, Human
uccuuggggcaggcag

SEQ ID NO: 2142102 - RNA, 20 nt, Human
uccuugggaggccccacugg

SEQ ID NO: 2142103 - RNA, 21 nt, Human
uccuugggaggccccacuggg

SEQ ID NO: 2142104 - RNA, 22 nt, Human
uccuugggaggccccacugggg

SEQ ID NO: 2142105 - RNA, 17 nt, Human
uccuugcaccugcaucc

SEQ ID NO: 2142106 - RNA, 18 nt, Human
uccuuuuucccaauaaau

SEQ ID NO: 2142107 - RNA, 13 nt, Human
uccuuuuuguuau

SEQ ID NO: 2142108 - RNA, 19 nt, Human
uccuuuuucuuuauaaacu

SEQ ID NO: 2142109 - RNA, 14 nt, Human
uccuuuuucuuuau

SEQ ID NO: 2142110 - RNA, 14 nt, Human
uccuuuuuguuauu

SEQ ID NO: 2142111 - RNA, 12 nt, Human
uccuuuuuuucc

SEQ ID NO: 2142112 - RNA, 13 nt, Human
ucgcaagcugggu

SEQ ID NO: 2142113 - RNA, 11 nt, Human
ucgcccaggag

SEQ ID NO: 2142114 - RNA, 17 nt, Human
ucgcccaaagccagaca

SEQ ID NO: 2142115 - RNA, 18 nt, Human
ucgcccaaagccagacag

SEQ ID NO: 2142116 - RNA, 12 nt, Human
ucgcccaggaga

SEQ ID NO: 2142117 - RNA, 13 nt, Human
ucggaagcagugc

SEQ ID NO: 2142118 - RNA, 19 nt, Human
ucggaaggcuggcugggca

SEQ ID NO: 2142119 - RNA, 15 nt, Human
ucggaagcagugccu

SEQ ID NO: 2142120 - RNA, 16 nt, Human
ucggaagcagugccuu

SEQ ID NO: 2142121 - RNA, 22 nt, Human
ucggaagcagugccuuccauaa

SEQ ID NO: 2142122 - RNA, 23 nt, Human
ucggaagcagugccuuccauaau

SEQ ID NO: 2142123 - RNA, 14 nt, Human
ucgcuucucuguga

SEQ ID NO: 2142124 - RNA, 15 nt, Human
ucgcuucccccauag

SEQ ID NO: 2142125 - RNA, 16 nt, Human
ucgcuucccccauagc

SEQ ID NO: 2142126 - RNA, 17 nt, Human
ucgcuucccccauagcc

SEQ ID NO: 2142127 - RNA, 19 nt, Human
ucgcuucccccauagccac

SEQ ID NO: 2142128 - RNA, 14 nt, Human
ucgcuucccccaua

SEQ ID NO: 2142129 - RNA, 13 nt, Human
ugaacauuccaga

SEQ ID NO: 2142130 - RNA, 14 nt, Human
ugaacauuccagag

SEQ ID NO: 2142131 - RNA, 15 nt, Human
ugaacauugcaauag

SEQ ID NO: 2142132 - RNA, 17 nt, Human
ugaacauugcaauagaa

SEQ ID NO: 2142133 - RNA, 20 nt, Human
ugaacauagacuagagaaac

SEQ ID NO: 2142134 - RNA, 22 nt, Human
ugaacacugggggaggggacau

SEQ ID NO: 2142135 - RNA, 15 nt, Human
ugaacacuuauugcu

SEQ ID NO: 2142136 - RNA, 17 nt, Human
ugaacacuuauugcuuu

SEQ ID NO: 2142137 - RNA, 18 nt, Human
ugaacacuuauugcuuug

SEQ ID NO: 2142138 - RNA, 18 nt, Human
ugaacacuggcaacaaca

SEQ ID NO: 2142139 - RNA, 14 nt, Human
ugaacacuggggga

SEQ ID NO: 2142140 - RNA, 16 nt, Human
ugaacacugggggagg

SEQ ID NO: 2142141 - RNA, 17 nt, Human
ugaacacugggggaggg

SEQ ID NO: 2142142 - RNA, 17 nt, Human
ugaaaugcucuccuuuc

SEQ ID NO: 2142143 - RNA, 16 nt, Human
ugaaaugcucuccuuu

SEQ ID NO: 2142144 - RNA, 14 nt, Human
ugaaaugccuuacu

SEQ ID NO: 2142145 - RNA, 15 nt, Human
ugaaaugccuuacuu

SEQ ID NO: 2142146 - RNA, 18 nt, Human
ugaaaugccuuacuuugu

SEQ ID NO: 2142147 - RNA, 19 nt, Human
ugaaaugccuuacuuugua

SEQ ID NO: 2142148 - RNA, 20 nt, Human
ugaaaugccuuacuuuguau

SEQ ID NO: 2142149 - RNA, 21 nt, Human
ugaaaugccuuacuuuguaug

SEQ ID NO: 2142150 - RNA, 22 nt, Human
ugaaaugccuuacuuuguauga

SEQ ID NO: 2142151 - RNA, 23 nt, Human
ugaaaugccuuacuuuguaugau

SEQ ID NO: 2142152 - RNA, 24 nt, Human
ugaaaugccuuacuuuguaugaua

SEQ ID NO: 2142153 - RNA, 16 nt, Human
ugaaaugcuggcauuu

SEQ ID NO: 2142154 - RNA, 14 nt, Human
ugaacacaucagcu

SEQ ID NO: 2142155 - RNA, 18 nt, Human
ugaacacaucagcuagca

SEQ ID NO: 2142156 - RNA, 19 nt, Human
ugaacacaucagcuagcaa

SEQ ID NO: 2142157 - RNA, 20 nt, Human
ugaacacaucagcuagcaaa

SEQ ID NO: 2142158 - RNA, 11 nt, Human
ugaacacagua

SEQ ID NO: 2142159 - RNA, 12 nt, Human
ugaacacaguau

SEQ ID NO: 2142160 - RNA, 13 nt, Human
ugaacacaguauu

SEQ ID NO: 2142161 - RNA, 15 nt, Human
ugaacacaguauuuu

SEQ ID NO: 2142162 - RNA, 19 nt, Human
ugaacacaguauuuuccca

SEQ ID NO: 2142163 - RNA, 16 nt, Human
ugaacacgaagcuuag

SEQ ID NO: 2142164 - RNA, 18 nt, Human
ugaacucuucaaucucuu

SEQ ID NO: 2142165 - RNA, 14 nt, Human
ugaacucuuucugg

SEQ ID NO: 2142166 - RNA, 20 nt, Human
ugaacucuuucuggccugcc

SEQ ID NO: 2142167 - RNA, 22 nt, Human
ugaacucuuucuggccugccuu

SEQ ID NO: 2142168 - RNA, 23 nt, Human
ugaacucuuucuggccugccuuc

SEQ ID NO: 2142169 - RNA, 22 nt, Human
ugaaccacaucuugcucugcug

SEQ ID NO: 2142170 - RNA, 15 nt, Human
ugaacucuucaaucu

SEQ ID NO: 2142171 - RNA, 21 nt, Human
ugaaccacaucuugcucugcu

SEQ ID NO: 2142172 - RNA, 20 nt, Human
ugaaccacaucuugcucugc

SEQ ID NO: 2142173 - RNA, 18 nt, Human
ugaacugcauguauaaau

SEQ ID NO: 2142174 - RNA, 20 nt, Human
ugaaggagagcccuucauuu

SEQ ID NO: 2142175 - RNA, 21 nt, Human
ugaagaugcugaaacaggaga

SEQ ID NO: 2142176 - RNA, 16 nt, Human
ugaagaugggaacgca

SEQ ID NO: 2142177 - RNA, 14 nt, Human
ugaagauagaagaa

SEQ ID NO: 2142178 - RNA, 15 nt, Human
ugaagauagaagaaa

SEQ ID NO: 2142179 - RNA, 16 nt, Human
ugaagauagaagaaaa

SEQ ID NO: 2142180 - RNA, 17 nt, Human
ugaagauagaagaaaaa

SEQ ID NO: 2142181 - RNA, 16 nt, Human
ugaagauaucuugaaa

SEQ ID NO: 2142182 - RNA, 21 nt, Human
ugaagauaucuugaaaugaaa

SEQ ID NO: 2142183 - RNA, 22 nt, Human
ugaagauaucuugaaaugaaag

SEQ ID NO: 2142184 - RNA, 19 nt, Human
ugaagaucguuaguaucua

SEQ ID NO: 2142185 - RNA, 18 nt, Human
ugaagagggagaagcaug

SEQ ID NO: 2142186 - RNA, 17 nt, Human
ugaagagggagaaggga

SEQ ID NO: 2142187 - RNA, 21 nt, Human
ugaagagggagaagcaugaaa

SEQ ID NO: 2142188 - RNA, 19 nt, Human
ugaacuggguacuugugga

SEQ ID NO: 2142189 - RNA, 16 nt, Human
ugaacuggaggccagg

SEQ ID NO: 2142190 - RNA, 14 nt, Human
ugaagacaggacag

SEQ ID NO: 2142191 - RNA, 14 nt, Human
ugaagacagaggga

SEQ ID NO: 2142192 - RNA, 18 nt, Human
ugaagaggaucggaggcu

SEQ ID NO: 2142193 - RNA, 13 nt, Human
ugaagaggaaggg

SEQ ID NO: 2142194 - RNA, 16 nt, Human
ucuuuuuauacuauua

SEQ ID NO: 2142195 - RNA, 20 nt, Human
ucuuuugacauguggaaagu

SEQ ID NO: 2142196 - RNA, 13 nt, Human
ucuuuugccauga

SEQ ID NO: 2142197 - RNA, 21 nt, Human
ucuuuugcccuucacaguguu

SEQ ID NO: 2142198 - RNA, 19 nt, Human
ucuuuugaauccaugcuug

SEQ ID NO: 2142199 - RNA, 20 nt, Human
ucuuuugaauccaugcuugg

SEQ ID NO: 2142200 - RNA, 13 nt, Human
ucuuuugacaugu

SEQ ID NO: 2142201 - RNA, 14 nt, Human
ucuuuugacaugug

SEQ ID NO: 2142202 - RNA, 15 nt, Human
ucuuuugacaugugg

SEQ ID NO: 2142203 - RNA, 17 nt, Human
ucuuuugacauguggaa

SEQ ID NO: 2142204 - RNA, 23 nt, Human
ucuuucacacuuccaccagccug

SEQ ID NO: 2142205 - RNA, 23 nt, Human
ucuuuucugcaucaucuguagau

SEQ ID NO: 2142206 - RNA, 20 nt, Human
ucuuucacacuuccaccagc

SEQ ID NO: 2142207 - RNA, 21 nt, Human
ucuuucacacuuccaccagcc

SEQ ID NO: 2142208 - RNA, 21 nt, Human
ucuuucaagugaaucuaaaag

SEQ ID NO: 2142209 - RNA, 10 nt, Human
ucuuucacau

SEQ ID NO: 2142210 - RNA, 15 nt, Human
ugaaaacuacauuuu

SEQ ID NO: 2142211 - RNA, 16 nt, Human
ugaaaacuacauuuua

SEQ ID NO: 2142212 - RNA, 17 nt, Human
ugaaaacuacauuuuaa

SEQ ID NO: 2142213 - RNA, 19 nt, Human
ugaaaacuacauuuuaaca

SEQ ID NO: 2142214 - RNA, 20 nt, Human
ugaaaacuacauuuuaacau

SEQ ID NO: 2142215 - RNA, 21 nt, Human
ugaaaacuacauuuuaacaug

SEQ ID NO: 2142216 - RNA, 20 nt, Human
ucuuuuuuagcauaaaauuu

SEQ ID NO: 2142217 - RNA, 13 nt, Human
ucuuuuuuaugug

SEQ ID NO: 2142218 - RNA, 15 nt, Human
ucuuuuuuagcauaa

SEQ ID NO: 2142219 - RNA, 16 nt, Human
ucuuuuuuagcauaaa

SEQ ID NO: 2142220 - RNA, 17 nt, Human
ucuuuuuuaaauuuucu

SEQ ID NO: 2142221 - RNA, 22 nt, Human
ucuuuuuuaaauuuucuucagu

SEQ ID NO: 2142222 - RNA, 14 nt, Human
ucuuuuucuggacu

SEQ ID NO: 2142223 - RNA, 22 nt, Human
ucuuuuuauugaugugcaaaaa

SEQ ID NO: 2142224 - RNA, 21 nt, Human
ucuuuuuauuuuuuaauuauu

SEQ ID NO: 2142225 - RNA, 12 nt, Human
ucuuuuucaguu

SEQ ID NO: 2142226 - RNA, 17 nt, Human
ugaaaagacaucaagca

SEQ ID NO: 2142227 - RNA, 18 nt, Human
ugaaaagacaucaagcac

SEQ ID NO: 2142228 - RNA, 12 nt, Human
ucuuuuuauuga

SEQ ID NO: 2142229 - RNA, 19 nt, Human
ugaaaacguuuuauugugu

SEQ ID NO: 2142230 - RNA, 11 nt, Human
ugaaagcugug

SEQ ID NO: 2142231 - RNA, 21 nt, Human
ugaaagauggcugugccucug

SEQ ID NO: 2142232 - RNA, 23 nt, Human
ugaaagauggcugugccucugcc

SEQ ID NO: 2142233 - RNA, 22 nt, Human
ugaaagauggcugugccucugc

SEQ ID NO: 2142234 - RNA, 23 nt, Human
ugaaaagaggggaccagaagcca

SEQ ID NO: 2142235 - RNA, 18 nt, Human
ugaaagggcccagagagg

SEQ ID NO: 2142236 - RNA, 17 nt, Human
ugaaagggcccagagag

SEQ ID NO: 2142237 - RNA, 16 nt, Human
ugaaagggcccagaga

SEQ ID NO: 2142238 - RNA, 15 nt, Human
ugaaagggcccagag

SEQ ID NO: 2142239 - RNA, 19 nt, Human
ugaaaucucagaauuccuu

SEQ ID NO: 2142240 - RNA, 16 nt, Human
ugaaaucucagaauuc

SEQ ID NO: 2142241 - RNA, 19 nt, Human
ugaaaugaccucaagaugu

SEQ ID NO: 2142242 - RNA, 13 nt, Human
ugaaaugaaaaca

SEQ ID NO: 2142243 - RNA, 14 nt, Human
ugaaaugaaaacau

SEQ ID NO: 2142244 - RNA, 19 nt, Human
ugaaaugaaaacauguaau

SEQ ID NO: 2142245 - RNA, 20 nt, Human
ugaaaugaaaacauguaaua

SEQ ID NO: 2142246 - RNA, 20 nt, Human
ugaaaugaggucagagccug

SEQ ID NO: 2142247 - RNA, 19 nt, Human
ugaaaugaggucagagccu

SEQ ID NO: 2142248 - RNA, 22 nt, Human
ugaaaugaggucagagccugca

SEQ ID NO: 2142249 - RNA, 21 nt, Human
ugaaaugaggucagagccugc

SEQ ID NO: 2142250 - RNA, 23 nt, Human
ugaaaugaggucagagccugcag

SEQ ID NO: 2142251 - RNA, 19 nt, Human
ugaaaugcagagucaauga

SEQ ID NO: 2142252 - RNA, 16 nt, Human
ucuuguauuaaguugu

SEQ ID NO: 2142253 - RNA, 18 nt, Human
ucuugcucuaucucacag

SEQ ID NO: 2142254 - RNA, 21 nt, Human
ucuugcucuaucucacagcac

SEQ ID NO: 2142255 - RNA, 18 nt, Human
ucuuguauuaaguuguua

SEQ ID NO: 2142256 - RNA, 22 nt, Human
ucuuguauuaaguuguuaauaa

SEQ ID NO: 2142257 - RNA, 15 nt, Human
ucuugucacaauaaa

SEQ ID NO: 2142258 - RNA, 16 nt, Human
ucuugucacaauaaau

SEQ ID NO: 2142259 - RNA, 22 nt, Human
ucuuguccagagacaagacuuc

SEQ ID NO: 2142260 - RNA, 11 nt, Human
ucuugcucugc

SEQ ID NO: 2142261 - RNA, 13 nt, Human
ucuugcucugcug

SEQ ID NO: 2142262 - RNA, 12 nt, Human
ucuugcucugcu

SEQ ID NO: 2142263 - RNA, 11 nt, Human
ucuugugacua

SEQ ID NO: 2142264 - RNA, 14 nt, Human
ucuugugacuagug

SEQ ID NO: 2142265 - RNA, 18 nt, Human
ucuugugaauauguacau

SEQ ID NO: 2142266 - RNA, 22 nt, Human
ucuugugaauauguacauaggc

SEQ ID NO: 2142267 - RNA, 21 nt, Human
ucuugugacauauuaugucuu

SEQ ID NO: 2142268 - RNA, 15 nt, Human
ucuugucucugggcu

SEQ ID NO: 2142269 - RNA, 14 nt, Human
ucuugucucugggc

SEQ ID NO: 2142270 - RNA, 13 nt, Human
ucuugucucuggg

SEQ ID NO: 2142271 - RNA, 12 nt, Human
ucuugucucugg

SEQ ID NO: 2142272 - RNA, 21 nt, Human
ucuuguccccaacaccccaca

SEQ ID NO: 2142273 - RNA, 21 nt, Human
ucuuguuuuuuuuuuccacuu

SEQ ID NO: 2142274 - RNA, 18 nt, Human
ucuuguuuuuuuuuucca

SEQ ID NO: 2142275 - RNA, 16 nt, Human
ucuugugacuagugcu

SEQ ID NO: 2142276 - RNA, 18 nt, Human
ucuugugacuagugcuga

SEQ ID NO: 2142277 - RNA, 19 nt, Human
ucuugugacuagugcugaa

SEQ ID NO: 2142278 - RNA, 21 nt, Human
ucuugugacuagugcugaagc

SEQ ID NO: 2142279 - RNA, 16 nt, Human
ucuucuccacuggaug

SEQ ID NO: 2142280 - RNA, 12 nt, Human
ucuucuccaggc

SEQ ID NO: 2142281 - RNA, 14 nt, Human
ucuucuccaggcug

SEQ ID NO: 2142282 - RNA, 13 nt, Human
ucuucuccaggcu

SEQ ID NO: 2142283 - RNA, 18 nt, Human
ucuugaacuccuggccuc

SEQ ID NO: 2142284 - RNA, 17 nt, Human
ucuugaacuccuggccu

SEQ ID NO: 2142285 - RNA, 16 nt, Human
ucuugaacuccuggcc

SEQ ID NO: 2142286 - RNA, 15 nt, Human
ucuucuccaggcugu

SEQ ID NO: 2142287 - RNA, 19 nt, Human
ucuugaccaagcaggaagc

SEQ ID NO: 2142288 - RNA, 18 nt, Human
ucuugaauuucuaaaaaa

SEQ ID NO: 2142289 - RNA, 20 nt, Human
ucuugccuaaguauuccuuu

SEQ ID NO: 2142290 - RNA, 21 nt, Human
ucuugaccaagcaggaagcuc

SEQ ID NO: 2142291 - RNA, 20 nt, Human
ucuugccuccauggugccuc

SEQ ID NO: 2142292 - RNA, 15 nt, Human
ucuucuauuuuauuc

SEQ ID NO: 2142293 - RNA, 16 nt, Human
ucuucuauuuuauucc

SEQ ID NO: 2142294 - RNA, 13 nt, Human
ucuucuccacugg

SEQ ID NO: 2142295 - RNA, 12 nt, Human
ucuucucaaagg

SEQ ID NO: 2142296 - RNA, 17 nt, Human
ucuucucacucccuucu

SEQ ID NO: 2142297 - RNA, 21 nt, Human
ucuuccaagacuccagcccug

SEQ ID NO: 2142298 - RNA, 18 nt, Human
ucuuccaagcaaagguga

SEQ ID NO: 2142299 - RNA, 24 nt, Human
ucuuccaagcaaaggugaagagac

SEQ ID NO: 2142300 - RNA, 16 nt, Human
ucuucaguaagccgug

SEQ ID NO: 2142301 - RNA, 15 nt, Human
ucuucagggggccag

SEQ ID NO: 2142302 - RNA, 16 nt, Human
ucuucagguggaaaaa

SEQ ID NO: 2142303 - RNA, 23 nt, Human
ucuucagguggaaaaacaucuga

SEQ ID NO: 2142304 - RNA, 14 nt, Human
ucuucagguucuua

SEQ ID NO: 2142305 - RNA, 19 nt, Human
ucuucagugggagaaaaca

SEQ ID NO: 2142306 - RNA, 13 nt, Human
ucuuccaccugga

SEQ ID NO: 2142307 - RNA, 14 nt, Human
ucuuccaccuggaa

SEQ ID NO: 2142308 - RNA, 18 nt, Human
ucuucguucuuguuagua

SEQ ID NO: 2142309 - RNA, 16 nt, Human
ucuucuaaaaaaaaac

SEQ ID NO: 2142310 - RNA, 14 nt, Human
ucuucuaccaccca

SEQ ID NO: 2142311 - RNA, 23 nt, Human
ucuucuagagccgugaugccucc

SEQ ID NO: 2142312 - RNA, 16 nt, Human
ucuuaguggauguucu

SEQ ID NO: 2142313 - RNA, 13 nt, Human
ucuuaaaacuccu

SEQ ID NO: 2142314 - RNA, 12 nt, Human
ucuuaaaacucc

SEQ ID NO: 2142315 - RNA, 20 nt, Human
ucuuaaaacauuaugaguuu

SEQ ID NO: 2142316 - RNA, 22 nt, Human
ucuuaaaaaguuauaaccaacu

SEQ ID NO: 2142317 - RNA, 19 nt, Human
ucuuaaaauauauuucaga

SEQ ID NO: 2142318 - RNA, 20 nt, Human
ucuuaaaauauauuucagau

SEQ ID NO: 2142319 - RNA, 22 nt, Human
ucuguucaguaacagggccuug

SEQ ID NO: 2142320 - RNA, 15 nt, Human
ucuuauacauuugau

SEQ ID NO: 2142321 - RNA, 14 nt, Human
ucuuauacauuuga

SEQ ID NO: 2142322 - RNA, 13 nt, Human
ucuucagggcacu

SEQ ID NO: 2142323 - RNA, 15 nt, Human
ucuucagggcacugc

SEQ ID NO: 2142324 - RNA, 15 nt, Human
ucuucaguaagccgu

SEQ ID NO: 2142325 - RNA, 14 nt, Human
ucuuaugccauuug

SEQ ID NO: 2142326 - RNA, 20 nt, Human
ucuuaugccauuuguuuauu

SEQ ID NO: 2142327 - RNA, 22 nt, Human
ucuuauagucaauguuucuuuu

SEQ ID NO: 2142328 - RNA, 20 nt, Human
ucuuauagaauauuuauuac

SEQ ID NO: 2142329 - RNA, 19 nt, Human
ucuuauagaauauuuauua

SEQ ID NO: 2142330 - RNA, 13 nt, Human
ucuuauagaaagu

SEQ ID NO: 2142331 - RNA, 15 nt, Human
ucugcaccccccugg

SEQ ID NO: 2142332 - RNA, 16 nt, Human
ucugcaccccccuggg

SEQ ID NO: 2142333 - RNA, 17 nt, Human
ucugcaccccccugggc

SEQ ID NO: 2142334 - RNA, 18 nt, Human
ucugcaccccccugggcu

SEQ ID NO: 2142335 - RNA, 16 nt, Human
ucuggagaauaauucu

SEQ ID NO: 2142336 - RNA, 16 nt, Human
ucuggagcccuugggu

SEQ ID NO: 2142337 - RNA, 14 nt, Human
ucuggaggccucug

SEQ ID NO: 2142338 - RNA, 15 nt, Human
ucuggaggccucugg

SEQ ID NO: 2142339 - RNA, 16 nt, Human
ucuggaggccucuggg

SEQ ID NO: 2142340 - RNA, 17 nt, Human
ucuggaggccucugggc

SEQ ID NO: 2142341 - RNA, 12 nt, Human
ucuggagcccuu

SEQ ID NO: 2142342 - RNA, 13 nt, Human
ucuggagcccuug

SEQ ID NO: 2142343 - RNA, 16 nt, Human
ucuggagggaaacacc

SEQ ID NO: 2142344 - RNA, 15 nt, Human
ucuggaggggagcuc

SEQ ID NO: 2142345 - RNA, 22 nt, Human
ucuggaggggagcucugucugu

SEQ ID NO: 2142346 - RNA, 13 nt, Human
ucuggcucugucu

SEQ ID NO: 2142347 - RNA, 22 nt, Human
ucuggcuagaggccagccccac

SEQ ID NO: 2142348 - RNA, 17 nt, Human
ucuggcuagaggccagc

SEQ ID NO: 2142349 - RNA, 21 nt, Human
ucuggcuagaggccagcccca

SEQ ID NO: 2142350 - RNA, 18 nt, Human
ucuggcgacaguuuuccu

SEQ ID NO: 2142351 - RNA, 22 nt, Human
ucuggcgacaguuuuccuucuc

SEQ ID NO: 2142352 - RNA, 16 nt, Human
ucuggcuaaggacagg

SEQ ID NO: 2142353 - RNA, 16 nt, Human
ucuggcuagaggccag

SEQ ID NO: 2142354 - RNA, 21 nt, Human
ucuguaagcucuuugaaacaa

SEQ ID NO: 2142355 - RNA, 19 nt, Human
ucuguaauaaacucauuuc

SEQ ID NO: 2142356 - RNA, 24 nt, Human
ucuguaauaaacucauuucuagca

SEQ ID NO: 2142357 - RNA, 23 nt, Human
ucuguaauaaacucauuucuagc

SEQ ID NO: 2142358 - RNA, 15 nt, Human
ucuggcucuccccaa

SEQ ID NO: 2142359 - RNA, 12 nt, Human
ucugggacacag

SEQ ID NO: 2142360 - RNA, 15 nt, Human
ucugggaacucccaa

SEQ ID NO: 2142361 - RNA, 18 nt, Human
ucugggaacugugccuuu

SEQ ID NO: 2142362 - RNA, 22 nt, Human
ucugggaaauggcuugaagcca

SEQ ID NO: 2142363 - RNA, 13 nt, Human
ucugggacacagu

SEQ ID NO: 2142364 - RNA, 18 nt, Human
ucugggaaauaagagaga

SEQ ID NO: 2142365 - RNA, 20 nt, Human
ucuguccguuuacuccaagg

SEQ ID NO: 2142366 - RNA, 19 nt, Human
ucuguccgagcuuugaaaa

SEQ ID NO: 2142367 - RNA, 17 nt, Human
ucuguacgucugacagg

SEQ ID NO: 2142368 - RNA, 22 nt, Human
ucuguaccauagcgcugcucuu

SEQ ID NO: 2142369 - RNA, 16 nt, Human
ucuguaccauuuauuu

SEQ ID NO: 2142370 - RNA, 22 nt, Human
ucugugucagguggggcagcuu

SEQ ID NO: 2142371 - RNA, 11 nt, Human
ucugugucucu

SEQ ID NO: 2142372 - RNA, 12 nt, Human
ucugugucucuu

SEQ ID NO: 2142373 - RNA, 16 nt, Human
ucuguucaaggaauca

SEQ ID NO: 2142374 - RNA, 18 nt, Human
ucuuaaaaaguggaaaaa

SEQ ID NO: 2142375 - RNA, 17 nt, Human
ucuguuaagugguuuca

SEQ ID NO: 2142376 - RNA, 16 nt, Human
ucuguguuuuugaaau

SEQ ID NO: 2142377 - RNA, 15 nt, Human
ucuguguuuuugaaa

SEQ ID NO: 2142378 - RNA, 20 nt, Human
uggaaaaaccacccccaaau

SEQ ID NO: 2142379 - RNA, 23 nt, Human
uggaaaaacaucugaaagccacg

SEQ ID NO: 2142380 - RNA, 15 nt, Human
uggaaaauaaaucaa

SEQ ID NO: 2142381 - RNA, 11 nt, Human
uggaaaauaaa

SEQ ID NO: 2142382 - RNA, 15 nt, Human
uggaaaauaaauuau

SEQ ID NO: 2142383 - RNA, 16 nt, Human
uggaaaauaaauuauu

SEQ ID NO: 2142384 - RNA, 18 nt, Human
uggaacccuuuuggcccc

SEQ ID NO: 2142385 - RNA, 19 nt, Human
uggaacccuuuuggccccc

SEQ ID NO: 2142386 - RNA, 21 nt, Human
uggaacccuuuuggcccccga

SEQ ID NO: 2142387 - RNA, 16 nt, Human
uggaaccgcaggaagc

SEQ ID NO: 2142388 - RNA, 17 nt, Human
uggaaccgcaggaagcu

SEQ ID NO: 2142389 - RNA, 19 nt, Human
uggaaccgcaggaagcugc

SEQ ID NO: 2142390 - RNA, 23 nt, Human
uggaaccgcaggaagcugcuccg

SEQ ID NO: 2142391 - RNA, 20 nt, Human
uggaaccgcaggaagcugcu

SEQ ID NO: 2142392 - RNA, 21 nt, Human
uggaauuaaccuggugcugga

SEQ ID NO: 2142393 - RNA, 17 nt, Human
uggaaaauaaaaggucu

SEQ ID NO: 2142394 - RNA, 16 nt, Human
uggaauuaaccuggug

SEQ ID NO: 2142395 - RNA, 17 nt, Human
uggaauuaaccuggugc

SEQ ID NO: 2142396 - RNA, 18 nt, Human
uggaauuaaccuggugcu

SEQ ID NO: 2142397 - RNA, 19 nt, Human
uggaauuaaccuggugcug

SEQ ID NO: 2142398 - RNA, 20 nt, Human
uggaauuaaccuggugcugg

SEQ ID NO: 2142399 - RNA, 20 nt, Human
uggaaucuucucuuugacaa

SEQ ID NO: 2142400 - RNA, 21 nt, Human
uggaaucuucucuuugacaau

SEQ ID NO: 2142401 - RNA, 22 nt, Human
uggaaucuucucuuugacaauu

SEQ ID NO: 2142402 - RNA, 14 nt, Human
uggaauuaaaacaa

SEQ ID NO: 2142403 - RNA, 15 nt, Human
uggaauuaaaacaau

SEQ ID NO: 2142404 - RNA, 16 nt, Human
uggaauuaaaacaaug

SEQ ID NO: 2142405 - RNA, 17 nt, Human
uggaauuaaaacaaugu

SEQ ID NO: 2142406 - RNA, 16 nt, Human
uggaaucuagaagaaa

SEQ ID NO: 2142407 - RNA, 17 nt, Human
uggaaucuagaagaaau

SEQ ID NO: 2142408 - RNA, 18 nt, Human
uggaaucuagaagaaaug

SEQ ID NO: 2142409 - RNA, 19 nt, Human
uggaaucuagaagaaauga

SEQ ID NO: 2142410 - RNA, 21 nt, Human
uggaaucuagaagaaaugaaa

SEQ ID NO: 2142411 - RNA, 22 nt, Human
uggaaucuagaagaaaugaaau

SEQ ID NO: 2142412 - RNA, 22 nt, Human
uggaauaucugcuguaugucaa

SEQ ID NO: 2142413 - RNA, 23 nt, Human
uggaauauuccccuaucucuaga

SEQ ID NO: 2142414 - RNA, 21 nt, Human
uggaagugugugaucuguggg

SEQ ID NO: 2142415 - RNA, 20 nt, Human
uggaauacuaaaaaucauga

SEQ ID NO: 2142416 - RNA, 22 nt, Human
uggaauacuaaaaaucaugaga

SEQ ID NO: 2142417 - RNA, 22 nt, Human
uggaauacaguguuauuuucuu

SEQ ID NO: 2142418 - RNA, 14 nt, Human
uggaauacaguguu

SEQ ID NO: 2142419 - RNA, 15 nt, Human
uggaauacaguguua

SEQ ID NO: 2142420 - RNA, 16 nt, Human
uggaaguuuguguucu

SEQ ID NO: 2142421 - RNA, 19 nt, Human
uggaaguuuguguucuguu

SEQ ID NO: 2142422 - RNA, 23 nt, Human
uggaaguuuguguucuguuuguu

SEQ ID NO: 2142423 - RNA, 13 nt, Human
uggaaguuuucag

SEQ ID NO: 2142424 - RNA, 15 nt, Human
uggaaguuuucagga

SEQ ID NO: 2142425 - RNA, 14 nt, Human
ugcuuguuggauuu

SEQ ID NO: 2142426 - RNA, 23 nt, Human
ugcuuguuugcucaccuggggug

SEQ ID NO: 2142427 - RNA, 14 nt, Human
ugcuugaaagaaaa

SEQ ID NO: 2142428 - RNA, 21 nt, Human
ugcuugaaagaaaauaugcau

SEQ ID NO: 2142429 - RNA, 12 nt, Human
ugcuugaacaca

SEQ ID NO: 2142430 - RNA, 13 nt, Human
ugcuugaacacag

SEQ ID NO: 2142431 - RNA, 14 nt, Human
ugcuugaacacagu

SEQ ID NO: 2142432 - RNA, 16 nt, Human
ugcuugaacacaguau

SEQ ID NO: 2142433 - RNA, 17 nt, Human
ugcuugaacacaguauu

SEQ ID NO: 2142434 - RNA, 20 nt, Human
ugcuugaacacaguauuuuc

SEQ ID NO: 2142435 - RNA, 17 nt, Human
ugcuugaacccaggaga

SEQ ID NO: 2142436 - RNA, 16 nt, Human
ugcuuguucccucucc

SEQ ID NO: 2142437 - RNA, 19 nt, Human
ugcuuguucccucucccug

SEQ ID NO: 2142438 - RNA, 23 nt, Human
ugcuuuuuuauggcgauucccau

SEQ ID NO: 2142439 - RNA, 19 nt, Human
ugcuuucaucuuggucaca

SEQ ID NO: 2142440 - RNA, 12 nt, Human
ugcuucugggaa

SEQ ID NO: 2142441 - RNA, 14 nt, Human
ugcuucugggaagg

SEQ ID NO: 2142442 - RNA, 13 nt, Human
ugcuucugggaga

SEQ ID NO: 2142443 - RNA, 17 nt, Human
ugcuucuguaguacucc

SEQ ID NO: 2142444 - RNA, 20 nt, Human
ugcuucuguaguacuccuua

SEQ ID NO: 2142445 - RNA, 21 nt, Human
ugcuucuucccuuaaaauuua

SEQ ID NO: 2142446 - RNA, 22 nt, Human
ugcuucuucccuuaaaauuuau

SEQ ID NO: 2142447 - RNA, 12 nt, Human
ugcuucucacug

SEQ ID NO: 2142448 - RNA, 18 nt, Human
ugcuucuaccaacuggaa

SEQ ID NO: 2142449 - RNA, 21 nt, Human
ugcuucuaccaacuggaagca

SEQ ID NO: 2142450 - RNA, 23 nt, Human
ugcuucuaccaacuggaagcaca

SEQ ID NO: 2142451 - RNA, 12 nt, Human
ugcugccucccc

SEQ ID NO: 2142452 - RNA, 13 nt, Human
ugcugccucccca

SEQ ID NO: 2142453 - RNA, 14 nt, Human
ugcugccuccccaa

SEQ ID NO: 2142454 - RNA, 17 nt, Human
ugcugccuccccaaccc

SEQ ID NO: 2142455 - RNA, 19 nt, Human
ugcugccuccccaacccug

SEQ ID NO: 2142456 - RNA, 22 nt, Human
ugcugccuccccaacccugccc

SEQ ID NO: 2142457 - RNA, 13 nt, Human
ugcugccuaggcu

SEQ ID NO: 2142458 - RNA, 18 nt, Human
ugcugccuaggcugaccu

SEQ ID NO: 2142459 - RNA, 20 nt, Human
ugcugccgccucccagccug

SEQ ID NO: 2142460 - RNA, 21 nt, Human
ugcugccgccucccagccugg

SEQ ID NO: 2142461 - RNA, 16 nt, Human
ugcugccgccucccag

SEQ ID NO: 2142462 - RNA, 17 nt, Human
ugcugccgccucccagc

SEQ ID NO: 2142463 - RNA, 19 nt, Human
ugcugccgccucccagccu

SEQ ID NO: 2142464 - RNA, 14 nt, Human
ugcugccuccagaa

SEQ ID NO: 2142465 - RNA, 19 nt, Human
uggauacgacaacuugcac

SEQ ID NO: 2142466 - RNA, 18 nt, Human
uggauaaugcuguugccu

SEQ ID NO: 2142467 - RNA, 17 nt, Human
uggauacugcccggggc

SEQ ID NO: 2142468 - RNA, 22 nt, Human
uggauacugcccggggcagcug

SEQ ID NO: 2142469 - RNA, 14 nt, Human
uggauaauuuugca

SEQ ID NO: 2142470 - RNA, 21 nt, Human
uggauaauuuugcauaaaauu

SEQ ID NO: 2142471 - RNA, 13 nt, Human
uggauagaugccc

SEQ ID NO: 2142472 - RNA, 14 nt, Human
uggauagaugcccu

SEQ ID NO: 2142473 - RNA, 17 nt, Human
uggauagaugcccugcu

SEQ ID NO: 2142474 - RNA, 13 nt, Human
uggauagcauguc

SEQ ID NO: 2142475 - RNA, 16 nt, Human
uggauagcaugucuuu

SEQ ID NO: 2142476 - RNA, 22 nt, Human
uggaugaaguuaucuggcuuca

SEQ ID NO: 2142477 - RNA, 12 nt, Human
uggaugauguuu

SEQ ID NO: 2142478 - RNA, 14 nt, Human
uggaggccagccag

SEQ ID NO: 2142479 - RNA, 15 nt, Human
uggaggccagccagu

SEQ ID NO: 2142480 - RNA, 22 nt, Human
uggaggcacacagcugcagaga

SEQ ID NO: 2142481 - RNA, 14 nt, Human
uggaggcagggccu

SEQ ID NO: 2142482 - RNA, 22 nt, Human
uggaggcagggccuugcccaga

SEQ ID NO: 2142483 - RNA, 18 nt, Human
uggaggcacacagcugca

SEQ ID NO: 2142484 - RNA, 19 nt, Human
uggaggcacacagcugcag

SEQ ID NO: 2142485 - RNA, 13 nt, Human
uggaggcugucuu

SEQ ID NO: 2142486 - RNA, 14 nt, Human
uggaggccucuggg

SEQ ID NO: 2142487 - RNA, 15 nt, Human
uggaggccucugggc

SEQ ID NO: 2142488 - RNA, 16 nt, Human
uggaggccucugggcc

SEQ ID NO: 2142489 - RNA, 22 nt, Human
uggaggccucugggccuccucu

SEQ ID NO: 2142490 - RNA, 14 nt, Human
uggaggcugucuuc

SEQ ID NO: 2142491 - RNA, 22 nt, Human
uggaggcugucuucucaggcuc

SEQ ID NO: 2142492 - RNA, 23 nt, Human
uggaggcugucuucucaggcucu

SEQ ID NO: 2142493 - RNA, 19 nt, Human
uggaggccgggugcucagg

SEQ ID NO: 2142494 - RNA, 21 nt, Human
uggaggccgggugcucagggc

SEQ ID NO: 2142495 - RNA, 14 nt, Human
uggaggccaggaau

SEQ ID NO: 2142496 - RNA, 17 nt, Human
uggagacugucucaaga

SEQ ID NO: 2142497 - RNA, 12 nt, Human
uggagagagggg

SEQ ID NO: 2142498 - RNA, 13 nt, Human
uggagagagggga

SEQ ID NO: 2142499 - RNA, 16 nt, Human
uggacaggcauguucu

SEQ ID NO: 2142500 - RNA, 12 nt, Human
uggacaggcaug

SEQ ID NO: 2142501 - RNA, 22 nt, Human
uggagaggagggaugcugccug

SEQ ID NO: 2142502 - RNA, 14 nt, Human
uggagagcaacaca

SEQ ID NO: 2142503 - RNA, 23 nt, Human
uggagaggagggaugcugccuga

SEQ ID NO: 2142504 - RNA, 19 nt, Human
uggagagggaugaggugcu

SEQ ID NO: 2142505 - RNA, 20 nt, Human
uggagagggacagcccacug

SEQ ID NO: 2142506 - RNA, 13 nt, Human
uggagagggauga

SEQ ID NO: 2142507 - RNA, 22 nt, Human
uggagagguuauaggucacucc

SEQ ID NO: 2142508 - RNA, 21 nt, Human
uggagagggaugaggugcugg

SEQ ID NO: 2142509 - RNA, 15 nt, Human
uggagaguaaaaacu

SEQ ID NO: 2142510 - RNA, 17 nt, Human
uggagagugcaacagua

SEQ ID NO: 2142511 - RNA, 20 nt, Human
uggagagugcaacaguagca

SEQ ID NO: 2142512 - RNA, 16 nt, Human
uggagaugggaugcuu

SEQ ID NO: 2142513 - RNA, 18 nt, Human
uggagaugggaugcuugc

SEQ ID NO: 2142514 - RNA, 13 nt, Human
uggagauggggag

SEQ ID NO: 2142515 - RNA, 15 nt, Human
uggagauggggagaa

SEQ ID NO: 2142516 - RNA, 17 nt, Human
uggagauggggagaaac

SEQ ID NO: 2142517 - RNA, 22 nt, Human
uggccacuccagaccccuggcu

SEQ ID NO: 2142518 - RNA, 20 nt, Human
uggcagugggagcugccugu

SEQ ID NO: 2142519 - RNA, 20 nt, Human
uggccagaagggggccauga

SEQ ID NO: 2142520 - RNA, 13 nt, Human
uggccagagagcc

SEQ ID NO: 2142521 - RNA, 23 nt, Human
uggccagagagccuggugcugcu

SEQ ID NO: 2142522 - RNA, 14 nt, Human
uggccagaccagag

SEQ ID NO: 2142523 - RNA, 15 nt, Human
uggccagaccagagc

SEQ ID NO: 2142524 - RNA, 16 nt, Human
uggccagaccagagcu

SEQ ID NO: 2142525 - RNA, 17 nt, Human
uggccagaccagagcuc

SEQ ID NO: 2142526 - RNA, 20 nt, Human
uggccagaccagagcucugg

SEQ ID NO: 2142527 - RNA, 21 nt, Human
uggccagaccagagcucugga

SEQ ID NO: 2142528 - RNA, 22 nt, Human
uggccagaccagagcucuggag

SEQ ID NO: 2142529 - RNA, 23 nt, Human
uggccagaccagagcucuggagc

SEQ ID NO: 2142530 - RNA, 15 nt, Human
uggcaggccagcugu

SEQ ID NO: 2142531 - RNA, 19 nt, Human
uggcagugggagcugccug

SEQ ID NO: 2142532 - RNA, 16 nt, Human
uggcagugggagcugc

SEQ ID NO: 2142533 - RNA, 15 nt, Human
uggcagugggagcug

SEQ ID NO: 2142534 - RNA, 14 nt, Human
uggcagugggagcu

SEQ ID NO: 2142535 - RNA, 14 nt, Human
uggaugccuggugg

SEQ ID NO: 2142536 - RNA, 14 nt, Human
uggaugccucagaa

SEQ ID NO: 2142537 - RNA, 14 nt, Human
uggaugauguuucg

SEQ ID NO: 2142538 - RNA, 19 nt, Human
uggcacugcauacaaucug

SEQ ID NO: 2142539 - RNA, 22 nt, Human
uggcagcugcgguccacccagg

SEQ ID NO: 2142540 - RNA, 21 nt, Human
uggcagcugcgguccacccag

SEQ ID NO: 2142541 - RNA, 23 nt, Human
uggcagcugcgguccacccagga

SEQ ID NO: 2142542 - RNA, 14 nt, Human
uggcagaacugagc

SEQ ID NO: 2142543 - RNA, 23 nt, Human
uggcagaaagcaaaugugaccug

SEQ ID NO: 2142544 - RNA, 16 nt, Human
uggcagaacugagcuc

SEQ ID NO: 2142545 - RNA, 20 nt, Human
uggcagaacugagcuccucu

SEQ ID NO: 2142546 - RNA, 21 nt, Human
uggcagaacugagcuccucug

SEQ ID NO: 2142547 - RNA, 13 nt, Human
uggcgcuaggcau

SEQ ID NO: 2142548 - RNA, 22 nt, Human
uggcgugcaguggugcgaucug

SEQ ID NO: 2142549 - RNA, 13 nt, Human
uggcgucugucuu

SEQ ID NO: 2142550 - RNA, 15 nt, Human
uggcgucugucuuca

SEQ ID NO: 2142551 - RNA, 17 nt, Human
uggcgucugucuucaag

SEQ ID NO: 2142552 - RNA, 20 nt, Human
uggcgucugucuucaagggc

SEQ ID NO: 2142553 - RNA, 22 nt, Human
uggcgucugucuucaagggcuu

SEQ ID NO: 2142554 - RNA, 15 nt, Human
uggccagaugcacca

SEQ ID NO: 2142555 - RNA, 14 nt, Human
uggccagaggcuug

SEQ ID NO: 2142556 - RNA, 22 nt, Human
uggccuuguucucucuauggua

SEQ ID NO: 2142557 - RNA, 18 nt, Human
uggccuuugcuuaugaau

SEQ ID NO: 2142558 - RNA, 21 nt, Human
uggccuuugcuuaugaauauu

SEQ ID NO: 2142559 - RNA, 12 nt, Human
uggcugggggcc

SEQ ID NO: 2142560 - RNA, 16 nt, Human
uggcugggggcaggag

SEQ ID NO: 2142561 - RNA, 17 nt, Human
uggcugggggcaggagg

SEQ ID NO: 2142562 - RNA, 16 nt, Human
uggcugggcccagaag

SEQ ID NO: 2142563 - RNA, 18 nt, Human
uggcucuguggcuugcua

SEQ ID NO: 2142564 - RNA, 16 nt, Human
uggcucucagaaggua

SEQ ID NO: 2142565 - RNA, 21 nt, Human
uggcuccugaggggcaucugc

SEQ ID NO: 2142566 - RNA, 23 nt, Human
uggcuccugaggggcaucugccc

SEQ ID NO: 2142567 - RNA, 14 nt, Human
uggcuaaagguccc

SEQ ID NO: 2142568 - RNA, 19 nt, Human
uggcucauauuccugcagc

SEQ ID NO: 2142569 - RNA, 21 nt, Human
uggcucauauuccugcagccu

SEQ ID NO: 2142570 - RNA, 22 nt, Human
uggcucauauuccugcagccug

SEQ ID NO: 2142571 - RNA, 18 nt, Human
uggcgugucccucucgga

SEQ ID NO: 2142572 - RNA, 21 nt, Human
uggcuuuggucucuugcuugu

SEQ ID NO: 2142573 - RNA, 11 nt, Human
uggcuuuguuu

SEQ ID NO: 2142574 - RNA, 17 nt, Human
uggcuuugucccacagc

SEQ ID NO: 2142575 - RNA, 22 nt, Human
uggcuuugucccacagcuuggg

SEQ ID NO: 2142576 - RNA, 20 nt, Human
uggcuguagaaggagacaga

SEQ ID NO: 2142577 - RNA, 17 nt, Human
uggcuguaucuuguuuu

SEQ ID NO: 2142578 - RNA, 14 nt, Human
uggcugucagcagg

SEQ ID NO: 2142579 - RNA, 17 nt, Human
uggcugucagcaggaag

SEQ ID NO: 2142580 - RNA, 15 nt, Human
uggcugggggccuca

SEQ ID NO: 2142581 - RNA, 14 nt, Human
uggcugggggccuc

SEQ ID NO: 2142582 - RNA, 21 nt, Human
ugggaauguauuauucugcag

SEQ ID NO: 2142583 - RNA, 16 nt, Human
ugggaaugcggcaaga

SEQ ID NO: 2142584 - RNA, 14 nt, Human
uggcuuuucacugc

SEQ ID NO: 2142585 - RNA, 15 nt, Human
uggcuuuucacugcu

SEQ ID NO: 2142586 - RNA, 13 nt, Human
ugggacccuuucc

SEQ ID NO: 2142587 - RNA, 14 nt, Human
ugggacccuuuccu

SEQ ID NO: 2142588 - RNA, 17 nt, Human
ugggacccuuuccuucc

SEQ ID NO: 2142589 - RNA, 18 nt, Human
ugggacccuuuccuuccu

SEQ ID NO: 2142590 - RNA, 22 nt, Human
ugggaauguauuauucugcagc

SEQ ID NO: 2142591 - RNA, 16 nt, Human
ugggacagggcauggc

SEQ ID NO: 2142592 - RNA, 22 nt, Human
ugggagccccagggucuucccu

SEQ ID NO: 2142593 - RNA, 23 nt, Human
ugggagccccagggucuucccua

SEQ ID NO: 2142594 - RNA, 12 nt, Human
ugggagccaggg

SEQ ID NO: 2142595 - RNA, 13 nt, Human
ugggagccccagg

SEQ ID NO: 2142596 - RNA, 14 nt, Human
ugggagccccaggg

SEQ ID NO: 2142597 - RNA, 16 nt, Human
ugggagccccaggguc

SEQ ID NO: 2142598 - RNA, 21 nt, Human
ugggagcagcgguuuggggag

SEQ ID NO: 2142599 - RNA, 23 nt, Human
ugggagcugccuguucagcucca

SEQ ID NO: 2142600 - RNA, 22 nt, Human
uggggcaggaggggagugaggc

SEQ ID NO: 2142601 - RNA, 22 nt, Human
uggggcagucaccugcccagau

SEQ ID NO: 2142602 - RNA, 12 nt, Human
uggggcaggcag

SEQ ID NO: 2142603 - RNA, 14 nt, Human
uggggcaggcagug

SEQ ID NO: 2142604 - RNA, 17 nt, Human
uggggcaggcuggcugg

SEQ ID NO: 2142605 - RNA, 18 nt, Human
uggguuccaauccuggcu

SEQ ID NO: 2142606 - RNA, 11 nt, Human
uggguucauua

SEQ ID NO: 2142607 - RNA, 13 nt, Human
uggguucauuauu

SEQ ID NO: 2142608 - RNA, 16 nt, Human
uggguucauuauugga

SEQ ID NO: 2142609 - RNA, 18 nt, Human
uggguucauuauuggaau

SEQ ID NO: 2142610 - RNA, 20 nt, Human
uggguucauuauuggaauua

SEQ ID NO: 2142611 - RNA, 21 nt, Human
uggguagcuucugaccucagc

SEQ ID NO: 2142612 - RNA, 20 nt, Human
uggguucccuuuccuuccau

SEQ ID NO: 2142613 - RNA, 13 nt, Human
uggguuccucuuc

SEQ ID NO: 2142614 - RNA, 21 nt, Human
uggguuccucuuccccacucc

SEQ ID NO: 2142615 - RNA, 17 nt, Human
uggguuggaaaacagua

SEQ ID NO: 2142616 - RNA, 19 nt, Human
uggguugcguccugacggc

SEQ ID NO: 2142617 - RNA, 14 nt, Human
uggguucugggugg

SEQ ID NO: 2142618 - RNA, 14 nt, Human
uggguugacuuuca

SEQ ID NO: 2142619 - RNA, 22 nt, Human
uggguuucacaagugaaaaaca

SEQ ID NO: 2142620 - RNA, 16 nt, Human
uggguucacugcaacc

SEQ ID NO: 2142621 - RNA, 24 nt, Human
uggguucaggggacucagcccuga

SEQ ID NO: 2142622 - RNA, 23 nt, Human
uggguucaagcgauucuucugcu

SEQ ID NO: 2142623 - RNA, 15 nt, Human
uggguccaggggaug

SEQ ID NO: 2142624 - RNA, 20 nt, Human
uggguccaggggaugggagg

SEQ ID NO: 2142625 - RNA, 21 nt, Human
uggguccaggggaugggaggu

SEQ ID NO: 2142626 - RNA, 22 nt, Human
uggguguauuuauuuuccuccc

SEQ ID NO: 2142627 - RNA, 23 nt, Human
ugggugucaagagggucugagga

SEQ ID NO: 2142628 - RNA, 21 nt, Human
ugggugucaagagggucugag

SEQ ID NO: 2142629 - RNA, 16 nt, Human
uggggcagcuugaggg

SEQ ID NO: 2142630 - RNA, 20 nt, Human
ugggcuucaguggcagcugc

SEQ ID NO: 2142631 - RNA, 19 nt, Human
ugggcuucaguggcagcug

SEQ ID NO: 2142632 - RNA, 18 nt, Human
ugggcuucaguggcagcu

SEQ ID NO: 2142633 - RNA, 13 nt, Human
ugggcggcagaga

SEQ ID NO: 2142634 - RNA, 15 nt, Human
ugggcggcagagagg

SEQ ID NO: 2142635 - RNA, 19 nt, Human
ugggcggcagagaggacug

SEQ ID NO: 2142636 - RNA, 24 nt, Human
ugggaggaagcagguugaggggcu

SEQ ID NO: 2142637 - RNA, 13 nt, Human
ugggaggaagcag

SEQ ID NO: 2142638 - RNA, 24 nt, Human
ugggagcugccuguucagcuccag

SEQ ID NO: 2142639 - RNA, 20 nt, Human
ugggagcuugauucucagca

SEQ ID NO: 2142640 - RNA, 12 nt, Human
ugggaggaaaag

SEQ ID NO: 2142641 - RNA, 20 nt, Human
ugggaggaaaagaaaagagg

SEQ ID NO: 2142642 - RNA, 11 nt, Human
ugggaggaagc

SEQ ID NO: 2142643 - RNA, 15 nt, Human
ugggaggaaauuuga

SEQ ID NO: 2142644 - RNA, 13 nt, Human
ugggccuugcuac

SEQ ID NO: 2142645 - RNA, 18 nt, Human
ugggccuccucuguccag

SEQ ID NO: 2142646 - RNA, 20 nt, Human
ugggccuccucuguccaggg

SEQ ID NO: 2142647 - RNA, 22 nt, Human
ugggccuccugugugugcgccu

SEQ ID NO: 2142648 - RNA, 16 nt, Human
ugggccuccugugugu

SEQ ID NO: 2142649 - RNA, 14 nt, Human
ugggccuccugugu

SEQ ID NO: 2142650 - RNA, 13 nt, Human
ugcgugucguggg

SEQ ID NO: 2142651 - RNA, 14 nt, Human
ugcguggcugaccc

SEQ ID NO: 2142652 - RNA, 17 nt, Human
ugcguggcugacccccc

SEQ ID NO: 2142653 - RNA, 20 nt, Human
ugcguacguuuccugagaag

SEQ ID NO: 2142654 - RNA, 23 nt, Human
ugcguacguuuccugagaagugu

SEQ ID NO: 2142655 - RNA, 15 nt, Human
ugcguacguuuccug

SEQ ID NO: 2142656 - RNA, 20 nt, Human
ugcuagcacuuggagccaag

SEQ ID NO: 2142657 - RNA, 17 nt, Human
ugcuagcuaugugaccu

SEQ ID NO: 2142658 - RNA, 18 nt, Human
ugcuagcuaugugaccuu

SEQ ID NO: 2142659 - RNA, 18 nt, Human
ugcuagcacuuggagcca

SEQ ID NO: 2142660 - RNA, 23 nt, Human
ugcuagaugagaauucagcugcc

SEQ ID NO: 2142661 - RNA, 18 nt, Human
ugcgugugcgugcaugug

SEQ ID NO: 2142662 - RNA, 19 nt, Human
ugcuccucuccccagcaag

SEQ ID NO: 2142663 - RNA, 22 nt, Human
ugcucaucauuccuugagaaaa

SEQ ID NO: 2142664 - RNA, 17 nt, Human
ugcucagcuucuccaac

SEQ ID NO: 2142665 - RNA, 20 nt, Human
ugcucagcuucuccaacaau

SEQ ID NO: 2142666 - RNA, 14 nt, Human
ugcuaggugggcca

SEQ ID NO: 2142667 - RNA, 21 nt, Human
ugcuaggugggccagccccuc

SEQ ID NO: 2142668 - RNA, 23 nt, Human
ugcuaggugggccagccccuccc

SEQ ID NO: 2142669 - RNA, 15 nt, Human
ugcuaggugggccag

SEQ ID NO: 2142670 - RNA, 17 nt, Human
ugcuaggugggccagcc

SEQ ID NO: 2142671 - RNA, 19 nt, Human
ugcuaggugggccagcccc

SEQ ID NO: 2142672 - RNA, 20 nt, Human
ugcuaggugggccagccccu

SEQ ID NO: 2142673 - RNA, 15 nt, Human
ugcugaguugguguu

SEQ ID NO: 2142674 - RNA, 19 nt, Human
ugcugacagacacaggccc

SEQ ID NO: 2142675 - RNA, 16 nt, Human
ugcugacagacacagg

SEQ ID NO: 2142676 - RNA, 15 nt, Human
ugcugacagacacag

SEQ ID NO: 2142677 - RNA, 21 nt, Human
ugcguggguggggagggaggu

SEQ ID NO: 2142678 - RNA, 19 nt, Human
ugcugaaucggaaucucug

SEQ ID NO: 2142679 - RNA, 17 nt, Human
ugcugauucucccguuc

SEQ ID NO: 2142680 - RNA, 16 nt, Human
ugcugaugcucauggu

SEQ ID NO: 2142681 - RNA, 22 nt, Human
ugcugaugcucaugguccccau

SEQ ID NO: 2142682 - RNA, 17 nt, Human
ugcugauguggcaacug

SEQ ID NO: 2142683 - RNA, 21 nt, Human
ugcugauguggcaacugcuga

SEQ ID NO: 2142684 - RNA, 17 nt, Human
ugcugaaugguuuucaa

SEQ ID NO: 2142685 - RNA, 18 nt, Human
ugcugaaugguuuucaaa

SEQ ID NO: 2142686 - RNA, 22 nt, Human
ugcugaaugguuuucaaaauaa

SEQ ID NO: 2142687 - RNA, 18 nt, Human
ugcugaauacagaggcaa

SEQ ID NO: 2142688 - RNA, 23 nt, Human
ugcugaauacagaggcaacugca

SEQ ID NO: 2142689 - RNA, 19 nt, Human
ugcuccuggcccacugcau

SEQ ID NO: 2142690 - RNA, 16 nt, Human
ugcuccuuagcugcca

SEQ ID NO: 2142691 - RNA, 18 nt, Human
ugcuccuuagcugccaag

SEQ ID NO: 2142692 - RNA, 20 nt, Human
ugcuccuuagcugccaagcc

SEQ ID NO: 2142693 - RNA, 19 nt, Human
ugcuccuuccaacaggagc

SEQ ID NO: 2142694 - RNA, 21 nt, Human
ugcuccuuccaacaggagcug

SEQ ID NO: 2142695 - RNA, 16 nt, Human
ugccuggcccccagcu

SEQ ID NO: 2142696 - RNA, 12 nt, Human
ugccuggccagg

SEQ ID NO: 2142697 - RNA, 14 nt, Human
ugccuggccaggca

SEQ ID NO: 2142698 - RNA, 16 nt, Human
ugccuggccaggcaga

SEQ ID NO: 2142699 - RNA, 20 nt, Human
ugccuggccaggcagaucug

SEQ ID NO: 2142700 - RNA, 18 nt, Human
ugccuucagcucuacagc

SEQ ID NO: 2142701 - RNA, 17 nt, Human
ugccuucagcucuacag

SEQ ID NO: 2142702 - RNA, 13 nt, Human
ugccuuccacgcu

SEQ ID NO: 2142703 - RNA, 13 nt, Human
ugccuucagcucu

SEQ ID NO: 2142704 - RNA, 18 nt, Human
ugccuuccagcacccugc

SEQ ID NO: 2142705 - RNA, 13 nt, Human
ugccuuccauaau

SEQ ID NO: 2142706 - RNA, 14 nt, Human
ugccuuccauaauu

SEQ ID NO: 2142707 - RNA, 17 nt, Human
ugccuuccauaauuaug

SEQ ID NO: 2142708 - RNA, 21 nt, Human
ugccuuccauaauuaugacag

SEQ ID NO: 2142709 - RNA, 23 nt, Human
ugccuuccacgcugucuccagac

SEQ ID NO: 2142710 - RNA, 21 nt, Human
ugccuuccacgcugucuccag

SEQ ID NO: 2142711 - RNA, 22 nt, Human
ugccuuccacgcugucuccaga

SEQ ID NO: 2142712 - RNA, 14 nt, Human
ugccuuccacgcug

SEQ ID NO: 2142713 - RNA, 17 nt, Human
ugccuuccacgcugucu

SEQ ID NO: 2142714 - RNA, 19 nt, Human
ugccuuccacgcugucucc

SEQ ID NO: 2142715 - RNA, 20 nt, Human
ugccuuccacgcugucucca

SEQ ID NO: 2142716 - RNA, 13 nt, Human
ugcgccuacagga

SEQ ID NO: 2142717 - RNA, 18 nt, Human
ugcgccauugcacuccag

SEQ ID NO: 2142718 - RNA, 21 nt, Human
ugcgccauugcacuccagccu

SEQ ID NO: 2142719 - RNA, 21 nt, Human
ugccuucuuauucucacucca

SEQ ID NO: 2142720 - RNA, 16 nt, Human
ugcgcacaacuuaaaa

SEQ ID NO: 2142721 - RNA, 22 nt, Human
ugcgcacaaggcugaccaagag

SEQ ID NO: 2142722 - RNA, 23 nt, Human
ugccuucuccagacaaaccagaa

SEQ ID NO: 2142723 - RNA, 14 nt, Human
ugccuaggcugacc

SEQ ID NO: 2142724 - RNA, 18 nt, Human
ugccuaggcugaccuuga

SEQ ID NO: 2142725 - RNA, 17 nt, Human
ugccuagggccuggucc

SEQ ID NO: 2142726 - RNA, 18 nt, Human
ugccuagggccuggucca

SEQ ID NO: 2142727 - RNA, 19 nt, Human
ugccuagcacucacaugcu

SEQ ID NO: 2142728 - RNA, 22 nt, Human
ugccuagcacucacaugcugga

SEQ ID NO: 2142729 - RNA, 17 nt, Human
ugccuaggaauucccag

SEQ ID NO: 2142730 - RNA, 15 nt, Human
ugccuacauuaucua

SEQ ID NO: 2142731 - RNA, 18 nt, Human
ugccuaauacauuaaagc

SEQ ID NO: 2142732 - RNA, 21 nt, Human
ugccuaauacauuaaagcagu

SEQ ID NO: 2142733 - RNA, 22 nt, Human
ugccuaauacauuaaagcaguc

SEQ ID NO: 2142734 - RNA, 17 nt, Human
ugccuaaguauuccuuu

SEQ ID NO: 2142735 - RNA, 14 nt, Human
ugccuaaguggcug

SEQ ID NO: 2142736 - RNA, 15 nt, Human
ugccuaaguggcugc

SEQ ID NO: 2142737 - RNA, 17 nt, Human
ugccuaaguggcugcug

SEQ ID NO: 2142738 - RNA, 18 nt, Human
ugccuaauaaacauccuu

SEQ ID NO: 2142739 - RNA, 21 nt, Human
ugccuaauaaacauccuucaa

SEQ ID NO: 2142740 - RNA, 19 nt, Human
ugcccagggcucagccugg

SEQ ID NO: 2142741 - RNA, 17 nt, Human
ugcccagggcucagccu

SEQ ID NO: 2142742 - RNA, 18 nt, Human
ugcccagggcucagccug

SEQ ID NO: 2142743 - RNA, 11 nt, Human
ugcccagggcu

SEQ ID NO: 2142744 - RNA, 14 nt, Human
ugcccagggcucag

SEQ ID NO: 2142745 - RNA, 15 nt, Human
ugcccagggcucagc

SEQ ID NO: 2142746 - RNA, 16 nt, Human
ugcccagggcucagcc

SEQ ID NO: 2142747 - RNA, 17 nt, Human
ugcccaggcuggucuca

SEQ ID NO: 2142748 - RNA, 17 nt, Human
ugcccagggauuugucc

SEQ ID NO: 2142749 - RNA, 19 nt, Human
ugcccagggccacucugcc

SEQ ID NO: 2142750 - RNA, 21 nt, Human
ugcccagggccacucugccuc

SEQ ID NO: 2142751 - RNA, 22 nt, Human
ugcccagggccacucugccucu

SEQ ID NO: 2142752 - RNA, 23 nt, Human
ugcccaggcuggcgugcaguggu

SEQ ID NO: 2142753 - RNA, 16 nt, Human
ugcccagaucccagaa

SEQ ID NO: 2142754 - RNA, 17 nt, Human
ugcccagaucccagaag

SEQ ID NO: 2142755 - RNA, 22 nt, Human
ugcccagaucccagaaggaccu

SEQ ID NO: 2142756 - RNA, 14 nt, Human
ugccucugggacug

SEQ ID NO: 2142757 - RNA, 17 nt, Human
ugccugaagucacacag

SEQ ID NO: 2142758 - RNA, 18 nt, Human
ugccugaagucacacagu

SEQ ID NO: 2142759 - RNA, 22 nt, Human
ugccugaagucacacagugagu

SEQ ID NO: 2142760 - RNA, 19 nt, Human
ugccugaaguuggagugag

SEQ ID NO: 2142761 - RNA, 19 nt, Human
ugccugagucacccaugaa

SEQ ID NO: 2142762 - RNA, 14 nt, Human
ugccugcaccagga

SEQ ID NO: 2142763 - RNA, 15 nt, Human
ugccugcaccaggag

SEQ ID NO: 2142764 - RNA, 16 nt, Human
ugccugcaccaggaga

SEQ ID NO: 2142765 - RNA, 17 nt, Human
ugccugcaccaggagac

SEQ ID NO: 2142766 - RNA, 18 nt, Human
ugccugcaccaggagaca

SEQ ID NO: 2142767 - RNA, 19 nt, Human
ugccugcaccaggagacag

SEQ ID NO: 2142768 - RNA, 20 nt, Human
ugccugcaccaggagacaga

SEQ ID NO: 2142769 - RNA, 15 nt, Human
ugcauuuuuuaaaac

SEQ ID NO: 2142770 - RNA, 19 nt, Human
ugcauuuuugugaaaugaa

SEQ ID NO: 2142771 - RNA, 17 nt, Human
ugcauuuuuuaaaacaa

SEQ ID NO: 2142772 - RNA, 19 nt, Human
ugcauuuuuuaaaacaaga

SEQ ID NO: 2142773 - RNA, 18 nt, Human
ugcauuacagagaggaga

SEQ ID NO: 2142774 - RNA, 14 nt, Human
ugcauuuuugugaa

SEQ ID NO: 2142775 - RNA, 16 nt, Human
ugcauuuuugugaaau

SEQ ID NO: 2142776 - RNA, 17 nt, Human
ugcauuuuugugaaaug

SEQ ID NO: 2142777 - RNA, 16 nt, Human
ugcauuacagagagga

SEQ ID NO: 2142778 - RNA, 17 nt, Human
ugcauuacagagaggag

SEQ ID NO: 2142779 - RNA, 12 nt, Human
ugccaaaauaau

SEQ ID NO: 2142780 - RNA, 13 nt, Human
ugccaaaauaaug

SEQ ID NO: 2142781 - RNA, 14 nt, Human
ugccaaaauaaugu

SEQ ID NO: 2142782 - RNA, 17 nt, Human
ugccaaaauaaugucuu

SEQ ID NO: 2142783 - RNA, 18 nt, Human
ugccaaaauaaugucuug

SEQ ID NO: 2142784 - RNA, 21 nt, Human
ugccaaaauaaugucuuguua

SEQ ID NO: 2142785 - RNA, 22 nt, Human
ugccaaaauaaugucuuguuaa

SEQ ID NO: 2142786 - RNA, 16 nt, Human
ugccaagaacugaaaa

SEQ ID NO: 2142787 - RNA, 17 nt, Human
ugccaagaacugaaaac

SEQ ID NO: 2142788 - RNA, 18 nt, Human
ugccaagaacugaaaaca

SEQ ID NO: 2142789 - RNA, 19 nt, Human
ugccaagaacugaaaacau

SEQ ID NO: 2142790 - RNA, 20 nt, Human
ugccaagaacugaaaacaua

SEQ ID NO: 2142791 - RNA, 19 nt, Human
ugcauguuacauaagauaa

SEQ ID NO: 2142792 - RNA, 11 nt, Human
ugcaugugugu

SEQ ID NO: 2142793 - RNA, 12 nt, Human
ugcaugugugcg

SEQ ID NO: 2142794 - RNA, 13 nt, Human
ugcaugugugugc

SEQ ID NO: 2142795 - RNA, 14 nt, Human
ugcaugugugugcu

SEQ ID NO: 2142796 - RNA, 11 nt, Human
ugcauuacaga

SEQ ID NO: 2142797 - RNA, 12 nt, Human
ugcauuacagag

SEQ ID NO: 2142798 - RNA, 15 nt, Human
ugcauuacagagagg

SEQ ID NO: 2142799 - RNA, 22 nt, Human
ugcauuacagagaggagaaaca

SEQ ID NO: 2142800 - RNA, 19 nt, Human
ugcaggaugauuguacaga

SEQ ID NO: 2142801 - RNA, 23 nt, Human
ugcaggaguuaaaaagggcaggg

SEQ ID NO: 2142802 - RNA, 16 nt, Human
ugcaucaucuguagau

SEQ ID NO: 2142803 - RNA, 17 nt, Human
ugcaucaucuguagaua

SEQ ID NO: 2142804 - RNA, 19 nt, Human
ugcauccauuccucaggga

SEQ ID NO: 2142805 - RNA, 14 nt, Human
ugcauccauuccuc

SEQ ID NO: 2142806 - RNA, 16 nt, Human
ugcauccauuccucag

SEQ ID NO: 2142807 - RNA, 17 nt, Human
ugcauccauuccucagg

SEQ ID NO: 2142808 - RNA, 18 nt, Human
ugcauccauuccucaggg

SEQ ID NO: 2142809 - RNA, 15 nt, Human
ugcaucguuucaucu

SEQ ID NO: 2142810 - RNA, 24 nt, Human
ugccagguuuuuggucugacccac

SEQ ID NO: 2142811 - RNA, 11 nt, Human
ugccagggagc

SEQ ID NO: 2142812 - RNA, 12 nt, Human
ugccagggagcu

SEQ ID NO: 2142813 - RNA, 15 nt, Human
ugccaagcacagugc

SEQ ID NO: 2142814 - RNA, 16 nt, Human
ugccaucugugggcac

SEQ ID NO: 2142815 - RNA, 18 nt, Human
ugccaucugugggcacgc

SEQ ID NO: 2142816 - RNA, 16 nt, Human
ugccaucuguguccug

SEQ ID NO: 2142817 - RNA, 20 nt, Human
ugccaucuguguccugguua

SEQ ID NO: 2142818 - RNA, 18 nt, Human
ugccauggacagaagaag

SEQ ID NO: 2142819 - RNA, 20 nt, Human
ugccauggacagaagaaggc

SEQ ID NO: 2142820 - RNA, 23 nt, Human
ugccauggacagaagaaggcagc

SEQ ID NO: 2142821 - RNA, 16 nt, Human
ugccauggaggcacac

SEQ ID NO: 2142822 - RNA, 17 nt, Human
ugccauggaggcacaca

SEQ ID NO: 2142823 - RNA, 18 nt, Human
ugccauggaggcacacag

SEQ ID NO: 2142824 - RNA, 23 nt, Human
ugccauggaggcacacagcugca

SEQ ID NO: 2142825 - RNA, 17 nt, Human
ugccauggcgugucccu

SEQ ID NO: 2142826 - RNA, 19 nt, Human
ugcccacauguguccaucc

SEQ ID NO: 2142827 - RNA, 23 nt, Human
ugcccacauguguccaucccagc

SEQ ID NO: 2142828 - RNA, 17 nt, Human
ugcccaccaacauccca

SEQ ID NO: 2142829 - RNA, 23 nt, Human
ugcccaccaacaucccauugccc

SEQ ID NO: 2142830 - RNA, 20 nt, Human
ugcccacccguggagauggg

SEQ ID NO: 2142831 - RNA, 20 nt, Human
ugcccagagggcccaggcag

SEQ ID NO: 2142832 - RNA, 21 nt, Human
ugcccagagggcccaggcagg

SEQ ID NO: 2142833 - RNA, 23 nt, Human
ugcccagagggcccaggcaggcc

SEQ ID NO: 2142834 - RNA, 19 nt, Human
ugcccacccguggagaugg

SEQ ID NO: 2142835 - RNA, 12 nt, Human
ugcagcccaugc

SEQ ID NO: 2142836 - RNA, 22 nt, Human
ugcagccagcccagcccagcug

SEQ ID NO: 2142837 - RNA, 13 nt, Human
ugcagcccaugcc

SEQ ID NO: 2142838 - RNA, 14 nt, Human
ugcagccagcccag

SEQ ID NO: 2142839 - RNA, 15 nt, Human
ugcagccagcccagc

SEQ ID NO: 2142840 - RNA, 16 nt, Human
ugcagccagcccagcc

SEQ ID NO: 2142841 - RNA, 17 nt, Human
ugcagccagcccagccc

SEQ ID NO: 2142842 - RNA, 19 nt, Human
ugcagccagcccagcccag

SEQ ID NO: 2142843 - RNA, 21 nt, Human
ugcagccagcccagcccagcu

SEQ ID NO: 2142844 - RNA, 23 nt, Human
ugcagccagcccagcccagcugg

SEQ ID NO: 2142845 - RNA, 12 nt, Human
ugcagccagccc

SEQ ID NO: 2142846 - RNA, 13 nt, Human
ugcagccagccca

SEQ ID NO: 2142847 - RNA, 18 nt, Human
ugcaggaccucaggugag

SEQ ID NO: 2142848 - RNA, 16 nt, Human
ugcaggaauaaggccu

SEQ ID NO: 2142849 - RNA, 17 nt, Human
ugcaggaauaaggccuu

SEQ ID NO: 2142850 - RNA, 15 nt, Human
ugcaggaccucaggu

SEQ ID NO: 2142851 - RNA, 16 nt, Human
ugcaggaccucaggug

SEQ ID NO: 2142852 - RNA, 14 nt, Human
ugcaggaccucagg

SEQ ID NO: 2142853 - RNA, 16 nt, Human
ugcacguacacacaca

SEQ ID NO: 2142854 - RNA, 19 nt, Human
ugcacguacacacacauac

SEQ ID NO: 2142855 - RNA, 22 nt, Human
ugcaccugccagccuggcuucu

SEQ ID NO: 2142856 - RNA, 18 nt, Human
ugcaccugcauccguagu

SEQ ID NO: 2142857 - RNA, 16 nt, Human
ugcacuugcagacucu

SEQ ID NO: 2142858 - RNA, 21 nt, Human
ugcacuugcagacucuacaga

SEQ ID NO: 2142859 - RNA, 14 nt, Human
ugcacuuggccucu

SEQ ID NO: 2142860 - RNA, 15 nt, Human
ugcacuuggccucug

SEQ ID NO: 2142861 - RNA, 17 nt, Human
ugcacuuggccucugga

SEQ ID NO: 2142862 - RNA, 18 nt, Human
ugcagagugcccagaacu

SEQ ID NO: 2142863 - RNA, 14 nt, Human
ugcagcaaccagag

SEQ ID NO: 2142864 - RNA, 16 nt, Human
ugcagcaaccagagca

SEQ ID NO: 2142865 - RNA, 17 nt, Human
ugcagcaaccagagcac

SEQ ID NO: 2142866 - RNA, 18 nt, Human
ugcagcaaccagagcacu

SEQ ID NO: 2142867 - RNA, 19 nt, Human
ugcagcaaccagagcacug

SEQ ID NO: 2142868 - RNA, 20 nt, Human
ugcagcaaccagagcacugu

SEQ ID NO: 2142869 - RNA, 22 nt, Human
ugcagcaaccagagcacuguau

SEQ ID NO: 2142870 - RNA, 13 nt, Human
ugcagagucagca

SEQ ID NO: 2142871 - RNA, 14 nt, Human
ugcagagucagcag

SEQ ID NO: 2142872 - RNA, 15 nt, Human
ugcagagucagcaga

SEQ ID NO: 2142873 - RNA, 17 nt, Human
ugcagagucagcagaac

SEQ ID NO: 2142874 - RNA, 14 nt, Human
ugcagagugcccag

SEQ ID NO: 2142875 - RNA, 15 nt, Human
ugcagagugcccaga

SEQ ID NO: 2142876 - RNA, 19 nt, Human
ugaaggccuuauucuacau

SEQ ID NO: 2142877 - RNA, 21 nt, Human
ugcacacuugugugugggcug

SEQ ID NO: 2142878 - RNA, 23 nt, Human
ugcacacuugugugugggcugug

SEQ ID NO: 2142879 - RNA, 19 nt, Human
ugcacagacgucccuccac

SEQ ID NO: 2142880 - RNA, 19 nt, Human
ugcacagauggauuugccu

SEQ ID NO: 2142881 - RNA, 23 nt, Human
ugcacagauggauuugccugugc

SEQ ID NO: 2142882 - RNA, 14 nt, Human
ugcaccucccccca

SEQ ID NO: 2142883 - RNA, 15 nt, Human
ugcaccuccccccac

SEQ ID NO: 2142884 - RNA, 16 nt, Human
ugcaccuccccccacu

SEQ ID NO: 2142885 - RNA, 17 nt, Human
ugcaccuccccccacug

SEQ ID NO: 2142886 - RNA, 18 nt, Human
ugcaccuccccccacugc

SEQ ID NO: 2142887 - RNA, 19 nt, Human
ugcaccuccccccacugca

SEQ ID NO: 2142888 - RNA, 20 nt, Human
ugcaccuccccccacugcag

SEQ ID NO: 2142889 - RNA, 11 nt, Human
ugcaccugcau

SEQ ID NO: 2142890 - RNA, 15 nt, Human
ugcaccugccagccu

SEQ ID NO: 2142891 - RNA, 16 nt, Human
ugcaccugccagccug

SEQ ID NO: 2142892 - RNA, 17 nt, Human
ugcaccugccagccugg

SEQ ID NO: 2142893 - RNA, 18 nt, Human
ugcaccugccagccuggc

SEQ ID NO: 2142894 - RNA, 19 nt, Human
ugcaccugccagccuggcu

SEQ ID NO: 2142895 - RNA, 20 nt, Human
ugcaccugccagccuggcuu

SEQ ID NO: 2142896 - RNA, 12 nt, Human
ugcacaucccug

SEQ ID NO: 2142897 - RNA, 15 nt, Human
ugcacauacuugaga

SEQ ID NO: 2142898 - RNA, 20 nt, Human
ugcacagugcaucucagccc

SEQ ID NO: 2142899 - RNA, 19 nt, Human
ugcacagugcaucucagcc

SEQ ID NO: 2142900 - RNA, 18 nt, Human
ugcacagugcaucucagc

SEQ ID NO: 2142901 - RNA, 19 nt, Human
ugcacagcuguaguacccc

SEQ ID NO: 2142902 - RNA, 20 nt, Human
uuaauagcgucauaacuaga

SEQ ID NO: 2142903 - RNA, 15 nt, Human
uuaaggcaacugaac

SEQ ID NO: 2142904 - RNA, 20 nt, Human
uuaaggcaacugaacaaaaa

SEQ ID NO: 2142905 - RNA, 22 nt, Human
uuaaggcaacugaacaaaaaaa

SEQ ID NO: 2142906 - RNA, 23 nt, Human
uuaaggcugaggaaaggccagcu

SEQ ID NO: 2142907 - RNA, 19 nt, Human
uuaaggagauguaagagcu

SEQ ID NO: 2142908 - RNA, 20 nt, Human
uuaaggauugugauauuuuu

SEQ ID NO: 2142909 - RNA, 13 nt, Human
uuaaggaagaaaa

SEQ ID NO: 2142910 - RNA, 17 nt, Human
uuaaggaagaaaaauca

SEQ ID NO: 2142911 - RNA, 18 nt, Human
uuaaggaagaaaaaucag

SEQ ID NO: 2142912 - RNA, 21 nt, Human
uuaaggaagacaaugugaaaa

SEQ ID NO: 2142913 - RNA, 14 nt, Human
uuaacauucuguaa

SEQ ID NO: 2142914 - RNA, 14 nt, Human
uuaacauugaccaa

SEQ ID NO: 2142915 - RNA, 19 nt, Human
uuaacauugaccaagaacu

SEQ ID NO: 2142916 - RNA, 20 nt, Human
uuaacauugaccaagaacug

SEQ ID NO: 2142917 - RNA, 21 nt, Human
uuaacauugaccaagaacugc

SEQ ID NO: 2142918 - RNA, 12 nt, Human
uuaagcuuauuu

SEQ ID NO: 2142919 - RNA, 13 nt, Human
uuaaugcuaaggg

SEQ ID NO: 2142920 - RNA, 21 nt, Human
uuaaugcuaagggcaggccca

SEQ ID NO: 2142921 - RNA, 13 nt, Human
uuaauauguauuu

SEQ ID NO: 2142922 - RNA, 17 nt, Human
uuaauauguauuuuaug

SEQ ID NO: 2142923 - RNA, 19 nt, Human
uuaauauguauuuuaugua

SEQ ID NO: 2142924 - RNA, 22 nt, Human
uuaauauguauuuuauguaugu

SEQ ID NO: 2142925 - RNA, 23 nt, Human
uuaauauguauuuuauguauguu

SEQ ID NO: 2142926 - RNA, 23 nt, Human
uuaauauguuaaccucaguguca

SEQ ID NO: 2142927 - RNA, 16 nt, Human
uuaauauggggaugca

SEQ ID NO: 2142928 - RNA, 22 nt, Human
uuaauauggggaugcagcauua

SEQ ID NO: 2142929 - RNA, 18 nt, Human
uuaaggcccaacauuaaa

SEQ ID NO: 2142930 - RNA, 18 nt, Human
uuaaugucacaggcaggu

SEQ ID NO: 2142931 - RNA, 17 nt, Human
uuaaugucacaggcagg

SEQ ID NO: 2142932 - RNA, 20 nt, Human
uuacaauaggugcuuauucu

SEQ ID NO: 2142933 - RNA, 18 nt, Human
uuacagauaggccuucuu

SEQ ID NO: 2142934 - RNA, 22 nt, Human
uuacaugguuaagguaaaguaa

SEQ ID NO: 2142935 - RNA, 12 nt, Human
uuacauguuuuc

SEQ ID NO: 2142936 - RNA, 18 nt, Human
uuacauguuuucuuugcu

SEQ ID NO: 2142937 - RNA, 22 nt, Human
uuacauguuuucuuugcuuuaa

SEQ ID NO: 2142938 - RNA, 12 nt, Human
uuacaaucaaag

SEQ ID NO: 2142939 - RNA, 23 nt, Human
uuacaauaaaaucuugaaaaugc

SEQ ID NO: 2142940 - RNA, 13 nt, Human
uuaauuauuguuu

SEQ ID NO: 2142941 - RNA, 13 nt, Human
uuaauucauguuu

SEQ ID NO: 2142942 - RNA, 21 nt, Human
uuacaauaaaacuuugcugcc

SEQ ID NO: 2142943 - RNA, 20 nt, Human
uuacagagaggagaaacaca

SEQ ID NO: 2142944 - RNA, 22 nt, Human
uuacagagaggagaaacacauc

SEQ ID NO: 2142945 - RNA, 14 nt, Human
uuacagagaggaga

SEQ ID NO: 2142946 - RNA, 17 nt, Human
uuacagagaggagaaac

SEQ ID NO: 2142947 - RNA, 18 nt, Human
uuacagagaggagaaaca

SEQ ID NO: 2142948 - RNA, 20 nt, Human
uuacgguuuuccagguuuaa

SEQ ID NO: 2142949 - RNA, 14 nt, Human
uuacggcuccucuc

SEQ ID NO: 2142950 - RNA, 20 nt, Human
uuacguaguguagauuuguu

SEQ ID NO: 2142951 - RNA, 21 nt, Human
uuacguaguguagauuuguuu

SEQ ID NO: 2142952 - RNA, 20 nt, Human
uuacgcacacguacuuaaau

SEQ ID NO: 2142953 - RNA, 13 nt, Human
uuaccacugaaga

SEQ ID NO: 2142954 - RNA, 21 nt, Human
uuaccacugaagauagaagaa

SEQ ID NO: 2142955 - RNA, 22 nt, Human
uuaccacugaagauagaagaaa

SEQ ID NO: 2142956 - RNA, 21 nt, Human
uuaccagacgguucaccagcc

SEQ ID NO: 2142957 - RNA, 22 nt, Human
uuaccagacgguucaccagccu

SEQ ID NO: 2142958 - RNA, 17 nt, Human
uguuuuuuccugagcuu

SEQ ID NO: 2142959 - RNA, 14 nt, Human
uguuuuuuaucuuu

SEQ ID NO: 2142960 - RNA, 23 nt, Human
uguuuuuuaucuuuucuacagca

SEQ ID NO: 2142961 - RNA, 14 nt, Human
uguuuuuugaaaac

SEQ ID NO: 2142962 - RNA, 16 nt, Human
uguuuuuugaaaacau

SEQ ID NO: 2142963 - RNA, 19 nt, Human
uguuuuuugaaaacauggu

SEQ ID NO: 2142964 - RNA, 12 nt, Human
uuaaaacaaugu

SEQ ID NO: 2142965 - RNA, 11 nt, Human
uuaaaacaaga

SEQ ID NO: 2142966 - RNA, 19 nt, Human
uuaaaacaagaaaguuucc

SEQ ID NO: 2142967 - RNA, 20 nt, Human
uuaaaacaagaaaguuuccc

SEQ ID NO: 2142968 - RNA, 20 nt, Human
uuaaaacaauauuguuucua

SEQ ID NO: 2142969 - RNA, 20 nt, Human
uguuuuuccuuguauuuaaa

SEQ ID NO: 2142970 - RNA, 13 nt, Human
uguuuuuguugug

SEQ ID NO: 2142971 - RNA, 20 nt, Human
uguuuuuuaaacuaggaaaa

SEQ ID NO: 2142972 - RNA, 15 nt, Human
uguuuuuuaaagucu

SEQ ID NO: 2142973 - RNA, 13 nt, Human
uguuuuugucuua

SEQ ID NO: 2142974 - RNA, 14 nt, Human
uguuuugcuaaagg

SEQ ID NO: 2142975 - RNA, 13 nt, Human
uguuuuucacauu

SEQ ID NO: 2142976 - RNA, 20 nt, Human
uguuuuuaugaagaaaaaau

SEQ ID NO: 2142977 - RNA, 17 nt, Human
uguuucucccccugggc

SEQ ID NO: 2142978 - RNA, 23 nt, Human
uguuucucccccugggcucugcc

SEQ ID NO: 2142979 - RNA, 15 nt, Human
uguuucucccccugg

SEQ ID NO: 2142980 - RNA, 16 nt, Human
uguuucucccccuggg

SEQ ID NO: 2142981 - RNA, 24 nt, Human
uguuucuauucucuccucagacug

SEQ ID NO: 2142982 - RNA, 16 nt, Human
uguuucuaguugagga

SEQ ID NO: 2142983 - RNA, 22 nt, Human
uguuucuaguugaggaguuucc

SEQ ID NO: 2142984 - RNA, 23 nt, Human
uguuucuaguugaggaguuuccu

SEQ ID NO: 2142985 - RNA, 17 nt, Human
uguuuguugucagcuga

SEQ ID NO: 2142986 - RNA, 16 nt, Human
uguuuguugucagcug

SEQ ID NO: 2142987 - RNA, 13 nt, Human
uguuucucugcug

SEQ ID NO: 2142988 - RNA, 14 nt, Human
uguuucucugcugu

SEQ ID NO: 2142989 - RNA, 15 nt, Human
uguuucucugcuguu

SEQ ID NO: 2142990 - RNA, 12 nt, Human
uguuuguuuugu

SEQ ID NO: 2142991 - RNA, 22 nt, Human
uguuuguuucucccccugggcu

SEQ ID NO: 2142992 - RNA, 13 nt, Human
uuaaauauagaau

SEQ ID NO: 2142993 - RNA, 23 nt, Human
uuaaaugggcuacuuuguccuuu

SEQ ID NO: 2142994 - RNA, 21 nt, Human
uuaaauggguagagaaacacu

SEQ ID NO: 2142995 - RNA, 16 nt, Human
uuaaauguaaauaauc

SEQ ID NO: 2142996 - RNA, 18 nt, Human
uuaaauguaaagacaaaa

SEQ ID NO: 2142997 - RNA, 13 nt, Human
uuaacauauaaua

SEQ ID NO: 2142998 - RNA, 18 nt, Human
uuaacauauaauauaugu

SEQ ID NO: 2142999 - RNA, 16 nt, Human
uuaacauggaacucua

SEQ ID NO: 2143000 - RNA, 15 nt, Human
uuaacauucauagag

SEQ ID NO: 2143001 - RNA, 18 nt, Human
uuaaauaguaaaaauaaa

SEQ ID NO: 2143002 - RNA, 15 nt, Human
uuaaauauaauaugc

SEQ ID NO: 2143003 - RNA, 16 nt, Human
uuaaauauauguaugu

SEQ ID NO: 2143004 - RNA, 17 nt, Human
uuaaauauauguaugua

SEQ ID NO: 2143005 - RNA, 18 nt, Human
uuaaauauauguauguaa

SEQ ID NO: 2143006 - RNA, 19 nt, Human
uuaaauauauguauguaaa

SEQ ID NO: 2143007 - RNA, 20 nt, Human
uuaaauauauguauguaaaa

SEQ ID NO: 2143008 - RNA, 22 nt, Human
uuaaauauauguauguaaaaau

SEQ ID NO: 2143009 - RNA, 13 nt, Human
uuaaauauauuuu

SEQ ID NO: 2143010 - RNA, 22 nt, Human
uuaaauauauuuucaaaguaca

SEQ ID NO: 2143011 - RNA, 23 nt, Human
uuaaauauauuuucaaaguacau

SEQ ID NO: 2143012 - RNA, 12 nt, Human
uuaaauaucaau

SEQ ID NO: 2143013 - RNA, 14 nt, Human
uuaaagcaaaggag

SEQ ID NO: 2143014 - RNA, 19 nt, Human
uuaaagcuaaaguaucugu

SEQ ID NO: 2143015 - RNA, 14 nt, Human
uuaaagcugccugu

SEQ ID NO: 2143016 - RNA, 15 nt, Human
uuaaagcugccugua

SEQ ID NO: 2143017 - RNA, 17 nt, Human
uuaaagcugccuguagu

SEQ ID NO: 2143018 - RNA, 18 nt, Human
uuaaagcugccuguaguu

SEQ ID NO: 2143019 - RNA, 14 nt, Human
uuaaaagacacugu

SEQ ID NO: 2143020 - RNA, 14 nt, Human
uguuggccaggcug

SEQ ID NO: 2143021 - RNA, 16 nt, Human
uguuuaaaaaaguuua

SEQ ID NO: 2143022 - RNA, 17 nt, Human
uguuuaaaaaaguuuaa

SEQ ID NO: 2143023 - RNA, 18 nt, Human
uguuuaaaaaaguuuaaa

SEQ ID NO: 2143024 - RNA, 19 nt, Human
uguuuaaaaaaguuuaaaa

SEQ ID NO: 2143025 - RNA, 21 nt, Human
uguuuaaaaaaguuuaaaaug

SEQ ID NO: 2143026 - RNA, 22 nt, Human
uguuuaaaaaaguuuaaaaugu

SEQ ID NO: 2143027 - RNA, 13 nt, Human
uguuguuuguaaa

SEQ ID NO: 2143028 - RNA, 14 nt, Human
uguuguuuguaaau

SEQ ID NO: 2143029 - RNA, 15 nt, Human
uguuguuuguaaaua

SEQ ID NO: 2143030 - RNA, 21 nt, Human
uguuguuuguaaauaagagau

SEQ ID NO: 2143031 - RNA, 17 nt, Human
uguuguuugaaaauauu

SEQ ID NO: 2143032 - RNA, 12 nt, Human
uguuguuuguuu

SEQ ID NO: 2143033 - RNA, 15 nt, Human
uguuuacaagaaaaa

SEQ ID NO: 2143034 - RNA, 14 nt, Human
uguuuacacuguca

SEQ ID NO: 2143035 - RNA, 15 nt, Human
uguuuacacugucaa

SEQ ID NO: 2143036 - RNA, 16 nt, Human
uguuuacacugucaaa

SEQ ID NO: 2143037 - RNA, 20 nt, Human
uguuggauuuuugucuugug

SEQ ID NO: 2143038 - RNA, 11 nt, Human
uguuggccagg

SEQ ID NO: 2143039 - RNA, 17 nt, Human
uguuggauuuuugucuu

SEQ ID NO: 2143040 - RNA, 19 nt, Human
uguuggauaaaucaguggu

SEQ ID NO: 2143041 - RNA, 20 nt, Human
uguuggauaaaucagugguu

SEQ ID NO: 2143042 - RNA, 14 nt, Human
uguugcuuggacua

SEQ ID NO: 2143043 - RNA, 21 nt, Human
uguuggaaaagaauacagaaa

SEQ ID NO: 2143044 - RNA, 13 nt, Human
uguuggaaaagaa

SEQ ID NO: 2143045 - RNA, 19 nt, Human
uguugagguggucugaaug

SEQ ID NO: 2143046 - RNA, 13 nt, Human
uguugagcuguuu

SEQ ID NO: 2143047 - RNA, 23 nt, Human
uguugagguggucugaauguucu

SEQ ID NO: 2143048 - RNA, 20 nt, Human
uguugagguggucugaaugu

SEQ ID NO: 2143049 - RNA, 21 nt, Human
uguugagguggucugaauguu

SEQ ID NO: 2143050 - RNA, 19 nt, Human
uguugauaaauuccacugg

SEQ ID NO: 2143051 - RNA, 22 nt, Human
uguugauaaauuccacuggacu

SEQ ID NO: 2143052 - RNA, 17 nt, Human
uguugagccaggccugg

SEQ ID NO: 2143053 - RNA, 15 nt, Human
uguucugacccugcu

SEQ ID NO: 2143054 - RNA, 13 nt, Human
uguucugacauua

SEQ ID NO: 2143055 - RNA, 15 nt, Human
uguucugacauuaac

SEQ ID NO: 2143056 - RNA, 16 nt, Human
uguucugacauuaaca

SEQ ID NO: 2143057 - RNA, 17 nt, Human
uguucugacauuaacag

SEQ ID NO: 2143058 - RNA, 18 nt, Human
uguucugacccugcuuca

SEQ ID NO: 2143059 - RNA, 19 nt, Human
uguucugacauuaacaguu

SEQ ID NO: 2143060 - RNA, 20 nt, Human
uguucugacauuaacaguuu

SEQ ID NO: 2143061 - RNA, 22 nt, Human
uguucugacauuaacaguuuuc

SEQ ID NO: 2143062 - RNA, 14 nt, Human
uguucugauuagaa

SEQ ID NO: 2143063 - RNA, 16 nt, Human
uguucugauuagaaau

SEQ ID NO: 2143064 - RNA, 19 nt, Human
uguucugauuagaaaugac

SEQ ID NO: 2143065 - RNA, 22 nt, Human
uguucugauuagaaaugaccaa

SEQ ID NO: 2143066 - RNA, 20 nt, Human
uguugaaaagccauguuuaa

SEQ ID NO: 2143067 - RNA, 22 nt, Human
uguugaaaagccauguuuaaga

SEQ ID NO: 2143068 - RNA, 23 nt, Human
uguugaaaagccauguuuaagau

SEQ ID NO: 2143069 - RNA, 11 nt, Human
uguugaaagau

SEQ ID NO: 2143070 - RNA, 18 nt, Human
uguucucugaggacacua

SEQ ID NO: 2143071 - RNA, 16 nt, Human
uguucucugaggacac

SEQ ID NO: 2143072 - RNA, 13 nt, Human
uguucucugagga

SEQ ID NO: 2143073 - RNA, 22 nt, Human
uguucuccuagacugacccuga

SEQ ID NO: 2143074 - RNA, 22 nt, Human
uguucaguaacagggccuugcu

SEQ ID NO: 2143075 - RNA, 14 nt, Human
uguucagucuuuca

SEQ ID NO: 2143076 - RNA, 22 nt, Human
uguucauuaaagcaugaauggu

SEQ ID NO: 2143077 - RNA, 12 nt, Human
uguucauuguaa

SEQ ID NO: 2143078 - RNA, 22 nt, Human
uguucauuguaauguuacugau

SEQ ID NO: 2143079 - RNA, 23 nt, Human
uguucauuguaauguuacugauc

SEQ ID NO: 2143080 - RNA, 13 nt, Human
uguucauuguaau

SEQ ID NO: 2143081 - RNA, 14 nt, Human
uguucauuguaaug

SEQ ID NO: 2143082 - RNA, 16 nt, Human
uguucauuguaauguu

SEQ ID NO: 2143083 - RNA, 18 nt, Human
uguucauuguaauguuac

SEQ ID NO: 2143084 - RNA, 19 nt, Human
uguucauuguaauguuacu

SEQ ID NO: 2143085 - RNA, 20 nt, Human
uguucauuguaauguuacug

SEQ ID NO: 2143086 - RNA, 21 nt, Human
uguucauuguaauguuacuga

SEQ ID NO: 2143087 - RNA, 13 nt, Human
uguuacauagugu

SEQ ID NO: 2143088 - RNA, 14 nt, Human
uguuacauagugua

SEQ ID NO: 2143089 - RNA, 15 nt, Human
uguuacauaguguag

SEQ ID NO: 2143090 - RNA, 15 nt, Human
uguuacugucuucag

SEQ ID NO: 2143091 - RNA, 16 nt, Human
uguuacugucuucagu

SEQ ID NO: 2143092 - RNA, 18 nt, Human
uguguuugguucuggggc

SEQ ID NO: 2143093 - RNA, 17 nt, Human
uguguuuucauaauaaa

SEQ ID NO: 2143094 - RNA, 11 nt, Human
uguguuugugu

SEQ ID NO: 2143095 - RNA, 13 nt, Human
uguguuuguguga

SEQ ID NO: 2143096 - RNA, 13 nt, Human
uguuagaacacua

SEQ ID NO: 2143097 - RNA, 14 nt, Human
uguuagaacacuau

SEQ ID NO: 2143098 - RNA, 15 nt, Human
uguuagaacacuauu

SEQ ID NO: 2143099 - RNA, 17 nt, Human
uguuagaacacuauuuu

SEQ ID NO: 2143100 - RNA, 18 nt, Human
uguuagaacacuauuuuc

SEQ ID NO: 2143101 - RNA, 19 nt, Human
uguuagaacacuauuuuca

SEQ ID NO: 2143102 - RNA, 20 nt, Human
uguuagaacacuauuuucag

SEQ ID NO: 2143103 - RNA, 21 nt, Human
uguuagaacacuauuuucaga

SEQ ID NO: 2143104 - RNA, 22 nt, Human
uguuagaacacuauuuucagaa

SEQ ID NO: 2143105 - RNA, 23 nt, Human
uguuagaacacuauuuucagaau

SEQ ID NO: 2143106 - RNA, 18 nt, Human
uguuagaguccaacgugg

SEQ ID NO: 2143107 - RNA, 23 nt, Human
uguuagaguccaacguggggcag

SEQ ID NO: 2143108 - RNA, 14 nt, Human
uguucagcuccagc

SEQ ID NO: 2143109 - RNA, 16 nt, Human
uguucaauguuuaaug

SEQ ID NO: 2143110 - RNA, 23 nt, Human
uguucaagaccagccugaccaac

SEQ ID NO: 2143111 - RNA, 18 nt, Human
uguucagcuccagcucac

SEQ ID NO: 2143112 - RNA, 11 nt, Human
uguucagcugg

SEQ ID NO: 2143113 - RNA, 16 nt, Human
uguucagcuccagcuc

SEQ ID NO: 2143114 - RNA, 15 nt, Human
uguucagcuccagcu

SEQ ID NO: 2143115 - RNA, 23 nt, Human
uguguagacgaagggggcaucug

SEQ ID NO: 2143116 - RNA, 19 nt, Human
uguguauuuccagugcaau

SEQ ID NO: 2143117 - RNA, 15 nt, Human
ugugucaagcugcuu

SEQ ID NO: 2143118 - RNA, 12 nt, Human
uguguauuguuc

SEQ ID NO: 2143119 - RNA, 13 nt, Human
uguguauuguucc

SEQ ID NO: 2143120 - RNA, 14 nt, Human
uguguauuguuccc

SEQ ID NO: 2143121 - RNA, 15 nt, Human
uguguauuguuccca

SEQ ID NO: 2143122 - RNA, 17 nt, Human
uguguauuuaauuguaa

SEQ ID NO: 2143123 - RNA, 18 nt, Human
uguguauuuaauuguaaa

SEQ ID NO: 2143124 - RNA, 19 nt, Human
uguguauuuaauuguaaac

SEQ ID NO: 2143125 - RNA, 20 nt, Human
uguguauuuaauuguaaacu

SEQ ID NO: 2143126 - RNA, 21 nt, Human
uguguauuuaauuguaaacug

SEQ ID NO: 2143127 - RNA, 22 nt, Human
uguguauuuaauuguaaacugu

SEQ ID NO: 2143128 - RNA, 23 nt, Human
uguguauuuaauuguaaacugua

SEQ ID NO: 2143129 - RNA, 17 nt, Human
ugugugagcaagcauuu

SEQ ID NO: 2143130 - RNA, 17 nt, Human
ugugugaggagcugcug

SEQ ID NO: 2143131 - RNA, 12 nt, Human
uguguuguuuga

SEQ ID NO: 2143132 - RNA, 14 nt, Human
uguguuguuugaaa

SEQ ID NO: 2143133 - RNA, 19 nt, Human
ugugugcguccugucggag

SEQ ID NO: 2143134 - RNA, 20 nt, Human
ugugugcaugugugugcuca

SEQ ID NO: 2143135 - RNA, 19 nt, Human
ugugugcagacucaauaaa

SEQ ID NO: 2143136 - RNA, 21 nt, Human
ugugugcagucucucuuaccc

SEQ ID NO: 2143137 - RNA, 20 nt, Human
ugugugaggagcugcuggcu

SEQ ID NO: 2143138 - RNA, 19 nt, Human
uguguguauguuugcacac

SEQ ID NO: 2143139 - RNA, 18 nt, Human
ugugugcgagugugugca

SEQ ID NO: 2143140 - RNA, 22 nt, Human
ugugugguuuaguguaaaaaug

SEQ ID NO: 2143141 - RNA, 23 nt, Human
ugugugguuuaguguaaaaauga

SEQ ID NO: 2143142 - RNA, 13 nt, Human
uguguguaugcua

SEQ ID NO: 2143143 - RNA, 15 nt, Human
uguauuuaaaugaaa

SEQ ID NO: 2143144 - RNA, 17 nt, Human
uguauugcgucuuagca

SEQ ID NO: 2143145 - RNA, 19 nt, Human
uguauugcauauauacaua

SEQ ID NO: 2143146 - RNA, 16 nt, Human
uguauuuaugugugag

SEQ ID NO: 2143147 - RNA, 13 nt, Human
uguauuuaauugu

SEQ ID NO: 2143148 - RNA, 17 nt, Human
uguauuuaauuguaaac

SEQ ID NO: 2143149 - RNA, 18 nt, Human
uguauuuaauuguaaacu

SEQ ID NO: 2143150 - RNA, 19 nt, Human
uguauuuaauuguaaacug

SEQ ID NO: 2143151 - RNA, 22 nt, Human
uguauuuaauuguaaacuguac

SEQ ID NO: 2143152 - RNA, 23 nt, Human
uguauuuaauuguaaacuguacu

SEQ ID NO: 2143153 - RNA, 15 nt, Human
uguaucggagacagu

SEQ ID NO: 2143154 - RNA, 17 nt, Human
uguaucggagacaguga

SEQ ID NO: 2143155 - RNA, 15 nt, Human
uguaucggaugcuuu

SEQ ID NO: 2143156 - RNA, 18 nt, Human
uguaucggagacagugau

SEQ ID NO: 2143157 - RNA, 21 nt, Human
uguauccuuccaauuuggaau

SEQ ID NO: 2143158 - RNA, 17 nt, Human
uguaucuagugcagcug

SEQ ID NO: 2143159 - RNA, 19 nt, Human
uguaucuagugcagcugau

SEQ ID NO: 2143160 - RNA, 21 nt, Human
uguaucuagugcagcugauuu

SEQ ID NO: 2143161 - RNA, 22 nt, Human
uguauugaacuuggaaagaaau

SEQ ID NO: 2143162 - RNA, 14 nt, Human
uguaugcacuuugu

SEQ ID NO: 2143163 - RNA, 18 nt, Human
uguaugcacgugugcaca

SEQ ID NO: 2143164 - RNA, 23 nt, Human
uguauaccccgugaagcauccag

SEQ ID NO: 2143165 - RNA, 13 nt, Human
uguauaccuguaa

SEQ ID NO: 2143166 - RNA, 15 nt, Human
uguauaccuguaacu

SEQ ID NO: 2143167 - RNA, 23 nt, Human
uguaucccaugagccucagcauc

SEQ ID NO: 2143168 - RNA, 19 nt, Human
uguaucccaugagccucag

SEQ ID NO: 2143169 - RNA, 15 nt, Human
uguauaauauuuuua

SEQ ID NO: 2143170 - RNA, 19 nt, Human
uguauaaguccuugcaaga

SEQ ID NO: 2143171 - RNA, 16 nt, Human
uguauaaguccuugca

SEQ ID NO: 2143172 - RNA, 16 nt, Human
uguauaaguugaggca

SEQ ID NO: 2143173 - RNA, 19 nt, Human
uguauaaguugaggcauuu

SEQ ID NO: 2143174 - RNA, 22 nt, Human
uguagcaaaauucuuaaguaug

SEQ ID NO: 2143175 - RNA, 20 nt, Human
uguagcaaaacgcauggagu

SEQ ID NO: 2143176 - RNA, 17 nt, Human
uguagcaaucagauuuu

SEQ ID NO: 2143177 - RNA, 13 nt, Human
ugucagucugcuu

SEQ ID NO: 2143178 - RNA, 14 nt, Human
ugucagugcagccc

SEQ ID NO: 2143179 - RNA, 16 nt, Human
ugucagugcagcccgu

SEQ ID NO: 2143180 - RNA, 23 nt, Human
ugucauaccaggccgccccagcc

SEQ ID NO: 2143181 - RNA, 16 nt, Human
ugucauaagaaugaau

SEQ ID NO: 2143182 - RNA, 17 nt, Human
ugucauaagaaugaaua

SEQ ID NO: 2143183 - RNA, 17 nt, Human
uguauuuaugugugagg

SEQ ID NO: 2143184 - RNA, 14 nt, Human
ugucauaagaauga

SEQ ID NO: 2143185 - RNA, 15 nt, Human
ugucauaagaaugaa

SEQ ID NO: 2143186 - RNA, 18 nt, Human
uguauuuguuaaugguuu

SEQ ID NO: 2143187 - RNA, 20 nt, Human
uguauuuguuaaugguuuga

SEQ ID NO: 2143188 - RNA, 17 nt, Human
ugucacugacacacacg

SEQ ID NO: 2143189 - RNA, 15 nt, Human
ugucacuaaagcagg

SEQ ID NO: 2143190 - RNA, 16 nt, Human
ugucacuacucacagu

SEQ ID NO: 2143191 - RNA, 14 nt, Human
ugucacuaaagcag

SEQ ID NO: 2143192 - RNA, 22 nt, Human
ugucacuacucacagucucuuu

SEQ ID NO: 2143193 - RNA, 23 nt, Human
ugucccaaaaagaaaggagggga

SEQ ID NO: 2143194 - RNA, 12 nt, Human
uguccauuuaua

SEQ ID NO: 2143195 - RNA, 17 nt, Human
ugucccacucaagccaa

SEQ ID NO: 2143196 - RNA, 20 nt, Human
ugucccacucaagccaagca

SEQ ID NO: 2143197 - RNA, 12 nt, Human
uguccaugugug

SEQ ID NO: 2143198 - RNA, 13 nt, Human
uguccaugugugu

SEQ ID NO: 2143199 - RNA, 15 nt, Human
uguccaugugugugc

SEQ ID NO: 2143200 - RNA, 16 nt, Human
uguccaugugugugca

SEQ ID NO: 2143201 - RNA, 19 nt, Human
ugucauuaccagacgguuc

SEQ ID NO: 2143202 - RNA, 13 nt, Human
ugucauugcuuua

SEQ ID NO: 2143203 - RNA, 14 nt, Human
ugucauugcuuuac

SEQ ID NO: 2143204 - RNA, 19 nt, Human
ugucauuaaaauaaauaaa

SEQ ID NO: 2143205 - RNA, 15 nt, Human
ugucauuaaacauga

SEQ ID NO: 2143206 - RNA, 20 nt, Human
ugucauauauggggggccaa

SEQ ID NO: 2143207 - RNA, 22 nt, Human
ugucauauauggggggccaaca

SEQ ID NO: 2143208 - RNA, 17 nt, Human
uguacagucuuguauua

SEQ ID NO: 2143209 - RNA, 14 nt, Human
uguacagucuugua

SEQ ID NO: 2143210 - RNA, 15 nt, Human
uguacagucuuguau

SEQ ID NO: 2143211 - RNA, 12 nt, Human
uguacagucuug

SEQ ID NO: 2143212 - RNA, 18 nt, Human
uguacaguauguucaaag

SEQ ID NO: 2143213 - RNA, 20 nt, Human
uguaaugguaucuuaaagug

SEQ ID NO: 2143214 - RNA, 13 nt, Human
uguaaugucacca

SEQ ID NO: 2143215 - RNA, 16 nt, Human
uguaaugucaccaccu

SEQ ID NO: 2143216 - RNA, 19 nt, Human
uguaaugucaccaccuucc

SEQ ID NO: 2143217 - RNA, 20 nt, Human
uguaaugucaccaccuuccc

SEQ ID NO: 2143218 - RNA, 14 nt, Human
uguaccucuuuuag

SEQ ID NO: 2143219 - RNA, 21 nt, Human
uguaccucuuuuagucauuuu

SEQ ID NO: 2143220 - RNA, 21 nt, Human
uguacccaguauucuagguag

SEQ ID NO: 2143221 - RNA, 12 nt, Human
uguacucuggcc

SEQ ID NO: 2143222 - RNA, 13 nt, Human
uguacucuggccu

SEQ ID NO: 2143223 - RNA, 14 nt, Human
uguacucuggccuc

SEQ ID NO: 2143224 - RNA, 15 nt, Human
uguacucuggccucu

SEQ ID NO: 2143225 - RNA, 16 nt, Human
uguacgucugacaggc

SEQ ID NO: 2143226 - RNA, 17 nt, Human
uguacgucugacaggca

SEQ ID NO: 2143227 - RNA, 14 nt, Human
uguacguggagagg

SEQ ID NO: 2143228 - RNA, 12 nt, Human
uguacguggaga

SEQ ID NO: 2143229 - RNA, 15 nt, Human
uguacguggagaggg

SEQ ID NO: 2143230 - RNA, 17 nt, Human
uguacguuuaaagugua

SEQ ID NO: 2143231 - RNA, 13 nt, Human
uguacuccuccca

SEQ ID NO: 2143232 - RNA, 12 nt, Human
uguacuccuccc

SEQ ID NO: 2143233 - RNA, 18 nt, Human
uguacucaggaggcugag

SEQ ID NO: 2143234 - RNA, 15 nt, Human
uguacuagucugugu

SEQ ID NO: 2143235 - RNA, 19 nt, Human
uguacuagucuguguggga

SEQ ID NO: 2143236 - RNA, 12 nt, Human
uguacuacaauu

SEQ ID NO: 2143237 - RNA, 21 nt, Human
uguacuaauuaacauauaaua

SEQ ID NO: 2143238 - RNA, 17 nt, Human
ugguaggacuguagaaa

SEQ ID NO: 2143239 - RNA, 18 nt, Human
ugguaggacuguagaaaa

SEQ ID NO: 2143240 - RNA, 19 nt, Human
ugguagggggaaaaugugu

SEQ ID NO: 2143241 - RNA, 20 nt, Human
ugguaguuaguagcauguug

SEQ ID NO: 2143242 - RNA, 21 nt, Human
ugguagucuaaccaaaugcau

SEQ ID NO: 2143243 - RNA, 22 nt, Human
ugguagucuaaccaaaugcauc

SEQ ID NO: 2143244 - RNA, 17 nt, Human
ugguaguuaguagcaug

SEQ ID NO: 2143245 - RNA, 18 nt, Human
ugguaguuaguagcaugu

SEQ ID NO: 2143246 - RNA, 17 nt, Human
ugguagggacuuaaaaa

SEQ ID NO: 2143247 - RNA, 22 nt, Human
ugguaguacuccugcaaaauuu

SEQ ID NO: 2143248 - RNA, 12 nt, Human
uguaaacagugc

SEQ ID NO: 2143249 - RNA, 14 nt, Human
uguaaacagugccu

SEQ ID NO: 2143250 - RNA, 16 nt, Human
uguaaacagugccugc

SEQ ID NO: 2143251 - RNA, 17 nt, Human
uguaaacagugccugcu

SEQ ID NO: 2143252 - RNA, 19 nt, Human
uguaaacagugccugcuga

SEQ ID NO: 2143253 - RNA, 21 nt, Human
uguaaacaaacuguguaacug

SEQ ID NO: 2143254 - RNA, 20 nt, Human
uguaaaauuuugccuaauac

SEQ ID NO: 2143255 - RNA, 21 nt, Human
uguaaaugaaguaacuugucu

SEQ ID NO: 2143256 - RNA, 22 nt, Human
uguaaaugcugucaacuaugau

SEQ ID NO: 2143257 - RNA, 18 nt, Human
uguaacugcccaaagcag

SEQ ID NO: 2143258 - RNA, 21 nt, Human
uguaacuggcaguuuuccauu

SEQ ID NO: 2143259 - RNA, 11 nt, Human
uguaacugccc

SEQ ID NO: 2143260 - RNA, 13 nt, Human
uguaacugcccaa

SEQ ID NO: 2143261 - RNA, 12 nt, Human
uguaacuccacc

SEQ ID NO: 2143262 - RNA, 13 nt, Human
uguaacuccacca

SEQ ID NO: 2143263 - RNA, 23 nt, Human
uguaacugcauugagaacugcau

SEQ ID NO: 2143264 - RNA, 15 nt, Human
uguaaucccagcacu

SEQ ID NO: 2143265 - RNA, 21 nt, Human
uguaaucauuucuugggcccu

SEQ ID NO: 2143266 - RNA, 16 nt, Human
uguaaucccagcuacu

SEQ ID NO: 2143267 - RNA, 22 nt, Human
uguaaucccagcacuuugggag

SEQ ID NO: 2143268 - RNA, 16 nt, Human
uguaaucccagcacuu

SEQ ID NO: 2143269 - RNA, 18 nt, Human
uguaaauuauuuuaaauu

SEQ ID NO: 2143270 - RNA, 14 nt, Human
uguaacgccugcuu

SEQ ID NO: 2143271 - RNA, 13 nt, Human
uguaaccugagau

SEQ ID NO: 2143272 - RNA, 19 nt, Human
uguaaccugagauggcccu

SEQ ID NO: 2143273 - RNA, 22 nt, Human
uguaaccugagauggcccucug

SEQ ID NO: 2143274 - RNA, 12 nt, Human
uguaaauuauuu

SEQ ID NO: 2143275 - RNA, 20 nt, Human
uguaaauuaccaguaaagug

SEQ ID NO: 2143276 - RNA, 21 nt, Human
uguaaauuaccaguaaagugu

SEQ ID NO: 2143277 - RNA, 10 nt, Human
uguaaauuau

SEQ ID NO: 2143278 - RNA, 18 nt, Human
ugucugccagccagcagc

SEQ ID NO: 2143279 - RNA, 19 nt, Human
ugucugccagccagcagcc

SEQ ID NO: 2143280 - RNA, 19 nt, Human
ugucuggcugaggauuuca

SEQ ID NO: 2143281 - RNA, 21 nt, Human
ugucugcgugguuccuuucuc

SEQ ID NO: 2143282 - RNA, 15 nt, Human
ugucugccagccagc

SEQ ID NO: 2143283 - RNA, 16 nt, Human
ugucugccagccagca

SEQ ID NO: 2143284 - RNA, 17 nt, Human
ugucucaguccaccuga

SEQ ID NO: 2143285 - RNA, 17 nt, Human
ugucucaggucccugca

SEQ ID NO: 2143286 - RNA, 16 nt, Human
ugucucaggucccugc

SEQ ID NO: 2143287 - RNA, 21 nt, Human
ugucucaagagggcacuggug

SEQ ID NO: 2143288 - RNA, 20 nt, Human
ugucucaagagggcacuggu

SEQ ID NO: 2143289 - RNA, 23 nt, Human
ugucucaagagggcacugguggc

SEQ ID NO: 2143290 - RNA, 20 nt, Human
ugucccauuucuaaaggccu

SEQ ID NO: 2143291 - RNA, 21 nt, Human
ugucccauuuucagacugcuu

SEQ ID NO: 2143292 - RNA, 19 nt, Human
ugucucaagagggcacugg

SEQ ID NO: 2143293 - RNA, 16 nt, Human
ugucuuuuuucacuac

SEQ ID NO: 2143294 - RNA, 23 nt, Human
ugucuggcugaggauuucaagcc

SEQ ID NO: 2143295 - RNA, 17 nt, Human
ugugacaugcgggcugg

SEQ ID NO: 2143296 - RNA, 18 nt, Human
ugugacauauuaugucuu

SEQ ID NO: 2143297 - RNA, 19 nt, Human
ugugacaauuuuguacaaa

SEQ ID NO: 2143298 - RNA, 19 nt, Human
ugugacaugcgggcugggc

SEQ ID NO: 2143299 - RNA, 21 nt, Human
ugugacaugcgggcugggcag

SEQ ID NO: 2143300 - RNA, 14 nt, Human
ugugaccagcacug

SEQ ID NO: 2143301 - RNA, 17 nt, Human
ugugaccagcacugucu

SEQ ID NO: 2143302 - RNA, 21 nt, Human
ugugacaaggauugcuacugu

SEQ ID NO: 2143303 - RNA, 15 nt, Human
ugugaaucagacccu

SEQ ID NO: 2143304 - RNA, 18 nt, Human
ugugaaucagacccuacc

SEQ ID NO: 2143305 - RNA, 20 nt, Human
ugugaauauggacucaguuu

SEQ ID NO: 2143306 - RNA, 12 nt, Human
ugugaauaaauu

SEQ ID NO: 2143307 - RNA, 14 nt, Human
ugugaaucagaccc

SEQ ID NO: 2143308 - RNA, 22 nt, Human
ugugauacccauagcuuccaug

SEQ ID NO: 2143309 - RNA, 18 nt, Human
ugugauaaggaucagaac

SEQ ID NO: 2143310 - RNA, 17 nt, Human
ugugcaaguaugugagu

SEQ ID NO: 2143311 - RNA, 18 nt, Human
ugugcaaguaugugagug

SEQ ID NO: 2143312 - RNA, 16 nt, Human
ugugcaaguguaugca

SEQ ID NO: 2143313 - RNA, 15 nt, Human
ugugcaagugucugu

SEQ ID NO: 2143314 - RNA, 19 nt, Human
ugugcaagugucugugugc

SEQ ID NO: 2143315 - RNA, 20 nt, Human
ugugcaagugucugugugca

SEQ ID NO: 2143316 - RNA, 12 nt, Human
ugugcaagugug

SEQ ID NO: 2143317 - RNA, 21 nt, Human
ugugcaagugugugcaugugu

SEQ ID NO: 2143318 - RNA, 21 nt, Human
ugugaggugcagagugcccag

SEQ ID NO: 2143319 - RNA, 15 nt, Human
ugugaguaagagcug

SEQ ID NO: 2143320 - RNA, 19 nt, Human
ugugaguaagagcuggugu

SEQ ID NO: 2143321 - RNA, 19 nt, Human
uguggcuugcuagcuaugu

SEQ ID NO: 2143322 - RNA, 17 nt, Human
uguggcuuucagagccu

SEQ ID NO: 2143323 - RNA, 17 nt, Human
uguggcuuucuuucuuu

SEQ ID NO: 2143324 - RNA, 19 nt, Human
uguggcugucagcaggaag

SEQ ID NO: 2143325 - RNA, 21 nt, Human
uguggcugucagcaggaagca

SEQ ID NO: 2143326 - RNA, 21 nt, Human
uguggcugggggcaggagggc

SEQ ID NO: 2143327 - RNA, 15 nt, Human
uguggcugucagcag

SEQ ID NO: 2143328 - RNA, 14 nt, Human
uguggcugcuagca

SEQ ID NO: 2143329 - RNA, 15 nt, Human
uguggcugggggcag

SEQ ID NO: 2143330 - RNA, 18 nt, Human
uguggcugggggcaggag

SEQ ID NO: 2143331 - RNA, 15 nt, Human
ugugggaagaaacaa

SEQ ID NO: 2143332 - RNA, 19 nt, Human
ugugggaagaaacaaaccc

SEQ ID NO: 2143333 - RNA, 15 nt, Human
ugugggaagggagag

SEQ ID NO: 2143334 - RNA, 18 nt, Human
ugugggaaugcggcaaga

SEQ ID NO: 2143335 - RNA, 19 nt, Human
ugugggaaugcggcaagaa

SEQ ID NO: 2143336 - RNA, 14 nt, Human
ugugggcugugagu

SEQ ID NO: 2143337 - RNA, 13 nt, Human
ugugggcugugag

SEQ ID NO: 2143338 - RNA, 17 nt, Human
ugugggacuagccuggc

SEQ ID NO: 2143339 - RNA, 13 nt, Human
ugugggacuguac

SEQ ID NO: 2143340 - RNA, 15 nt, Human
ugugggacuguacac

SEQ ID NO: 2143341 - RNA, 16 nt, Human
ugugggacuguacaca

SEQ ID NO: 2143342 - RNA, 19 nt, Human
ugugggacuguacacacuu

SEQ ID NO: 2143343 - RNA, 20 nt, Human
ugugggacuguacacacuuu

SEQ ID NO: 2143344 - RNA, 13 nt, Human
ugugggcucccuu

SEQ ID NO: 2143345 - RNA, 14 nt, Human
ugugggcucccuuc

SEQ ID NO: 2143346 - RNA, 12 nt, Human
uguggggccuug

SEQ ID NO: 2143347 - RNA, 16 nt, Human
uguggggauuucuccc

SEQ ID NO: 2143348 - RNA, 15 nt, Human
ugugggucaaggaau

SEQ ID NO: 2143349 - RNA, 21 nt, Human
uguggguacagagaggucaag

SEQ ID NO: 2143350 - RNA, 15 nt, Human
uguggguaccuguau

SEQ ID NO: 2143351 - RNA, 15 nt, Human
uguguacguggagag

SEQ ID NO: 2143352 - RNA, 14 nt, Human
uguguacucuggcc

SEQ ID NO: 2143353 - RNA, 15 nt, Human
uguguacucuggccu

SEQ ID NO: 2143354 - RNA, 16 nt, Human
uguguacucuggccuc

SEQ ID NO: 2143355 - RNA, 17 nt, Human
uguguacucuggccucu

SEQ ID NO: 2143356 - RNA, 18 nt, Human
uguguacucuggccucug

SEQ ID NO: 2143357 - RNA, 20 nt, Human
uguguacucuggccucuguc

SEQ ID NO: 2143358 - RNA, 17 nt, Human
uguguacuguaaagaau

SEQ ID NO: 2143359 - RNA, 16 nt, Human
uguguacguggagagg

SEQ ID NO: 2143360 - RNA, 13 nt, Human
uguggacacagcu

SEQ ID NO: 2143361 - RNA, 14 nt, Human
uguggacacagcuc

SEQ ID NO: 2143362 - RNA, 14 nt, Human
uguggaaagccucu

SEQ ID NO: 2143363 - RNA, 15 nt, Human
uguggaaagccucug

SEQ ID NO: 2143364 - RNA, 17 nt, Human
uguggaaagccucugcu

SEQ ID NO: 2143365 - RNA, 19 nt, Human
uguggaaagccucugcugc

SEQ ID NO: 2143366 - RNA, 20 nt, Human
uguggaaagccucugcugcc

SEQ ID NO: 2143367 - RNA, 16 nt, Human
uguggaaagugaauuu

SEQ ID NO: 2143368 - RNA, 19 nt, Human
uguggaaagugaauuugaa

SEQ ID NO: 2143369 - RNA, 22 nt, Human
uguggaaagugaauuugaauga

SEQ ID NO: 2143370 - RNA, 23 nt, Human
uguggaaagugaauuugaaugaa

SEQ ID NO: 2143371 - RNA, 17 nt, Human
uguggaaaaugaaaauu

SEQ ID NO: 2143372 - RNA, 12 nt, Human
uguggaaagccu

SEQ ID NO: 2143373 - RNA, 14 nt, Human
uguggaaaaauauu

SEQ ID NO: 2143374 - RNA, 16 nt, Human
uguggaaaaauauuua

SEQ ID NO: 2143375 - RNA, 14 nt, Human
uguggacugugaug

SEQ ID NO: 2143376 - RNA, 15 nt, Human
uguggacugugaugc

SEQ ID NO: 2143377 - RNA, 16 nt, Human
uguggacacagcucuu

SEQ ID NO: 2143378 - RNA, 15 nt, Human
uguggacacagcucu

SEQ ID NO: 2143379 - RNA, 21 nt, Human
uguggcuccuggggguucuuu

SEQ ID NO: 2143380 - RNA, 23 nt, Human
uguggcuccccucuauuuagcau

SEQ ID NO: 2143381 - RNA, 15 nt, Human
uguggcuccccucua

SEQ ID NO: 2143382 - RNA, 23 nt, Human
uguggagaaacuguagucucagg

SEQ ID NO: 2143383 - RNA, 12 nt, Human
uguggagaagcg

SEQ ID NO: 2143384 - RNA, 21 nt, Human
uguggagaagcggcuggcagc

SEQ ID NO: 2143385 - RNA, 14 nt, Human
ugugccucugccug

SEQ ID NO: 2143386 - RNA, 14 nt, Human
ugugcaugugugug

SEQ ID NO: 2143387 - RNA, 13 nt, Human
ugugccucuggga

SEQ ID NO: 2143388 - RNA, 15 nt, Human
ugugccucugggacu

SEQ ID NO: 2143389 - RNA, 16 nt, Human
ugugccucugggacug

SEQ ID NO: 2143390 - RNA, 19 nt, Human
ugugcauagagccacguau

SEQ ID NO: 2143391 - RNA, 19 nt, Human
ugugcaugggugaagggag

SEQ ID NO: 2143392 - RNA, 22 nt, Human
ugugcaugugugcgagugugug

SEQ ID NO: 2143393 - RNA, 13 nt, Human
ugugcauggguga

SEQ ID NO: 2143394 - RNA, 22 nt, Human
ugugcacaugcacgugugugca

SEQ ID NO: 2143395 - RNA, 16 nt, Human
ugugcacaugcacgug

SEQ ID NO: 2143396 - RNA, 18 nt, Human
ugugcacaugugugcgug

SEQ ID NO: 2143397 - RNA, 23 nt, Human
ugugcagacucaauaaaaucaug

SEQ ID NO: 2143398 - RNA, 21 nt, Human
ugugcacgagugggaaggacu

SEQ ID NO: 2143399 - RNA, 13 nt, Human
ugugcuuauguuu

SEQ ID NO: 2143400 - RNA, 15 nt, Human
ugugcgugaaacaca

SEQ ID NO: 2143401 - RNA, 16 nt, Human
ugugcgugaaacacac

SEQ ID NO: 2143402 - RNA, 22 nt, Human
ugugcgugaaacacaccaggcu

SEQ ID NO: 2143403 - RNA, 15 nt, Human
ugugcgugcaugugc

SEQ ID NO: 2143404 - RNA, 21 nt, Human
ugugcguguguccaugugugu

SEQ ID NO: 2143405 - RNA, 20 nt, Human
ugugcguguguccaugugug

SEQ ID NO: 2143406 - RNA, 17 nt, Human
ugugcuacugauuguuu

SEQ ID NO: 2143407 - RNA, 17 nt, Human
ugugcuacaugacgaca

SEQ ID NO: 2143408 - RNA, 23 nt, Human
ugugcuaaccacgucugucuuca

SEQ ID NO: 2143409 - RNA, 13 nt, Human
ugugccuggagcu

SEQ ID NO: 2143410 - RNA, 17 nt, Human
ugugccuggagcuccug

SEQ ID NO: 2143411 - RNA, 18 nt, Human
ugugccuggagcuccugg

SEQ ID NO: 2143412 - RNA, 19 nt, Human
ugugccuggagcuccuggg

SEQ ID NO: 2143413 - RNA, 13 nt, Human
ugugccugcagcc

SEQ ID NO: 2143414 - RNA, 15 nt, Human
ugugccucugccugu

SEQ ID NO: 2143415 - RNA, 14 nt, Human
ugugccugcaccag

SEQ ID NO: 2143416 - RNA, 16 nt, Human
ugugccugcaccagga

SEQ ID NO: 2143417 - RNA, 17 nt, Human
ugugccugcaccaggag

SEQ ID NO: 2143418 - RNA, 18 nt, Human
ugugccugcaccaggaga

SEQ ID NO: 2143419 - RNA, 19 nt, Human
ugugccugcaccaggagac

SEQ ID NO: 2143420 - RNA, 12 nt, Human
ugugccugcagc

SEQ ID NO: 2143421 - RNA, 17 nt, Human
ugugccucugggacugg

SEQ ID NO: 2143422 - RNA, 14 nt, Human
ugugcguccugucg

SEQ ID NO: 2143423 - RNA, 15 nt, Human
ugugcggugcauaca

SEQ ID NO: 2143424 - RNA, 13 nt, Human
ugugcgugaaaca

SEQ ID NO: 2143425 - RNA, 14 nt, Human
ugugcgugaaacac

SEQ ID NO: 2143426 - RNA, 16 nt, Human
uuguacaguuuuuauu

SEQ ID NO: 2143427 - RNA, 12 nt, Human
uuguacaguuuu

SEQ ID NO: 2143428 - RNA, 13 nt, Human
uuguacaguuuuu

SEQ ID NO: 2143429 - RNA, 21 nt, Human
uuguacagacguaugcuuauu

SEQ ID NO: 2143430 - RNA, 18 nt, Human
uuguacagacguaugcuu

SEQ ID NO: 2143431 - RNA, 19 nt, Human
uuguacagacguaugcuua

SEQ ID NO: 2143432 - RNA, 15 nt, Human
uuguagagccagggu

SEQ ID NO: 2143433 - RNA, 14 nt, Human
uuguagagccaggg

SEQ ID NO: 2143434 - RNA, 19 nt, Human
uuguaucauuugaacaacu

SEQ ID NO: 2143435 - RNA, 13 nt, Human
uuguaucuagugc

SEQ ID NO: 2143436 - RNA, 17 nt, Human
uuguaucuagugcagcu

SEQ ID NO: 2143437 - RNA, 18 nt, Human
uuguaucuagugcagcug

SEQ ID NO: 2143438 - RNA, 20 nt, Human
uuguaucuagugcagcugau

SEQ ID NO: 2143439 - RNA, 21 nt, Human
uuguaucuagugcagcugauu

SEQ ID NO: 2143440 - RNA, 13 nt, Human
uuguaaagaguug

SEQ ID NO: 2143441 - RNA, 20 nt, Human
uuguaucucuuuugaaucca

SEQ ID NO: 2143442 - RNA, 13 nt, Human
uuguaucucuuuu

SEQ ID NO: 2143443 - RNA, 14 nt, Human
uuguaucucuuuug

SEQ ID NO: 2143444 - RNA, 21 nt, Human
uugguccuaagucccugcccc

SEQ ID NO: 2143445 - RNA, 12 nt, Human
uugguccucuug

SEQ ID NO: 2143446 - RNA, 17 nt, Human
uugguccucuugccauc

SEQ ID NO: 2143447 - RNA, 19 nt, Human
uuguacagaaucauugcuu

SEQ ID NO: 2143448 - RNA, 20 nt, Human
uuguacagaaucauugcuua

SEQ ID NO: 2143449 - RNA, 19 nt, Human
uuguacacaccuuauauuu

SEQ ID NO: 2143450 - RNA, 23 nt, Human
uuguacaauugaacuuaaauaaa

SEQ ID NO: 2143451 - RNA, 19 nt, Human
uuguaaauauuuauguaaa

SEQ ID NO: 2143452 - RNA, 13 nt, Human
uuguaaauaagag

SEQ ID NO: 2143453 - RNA, 14 nt, Human
uuguaaauaagaga

SEQ ID NO: 2143454 - RNA, 15 nt, Human
uuguaaauaagagau

SEQ ID NO: 2143455 - RNA, 16 nt, Human
uuguaaauaagagauu

SEQ ID NO: 2143456 - RNA, 12 nt, Human
uuguaaauauuu

SEQ ID NO: 2143457 - RNA, 13 nt, Human
uuguaaauauuua

SEQ ID NO: 2143458 - RNA, 16 nt, Human
uuguaaauauuuaugu

SEQ ID NO: 2143459 - RNA, 16 nt, Human
uuggguggaugccugg

SEQ ID NO: 2143460 - RNA, 19 nt, Human
uuggguguaacaggucucc

SEQ ID NO: 2143461 - RNA, 20 nt, Human
uuggguguaacaggucuccu

SEQ ID NO: 2143462 - RNA, 17 nt, Human
uuggguucauuauugga

SEQ ID NO: 2143463 - RNA, 12 nt, Human
uugggaggcuga

SEQ ID NO: 2143464 - RNA, 17 nt, Human
uugggaggccccacugg

SEQ ID NO: 2143465 - RNA, 22 nt, Human
uuggcuuuggguugcaggaccu

SEQ ID NO: 2143466 - RNA, 17 nt, Human
uuggcuuacugcagccu

SEQ ID NO: 2143467 - RNA, 21 nt, Human
uuggcuuucaugaggaggcag

SEQ ID NO: 2143468 - RNA, 16 nt, Human
uuggcuuuccagucau

SEQ ID NO: 2143469 - RNA, 22 nt, Human
uuggcugggggccucagugcca

SEQ ID NO: 2143470 - RNA, 21 nt, Human
uuggcugggggccucagugcc

SEQ ID NO: 2143471 - RNA, 21 nt, Human
uuggcuguagaaggagacaga

SEQ ID NO: 2143472 - RNA, 16 nt, Human
uuggcugggcccagaa

SEQ ID NO: 2143473 - RNA, 17 nt, Human
uuggcugggcccagaag

SEQ ID NO: 2143474 - RNA, 18 nt, Human
uuggcugggcccagaagg

SEQ ID NO: 2143475 - RNA, 11 nt, Human
uuggcugggua

SEQ ID NO: 2143476 - RNA, 18 nt, Human
uuggcugggggccucagu

SEQ ID NO: 2143477 - RNA, 13 nt, Human
uuggcugggccca

SEQ ID NO: 2143478 - RNA, 24 nt, Human
uuggccaaagccaaagcuaggccu

SEQ ID NO: 2143479 - RNA, 14 nt, Human
uuggcauuaaaacu

SEQ ID NO: 2143480 - RNA, 15 nt, Human
uuggcauuaaaacuu

SEQ ID NO: 2143481 - RNA, 15 nt, Human
uuggccaaaguguua

SEQ ID NO: 2143482 - RNA, 14 nt, Human
uuggccaggcuggu

SEQ ID NO: 2143483 - RNA, 13 nt, Human
uuggcauucccca

SEQ ID NO: 2143484 - RNA, 21 nt, Human
uuggcaucacagggcagagcc

SEQ ID NO: 2143485 - RNA, 18 nt, Human
uuggauuuuugucuugug

SEQ ID NO: 2143486 - RNA, 17 nt, Human
uuggcaaaaaggcagga

SEQ ID NO: 2143487 - RNA, 15 nt, Human
uuggauugacaguaa

SEQ ID NO: 2143488 - RNA, 17 nt, Human
uuggauugacaguaacu

SEQ ID NO: 2143489 - RNA, 18 nt, Human
uuggauugacaguaacuu

SEQ ID NO: 2143490 - RNA, 19 nt, Human
uuggaaguuuguguucugu

SEQ ID NO: 2143491 - RNA, 16 nt, Human
uuggaaguuuucagga

SEQ ID NO: 2143492 - RNA, 20 nt, Human
uugcuguagaagauggcacu

SEQ ID NO: 2143493 - RNA, 15 nt, Human
uugcuggucacugcc

SEQ ID NO: 2143494 - RNA, 17 nt, Human
uugcuggucuuguaaga

SEQ ID NO: 2143495 - RNA, 18 nt, Human
uugcuggucuuguaagag

SEQ ID NO: 2143496 - RNA, 23 nt, Human
uugcuggucuuguaagagcuaua

SEQ ID NO: 2143497 - RNA, 21 nt, Human
uugcugccugaagaacaguaa

SEQ ID NO: 2143498 - RNA, 22 nt, Human
uuggaaccacggagaucuccuu

SEQ ID NO: 2143499 - RNA, 20 nt, Human
uuggaaagcaucaccucagg

SEQ ID NO: 2143500 - RNA, 14 nt, Human
uuggaaaggaccag

SEQ ID NO: 2143501 - RNA, 22 nt, Human
uuggaaagcaucaccucaggcc

SEQ ID NO: 2143502 - RNA, 22 nt, Human
uugcuaaaggaaaaaaccaucc

SEQ ID NO: 2143503 - RNA, 19 nt, Human
uugcguuagaaugaggagg

SEQ ID NO: 2143504 - RNA, 15 nt, Human
uugcugauucuugag

SEQ ID NO: 2143505 - RNA, 12 nt, Human
uugccugcaggc

SEQ ID NO: 2143506 - RNA, 18 nt, Human
uugccugcggucaaggcc

SEQ ID NO: 2143507 - RNA, 19 nt, Human
uugccugcggucaaggcca

SEQ ID NO: 2143508 - RNA, 22 nt, Human
uugccugcguuuuggaagcucu

SEQ ID NO: 2143509 - RNA, 20 nt, Human
uugccugaaguuggagugag

SEQ ID NO: 2143510 - RNA, 21 nt, Human
uugcguggaauugugcugagu

SEQ ID NO: 2143511 - RNA, 21 nt, Human
uugcuaaaaauaguggccaga

SEQ ID NO: 2143512 - RNA, 12 nt, Human
uugcccagagau

SEQ ID NO: 2143513 - RNA, 16 nt, Human
uugcccagagaugccu

SEQ ID NO: 2143514 - RNA, 17 nt, Human
uugcccagagaugccuc

SEQ ID NO: 2143515 - RNA, 18 nt, Human
uugcccagagaugccucc

SEQ ID NO: 2143516 - RNA, 19 nt, Human
uugcccagagaugccucca

SEQ ID NO: 2143517 - RNA, 22 nt, Human
uugcccagagaugccuccaccg

SEQ ID NO: 2143518 - RNA, 11 nt, Human
uugcccaggca

SEQ ID NO: 2143519 - RNA, 23 nt, Human
uugcccacgcuggagugcaguga

SEQ ID NO: 2143520 - RNA, 13 nt, Human
uugccagugucuu

SEQ ID NO: 2143521 - RNA, 14 nt, Human
uugccagugucuuu

SEQ ID NO: 2143522 - RNA, 15 nt, Human
uugccagugucuuuc

SEQ ID NO: 2143523 - RNA, 16 nt, Human
uugccagugucuuucu

SEQ ID NO: 2143524 - RNA, 17 nt, Human
uugccagugucuuucuu

SEQ ID NO: 2143525 - RNA, 18 nt, Human
uugccagugucuuucuuu

SEQ ID NO: 2143526 - RNA, 21 nt, Human
uugccagugucuuucuuuggu

SEQ ID NO: 2143527 - RNA, 18 nt, Human
uugccacugccucuuccu

SEQ ID NO: 2143528 - RNA, 15 nt, Human
uugccuccuguguaa

SEQ ID NO: 2143529 - RNA, 14 nt, Human
uugccucugccucu

SEQ ID NO: 2143530 - RNA, 11 nt, Human
uugccucugcc

SEQ ID NO: 2143531 - RNA, 18 nt, Human
uugccucugccucugaca

SEQ ID NO: 2143532 - RNA, 16 nt, Human
uugccucugccucuga

SEQ ID NO: 2143533 - RNA, 13 nt, Human
uucugacugcuga

SEQ ID NO: 2143534 - RNA, 22 nt, Human
uucugacuucauagauuuccuu

SEQ ID NO: 2143535 - RNA, 17 nt, Human
uucuguccgagcuuuga

SEQ ID NO: 2143536 - RNA, 21 nt, Human
uucuguccgagcuuugaaaau

SEQ ID NO: 2143537 - RNA, 15 nt, Human
uucuguucauuuguu

SEQ ID NO: 2143538 - RNA, 16 nt, Human
uucuguucauuuguua

SEQ ID NO: 2143539 - RNA, 17 nt, Human
uucuguucauuuguuau

SEQ ID NO: 2143540 - RNA, 22 nt, Human
uucugugggagaauucuuacau

SEQ ID NO: 2143541 - RNA, 17 nt, Human
uucuguccuacucugug

SEQ ID NO: 2143542 - RNA, 16 nt, Human
uucuguggcucacaga

SEQ ID NO: 2143543 - RNA, 12 nt, Human
uucuguggcuca

SEQ ID NO: 2143544 - RNA, 14 nt, Human
uucuucagaagaca

SEQ ID NO: 2143545 - RNA, 17 nt, Human
uucuucagaagacacug

SEQ ID NO: 2143546 - RNA, 22 nt, Human
uucuucaccuaagucucuguga

SEQ ID NO: 2143547 - RNA, 21 nt, Human
uucuucaccuaagucucugug

SEQ ID NO: 2143548 - RNA, 17 nt, Human
uucuucaacaucaaugu

SEQ ID NO: 2143549 - RNA, 21 nt, Human
uucuucaacaucaauguucau

SEQ ID NO: 2143550 - RNA, 22 nt, Human
uucuucaacaucaauguucauu

SEQ ID NO: 2143551 - RNA, 19 nt, Human
uucuuauuuaaugaaagac

SEQ ID NO: 2143552 - RNA, 23 nt, Human
uucuuauuuaaugaaagacugua

SEQ ID NO: 2143553 - RNA, 17 nt, Human
uugaagagagagcugag

SEQ ID NO: 2143554 - RNA, 22 nt, Human
uugaagacacugaaauauacac

SEQ ID NO: 2143555 - RNA, 15 nt, Human
uugaagacacugaaa

SEQ ID NO: 2143556 - RNA, 13 nt, Human
uugaagacacuga

SEQ ID NO: 2143557 - RNA, 17 nt, Human
uugaagacaaaaauacu

SEQ ID NO: 2143558 - RNA, 22 nt, Human
uugaagacaaaaauacucuaau

SEQ ID NO: 2143559 - RNA, 19 nt, Human
uugaacucuucaaucucuu

SEQ ID NO: 2143560 - RNA, 10 nt, Human
uucuuucaag

SEQ ID NO: 2143561 - RNA, 20 nt, Human
uucuuucaagugaaucuaaa

SEQ ID NO: 2143562 - RNA, 22 nt, Human
uucuuucaagugaaucuaaaag

SEQ ID NO: 2143563 - RNA, 13 nt, Human
uucuuuauaaacu

SEQ ID NO: 2143564 - RNA, 14 nt, Human
uucuuuauaaacuu

SEQ ID NO: 2143565 - RNA, 18 nt, Human
uucuuuauaauucuacuu

SEQ ID NO: 2143566 - RNA, 15 nt, Human
uugaaagaaaauaug

SEQ ID NO: 2143567 - RNA, 15 nt, Human
uugccacugccucuu

SEQ ID NO: 2143568 - RNA, 14 nt, Human
uugccacugccucu

SEQ ID NO: 2143569 - RNA, 22 nt, Human
uugccacugagagaucugcugu

SEQ ID NO: 2143570 - RNA, 15 nt, Human
uugcagugagcugag

SEQ ID NO: 2143571 - RNA, 13 nt, Human
uugcaguggaaga

SEQ ID NO: 2143572 - RNA, 20 nt, Human
uugcaguguggugagaucau

SEQ ID NO: 2143573 - RNA, 17 nt, Human
uugcagucugcuucugc

SEQ ID NO: 2143574 - RNA, 13 nt, Human
uugcagugagcca

SEQ ID NO: 2143575 - RNA, 22 nt, Human
uugcagacaggcaagcaccucc

SEQ ID NO: 2143576 - RNA, 20 nt, Human
uugcaguagagucaucucca

SEQ ID NO: 2143577 - RNA, 20 nt, Human
uugcagaagggggucucuuc

SEQ ID NO: 2143578 - RNA, 16 nt, Human
uugcagacaggcaagc

SEQ ID NO: 2143579 - RNA, 13 nt, Human
uugcaacacacag

SEQ ID NO: 2143580 - RNA, 15 nt, Human
uugcaacacacagac

SEQ ID NO: 2143581 - RNA, 22 nt, Human
uugcagaaacauuuugugguca

SEQ ID NO: 2143582 - RNA, 16 nt, Human
uugcaaaauuuccagu

SEQ ID NO: 2143583 - RNA, 21 nt, Human
uugcaaaauuuccaguaccuu

SEQ ID NO: 2143584 - RNA, 22 nt, Human
uugcaaaauuuccaguaccuuu

SEQ ID NO: 2143585 - RNA, 23 nt, Human
uugcaaaauuuccaguaccuuug

SEQ ID NO: 2143586 - RNA, 15 nt, Human
uugcaaaauuuccag

SEQ ID NO: 2143587 - RNA, 11 nt, Human
uugcaaaauuu

SEQ ID NO: 2143588 - RNA, 17 nt, Human
uugcaacaggcugggcu

SEQ ID NO: 2143589 - RNA, 14 nt, Human
uugcaacaggcugg

SEQ ID NO: 2143590 - RNA, 17 nt, Human
uugauuucccuucuucu

SEQ ID NO: 2143591 - RNA, 18 nt, Human
uugauuucccuucuucug

SEQ ID NO: 2143592 - RNA, 20 nt, Human
uugaaugaaaaauuuaagca

SEQ ID NO: 2143593 - RNA, 16 nt, Human
uugauuuaauaacaua

SEQ ID NO: 2143594 - RNA, 17 nt, Human
uugauugucagcuacua

SEQ ID NO: 2143595 - RNA, 21 nt, Human
uugauugucagcuacuaauga

SEQ ID NO: 2143596 - RNA, 15 nt, Human
uugaugaaagcugau

SEQ ID NO: 2143597 - RNA, 16 nt, Human
uugaugaaagcugauu

SEQ ID NO: 2143598 - RNA, 15 nt, Human
uugauugucagcuac

SEQ ID NO: 2143599 - RNA, 18 nt, Human
uugaccuaagauuuauuu

SEQ ID NO: 2143600 - RNA, 15 nt, Human
uugaccucaggugau

SEQ ID NO: 2143601 - RNA, 18 nt, Human
uugaauggccugccuuga

SEQ ID NO: 2143602 - RNA, 15 nt, Human
uugaauggguccauu

SEQ ID NO: 2143603 - RNA, 18 nt, Human
uugaaugaaaaauuuaag

SEQ ID NO: 2143604 - RNA, 12 nt, Human
uugaaugaaaaa

SEQ ID NO: 2143605 - RNA, 15 nt, Human
uugaaugaaaaauuu

SEQ ID NO: 2143606 - RNA, 16 nt, Human
uugaaugcuuccugac

SEQ ID NO: 2143607 - RNA, 16 nt, Human
uugaggggcuccugga

SEQ ID NO: 2143608 - RNA, 15 nt, Human
uugaggggcuccugg

SEQ ID NO: 2143609 - RNA, 22 nt, Human
uugagggacaaauuuaaaacaa

SEQ ID NO: 2143610 - RNA, 23 nt, Human
uugagggacaaauuuaaaacaaa

SEQ ID NO: 2143611 - RNA, 12 nt, Human
uugagcuguuuu

SEQ ID NO: 2143612 - RNA, 18 nt, Human
uugagcuguuuucccuga

SEQ ID NO: 2143613 - RNA, 18 nt, Human
uugagcuuagugaaauua

SEQ ID NO: 2143614 - RNA, 22 nt, Human
uugacuagaaaauuuaaaacau

SEQ ID NO: 2143615 - RNA, 19 nt, Human
uugacuagggauucaggcu

SEQ ID NO: 2143616 - RNA, 21 nt, Human
uugacuagggauucaggcugc

SEQ ID NO: 2143617 - RNA, 17 nt, Human
uugacuaucaaacugaa

SEQ ID NO: 2143618 - RNA, 13 nt, Human
uucucaaagaaau

SEQ ID NO: 2143619 - RNA, 15 nt, Human
uucucaaagaaauuu

SEQ ID NO: 2143620 - RNA, 19 nt, Human
uucucaaagaaauuuccac

SEQ ID NO: 2143621 - RNA, 20 nt, Human
uucucaaagaaauuuccacu

SEQ ID NO: 2143622 - RNA, 15 nt, Human
uucucauccugcagg

SEQ ID NO: 2143623 - RNA, 12 nt, Human
uucucaaagcag

SEQ ID NO: 2143624 - RNA, 15 nt, Human
uucucaaagcaggaa

SEQ ID NO: 2143625 - RNA, 19 nt, Human
uucucaaaggguacuucca

SEQ ID NO: 2143626 - RNA, 14 nt, Human
uucuccaaaugaga

SEQ ID NO: 2143627 - RNA, 15 nt, Human
uucuauuuuuguaga

SEQ ID NO: 2143628 - RNA, 13 nt, Human
uucuauuuaagug

SEQ ID NO: 2143629 - RNA, 16 nt, Human
uucuauuuaaguguac

SEQ ID NO: 2143630 - RNA, 15 nt, Human
uucuauuuauuuacu

SEQ ID NO: 2143631 - RNA, 14 nt, Human
uucuaauagaacuc

SEQ ID NO: 2143632 - RNA, 12 nt, Human
uucuaauagaac

SEQ ID NO: 2143633 - RNA, 18 nt, Human
uucuaauagaacucaguu

SEQ ID NO: 2143634 - RNA, 13 nt, Human
uucuaaucugcua

SEQ ID NO: 2143635 - RNA, 14 nt, Human
uucuaaucugcuau

SEQ ID NO: 2143636 - RNA, 15 nt, Human
uucuaaucugcuaug

SEQ ID NO: 2143637 - RNA, 14 nt, Human
uucuauuaaaagug

SEQ ID NO: 2143638 - RNA, 18 nt, Human
uucuauuaaaagugggaa

SEQ ID NO: 2143639 - RNA, 23 nt, Human
uucuauuaaaagugggaauuagg

SEQ ID NO: 2143640 - RNA, 17 nt, Human
uucuauucucuccucag

SEQ ID NO: 2143641 - RNA, 20 nt, Human
uucuauucucuccucagacu

SEQ ID NO: 2143642 - RNA, 13 nt, Human
uuccuucccucaa

SEQ ID NO: 2143643 - RNA, 22 nt, Human
uucuaugugacaauuuuguaca

SEQ ID NO: 2143644 - RNA, 15 nt, Human
uucuccauccuacca

SEQ ID NO: 2143645 - RNA, 18 nt, Human
uucuccaucuggcagggu

SEQ ID NO: 2143646 - RNA, 23 nt, Human
uucuccaugagacacaucuccuc

SEQ ID NO: 2143647 - RNA, 23 nt, Human
uucucccaauucauccucacuca

SEQ ID NO: 2143648 - RNA, 13 nt, Human
uucucccacacug

SEQ ID NO: 2143649 - RNA, 23 nt, Human
uucucccaggccaggcuccuucc

SEQ ID NO: 2143650 - RNA, 13 nt, Human
uucuccacccugc

SEQ ID NO: 2143651 - RNA, 11 nt, Human
uucuccaggcu

SEQ ID NO: 2143652 - RNA, 21 nt, Human
uucucucugccugugagccag

SEQ ID NO: 2143653 - RNA, 16 nt, Human
uucucucuccugucca

SEQ ID NO: 2143654 - RNA, 18 nt, Human
uucucucuaugguaaaga

SEQ ID NO: 2143655 - RNA, 20 nt, Human
uucucucuaugguaaagaua

SEQ ID NO: 2143656 - RNA, 22 nt, Human
uucucucuaugguaaagauauu

SEQ ID NO: 2143657 - RNA, 20 nt, Human
uucucucggaguaucuggga

SEQ ID NO: 2143658 - RNA, 14 nt, Human
uucucccccugggc

SEQ ID NO: 2143659 - RNA, 17 nt, Human
uucucccccugggcucu

SEQ ID NO: 2143660 - RNA, 18 nt, Human
uucucccccugggcucug

SEQ ID NO: 2143661 - RNA, 14 nt, Human
uucucuguauagua

SEQ ID NO: 2143662 - RNA, 13 nt, Human
uucugaccucagc

SEQ ID NO: 2143663 - RNA, 14 nt, Human
uucugaccucagca

SEQ ID NO: 2143664 - RNA, 15 nt, Human
uucugaccucagcau

SEQ ID NO: 2143665 - RNA, 22 nt, Human
uucucugaguaucuccucgcaa

SEQ ID NO: 2143666 - RNA, 15 nt, Human
uucucugcuccacca

SEQ ID NO: 2143667 - RNA, 11 nt, Human
uucucugcuuc

SEQ ID NO: 2143668 - RNA, 12 nt, Human
uucucugcuuca

SEQ ID NO: 2143669 - RNA, 15 nt, Human
uucucugcuucagcu

SEQ ID NO: 2143670 - RNA, 19 nt, Human
uucucugcuucagcuugcu

SEQ ID NO: 2143671 - RNA, 11 nt, Human
uucucugcucc

SEQ ID NO: 2143672 - RNA, 13 nt, Human
uucucugcuccac

SEQ ID NO: 2143673 - RNA, 14 nt, Human
uucucugcuccacc

SEQ ID NO: 2143674 - RNA, 23 nt, Human
uucucugaagaguggguuucaca

SEQ ID NO: 2143675 - RNA, 13 nt, Human
uucuaaagaugga

SEQ ID NO: 2143676 - RNA, 20 nt, Human
uucuaaaggccucuuccuug

SEQ ID NO: 2143677 - RNA, 15 nt, Human
uucuaauaaaacaaa

SEQ ID NO: 2143678 - RNA, 12 nt, Human
uuccuuucucag

SEQ ID NO: 2143679 - RNA, 16 nt, Human
uuccuuucccuuuagc

SEQ ID NO: 2143680 - RNA, 18 nt, Human
uuccuuucccuuuagcac

SEQ ID NO: 2143681 - RNA, 14 nt, Human
uuccuuccuucccu

SEQ ID NO: 2143682 - RNA, 14 nt, Human
uuccuucucaucug

SEQ ID NO: 2143683 - RNA, 16 nt, Human
uuccuucucaucugug

SEQ ID NO: 2143684 - RNA, 16 nt, Human
uuccuuccuucccugg

SEQ ID NO: 2143685 - RNA, 20 nt, Human
uuccuuccaucccuaccccc

SEQ ID NO: 2143686 - RNA, 15 nt, Human
uuccugccuggucuc

SEQ ID NO: 2143687 - RNA, 16 nt, Human
uuccugccuggucucc

SEQ ID NO: 2143688 - RNA, 17 nt, Human
uuccugccuggucuccu

SEQ ID NO: 2143689 - RNA, 12 nt, Human
uuccuucccugg

SEQ ID NO: 2143690 - RNA, 13 nt, Human
uuccuucccuggc

SEQ ID NO: 2143691 - RNA, 14 nt, Human
uuccuucccuggcu

SEQ ID NO: 2143692 - RNA, 19 nt, Human
uuccuucauucaacccacc

SEQ ID NO: 2143693 - RNA, 14 nt, Human
uucccuuaaaauuu

SEQ ID NO: 2143694 - RNA, 14 nt, Human
uuccccacugccug

SEQ ID NO: 2143695 - RNA, 18 nt, Human
uuccccacugccugccca

SEQ ID NO: 2143696 - RNA, 21 nt, Human
uuccccacugacagccuccca

SEQ ID NO: 2143697 - RNA, 23 nt, Human
uuccccacugacagccucccacc

SEQ ID NO: 2143698 - RNA, 17 nt, Human
uuccccacugacagccu

SEQ ID NO: 2143699 - RNA, 21 nt, Human
uuccccaccagugaaugaaag

SEQ ID NO: 2143700 - RNA, 22 nt, Human
uuccccacuugagaauuacccu

SEQ ID NO: 2143701 - RNA, 21 nt, Human
uucccuuuagcacguuuaaag

SEQ ID NO: 2143702 - RNA, 23 nt, Human
uucccuuuagcacguuuaaaguu

SEQ ID NO: 2143703 - RNA, 16 nt, Human
uucccuuggccucaga

SEQ ID NO: 2143704 - RNA, 11 nt, Human
uucccuuggcc

SEQ ID NO: 2143705 - RNA, 12 nt, Human
uucccuuggccu

SEQ ID NO: 2143706 - RNA, 14 nt, Human
uucccuuggccuca

SEQ ID NO: 2143707 - RNA, 15 nt, Human
uucccuuggccucag

SEQ ID NO: 2143708 - RNA, 17 nt, Human
uuccuagauaaaaagau

SEQ ID NO: 2143709 - RNA, 18 nt, Human
uuccuagauaaaaagaug

SEQ ID NO: 2143710 - RNA, 15 nt, Human
uucccuuuccuucca

SEQ ID NO: 2143711 - RNA, 23 nt, Human
uuccucauaguaugguggcuggg

SEQ ID NO: 2143712 - RNA, 22 nt, Human
uuccucccucccucuuucccuc

SEQ ID NO: 2143713 - RNA, 12 nt, Human
uuccucccuccc

SEQ ID NO: 2143714 - RNA, 19 nt, Human
uuccucccucccucuuucc

SEQ ID NO: 2143715 - RNA, 21 nt, Human
uuccucccucccucuuucccu

SEQ ID NO: 2143716 - RNA, 12 nt, Human
uucaguuuucag

SEQ ID NO: 2143717 - RNA, 17 nt, Human
uucaguuuuaucuuuaa

SEQ ID NO: 2143718 - RNA, 19 nt, Human
uucaguuucaauucagugc

SEQ ID NO: 2143719 - RNA, 20 nt, Human
uucaucuaccauuuucuggu

SEQ ID NO: 2143720 - RNA, 13 nt, Human
uucaguggcagcu

SEQ ID NO: 2143721 - RNA, 19 nt, Human
uucagugcuguggccuggg

SEQ ID NO: 2143722 - RNA, 21 nt, Human
uucagugcuguggccugggca

SEQ ID NO: 2143723 - RNA, 18 nt, Human
uucagggaauuucaggaa

SEQ ID NO: 2143724 - RNA, 22 nt, Human
uucagggaauuucaggaacuag

SEQ ID NO: 2143725 - RNA, 13 nt, Human
uucagugcugugg

SEQ ID NO: 2143726 - RNA, 17 nt, Human
uucaguugguaagcuuc

SEQ ID NO: 2143727 - RNA, 18 nt, Human
uucaguugguguguuuuu

SEQ ID NO: 2143728 - RNA, 19 nt, Human
uucaguuggcugacuucca

SEQ ID NO: 2143729 - RNA, 16 nt, Human
uucaguugauuuuaca

SEQ ID NO: 2143730 - RNA, 16 nt, Human
uucaggcucuucuccu

SEQ ID NO: 2143731 - RNA, 13 nt, Human
uucaggcugcuug

SEQ ID NO: 2143732 - RNA, 16 nt, Human
uucaggcugcuuggga

SEQ ID NO: 2143733 - RNA, 13 nt, Human
uucauuucaucua

SEQ ID NO: 2143734 - RNA, 19 nt, Human
uucauuuggaaauaagcug

SEQ ID NO: 2143735 - RNA, 16 nt, Human
uucauuuguuauucuu

SEQ ID NO: 2143736 - RNA, 18 nt, Human
uucauuuguuauucuuaa

SEQ ID NO: 2143737 - RNA, 20 nt, Human
uucaucuuccaacucaaacu

SEQ ID NO: 2143738 - RNA, 16 nt, Human
uucaucuauuucugag

SEQ ID NO: 2143739 - RNA, 17 nt, Human
uucaucuauuucugaga

SEQ ID NO: 2143740 - RNA, 18 nt, Human
uucaucuauuucugagaa

SEQ ID NO: 2143741 - RNA, 21 nt, Human
uuccacuuagaaauugcauuu

SEQ ID NO: 2143742 - RNA, 20 nt, Human
uuccacugucaagaaagagc

SEQ ID NO: 2143743 - RNA, 12 nt, Human
uuccacuggacu

SEQ ID NO: 2143744 - RNA, 22 nt, Human
uuccacuggacuugagcuuggc

SEQ ID NO: 2143745 - RNA, 18 nt, Human
uuccacugauggaaacaa

SEQ ID NO: 2143746 - RNA, 23 nt, Human
uuccacugauggaaacaaagugg

SEQ ID NO: 2143747 - RNA, 23 nt, Human
uuccaucucgccaccccuccuuc

SEQ ID NO: 2143748 - RNA, 15 nt, Human
uuccaucccuacccc

SEQ ID NO: 2143749 - RNA, 21 nt, Human
uuccaucccuacccccuaaga

SEQ ID NO: 2143750 - RNA, 17 nt, Human
uuccagaaaaccccagc

SEQ ID NO: 2143751 - RNA, 18 nt, Human
uuccagaaaaccccagca

SEQ ID NO: 2143752 - RNA, 21 nt, Human
uuccagaaaaccccagcaucc

SEQ ID NO: 2143753 - RNA, 14 nt, Human
uuccagaaaggaua

SEQ ID NO: 2143754 - RNA, 15 nt, Human
uuccagaaaggauau

SEQ ID NO: 2143755 - RNA, 22 nt, Human
uuccagaaaggauauuuaagaa

SEQ ID NO: 2143756 - RNA, 15 nt, Human
uuccauuucucucuc

SEQ ID NO: 2143757 - RNA, 21 nt, Human
uuccauuucucucuccagucu

SEQ ID NO: 2143758 - RNA, 14 nt, Human
uuccauuugugugu

SEQ ID NO: 2143759 - RNA, 21 nt, Human
uuccaugucgccucugcauuc

SEQ ID NO: 2143760 - RNA, 20 nt, Human
uuccaugucgccucugcauu

SEQ ID NO: 2143761 - RNA, 13 nt, Human
uuccauuguguga

SEQ ID NO: 2143762 - RNA, 16 nt, Human
uuccccaacgaaaagc

SEQ ID NO: 2143763 - RNA, 18 nt, Human
uuccccaacgaaaagcac

SEQ ID NO: 2143764 - RNA, 18 nt, Human
uuccccaaccacuucauu

SEQ ID NO: 2143765 - RNA, 14 nt, Human
uucccauuuugcaa

SEQ ID NO: 2143766 - RNA, 17 nt, Human
uucccauuuugcaaaau

SEQ ID NO: 2143767 - RNA, 19 nt, Human
uucccauuuugcaaaauuu

SEQ ID NO: 2143768 - RNA, 13 nt, Human
uucccauuuugga

SEQ ID NO: 2143769 - RNA, 19 nt, Human
uuccaugucgccucugcau

SEQ ID NO: 2143770 - RNA, 18 nt, Human
uuccaugucgccucugca

SEQ ID NO: 2143771 - RNA, 16 nt, Human
uuccaugucgccucug

SEQ ID NO: 2143772 - RNA, 17 nt, Human
uuccaugucgccucugc

SEQ ID NO: 2143773 - RNA, 12 nt, Human
uuccaugaaugu

SEQ ID NO: 2143774 - RNA, 16 nt, Human
uuccaugaaggcagag

SEQ ID NO: 2143775 - RNA, 15 nt, Human
uuccaugaauguauc

SEQ ID NO: 2143776 - RNA, 20 nt, Human
uuccaugaauguaucaggaa

SEQ ID NO: 2143777 - RNA, 18 nt, Human
uuccaugacugcauuuua

SEQ ID NO: 2143778 - RNA, 18 nt, Human
uuccaugagaacagcagg

SEQ ID NO: 2143779 - RNA, 13 nt, Human
uuccaugaaaacg

SEQ ID NO: 2143780 - RNA, 15 nt, Human
uuccaugaaaacguu

SEQ ID NO: 2143781 - RNA, 22 nt, Human
uuccaugaaaacguuuuauugu

SEQ ID NO: 2143782 - RNA, 15 nt, Human
uuccaugaaaaugca

SEQ ID NO: 2143783 - RNA, 24 nt, Human
uuccaugaaaaugcaacaacaugu

SEQ ID NO: 2143784 - RNA, 18 nt, Human
uucaauucucauuuguca

SEQ ID NO: 2143785 - RNA, 16 nt, Human
uucaauuccucuggga

SEQ ID NO: 2143786 - RNA, 13 nt, Human
uucaauuccuggg

SEQ ID NO: 2143787 - RNA, 12 nt, Human
uucaauuccucu

SEQ ID NO: 2143788 - RNA, 19 nt, Human
uucaauucagugcuguacu

SEQ ID NO: 2143789 - RNA, 13 nt, Human
uucaauucagugc

SEQ ID NO: 2143790 - RNA, 23 nt, Human
uucaaugguuugcaaggaagcca

SEQ ID NO: 2143791 - RNA, 20 nt, Human
uucaaugguuugcaaggaag

SEQ ID NO: 2143792 - RNA, 22 nt, Human
uucaaugguuugcaaggaagcc

SEQ ID NO: 2143793 - RNA, 15 nt, Human
uucaacgcagcccug

SEQ ID NO: 2143794 - RNA, 14 nt, Human
uucaacgcagcccu

SEQ ID NO: 2143795 - RNA, 13 nt, Human
uucaacgcagccc

SEQ ID NO: 2143796 - RNA, 20 nt, Human
uucaaccauuccccauggga

SEQ ID NO: 2143797 - RNA, 17 nt, Human
uucaaccauuccccaug

SEQ ID NO: 2143798 - RNA, 23 nt, Human
uucaacagacccccucuagaaau

SEQ ID NO: 2143799 - RNA, 23 nt, Human
uucaaagccaaguuuauauacaa

SEQ ID NO: 2143800 - RNA, 13 nt, Human
uucaaauuucaca

SEQ ID NO: 2143801 - RNA, 16 nt, Human
uuauuuucuccugaua

SEQ ID NO: 2143802 - RNA, 17 nt, Human
uuauuuucuuugaaauu

SEQ ID NO: 2143803 - RNA, 12 nt, Human
uuauuuucuggu

SEQ ID NO: 2143804 - RNA, 21 nt, Human
uuauuuucugguagauagaaa

SEQ ID NO: 2143805 - RNA, 16 nt, Human
uuauuuuccuccccag

SEQ ID NO: 2143806 - RNA, 14 nt, Human
uuauuuuccucccc

SEQ ID NO: 2143807 - RNA, 15 nt, Human
uuauuuuccucccca

SEQ ID NO: 2143808 - RNA, 21 nt, Human
uucagagacucagggccccag

SEQ ID NO: 2143809 - RNA, 14 nt, Human
uucagacucagacu

SEQ ID NO: 2143810 - RNA, 15 nt, Human
uucagagacucaggg

SEQ ID NO: 2143811 - RNA, 20 nt, Human
uucagagacucagggcccca

SEQ ID NO: 2143812 - RNA, 13 nt, Human
uucagaccccagc

SEQ ID NO: 2143813 - RNA, 15 nt, Human
uucagaccccagcgg

SEQ ID NO: 2143814 - RNA, 12 nt, Human
uucagacucaga

SEQ ID NO: 2143815 - RNA, 13 nt, Human
uucagacucagac

SEQ ID NO: 2143816 - RNA, 19 nt, Human
uucacugaaguucuccuga

SEQ ID NO: 2143817 - RNA, 10 nt, Human
uucagacccc

SEQ ID NO: 2143818 - RNA, 23 nt, Human
uucaaucugaagauacaugucuu

SEQ ID NO: 2143819 - RNA, 13 nt, Human
uucaccccacccu

SEQ ID NO: 2143820 - RNA, 14 nt, Human
uucaccccacccuu

SEQ ID NO: 2143821 - RNA, 14 nt, Human
uucaauuccugggc

SEQ ID NO: 2143822 - RNA, 16 nt, Human
uucaauuccugggccc

SEQ ID NO: 2143823 - RNA, 16 nt, Human
uucaauucaaaaaugu

SEQ ID NO: 2143824 - RNA, 19 nt, Human
uucaauucaaaaauguaca

SEQ ID NO: 2143825 - RNA, 20 nt, Human
uucaauucaaaaauguacaa

SEQ ID NO: 2143826 - RNA, 14 nt, Human
uucacccacagaaa

SEQ ID NO: 2143827 - RNA, 16 nt, Human
uucacccacagaaaga

SEQ ID NO: 2143828 - RNA, 17 nt, Human
uucacccacagaaagag

SEQ ID NO: 2143829 - RNA, 19 nt, Human
uucacccacagaaagagag

SEQ ID NO: 2143830 - RNA, 15 nt, Human
uucacccagacagcu

SEQ ID NO: 2143831 - RNA, 23 nt, Human
uucagcuccagcucaccagcccc

SEQ ID NO: 2143832 - RNA, 16 nt, Human
uucagaggcugaggug

SEQ ID NO: 2143833 - RNA, 17 nt, Human
uucagagggaaaguaaa

SEQ ID NO: 2143834 - RNA, 17 nt, Human
uucagcucugcaagaau

SEQ ID NO: 2143835 - RNA, 24 nt, Human
uucagcucugcaagaauugaagca

SEQ ID NO: 2143836 - RNA, 21 nt, Human
uucagcugguugagguuucaa

SEQ ID NO: 2143837 - RNA, 19 nt, Human
uucagagguggcucuggaa

SEQ ID NO: 2143838 - RNA, 12 nt, Human
uucagcugcccc

SEQ ID NO: 2143839 - RNA, 17 nt, Human
uucagcugacuuuucug

SEQ ID NO: 2143840 - RNA, 15 nt, Human
uucaggcucuucucc

SEQ ID NO: 2143841 - RNA, 21 nt, Human
uucaggauacucugucagaug

SEQ ID NO: 2143842 - RNA, 17 nt, Human
uucaggagucccaagga

SEQ ID NO: 2143843 - RNA, 17 nt, Human
uucaggauacucuguca

SEQ ID NO: 2143844 - RNA, 18 nt, Human
uucaggacacucacuaca

SEQ ID NO: 2143845 - RNA, 14 nt, Human
uucaggaggcugga

SEQ ID NO: 2143846 - RNA, 23 nt, Human
uucagcugcccccgcucaugggc

SEQ ID NO: 2143847 - RNA, 16 nt, Human
uucagcugcuucucuu

SEQ ID NO: 2143848 - RNA, 13 nt, Human
uuuauugcuuguu

SEQ ID NO: 2143849 - RNA, 14 nt, Human
uuuauugcuacuuc

SEQ ID NO: 2143850 - RNA, 19 nt, Human
uuuauugcuguguaacacu

SEQ ID NO: 2143851 - RNA, 17 nt, Human
uuuauugcuugauacuu

SEQ ID NO: 2143852 - RNA, 15 nt, Human
uuuaugcaaggaagg

SEQ ID NO: 2143853 - RNA, 17 nt, Human
uuuaugcaaggaaggaa

SEQ ID NO: 2143854 - RNA, 18 nt, Human
uuuaugcaaggaaggaaa

SEQ ID NO: 2143855 - RNA, 12 nt, Human
uuuauucaaggu

SEQ ID NO: 2143856 - RNA, 19 nt, Human
uuuauucaagguaaaauuc

SEQ ID NO: 2143857 - RNA, 20 nt, Human
uuuauucaagguaaaauucu

SEQ ID NO: 2143858 - RNA, 17 nt, Human
uuuauuauuuucaccug

SEQ ID NO: 2143859 - RNA, 17 nt, Human
uuuauucaauuccucug

SEQ ID NO: 2143860 - RNA, 15 nt, Human
uuuauuuaucaguga

SEQ ID NO: 2143861 - RNA, 15 nt, Human
uuuauuuauacuauu

SEQ ID NO: 2143862 - RNA, 17 nt, Human
uuuauuguguuuuuaau

SEQ ID NO: 2143863 - RNA, 17 nt, Human
uuuauaaaauuaaagaa

SEQ ID NO: 2143864 - RNA, 18 nt, Human
uuuauaaaauuaaagaaa

SEQ ID NO: 2143865 - RNA, 19 nt, Human
uuuauaaaauuaaagaaaa

SEQ ID NO: 2143866 - RNA, 20 nt, Human
uuuauaaaauuaaagaaaau

SEQ ID NO: 2143867 - RNA, 21 nt, Human
uuuagagauaagaguuggcug

SEQ ID NO: 2143868 - RNA, 18 nt, Human
uuuagaguagcaugagag

SEQ ID NO: 2143869 - RNA, 21 nt, Human
uuuaugaaaugguuaagaauu

SEQ ID NO: 2143870 - RNA, 18 nt, Human
uuuaugaagaaaaaauac

SEQ ID NO: 2143871 - RNA, 19 nt, Human
uuuaugaagaaaaaauaca

SEQ ID NO: 2143872 - RNA, 12 nt, Human
uuuaugaagaaa

SEQ ID NO: 2143873 - RNA, 22 nt, Human
uuuaugaagaaaaaauacauuu

SEQ ID NO: 2143874 - RNA, 17 nt, Human
uuuaugaaggcaaaaaa

SEQ ID NO: 2143875 - RNA, 22 nt, Human
uuuaugauauuuuuuuaagucu

SEQ ID NO: 2143876 - RNA, 19 nt, Human
uuuaugauuuacucauuau

SEQ ID NO: 2143877 - RNA, 13 nt, Human
uuuaucuauugua

SEQ ID NO: 2143878 - RNA, 14 nt, Human
uuuaucuauuguaa

SEQ ID NO: 2143879 - RNA, 16 nt, Human
uuuaucuauuguaaga

SEQ ID NO: 2143880 - RNA, 17 nt, Human
uuuaucuauuguaagau

SEQ ID NO: 2143881 - RNA, 20 nt, Human
uuuaucuauuguaagauaaa

SEQ ID NO: 2143882 - RNA, 12 nt, Human
uuuaucuuuucu

SEQ ID NO: 2143883 - RNA, 15 nt, Human
uuuaucuuuucuaca

SEQ ID NO: 2143884 - RNA, 16 nt, Human
uuuaucuuuucuacag

SEQ ID NO: 2143885 - RNA, 21 nt, Human
uuuaucuuuucuacagcaaau

SEQ ID NO: 2143886 - RNA, 19 nt, Human
uuuaugaaagguuuacauu

SEQ ID NO: 2143887 - RNA, 18 nt, Human
uuuaugaaagguuuacau

SEQ ID NO: 2143888 - RNA, 13 nt, Human
uuuaugaaaagag

SEQ ID NO: 2143889 - RNA, 23 nt, Human
uuguauuuaaaugaaagugagac

SEQ ID NO: 2143890 - RNA, 19 nt, Human
uuuacaagaaaaaaugaau

SEQ ID NO: 2143891 - RNA, 21 nt, Human
uuuacaagaaaaaaugaauuu

SEQ ID NO: 2143892 - RNA, 13 nt, Human
uuuaaucuucagu

SEQ ID NO: 2143893 - RNA, 14 nt, Human
uuuaauccagaauu

SEQ ID NO: 2143894 - RNA, 21 nt, Human
uuuaauccagaauugaccuuu

SEQ ID NO: 2143895 - RNA, 15 nt, Human
uuuacaauugaaaug

SEQ ID NO: 2143896 - RNA, 16 nt, Human
uuuacaauugaaauga

SEQ ID NO: 2143897 - RNA, 23 nt, Human
uuuacaauuguaaaacugaggca

SEQ ID NO: 2143898 - RNA, 21 nt, Human
uuuacaaucagccacauucua

SEQ ID NO: 2143899 - RNA, 19 nt, Human
uuuacaugggguuuucaau

SEQ ID NO: 2143900 - RNA, 13 nt, Human
uuuacuuugaauu

SEQ ID NO: 2143901 - RNA, 15 nt, Human
uuuacuuuguguuca

SEQ ID NO: 2143902 - RNA, 18 nt, Human
uuuacaugggguuuucaa

SEQ ID NO: 2143903 - RNA, 22 nt, Human
uuuagaaugaugcacauuucau

SEQ ID NO: 2143904 - RNA, 22 nt, Human
uuuagagauaagaguuggcugg

SEQ ID NO: 2143905 - RNA, 21 nt, Human
uuuagagaugaauuaaauuua

SEQ ID NO: 2143906 - RNA, 15 nt, Human
uuuagaacagaaaac

SEQ ID NO: 2143907 - RNA, 16 nt, Human
uuuagaacagaaaaca

SEQ ID NO: 2143908 - RNA, 17 nt, Human
uuuagaacagaaaacaa

SEQ ID NO: 2143909 - RNA, 18 nt, Human
uuuagaacagaaaacaac

SEQ ID NO: 2143910 - RNA, 22 nt, Human
uuuagaacagaaaacaacaaaa

SEQ ID NO: 2143911 - RNA, 23 nt, Human
uuuagaacagaaaacaacaaaaa

SEQ ID NO: 2143912 - RNA, 11 nt, Human
uuuagaaacuu

SEQ ID NO: 2143913 - RNA, 16 nt, Human
uuuagaaacuuaucuu

SEQ ID NO: 2143914 - RNA, 19 nt, Human
uuuagaaacuuaucuuaca

SEQ ID NO: 2143915 - RNA, 20 nt, Human
uuuagaaacuuaucuuacaa

SEQ ID NO: 2143916 - RNA, 13 nt, Human
uuucagacugcuu

SEQ ID NO: 2143917 - RNA, 15 nt, Human
uuucagacugcuuua

SEQ ID NO: 2143918 - RNA, 13 nt, Human
uuucagagccucc

SEQ ID NO: 2143919 - RNA, 13 nt, Human
uuuauuucuuaaa

SEQ ID NO: 2143920 - RNA, 20 nt, Human
uuuauuuguuugugcauuug

SEQ ID NO: 2143921 - RNA, 14 nt, Human
uuuauuuaucagug

SEQ ID NO: 2143922 - RNA, 14 nt, Human
uuuauuuauuaaga

SEQ ID NO: 2143923 - RNA, 13 nt, Human
uuucauugccagu

SEQ ID NO: 2143924 - RNA, 16 nt, Human
uuucauugccaguguc

SEQ ID NO: 2143925 - RNA, 18 nt, Human
uuucauugccagugucuu

SEQ ID NO: 2143926 - RNA, 19 nt, Human
uuucauugccagugucuuu

SEQ ID NO: 2143927 - RNA, 15 nt, Human
uuuccaaauucacaa

SEQ ID NO: 2143928 - RNA, 22 nt, Human
uuucaggaggcuggaggaaggg

SEQ ID NO: 2143929 - RNA, 13 nt, Human
uuucaggauacuc

SEQ ID NO: 2143930 - RNA, 16 nt, Human
uuucaggauacucugu

SEQ ID NO: 2143931 - RNA, 19 nt, Human
uuucaggauacucugucag

SEQ ID NO: 2143932 - RNA, 20 nt, Human
uuucaggauacucugucaga

SEQ ID NO: 2143933 - RNA, 21 nt, Human
uuucaggauacucugucagau

SEQ ID NO: 2143934 - RNA, 21 nt, Human
uuucaggggucgucaccaccu

SEQ ID NO: 2143935 - RNA, 22 nt, Human
uuucagggagguggcuggguuu

SEQ ID NO: 2143936 - RNA, 19 nt, Human
uuucagggagguggcuggg

SEQ ID NO: 2143937 - RNA, 22 nt, Human
uuucauugcugggcuugucugu

SEQ ID NO: 2143938 - RNA, 22 nt, Human
uuucauugacuaucaaacugaa

SEQ ID NO: 2143939 - RNA, 21 nt, Human
uuucauugauaugaaaaauau

SEQ ID NO: 2143940 - RNA, 22 nt, Human
uuucauugauaugaaaaauaug

SEQ ID NO: 2143941 - RNA, 13 nt, Human
uuuccugagcuug

SEQ ID NO: 2143942 - RNA, 18 nt, Human
uuuccugagcuuggccag

SEQ ID NO: 2143943 - RNA, 22 nt, Human
uuuccugagcuuggccagaagg

SEQ ID NO: 2143944 - RNA, 19 nt, Human
uuucuaaaggccucuuccu

SEQ ID NO: 2143945 - RNA, 22 nt, Human
uuucuaacacuagucugugugc

SEQ ID NO: 2143946 - RNA, 16 nt, Human
uuucuaacucugaugu

SEQ ID NO: 2143947 - RNA, 18 nt, Human
uuucuaacucugauguaa

SEQ ID NO: 2143948 - RNA, 20 nt, Human
uuucuaacucugauguaaau

SEQ ID NO: 2143949 - RNA, 21 nt, Human
uuucuaacucugauguaaaug

SEQ ID NO: 2143950 - RNA, 22 nt, Human
uuucuaacucugauguaaauga

SEQ ID NO: 2143951 - RNA, 23 nt, Human
uuuccugacagaaggacucaggu

SEQ ID NO: 2143952 - RNA, 15 nt, Human
uuuccuacuuuuccu

SEQ ID NO: 2143953 - RNA, 20 nt, Human
uuuccuacuuuuccuucccu

SEQ ID NO: 2143954 - RNA, 21 nt, Human
uuucuagcuguugagcuguuu

SEQ ID NO: 2143955 - RNA, 19 nt, Human
uuucuagcuguugagcugu

SEQ ID NO: 2143956 - RNA, 18 nt, Human
uuucuagcuaauggaaaa

SEQ ID NO: 2143957 - RNA, 13 nt, Human
uuucucuugggcu

SEQ ID NO: 2143958 - RNA, 21 nt, Human
uuucucuugggcugagacugg

SEQ ID NO: 2143959 - RNA, 12 nt, Human
uuucucuugggc

SEQ ID NO: 2143960 - RNA, 13 nt, Human
uuucuccuaucuu

SEQ ID NO: 2143961 - RNA, 19 nt, Human
uuucuccuuagucuucuca

SEQ ID NO: 2143962 - RNA, 20 nt, Human
uuucuccuuagucuucucau

SEQ ID NO: 2143963 - RNA, 16 nt, Human
uuucugagaagguccu

SEQ ID NO: 2143964 - RNA, 19 nt, Human
uuucugagaagguccuuaa

SEQ ID NO: 2143965 - RNA, 14 nt, Human
uuucucuuucuccu

SEQ ID NO: 2143966 - RNA, 12 nt, Human
uuucucuuucuc

SEQ ID NO: 2143967 - RNA, 20 nt, Human
uuuucacugcuggcugccuu

SEQ ID NO: 2143968 - RNA, 19 nt, Human
uuuucacugcuggcugccu

SEQ ID NO: 2143969 - RNA, 18 nt, Human
uuuucaauuuugcaugcu

SEQ ID NO: 2143970 - RNA, 23 nt, Human
uuuucacacaauacaauaaguua

SEQ ID NO: 2143971 - RNA, 14 nt, Human
uuuucaauuuugca

SEQ ID NO: 2143972 - RNA, 17 nt, Human
uuuucaauucaaaaaug

SEQ ID NO: 2143973 - RNA, 18 nt, Human
uuuucaauucaaaaaugu

SEQ ID NO: 2143974 - RNA, 20 nt, Human
uuuucaauucaaaaauguac

SEQ ID NO: 2143975 - RNA, 22 nt, Human
uuuucaauucaaaaauguacaa

SEQ ID NO: 2143976 - RNA, 16 nt, Human
uuuucaauauuuauua

SEQ ID NO: 2143977 - RNA, 14 nt, Human
uuuucaauauuuau

SEQ ID NO: 2143978 - RNA, 11 nt, Human
uuuuaugauau

SEQ ID NO: 2143979 - RNA, 18 nt, Human
uuuuaugagcucauguag

SEQ ID NO: 2143980 - RNA, 21 nt, Human
uuuuaugagcucauguagcaa

SEQ ID NO: 2143981 - RNA, 22 nt, Human
uuuuaugagcucauguagcaau

SEQ ID NO: 2143982 - RNA, 22 nt, Human
uuuucaacgcagcccugcuuug

SEQ ID NO: 2143983 - RNA, 21 nt, Human
uuuucaacgcagcccugcuuu

SEQ ID NO: 2143984 - RNA, 17 nt, Human
uuuucaacgcagcccug

SEQ ID NO: 2143985 - RNA, 18 nt, Human
uuuucaagcaucuccuga

SEQ ID NO: 2143986 - RNA, 21 nt, Human
uuuucaagcaucuccugagga

SEQ ID NO: 2143987 - RNA, 22 nt, Human
uuuucaagcaucuccugaggau

SEQ ID NO: 2143988 - RNA, 14 nt, Human
uuuucuucucccuc

SEQ ID NO: 2143989 - RNA, 19 nt, Human
uuuucgaagcucagcccac

SEQ ID NO: 2143990 - RNA, 16 nt, Human
uuuucguuaacauuga

SEQ ID NO: 2143991 - RNA, 12 nt, Human
uuuucguuuguu

SEQ ID NO: 2143992 - RNA, 21 nt, Human
uuuuaugaggagugaacauuu

SEQ ID NO: 2143993 - RNA, 16 nt, Human
uuuuccauugguuuac

SEQ ID NO: 2143994 - RNA, 13 nt, Human
uuuucccaauaaa

SEQ ID NO: 2143995 - RNA, 14 nt, Human
uuuucccaauaaau

SEQ ID NO: 2143996 - RNA, 21 nt, Human
uuuucccaauagcacuuucau

SEQ ID NO: 2143997 - RNA, 19 nt, Human
uuuuccuccgggagagggg

SEQ ID NO: 2143998 - RNA, 16 nt, Human
uuuuauccaaucuugu

SEQ ID NO: 2143999 - RNA, 19 nt, Human
uuuuauauagcuugaaaca

SEQ ID NO: 2144000 - RNA, 18 nt, Human
uuuuacugucuuaauuaa

SEQ ID NO: 2144001 - RNA, 22 nt, Human
uuuuacugucuuaauuaaguaa

SEQ ID NO: 2144002 - RNA, 14 nt, Human
uuuuacuuagcaau

SEQ ID NO: 2144003 - RNA, 22 nt, Human
uuuuacuugcauugaauauauu

SEQ ID NO: 2144004 - RNA, 15 nt, Human
uuuuacugcuuuuaa

SEQ ID NO: 2144005 - RNA, 23 nt, Human
uuuuacugcuuuuaacuucugau

SEQ ID NO: 2144006 - RNA, 14 nt, Human
uuuguguuguuuga

SEQ ID NO: 2144007 - RNA, 23 nt, Human
uuuuaauuuaugaguuuuugaua

SEQ ID NO: 2144008 - RNA, 21 nt, Human
uuuuaauuuauuuauacuauu

SEQ ID NO: 2144009 - RNA, 16 nt, Human
uuuuacagcugccugc

SEQ ID NO: 2144010 - RNA, 21 nt, Human
uuuuaauuuuguaaaggugaa

SEQ ID NO: 2144011 - RNA, 22 nt, Human
uuuuaauuuuguaaaggugaaa

SEQ ID NO: 2144012 - RNA, 13 nt, Human
uuuuaauuuugua

SEQ ID NO: 2144013 - RNA, 10 nt, Human
uuuuacaaaa

SEQ ID NO: 2144014 - RNA, 15 nt, Human
uuuuaauuugaugaa

SEQ ID NO: 2144015 - RNA, 19 nt, Human
uuuuaauuugaugaaagcu

SEQ ID NO: 2144016 - RNA, 20 nt, Human
uuuuaauuugaugaaagcug

SEQ ID NO: 2144017 - RNA, 21 nt, Human
uuuuaauuugaugaaagcuga

SEQ ID NO: 2144018 - RNA, 12 nt, Human
uuuuaauuuugu

SEQ ID NO: 2144019 - RNA, 22 nt, Human
uuuuaauuuauuuauuaagaug

SEQ ID NO: 2144020 - RNA, 13 nt, Human
uuuuaauuugaua

SEQ ID NO: 2144021 - RNA, 15 nt, Human
uuuuacuacugugga

SEQ ID NO: 2144022 - RNA, 13 nt, Human
uuuuacuccccuu

SEQ ID NO: 2144023 - RNA, 17 nt, Human
uuuuaccaaguuauaua

SEQ ID NO: 2144024 - RNA, 21 nt, Human
uuuuaccaaguuauauaaaga

SEQ ID NO: 2144025 - RNA, 15 nt, Human
uuuuacauacugcug

SEQ ID NO: 2144026 - RNA, 16 nt, Human
uuuuacauacugcugu

SEQ ID NO: 2144027 - RNA, 22 nt, Human
uuugccaugacaacuucuaauu

SEQ ID NO: 2144028 - RNA, 16 nt, Human
uuugccagugggaacu

SEQ ID NO: 2144029 - RNA, 15 nt, Human
uuugccagugggaac

SEQ ID NO: 2144030 - RNA, 18 nt, Human
uuugccauguuggccagg

SEQ ID NO: 2144031 - RNA, 14 nt, Human
uuugcagacaggca

SEQ ID NO: 2144032 - RNA, 17 nt, Human
uuugcacuguaugcugg

SEQ ID NO: 2144033 - RNA, 22 nt, Human
uuugagucccuuccaggccauc

SEQ ID NO: 2144034 - RNA, 18 nt, Human
uuugauaguauugugcau

SEQ ID NO: 2144035 - RNA, 15 nt, Human
uuugauacuuguuca

SEQ ID NO: 2144036 - RNA, 19 nt, Human
uuugcagaaaagcaccugc

SEQ ID NO: 2144037 - RNA, 20 nt, Human
uuugcagaaaagcaccugcc

SEQ ID NO: 2144038 - RNA, 22 nt, Human
uuugcagaaaagcaccugccga

SEQ ID NO: 2144039 - RNA, 14 nt, Human
uuugcagaaacaga

SEQ ID NO: 2144040 - RNA, 21 nt, Human
uuugcagcagugagucucuuc

SEQ ID NO: 2144041 - RNA, 16 nt, Human
uuucugaggagaaaca

SEQ ID NO: 2144042 - RNA, 18 nt, Human
uuucugaggagaaacaaa

SEQ ID NO: 2144043 - RNA, 15 nt, Human
uuugagcagggcuca

SEQ ID NO: 2144044 - RNA, 19 nt, Human
uuugagcuuagugaaauua

SEQ ID NO: 2144045 - RNA, 19 nt, Human
uuugauacauaugugaaua

SEQ ID NO: 2144046 - RNA, 16 nt, Human
uuugauacauauguga

SEQ ID NO: 2144047 - RNA, 16 nt, Human
uuuguugucagcugaa

SEQ ID NO: 2144048 - RNA, 16 nt, Human
uuuguuaacuuugggu

SEQ ID NO: 2144049 - RNA, 18 nt, Human
uuuguuaaauauuuacau

SEQ ID NO: 2144050 - RNA, 22 nt, Human
uuuguuaaauauuuacauauga

SEQ ID NO: 2144051 - RNA, 21 nt, Human
uuuguuaaaacuggcaucuga

SEQ ID NO: 2144052 - RNA, 17 nt, Human
uuuguuaaauauuuaca

SEQ ID NO: 2144053 - RNA, 12 nt, Human
uuugucauuuug

SEQ ID NO: 2144054 - RNA, 14 nt, Human
uuugucauuuugaa

SEQ ID NO: 2144055 - RNA, 17 nt, Human
uuugucauuuugaagcu

SEQ ID NO: 2144056 - RNA, 19 nt, Human
uuugucauuuugaagcuaa

SEQ ID NO: 2144057 - RNA, 20 nt, Human
uuugucauuuugaagcuaau

SEQ ID NO: 2144058 - RNA, 19 nt, Human
uuuguguucuguuuguuaa

SEQ ID NO: 2144059 - RNA, 21 nt, Human
uuuguguuguuggaaaaaguc

SEQ ID NO: 2144060 - RNA, 20 nt, Human
uuuguguuguuggaaaaagu

SEQ ID NO: 2144061 - RNA, 12 nt, Human
uuuguguucugu

SEQ ID NO: 2144062 - RNA, 16 nt, Human
uuugucccacagcuug

SEQ ID NO: 2144063 - RNA, 14 nt, Human
uuugucagacuuua

SEQ ID NO: 2144064 - RNA, 23 nt, Human
uuugucacaauccuaacacauua

SEQ ID NO: 2144065 - RNA, 17 nt, Human
uuugucaaugacaguuu

SEQ ID NO: 2144066 - RNA, 16 nt, Human
uuuguauaguaaagug

SEQ ID NO: 2144067 - RNA, 16 nt, Human
uuugucaaacuguaga

SEQ ID NO: 2144068 - RNA, 17 nt, Human
uuugucaaacuguagaa

SEQ ID NO: 2144069 - RNA, 23 nt, Human
uuugucaaacuguagaaaugaug

SEQ ID NO: 2144070 - RNA, 11 nt, Human
uuugucaauga

SEQ ID NO: 2144071 - RNA, 13 nt, Human
uuuguauaaaaug

SEQ ID NO: 2144072 - RNA, 13 nt, Human
uuuggaauaaagu

SEQ ID NO: 2144073 - RNA, 18 nt, Human
uuuggaaguuuguguucu

SEQ ID NO: 2144074 - RNA, 14 nt, Human
uuuggaaguuuuca

SEQ ID NO: 2144075 - RNA, 13 nt, Human
uuuggaaucuaga

SEQ ID NO: 2144076 - RNA, 14 nt, Human
uuuggaaucuagaa

SEQ ID NO: 2144077 - RNA, 15 nt, Human
uuugguuaaguuggc

SEQ ID NO: 2144078 - RNA, 19 nt, Human
uuugguuaaguuggcuucu

SEQ ID NO: 2144079 - RNA, 22 nt, Human
uuugguuaaguuggcuucuguu

SEQ ID NO: 2144080 - RNA, 11 nt, Human
uuuuuucuacc

SEQ ID NO: 2144081 - RNA, 15 nt, Human
uuuuuuauguuuugu

SEQ ID NO: 2144082 - RNA, 13 nt, Human
uuuuuucguuugu

SEQ ID NO: 2144083 - RNA, 11 nt, Human
uuuuuuauucu

SEQ ID NO: 2144084 - RNA, 14 nt, Human
uuuuuuauucuugu

SEQ ID NO: 2144085 - RNA, 12 nt, Human
uuuuuuaucuuu

SEQ ID NO: 2144086 - RNA, 13 nt, Human
uuuuuuaucuuuu

SEQ ID NO: 2144087 - RNA, 11 nt, Human
uuuuuuauaca

SEQ ID NO: 2144088 - RNA, 13 nt, Human
uuuuuuagaacag

SEQ ID NO: 2144089 - RNA, 12 nt, Human
uuuugaaaaggc

SEQ ID NO: 2144090 - RNA, 22 nt, Human
uuuugaaauauuaaacccugga

SEQ ID NO: 2144091 - RNA, 18 nt, Human
uuuugaaaacuacauuuu

SEQ ID NO: 2144092 - RNA, 23 nt, Human
uuuugaaaacuacauuuuaacau

SEQ ID NO: 2144093 - RNA, 21 nt, Human
uuuucuugccaaugaggucug

SEQ ID NO: 2144094 - RNA, 12 nt, Human
uuuuuugaaaac

SEQ ID NO: 2144095 - RNA, 21 nt, Human
gacuggcuguccuuuccagug

SEQ ID NO: 2144096 - RNA, 13 nt, Human
gacuguagaagaa

SEQ ID NO: 2144097 - RNA, 22 nt, Human
gacaucuuaguauuugcauauu

SEQ ID NO: 2144098 - RNA, 18 nt, Human
gaugauuaauucaccuuc

SEQ ID NO: 2144099 - RNA, 21 nt, Human
gaucacgagaucaagagauca

SEQ ID NO: 2144100 - RNA, 23 nt, Human
gaagagacguuuaaaagccauca

SEQ ID NO: 2144101 - RNA, 16 nt, Human
gacaucucuuugaugu

SEQ ID NO: 2144102 - RNA, 16 nt, Human
gaccaggacaggacca

SEQ ID NO: 2144103 - RNA, 14 nt, Human
gaccauagugacca

SEQ ID NO: 2144104 - RNA, 13 nt, Human
gacuaugaauauu

SEQ ID NO: 2144105 - RNA, 17 nt, Human
gaccucaccauuuuugu

SEQ ID NO: 2144106 - RNA, 14 nt, Human
gaccucagagucca

SEQ ID NO: 2144107 - RNA, 19 nt, Human
gaccucggugggcccagug

SEQ ID NO: 2144108 - RNA, 22 nt, Human
gaggcagggccuugcccagaga

SEQ ID NO: 2144109 - RNA, 15 nt, Human
gagucacugccucuc

SEQ ID NO: 2144110 - RNA, 20 nt, Human
gcuaauuuuucauuuuuagu

SEQ ID NO: 2144111 - RNA, 14 nt, Human
gcccaggagagcca

SEQ ID NO: 2144112 - RNA, 11 nt, Human
gcauuuuuaga

SEQ ID NO: 2144113 - RNA, 13 nt, Human
gcauaugucuaua

SEQ ID NO: 2144114 - RNA, 17 nt, Human
gaugcauguacccuaag

SEQ ID NO: 2144115 - RNA, 17 nt, Human
gauugauuaccuaguag

SEQ ID NO: 2144116 - RNA, 12 nt, Human
gcaauaaaaauc

SEQ ID NO: 2144117 - RNA, 18 nt, Human
cuguguuuuugaaauauu

SEQ ID NO: 2144118 - RNA, 17 nt, Human
cuguuguguuguuguua

SEQ ID NO: 2144119 - RNA, 16 nt, Human
cuugaguuuuguuuua

SEQ ID NO: 2144120 - RNA, 21 nt, Human
cuuguugacacggccaugacc

SEQ ID NO: 2144121 - RNA, 15 nt, Human
cuuuacuguuuguua

SEQ ID NO: 2144122 - RNA, 19 nt, Human
gaaaagaguugggaacuuc

SEQ ID NO: 2144123 - RNA, 15 nt, Human
gaaaaugaaccauuc

SEQ ID NO: 2144124 - RNA, 17 nt, Human
gaaauuaccaaaauguc

SEQ ID NO: 2144125 - RNA, 14 nt, Human
gaaauuuguuauaa

SEQ ID NO: 2144126 - RNA, 23 nt, Human
cugggcugccaugugaagaggga

SEQ ID NO: 2144127 - RNA, 15 nt, Human
gcgagucacugccuc

SEQ ID NO: 2144128 - RNA, 19 nt, Human
gcuaaaaccaucauaguac

SEQ ID NO: 2144129 - RNA, 19 nt, Human
gcuaagaagggaaaauauc

SEQ ID NO: 2144130 - RNA, 14 nt, Human
uuauuuuaaaauuu

SEQ ID NO: 2144131 - RNA, 18 nt, Human
uuacuguggccaguauuu

SEQ ID NO: 2144132 - RNA, 18 nt, Human
uuauacccguuucacaug

SEQ ID NO: 2144133 - RNA, 21 nt, Human
uuauacgauaaauaacuuuuu

SEQ ID NO: 2144134 - RNA, 13 nt, Human
uuaacaucuuuuu

SEQ ID NO: 2144135 - RNA, 12 nt, Human
uggucacagaga

SEQ ID NO: 2144136 - RNA, 14 nt, Human
uguauaaauaugua

SEQ ID NO: 2144137 - RNA, 23 nt, Human
uguaugacuaaagagagaaugua

SEQ ID NO: 2144138 - RNA, 15 nt, Human
uguauuuuauuuuuu

SEQ ID NO: 2144139 - RNA, 16 nt, Human
ugucuuccauaaugua

SEQ ID NO: 2144140 - RNA, 19 nt, Human
guauccuuccaauuuggaa

SEQ ID NO: 2144141 - RNA, 16 nt, Human
gucuagggagagaccc

SEQ ID NO: 2144142 - RNA, 17 nt, Human
guuaucuggcuucaaau

SEQ ID NO: 2144143 - RNA, 17 nt, Human
uaaauaucaaucauuuu

SEQ ID NO: 2144144 - RNA, 23 nt, Human
uaaauauuuacauaugaaauuua

SEQ ID NO: 2144145 - RNA, 18 nt, Human
uaacaacaccuucagagg

SEQ ID NO: 2144146 - RNA, 14 nt, Human
guuuccuuuuauga

SEQ ID NO: 2144147 - RNA, 20 nt, Human
uagccugccucuucucuacu

SEQ ID NO: 2144148 - RNA, 20 nt, Human
uacagccaggcccagagcaa

SEQ ID NO: 2144149 - RNA, 16 nt, Human
uaaggcaggacagaga

SEQ ID NO: 2144150 - RNA, 17 nt, Human
uacaauauuuaaaauuu

SEQ ID NO: 2144151 - RNA, 16 nt, Human
ucaaagagguuuuaaa

SEQ ID NO: 2144152 - RNA, 17 nt, Human
ucaauucauaucuauuu

SEQ ID NO: 2144153 - RNA, 19 nt, Human
ucauaggaaaguauuuuuu

SEQ ID NO: 2144154 - RNA, 22 nt, Human
uauacuguacuuaauaaauuca

SEQ ID NO: 2144155 - RNA, 22 nt, Human
uaggguuauaauaauguuaaca

SEQ ID NO: 2144156 - RNA, 23 nt, Human
uaguaccccaagaagaaaauguu

SEQ ID NO: 2144157 - RNA, 19 nt, Human
uaguauauuaaaaauggua

SEQ ID NO: 2144158 - RNA, 14 nt, Human
ucuucuaaucuuuu

SEQ ID NO: 2144159 - RNA, 17 nt, Human
ucuuucagggauuuuuu

SEQ ID NO: 2144160 - RNA, 19 nt, Human
ucucucuccuguacuuuuu

SEQ ID NO: 2144161 - RNA, 12 nt, Human
ugaugaagaaaa

SEQ ID NO: 2144162 - RNA, 20 nt, Human
ugaauaagacaacaaagaga

SEQ ID NO: 2144163 - RNA, 16 nt, Human
ugaauauuauaguauu

SEQ ID NO: 2144164 - RNA, 17 nt, Human
ugcagauaucacagagg

SEQ ID NO: 2144165 - RNA, 13 nt, Human
ugcauaaaauguu

SEQ ID NO: 2144166 - RNA, 14 nt, Human
ugggaagacaugaa

SEQ ID NO: 2144167 - RNA, 23 nt, Human
ugggauguccacagaugccucca

SEQ ID NO: 2144168 - RNA, 19 nt, Human
uggugaucaauuaaaugua

SEQ ID NO: 2144169 - RNA, 13 nt, Human
uggacaaagcguu

SEQ ID NO: 2144170 - RNA, 20 nt, Human
uggagccuccacugccucug

SEQ ID NO: 2144171 - RNA, 16 nt, Human
uggcuagucagagaga

SEQ ID NO: 2144172 - RNA, 12 nt, Human
gcugcuccagug

SEQ ID NO: 2144173 - RNA, 15 nt, Human
ggagcauggggauaa

SEQ ID NO: 2144174 - RNA, 14 nt, Human
ggcagggugauaaa

SEQ ID NO: 2144175 - RNA, 18 nt, Human
gggacuauuacauccaca

SEQ ID NO: 2144176 - RNA, 16 nt, Human
ggccuuugcuuaugaa

SEQ ID NO: 2144177 - RNA, 23 nt, Human
gcuguguucuugccacugcacuc

SEQ ID NO: 2144178 - RNA, 10 nt, Human
gcuuccacau

SEQ ID NO: 2144179 - RNA, 16 nt, Human
ggaaaauauguccaua

SEQ ID NO: 2144180 - RNA, 14 nt, Human
ggagaaggcaugaa

SEQ ID NO: 2144181 - RNA, 18 nt, Human
ggaaucuucucuuugaca

SEQ ID NO: 2144182 - RNA, 19 nt, Human
ggacucaaguuucuucaau

SEQ ID NO: 2144183 - RNA, 15 nt, Human
gguguuuaguugcag

SEQ ID NO: 2144184 - RNA, 14 nt, Human
gcugggagcucugc

SEQ ID NO: 2144185 - RNA, 17 nt, Human
ggacggcauuccugcuu

SEQ ID NO: 2144186 - RNA, 17 nt, Human
aaugaauaguuuuucau

SEQ ID NO: 2144187 - RNA, 15 nt, Human
aauguacaacuuuuu

SEQ ID NO: 2144188 - RNA, 21 nt, Human
aagucuucaagggcugcuuca

SEQ ID NO: 2144189 - RNA, 22 nt, Human
acaaauugcuugaaagaaaaua

SEQ ID NO: 2144190 - RNA, 20 nt, Human
acaacacacacuguucugaa

SEQ ID NO: 2144191 - RNA, 17 nt, Human
acacaacaaaaauuuga

SEQ ID NO: 2144192 - RNA, 14 nt, Human
acacacagcucugu

SEQ ID NO: 2144193 - RNA, 20 nt, Human
aauuacuaaauuacaaaugc

SEQ ID NO: 2144194 - RNA, 13 nt, Human
aauugcauuuuuu

SEQ ID NO: 2144195 - RNA, 21 nt, Human
aauuuugggguaagacuuuuu

SEQ ID NO: 2144196 - RNA, 16 nt, Human
aaguguaaauccuuuu

SEQ ID NO: 2144197 - RNA, 17 nt, Human
aauaaaguguuuucaga

SEQ ID NO: 2144198 - RNA, 22 nt, Human
aauacauggauaacacauuuga

SEQ ID NO: 2144199 - RNA, 20 nt, Human
aauacgccagaacugcuuua

SEQ ID NO: 2144200 - RNA, 17 nt, Human
aauagcaacaugcuuca

SEQ ID NO: 2144201 - RNA, 13 nt, Human
aauauuguacagu

SEQ ID NO: 2144202 - RNA, 18 nt, Human
aauauuuccuuaaacugu

SEQ ID NO: 2144203 - RNA, 18 nt, Human
aaucaugaaagcaucuga

SEQ ID NO: 2144204 - RNA, 17 nt, Human
agccugaggcugagacu

SEQ ID NO: 2144205 - RNA, 15 nt, Human
agcugggaccacagg

SEQ ID NO: 2144206 - RNA, 14 nt, Human
agcugguuuuuagc

SEQ ID NO: 2144207 - RNA, 16 nt, Human
aguaacuugucuuaaa

SEQ ID NO: 2144208 - RNA, 19 nt, Human
aggucgggcucagcucugg

SEQ ID NO: 2144209 - RNA, 21 nt, Human
agucacauucuuguuuuaagu

SEQ ID NO: 2144210 - RNA, 23 nt, Human
agucuauaugacuucagaaaugu

SEQ ID NO: 2144211 - RNA, 23 nt, Human
agucucuagguucugagcucugg

SEQ ID NO: 2144212 - RNA, 19 nt, Human
agccuagaagagcuucuga

SEQ ID NO: 2144213 - RNA, 23 nt, Human
agcaagugagacccugucucaaa

SEQ ID NO: 2144214 - RNA, 16 nt, Human
agauuauuuuuuauga

SEQ ID NO: 2144215 - RNA, 16 nt, Human
agagauagaaccugga

SEQ ID NO: 2144216 - RNA, 20 nt, Human
agagcuuucuucccgaaccc

SEQ ID NO: 2144217 - RNA, 21 nt, Human
agauaucacagaggccuauaa

SEQ ID NO: 2144218 - RNA, 23 nt, Human
agauaucuugaaaugaaaguaua

SEQ ID NO: 2144219 - RNA, 15 nt, Human
agaccagagcucugg

SEQ ID NO: 2144220 - RNA, 22 nt, Human
agaauugaucauuuucccccca

SEQ ID NO: 2144221 - RNA, 23 nt, Human
agaaaugacuuugaaaaccuggc

SEQ ID NO: 2144222 - RNA, 23 nt, Human
agaaaugaugauguggaagaacu

SEQ ID NO: 2144223 - RNA, 19 nt, Human
agaaauaaagagaagauau

SEQ ID NO: 2144224 - RNA, 20 nt, Human
aaacagcagaacuucugaaa

SEQ ID NO: 2144225 - RNA, 18 nt, Human
aaacauuuugucauauaa

SEQ ID NO: 2144226 - RNA, 17 nt, Human
aaaccagggagccccuu

SEQ ID NO: 2144227 - RNA, 13 nt, Human
aaaauaaaauaua

SEQ ID NO: 2144228 - RNA, 22 nt, Human
aaaauuauaucucaguaaacuu

SEQ ID NO: 2144229 - RNA, 12 nt, Human
aaaauucagaga

SEQ ID NO: 2144230 - RNA, 14 nt, Human
aaauaauuuuauga

SEQ ID NO: 2144231 - RNA, 23 nt, Human
aaauaugaaacauuuaaaauaua

SEQ ID NO: 2144232 - RNA, 16 nt, Human
aaauauuuggaaaaua

SEQ ID NO: 2144233 - RNA, 17 nt, Human
acuagcuggaauuuuuu

SEQ ID NO: 2144234 - RNA, 20 nt, Human
acucaccugcuggccccuca

SEQ ID NO: 2144235 - RNA, 15 nt, Human
acucauauauaucua

SEQ ID NO: 2144236 - RNA, 18 nt, Human
acucuguuccuucacauc

SEQ ID NO: 2144237 - RNA, 23 nt, Human
acuucuuuuuuuuuauuuuuaga

SEQ ID NO: 2144238 - RNA, 15 nt, Human
auuuccuaucauuuu

SEQ ID NO: 2144239 - RNA, 13 nt, Human
aaauugaaauaua

SEQ ID NO: 2144240 - RNA, 18 nt, Human
aaaugaacaucagaauuu

SEQ ID NO: 2144241 - RNA, 12 nt, Human
aaauguccucca

SEQ ID NO: 2144242 - RNA, 13 nt, Human
aaauguucuugca

SEQ ID NO: 2144243 - RNA, 18 nt, Human
acagcauugcuuucugaa

SEQ ID NO: 2144244 - RNA, 17 nt, Human
acauucuguaaaauguc

SEQ ID NO: 2144245 - RNA, 15 nt, Human
accucuuuucugcau

SEQ ID NO: 2144246 - RNA, 23 nt, Human
acuugucaggguauaaaaugaca

SEQ ID NO: 2144247 - RNA, 15 nt, Human
acugacauauaucua

SEQ ID NO: 2144248 - RNA, 15 nt, Human
acuguagauugcuuc

SEQ ID NO: 2144249 - RNA, 21 nt, Human
acuacacauauguauuccuga

SEQ ID NO: 2144250 - RNA, 17 nt, Human
acucuccuggaaauauu

SEQ ID NO: 2144251 - RNA, 18 nt, Human
agaaugccuugaagauau

SEQ ID NO: 2144252 - RNA, 14 nt, Human
agaauuuuuaaugu

SEQ ID NO: 2144253 - RNA, 20 nt, Human
agaacuagugguggcucuga

SEQ ID NO: 2144254 - RNA, 22 nt, Human
agaauaaauacuguuuuacugu

SEQ ID NO: 2144255 - RNA, 15 nt, Human
agacuuuuuuuauga

SEQ ID NO: 2144256 - RNA, 15 nt, Human
ccuuggacuguguuu

SEQ ID NO: 2144257 - RNA, 14 nt, Human
ccugagcucacuga

SEQ ID NO: 2144258 - RNA, 21 nt, Human
uuucaccaacuauagaaugua

SEQ ID NO: 2144259 - RNA, 16 nt, Human
uuuccuggcuacucca

SEQ ID NO: 2144260 - RNA, 17 nt, Human
uuucuuaaacaaaugua

SEQ ID NO: 2144261 - RNA, 14 nt, Human
uuuguauauauauu

SEQ ID NO: 2144262 - RNA, 13 nt, Human
uuuguuaaaaucu

SEQ ID NO: 2144263 - RNA, 14 nt, Human
uuuguuaaauauuu

SEQ ID NO: 2144264 - RNA, 14 nt, Human
uuuguuuuaaaauu

SEQ ID NO: 2144265 - RNA, 17 nt, Human
uuguuaaugaaaauguc

SEQ ID NO: 2144266 - RNA, 15 nt, Human
uuuaaaaauauaauu

SEQ ID NO: 2144267 - RNA, 16 nt, Human
uuuaaauauagaauuu

SEQ ID NO: 2144268 - RNA, 15 nt, Human
uuuaaggauaaauuu

SEQ ID NO: 2144269 - RNA, 17 nt, Human
uuuaauagaauauaauu

SEQ ID NO: 2144270 - RNA, 17 nt, Human
uuuacuucuuauacauu

SEQ ID NO: 2144271 - RNA, 15 nt, Human
uuuagaaauauaauu

SEQ ID NO: 2144272 - RNA, 19 nt, Human
uuuagauugaguaagauuu

SEQ ID NO: 2144273 - RNA, 20 nt, Human
uuuaguauauuuauauaauu

SEQ ID NO: 2144274 - RNA, 21 nt, Human
uuuauaaaauuggcaaaauua

SEQ ID NO: 2144275 - RNA, 16 nt, Human
uuuaugaguacuuuuu

SEQ ID NO: 2144276 - RNA, 16 nt, Human
cccuuugaccuuguuu

SEQ ID NO: 2144277 - RNA, 22 nt, Human
ccgagaucgcgccacugcacuc

SEQ ID NO: 2144278 - RNA, 22 nt, Human
gcuuauuuaauuaaaaaauuuc

SEQ ID NO: 2144279 - RNA, 18 nt, Human
gggaggaacacugcacuc

SEQ ID NO: 2144280 - RNA, 22 nt, Human
uugacacuauucacuaaaauua

SEQ ID NO: 2144281 - RNA, 13 nt, Human
uucuaaucuuuua

SEQ ID NO: 2144282 - RNA, 13 nt, Human
uucuacugcuucu

SEQ ID NO: 2144283 - RNA, 12 nt, Human
uucucugcuuca

SEQ ID NO: 2144284 - RNA, 12 nt, Human
uucuuucagugg

SEQ ID NO: 2144285 - RNA, 13 nt, Human
uugcauaaaauug

SEQ ID NO: 2144286 - RNA, 23 nt, Human
uugcauguaucuucuaagaauuu

SEQ ID NO: 2144287 - RNA, 18 nt, Human
uugagcuuggcagcugaa

SEQ ID NO: 2144288 - RNA, 15 nt, Human
uuggacaaucaugaa

SEQ ID NO: 2144289 - RNA, 13 nt, Human
uugucaaacugua

SEQ ID NO: 2144290 - RNA, 17 nt, Human
gggccacucugccucug

SEQ ID NO: 2144291 - RNA, 13 nt, Human
guaauugaacuua

SEQ ID NO: 2144292 - RNA, 21 nt, Human
guacaacuuuuuaccuaguac

SEQ ID NO: 2144293 - RNA, 18 nt, Human
uugacaauaauuucaggu

SEQ ID NO: 2144294 - RNA, 22 nt, Human
ccgagaucacgccacugcacuc

SEQ ID NO: 2144295 - RNA, 11 nt, Human
cccuuccucuu

SEQ ID NO: 2144296 - RNA, 16 nt, Human
ccugucuaaaaauuca

SEQ ID NO: 2144297 - RNA, 14 nt, Human
ccugugaaauacca

SEQ ID NO: 2144298 - RNA, 22 nt, Human
ccuuaaguaauguuaauucuua

SEQ ID NO: 2144299 - RNA, 20 nt, Human
ccugaauuuggccugcacua

SEQ ID NO: 2144300 - RNA, 14 nt, Human
gcuaauaaaauauc

SEQ ID NO: 2144301 - RNA, 20 nt, Human
ugccagaaagcauaaaauuc

SEQ ID NO: 2144302 - RNA, 23 nt, Human
ugucuccagacccccaccccuuc

SEQ ID NO: 2144303 - RNA, 16 nt, Human
uggauaggcacauaga

SEQ ID NO: 2144304 - RNA, 20 nt, Human
uggcacagcccaaagaagga

SEQ ID NO: 2144305 - RNA, 13 nt, Human
uuagauaucuuuu

SEQ ID NO: 2144306 - RNA, 21 nt, Human
uuaaaggggcagaaaaacucu

SEQ ID NO: 2144307 - RNA, 13 nt, Human
uuaaauuagauaa

SEQ ID NO: 2144308 - RNA, 16 nt, Human
uuaauuuaaucuuuuu

SEQ ID NO: 2144309 - RNA, 19 nt, Human
uuacaucuguuuuaaauuu

SEQ ID NO: 2144310 - RNA, 20 nt, Human
ugcugccuccccaacccugc

SEQ ID NO: 2144311 - RNA, 15 nt, Human
ugccugcaccccugc

SEQ ID NO: 2144312 - RNA, 20 nt, Human
ugcuauuuuacugucuuaau

SEQ ID NO: 2144313 - RNA, 22 nt, Human
ugggaaugcggcaagaaggaau

SEQ ID NO: 2144314 - RNA, 22 nt, Human
ugggacacuaauggggcgguga

SEQ ID NO: 2144315 - RNA, 18 nt, Human
ugggcaaaacccacagaa

SEQ ID NO: 2144316 - RNA, 15 nt, Human
uggugaugaaaugua

SEQ ID NO: 2144317 - RNA, 17 nt, Human
uggugauuuagcaggaa

SEQ ID NO: 2144318 - RNA, 19 nt, Human
uguaauaaaguauauaauu

SEQ ID NO: 2144319 - RNA, 16 nt, Human
uguacauauauauauu

SEQ ID NO: 2144320 - RNA, 14 nt, Human
uguauuuucuuuuu

SEQ ID NO: 2144321 - RNA, 18 nt, Human
ugucauuaaauaaaaauu

SEQ ID NO: 2144322 - RNA, 17 nt, Human
uucccauugaaaaugua

SEQ ID NO: 2144323 - RNA, 19 nt, Human
uuccccgugggccauggca

SEQ ID NO: 2144324 - RNA, 13 nt, Human
uugcuaagaaggg

SEQ ID NO: 2144325 - RNA, 23 nt, Human
uugcucauuuuuuaaaaaaugga

SEQ ID NO: 2144326 - RNA, 18 nt, Human
uuugauuuuuucaaauuu

SEQ ID NO: 2144327 - RNA, 23 nt, Human
uuuaaugcauguuaggaaaauuu

SEQ ID NO: 2144328 - RNA, 16 nt, Human
uuuaauuaaaaaauuu

SEQ ID NO: 2144329 - RNA, 20 nt, Human
uuuagauuuuaaucaaauuu

SEQ ID NO: 2144330 - RNA, 18 nt, Human
uuuaggaagauaaaaguu

SEQ ID NO: 2144331 - RNA, 16 nt, Human
uuuauaaaaaaaauga

SEQ ID NO: 2144332 - RNA, 22 nt, Human
uuuauauauuuaacuacaauuu

SEQ ID NO: 2144333 - RNA, 16 nt, Human
uuuauccaaucuuguu

SEQ ID NO: 2144334 - RNA, 22 nt, Human
uuuaugaaaugguuaagaauuu

SEQ ID NO: 2144335 - RNA, 14 nt, Human
uuuauguaaaauuu

SEQ ID NO: 2144336 - RNA, 13 nt, Human
uuuauuaaaaucu

SEQ ID NO: 2144337 - RNA, 18 nt, Human
uuuauucaagguaaaauu

SEQ ID NO: 2144338 - RNA, 13 nt, Human
uuucacaaaauuu

SEQ ID NO: 2144339 - RNA, 23 nt, Human
uuuccuuaaauuaucuaaaaucu

SEQ ID NO: 2144340 - RNA, 13 nt, Human
uuuccuucagugc

SEQ ID NO: 2144341 - RNA, 17 nt, Human
uucaagcauucuucaac

SEQ ID NO: 2144342 - RNA, 17 nt, Human
uucacauaaaauagauu

SEQ ID NO: 2144343 - RNA, 20 nt, Human
uucacuuguucuuaaacuuu

SEQ ID NO: 2144344 - RNA, 15 nt, Human
uucauagaaaaagua

SEQ ID NO: 2144345 - RNA, 22 nt, Human
uuaucaaaaaaaaaaaaaugug

SEQ ID NO: 2144346 - RNA, 11 nt, Human
uuauuagauaa

SEQ ID NO: 2144347 - RNA, 19 nt, Human
uuaggcagauugaaaagga

SEQ ID NO: 2144348 - RNA, 18 nt, Human
uuguacguuuaaagugua

SEQ ID NO: 2144349 - RNA, 13 nt, Human
uuguuuucagugu

SEQ ID NO: 2144350 - RNA, 21 nt, Human
uuuaaaaaaguuuaaaaugua

SEQ ID NO: 2144351 - RNA, 14 nt, Human
uuuaaauauagaau

SEQ ID NO: 2144352 - RNA, 22 nt, Human
uuuaaauuauaacuuaaaauau

SEQ ID NO: 2144353 - RNA, 21 nt, Human
uuuaaauucuuuuuuaaauuu

SEQ ID NO: 2144354 - RNA, 14 nt, Human
uucugcuucacauu

SEQ ID NO: 2144355 - RNA, 12 nt, Human
uuuauaaaauug

SEQ ID NO: 2144356 - RNA, 20 nt, Human
uuuauguugaccuaagauuu

SEQ ID NO: 2144357 - RNA, 17 nt, Human
uuuauguuguauagauu

SEQ ID NO: 2144358 - RNA, 17 nt, Human
uuuauucaagaaaagua

SEQ ID NO: 2144359 - RNA, 16 nt, Human
uuuauuucaaaauaua

SEQ ID NO: 2144360 - RNA, 19 nt, Human
uuucacaccugaaaauguu

SEQ ID NO: 2144361 - RNA, 22 nt, Human
uuucagaaagcuagaaagugua

SEQ ID NO: 2144362 - RNA, 14 nt, Human
uuucaguauaauuu

SEQ ID NO: 2144363 - RNA, 17 nt, Human
uuguuauuauaaaagua

SEQ ID NO: 2144364 - RNA, 13 nt, Human
uuuaaaaaaugua

SEQ ID NO: 2144365 - RNA, 22 nt, Human
uuucuacucucuuuuaauauuu

SEQ ID NO: 2144366 - RNA, 13 nt, Human
uuucugaaaauua

SEQ ID NO: 2144367 - RNA, 15 nt, Human
uuugauauuaaauuu

SEQ ID NO: 2144368 - RNA, 17 nt, Human
uuugaucaguauaauuu

SEQ ID NO: 2144369 - RNA, 18 nt, Human
ccauucucccucuuguuu

SEQ ID NO: 2144370 - RNA, 22 nt, Human
uuuguauugaaagcuuuuguua

SEQ ID NO: 2144371 - RNA, 21 nt, Human
gcauaaaauucuuaaaauaua

SEQ ID NO: 2144372 - RNA, 13 nt, Human
gccuguuuuaugu

SEQ ID NO: 2144373 - RNA, 16 nt, Human
gcccgaggcaccagug

SEQ ID NO: 2144374 - RNA, 14 nt, Human
uagccaaaaauguc

SEQ ID NO: 2144375 - RNA, 22 nt, Human
uagccaaauugaaaaaagaaau

SEQ ID NO: 2144376 - RNA, 21 nt, Human
uagcuauuuuuauggaauuuu

SEQ ID NO: 2144377 - RNA, 15 nt, Human
uaaaguguaaauccu

SEQ ID NO: 2144378 - RNA, 18 nt, Human
uaaauaaacacauagauu

SEQ ID NO: 2144379 - RNA, 18 nt, Human
uaaaaggucuaugcucau

SEQ ID NO: 2144380 - RNA, 22 nt, Human
uaaaauaaaguauauauagaau

SEQ ID NO: 2144381 - RNA, 13 nt, Human
uacaaauucaagc

SEQ ID NO: 2144382 - RNA, 20 nt, Human
uaacauggaagggaagaaaa

SEQ ID NO: 2144383 - RNA, 18 nt, Human
guuuuuccuccauaaauu

SEQ ID NO: 2144384 - RNA, 16 nt, Human
guggcgcgcaccugua

SEQ ID NO: 2144385 - RNA, 16 nt, Human
uccagaucagauucuu

SEQ ID NO: 2144386 - RNA, 16 nt, Human
uccagucucccaacuu

SEQ ID NO: 2144387 - RNA, 13 nt, Human
ucauuuauuuuuu

SEQ ID NO: 2144388 - RNA, 19 nt, Human
uccaaaugcccagcuuaaa

SEQ ID NO: 2144389 - RNA, 17 nt, Human
uccaaucagaucuuuau

SEQ ID NO: 2144390 - RNA, 17 nt, Human
uauguaaaauaaaauua

SEQ ID NO: 2144391 - RNA, 21 nt, Human
uauaauuguuuuuuaucuuuu

SEQ ID NO: 2144392 - RNA, 22 nt, Human
uauauuaaaaaugguaaaauug

SEQ ID NO: 2144393 - RNA, 13 nt, Human
ucaaacacagaga

SEQ ID NO: 2144394 - RNA, 13 nt, Human
ucaaacucuuaaa

SEQ ID NO: 2144395 - RNA, 20 nt, Human
ucaacccuuugccccaccuu

SEQ ID NO: 2144396 - RNA, 15 nt, Human
ucagcugaaccuggg

SEQ ID NO: 2144397 - RNA, 15 nt, Human
ucaguauaauuuuuu

SEQ ID NO: 2144398 - RNA, 23 nt, Human
ucaugagaaauuaccaaaauguc

SEQ ID NO: 2144399 - RNA, 13 nt, Human
gucauuuuuaugu

SEQ ID NO: 2144400 - RNA, 19 nt, Human
guaaauaagagauuuggag

SEQ ID NO: 2144401 - RNA, 16 nt, Human
guauuugaaaaauauu

SEQ ID NO: 2144402 - RNA, 16 nt, Human
guacuuuuggaaucua

SEQ ID NO: 2144403 - RNA, 21 nt, Human
ggagauaacaaucuguauaua

SEQ ID NO: 2144404 - RNA, 14 nt, Human
ggcagaaagcaaau

SEQ ID NO: 2144405 - RNA, 18 nt, Human
ggaauguacaugucaaua

SEQ ID NO: 2144406 - RNA, 19 nt, Human
cuugaaggaucuguuuuua

SEQ ID NO: 2144407 - RNA, 10 nt, Human
gaccaaucag

SEQ ID NO: 2144408 - RNA, 13 nt, Human
gacacuagaagau

SEQ ID NO: 2144409 - RNA, 15 nt, Human
gacagaucauagauu

SEQ ID NO: 2144410 - RNA, 19 nt, Human
gaagggaaaauauccaucc

SEQ ID NO: 2144411 - RNA, 13 nt, Human
gaagggacauauu

SEQ ID NO: 2144412 - RNA, 16 nt, Human
gaaguaacuugucuua

SEQ ID NO: 2144413 - RNA, 16 nt, Human
gaaguaugagggaaaa

SEQ ID NO: 2144414 - RNA, 19 nt, Human
gaauauuauuggaaaauuc

SEQ ID NO: 2144415 - RNA, 15 nt, Human
gaaauagccaaucau

SEQ ID NO: 2144416 - RNA, 14 nt, Human
cuuugucaaaagga

SEQ ID NO: 2144417 - RNA, 14 nt, Human
cuuuugacaacaaa

SEQ ID NO: 2144418 - RNA, 14 nt, Human
cuuuuguaaauaca

SEQ ID NO: 2144419 - RNA, 17 nt, Human
gaaaauuuuuguuuaua

SEQ ID NO: 2144420 - RNA, 15 nt, Human
cuuuccauguuguug

SEQ ID NO: 2144421 - RNA, 14 nt, Human
cucuguagaaauuc

SEQ ID NO: 2144422 - RNA, 16 nt, Human
cuguaucccaugagcc

SEQ ID NO: 2144423 - RNA, 14 nt, Human
cugugccaugugcc

SEQ ID NO: 2144424 - RNA, 16 nt, Human
cugugggguuuuguua

SEQ ID NO: 2144425 - RNA, 19 nt, Human
cuucagagggaaaguaaau

SEQ ID NO: 2144426 - RNA, 21 nt, Human
cuuccaggggagguucaguga

SEQ ID NO: 2144427 - RNA, 17 nt, Human
cuguacgucugacaggc

SEQ ID NO: 2144428 - RNA, 14 nt, Human
ucuuuauucuuuuu

SEQ ID NO: 2144429 - RNA, 18 nt, Human
ucuguuaaaauaaaauug

SEQ ID NO: 2144430 - RNA, 16 nt, Human
ugaaguuguagguaau

SEQ ID NO: 2144431 - RNA, 23 nt, Human
ugaauaaccacuuaaaaaauguc

SEQ ID NO: 2144432 - RNA, 12 nt, Human
ugagaaaauguc

SEQ ID NO: 2144433 - RNA, 14 nt, Human
ugaugcucccuccc

SEQ ID NO: 2144434 - RNA, 12 nt, Human
ugcaaaaaugua

SEQ ID NO: 2144435 - RNA, 14 nt, Human
ugcaauaaccuggg

SEQ ID NO: 2144436 - RNA, 16 nt, Human
cuacucugugucaggu

SEQ ID NO: 2144437 - RNA, 17 nt, Human
cuauauggaauugcuua

SEQ ID NO: 2144438 - RNA, 16 nt, Human
cuauucacuaaaauua

SEQ ID NO: 2144439 - RNA, 18 nt, Human
cucaucaucaacccuaaa

SEQ ID NO: 2144440 - RNA, 17 nt, Human
cggauugcauuagaaau

SEQ ID NO: 2144441 - RNA, 20 nt, Human
ucagcaaaaaaguacuuaaa

SEQ ID NO: 2144442 - RNA, 12 nt, Human
uugaacaaauga

SEQ ID NO: 2144443 - RNA, 16 nt, Human
uugacuagaaaauuua

SEQ ID NO: 2144444 - RNA, 12 nt, Human
uugagagagcaa

SEQ ID NO: 2144445 - RNA, 14 nt, Human
uugaugaaaaugua

SEQ ID NO: 2144446 - RNA, 10 nt, Human
uucacagagc

SEQ ID NO: 2144447 - RNA, 13 nt, Human
uucauagauugug

SEQ ID NO: 2144448 - RNA, 23 nt, Human
uucauaucacacuguuaaaaguu

SEQ ID NO: 2144449 - RNA, 22 nt, Human
uucauaucuauuuauuaaauuu

SEQ ID NO: 2144450 - RNA, 12 nt, Human
uucccugaucaa

SEQ ID NO: 2144451 - RNA, 23 nt, Human
uucucuuugguguacaaaaugga

SEQ ID NO: 2144452 - RNA, 11 nt, Human
uucugcuccac

SEQ ID NO: 2144453 - RNA, 12 nt, Human
ucucugcuccac

SEQ ID NO: 2144454 - RNA, 21 nt, Human
ucuauguggcuguaucuuguu

SEQ ID NO: 2144455 - RNA, 14 nt, Human
uccaggcaauggcc

SEQ ID NO: 2144456 - RNA, 14 nt, Human
uccccuucucugua

SEQ ID NO: 2144457 - RNA, 21 nt, Human
ucauuuucugccuaucuucuu

SEQ ID NO: 2144458 - RNA, 16 nt, Human
ucgauaucuucuuuuu

SEQ ID NO: 2144459 - RNA, 18 nt, Human
uggaguccgaugauucuc

SEQ ID NO: 2144460 - RNA, 14 nt, Human
uggcugugccucug

SEQ ID NO: 2144461 - RNA, 16 nt, Human
uggucugacccacugc

SEQ ID NO: 2144462 - RNA, 18 nt, Human
ugguagggggaaaaugug

SEQ ID NO: 2144463 - RNA, 18 nt, Human
uuacugaagguaaaauug

SEQ ID NO: 2144464 - RNA, 16 nt, Human
uuauacguuauagagu

SEQ ID NO: 2144465 - RNA, 17 nt, Human
uuauaugugaucuuugu

SEQ ID NO: 2144466 - RNA, 13 nt, Human
uuauuuuagauau

SEQ ID NO: 2144467 - RNA, 11 nt, Human
uucaaaauguc

SEQ ID NO: 2144468 - RNA, 22 nt, Human
uuaaauucacaauagaaacuca

SEQ ID NO: 2144469 - RNA, 21 nt, Human
uuaacagagacagauaacucu

SEQ ID NO: 2144470 - RNA, 13 nt, Human
uuaaucuuccaug

SEQ ID NO: 2144471 - RNA, 22 nt, Human
uuaauguuuccuuuaauuuuuu

SEQ ID NO: 2144472 - RNA, 16 nt, Human
ugugaagaaaaaugua

SEQ ID NO: 2144473 - RNA, 20 nt, Human
uguacauggaauaacaugua

SEQ ID NO: 2144474 - RNA, 15 nt, Human
uguauguuauagaua

SEQ ID NO: 2144475 - RNA, 13 nt, Human
uguuaaaaauguu

SEQ ID NO: 2144476 - RNA, 14 nt, Human
uguucugacccugc

SEQ ID NO: 2144477 - RNA, 22 nt, Human
ugcuccaccccacucacagaga

SEQ ID NO: 2144478 - RNA, 19 nt, Human
ugccugcccaggccccugc

SEQ ID NO: 2144479 - RNA, 20 nt, Human
ugcaauagagacuguagauu

SEQ ID NO: 2144480 - RNA, 20 nt, Human
ugacaucaagaaucuucugu

SEQ ID NO: 2144481 - RNA, 20 nt, Human
ugacaucgccaguaaaauua

SEQ ID NO: 2144482 - RNA, 15 nt, Human
ugagaccaaccuggg

SEQ ID NO: 2144483 - RNA, 21 nt, Human
ucuaaccagagcaagcuuuuu

SEQ ID NO: 2144484 - RNA, 18 nt, Human
ucuacucucuuuuaauau

SEQ ID NO: 2144485 - RNA, 16 nt, Human
ucagauggagcaugaa

SEQ ID NO: 2144486 - RNA, 17 nt, Human
ucgagaccagccuggcc

SEQ ID NO: 2144487 - RNA, 18 nt, Human
ucuccagaugagaguaca

SEQ ID NO: 2144488 - RNA, 23 nt, Human
ucuccuuugcaggcucauaggga

SEQ ID NO: 2144489 - RNA, 23 nt, Human
ucucuuauucaguaaaaaacaac

SEQ ID NO: 2144490 - RNA, 22 nt, Human
ugaaaguauaacugaguuaaau

SEQ ID NO: 2144491 - RNA, 21 nt, Human
uaguaauagguaggaaaauga

SEQ ID NO: 2144492 - RNA, 16 nt, Human
uaguaucuaacaugua

SEQ ID NO: 2144493 - RNA, 22 nt, Human
uaguccuuuacuaauccaaccc

SEQ ID NO: 2144494 - RNA, 21 nt, Human
uaucaguuugcuagcagaaau

SEQ ID NO: 2144495 - RNA, 14 nt, Human
uaucugaaaaugua

SEQ ID NO: 2144496 - RNA, 14 nt, Human
uaugaaucucuacg

SEQ ID NO: 2144497 - RNA, 20 nt, Human
ucaagaaagccagucuuaac

SEQ ID NO: 2144498 - RNA, 16 nt, Human
ucaaucucugauucug

SEQ ID NO: 2144499 - RNA, 22 nt, Human
uaaccacgucugucuucacagc

SEQ ID NO: 2144500 - RNA, 16 nt, Human
uaacuagggaagaaag

SEQ ID NO: 2144501 - RNA, 16 nt, Human
uaagaauuugguaaau

SEQ ID NO: 2144502 - RNA, 21 nt, Human
uaagcauuguuugcuuauugu

SEQ ID NO: 2144503 - RNA, 16 nt, Human
uaaauaaaauauaauu

SEQ ID NO: 2144504 - RNA, 13 nt, Human
uaaaugaaaaaau

SEQ ID NO: 2144505 - RNA, 13 nt, Human
uaaaugcuuaugu

SEQ ID NO: 2144506 - RNA, 16 nt, Human
uaaauuaggaauaaau

SEQ ID NO: 2144507 - RNA, 16 nt, Human
uaacaauaacuacugu

SEQ ID NO: 2144508 - RNA, 18 nt, Human
uaaaaccccaucucuaca

SEQ ID NO: 2144509 - RNA, 19 nt, Human
guucaggguuggccccugc

SEQ ID NO: 2144510 - RNA, 18 nt, Human
gguuaacagcugucuaug

SEQ ID NO: 2144511 - RNA, 21 nt, Human
guagauaaacucagaaauuua

SEQ ID NO: 2144512 - RNA, 23 nt, Human
guauauuuauaaauaaaaauauu

SEQ ID NO: 2144513 - RNA, 14 nt, Human
uuuaaaauauaauu

SEQ ID NO: 2144514 - RNA, 20 nt, Human
uuuaaacugaaugaacaacc

SEQ ID NO: 2144515 - RNA, 22 nt, Human
uuuaaauuagauaacaaaauuu

SEQ ID NO: 2144516 - RNA, 19 nt, Human
uuugacucuauuaaaaucu

SEQ ID NO: 2144517 - RNA, 20 nt, Human
uuugguggagauaaagauuu

SEQ ID NO: 2144518 - RNA, 18 nt, Human
uuuugggguacccacugc

SEQ ID NO: 2144519 - RNA, 13 nt, Human
uugacuuucaggu

SEQ ID NO: 2144520 - RNA, 14 nt, Human
uugauguguuaucu

SEQ ID NO: 2144521 - RNA, 14 nt, Human
uugcacaaaauaua

SEQ ID NO: 2144522 - RNA, 17 nt, Human
uugccucaguaaaauga

SEQ ID NO: 2144523 - RNA, 15 nt, Human
uugcucaaaaaauga

SEQ ID NO: 2144524 - RNA, 22 nt, Human
uugcuucuucccuuaaaauuua

SEQ ID NO: 2144525 - RNA, 14 nt, Human
uuggaaauuuguua

SEQ ID NO: 2144526 - RNA, 20 nt, Human
uugugaaaugaaaacaugua

SEQ ID NO: 2144527 - RNA, 17 nt, Human
uugguuucuagcaugaa

SEQ ID NO: 2144528 - RNA, 22 nt, Human
uuguaauuauuuuuaauaugua

SEQ ID NO: 2144529 - RNA, 14 nt, Human
uuguuuuaaaauua

SEQ ID NO: 2144530 - RNA, 18 nt, Human
uuuaaguauuuauauauu

SEQ ID NO: 2144531 - RNA, 20 nt, Human
uuuaaguguuguaaauauuu

SEQ ID NO: 2144532 - RNA, 14 nt, Human
uuuagcauaaaauu

SEQ ID NO: 2144533 - RNA, 14 nt, Human
uuuaugauauuuuu

SEQ ID NO: 2144534 - RNA, 21 nt, Human
uuuauuauguacaaauagauu

SEQ ID NO: 2144535 - RNA, 21 nt, Human
uuuauugaugugcaaaaauuu

SEQ ID NO: 2144536 - RNA, 17 nt, Human
uuucaaaauaaaaauga

SEQ ID NO: 2144537 - RNA, 18 nt, Human
uuucaauucaaaaaugua

SEQ ID NO: 2144538 - RNA, 16 nt, Human
uuucacauuaauauuu

SEQ ID NO: 2144539 - RNA, 15 nt, Human
uuuccuaaaagugua

SEQ ID NO: 2144540 - RNA, 22 nt, Human
uuucuacagcaaauuuauaauu

SEQ ID NO: 2144541 - RNA, 23 nt, Human
uuucuacagcaaauuuauaauuu

SEQ ID NO: 2144542 - RNA, 21 nt, Human
uuucuagcuaauggaaaauga

SEQ ID NO: 2144543 - RNA, 23 nt, Human
gcagagugcccagaacuggacuc

SEQ ID NO: 2144544 - RNA, 13 nt, Human
gccucacuccagg

SEQ ID NO: 2144545 - RNA, 15 nt, Human
gcaaguaaaaauaua

SEQ ID NO: 2144546 - RNA, 24 nt, Human
gcaauugugcucuucauuuaggau

SEQ ID NO: 2144547 - RNA, 19 nt, Human
gacuuuucgaccaauucaa

SEQ ID NO: 2144548 - RNA, 14 nt, Human
gacuucagcucugu

SEQ ID NO: 2144549 - RNA, 14 nt, Human
gaggucaacagaga

SEQ ID NO: 2144550 - RNA, 12 nt, Human
gaggucaagaga

SEQ ID NO: 2144551 - RNA, 17 nt, Human
gagguggaucacagagg

SEQ ID NO: 2144552 - RNA, 16 nt, Human
gagucgcaucucagug

SEQ ID NO: 2144553 - RNA, 19 nt, Human
gauaaggacgggaccauuu

SEQ ID NO: 2144554 - RNA, 17 nt, Human
aaaauuuuuguuuauaa

SEQ ID NO: 2144555 - RNA, 13 nt, Human
aaauuuucacaua

SEQ ID NO: 2144556 - RNA, 16 nt, Human
aacaaauaauuuuuaa

SEQ ID NO: 2144557 - RNA, 16 nt, Human
aacaaucuguauauaa

SEQ ID NO: 2144558 - RNA, 21 nt, Human
aacagaagcuuccauuccaag

SEQ ID NO: 2144559 - RNA, 12 nt, Human
aaauagaaauaa

SEQ ID NO: 2144560 - RNA, 22 nt, Human
aaaucagaguuuucauguauuu

SEQ ID NO: 2144561 - RNA, 13 nt, Human
aaaucuuuuuugu

SEQ ID NO: 2144562 - RNA, 23 nt, Human
aaauggcuggagugauucugaau

SEQ ID NO: 2144563 - RNA, 14 nt, Human
agaaauuuuucaga

SEQ ID NO: 2144564 - RNA, 14 nt, Human
agaaacuuguuaga

SEQ ID NO: 2144565 - RNA, 17 nt, Human
acucuucugaauugacu

SEQ ID NO: 2144566 - RNA, 16 nt, Human
accugcugagagaccc

SEQ ID NO: 2144567 - RNA, 14 nt, Human
acauuugaaaucua

SEQ ID NO: 2144568 - RNA, 22 nt, Human
aagcauaaaauucuuaaaauau

SEQ ID NO: 2144569 - RNA, 19 nt, Human
aagaucguucucugccuca

SEQ ID NO: 2144570 - RNA, 15 nt, Human
aacuuaauaguauuu

SEQ ID NO: 2144571 - RNA, 20 nt, Human
aacuuuaaaggauucuguau

SEQ ID NO: 2144572 - RNA, 11 nt, Human
aacuuuuaugc

SEQ ID NO: 2144573 - RNA, 17 nt, Human
aagaaagccagucuuaa

SEQ ID NO: 2144574 - RNA, 22 nt, Human
aagacaaugugaaaagaaaaau

SEQ ID NO: 2144575 - RNA, 19 nt, Human
aagauaugugaagaaaaau

SEQ ID NO: 2144576 - RNA, 15 nt, Human
aauaguguguucuga

SEQ ID NO: 2144577 - RNA, 13 nt, Human
aauaaaaaauaua

SEQ ID NO: 2144578 - RNA, 20 nt, Human
aacaugagaaacgcuuaugu

SEQ ID NO: 2144579 - RNA, 14 nt, Human
aacccaacaugacu

SEQ ID NO: 2144580 - RNA, 15 nt, Human
aacccuugcuugcaa

SEQ ID NO: 2144581 - RNA, 21 nt, Human
aagcagaauaguauuuuuaua

SEQ ID NO: 2144582 - RNA, 16 nt, Human
aagccacagacaauau

SEQ ID NO: 2144583 - RNA, 15 nt, Human
aagcuaauaaaauau

SEQ ID NO: 2144584 - RNA, 16 nt, Human
aaggacucuuccagag

SEQ ID NO: 2144585 - RNA, 20 nt, Human
aagucaugcguuuaaucaca

SEQ ID NO: 2144586 - RNA, 23 nt, Human
aagucucuauuuaaauucuuuuu

SEQ ID NO: 2144587 - RNA, 14 nt, Human
aagucucugugaau

SEQ ID NO: 2144588 - RNA, 14 nt, Human
aagugacuucacag

SEQ ID NO: 2144589 - RNA, 19 nt, Human
aaguguauuugaaaaauau

SEQ ID NO: 2144590 - RNA, 17 nt, Human
aacuuaaaaaaaugaca

SEQ ID NO: 2144591 - RNA, 17 nt, Human
aacuuauuuuaaaauau

SEQ ID NO: 2144592 - RNA, 21 nt, Human
aagaauguguuuaaacuuggu

SEQ ID NO: 2144593 - RNA, 15 nt, Human
aagaauuuuuuuuaa

SEQ ID NO: 2144594 - RNA, 23 nt, Human
aaccaccuggcccuuagaaauag

SEQ ID NO: 2144595 - RNA, 21 nt, Human
aaccgaaaggccaaauucccu

SEQ ID NO: 2144596 - RNA, 16 nt, Human
aaggcuuuauauuuuu

SEQ ID NO: 2144597 - RNA, 21 nt, Human
aagguuuccucaaacugugau

SEQ ID NO: 2144598 - RNA, 19 nt, Human
aaguaaugaauuuuuauga

SEQ ID NO: 2144599 - RNA, 21 nt, Human
aaguacauauuaggaaaauau

SEQ ID NO: 2144600 - RNA, 18 nt, Human
aaguacauuauuguuuau

SEQ ID NO: 2144601 - RNA, 21 nt, Human
aagucuuagacuugaaauacu

SEQ ID NO: 2144602 - RNA, 18 nt, Human
aaguguagguaucauuuu

SEQ ID NO: 2144603 - RNA, 22 nt, Human
aaguuuuguucuguccuggaau

SEQ ID NO: 2144604 - RNA, 20 nt, Human
aauguuuccuuuaauuuuuu

SEQ ID NO: 2144605 - RNA, 15 nt, Human
aauagcaaccuuuuu

SEQ ID NO: 2144606 - RNA, 22 nt, Human
aaucaaguuggcuucuaaucaa

SEQ ID NO: 2144607 - RNA, 16 nt, Human
aaucaggguuuuuaga

SEQ ID NO: 2144608 - RNA, 15 nt, Human
aaucuccuauuuuuu

SEQ ID NO: 2144609 - RNA, 14 nt, Human
aaucuucaguauuu

SEQ ID NO: 2144610 - RNA, 22 nt, Human
acaggauguuugcucagcuucu

SEQ ID NO: 2144611 - RNA, 15 nt, Human
acaguugggaaaaua

SEQ ID NO: 2144612 - RNA, 17 nt, Human
acaguugggaaaauaug

SEQ ID NO: 2144613 - RNA, 17 nt, Human
acauaugcaaaaauaua

SEQ ID NO: 2144614 - RNA, 20 nt, Human
acauauucauuuggaaauaa

SEQ ID NO: 2144615 - RNA, 20 nt, Human
acaucuuuuacauucugcaa

SEQ ID NO: 2144616 - RNA, 17 nt, Human
aauucagauauauuuuu

SEQ ID NO: 2144617 - RNA, 19 nt, Human
aauuccauaugcuguuuca

SEQ ID NO: 2144618 - RNA, 15 nt, Human
aauucucuauuuuuu

SEQ ID NO: 2144619 - RNA, 18 nt, Human
aauuguuuuuuaucuuuu

SEQ ID NO: 2144620 - RNA, 14 nt, Human
aauuuaaucuuuuu

SEQ ID NO: 2144621 - RNA, 14 nt, Human
aauuuuaucuguuu

SEQ ID NO: 2144622 - RNA, 17 nt, Human
acaaucaaaggaaaaua

SEQ ID NO: 2144623 - RNA, 14 nt, Human
uucccuuaaaauuu

SEQ ID NO: 2144624 - RNA, 21 nt, Human
uuaucacugacacaaaaagua

SEQ ID NO: 2144625 - RNA, 17 nt, Human
uuaucuuacaaagugua

SEQ ID NO: 2144626 - RNA, 21 nt, Human
uuauuaccagugaaucuuugu

SEQ ID NO: 2144627 - RNA, 13 nt, Human
uuauuauauaauu

SEQ ID NO: 2144628 - RNA, 15 nt, Human
uuccaugaaaaugca

SEQ ID NO: 2144629 - RNA, 21 nt, Human
ugaccucccagugaccccuga

SEQ ID NO: 2144630 - RNA, 16 nt, Human
ucuuuaacaucuucuu

SEQ ID NO: 2144631 - RNA, 19 nt, Human
ucuuuauugcucauuuuuu

SEQ ID NO: 2144632 - RNA, 20 nt, Human
ucuuuuaguuguaucucuuu

SEQ ID NO: 2144633 - RNA, 12 nt, Human
ugaaaucuuuuu

SEQ ID NO: 2144634 - RNA, 14 nt, Human
ucuuaggugcuucu

SEQ ID NO: 2144635 - RNA, 17 nt, Human
ucuugccacugccucuu

SEQ ID NO: 2144636 - RNA, 19 nt, Human
ugcuccagccaaccccugu

SEQ ID NO: 2144637 - RNA, 23 nt, Human
ugagcuccccaaaaaccucaccc

SEQ ID NO: 2144638 - RNA, 14 nt, Human
ugucuuuaaaagua

SEQ ID NO: 2144639 - RNA, 20 nt, Human
ugugaggagguggagagaca

SEQ ID NO: 2144640 - RNA, 21 nt, Human
uguucuggcccucaccccugc

SEQ ID NO: 2144641 - RNA, 16 nt, Human
uuacauuuuacuuuuu

SEQ ID NO: 2144642 - RNA, 14 nt, Human
uuagaguagcauga

SEQ ID NO: 2144643 - RNA, 13 nt, Human
uuaggagcaugag

SEQ ID NO: 2144644 - RNA, 15 nt, Human
uuauauaaauuuuuu

SEQ ID NO: 2144645 - RNA, 20 nt, Human
uuaauaaaacacuauuuuuu

SEQ ID NO: 2144646 - RNA, 23 nt, Human
uuaauugagaagcguauguuuuu

SEQ ID NO: 2144647 - RNA, 19 nt, Human
uggcaagaauguguuuaaa

SEQ ID NO: 2144648 - RNA, 17 nt, Human
ugggaaaauauguccau

SEQ ID NO: 2144649 - RNA, 15 nt, Human
ugggaugaugccuca

SEQ ID NO: 2144650 - RNA, 22 nt, Human
uguauuuuguuuuugucuuaaa

SEQ ID NO: 2144651 - RNA, 17 nt, Human
uguauuuuuaccuuuuu

SEQ ID NO: 2144652 - RNA, 13 nt, Human
cuuguuucagagu

SEQ ID NO: 2144653 - RNA, 17 nt, Human
auuuguuuucacuuuuu

SEQ ID NO: 2144654 - RNA, 14 nt, Human
auugcucauuuuuu

SEQ ID NO: 2144655 - RNA, 15 nt, Human
caaaaccauugcuuc

SEQ ID NO: 2144656 - RNA, 16 nt, Human
agaaauggugaaaaua

SEQ ID NO: 2144657 - RNA, 16 nt, Human
agaauguauuuuauau

SEQ ID NO: 2144658 - RNA, 17 nt, Human
agaaaauuuuuguuuau

SEQ ID NO: 2144659 - RNA, 21 nt, Human
agaaacaaacccguuuuauga

SEQ ID NO: 2144660 - RNA, 14 nt, Human
agauugcugcuucu

SEQ ID NO: 2144661 - RNA, 21 nt, Human
agauacaggaaaagcugcuga

SEQ ID NO: 2144662 - RNA, 14 nt, Human
aguuuuaguugcag

SEQ ID NO: 2144663 - RNA, 14 nt, Human
aguauccugcuucu

SEQ ID NO: 2144664 - RNA, 15 nt, Human
aguucagcugcuucu

SEQ ID NO: 2144665 - RNA, 13 nt, Human
aguucaucuuuug

SEQ ID NO: 2144666 - RNA, 14 nt, Human
auacauuuguaugu

SEQ ID NO: 2144667 - RNA, 18 nt, Human
auauguguuuuucacauu

SEQ ID NO: 2144668 - RNA, 15 nt, Human
aucuaauuucugaaa

SEQ ID NO: 2144669 - RNA, 20 nt, Human
aucuauauauguauaaauau

SEQ ID NO: 2144670 - RNA, 23 nt, Human
aggacccacuuccugaucccuca

SEQ ID NO: 2144671 - RNA, 20 nt, Human
agugaucugaacagaaauac

SEQ ID NO: 2144672 - RNA, 17 nt, Human
agugccguaacaacugu

SEQ ID NO: 2144673 - RNA, 18 nt, Human
aguggcuugaaaucuuuu

SEQ ID NO: 2144674 - RNA, 19 nt, Human
aguggcuugaaaucuuuuu

SEQ ID NO: 2144675 - RNA, 15 nt, Human
auuccauaauuccau

SEQ ID NO: 2144676 - RNA, 17 nt, Human
auugggauauucugaaa

SEQ ID NO: 2144677 - RNA, 19 nt, Human
auuuauugcacaaaauaua

SEQ ID NO: 2144678 - RNA, 17 nt, Human
auguauaaaauaaauau

SEQ ID NO: 2144679 - RNA, 18 nt, Human
auggcuggagugauucug

SEQ ID NO: 2144680 - RNA, 20 nt, Human
augaagacaauuuugauuua

SEQ ID NO: 2144681 - RNA, 13 nt, Human
augagugauucuu

SEQ ID NO: 2144682 - RNA, 20 nt, Human
augaucuggauccaccaaga

SEQ ID NO: 2144683 - RNA, 18 nt, Human
augcaaugccucuggaau

SEQ ID NO: 2144684 - RNA, 20 nt, Human
augcgcacaaggcugaccaa

SEQ ID NO: 2144685 - RNA, 12 nt, Human
caaagccuucau

SEQ ID NO: 2144686 - RNA, 21 nt, Human
caaagcguucacucccaaccu

SEQ ID NO: 2144687 - RNA, 16 nt, Human
augucuuauuuuuaga

SEQ ID NO: 2144688 - RNA, 23 nt, Human
ccauuuauaugugaucuuuguuu

SEQ ID NO: 2144689 - RNA, 21 nt, Human
cccaucaaaacuccugucuuu

SEQ ID NO: 2144690 - RNA, 12 nt, Human
ccuaucuucaua

SEQ ID NO: 2144691 - RNA, 20 nt, Human
ccuuguucuuuggaaauaca

SEQ ID NO: 2144692 - RNA, 22 nt, Human
cauauaguauguaaccuguuuu

SEQ ID NO: 2144693 - RNA, 13 nt, Human
cauauauuuguau

SEQ ID NO: 2144694 - RNA, 16 nt, Human
caggacagagaaauug

SEQ ID NO: 2144695 - RNA, 21 nt, Human
caggaguucgaggcugcaguc

SEQ ID NO: 2144696 - RNA, 23 nt, Human
cauugcuuguguaguagaaacua

SEQ ID NO: 2144697 - RNA, 23 nt, Human
cauuugaaaucuaugaaauauca

SEQ ID NO: 2144698 - RNA, 13 nt, Human
ccagccugcacua

SEQ ID NO: 2144699 - RNA, 13 nt, Human
ccaaguuccucua

SEQ ID NO: 2144700 - RNA, 22 nt, Human
cugagagcauguuuuaucauua

SEQ ID NO: 2144701 - RNA, 13 nt, Human
cugcaaagguaau

SEQ ID NO: 2144702 - RNA, 21 nt, Human
cuauagccuaggugacagagu

SEQ ID NO: 2144703 - RNA, 20 nt, Human
cucucaucacuuuucucuga

SEQ ID NO: 2144704 - RNA, 18 nt, Human
cuaauuuuuguauuuuuu

SEQ ID NO: 2144705 - RNA, 20 nt, Human
cuauuuuuacuaaucuuucu

SEQ ID NO: 2144706 - RNA, 16 nt, Human
cucaauaguaaaagau

SEQ ID NO: 2144707 - RNA, 15 nt, Human
cucaugcauugcuug

SEQ ID NO: 2144708 - RNA, 17 nt, Human
cuaacacuggccccuag

SEQ ID NO: 2144709 - RNA, 15 nt, Human
cguacauucaauguu

SEQ ID NO: 2144710 - RNA, 21 nt, Human
cgaauagcugggacuacaggu

SEQ ID NO: 2144711 - RNA, 21 nt, Human
ccuggugaggaagcuccaguc

SEQ ID NO: 2144712 - RNA, 22 nt, Human
ccuaaucccugggcauugcuuu

SEQ ID NO: 2144713 - RNA, 20 nt, Human
cuugacucuuguuuucaguu

SEQ ID NO: 2144714 - RNA, 23 nt, Human
cucaacccucccucagccccucu

SEQ ID NO: 2144715 - RNA, 19 nt, Human
cucuacagaggccaugggc

SEQ ID NO: 2144716 - RNA, 15 nt, Human
cucugcugccauggc

SEQ ID NO: 2144717 - RNA, 21 nt, Human
cuagggagggggaaagaagga

SEQ ID NO: 2144718 - RNA, 15 nt, Human
cuaguuccuucaugu

SEQ ID NO: 2144719 - RNA, 16 nt, Human
cuauggucaucuuuuu

SEQ ID NO: 2144720 - RNA, 15 nt, Human
cuaaauuaacuuuuu

SEQ ID NO: 2144721 - RNA, 14 nt, Human
cucuuuucaaugug

SEQ ID NO: 2144722 - RNA, 21 nt, Human
cucuccagaaagcucaucuca

SEQ ID NO: 2144723 - RNA, 23 nt, Human
cugcuaggugggccagccccucc

SEQ ID NO: 2144724 - RNA, 17 nt, Human
cuuuguccuuuuuguua

SEQ ID NO: 2144725 - RNA, 12 nt, Human
cuuuuguuguug

SEQ ID NO: 2144726 - RNA, 14 nt, Human
ccgugggccauggc

SEQ ID NO: 2144727 - RNA, 16 nt, Human
ccauguacuguaguuu

SEQ ID NO: 2144728 - RNA, 21 nt, Human
ccauuuuuauuucaaaauaua

SEQ ID NO: 2144729 - RNA, 12 nt, Human
cccaucuuguuu

SEQ ID NO: 2144730 - RNA, 19 nt, Human
cccaugcugaccuguguuu

SEQ ID NO: 2144731 - RNA, 19 nt, Human
ccacugaggagcuuuguuu

SEQ ID NO: 2144732 - RNA, 20 nt, Human
ccagcauaaauaucuucuga

SEQ ID NO: 2144733 - RNA, 14 nt, Human
cauuuuuaaauaca

SEQ ID NO: 2144734 - RNA, 20 nt, Human
cauuuuuauuucaaaauaua

SEQ ID NO: 2144735 - RNA, 18 nt, Human
cacagaucacagcuucag

SEQ ID NO: 2144736 - RNA, 19 nt, Human
caccuuucccaucuuccaa

SEQ ID NO: 2144737 - RNA, 15 nt, Human
cacagaaguagcucu

SEQ ID NO: 2144738 - RNA, 16 nt, Human
caacuaugauuuggaa

SEQ ID NO: 2144739 - RNA, 13 nt, Human
caauauuccugaa

SEQ ID NO: 2144740 - RNA, 16 nt, Human
cagaaaucuagaagac

SEQ ID NO: 2144741 - RNA, 16 nt, Human
cagaugauucuauguc

SEQ ID NO: 2144742 - RNA, 12 nt, Human
caugagaaauua

SEQ ID NO: 2144743 - RNA, 22 nt, Human
cauuaucuugucacuguaguuu

SEQ ID NO: 2144744 - RNA, 18 nt, Human
cauugcuuucugaaauua

SEQ ID NO: 2144745 - RNA, 20 nt, Human
cauuguaccaugaaauaucc

SEQ ID NO: 2144746 - RNA, 13 nt, Human
cauuuaaaauaua

SEQ ID NO: 2144747 - RNA, 23 nt, Human
cagggcucugugaccaggaagga

SEQ ID NO: 2144748 - RNA, 16 nt, Human
ccagcaauauaucuga

SEQ ID NO: 2144749 - RNA, 20 nt, Human
cagagggguggguuccucuu

SEQ ID NO: 2144750 - RNA, 21 nt, Human
caauuuauugcacaaaauaua

SEQ ID NO: 2144751 - RNA, 13 nt, Human
cacauucuuguuu

SEQ ID NO: 2144752 - RNA, 14 nt, Human
caaauaagaaauuu

SEQ ID NO: 2144753 - RNA, 11 nt, Human
ccacugcacuc

SEQ ID NO: 2144754 - RNA, 14 nt, Human
cacucaaucucuga

SEQ ID NO: 2144755 - RNA, 16 nt, Human
auuuucuacucuuuuu

SEQ ID NO: 2144756 - RNA, 17 nt, Human
cacacuccccugcacug

SEQ ID NO: 2144757 - RNA, 20 nt, Human
cacaaggugcaaaucaaugc

SEQ ID NO: 2144758 - RNA, 17 nt, Human
cagacaccuugacaggg

SEQ ID NO: 2144759 - RNA, 20 nt, Human
caauuuauaaaauagaaaua

SEQ ID NO: 2144760 - RNA, 15 nt, Human
caggagaauugcuug

SEQ ID NO: 2144761 - RNA, 15 nt, Human
ccagcauaaauaucu

SEQ ID NO: 2144762 - RNA, 17 nt, Human
ccauguugccugucuuu

SEQ ID NO: 2144763 - RNA, 12 nt, Human
cauuauuuggau

SEQ ID NO: 2144764 - RNA, 19 nt, Human
cauucaaaaguugaaauua

SEQ ID NO: 2144765 - RNA, 16 nt, Human
cauuuuacuguacaga

SEQ ID NO: 2144766 - RNA, 17 nt, Human
cauauaccagcaauaua

SEQ ID NO: 2144767 - RNA, 19 nt, Human
cauauaccagcaauauauc

SEQ ID NO: 2144768 - RNA, 14 nt, Human
cagugcaagaagga

SEQ ID NO: 2144769 - RNA, 14 nt, Human
caguucaucuuuug

SEQ ID NO: 2144770 - RNA, 16 nt, Human
auuguauggaaauaua

SEQ ID NO: 2144771 - RNA, 14 nt, Human
auugcgaaucuuuu

SEQ ID NO: 2144772 - RNA, 20 nt, Human
auucuuacauuuuacuuuuu

SEQ ID NO: 2144773 - RNA, 24 nt, Human
auuagagaaauauaguucacaaug

SEQ ID NO: 2144774 - RNA, 17 nt, Human
auuacaucuuucacauu

SEQ ID NO: 2144775 - RNA, 15 nt, Human
caauaaagccuucaa

SEQ ID NO: 2144776 - RNA, 15 nt, Human
caaauuuguaaacuu

SEQ ID NO: 2144777 - RNA, 15 nt, Human
caacaguuccuucag

SEQ ID NO: 2144778 - RNA, 18 nt, Human
ccauagcaagauugcuua

SEQ ID NO: 2144779 - RNA, 18 nt, Human
cacuuaccucucuguguu

SEQ ID NO: 2144780 - RNA, 20 nt, Human
cagacccccucuagaaauuu

SEQ ID NO: 2144781 - RNA, 15 nt, Human
cagaaucauugcuua

SEQ ID NO: 2144782 - RNA, 13 nt, Human
cagugcuuccaag

SEQ ID NO: 2144783 - RNA, 22 nt, Human
caucccugaggcuggacuccag

SEQ ID NO: 2144784 - RNA, 21 nt, Human
caucuaccuuuucucuucauu

SEQ ID NO: 2144785 - RNA, 17 nt, Human
cauggacagaagaaggc

SEQ ID NO: 2144786 - RNA, 16 nt, Human
cauggacuaagaacga

SEQ ID NO: 2144787 - RNA, 23 nt, Human
aauaguuuauaaaugugaacuua

SEQ ID NO: 2144788 - RNA, 14 nt, Human
aauauaauaaauau

SEQ ID NO: 2144789 - RNA, 16 nt, Human
aauauguauuuuaugu

SEQ ID NO: 2144790 - RNA, 16 nt, Human
aaucauugaaguauuu

SEQ ID NO: 2144791 - RNA, 15 nt, Human
aauccuggauuuuuu

SEQ ID NO: 2144792 - RNA, 12 nt, Human
aauuuugauuca

SEQ ID NO: 2144793 - RNA, 12 nt, Human
aaugaucuuuuc

SEQ ID NO: 2144794 - RNA, 15 nt, Human
aaugaugugauacaa

SEQ ID NO: 2144795 - RNA, 14 nt, Human
aauuagagaaauau

SEQ ID NO: 2144796 - RNA, 23 nt, Human
aauuauuaccagugaaucuuugu

SEQ ID NO: 2144797 - RNA, 17 nt, Human
aauuauuucagaaaugu

SEQ ID NO: 2144798 - RNA, 14 nt, Human
aauuccacuggacu

SEQ ID NO: 2144799 - RNA, 21 nt, Human
aauuccugguuugaagaaaua

SEQ ID NO: 2144800 - RNA, 14 nt, Human
aauucuaacuuuuu

SEQ ID NO: 2144801 - RNA, 14 nt, Human
aauugacuguauuu

SEQ ID NO: 2144802 - RNA, 21 nt, Human
aauugagaagcguauguuuuu

SEQ ID NO: 2144803 - RNA, 12 nt, Human
acuacuguguuc

SEQ ID NO: 2144804 - RNA, 16 nt, Human
acuaguguuuuuuaga

SEQ ID NO: 2144805 - RNA, 14 nt, Human
accuugacuugauu

SEQ ID NO: 2144806 - RNA, 20 nt, Human
aaaagugaucaauaaaaugu

SEQ ID NO: 2144807 - RNA, 17 nt, Human
aaaauguaggguuauaa

SEQ ID NO: 2144808 - RNA, 23 nt, Human
acaauuuauaaaauagaaauaua

SEQ ID NO: 2144809 - RNA, 12 nt, Human
acaguguacagu

SEQ ID NO: 2144810 - RNA, 23 nt, Human
acauacaggaagguagaaauauc

SEQ ID NO: 2144811 - RNA, 13 nt, Human
acauaugaaaaua

SEQ ID NO: 2144812 - RNA, 14 nt, Human
acauaugaaaauac

SEQ ID NO: 2144813 - RNA, 14 nt, Human
acaucuggaaaaua

SEQ ID NO: 2144814 - RNA, 17 nt, Human
accacagcaggugucau

SEQ ID NO: 2144815 - RNA, 20 nt, Human
acccuccgauuguuccugaa

SEQ ID NO: 2144816 - RNA, 13 nt, Human
acagcauugcuuu

SEQ ID NO: 2144817 - RNA, 15 nt, Human
ucuccucucucugua

SEQ ID NO: 2144818 - RNA, 20 nt, Human
ucuaagaauuuuaucuguuu

SEQ ID NO: 2144819 - RNA, 17 nt, Human
ucuauucugaucuuauu

SEQ ID NO: 2144820 - RNA, 18 nt, Human
ucuauuuaaauucuuuuu

SEQ ID NO: 2144821 - RNA, 17 nt, Human
uauugccugagagcaca

SEQ ID NO: 2144822 - RNA, 16 nt, Human
uaucucgaacauggaa

SEQ ID NO: 2144823 - RNA, 12 nt, Human
guuuuuuuuagu

SEQ ID NO: 2144824 - RNA, 22 nt, Human
uagccagguaaugugaauaaau

SEQ ID NO: 2144825 - RNA, 19 nt, Human
uagcuagaggaaccaaccc

SEQ ID NO: 2144826 - RNA, 16 nt, Human
ucauugcgaaucuuuu

SEQ ID NO: 2144827 - RNA, 19 nt, Human
uccauguuggcuagccucu

SEQ ID NO: 2144828 - RNA, 16 nt, Human
uccauuucaucuauuu

SEQ ID NO: 2144829 - RNA, 23 nt, Human
gucaucuuuuucucuaaaauagc

SEQ ID NO: 2144830 - RNA, 19 nt, Human
guuauuagggugguauuua

SEQ ID NO: 2144831 - RNA, 21 nt, Human
aucugcuuaguagagcuuuuu

SEQ ID NO: 2144832 - RNA, 22 nt, Human
aguuuagaggaaaaaaaugacu

SEQ ID NO: 2144833 - RNA, 22 nt, Human
auagaguugggacaauugcuua

SEQ ID NO: 2144834 - RNA, 15 nt, Human
auagauucaccugua

SEQ ID NO: 2144835 - RNA, 12 nt, Human
auuaugauucuu

SEQ ID NO: 2144836 - RNA, 16 nt, Human
auuauuuucaccuguu

SEQ ID NO: 2144837 - RNA, 23 nt, Human
auucuaaccagagcaagcuuuuu

SEQ ID NO: 2144838 - RNA, 14 nt, Human
auucugguuacaug

SEQ ID NO: 2144839 - RNA, 17 nt, Human
augcaccaaaucaucuc

SEQ ID NO: 2144840 - RNA, 17 nt, Human
augcauugcuaaaauau

SEQ ID NO: 2144841 - RNA, 20 nt, Human
augugcucuccaaauuuuuu

SEQ ID NO: 2144842 - RNA, 16 nt, Human
aaauuagagaaauaua

SEQ ID NO: 2144843 - RNA, 20 nt, Human
aaauuuguuacuuaaauaua

SEQ ID NO: 2144844 - RNA, 18 nt, Human
aacaaauaauuuuuuagu

SEQ ID NO: 2144845 - RNA, 16 nt, Human
aacaauagaaaccugu

SEQ ID NO: 2144846 - RNA, 14 nt, Human
aaagauacauuugu

SEQ ID NO: 2144847 - RNA, 21 nt, Human
aaagucaaucuuaucauauuu

SEQ ID NO: 2144848 - RNA, 14 nt, Human
aaauaaaaaauaua

SEQ ID NO: 2144849 - RNA, 16 nt, Human
aaauaaaauuguacau

SEQ ID NO: 2144850 - RNA, 22 nt, Human
aaauauguucuuuaaaaauaua

SEQ ID NO: 2144851 - RNA, 20 nt, Human
aaauauguugaugaaaaaua

SEQ ID NO: 2144852 - RNA, 16 nt, Human
aaauauuauucuuaau

SEQ ID NO: 2144853 - RNA, 16 nt, Human
agacuguagaagaaag

SEQ ID NO: 2144854 - RNA, 16 nt, Human
agaguuaagaagaaaa

SEQ ID NO: 2144855 - RNA, 16 nt, Human
agauaugugaagaaaa

SEQ ID NO: 2144856 - RNA, 17 nt, Human
agaucacuuugcucuga

SEQ ID NO: 2144857 - RNA, 22 nt, Human
aacuauuacaccaaauaaauau

SEQ ID NO: 2144858 - RNA, 13 nt, Human
aacucagaaauuu

SEQ ID NO: 2144859 - RNA, 15 nt, Human
aacuugagcgugaau

SEQ ID NO: 2144860 - RNA, 23 nt, Human
aaggagccaauugauuucaacag

SEQ ID NO: 2144861 - RNA, 19 nt, Human
aagggaagugguucuuaga

SEQ ID NO: 2144862 - RNA, 18 nt, Human
aagggucaacaucuuuua

SEQ ID NO: 2144863 - RNA, 16 nt, Human
aaguaacuugucuuaa

SEQ ID NO: 2144864 - RNA, 17 nt, Human
aaguaguggagccccug

SEQ ID NO: 2144865 - RNA, 21 nt, Human
agucugauucccaagcucugc

SEQ ID NO: 2144866 - RNA, 18 nt, Human
aggaaacuagcuuacaug

SEQ ID NO: 2144867 - RNA, 18 nt, Human
aguagauuagaucuuuua

SEQ ID NO: 2144868 - RNA, 17 nt, Human
agggauuccccuaaccu

SEQ ID NO: 2144869 - RNA, 12 nt, Human
agggucucuacc

SEQ ID NO: 2144870 - RNA, 21 nt, Human
aggucgaccccaaagccccuu

SEQ ID NO: 2144871 - RNA, 20 nt, Human
agcagcuaccagguguucua

SEQ ID NO: 2144872 - RNA, 18 nt, Human
agauuucugauuuuaugu

SEQ ID NO: 2144873 - RNA, 21 nt, Human
aggccuguugcuuuuuuaugg

SEQ ID NO: 2144874 - RNA, 17 nt, Human
agcucacugaaaagacu

SEQ ID NO: 2144875 - RNA, 17 nt, Human
agcuuagugaaauuacu

SEQ ID NO: 2144876 - RNA, 23 nt, Human
aacaugaaguguguuuccuucag

SEQ ID NO: 2144877 - RNA, 13 nt, Human
aacauuuuuaagu

SEQ ID NO: 2144878 - RNA, 18 nt, Human
aacuagggaagauaauau

SEQ ID NO: 2144879 - RNA, 23 nt, Human
aacuucagagggaaaguaaauau

SEQ ID NO: 2144880 - RNA, 20 nt, Human
aagaaucuucuguuccacau

SEQ ID NO: 2144881 - RNA, 17 nt, Human
aagccaaaucaaaauau

SEQ ID NO: 2144882 - RNA, 16 nt, Human
aagcccuuaaaaauau

SEQ ID NO: 2144883 - RNA, 18 nt, Human
aagcuacuuuguuuuuaa

SEQ ID NO: 2144884 - RNA, 22 nt, Human
aagcugucccucacuguugaau

SEQ ID NO: 2144885 - RNA, 15 nt, Human
aagcuguuuccauag

SEQ ID NO: 2144886 - RNA, 12 nt, Human
aagcuuuuuagu

SEQ ID NO: 2144887 - RNA, 22 nt, Human
aagggauggaagaaguaaauau

SEQ ID NO: 2144888 - RNA, 19 nt, Human
aagucagacugcugggacu

SEQ ID NO: 2144889 - RNA, 22 nt, Human
aauaaguaucacacuguauaua

SEQ ID NO: 2144890 - RNA, 17 nt, Human
aauuauuaccagugaau

SEQ ID NO: 2144891 - RNA, 15 nt, Human
aauucauaucuauuu

SEQ ID NO: 2144892 - RNA, 18 nt, Human
aauuucuuuuuucuuuuu

SEQ ID NO: 2144893 - RNA, 20 nt, Human
acaaauaauuuuuaaauaua

SEQ ID NO: 2144894 - RNA, 13 nt, Human
acaaggguggcau

SEQ ID NO: 2144895 - RNA, 12 nt, Human
acaaugaaauua

SEQ ID NO: 2144896 - RNA, 20 nt, Human
acaguuuagagugaaauaua

SEQ ID NO: 2144897 - RNA, 21 nt, Human
acauccacaugauaccucuga

SEQ ID NO: 2144898 - RNA, 18 nt, Human
acucaauaaaaucaugua

SEQ ID NO: 2144899 - RNA, 22 nt, Human
acagcauugcuuucugaaauua

SEQ ID NO: 2144900 - RNA, 15 nt, Human
accugucgcccagug

SEQ ID NO: 2144901 - RNA, 21 nt, Human
aaauccuggauuuuuuucugu

SEQ ID NO: 2144902 - RNA, 15 nt, Human
aaauuugguucuaau

SEQ ID NO: 2144903 - RNA, 11 nt, Human
aaauuuuaugu

SEQ ID NO: 2144904 - RNA, 21 nt, Human
aacaacaaauaauuuuuuagu

SEQ ID NO: 2144905 - RNA, 15 nt, Human
aacauacuuauaugu

SEQ ID NO: 2144906 - RNA, 15 nt, Human
auacaaguuuucaua

SEQ ID NO: 2144907 - RNA, 15 nt, Human
auagcuuuauuuuuu

SEQ ID NO: 2144908 - RNA, 20 nt, Human
auauauguauaugcaauaua

SEQ ID NO: 2144909 - RNA, 12 nt, Human
auaucugugaaa

SEQ ID NO: 2144910 - RNA, 13 nt, Human
aucagagagcuca

SEQ ID NO: 2144911 - RNA, 22 nt, Human
agauauuaaaugauguuuuauu

SEQ ID NO: 2144912 - RNA, 14 nt, Human
agauguuuuuaugu

SEQ ID NO: 2144913 - RNA, 17 nt, Human
agauuuuaauuuugaau

SEQ ID NO: 2144914 - RNA, 21 nt, Human
agcaaauuuauaauuuuaaga

SEQ ID NO: 2144915 - RNA, 23 nt, Human
agcaagcuuuuuuauuuuuuaua

SEQ ID NO: 2144916 - RNA, 14 nt, Human
aaucuuuuuuaugu

SEQ ID NO: 2144917 - RNA, 16 nt, Human
acuguggaaaaauauu

SEQ ID NO: 2144918 - RNA, 17 nt, Human
acuuauuuuaaaauauu

SEQ ID NO: 2144919 - RNA, 19 nt, Human
acuugauggcuccgaacac

SEQ ID NO: 2144920 - RNA, 18 nt, Human
acuuggggaaauugcuuu

SEQ ID NO: 2144921 - RNA, 12 nt, Human
aaauaaaauaua

SEQ ID NO: 2144922 - RNA, 23 nt, Human
aaauaucaugcuccauuguucag

SEQ ID NO: 2144923 - RNA, 21 nt, Human
aaacauuccguuuacauuuua

SEQ ID NO: 2144924 - RNA, 16 nt, Human
aaacauuuucuugaau

SEQ ID NO: 2144925 - RNA, 21 nt, Human
aucucuacgcaaaaaauaacu

SEQ ID NO: 2144926 - RNA, 15 nt, Human
augaagaugaugcua

SEQ ID NO: 2144927 - RNA, 19 nt, Human
augaggagugaacauuugg

SEQ ID NO: 2144928 - RNA, 13 nt, Human
augauuguacaga

SEQ ID NO: 2144929 - RNA, 21 nt, Human
auauuuucugugcagccacug

SEQ ID NO: 2144930 - RNA, 19 nt, Human
auagcugacccagccccuu

SEQ ID NO: 2144931 - RNA, 17 nt, Human
auguuuuguuucugaaa

SEQ ID NO: 2144932 - RNA, 14 nt, Human
auggucaucuuuuu

SEQ ID NO: 2144933 - RNA, 10 nt, Human
augucuauaa

SEQ ID NO: 2144934 - RNA, 18 nt, Human
augcuguauuuucuuuuu

SEQ ID NO: 2144935 - RNA, 19 nt, Human
augcuuauguuagaaauaa

SEQ ID NO: 2144936 - RNA, 23 nt, Human
auuaucaagcuaauaaaauauca

SEQ ID NO: 2144937 - RNA, 14 nt, Human
auucuccugccuca

SEQ ID NO: 2144938 - RNA, 23 nt, Human
auugccuuuuccuguaucuauuu

SEQ ID NO: 2144939 - RNA, 15 nt, Human
agcucagcuuuuugu

SEQ ID NO: 2144940 - RNA, 14 nt, Human
aguuaaauuuucau

SEQ ID NO: 2144941 - RNA, 15 nt, Human
aggggaggguggcag

SEQ ID NO: 2144942 - RNA, 20 nt, Human
auaaagccuucaaacucccu

SEQ ID NO: 2144943 - RNA, 18 nt, Human
aguucuuagauaucuuuu

SEQ ID NO: 2144944 - RNA, 16 nt, Human
aguugcccaucuuguu

SEQ ID NO: 2144945 - RNA, 20 nt, Human
auaauaaacaguggaauaua

SEQ ID NO: 2144946 - RNA, 17 nt, Human
auaaugaauggacucaa

SEQ ID NO: 2144947 - RNA, 20 nt, Human
agcacuaaggugugcucuga

SEQ ID NO: 2144948 - RNA, 16 nt, Human
aggccucccucaaccc

SEQ ID NO: 2144949 - RNA, 15 nt, Human
aggcuguccuuaccc

SEQ ID NO: 2144950 - RNA, 15 nt, Human
aggaguuccuaacca

SEQ ID NO: 2144951 - RNA, 13 nt, Human
aggacucccuccu

SEQ ID NO: 2144952 - RNA, 18 nt, Human
cuaaaucuccuauuuuuu

SEQ ID NO: 2144953 - RNA, 16 nt, Human
cuacaauaucuucaua

SEQ ID NO: 2144954 - RNA, 12 nt, Human
cucaaaaugaca

SEQ ID NO: 2144955 - RNA, 17 nt, Human
cucccagggccagggcc

SEQ ID NO: 2144956 - RNA, 12 nt, Human
cucauuccugaa

SEQ ID NO: 2144957 - RNA, 13 nt, Human
cugaauguucuga

SEQ ID NO: 2144958 - RNA, 19 nt, Human
cucuauauuuagauuguua

SEQ ID NO: 2144959 - RNA, 14 nt, Human
cugauggaguaaau

SEQ ID NO: 2144960 - RNA, 23 nt, Human
cuucaccaauaaguauucugugu

SEQ ID NO: 2144961 - RNA, 18 nt, Human
gaaaaugaaaauuaggau

SEQ ID NO: 2144962 - RNA, 17 nt, Human
cuuuguuuguguuguug

SEQ ID NO: 2144963 - RNA, 23 nt, Human
cuuuugcuuuuccuuuguuuuua

SEQ ID NO: 2144964 - RNA, 12 nt, Human
cuugauguguua

SEQ ID NO: 2144965 - RNA, 16 nt, Human
gaucuugugacauauu

SEQ ID NO: 2144966 - RNA, 15 nt, Human
gauaugaaaaauaug

SEQ ID NO: 2144967 - RNA, 13 nt, Human
gagggaaaauguu

SEQ ID NO: 2144968 - RNA, 14 nt, Human
gccaaagaccaaau

SEQ ID NO: 2144969 - RNA, 21 nt, Human
gcaccaauaaagccuucaaac

SEQ ID NO: 2144970 - RNA, 17 nt, Human
gaacauguugguauuua

SEQ ID NO: 2144971 - RNA, 20 nt, Human
gacaaggccccagagacuca

SEQ ID NO: 2144972 - RNA, 17 nt, Human
gacauggugaaaauauu

SEQ ID NO: 2144973 - RNA, 12 nt, Human
gacuggaauuuu

SEQ ID NO: 2144974 - RNA, 24 nt, Human
gaccucguccucccccugccagug

SEQ ID NO: 2144975 - RNA, 15 nt, Human
gcccuuaaaaauaug

SEQ ID NO: 2144976 - RNA, 15 nt, Human
gcccuucauuuggag

SEQ ID NO: 2144977 - RNA, 16 nt, Human
gcccagggagaggcca

SEQ ID NO: 2144978 - RNA, 16 nt, Human
gcgaaucuuuuuuagc

SEQ ID NO: 2144979 - RNA, 12 nt, Human herpesvirus 7
guuucaaaaagu

SEQ ID NO: 2144980 - RNA, 20 nt, Human herpesvirus 7
caaagcuucuacaaacaauu

SEQ ID NO: 2144981 - RNA, 16 nt, Human herpesvirus 7
augucuaaaaguacag

SEQ ID NO: 2144982 - RNA, 19 nt, Human herpesvirus 7
uucauauggagaaggcaug

SEQ ID NO: 2144983 - RNA, 18 nt, Human herpesvirus 7
auggaaaguuuauagaac

SEQ ID NO: 2144984 - RNA, 14 nt, Human herpesvirus 7
uuuucaggaaaauc

SEQ ID NO: 2144985 - RNA, 16 nt, Human herpesvirus 7
aauuugaugaaauugu

SEQ ID NO: 2144986 - RNA, 15 nt, Human herpesvirus 7
caucucuguggcugu

SEQ ID NO: 2144987 - RNA, 18 nt, Human herpesvirus 7
uuugaacggaauaaacaa

SEQ ID NO: 2144988 - RNA, 14 nt, Human herpesvirus 7
auaucuaaagugga

SEQ ID NO: 2144989 - RNA, 15 nt, Human herpesvirus 7
uauacgcuuaaaauu

SEQ ID NO: 2144990 - RNA, 17 nt, Human herpesvirus 7
uagaaaaugcuguuuuu

SEQ ID NO: 2144991 - RNA, 13 nt, Human herpesvirus 7
cauuaugagauuu

SEQ ID NO: 2144992 - RNA, 21 nt, Human herpesvirus 7
auuuugugccccaaacuguau

SEQ ID NO: 2144993 - RNA, 23 nt, Human herpesvirus 7
ggaucaaaagcugcagcugaaag

SEQ ID NO: 2144994 - RNA, 16 nt, Human herpesvirus 7
cauuuuaccaaauaug

SEQ ID NO: 2144995 - RNA, 17 nt, Human herpesvirus 7
gcauugcauaucaugau

SEQ ID NO: 2144996 - RNA, 12 nt, Human herpesvirus 7
guuguuggaaau

SEQ ID NO: 2144997 - RNA, 17 nt, Human herpesvirus 7
uaagcaaauaaauugug

SEQ ID NO: 2144998 - RNA, 14 nt, Human herpesvirus 7
uacacucuguuacu

SEQ ID NO: 2144999 - RNA, 17 nt, Human herpesvirus 7
ugaaaucauuuugcugu

SEQ ID NO: 2145000 - RNA, 13 nt, Human herpesvirus 7
cauaaaauguaca

SEQ ID NO: 2145001 - RNA, 21 nt, Human herpesvirus 7
aguuugucucauugacauguu

SEQ ID NO: 2145002 - RNA, 14 nt, Human herpesvirus 7
cucguguggccuuc

SEQ ID NO: 2145003 - RNA, 14 nt, Human herpesvirus 7
cggacuuaugucca

SEQ ID NO: 2145004 - RNA, 20 nt, Human herpesvirus 7
uccaugcauauuugaacaua

SEQ ID NO: 2145005 - RNA, 22 nt, Human herpesvirus 7
aaaauacaauagugaacaugug

SEQ ID NO: 2145006 - RNA, 14 nt, Human herpesvirus 7
uuaagauacauuuu

SEQ ID NO: 2145007 - RNA, 15 nt, Human herpesvirus 7
aguuaauuuugcaga

SEQ ID NO: 2145008 - RNA, 23 nt, Human herpesvirus 7
aacuauaucaucaucuuuuugaa

SEQ ID NO: 2145009 - RNA, 15 nt, Human herpesvirus 7
aaaagccauaaaaug

SEQ ID NO: 2145010 - RNA, 15 nt, Human herpesvirus 7
uugagcaauugauuc

SEQ ID NO: 2145011 - RNA, 17 nt, Human herpesvirus 7
gagguccaauagaaaac

SEQ ID NO: 2145012 - RNA, 20 nt, Human herpesvirus 7
cgauaugaauuugaaacugg

SEQ ID NO: 2145013 - RNA, 17 nt, Human herpesvirus 7
uaaaauuaauguaauuu

SEQ ID NO: 2145014 - RNA, 22 nt, Human herpesvirus 7
aaguguaagcuuuuucuuccgc

SEQ ID NO: 2145015 - RNA, 16 nt, Human herpesvirus 7
ugaguguguuaaaugc

SEQ ID NO: 2145016 - RNA, 16 nt, Human herpesvirus 7
acugauauaaaugcuu

SEQ ID NO: 2145017 - RNA, 13 nt, Human herpesvirus 7
guacaaauguuuu

SEQ ID NO: 2145018 - RNA, 15 nt, Human herpesvirus 7
uucgcugaagaacau

SEQ ID NO: 2145019 - RNA, 19 nt, Human herpesvirus 7
uccgaaaagacaacaaggg

SEQ ID NO: 2145020 - RNA, 15 nt, Human herpesvirus 7
acaaaauguauacaa

SEQ ID NO: 2145021 - RNA, 17 nt, Human herpesvirus 7
ccacucuggaaauguca

SEQ ID NO: 2145022 - RNA, 13 nt, Human herpesvirus 7
auggaugugcaca

SEQ ID NO: 2145023 - RNA, 17 nt, Human herpesvirus 7
uuuucaaugcaacuuua

SEQ ID NO: 2145024 - RNA, 16 nt, Human herpesvirus 7
aaauuauuauuaguau

SEQ ID NO: 2145025 - RNA, 22 nt, Human herpesvirus 7
aaaaucagaaauguuacuuaag

SEQ ID NO: 2145026 - RNA, 21 nt, Human herpesvirus 7
aguugagcgcauggagcacaa

SEQ ID NO: 2145027 - RNA, 17 nt, Human herpesvirus 7
gauuucagaauuuccag

SEQ ID NO: 2145028 - RNA, 20 nt, Human herpesvirus 7
uauuccagauaugacaaauu

SEQ ID NO: 2145029 - RNA, 16 nt, Human herpesvirus 7
auuaauucuagcagcu

SEQ ID NO: 2145030 - RNA, 16 nt, Human herpesvirus 7
aauuaaugcauuggaa

SEQ ID NO: 2145031 - RNA, 23 nt, Human herpesvirus 7
uuacguacauggacauaagaauc

SEQ ID NO: 2145032 - RNA, 14 nt, Human herpesvirus 7
cuggcaauauccca

SEQ ID NO: 2145033 - RNA, 22 nt, Human herpesvirus 7
cuucuuuuuuugaacuguugcc

SEQ ID NO: 2145034 - RNA, 22 nt, Human herpesvirus 7
aaguagguaaaaaauaaauaua

SEQ ID NO: 2145035 - RNA, 17 nt, Human herpesvirus 7
uaacucugccagucucu

SEQ ID NO: 2145036 - RNA, 19 nt, Human herpesvirus 7
aacacauucugucuuggaa

SEQ ID NO: 2145037 - RNA, 19 nt, Human herpesvirus 7
uguuacaucauguuaaaaa

SEQ ID NO: 2145038 - RNA, 19 nt, Human herpesvirus 7
aggaaucgcaguguucauu

SEQ ID NO: 2145039 - RNA, 18 nt, Human herpesvirus 7
aaucauuuuuaaaaauaa

SEQ ID NO: 2145040 - RNA, 18 nt, Human herpesvirus 7
auauaugcauuauaucca

SEQ ID NO: 2145041 - RNA, 14 nt, Human herpesvirus 7
uuuauauuaauuug

SEQ ID NO: 2145042 - RNA, 19 nt, Human herpesvirus 7
uauucaaauuccuccugaa

SEQ ID NO: 2145043 - RNA, 13 nt, Human herpesvirus 7
uguaaguaaauuu

SEQ ID NO: 2145044 - RNA, 22 nt, Human herpesvirus 7
ccaacugaccagagauguuuua

SEQ ID NO: 2145045 - RNA, 21 nt, Human herpesvirus 7
uacaaugcugucucugaggag

SEQ ID NO: 2145046 - RNA, 18 nt, Human herpesvirus 7
caugggauuucuguaaaa

SEQ ID NO: 2145047 - RNA, 13 nt, Human herpesvirus 7
uugugcaauuugg

SEQ ID NO: 2145048 - RNA, 18 nt, Human herpesvirus 7
acuccauucgguuuucaa

SEQ ID NO: 2145049 - RNA, 21 nt, Human herpesvirus 7
acaaucgcggggaaaaaauga

SEQ ID NO: 2145050 - RNA, 21 nt, Human herpesvirus 7
uuuucuuccuagcauuaauuu

SEQ ID NO: 2145051 - RNA, 20 nt, Human herpesvirus 7
cauacuaaauuucuuaaaga

SEQ ID NO: 2145052 - RNA, 17 nt, Human herpesvirus 7
uaugugaaaauaaacag

SEQ ID NO: 2145053 - RNA, 12 nt, Human herpesvirus 7
uuaauuaucuac

SEQ ID NO: 2145054 - RNA, 20 nt, Human herpesvirus 7
aucauguuuaagaaaaguug

SEQ ID NO: 2145055 - RNA, 14 nt, Human herpesvirus 7
gaaaauaaacagga

SEQ ID NO: 2145056 - RNA, 21 nt, Human herpesvirus 7
uauuaacaagcacacuaaaaa

SEQ ID NO: 2145057 - RNA, 15 nt, Human herpesvirus 7
cauuugcuucuucua

SEQ ID NO: 2145058 - RNA, 17 nt, Human herpesvirus 7
guagaaaaaaacaauga

SEQ ID NO: 2145059 - RNA, 11 nt, Human herpesvirus 7
acgaauuauuu

SEQ ID NO: 2145060 - RNA, 15 nt, Human herpesvirus 7
gcaugcuuacaguga

SEQ ID NO: 2145061 - RNA, 18 nt, Human herpesvirus 7
cauagcacucauacuaau

SEQ ID NO: 2145062 - RNA, 19 nt, Human herpesvirus 7
agaucaauugaguuuacug

SEQ ID NO: 2145063 - RNA, 13 nt, Human herpesvirus 7
gggacaauuauuu

SEQ ID NO: 2145064 - RNA, 13 nt, Human herpesvirus 7
gguugucuguucu

SEQ ID NO: 2145065 - RNA, 21 nt, Human herpesvirus 7
auuaaacaaucuggacauuuc

SEQ ID NO: 2145066 - RNA, 16 nt, Human herpesvirus 7
gcucagcuagaaugug

SEQ ID NO: 2145067 - RNA, 21 nt, Human herpesvirus 7
acgauuugguguacuacauau

SEQ ID NO: 2145068 - RNA, 20 nt, Human herpesvirus 7
acuuucuauuguaugggaaa

SEQ ID NO: 2145069 - RNA, 14 nt, Human herpesvirus 7
acagugcuguacuu

SEQ ID NO: 2145070 - RNA, 17 nt, Human herpesvirus 7
ugcaacucuucuucaga

SEQ ID NO: 2145071 - RNA, 20 nt, Human herpesvirus 7
auuuccguuguuaaaaauua

SEQ ID NO: 2145072 - RNA, 21 nt, Human herpesvirus 7
gacuuccucucguguggccuu

SEQ ID NO: 2145073 - RNA, 19 nt, Human herpesvirus 7
auuuuuuaaagaaaagcuu

SEQ ID NO: 2145074 - RNA, 16 nt, Human herpesvirus 7
acucaaaacagaacuu

SEQ ID NO: 2145075 - RNA, 15 nt, Human herpesvirus 7
acaguugcuugugaa

SEQ ID NO: 2145076 - RNA, 15 nt, Human herpesvirus 7
uucaguaaauucuuc

SEQ ID NO: 2145077 - RNA, 23 nt, Human herpesvirus 7
uuggaguaaucaauaaaauuaaa

SEQ ID NO: 2145078 - RNA, 18 nt, Human herpesvirus 7
cugcagcugaaagcgcaa

SEQ ID NO: 2145079 - RNA, 19 nt, Human herpesvirus 7
aacaaguagaaaaugcugu

SEQ ID NO: 2145080 - RNA, 22 nt, Human herpesvirus 7
acuguaauauaauuauuuuaaa

SEQ ID NO: 2145081 - RNA, 21 nt, Human herpesvirus 7
gcagacauugaagauuguuua

SEQ ID NO: 2145082 - RNA, 11 nt, Human herpesvirus 7
cuuacagugaa

SEQ ID NO: 2145083 - RNA, 24 nt, Human herpesvirus 7
cauuucaaaaucagaaauguuacu

SEQ ID NO: 2145084 - RNA, 21 nt, Human herpesvirus 7
uuucuggaauguugguuuaua

SEQ ID NO: 2145085 - RNA, 15 nt, Human herpesvirus 7
auguucaaauaugca

SEQ ID NO: 2145086 - RNA, 20 nt, Human herpesvirus 7
cuauccagaacauuuauuuu

SEQ ID NO: 2145087 - RNA, 15 nt, Human herpesvirus 7
uuugugcugugucaa

SEQ ID NO: 2145088 - RNA, 15 nt, Human herpesvirus 7
uauauguguacagau

SEQ ID NO: 2145089 - RNA, 23 nt, Human herpesvirus 7
ugaaaacauuagcauugaaauca

SEQ ID NO: 2145090 - RNA, 13 nt, Human herpesvirus 7
ugcaaaacaaaau

SEQ ID NO: 2145091 - RNA, 14 nt, Human herpesvirus 7
ugacaaauuucagg

SEQ ID NO: 2145092 - RNA, 14 nt, Human herpesvirus 7
auugcuuucuaagu

SEQ ID NO: 2145093 - RNA, 20 nt, Human herpesvirus 7
gucuauuucaauuaaugcau

SEQ ID NO: 2145094 - RNA, 22 nt, Human herpesvirus 7
ucucauaauaucgguuaucuua

SEQ ID NO: 2145095 - RNA, 12 nt, Human herpesvirus 7
aacuaaguugaa

SEQ ID NO: 2145096 - RNA, 19 nt, Human herpesvirus 7
ugcaauuuucacaauggaa

SEQ ID NO: 2145097 - RNA, 19 nt, Human herpesvirus 7
augcaaucaacaaaaugac

SEQ ID NO: 2145098 - RNA, 22 nt, Human herpesvirus 7
uaaaaaucucagcucuguaaua

SEQ ID NO: 2145099 - RNA, 12 nt, Human herpesvirus 7
aucuauuaaaua

SEQ ID NO: 2145100 - RNA, 21 nt, Human herpesvirus 7
uuccacgaucauuccguuuuu

SEQ ID NO: 2145101 - RNA, 15 nt, Human herpesvirus 7
ucaaguagaauacca

SEQ ID NO: 2145102 - RNA, 20 nt, Human herpesvirus 7
aauuuggugaagauucuuaa

SEQ ID NO: 2145103 - RNA, 18 nt, Human herpesvirus 7
cuauucucauagauuuca

SEQ ID NO: 2145104 - RNA, 13 nt, Human herpesvirus 7
aaguuuucuuaua

SEQ ID NO: 2145105 - RNA, 21 nt, Human herpesvirus 7
uguuacaaucgcggggaaaaa

SEQ ID NO: 2145106 - RNA, 17 nt, Human herpesvirus 7
uuaaauuauuauuagua

SEQ ID NO: 2145107 - RNA, 15 nt, Human herpesvirus 7
uaaaauagaaaaugu

SEQ ID NO: 2145108 - RNA, 20 nt, Human herpesvirus 7
uaaauuacgagauauuauua

SEQ ID NO: 2145109 - RNA, 10 nt, Human herpesvirus 7
acaaaacaag

SEQ ID NO: 2145110 - RNA, 23 nt, Human herpesvirus 7
uaacgugagggggacaauuauuu

SEQ ID NO: 2145111 - RNA, 20 nt, Human herpesvirus 7
gcugaaacucaucauugaag

SEQ ID NO: 2145112 - RNA, 18 nt, Human herpesvirus 7
aauuaagaaucauuugua

SEQ ID NO: 2145113 - RNA, 19 nt, Human herpesvirus 7
ucaaaagacgcuugcuauu

SEQ ID NO: 2145114 - RNA, 13 nt, Human herpesvirus 7
cuagaaaaacacu

SEQ ID NO: 2145115 - RNA, 17 nt, Human herpesvirus 7
uguaaugaauaaaaucu

SEQ ID NO: 2145116 - RNA, 20 nt, Human herpesvirus 7
uaaaaaaaccaggaacagau

SEQ ID NO: 2145117 - RNA, 13 nt, Human herpesvirus 7
aacagcgugucaa

SEQ ID NO: 2145118 - RNA, 19 nt, Human herpesvirus 7
acuaaauauggagcagcuu

SEQ ID NO: 2145119 - RNA, 13 nt, Human herpesvirus 7
aaaaaaacaauga

SEQ ID NO: 2145120 - RNA, 23 nt, Human herpesvirus 7
agaaauuguuccugugugcaaug

SEQ ID NO: 2145121 - RNA, 17 nt, Human herpesvirus 7
cauuagagcauauucca

SEQ ID NO: 2145122 - RNA, 18 nt, Human herpesvirus 7
auucauuugugaaauuga

SEQ ID NO: 2145123 - RNA, 21 nt, Human herpesvirus 7
gcugguaauaauaguggugaa

SEQ ID NO: 2145124 - RNA, 14 nt, Human herpesvirus 7
aaaacaacauacau

SEQ ID NO: 2145125 - RNA, 17 nt, Human herpesvirus 7
aguaacagguaaauugu

SEQ ID NO: 2145126 - RNA, 15 nt, Human herpesvirus 7
aauuuugauuccugu

SEQ ID NO: 2145127 - RNA, 23 nt, Human herpesvirus 7
guauuuauuuuuuccaugucaca

SEQ ID NO: 2145128 - RNA, 19 nt, Human herpesvirus 7
aguauuguaauaauuuaaa

SEQ ID NO: 2145129 - RNA, 16 nt, Human herpesvirus 7
uccaaucauaauuuuc

SEQ ID NO: 2145130 - RNA, 12 nt, Human herpesvirus 7
caaaacauuuca

SEQ ID NO: 2145131 - RNA, 21 nt, Human herpesvirus 7
ugaagagcuuuuuaaguaaau

SEQ ID NO: 2145132 - RNA, 14 nt, Human herpesvirus 7
acaaucaaacaugu

SEQ ID NO: 2145133 - RNA, 16 nt, Human herpesvirus 7
uacaauuacaaaaugu

SEQ ID NO: 2145134 - RNA, 19 nt, Human herpesvirus 7
ugacauuaguucuggccgu

SEQ ID NO: 2145135 - RNA, 14 nt, Human herpesvirus 7
agucaaucugugaa

SEQ ID NO: 2145136 - RNA, 15 nt, Human herpesvirus 7
acacuuauuugauua

SEQ ID NO: 2145137 - RNA, 15 nt, Human herpesvirus 7
gcaacaaugacuuua

SEQ ID NO: 2145138 - RNA, 23 nt, Human herpesvirus 7
agcuauuauaauguaagaaauuu

SEQ ID NO: 2145139 - RNA, 20 nt, Human herpesvirus 7
gccaguucuaucucaaaaca

SEQ ID NO: 2145140 - RNA, 19 nt, Human herpesvirus 7
uagcuuucaugauuucaau

SEQ ID NO: 2145141 - RNA, 22 nt, Human herpesvirus 7
aaacuauucgaaaauaucuucu

SEQ ID NO: 2145142 - RNA, 18 nt, Human herpesvirus 7
gugcguacacuguaagcu

SEQ ID NO: 2145143 - RNA, 18 nt, Human herpesvirus 7
auuuaaaguagcugaauu

SEQ ID NO: 2145144 - RNA, 18 nt, Human herpesvirus 7
uggaagacgccaauaaau

SEQ ID NO: 2145145 - RNA, 17 nt, Human herpesvirus 7
uaaaauagaaaauguca

SEQ ID NO: 2145146 - RNA, 14 nt, Human herpesvirus 7
auacuuuuuugguu

SEQ ID NO: 2145147 - RNA, 19 nt, Human herpesvirus 7
uucugagugauuuuucauu

SEQ ID NO: 2145148 - RNA, 15 nt, Human herpesvirus 7
augucagaguuuaaa

SEQ ID NO: 2145149 - RNA, 19 nt, Human herpesvirus 7
acuuacuuguguugugaaa

SEQ ID NO: 2145150 - RNA, 18 nt, Human herpesvirus 7
aaauaagaaaccagcuuu

SEQ ID NO: 2145151 - RNA, 17 nt, Human herpesvirus 7
aauuuuucgaucuguaa

SEQ ID NO: 2145152 - RNA, 23 nt, Human herpesvirus 7
acuaauaaaaauuacucaugaag

SEQ ID NO: 2145153 - RNA, 17 nt, Human herpesvirus 7
uaaugaaaaagccauaa

SEQ ID NO: 2145154 - RNA, 15 nt, Human herpesvirus 7
agguugcuucuucga

SEQ ID NO: 2145155 - RNA, 20 nt, Human herpesvirus 7
agauuuaaaguaagaaugga

SEQ ID NO: 2145156 - RNA, 16 nt, Human herpesvirus 7
agaacauguaguacaa

SEQ ID NO: 2145157 - RNA, 18 nt, Human herpesvirus 7
aaaaguuguuaagaaucu

SEQ ID NO: 2145158 - RNA, 15 nt, Human herpesvirus 7
gcaacagagaacacc

SEQ ID NO: 2145159 - RNA, 14 nt, Human herpesvirus 7
ugauaaucaagaaa

SEQ ID NO: 2145160 - RNA, 23 nt, Human herpesvirus 7
ucaguacaacgacauugaaacuc

SEQ ID NO: 2145161 - RNA, 13 nt, Human herpesvirus 7
caaucaaaaacug

SEQ ID NO: 2145162 - RNA, 13 nt, Human herpesvirus 7
aaaagaauuuucu

SEQ ID NO: 2145163 - RNA, 22 nt, Human herpesvirus 7
agacucacuccuugcauacuuu

SEQ ID NO: 2145164 - RNA, 22 nt, Human herpesvirus 7
aauaaauuuuucgaucuguaaa

SEQ ID NO: 2145165 - RNA, 13 nt, Human herpesvirus 7
cagaguuuaaagu

SEQ ID NO: 2145166 - RNA, 22 nt, Human herpesvirus 7
agcgugucaaaaaaaaaacaau

SEQ ID NO: 2145167 - RNA, 23 nt, Human herpesvirus 7
gaaaacaaaucugauaaauuaca

SEQ ID NO: 2145168 - RNA, 16 nt, Human herpesvirus 7
acauuccucauggcca

SEQ ID NO: 2145169 - RNA, 15 nt, Human herpesvirus 7
acuguccaacacaag

SEQ ID NO: 2145170 - RNA, 23 nt, Human herpesvirus 7
auuaauuuccacguuuuuuagcu

SEQ ID NO: 2145171 - RNA, 16 nt, Human herpesvirus 7
uauugaaaauuuauug

SEQ ID NO: 2145172 - RNA, 19 nt, Human herpesvirus 7
cauuaugagauuugccugc

SEQ ID NO: 2145173 - RNA, 17 nt, Human herpesvirus 7
uacauuaaacagcauuu

SEQ ID NO: 2145174 - RNA, 15 nt, Human herpesvirus 7
uuaauggaagaacaa

SEQ ID NO: 2145175 - RNA, 19 nt, Human herpesvirus 7
cacagaaacgucaggaaaa

SEQ ID NO: 2145176 - RNA, 20 nt, Human herpesvirus 7
aaucaagacgcuguaugcaa

SEQ ID NO: 2145177 - RNA, 22 nt, Human herpesvirus 7
aguguaggcaagaaggccacgc

SEQ ID NO: 2145178 - RNA, 16 nt, Human herpesvirus 7
ggacaauuauuuaaac

SEQ ID NO: 2145179 - RNA, 15 nt, Human herpesvirus 7
augcagacugcgcuu

SEQ ID NO: 2145180 - RNA, 14 nt, Human herpesvirus 7
cuucaaaaauguuu

SEQ ID NO: 2145181 - RNA, 17 nt, Human herpesvirus 7
caauauagaguaccaau

SEQ ID NO: 2145182 - RNA, 21 nt, Human herpesvirus 7
auuuuucauuuuuuucuuaua

SEQ ID NO: 2145183 - RNA, 23 nt, Human herpesvirus 7
cacauguacagacagaaugccag

SEQ ID NO: 2145184 - RNA, 17 nt, Human herpesvirus 7
gaaaaaaacaaaaucua

SEQ ID NO: 2145185 - RNA, 12 nt, Human herpesvirus 7
cgcuuucucaag

SEQ ID NO: 2145186 - RNA, 13 nt, Human herpesvirus 7
guucuaaauguac

SEQ ID NO: 2145187 - RNA, 22 nt, Human herpesvirus 7
aacaaagauugaagcacacacg

SEQ ID NO: 2145188 - RNA, 12 nt, Human herpesvirus 7
agauuucagaau

SEQ ID NO: 2145189 - RNA, 16 nt, Human herpesvirus 7
cuugacaccaacaucu

SEQ ID NO: 2145190 - RNA, 22 nt, Human herpesvirus 7
ucuacacaucuucaauguucga

SEQ ID NO: 2145191 - RNA, 14 nt, Human herpesvirus 7
cugaaucaaaaucc

SEQ ID NO: 2145192 - RNA, 14 nt, Human herpesvirus 7
uuuaauacaacaua

SEQ ID NO: 2145193 - RNA, 16 nt, Human herpesvirus 7
caaaucaaugugaagu

SEQ ID NO: 2145194 - RNA, 17 nt, Human herpesvirus 7
ucuuugacaaaaauguu

SEQ ID NO: 2145195 - RNA, 18 nt, Human herpesvirus 7
gcuucagaaauaacaaaa

SEQ ID NO: 2145196 - RNA, 13 nt, Human herpesvirus 7
ugaauuaauucuu

SEQ ID NO: 2145197 - RNA, 15 nt, Human herpesvirus 7
ugcguuacuucuguc

SEQ ID NO: 2145198 - RNA, 16 nt, Human herpesvirus 7
gaaacaaucccagaaa

SEQ ID NO: 2145199 - RNA, 19 nt, Human herpesvirus 7
acaugggauuucuguaaaa

SEQ ID NO: 2145200 - RNA, 20 nt, Human herpesvirus 7
cgguacauuuauguauuuua

SEQ ID NO: 2145201 - RNA, 23 nt, Human herpesvirus 7
aaugugucuuacaacuagaaaau

SEQ ID NO: 2145202 - RNA, 21 nt, Human herpesvirus 7
uuacgaaacaauuucacagac

SEQ ID NO: 2145203 - RNA, 13 nt, Human herpesvirus 7
acaaacuggauau

SEQ ID NO: 2145204 - RNA, 15 nt, Human herpesvirus 7
aaaauuugacauuug

SEQ ID NO: 2145205 - RNA, 16 nt, Human herpesvirus 7
auuucuaaauaugaug

SEQ ID NO: 2145206 - RNA, 15 nt, Human herpesvirus 7
gaacaucuugagaaa

SEQ ID NO: 2145207 - RNA, 20 nt, Human herpesvirus 7
acugcgcuuggcaaacaguc

SEQ ID NO: 2145208 - RNA, 13 nt, Human herpesvirus 7
guacuaaagccaa

SEQ ID NO: 2145209 - RNA, 16 nt, Human herpesvirus 7
cagugaguggaagcag

SEQ ID NO: 2145210 - RNA, 18 nt, Human herpesvirus 7
gcuauuauaauguaagaa

SEQ ID NO: 2145211 - RNA, 14 nt, Human herpesvirus 7
gugaaaauaacagg

SEQ ID NO: 2145212 - RNA, 21 nt, Human herpesvirus 7
uucgcuuaccuuuuuguuuuu

SEQ ID NO: 2145213 - RNA, 11 nt, Human herpesvirus 7
uauugcaauuu

SEQ ID NO: 2145214 - RNA, 22 nt, Human herpesvirus 7
caugauugguaaaaaauuacuu

SEQ ID NO: 2145215 - RNA, 12 nt, Human herpesvirus 7
accauuucugaa

SEQ ID NO: 2145216 - RNA, 22 nt, Human herpesvirus 7
ucaagaaauaaugaaggauggc

SEQ ID NO: 2145217 - RNA, 17 nt, Human herpesvirus 7
agugauugguagaaaug

SEQ ID NO: 2145218 - RNA, 13 nt, Human herpesvirus 7
uuaaaggaaauaa

SEQ ID NO: 2145219 - RNA, 14 nt, Human herpesvirus 7
cugauauaaaugcu

SEQ ID NO: 2145220 - RNA, 15 nt, Human herpesvirus 7
aauacaugaauuauc

SEQ ID NO: 2145221 - RNA, 13 nt, Human herpesvirus 7
caucuaugugcuc

SEQ ID NO: 2145222 - RNA, 22 nt, Human herpesvirus 7
auuucaaacguaaugcaaaaua

SEQ ID NO: 2145223 - RNA, 17 nt, Human herpesvirus 7
ucugauuuauauagcaa

SEQ ID NO: 2145224 - RNA, 15 nt, Human herpesvirus 7
auacguccaaaaauu

SEQ ID NO: 2145225 - RNA, 14 nt, Human herpesvirus 7
uuaagugaacuguu

SEQ ID NO: 2145226 - RNA, 17 nt, Human herpesvirus 7
caucauucuucucggag

SEQ ID NO: 2145227 - RNA, 11 nt, Human herpesvirus 7
auuucuguaaa

SEQ ID NO: 2145228 - RNA, 18 nt, Human herpesvirus 7
caaaagucgagaaaacac

SEQ ID NO: 2145229 - RNA, 21 nt, Human herpesvirus 7
auuuccucuggaaaagggaga

SEQ ID NO: 2145230 - RNA, 17 nt, Human herpesvirus 7
auagauuucagaauuuc

SEQ ID NO: 2145231 - RNA, 21 nt, Human herpesvirus 7
acagaaugugguaaaaaaguu

SEQ ID NO: 2145232 - RNA, 19 nt, Human herpesvirus 7
ugcucuuugucuuugcucu

SEQ ID NO: 2145233 - RNA, 16 nt, Human herpesvirus 7
gagucaacacauaucu

SEQ ID NO: 2145234 - RNA, 21 nt, Human herpesvirus 7
ucaucccaaaccaugauguua

SEQ ID NO: 2145235 - RNA, 18 nt, Human herpesvirus 7
gcaacuuuucuuaaacau

SEQ ID NO: 2145236 - RNA, 13 nt, Human herpesvirus 7
guucauaaaccug

SEQ ID NO: 2145237 - RNA, 15 nt, Human herpesvirus 7
aaaggauuugaaggu

SEQ ID NO: 2145238 - RNA, 12 nt, Human herpesvirus 7
uguguuggaaac

SEQ ID NO: 2145239 - RNA, 13 nt, Human herpesvirus 7
acauaucagauuu

SEQ ID NO: 2145240 - RNA, 20 nt, Human herpesvirus 7
cugcaaauuguaaauucucc

SEQ ID NO: 2145241 - RNA, 16 nt, Human herpesvirus 7
uacagacagaaugcca

SEQ ID NO: 2145242 - RNA, 17 nt, Human herpesvirus 7
uuauuuacccacauuuu

SEQ ID NO: 2145243 - RNA, 22 nt, Human herpesvirus 7
cuugaaaaagaauuuucugcuu

SEQ ID NO: 2145244 - RNA, 17 nt, Human herpesvirus 7
cgucuuuugauuuugcc

SEQ ID NO: 2145245 - RNA, 15 nt, Human herpesvirus 7
caaagauugaagcac

SEQ ID NO: 2145246 - RNA, 23 nt, Human herpesvirus 7
cugaucuaaaguauggaaaaaug

SEQ ID NO: 2145247 - RNA, 16 nt, Human herpesvirus 7
uuuacaaugcagccua

SEQ ID NO: 2145248 - RNA, 14 nt, Human herpesvirus 7
uaagccagauuuca

SEQ ID NO: 2145249 - RNA, 20 nt, Human herpesvirus 7
aucucucuuucuggaguuca

SEQ ID NO: 2145250 - RNA, 23 nt, Human herpesvirus 7
cuguuaguugggcaaacaguuuu

SEQ ID NO: 2145251 - RNA, 18 nt, Human herpesvirus 7
uggaucguagcaacagag

SEQ ID NO: 2145252 - RNA, 16 nt, Human herpesvirus 7
aacagagaacaccaua

SEQ ID NO: 2145253 - RNA, 17 nt, Human herpesvirus 7
guuccuauaugugaaau

SEQ ID NO: 2145254 - RNA, 14 nt, Human herpesvirus 7
cucucucuauuaca

SEQ ID NO: 2145255 - RNA, 24 nt, Human herpesvirus 7
caugcgaguuagacgucaacuuga

SEQ ID NO: 2145256 - RNA, 18 nt, Human herpesvirus 7
auaaaaagauauacauaa

SEQ ID NO: 2145257 - RNA, 21 nt, Human herpesvirus 7
cacuaucuccuaaaugaauuu

SEQ ID NO: 2145258 - RNA, 17 nt, Human herpesvirus 7
ccaauagaaaacaaauc

SEQ ID NO: 2145259 - RNA, 22 nt, Human herpesvirus 7
aaauuaaagcgagcuuucuuua

SEQ ID NO: 2145260 - RNA, 16 nt, Human herpesvirus 7
gacagcuguauaucua

SEQ ID NO: 2145261 - RNA, 16 nt, Human herpesvirus 7
uauuguaucuaugaaa

SEQ ID NO: 2145262 - RNA, 18 nt, Human herpesvirus 7
aaccgccauucuuuucaa

SEQ ID NO: 2145263 - RNA, 23 nt, Human herpesvirus 7
aauaguuuuacaaagaacaugua

SEQ ID NO: 2145264 - RNA, 19 nt, Human herpesvirus 7
aacuuugcaacaaaaucua

SEQ ID NO: 2145265 - RNA, 17 nt, Human herpesvirus 7
ugguguacuacauauua

SEQ ID NO: 2145266 - RNA, 13 nt, Human herpesvirus 7
uacauuuuucuau

SEQ ID NO: 2145267 - RNA, 15 nt, Human herpesvirus 7
agaauugauugaauu

SEQ ID NO: 2145268 - RNA, 12 nt, Human herpesvirus 7
acaaauacaguu

SEQ ID NO: 2145269 - RNA, 16 nt, Human herpesvirus 7
uguaaaaaaaaguugu

SEQ ID NO: 2145270 - RNA, 18 nt, Human herpesvirus 7
auaauccucugacauuug

SEQ ID NO: 2145271 - RNA, 17 nt, Human herpesvirus 7
cugacgaaaacugcaac

SEQ ID NO: 2145272 - RNA, 14 nt, Human herpesvirus 7
uuuucaaacaugau

SEQ ID NO: 2145273 - RNA, 23 nt, Human herpesvirus 7
uuuucuucuucuuuuuuugaacu

SEQ ID NO: 2145274 - RNA, 17 nt, Human herpesvirus 7
cccuggaacguccucug

SEQ ID NO: 2145275 - RNA, 13 nt, Human herpesvirus 7
uuuauccaucaaa

SEQ ID NO: 2145276 - RNA, 17 nt, Human herpesvirus 7
gaaaucaaaaauaccgg

SEQ ID NO: 2145277 - RNA, 12 nt, Human herpesvirus 7
aaauuaaauacu

SEQ ID NO: 2145278 - RNA, 17 nt, Human herpesvirus 7
aauucuucuacuucuag

SEQ ID NO: 2145279 - RNA, 22 nt, Human herpesvirus 7
uaagaaaaaucauuuuuaaaaa

SEQ ID NO: 2145280 - RNA, 16 nt, Human herpesvirus 7
auucugaauaaaagua

SEQ ID NO: 2145281 - RNA, 20 nt, Human herpesvirus 7
ucuauuagauaaugacaaac

SEQ ID NO: 2145282 - RNA, 13 nt, Human herpesvirus 7
auaccuguaugga

SEQ ID NO: 2145283 - RNA, 17 nt, Human herpesvirus 7
agaaacuaauaaaaauu

SEQ ID NO: 2145284 - RNA, 18 nt, Human herpesvirus 7
gacacaugcuuacagauc

SEQ ID NO: 2145285 - RNA, 15 nt, Human herpesvirus 7
cugaaauaaacauuu

SEQ ID NO: 2145286 - RNA, 22 nt, Human herpesvirus 7
aaaacacguccaagaaauaugc

SEQ ID NO: 2145287 - RNA, 20 nt, Human herpesvirus 7
uucaacugauauaaaugcuu

SEQ ID NO: 2145288 - RNA, 14 nt, Human herpesvirus 7
ucagaauuuccaga

SEQ ID NO: 2145289 - RNA, 22 nt, Human herpesvirus 7
uacaacuuuauggaacaugaaa

SEQ ID NO: 2145290 - RNA, 20 nt, Human herpesvirus 7
cuacaauuucuggcaauaaa

SEQ ID NO: 2145291 - RNA, 12 nt, Human herpesvirus 7
uuuuaauaaacg

SEQ ID NO: 2145292 - RNA, 17 nt, Human herpesvirus 7
auuauaaauguaacuuu

SEQ ID NO: 2145293 - RNA, 18 nt, Human herpesvirus 7
aucuucugaaucugcaaa

SEQ ID NO: 2145294 - RNA, 14 nt, Human herpesvirus 7
accuguauggaacc

SEQ ID NO: 2145295 - RNA, 13 nt, Human herpesvirus 7
caauuaaugcauu

SEQ ID NO: 2145296 - RNA, 20 nt, Human herpesvirus 7
acguucugaaacagucugaa

SEQ ID NO: 2145297 - RNA, 22 nt, Human herpesvirus 7
auuaacagcuccaagcuuaaau

SEQ ID NO: 2145298 - RNA, 13 nt, Human herpesvirus 7
auucuuuguacuu

SEQ ID NO: 2145299 - RNA, 21 nt, Human herpesvirus 7
aauuucaaacguaaugcaaaa

SEQ ID NO: 2145300 - RNA, 17 nt, Human herpesvirus 7
cuguucccacugggaca

SEQ ID NO: 2145301 - RNA, 21 nt, Human herpesvirus 7
cugcaauaugcauguguaaag

SEQ ID NO: 2145302 - RNA, 15 nt, Human herpesvirus 7
aaauauuuagagucg

SEQ ID NO: 2145303 - RNA, 15 nt, Human herpesvirus 7
cacguuuugcaaagu

SEQ ID NO: 2145304 - RNA, 21 nt, Human herpesvirus 7
ccaaauaaacguccauugauu

SEQ ID NO: 2145305 - RNA, 15 nt, Human herpesvirus 7
cacaucuucaauguu

SEQ ID NO: 2145306 - RNA, 22 nt, Human herpesvirus 7
acuauuugacuggguaggaaaa

SEQ ID NO: 2145307 - RNA, 16 nt, Human herpesvirus 7
caaugcauuggaaaaa

SEQ ID NO: 2145308 - RNA, 19 nt, Human herpesvirus 7
auauugucauaaaauuauc

SEQ ID NO: 2145309 - RNA, 21 nt, Human herpesvirus 7
auuuaaacagcguucaaucaa

SEQ ID NO: 2145310 - RNA, 16 nt, Human herpesvirus 7
aguucugacuaaagcu

SEQ ID NO: 2145311 - RNA, 18 nt, Human herpesvirus 7
ugaaaauguuuuugcuag

SEQ ID NO: 2145312 - RNA, 15 nt, Human herpesvirus 7
aggaugaaagugcau

SEQ ID NO: 2145313 - RNA, 19 nt, Human herpesvirus 7
accgauuauauucaaauaa

SEQ ID NO: 2145314 - RNA, 21 nt, Human herpesvirus 7
gcuugcauugcauaucaugau

SEQ ID NO: 2145315 - RNA, 15 nt, Human herpesvirus 7
aaauaauagaugucu

SEQ ID NO: 2145316 - RNA, 14 nt, Human herpesvirus 7
auuccauuuaaaug

SEQ ID NO: 2145317 - RNA, 14 nt, Human herpesvirus 7
gauuagcuuucagc

SEQ ID NO: 2145318 - RNA, 22 nt, Human herpesvirus 7
caaauugaaccuuaacauacug

SEQ ID NO: 2145319 - RNA, 14 nt, Human herpesvirus 7
auaaucaaaaaauu

SEQ ID NO: 2145320 - RNA, 22 nt, Human herpesvirus 7
auagucuacuaaggugucuucg

SEQ ID NO: 2145321 - RNA, 18 nt, Human herpesvirus 7
aacaucuuuauauguguu

SEQ ID NO: 2145322 - RNA, 13 nt, Human herpesvirus 7
gcacuccuagaaa

SEQ ID NO: 2145323 - RNA, 17 nt, Human herpesvirus 7
agaaccuaucaaaauuc

SEQ ID NO: 2145324 - RNA, 15 nt, Human herpesvirus 7
uuuguauacaacuuu

SEQ ID NO: 2145325 - RNA, 21 nt, Human herpesvirus 7
cucuuuuuuuuuauugccuug

SEQ ID NO: 2145326 - RNA, 13 nt, Human herpesvirus 7
cggauuaagagaa

SEQ ID NO: 2145327 - RNA, 12 nt, Human herpesvirus 7
guuuuauuccca

SEQ ID NO: 2145328 - RNA, 12 nt, Human herpesvirus 7
uagaaauuaaaa

SEQ ID NO: 2145329 - RNA, 14 nt, Human herpesvirus 7
uuacuuauuuuaaa

SEQ ID NO: 2145330 - RNA, 19 nt, Human herpesvirus 7
cuaauugcgcaguguuuaa

SEQ ID NO: 2145331 - RNA, 20 nt, Human herpesvirus 7
gaaucaucuuaaaaguacaa

SEQ ID NO: 2145332 - RNA, 18 nt, Human herpesvirus 7
acaagacagaaaugaauc

SEQ ID NO: 2145333 - RNA, 19 nt, Human herpesvirus 7
uggagauaguucgcaaugg

SEQ ID NO: 2145334 - RNA, 21 nt, Human herpesvirus 7
auaaucuugugaaguuugcug

SEQ ID NO: 2145335 - RNA, 21 nt, Human herpesvirus 7
agcaaauucacgcucucaauc

SEQ ID NO: 2145336 - RNA, 19 nt, Human herpesvirus 7
aacaucuuucauaacaaag

SEQ ID NO: 2145337 - RNA, 13 nt, Human herpesvirus 7
guccaagaaauau

SEQ ID NO: 2145338 - RNA, 23 nt, Human herpesvirus 7
uuuaaacagcguucaaucaaauu

SEQ ID NO: 2145339 - RNA, 20 nt, Human herpesvirus 7
guaucaugaaccauguuuua

SEQ ID NO: 2145340 - RNA, 16 nt, Human herpesvirus 7
agacauugaagauugu

SEQ ID NO: 2145341 - RNA, 12 nt, Human herpesvirus 7
uuguuaacauga

SEQ ID NO: 2145342 - RNA, 19 nt, Human herpesvirus 7
auauuagaacgagagacaa

SEQ ID NO: 2145343 - RNA, 18 nt, Human herpesvirus 7
gaaacuacgucaccaccg

SEQ ID NO: 2145344 - RNA, 16 nt, Human herpesvirus 7
uuauaauagaaauuaa

SEQ ID NO: 2145345 - RNA, 14 nt, Human herpesvirus 7
uuauauuuuaagua

SEQ ID NO: 2145346 - RNA, 19 nt, Human herpesvirus 7
aauaaaggaaagacaaacu

SEQ ID NO: 2145347 - RNA, 23 nt, Human herpesvirus 7
gccacuguugaugauuuaauaua

SEQ ID NO: 2145348 - RNA, 20 nt, Human herpesvirus 7
aaucuuuuauaaauaguuuc

SEQ ID NO: 2145349 - RNA, 23 nt, Human herpesvirus 7
agagucugugugugcaguguuuu

SEQ ID NO: 2145350 - RNA, 15 nt, Human herpesvirus 7
ucugccucuuggccu

SEQ ID NO: 2145351 - RNA, 18 nt, Human herpesvirus 7
auaacaauauuuaaagua

SEQ ID NO: 2145352 - RNA, 19 nt, Human herpesvirus 7
auuuuacaaaaagaauuga

SEQ ID NO: 2145353 - RNA, 22 nt, Human herpesvirus 7
auaucucuguuuugucucuuua

SEQ ID NO: 2145354 - RNA, 16 nt, Human herpesvirus 7
gaaaauaucuucugaa

SEQ ID NO: 2145355 - RNA, 15 nt, Human herpesvirus 7
acugagaaaaaugac

SEQ ID NO: 2145356 - RNA, 12 nt, Human herpesvirus 7
caaaagcuuacu

SEQ ID NO: 2145357 - RNA, 20 nt, Human herpesvirus 7
aaaauccuggauuucagcau

SEQ ID NO: 2145358 - RNA, 19 nt, Human herpesvirus 7
gauuuuuaaacuugugaaa

SEQ ID NO: 2145359 - RNA, 19 nt, Human herpesvirus 7
ucuccuugauaagauuucc

SEQ ID NO: 2145360 - RNA, 15 nt, Human herpesvirus 7
caucuucucuauacc

SEQ ID NO: 2145361 - RNA, 14 nt, Human herpesvirus 7
aucuuuaacgguaa

SEQ ID NO: 2145362 - RNA, 11 nt, Human herpesvirus 7
aacagaccucc

SEQ ID NO: 2145363 - RNA, 22 nt, Human herpesvirus 7
agcuaacgauccaguacuugca

SEQ ID NO: 2145364 - RNA, 15 nt, Human herpesvirus 7
agaauuagagugcuu

SEQ ID NO: 2145365 - RNA, 23 nt, Human herpesvirus 7
ucuuauaacaaaguucaaguuuu

SEQ ID NO: 2145366 - RNA, 18 nt, Human herpesvirus 7
aacagccaucuaauugca

SEQ ID NO: 2145367 - RNA, 20 nt, Human herpesvirus 7
gcuugguuuuacaaauuaaa

SEQ ID NO: 2145368 - RNA, 14 nt, Human herpesvirus 7
uacaaaaguucugu

SEQ ID NO: 2145369 - RNA, 21 nt, Human herpesvirus 7
uaacaucuuuuuuauauuucu

SEQ ID NO: 2145370 - RNA, 16 nt, Human herpesvirus 7
acuuaugauuggagua

SEQ ID NO: 2145371 - RNA, 19 nt, Human herpesvirus 7
accaugaaaaauaaauacu

SEQ ID NO: 2145372 - RNA, 12 nt, Human herpesvirus 7
cauuuguugcuu

SEQ ID NO: 2145373 - RNA, 16 nt, Human herpesvirus 7
aucuuucguauugccu

SEQ ID NO: 2145374 - RNA, 16 nt, Human herpesvirus 7
aagcaucgauguuuua

SEQ ID NO: 2145375 - RNA, 13 nt, Human herpesvirus 7
auuuucagaaaag

SEQ ID NO: 2145376 - RNA, 18 nt, Human herpesvirus 7
uucuuugacaaaaauguu

SEQ ID NO: 2145377 - RNA, 22 nt, Human herpesvirus 7
guggaaaucuuuaauaaaaaca

SEQ ID NO: 2145378 - RNA, 14 nt, Human herpesvirus 7
gaguauuuaagaac

SEQ ID NO: 2145379 - RNA, 16 nt, Human herpesvirus 7
uucaaucaaauuauac

SEQ ID NO: 2145380 - RNA, 14 nt, Human herpesvirus 7
gaaaucaaaaaugu

SEQ ID NO: 2145381 - RNA, 17 nt, Human herpesvirus 7
auucgacacuauuggac

SEQ ID NO: 2145382 - RNA, 16 nt, Human herpesvirus 7
ucuuuuucauuaacuu

SEQ ID NO: 2145383 - RNA, 14 nt, Human herpesvirus 7
gcaaaucugaaaau

SEQ ID NO: 2145384 - RNA, 21 nt, Human herpesvirus 7
uuaauuuggaaauuguuugau

SEQ ID NO: 2145385 - RNA, 17 nt, Human herpesvirus 7
uuaaggagcuucauuuu

SEQ ID NO: 2145386 - RNA, 13 nt, Human herpesvirus 7
aucauugaagaaa

SEQ ID NO: 2145387 - RNA, 15 nt, Human herpesvirus 7
aaauugguucagcgu

SEQ ID NO: 2145388 - RNA, 19 nt, Human herpesvirus 7
cugcaacuuugugccugaa

SEQ ID NO: 2145389 - RNA, 13 nt, Human herpesvirus 7
ucacacaaugccu

SEQ ID NO: 2145390 - RNA, 22 nt, Human herpesvirus 7
auagaacgcuuauucgacacua

SEQ ID NO: 2145391 - RNA, 18 nt, Human herpesvirus 7
aagagucuauugacauaa

SEQ ID NO: 2145392 - RNA, 13 nt, Human herpesvirus 7
uauaaucacgaaa

SEQ ID NO: 2145393 - RNA, 15 nt, Human herpesvirus 7
cuugcgguagcacua

SEQ ID NO: 2145394 - RNA, 21 nt, Human herpesvirus 7
gaacgacuccaacugaccaga

SEQ ID NO: 2145395 - RNA, 15 nt, Human herpesvirus 7
uugugaaaauaacag

SEQ ID NO: 2145396 - RNA, 15 nt, Human herpesvirus 7
cuauagaaaacaucc

SEQ ID NO: 2145397 - RNA, 17 nt, Human herpesvirus 7
uuagaaacaucuguuuu

SEQ ID NO: 2145398 - RNA, 13 nt, Human herpesvirus 7
gaagcgagauuua

SEQ ID NO: 2145399 - RNA, 17 nt, Human herpesvirus 7
auucaaugcuaguguuc

SEQ ID NO: 2145400 - RNA, 17 nt, Human herpesvirus 7
ucuuacagugcucuuug

SEQ ID NO: 2145401 - RNA, 21 nt, Human herpesvirus 7
agcauuauuguauaugaugac

SEQ ID NO: 2145402 - RNA, 17 nt, Human herpesvirus 7
ugucuuacaacuagaaa

SEQ ID NO: 2145403 - RNA, 20 nt, Human herpesvirus 7
aaugugucuuacaacuagaa

SEQ ID NO: 2145404 - RNA, 23 nt, Human herpesvirus 7
gaccucgacauucuccaguggca

SEQ ID NO: 2145405 - RNA, 16 nt, Human herpesvirus 7
ucucagaaguuucaau

SEQ ID NO: 2145406 - RNA, 15 nt, Human herpesvirus 7
uugaauauaaguuuu

SEQ ID NO: 2145407 - RNA, 20 nt, Human herpesvirus 7
caggcauuuaagaauuuaau

SEQ ID NO: 2145408 - RNA, 15 nt, Human herpesvirus 7
accaugaaaaauaug

SEQ ID NO: 2145409 - RNA, 14 nt, Human herpesvirus 7
gcugcaucuuuuca

SEQ ID NO: 2145410 - RNA, 19 nt, Human herpesvirus 7
uuucuuuaccgauucuaaa

SEQ ID NO: 2145411 - RNA, 19 nt, Human herpesvirus 7
uauaugaagaauguaugaa

SEQ ID NO: 2145412 - RNA, 15 nt, Human herpesvirus 7
aguugaaaauguuuu

SEQ ID NO: 2145413 - RNA, 15 nt, Human herpesvirus 7
gccauaauuugaauu

SEQ ID NO: 2145414 - RNA, 17 nt, Human herpesvirus 7
uucacccuuuguuugag

SEQ ID NO: 2145415 - RNA, 14 nt, Human herpesvirus 7
uauaugaaauuuca

SEQ ID NO: 2145416 - RNA, 13 nt, Human herpesvirus 7
uauuuuacauauu

SEQ ID NO: 2145417 - RNA, 18 nt, Human herpesvirus 7
uuucaauugguuguucaa

SEQ ID NO: 2145418 - RNA, 21 nt, Human herpesvirus 7
auaugcuagaagacugcaacc

SEQ ID NO: 2145419 - RNA, 17 nt, Human herpesvirus 7
gauugaucacuuugcau

SEQ ID NO: 2145420 - RNA, 18 nt, Human herpesvirus 7
ugauagccauaaaugcuu

SEQ ID NO: 2145421 - RNA, 14 nt, Human herpesvirus 7
gaaauucuguggag

SEQ ID NO: 2145422 - RNA, 18 nt, Human herpesvirus 7
agcucuaaacaaacaaug

SEQ ID NO: 2145423 - RNA, 17 nt, Human herpesvirus 7
gauaauguuuuuuucau

SEQ ID NO: 2145424 - RNA, 23 nt, Human herpesvirus 7
ucaaggggucgcauauugcaauu

SEQ ID NO: 2145425 - RNA, 16 nt, Human herpesvirus 7
uuggaaacaaauugug

SEQ ID NO: 2145426 - RNA, 23 nt, Human herpesvirus 7
aauuaccgauggaacugaaaaca

SEQ ID NO: 2145427 - RNA, 18 nt, Human herpesvirus 7
uaugauuuuuuaaaugug

SEQ ID NO: 2145428 - RNA, 16 nt, Human herpesvirus 7
uaauuucucaaaucaa

SEQ ID NO: 2145429 - RNA, 15 nt, Human herpesvirus 7
ucagaacauugucaa

SEQ ID NO: 2145430 - RNA, 16 nt, Human herpesvirus 7
acuaauaaaaauuacu

SEQ ID NO: 2145431 - RNA, 17 nt, Human herpesvirus 7
uaaaugauuuuaaauuu

SEQ ID NO: 2145432 - RNA, 17 nt, Human herpesvirus 7
auccguuaauggauaac

SEQ ID NO: 2145433 - RNA, 14 nt, Human herpesvirus 7
ucaguuguuggaaa

SEQ ID NO: 2145434 - RNA, 13 nt, Human herpesvirus 7
cuggaaagcucau

SEQ ID NO: 2145435 - RNA, 16 nt, Human herpesvirus 7
aagguuuaaaacauuu

SEQ ID NO: 2145436 - RNA, 15 nt, Human herpesvirus 7
guaaaggaaauuagu

SEQ ID NO: 2145437 - RNA, 20 nt, Human herpesvirus 7
uggauucaagaaaucagauu

SEQ ID NO: 2145438 - RNA, 20 nt, Human herpesvirus 7
gucugauucuuauucuacac

SEQ ID NO: 2145439 - RNA, 18 nt, Human herpesvirus 7
gcgcuuggcaaacagucu

SEQ ID NO: 2145440 - RNA, 16 nt, Human herpesvirus 7
aacacucaaaacagaa

SEQ ID NO: 2145441 - RNA, 19 nt, Human herpesvirus 7
uggcgccaaaaaaacacag

SEQ ID NO: 2145442 - RNA, 14 nt, Human herpesvirus 7
augcucgauauaca

SEQ ID NO: 2145443 - RNA, 20 nt, Human herpesvirus 7
ucuaauuaaucugcauauaa

SEQ ID NO: 2145444 - RNA, 16 nt, Human herpesvirus 7
augcuauuaaaugauu

SEQ ID NO: 2145445 - RNA, 19 nt, Human herpesvirus 7
gauuucacccuuuguuuga

SEQ ID NO: 2145446 - RNA, 22 nt, Human herpesvirus 7
gaguaucuccgugacaaagcau

SEQ ID NO: 2145447 - RNA, 13 nt, Human herpesvirus 7
caacucuuccuuu

SEQ ID NO: 2145448 - RNA, 18 nt, Human herpesvirus 7
caaauugauccugcuauu

SEQ ID NO: 2145449 - RNA, 15 nt, Human herpesvirus 7
acaacagccaaaugu

SEQ ID NO: 2145450 - RNA, 17 nt, Human herpesvirus 7
aaauucugcuugucucu

SEQ ID NO: 2145451 - RNA, 20 nt, Human herpesvirus 7
aauuguuuuucuuucuugca

SEQ ID NO: 2145452 - RNA, 19 nt, Human herpesvirus 7
uaacauggaaauucagaau

SEQ ID NO: 2145453 - RNA, 21 nt, Human herpesvirus 7
auuuugggcugacuuaauuga

SEQ ID NO: 2145454 - RNA, 12 nt, Human herpesvirus 7
accgauuacugu

SEQ ID NO: 2145455 - RNA, 20 nt, Human herpesvirus 7
gaacaugacuucagaaaaac

SEQ ID NO: 2145456 - RNA, 12 nt, Human herpesvirus 7
auagaagaggac

SEQ ID NO: 2145457 - RNA, 21 nt, Human herpesvirus 7
cuaauuuuggcgaaacaauac

SEQ ID NO: 2145458 - RNA, 21 nt, Human herpesvirus 7
uuucgcaacaaucaacauuug

SEQ ID NO: 2145459 - RNA, 15 nt, Human herpesvirus 7
uauggacaaauuugg

SEQ ID NO: 2145460 - RNA, 13 nt, Human herpesvirus 7
ugcugugagugaa

SEQ ID NO: 2145461 - RNA, 19 nt, Human herpesvirus 7
agauuuuuugaaaaagauu

SEQ ID NO: 2145462 - RNA, 15 nt, Human herpesvirus 7
cagaacaucugucag

SEQ ID NO: 2145463 - RNA, 18 nt, Human herpesvirus 7
uauuagauaaugacaaac

SEQ ID NO: 2145464 - RNA, 13 nt, Human herpesvirus 7
auucaguuucuuu

SEQ ID NO: 2145465 - RNA, 12 nt, Human herpesvirus 7
uucaauugccac

SEQ ID NO: 2145466 - RNA, 17 nt, Human herpesvirus 7
gaucguagcaacagaga

SEQ ID NO: 2145467 - RNA, 20 nt, Human herpesvirus 7
ugcaggcuagaaguuuagag

SEQ ID NO: 2145468 - RNA, 19 nt, Human herpesvirus 7
ggcaacaaacaaauaauuc

SEQ ID NO: 2145469 - RNA, 16 nt, Human herpesvirus 7
uugcaguuauuucuua

SEQ ID NO: 2145470 - RNA, 16 nt, Human herpesvirus 7
uaauacuccuuuccug

SEQ ID NO: 2145471 - RNA, 18 nt, Human herpesvirus 7
aaaaucuguagaaaaugu

SEQ ID NO: 2145472 - RNA, 20 nt, Human herpesvirus 7
accaaaaaccugaaaaacau

SEQ ID NO: 2145473 - RNA, 15 nt, Human herpesvirus 7
cugcuugucucuguc

SEQ ID NO: 2145474 - RNA, 16 nt, Human herpesvirus 7
ugaucuggauucaaga

SEQ ID NO: 2145475 - RNA, 23 nt, Human herpesvirus 7
aggucacaaaagcuuugaucuac

SEQ ID NO: 2145476 - RNA, 16 nt, Human herpesvirus 7
agaaaaaaacaaugaa

SEQ ID NO: 2145477 - RNA, 14 nt, Human herpesvirus 7
ugacuguaucucca

SEQ ID NO: 2145478 - RNA, 18 nt, Human herpesvirus 7
uugugaagacuacauaaa

SEQ ID NO: 2145479 - RNA, 20 nt, Human herpesvirus 7
uuucuuuaccgauucuaaau

SEQ ID NO: 2145480 - RNA, 14 nt, Human herpesvirus 7
aauaaauuuaaaau

SEQ ID NO: 2145481 - RNA, 14 nt, Human herpesvirus 7
uuaaaauuauuaau

SEQ ID NO: 2145482 - RNA, 18 nt, Human herpesvirus 7
ucauuaucaccacaauuu

SEQ ID NO: 2145483 - RNA, 12 nt, Human herpesvirus 7
aaagaaaagcuu

SEQ ID NO: 2145484 - RNA, 14 nt, Human herpesvirus 7
caaguuuuacagaa

SEQ ID NO: 2145485 - RNA, 20 nt, Human herpesvirus 7
agaacuuuuguaggaaauuu

SEQ ID NO: 2145486 - RNA, 14 nt, Human herpesvirus 7
gaaugcaucugaau

SEQ ID NO: 2145487 - RNA, 16 nt, Human herpesvirus 7
aucagacaauuucaca

SEQ ID NO: 2145488 - RNA, 23 nt, Human herpesvirus 7
agucaaucugugaacugauguuu

SEQ ID NO: 2145489 - RNA, 16 nt, Human herpesvirus 7
aacgugugaaaacaau

SEQ ID NO: 2145490 - RNA, 18 nt, Human herpesvirus 7
aaauguguaacaauugag

SEQ ID NO: 2145491 - RNA, 20 nt, Human herpesvirus 7
uuaagcuuuuguaaacauga

SEQ ID NO: 2145492 - RNA, 13 nt, Human herpesvirus 7
augguaagcaaaa

SEQ ID NO: 2145493 - RNA, 22 nt, Human herpesvirus 7
uauucaaacgcuugaacaaauu

SEQ ID NO: 2145494 - RNA, 19 nt, Human herpesvirus 7
uucacaauggaaagaagaa

SEQ ID NO: 2145495 - RNA, 14 nt, Human herpesvirus 7
uguaugguuucauu

SEQ ID NO: 2145496 - RNA, 22 nt, Human herpesvirus 7
uaacuuuuuuuuucuuuaguuu

SEQ ID NO: 2145497 - RNA, 12 nt, Human herpesvirus 7
cuuacagugaag

SEQ ID NO: 2145498 - RNA, 23 nt, Human herpesvirus 7
ucuaugaaauaaaauuuuucauu

SEQ ID NO: 2145499 - RNA, 20 nt, Human herpesvirus 7
aauuguuugauuaauuucca

SEQ ID NO: 2145500 - RNA, 17 nt, Human herpesvirus 7
aggcuuuuagaaaucuu

SEQ ID NO: 2145501 - RNA, 14 nt, Human herpesvirus 7
aacagugggaaagu

SEQ ID NO: 2145502 - RNA, 19 nt, Human herpesvirus 7
uaguugcaacucuucuuca

SEQ ID NO: 2145503 - RNA, 13 nt, Human herpesvirus 7
cauauuaacaagc

SEQ ID NO: 2145504 - RNA, 13 nt, Human herpesvirus 7
ucucucacacuca

SEQ ID NO: 2145505 - RNA, 14 nt, Human herpesvirus 7
uuaauugugcaucu

SEQ ID NO: 2145506 - RNA, 15 nt, Human herpesvirus 7
augaacaaauaauga

SEQ ID NO: 2145507 - RNA, 20 nt, Human herpesvirus 7
aggaagguacaucuuucgua

SEQ ID NO: 2145508 - RNA, 15 nt, Human herpesvirus 7
guacaacgacauuga

SEQ ID NO: 2145509 - RNA, 16 nt, Human herpesvirus 7
cauuccacuaaaagag

SEQ ID NO: 2145510 - RNA, 19 nt, Human herpesvirus 7
aagaaaagcaaaccuuaca

SEQ ID NO: 2145511 - RNA, 22 nt, Human herpesvirus 7
uuuuugcauauggacuuaucaa

SEQ ID NO: 2145512 - RNA, 19 nt, Human herpesvirus 7
cuauuucugucaucuuaua

SEQ ID NO: 2145513 - RNA, 19 nt, Human herpesvirus 7
aguuucugcauacucuugu

SEQ ID NO: 2145514 - RNA, 15 nt, Human herpesvirus 7
gcggauuaagagaaa

SEQ ID NO: 2145515 - RNA, 13 nt, Human herpesvirus 7
agcucauuucauc

SEQ ID NO: 2145516 - RNA, 12 nt, Human herpesvirus 7
aauaaaaugguu

SEQ ID NO: 2145517 - RNA, 20 nt, Human herpesvirus 7
gucuacuaugggcuguuuua

SEQ ID NO: 2145518 - RNA, 13 nt, Human herpesvirus 7
ugcuggaaaacau

SEQ ID NO: 2145519 - RNA, 18 nt, Human herpesvirus 7
cacaguugaauaaagauu

SEQ ID NO: 2145520 - RNA, 16 nt, Human herpesvirus 7
accguggacuuucuug

SEQ ID NO: 2145521 - RNA, 18 nt, Human herpesvirus 7
agauaaguauaaacaguc

SEQ ID NO: 2145522 - RNA, 22 nt, Human herpesvirus 7
ugaugauuauuauaacuuguaa

SEQ ID NO: 2145523 - RNA, 16 nt, Human herpesvirus 7
auauuccauuaagcca

SEQ ID NO: 2145524 - RNA, 16 nt, Human herpesvirus 7
auacagauauuuuaau

SEQ ID NO: 2145525 - RNA, 18 nt, Human herpesvirus 7
uucugguuucuguugacu

SEQ ID NO: 2145526 - RNA, 15 nt, Human herpesvirus 7
ugguuauccaaguuu

SEQ ID NO: 2145527 - RNA, 15 nt, Human herpesvirus 7
augaaaucuugaauu

SEQ ID NO: 2145528 - RNA, 18 nt, Human herpesvirus 7
uuauuagugaauuacaga

SEQ ID NO: 2145529 - RNA, 15 nt, Human herpesvirus 7
gaaacgucaggaaaa

SEQ ID NO: 2145530 - RNA, 19 nt, Human herpesvirus 7
cguaacgaauaaaaaguuu

SEQ ID NO: 2145531 - RNA, 14 nt, Human herpesvirus 7
gaaagcuugugaag

SEQ ID NO: 2145532 - RNA, 23 nt, Human herpesvirus 7
auucugacuccuuuuuuucugcu

SEQ ID NO: 2145533 - RNA, 16 nt, Human herpesvirus 7
auagcaggaagcacaa

SEQ ID NO: 2145534 - RNA, 16 nt, Human herpesvirus 7
acuaaagcuacagcuu

SEQ ID NO: 2145535 - RNA, 20 nt, Human herpesvirus 7
uuggaaagggauuuauuauu

SEQ ID NO: 2145536 - RNA, 14 nt, Human herpesvirus 7
uugcauacuuuuuu

SEQ ID NO: 2145537 - RNA, 13 nt, Human herpesvirus 7
gaaaauaaaagag

SEQ ID NO: 2145538 - RNA, 18 nt, Human herpesvirus 7
cgccaaaucuaauuuaug

SEQ ID NO: 2145539 - RNA, 22 nt, Human herpesvirus 7
cagagaucauaauuacauugca

SEQ ID NO: 2145540 - RNA, 16 nt, Human herpesvirus 7
uaaugcugugauuuuc

SEQ ID NO: 2145541 - RNA, 21 nt, Human herpesvirus 7
aauugaaauauuuaugccuuu

SEQ ID NO: 2145542 - RNA, 16 nt, Human herpesvirus 7
aaagauguuucuuucu

SEQ ID NO: 2145543 - RNA, 15 nt, Human herpesvirus 7
aaagcucauuucauc

SEQ ID NO: 2145544 - RNA, 21 nt, Human herpesvirus 7
ugacuccuuuuuuucugcucg

SEQ ID NO: 2145545 - RNA, 19 nt, Human herpesvirus 7
ucaugcggaagaacaagca

SEQ ID NO: 2145546 - RNA, 16 nt, Human herpesvirus 7
agcuugaugaaucaaa

SEQ ID NO: 2145547 - RNA, 20 nt, Human herpesvirus 7
cuuugcuaaccacuguguca

SEQ ID NO: 2145548 - RNA, 16 nt, Human herpesvirus 7
uuugguuauccaaguu

SEQ ID NO: 2145549 - RNA, 21 nt, Human herpesvirus 7
aaagcauacuuuaaaacuuug

SEQ ID NO: 2145550 - RNA, 12 nt, Human herpesvirus 7
uuugcuugcuga

SEQ ID NO: 2145551 - RNA, 15 nt, Human herpesvirus 7
aagaaugcucuuuug

SEQ ID NO: 2145552 - RNA, 13 nt, Human herpesvirus 7
uguuuaaaauguu

SEQ ID NO: 2145553 - RNA, 15 nt, Human herpesvirus 7
uguuucuuucuuuua

SEQ ID NO: 2145554 - RNA, 23 nt, Human herpesvirus 7
uaauuuccacguuuuuuagcuuu

SEQ ID NO: 2145555 - RNA, 22 nt, Human herpesvirus 7
ucgaaaccgucagcaucucaga

SEQ ID NO: 2145556 - RNA, 15 nt, Human herpesvirus 7
auuuuccaacgaaau

SEQ ID NO: 2145557 - RNA, 17 nt, Human herpesvirus 7
aaucauguuuaagaaaa

SEQ ID NO: 2145558 - RNA, 18 nt, Human herpesvirus 7
agaaacuuucuaugauuu

SEQ ID NO: 2145559 - RNA, 14 nt, Human herpesvirus 7
ugcuugugaaggag

SEQ ID NO: 2145560 - RNA, 20 nt, Human herpesvirus 7
acggaaaauuuccgaccuga

SEQ ID NO: 2145561 - RNA, 20 nt, Human herpesvirus 7
cguuuucuaaacgugcccuc

SEQ ID NO: 2145562 - RNA, 19 nt, Human herpesvirus 7
agaacagcugaaacucauc

SEQ ID NO: 2145563 - RNA, 18 nt, Human herpesvirus 7
acgucuagacauuuguuu

SEQ ID NO: 2145564 - RNA, 13 nt, Human herpesvirus 7
uuuuuuguucaaa

SEQ ID NO: 2145565 - RNA, 18 nt, Human herpesvirus 7
agucagaacauugucaaa

SEQ ID NO: 2145566 - RNA, 23 nt, Human herpesvirus 7
aaaauacaauagugaacaugugc

SEQ ID NO: 2145567 - RNA, 17 nt, Human herpesvirus 7
uuaugagauuugccugc

SEQ ID NO: 2145568 - RNA, 17 nt, Human herpesvirus 7
cuaacaaaaaaauaccu

SEQ ID NO: 2145569 - RNA, 21 nt, Human herpesvirus 7
aaucauaccauaaauaccaaa

SEQ ID NO: 2145570 - RNA, 19 nt, Human herpesvirus 7
cagacagcuguauaucuau

SEQ ID NO: 2145571 - RNA, 19 nt, Human herpesvirus 7
ugaaaaucaauccaaauaa

SEQ ID NO: 2145572 - RNA, 15 nt, Human herpesvirus 7
gcaucaagaaacaag

SEQ ID NO: 2145573 - RNA, 15 nt, Human herpesvirus 7
aacaauauuuaaagu

SEQ ID NO: 2145574 - RNA, 21 nt, Human herpesvirus 7
gcaacuggcauuccuuggaaa

SEQ ID NO: 2145575 - RNA, 21 nt, Human herpesvirus 7
uauuaaguguuugcucugaaa

SEQ ID NO: 2145576 - RNA, 20 nt, Human herpesvirus 7
uggaaaaacagaauguggua

SEQ ID NO: 2145577 - RNA, 17 nt, Human herpesvirus 7
cugggagcaaugcauga

SEQ ID NO: 2145578 - RNA, 16 nt, Human herpesvirus 7
cauaauuaugaaaugu

SEQ ID NO: 2145579 - RNA, 19 nt, Human herpesvirus 7
agcaucccuauugcaucaa

SEQ ID NO: 2145580 - RNA, 20 nt, Human herpesvirus 7
gaaaaagcaacaaauguuua

SEQ ID NO: 2145581 - RNA, 16 nt, Human herpesvirus 7
gcagacauugaagauu

SEQ ID NO: 2145582 - RNA, 22 nt, Human herpesvirus 7
cgaaagccacuguugaugauuu

SEQ ID NO: 2145583 - RNA, 20 nt, Human herpesvirus 7
cauaaaacaugcaacauaau

SEQ ID NO: 2145584 - RNA, 22 nt, Human herpesvirus 7
aguaagaagugaguuuuucagu

SEQ ID NO: 2145585 - RNA, 17 nt, Human herpesvirus 7
acaacuaaagagaaugu

SEQ ID NO: 2145586 - RNA, 16 nt, Human herpesvirus 7
gauucuauaaaacgug

SEQ ID NO: 2145587 - RNA, 20 nt, Human herpesvirus 7
uggcagcgauauauuggaaa

SEQ ID NO: 2145588 - RNA, 18 nt, Human herpesvirus 7
gaaggcaucaagaaacaa

SEQ ID NO: 2145589 - RNA, 20 nt, Human herpesvirus 7
gaaaauuuauauuugcuugc

SEQ ID NO: 2145590 - RNA, 19 nt, Human herpesvirus 7
gugaaacacauucugucuu

SEQ ID NO: 2145591 - RNA, 18 nt, Human herpesvirus 7
uuuguaaacauuuuugaa

SEQ ID NO: 2145592 - RNA, 23 nt, Human herpesvirus 7
gauuuuuuaaaugugucuuacaa

SEQ ID NO: 2145593 - RNA, 20 nt, Human herpesvirus 7
agcgcuuuuuaaaaaaucua

SEQ ID NO: 2145594 - RNA, 22 nt, Human herpesvirus 7
uugaagaaauugugaagucuuu

SEQ ID NO: 2145595 - RNA, 20 nt, Human herpesvirus 7
cuuuagagucugugugugca

SEQ ID NO: 2145596 - RNA, 18 nt, Human herpesvirus 7
aacaugaguacuguuucu

SEQ ID NO: 2145597 - RNA, 18 nt, Human herpesvirus 7
uagauuacgcacaaauuu

SEQ ID NO: 2145598 - RNA, 20 nt, Human herpesvirus 7
cauuuguacuucaaaguagc

SEQ ID NO: 2145599 - RNA, 13 nt, Human herpesvirus 7
uucaacuguguuu

SEQ ID NO: 2145600 - RNA, 12 nt, Human herpesvirus 7
aauuuuaaaacu

SEQ ID NO: 2145601 - RNA, 18 nt, Human herpesvirus 7
caaaauauuuaucugcau

SEQ ID NO: 2145602 - RNA, 18 nt, Human herpesvirus 7
uaauaaaacaaacuaugu

SEQ ID NO: 2145603 - RNA, 20 nt, Human herpesvirus 7
aaauaauaacaauuauagaa

SEQ ID NO: 2145604 - RNA, 15 nt, Human herpesvirus 7
uguuuggcaacucuu

SEQ ID NO: 2145605 - RNA, 19 nt, Human herpesvirus 7
uacaacgacauugaaacuc

SEQ ID NO: 2145606 - RNA, 13 nt, Human herpesvirus 7
acaucauguuaaa

SEQ ID NO: 2145607 - RNA, 18 nt, Human herpesvirus 7
uguaauuucucaaaucuu

SEQ ID NO: 2145608 - RNA, 15 nt, Human herpesvirus 7
cauuuguuguggauu

SEQ ID NO: 2145609 - RNA, 23 nt, Human herpesvirus 7
uuaacgaaggcaucaagaaacaa

SEQ ID NO: 2145610 - RNA, 20 nt, Human herpesvirus 7
auggacggcauuuaacucau

SEQ ID NO: 2145611 - RNA, 17 nt, Human herpesvirus 7
acagcaacugugcauga

SEQ ID NO: 2145612 - RNA, 15 nt, Human herpesvirus 7
aaauuguaaguaaau

SEQ ID NO: 2145613 - RNA, 22 nt, Human herpesvirus 7
ggaaauuuucauagcacucaua

SEQ ID NO: 2145614 - RNA, 21 nt, Human herpesvirus 7
aaaguagaggccgaaaaucua

SEQ ID NO: 2145615 - RNA, 19 nt, Human herpesvirus 7
gcaacugugcaugaaaucu

SEQ ID NO: 2145616 - RNA, 17 nt, Human herpesvirus 7
aggaagcuuuacagcag

SEQ ID NO: 2145617 - RNA, 17 nt, Human herpesvirus 7
aagaggagaauucugua

SEQ ID NO: 2145618 - RNA, 18 nt, Human herpesvirus 7
aauuuuuuacugucuuua

SEQ ID NO: 2145619 - RNA, 13 nt, Human herpesvirus 7
uacagcacuuuga

SEQ ID NO: 2145620 - RNA, 23 nt, Human herpesvirus 7
uuuaaaacaagacagaaaugaau

SEQ ID NO: 2145621 - RNA, 17 nt, Human herpesvirus 7
ugccagguuuuucaaag

SEQ ID NO: 2145622 - RNA, 20 nt, Human herpesvirus 7
cuuuaccccaaacgccuuau

SEQ ID NO: 2145623 - RNA, 18 nt, Human herpesvirus 7
auuccuauuaagcagcuu

SEQ ID NO: 2145624 - RNA, 20 nt, Human herpesvirus 7
cugaauaauaugcuuucacu

SEQ ID NO: 2145625 - RNA, 17 nt, Human herpesvirus 7
aaucuaugcaaagcaag

SEQ ID NO: 2145626 - RNA, 23 nt, Human herpesvirus 7
gauuacgcacaaauuucuuguaa

SEQ ID NO: 2145627 - RNA, 13 nt, Human herpesvirus 7
aauaaacaggaac

SEQ ID NO: 2145628 - RNA, 14 nt, Human herpesvirus 7
gaauagacaucuuc

SEQ ID NO: 2145629 - RNA, 20 nt, Human herpesvirus 7
aauaucuuuuucaaauggau

SEQ ID NO: 2145630 - RNA, 17 nt, Human herpesvirus 7
guagauuuagauuuaaa

SEQ ID NO: 2145631 - RNA, 14 nt, Human herpesvirus 7
auugacagcaccaa

SEQ ID NO: 2145632 - RNA, 19 nt, Human herpesvirus 7
uucagaaauaacaaaauug

SEQ ID NO: 2145633 - RNA, 20 nt, Human herpesvirus 7
auuuaugcuuuaacuggaau

SEQ ID NO: 2145634 - RNA, 16 nt, Human herpesvirus 7
caauaaaagauuuaaa

SEQ ID NO: 2145635 - RNA, 21 nt, Human herpesvirus 7
aucaguacaacgacauugaaa

SEQ ID NO: 2145636 - RNA, 16 nt, Human herpesvirus 7
uaaaaauccuaaauuu

SEQ ID NO: 2145637 - RNA, 14 nt, Human herpesvirus 7
cuggcucaagcaca

SEQ ID NO: 2145638 - RNA, 15 nt, Human herpesvirus 7
cugaaaaacaugagu

SEQ ID NO: 2145639 - RNA, 16 nt, Human herpesvirus 7
gccucugccucuuggc

SEQ ID NO: 2145640 - RNA, 16 nt, Human herpesvirus 7
agcaguuauaugaaau

SEQ ID NO: 2145641 - RNA, 17 nt, Human herpesvirus 7
aggaaauugcuuucuaa

SEQ ID NO: 2145642 - RNA, 22 nt, Human herpesvirus 7
ucauuuaucaggugcucuaaau

SEQ ID NO: 2145643 - RNA, 14 nt, Human herpesvirus 7
gugauugguagaaa

SEQ ID NO: 2145644 - RNA, 21 nt, Human herpesvirus 7
uggcacauaaguugacaaugu

SEQ ID NO: 2145645 - RNA, 18 nt, Human herpesvirus 7
uaacgauuccaaaccuau

SEQ ID NO: 2145646 - RNA, 16 nt, Human herpesvirus 7
uuaggggaagaaucaa

SEQ ID NO: 2145647 - RNA, 19 nt, Human herpesvirus 7
uacagaucauuuuucgacu

SEQ ID NO: 2145648 - RNA, 23 nt, Human herpesvirus 7
uguuaucauacguuuacaguuuu

SEQ ID NO: 2145649 - RNA, 16 nt, Human herpesvirus 7
agaaugggugucagcu

SEQ ID NO: 2145650 - RNA, 17 nt, Human herpesvirus 7
uuaaaggaaauaaacaa

SEQ ID NO: 2145651 - RNA, 15 nt, Human herpesvirus 7
agaaaaucucucaac

SEQ ID NO: 2145652 - RNA, 13 nt, Human herpesvirus 7
uuuaacaugugua

SEQ ID NO: 2145653 - RNA, 22 nt, Human herpesvirus 7
cuucuagaaacuaaagaaaaaa

SEQ ID NO: 2145654 - RNA, 13 nt, Human herpesvirus 7
auaaugaaacugu

SEQ ID NO: 2145655 - RNA, 21 nt, Human herpesvirus 7
cuauuaagcguucguaacaaa

SEQ ID NO: 2145656 - RNA, 18 nt, Human herpesvirus 7
agguaaaaaauaaauaua

SEQ ID NO: 2145657 - RNA, 18 nt, Human herpesvirus 7
uuugacaagcgcauuugu

SEQ ID NO: 2145658 - RNA, 15 nt, Human herpesvirus 7
ucugagaauuuaaag

SEQ ID NO: 2145659 - RNA, 16 nt, Human herpesvirus 7
uaaaaaaaauaaauuu

SEQ ID NO: 2145660 - RNA, 19 nt, Human herpesvirus 7
acaagguuuaaaacauuua

SEQ ID NO: 2145661 - RNA, 18 nt, Human herpesvirus 7
ugcagacuaauuacagcu

SEQ ID NO: 2145662 - RNA, 15 nt, Human herpesvirus 7
ggaaugauauaaagu

SEQ ID NO: 2145663 - RNA, 16 nt, Human herpesvirus 7
cauaaauaaaaacaug

SEQ ID NO: 2145664 - RNA, 23 nt, Human herpesvirus 7
auuguagauggcaccaauagaaa

SEQ ID NO: 2145665 - RNA, 18 nt, Human herpesvirus 7
ucuuaauaaaguuuaauu

SEQ ID NO: 2145666 - RNA, 23 nt, Human herpesvirus 7
aauguaaacgaagaaucauuuau

SEQ ID NO: 2145667 - RNA, 15 nt, Human herpesvirus 7
auugcgaaaaugaua

SEQ ID NO: 2145668 - RNA, 14 nt, Human herpesvirus 7
caacagccaaaugu

SEQ ID NO: 2145669 - RNA, 22 nt, Human herpesvirus 7
aaaauauguucagauugaaauu

SEQ ID NO: 2145670 - RNA, 17 nt, Human herpesvirus 7
uuauguccgcuuacaag

SEQ ID NO: 2145671 - RNA, 16 nt, Human herpesvirus 7
cuucuuuauaagcagu

SEQ ID NO: 2145672 - RNA, 22 nt, Human herpesvirus 7
uuaucauacguuuacaguuuuu

SEQ ID NO: 2145673 - RNA, 12 nt, Human herpesvirus 7
aguauuuaagaa

SEQ ID NO: 2145674 - RNA, 16 nt, Human herpesvirus 7
uuggaaaaaaaacggg

SEQ ID NO: 2145675 - RNA, 13 nt, Human herpesvirus 7
auauaaaaaauuu

SEQ ID NO: 2145676 - RNA, 22 nt, Human herpesvirus 7
ucuaaccccgcucuuuuauuuu

SEQ ID NO: 2145677 - RNA, 21 nt, Human herpesvirus 7
acgauaugguuugaaaaccau

SEQ ID NO: 2145678 - RNA, 16 nt, Human herpesvirus 7
acgagcgauuuaaugu

SEQ ID NO: 2145679 - RNA, 16 nt, Human herpesvirus 7
auuauauucaaauaag

SEQ ID NO: 2145680 - RNA, 18 nt, Human herpesvirus 7
ucucuugaggaaaugucu

SEQ ID NO: 2145681 - RNA, 22 nt, Human herpesvirus 7
aagaauuaauaaaaguaucauu

SEQ ID NO: 2145682 - RNA, 18 nt, Human herpesvirus 7
caauuuuuaacauuacgu

SEQ ID NO: 2145683 - RNA, 21 nt, Human herpesvirus 7
aucuaccccgauccucagaau

SEQ ID NO: 2145684 - RNA, 13 nt, Human herpesvirus 7
uacaaugcagccu

SEQ ID NO: 2145685 - RNA, 21 nt, Human herpesvirus 7
cuuauuccagauaugacaaau

SEQ ID NO: 2145686 - RNA, 14 nt, Human herpesvirus 7
auuacauugcaguc

SEQ ID NO: 2145687 - RNA, 15 nt, Human herpesvirus 7
aauuucuauuagaua

SEQ ID NO: 2145688 - RNA, 19 nt, Human herpesvirus 7
gacaugcccuuucucguga

SEQ ID NO: 2145689 - RNA, 18 nt, Human herpesvirus 7
acaaauaucacuggcaau

SEQ ID NO: 2145690 - RNA, 22 nt, Human herpesvirus 7
uugaaaaagcguugguugcuug

SEQ ID NO: 2145691 - RNA, 13 nt, Human herpesvirus 7
aucaaauuucaaa

SEQ ID NO: 2145692 - RNA, 12 nt, Human herpesvirus 7
aacauuucagau

SEQ ID NO: 2145693 - RNA, 14 nt, Human herpesvirus 7
uaauaacaauuuga

SEQ ID NO: 2145694 - RNA, 20 nt, Human herpesvirus 7
gcaaagcuuuugcgagaaaa

SEQ ID NO: 2145695 - RNA, 23 nt, Human herpesvirus 7
gcuauuuaaucuaugcaaagcaa

SEQ ID NO: 2145696 - RNA, 22 nt, Human herpesvirus 7
auaugaaucaaauuucaaacgu

SEQ ID NO: 2145697 - RNA, 17 nt, Human herpesvirus 7
accgccaccuucuuaua

SEQ ID NO: 2145698 - RNA, 15 nt, Human herpesvirus 7
acugucacuguccaa

SEQ ID NO: 2145699 - RNA, 20 nt, Human herpesvirus 7
cucuugaggaaaugucuuug

SEQ ID NO: 2145700 - RNA, 22 nt, Human herpesvirus 7
uuuaggaaauugcuuucuaagu

SEQ ID NO: 2145701 - RNA, 14 nt, Human herpesvirus 7
ugugaaaauaacag

SEQ ID NO: 2145702 - RNA, 21 nt, Human herpesvirus 7
uggaucuucugcuaacucaua

SEQ ID NO: 2145703 - RNA, 13 nt, Human herpesvirus 7
aaacauucuaaau

SEQ ID NO: 2145704 - RNA, 16 nt, Human herpesvirus 7
aaaacaaacuaugucc

SEQ ID NO: 2145705 - RNA, 23 nt, Human herpesvirus 7
acagcaccaauccuuuuaaaacc

SEQ ID NO: 2145706 - RNA, 12 nt, Human herpesvirus 7
ggcaacaucuuc

SEQ ID NO: 2145707 - RNA, 22 nt, Human herpesvirus 7
acgaauaaaaaguuuuugagua

SEQ ID NO: 2145708 - RNA, 21 nt, Human herpesvirus 7
uugaaagcguuucacugggaa

SEQ ID NO: 2145709 - RNA, 12 nt, Human herpesvirus 7
ugucuuggaaga

SEQ ID NO: 2145710 - RNA, 15 nt, Human herpesvirus 7
acuauguccaaaaau

SEQ ID NO: 2145711 - RNA, 13 nt, Human herpesvirus 7
cauuaauaucaau

SEQ ID NO: 2145712 - RNA, 18 nt, Human herpesvirus 7
uugauuuucaaguuucuu

SEQ ID NO: 2145713 - RNA, 14 nt, Human herpesvirus 7
uacuuucguuuucu

SEQ ID NO: 2145714 - RNA, 21 nt, Human herpesvirus 7
gucauuugcaguuauuucuua

SEQ ID NO: 2145715 - RNA, 15 nt, Human herpesvirus 7
uucuaaaaauucugg

SEQ ID NO: 2145716 - RNA, 15 nt, Human herpesvirus 7
agagaauuuagauua

SEQ ID NO: 2145717 - RNA, 16 nt, Human herpesvirus 7
ugugacuucauaucug

SEQ ID NO: 2145718 - RNA, 17 nt, Human herpesvirus 7
uccuucuaccucuuaca

SEQ ID NO: 2145719 - RNA, 23 nt, Human herpesvirus 7
ugacagacacaugcuuacagauc

SEQ ID NO: 2145720 - RNA, 15 nt, Human herpesvirus 7
guacauuccuugaga

SEQ ID NO: 2145721 - RNA, 20 nt, Human herpesvirus 7
cuaagaaaaaaacaaaaucu

SEQ ID NO: 2145722 - RNA, 21 nt, Human herpesvirus 7
acauuucagaugacaacucaa

SEQ ID NO: 2145723 - RNA, 17 nt, Human herpesvirus 7
guaaggcagugauuggu

SEQ ID NO: 2145724 - RNA, 20 nt, Human herpesvirus 7
uguucaaucacauacucuau

SEQ ID NO: 2145725 - RNA, 22 nt, Human herpesvirus 7
accucgacauucuccaguggca

SEQ ID NO: 2145726 - RNA, 13 nt, Human herpesvirus 7
gauguguuggaaa

SEQ ID NO: 2145727 - RNA, 22 nt, Human herpesvirus 7
ucaacagagcgcuuugcuuauu

SEQ ID NO: 2145728 - RNA, 15 nt, Human herpesvirus 7
auaccaaacaaaauu

SEQ ID NO: 2145729 - RNA, 11 nt, Human herpesvirus 7
uuacaacaaua

SEQ ID NO: 2145730 - RNA, 21 nt, Human herpesvirus 7
gauuauauucaaauaagggau

SEQ ID NO: 2145731 - RNA, 17 nt, Human herpesvirus 7
agguuacguguucauuu

SEQ ID NO: 2145732 - RNA, 23 nt, Human herpesvirus 7
uugcaauacaaauuccugcuugc

SEQ ID NO: 2145733 - RNA, 18 nt, Human herpesvirus 7
gcaguauucuuaugccag

SEQ ID NO: 2145734 - RNA, 19 nt, Human herpesvirus 7
auaaaccguuagagcaguu

SEQ ID NO: 2145735 - RNA, 21 nt, Human herpesvirus 7
ucuggaacuuuuaaauuaaaa

SEQ ID NO: 2145736 - RNA, 12 nt, Human herpesvirus 7
uaagccaaauau

SEQ ID NO: 2145737 - RNA, 16 nt, Human herpesvirus 7
accgcaugugaaaaug

SEQ ID NO: 2145738 - RNA, 15 nt, Human herpesvirus 7
gaugcauccaaagaa

SEQ ID NO: 2145739 - RNA, 14 nt, Human herpesvirus 7
uacuuguaugcuau

SEQ ID NO: 2145740 - RNA, 22 nt, Human herpesvirus 7
augaaaacuuggaaaacaauca

SEQ ID NO: 2145741 - RNA, 16 nt, Human herpesvirus 7
caacuugaaugagcug

SEQ ID NO: 2145742 - RNA, 14 nt, Human herpesvirus 7
aucgauuaaaucuu

SEQ ID NO: 2145743 - RNA, 22 nt, Human herpesvirus 7
auagacugauacgcuuucugaa

SEQ ID NO: 2145744 - RNA, 23 nt, Human herpesvirus 7
ugauguuauacauaaagagaaag

SEQ ID NO: 2145745 - RNA, 19 nt, Human herpesvirus 7
uagcagcuuuuauuccuuc

SEQ ID NO: 2145746 - RNA, 18 nt, Human herpesvirus 7
uuuauuuagaaguggcuu

SEQ ID NO: 2145747 - RNA, 23 nt, Human herpesvirus 7
uugugguacaacaaacauuccaa

SEQ ID NO: 2145748 - RNA, 18 nt, Human herpesvirus 7
uacucuagaacaaacugu

SEQ ID NO: 2145749 - RNA, 20 nt, Human herpesvirus 7
acaaauuuaagagacauuga

SEQ ID NO: 2145750 - RNA, 16 nt, Human herpesvirus 7
auaauagccuuucacu

SEQ ID NO: 2145751 - RNA, 16 nt, Human herpesvirus 7
ucuggauucaagaaau

SEQ ID NO: 2145752 - RNA, 12 nt, Human herpesvirus 7
gcgaaaaugaua

SEQ ID NO: 2145753 - RNA, 17 nt, Human herpesvirus 7
uuguacauuuuaccaaa

SEQ ID NO: 2145754 - RNA, 18 nt, Human herpesvirus 7
agguuuaggaaauugcuu

SEQ ID NO: 2145755 - RNA, 22 nt, Human herpesvirus 7
cacugagccaucaaaaaauuua

SEQ ID NO: 2145756 - RNA, 14 nt, Human herpesvirus 7
auguugcaaauguu

SEQ ID NO: 2145757 - RNA, 19 nt, Human herpesvirus 7
auugugcaucuccuguaac

SEQ ID NO: 2145758 - RNA, 14 nt, Human herpesvirus 7
uaugcaugcaauuu

SEQ ID NO: 2145759 - RNA, 14 nt, Human herpesvirus 7
uccuguucauguuu

SEQ ID NO: 2145760 - RNA, 20 nt, Human herpesvirus 7
guugcacuccuagaaacacg

SEQ ID NO: 2145761 - RNA, 17 nt, Human herpesvirus 7
uaaacuugugaaaauaa

SEQ ID NO: 2145762 - RNA, 18 nt, Human herpesvirus 7
gaagguugucuguucuca

SEQ ID NO: 2145763 - RNA, 16 nt, Human herpesvirus 7
uccgagacagagucaa

SEQ ID NO: 2145764 - RNA, 21 nt, Human herpesvirus 7
acucuggguccggaaguugag

SEQ ID NO: 2145765 - RNA, 16 nt, Human herpesvirus 7
auuauguguacacuuu

SEQ ID NO: 2145766 - RNA, 18 nt, Human herpesvirus 7
agauuaauauauuuuccu

SEQ ID NO: 2145767 - RNA, 18 nt, Human herpesvirus 7
auauugaaggugucuauu

SEQ ID NO: 2145768 - RNA, 17 nt, Human herpesvirus 7
uuuuuguuguuuucaua

SEQ ID NO: 2145769 - RNA, 19 nt, Human herpesvirus 7
gaauaagcaaauaaauugu

SEQ ID NO: 2145770 - RNA, 15 nt, Human herpesvirus 7
agaauacacauuuag

SEQ ID NO: 2145771 - RNA, 18 nt, Human herpesvirus 7
accaaacuauauugaauu

SEQ ID NO: 2145772 - RNA, 16 nt, Human herpesvirus 7
uauguauuuuacugga

SEQ ID NO: 2145773 - RNA, 18 nt, Human herpesvirus 7
cacguucuaaaaaacaaa

SEQ ID NO: 2145774 - RNA, 13 nt, Human herpesvirus 7
uaggauaccaaac

SEQ ID NO: 2145775 - RNA, 18 nt, Human herpesvirus 7
guacaauaauuucuauua

SEQ ID NO: 2145776 - RNA, 19 nt, Human herpesvirus 7
uugacaggugauauucuuu

SEQ ID NO: 2145777 - RNA, 19 nt, Human herpesvirus 7
cucaauuuuucgcugaaga

SEQ ID NO: 2145778 - RNA, 13 nt, Human herpesvirus 7
caaagugaugaaa

SEQ ID NO: 2145779 - RNA, 16 nt, Human herpesvirus 7
gaaguaauuuaugcuu

SEQ ID NO: 2145780 - RNA, 13 nt, Human herpesvirus 7
gucuuacagugcu

SEQ ID NO: 2145781 - RNA, 23 nt, Human herpesvirus 7
cacucugcauuccacuaaaagag

SEQ ID NO: 2145782 - RNA, 17 nt, Human herpesvirus 7
acauuauaaauguaacu

SEQ ID NO: 2145783 - RNA, 20 nt, Human herpesvirus 7
ucaugaacacaacauccaga

SEQ ID NO: 2145784 - RNA, 13 nt, Human herpesvirus 7
gcucucaaucaaa

SEQ ID NO: 2145785 - RNA, 19 nt, Human herpesvirus 7
agaacuugcgaauacuugu

SEQ ID NO: 2145786 - RNA, 11 nt, Human herpesvirus 7
cuguuaagaau

SEQ ID NO: 2145787 - RNA, 14 nt, Human herpesvirus 7
auggauacaaggaa

SEQ ID NO: 2145788 - RNA, 20 nt, Human herpesvirus 7
uuucgaacuugucaccuauu

SEQ ID NO: 2145789 - RNA, 10 nt, Human herpesvirus 7
caggaagcaa

SEQ ID NO: 2145790 - RNA, 16 nt, Human herpesvirus 7
caugauuucaauaauc

SEQ ID NO: 2145791 - RNA, 14 nt, Human herpesvirus 7
aaaaagcagacauu

SEQ ID NO: 2145792 - RNA, 16 nt, Human herpesvirus 7
auucugaaauaaacau

SEQ ID NO: 2145793 - RNA, 18 nt, Human herpesvirus 7
uuguuugcuauuauuaaa

SEQ ID NO: 2145794 - RNA, 12 nt, Human herpesvirus 7
agugaacauuug

SEQ ID NO: 2145795 - RNA, 14 nt, Human herpesvirus 7
auuuucguaucugu

SEQ ID NO: 2145796 - RNA, 14 nt, Human herpesvirus 7
cuuuauuuaauaac

SEQ ID NO: 2145797 - RNA, 20 nt, Human herpesvirus 7
uguuucuuugaaucuauuaa

SEQ ID NO: 2145798 - RNA, 19 nt, Human herpesvirus 7
uuaaaaaagugauugcaga

SEQ ID NO: 2145799 - RNA, 23 nt, Human herpesvirus 7
caaccuuuuaaaaucaaauguaa

SEQ ID NO: 2145800 - RNA, 16 nt, Human herpesvirus 7
auauuugcuugcugaa

SEQ ID NO: 2145801 - RNA, 19 nt, Human herpesvirus 7
auguacugcucaucaaaua

SEQ ID NO: 2145802 - RNA, 16 nt, Human herpesvirus 7
auaugccaaugaacaa

SEQ ID NO: 2145803 - RNA, 15 nt, Human herpesvirus 7
ugcuuuucaugcuuu

SEQ ID NO: 2145804 - RNA, 14 nt, Human herpesvirus 7
agugaauuacagau

SEQ ID NO: 2145805 - RNA, 22 nt, Human herpesvirus 7
acauucucaaaaaugauaugac

SEQ ID NO: 2145806 - RNA, 15 nt, Human herpesvirus 7
aaacauguugaaaga

SEQ ID NO: 2145807 - RNA, 22 nt, Human herpesvirus 7
guuuccacauccgcaccgacag

SEQ ID NO: 2145808 - RNA, 22 nt, Human herpesvirus 7
aauuuugauuccugucuugacc

SEQ ID NO: 2145809 - RNA, 16 nt, Human herpesvirus 7
ucuauuuaaaauauua

SEQ ID NO: 2145810 - RNA, 17 nt, Human herpesvirus 7
cauugaauauaaguuuu

SEQ ID NO: 2145811 - RNA, 12 nt, Human herpesvirus 7
ucaaaauuccau

SEQ ID NO: 2145812 - RNA, 15 nt, Human herpesvirus 7
gaaucacaacauaua

SEQ ID NO: 2145813 - RNA, 23 nt, Human herpesvirus 7
uuguaguuuuugcauauggacuu

SEQ ID NO: 2145814 - RNA, 15 nt, Human herpesvirus 7
aaagugauugcagau

SEQ ID NO: 2145815 - RNA, 16 nt, Human herpesvirus 7
uaaccaaaauguggga

SEQ ID NO: 2145816 - RNA, 19 nt, Human herpesvirus 7
aaaaacaugggauuucugu

SEQ ID NO: 2145817 - RNA, 14 nt, Human herpesvirus 7
cuugcuuugaaaaa

SEQ ID NO: 2145818 - RNA, 18 nt, Human herpesvirus 7
uuaaacuugugaaaauaa

SEQ ID NO: 2145819 - RNA, 20 nt, Human herpesvirus 7
ucuacacaaacgaguuucaa

SEQ ID NO: 2145820 - RNA, 18 nt, Human herpesvirus 7
cauuuauggaaauaggcg

SEQ ID NO: 2145821 - RNA, 15 nt, Human herpesvirus 7
aagauugcuugcacu

SEQ ID NO: 2145822 - RNA, 16 nt, Human herpesvirus 7
gauguauaaaucagaa

SEQ ID NO: 2145823 - RNA, 18 nt, Human herpesvirus 7
auuucuaauagacaaauu

SEQ ID NO: 2145824 - RNA, 22 nt, Human herpesvirus 7
aaauuauuaauauuaguauugu

SEQ ID NO: 2145825 - RNA, 16 nt, Human herpesvirus 7
aucuguagaaaauguu

SEQ ID NO: 2145826 - RNA, 18 nt, Human herpesvirus 7
caugaucuuguaauuucu

SEQ ID NO: 2145827 - RNA, 16 nt, Human herpesvirus 7
gaaaauacuacaguua

SEQ ID NO: 2145828 - RNA, 23 nt, Human herpesvirus 7
cacauacucuagaacaaacugua

SEQ ID NO: 2145829 - RNA, 16 nt, Human herpesvirus 7
caaaaucagaaauguu

SEQ ID NO: 2145830 - RNA, 22 nt, Human herpesvirus 7
agauagcauuuguuacagcuuu

SEQ ID NO: 2145831 - RNA, 14 nt, Human herpesvirus 7
auauaacaaaaaac

SEQ ID NO: 2145832 - RNA, 14 nt, Human herpesvirus 7
aauuagcuaaauaa

SEQ ID NO: 2145833 - RNA, 18 nt, Human herpesvirus 7
gggaaaaagcauaaagca

SEQ ID NO: 2145834 - RNA, 19 nt, Human herpesvirus 7
uaugccacaaaaaacuuug

SEQ ID NO: 2145835 - RNA, 22 nt, Human herpesvirus 7
cuaucaaauuuaucucauagcu

SEQ ID NO: 2145836 - RNA, 15 nt, Human herpesvirus 7
ugcauauuuugcuag

SEQ ID NO: 2145837 - RNA, 13 nt, Human herpesvirus 7
cuugcuagauucu

SEQ ID NO: 2145838 - RNA, 17 nt, Human herpesvirus 7
auuaaaugauuuuaaau

SEQ ID NO: 2145839 - RNA, 14 nt, Human herpesvirus 7
gaauuccaggguaa

SEQ ID NO: 2145840 - RNA, 12 nt, Human herpesvirus 7
gaauuacagaua

SEQ ID NO: 2145841 - RNA, 17 nt, Human herpesvirus 7
uguacgauuuauaucug

SEQ ID NO: 2145842 - RNA, 14 nt, Human herpesvirus 7
gaaauaaugaagga

SEQ ID NO: 2145843 - RNA, 16 nt, Human herpesvirus 7
aagagcucgauuuacu

SEQ ID NO: 2145844 - RNA, 12 nt, Human herpesvirus 7
ucuucuucugag

SEQ ID NO: 2145845 - RNA, 19 nt, Human herpesvirus 7
auguugccuucuaaaacag

SEQ ID NO: 2145846 - RNA, 17 nt, Human herpesvirus 7
uguuaaccaaaaugugg

SEQ ID NO: 2145847 - RNA, 23 nt, Human herpesvirus 7
ucuaacacugcaagcugauucaa

SEQ ID NO: 2145848 - RNA, 14 nt, Human herpesvirus 7
gaguauguugcaua

SEQ ID NO: 2145849 - RNA, 20 nt, Human herpesvirus 7
acaacuuuauggaacaugaa

SEQ ID NO: 2145850 - RNA, 13 nt, Human herpesvirus 7
cuuuaccgauucu

SEQ ID NO: 2145851 - RNA, 21 nt, Human herpesvirus 7
acaauguguuaaauaaagagu

SEQ ID NO: 2145852 - RNA, 20 nt, Human herpesvirus 7
gucagaacaucccuggacag

SEQ ID NO: 2145853 - RNA, 21 nt, Human herpesvirus 7
caaaauucugcuugucucugu

SEQ ID NO: 2145854 - RNA, 22 nt, Human herpesvirus 7
uaguauuguaauaauuuaaaau

SEQ ID NO: 2145855 - RNA, 18 nt, Human herpesvirus 7
guauuuguugaucuucaa

SEQ ID NO: 2145856 - RNA, 16 nt, Human herpesvirus 7
agccauaaaugcuuaa

SEQ ID NO: 2145857 - RNA, 15 nt, Human herpesvirus 7
guuuaaguauguuua

SEQ ID NO: 2145858 - RNA, 15 nt, Human herpesvirus 7
aguacaucuuucuag

SEQ ID NO: 2145859 - RNA, 17 nt, Human herpesvirus 7
auauauaagagaauugc

SEQ ID NO: 2145860 - RNA, 14 nt, Human herpesvirus 7
gagagacaagagga

SEQ ID NO: 2145861 - RNA, 18 nt, Human herpesvirus 7
aaaauuccaaaauguaaa

SEQ ID NO: 2145862 - RNA, 21 nt, Human herpesvirus 7
agcauaugugagaaaacauua

SEQ ID NO: 2145863 - RNA, 17 nt, Human herpesvirus 7
aagagcuuuugcaaagc

SEQ ID NO: 2145864 - RNA, 19 nt, Human herpesvirus 7
aaaccaaguuuuuugagau

SEQ ID NO: 2145865 - RNA, 20 nt, Human herpesvirus 7
uuucuggcaacaguucaaaa

SEQ ID NO: 2145866 - RNA, 16 nt, Human herpesvirus 7
aacuuugcaacaaaau

SEQ ID NO: 2145867 - RNA, 17 nt, Human herpesvirus 7
ucucuaaaauuuucuua

SEQ ID NO: 2145868 - RNA, 22 nt, Human herpesvirus 7
agauauuuuaauucuaaaaauu

SEQ ID NO: 2145869 - RNA, 18 nt, Human herpesvirus 7
gaccuaacaaaaaaauac

SEQ ID NO: 2145870 - RNA, 15 nt, Human herpesvirus 7
uugcucauguugacg

SEQ ID NO: 2145871 - RNA, 15 nt, Human herpesvirus 7
uuauucccaugccua

SEQ ID NO: 2145872 - RNA, 18 nt, Human herpesvirus 7
uuacacaggaauugcugu

SEQ ID NO: 2145873 - RNA, 19 nt, Human herpesvirus 7
aaaguuuauagaacaagua

SEQ ID NO: 2145874 - RNA, 12 nt, Human herpesvirus 7
aaaguacaaaug

SEQ ID NO: 2145875 - RNA, 13 nt, Human herpesvirus 7
uaccaauaaaagg

SEQ ID NO: 2145876 - RNA, 19 nt, Human herpesvirus 7
cuucaauaugcuuaguuuu

SEQ ID NO: 2145877 - RNA, 19 nt, Human herpesvirus 7
guaaauuuacuugauuuuc

SEQ ID NO: 2145878 - RNA, 16 nt, Human herpesvirus 7
cauugaaaucauuuug

SEQ ID NO: 2145879 - RNA, 15 nt, Human herpesvirus 7
acucugaauacguua

SEQ ID NO: 2145880 - RNA, 20 nt, Human herpesvirus 7
aaauagaguuuaauuguacu

SEQ ID NO: 2145881 - RNA, 22 nt, Human herpesvirus 7
caacaacuaaaacuacauuuaa

SEQ ID NO: 2145882 - RNA, 15 nt, Human herpesvirus 7
aauuacacaaauuga

SEQ ID NO: 2145883 - RNA, 12 nt, Human herpesvirus 7
uaaaaacaaugg

SEQ ID NO: 2145884 - RNA, 18 nt, Human herpesvirus 7
auaaauguucuucuguaa

SEQ ID NO: 2145885 - RNA, 16 nt, Human herpesvirus 7
cugugaaguacauucc

SEQ ID NO: 2145886 - RNA, 14 nt, Human herpesvirus 7
acuuuaaauuauua

SEQ ID NO: 2145887 - RNA, 15 nt, Human herpesvirus 7
cauaguaaacacgua

SEQ ID NO: 2145888 - RNA, 13 nt, Human herpesvirus 7
aauuagugaaaac

SEQ ID NO: 2145889 - RNA, 18 nt, Human herpesvirus 7
ucaauaacgaauuauuua

SEQ ID NO: 2145890 - RNA, 22 nt, Human herpesvirus 7
acaauaaugcugugauuuuccu

SEQ ID NO: 2145891 - RNA, 18 nt, Human herpesvirus 7
gacauuugaaauggguuu

SEQ ID NO: 2145892 - RNA, 19 nt, Human herpesvirus 7
acucagagaucauaauuac

SEQ ID NO: 2145893 - RNA, 17 nt, Human herpesvirus 7
ucaucaauguuuucauu

SEQ ID NO: 2145894 - RNA, 18 nt, Human herpesvirus 7
uaaguauuuuacaacaau

SEQ ID NO: 2145895 - RNA, 20 nt, Human herpesvirus 7
guuuggaaaaguugaagaaa

SEQ ID NO: 2145896 - RNA, 18 nt, Human herpesvirus 7
aagagguaaguguaagcu

SEQ ID NO: 2145897 - RNA, 19 nt, Human herpesvirus 7
cuaauucuggaaaauguga

SEQ ID NO: 2145898 - RNA, 16 nt, Human herpesvirus 7
uuguuccugugugcaa

SEQ ID NO: 2145899 - RNA, 13 nt, Human herpesvirus 7
auuucaaaggaag

SEQ ID NO: 2145900 - RNA, 13 nt, Human herpesvirus 7
ggcuuagaauauu

SEQ ID NO: 2145901 - RNA, 19 nt, Human herpesvirus 7
auuuagcaccaacugaauu

SEQ ID NO: 2145902 - RNA, 23 nt, Human herpesvirus 7
caggcauuuaagaauuuaaucau

SEQ ID NO: 2145903 - RNA, 14 nt, Human herpesvirus 7
aaauuuuuagcucu

SEQ ID NO: 2145904 - RNA, 11 nt, Human herpesvirus 7
aauuaaauacu

SEQ ID NO: 2145905 - RNA, 17 nt, Human herpesvirus 7
guuuccgcauaaaaaau

SEQ ID NO: 2145906 - RNA, 22 nt, Human herpesvirus 7
aguuauuuguuccaguugaaug

SEQ ID NO: 2145907 - RNA, 20 nt, Human herpesvirus 7
gauuuuaaaagguugacauc

SEQ ID NO: 2145908 - RNA, 20 nt, Human herpesvirus 7
uccagcaaagacuugcaaag

SEQ ID NO: 2145909 - RNA, 16 nt, Human herpesvirus 7
gaaacgucccugugac

SEQ ID NO: 2145910 - RNA, 20 nt, Human herpesvirus 7
aaaugcgauacuaguuuauu

SEQ ID NO: 2145911 - RNA, 17 nt, Human herpesvirus 7
agaaauaacaaaauugu

SEQ ID NO: 2145912 - RNA, 14 nt, Human herpesvirus 7
agaauuuucaagau

SEQ ID NO: 2145913 - RNA, 15 nt, Human herpesvirus 7
guucuuguuuggaaa

SEQ ID NO: 2145914 - RNA, 21 nt, Human herpesvirus 7
uuauaaaagauggaaaguuua

SEQ ID NO: 2145915 - RNA, 15 nt, Human herpesvirus 7
cauugaaaaugcauu

SEQ ID NO: 2145916 - RNA, 19 nt, Human herpesvirus 7
caaucugugaacugauguu

SEQ ID NO: 2145917 - RNA, 22 nt, Human herpesvirus 7
aaagagaacgaugaauuuuucu

SEQ ID NO: 2145918 - RNA, 13 nt, Human herpesvirus 7
uaauccauuccug

SEQ ID NO: 2145919 - RNA, 10 nt, Human herpesvirus 7
caacaucuuu

SEQ ID NO: 2145920 - RNA, 16 nt, Human herpesvirus 7
agcagacaaggggcau

SEQ ID NO: 2145921 - RNA, 19 nt, Human herpesvirus 7
ugcaacuuuaauuaacacu

SEQ ID NO: 2145922 - RNA, 13 nt, Human herpesvirus 7
aaauaauaacaau

SEQ ID NO: 2145923 - RNA, 23 nt, Human herpesvirus 7
gacauuguacaauuacaaaaugu

SEQ ID NO: 2145924 - RNA, 18 nt, Human herpesvirus 7
acuaucuccuaaaugaau

SEQ ID NO: 2145925 - RNA, 15 nt, Human herpesvirus 7
aaaacgguauguaaa

SEQ ID NO: 2145926 - RNA, 12 nt, Human herpesvirus 7
guuuccauugcu

SEQ ID NO: 2145927 - RNA, 15 nt, Human herpesvirus 7
uucugaaauaaacau

SEQ ID NO: 2145928 - RNA, 22 nt, Human herpesvirus 7
aaacgcuaaccaucugcuggaa

SEQ ID NO: 2145929 - RNA, 16 nt, Human herpesvirus 7
gaacagucccagauaa

SEQ ID NO: 2145930 - RNA, 17 nt, Human herpesvirus 7
uccagauaugacaaauu

SEQ ID NO: 2145931 - RNA, 18 nt, Human herpesvirus 7
acucggaaccgagaaugu

SEQ ID NO: 2145932 - RNA, 17 nt, Human herpesvirus 7
aacggaauaaacaaugu

SEQ ID NO: 2145933 - RNA, 17 nt, Human herpesvirus 7
aaaauaacuuuaaauua

SEQ ID NO: 2145934 - RNA, 15 nt, Human herpesvirus 7
uaaaaaaaaaaccac

SEQ ID NO: 2145935 - RNA, 16 nt, Human herpesvirus 7
aaacacuugcuagcug

SEQ ID NO: 2145936 - RNA, 18 nt, Human herpesvirus 7
cauuuaaaugugucuucc

SEQ ID NO: 2145937 - RNA, 17 nt, Human herpesvirus 7
cuguaucuccaaaguuu

SEQ ID NO: 2145938 - RNA, 19 nt, Human herpesvirus 7
caugaauuaauaaaacaaa

SEQ ID NO: 2145939 - RNA, 22 nt, Human herpesvirus 7
gaacuuuuaaaaaagaacuuac

SEQ ID NO: 2145940 - RNA, 22 nt, Human herpesvirus 7
cacaacauccagagucucuaaa

SEQ ID NO: 2145941 - RNA, 15 nt, Human herpesvirus 7
cgugaacaaauacug

SEQ ID NO: 2145942 - RNA, 19 nt, Human herpesvirus 7
cuacauauggacaaauuug

SEQ ID NO: 2145943 - RNA, 21 nt, Human herpesvirus 7
agcuggaauuguaauugaaag

SEQ ID NO: 2145944 - RNA, 18 nt, Human herpesvirus 7
aagagaaaguaaaagcua

SEQ ID NO: 2145945 - RNA, 22 nt, Human herpesvirus 7
aagucugugacagauuuaagug

SEQ ID NO: 2145946 - RNA, 12 nt, Human herpesvirus 7
cuaaaaaaauuc

SEQ ID NO: 2145947 - RNA, 17 nt, Human herpesvirus 7
acuacuaacauggaaau

SEQ ID NO: 2145948 - RNA, 16 nt, Human herpesvirus 7
cuaggauaccaaacaa

SEQ ID NO: 2145949 - RNA, 17 nt, Human herpesvirus 7
uaaauuaaaaagaaugc

SEQ ID NO: 2145950 - RNA, 17 nt, Human herpesvirus 7
uuuuaaacuugugaaaa

SEQ ID NO: 2145951 - RNA, 18 nt, Human herpesvirus 7
gcaauguauauaagcaga

SEQ ID NO: 2145952 - RNA, 22 nt, Human herpesvirus 7
caaugagacagcaacugugcau

SEQ ID NO: 2145953 - RNA, 18 nt, Human herpesvirus 7
aauuugagcuuugacaaa

SEQ ID NO: 2145954 - RNA, 19 nt, Human herpesvirus 7
acauauuuaauuucucguu

SEQ ID NO: 2145955 - RNA, 12 nt, Human herpesvirus 7
uauacaacuuua

SEQ ID NO: 2145956 - RNA, 17 nt, Human herpesvirus 7
agagaauauguuaucau

SEQ ID NO: 2145957 - RNA, 19 nt, Human herpesvirus 7
guuacccaaaauguaaaau

SEQ ID NO: 2145958 - RNA, 12 nt, Human herpesvirus 7
ugcaugaaaucu

SEQ ID NO: 2145959 - RNA, 19 nt, Human herpesvirus 7
aauagauacguuaguugca

SEQ ID NO: 2145960 - RNA, 22 nt, Human herpesvirus 7
uucgcaaauguacaauuugcau

SEQ ID NO: 2145961 - RNA, 14 nt, Human herpesvirus 7
cuauuacacaggaa

SEQ ID NO: 2145962 - RNA, 20 nt, Human herpesvirus 7
aagaaugaacaccgcaaaca

SEQ ID NO: 2145963 - RNA, 18 nt, Human herpesvirus 7
cuauugaaaauuuauuga

SEQ ID NO: 2145964 - RNA, 15 nt, Human herpesvirus 7
uacgaacgcuuaaua

SEQ ID NO: 2145965 - RNA, 15 nt, Human herpesvirus 7
aaauuauuaauauua

SEQ ID NO: 2145966 - RNA, 14 nt, Human herpesvirus 7
aaagcgagcuuucu

SEQ ID NO: 2145967 - RNA, 19 nt, Human herpesvirus 7
caaacaaugagcaauucau

SEQ ID NO: 2145968 - RNA, 23 nt, Human herpesvirus 7
acuuguuuugacuuauggugugg

SEQ ID NO: 2145969 - RNA, 23 nt, Human herpesvirus 7
uuugacaaucuuggcauugaaau

SEQ ID NO: 2145970 - RNA, 12 nt, Human herpesvirus 7
uacgguuuucag

SEQ ID NO: 2145971 - RNA, 16 nt, Human herpesvirus 7
uugcuguucuugcugg

SEQ ID NO: 2145972 - RNA, 13 nt, Human herpesvirus 7
augaacaaauaau

SEQ ID NO: 2145973 - RNA, 18 nt, Human herpesvirus 7
aacgauccaguacuugca

SEQ ID NO: 2145974 - RNA, 22 nt, Human herpesvirus 7
caucauguuaaaaaaucaacuu

SEQ ID NO: 2145975 - RNA, 21 nt, Human herpesvirus 7
cuaaaguauggaaaaauguua

SEQ ID NO: 2145976 - RNA, 13 nt, Human herpesvirus 7
aacaauguguuaa

SEQ ID NO: 2145977 - RNA, 23 nt, Human herpesvirus 7
gagcauauuccauuaagccagau

SEQ ID NO: 2145978 - RNA, 20 nt, Human herpesvirus 7
cuaagacggaacuucuuucu

SEQ ID NO: 2145979 - RNA, 12 nt, Human herpesvirus 7
ugcgucucuuug

SEQ ID NO: 2145980 - RNA, 14 nt, Human herpesvirus 7
uauuuuacauauua

SEQ ID NO: 2145981 - RNA, 15 nt, Human herpesvirus 7
auuguacauuuuacc

SEQ ID NO: 2145982 - RNA, 23 nt, Human herpesvirus 7
aauagaugucugcauagacagua

SEQ ID NO: 2145983 - RNA, 13 nt, Human herpesvirus 7
agauucuccagaa

SEQ ID NO: 2145984 - RNA, 13 nt, Human herpesvirus 7
ucgcugaugaaaa

SEQ ID NO: 2145985 - RNA, 12 nt, Human herpesvirus 7
gauuucuacaau

SEQ ID NO: 2145986 - RNA, 15 nt, Human herpesvirus 7
uuuaacgauuccaaa

SEQ ID NO: 2145987 - RNA, 18 nt, Human herpesvirus 7
uacauguuuaacaaacaa

SEQ ID NO: 2145988 - RNA, 19 nt, Human herpesvirus 7
gcuuugaucuacauauacu

SEQ ID NO: 2145989 - RNA, 23 nt, Human herpesvirus 7
aaaauaugaguguggugacagaa

SEQ ID NO: 2145990 - RNA, 21 nt, Human herpesvirus 7
auuccugcuugcacaaagauc

SEQ ID NO: 2145991 - RNA, 18 nt, Human herpesvirus 7
cauuuaaaaaaucugaau

SEQ ID NO: 2145992 - RNA, 19 nt, Human herpesvirus 7
aacuguacccaaaaauaag

SEQ ID NO: 2145993 - RNA, 15 nt, Human herpesvirus 7
auucucgcuucaaag

SEQ ID NO: 2145994 - RNA, 16 nt, Human herpesvirus 7
uggaaaugagauuucu

SEQ ID NO: 2145995 - RNA, 22 nt, Human herpesvirus 7
cacgugccgcguuuuaaaauug

SEQ ID NO: 2145996 - RNA, 21 nt, Human herpesvirus 7
uuuauccaucaaaagucuugu

SEQ ID NO: 2145997 - RNA, 19 nt, Human herpesvirus 7
uaauaaaaguaucauuaaa

SEQ ID NO: 2145998 - RNA, 16 nt, Human herpesvirus 7
aauguucgcaaaugua

SEQ ID NO: 2145999 - RNA, 17 nt, Human herpesvirus 7
caucccugcugauacaa

SEQ ID NO: 2146000 - RNA, 19 nt, Human herpesvirus 7
ugaacaccgcaaacauuuu

SEQ ID NO: 2146001 - RNA, 19 nt, Human herpesvirus 7
aucucagaaguuucaauug

SEQ ID NO: 2146002 - RNA, 16 nt, Human herpesvirus 7
aauggauuuaaucgau

SEQ ID NO: 2146003 - RNA, 17 nt, Human herpesvirus 7
aauguuuaaauuacagu

SEQ ID NO: 2146004 - RNA, 23 nt, Human herpesvirus 7
gaucguguguuacuauuugacug

SEQ ID NO: 2146005 - RNA, 18 nt, Human herpesvirus 7
aagcccaaacuguuuuua

SEQ ID NO: 2146006 - RNA, 15 nt, Human herpesvirus 7
uauaugaaauuucaa

SEQ ID NO: 2146007 - RNA, 21 nt, Human herpesvirus 7
gaauauggaacguuugaaucu

SEQ ID NO: 2146008 - RNA, 21 nt, Human herpesvirus 7
ucgaacccuggagagacauag

SEQ ID NO: 2146009 - RNA, 15 nt, Human herpesvirus 7
gagauuccaaagagc

SEQ ID NO: 2146010 - RNA, 16 nt, Human herpesvirus 7
gaaagggauuuauuau

SEQ ID NO: 2146011 - RNA, 19 nt, Human herpesvirus 7
agaacauuuauuuucuuaa

SEQ ID NO: 2146012 - RNA, 15 nt, Human herpesvirus 7
aagccauaaaaugua

SEQ ID NO: 2146013 - RNA, 12 nt, Human herpesvirus 7
caaagcaagcau

SEQ ID NO: 2146014 - RNA, 21 nt, Human herpesvirus 7
cagggaagaaacagcugaaaa

SEQ ID NO: 2146015 - RNA, 15 nt, Human herpesvirus 7
ucucaaaacaaacuc

SEQ ID NO: 2146016 - RNA, 20 nt, Human herpesvirus 7
uucuggaucugccucugccu

SEQ ID NO: 2146017 - RNA, 14 nt, Human herpesvirus 7
acgaugauauuguc

SEQ ID NO: 2146018 - RNA, 16 nt, Human herpesvirus 7
uuucauagcacucaua

SEQ ID NO: 2146019 - RNA, 16 nt, Human herpesvirus 7
auuaauauauuuuccu

SEQ ID NO: 2146020 - RNA, 17 nt, Human herpesvirus 7
ucuuacggcucuaacau

SEQ ID NO: 2146021 - RNA, 17 nt, Human herpesvirus 7
acaugggauuucuguaa

SEQ ID NO: 2146022 - RNA, 16 nt, Human herpesvirus 7
gaaaacgcgauaaugu

SEQ ID NO: 2146023 - RNA, 13 nt, Human herpesvirus 7
auuaugauguuuc

SEQ ID NO: 2146024 - RNA, 14 nt, Human herpesvirus 7
auuauuuuuaaaaa

SEQ ID NO: 2146025 - RNA, 23 nt, Human herpesvirus 7
auuccaaaaucaaguguuucuuu

SEQ ID NO: 2146026 - RNA, 19 nt, Human herpesvirus 7
uacucuucucgaagaauuc

SEQ ID NO: 2146027 - RNA, 20 nt, Human herpesvirus 7
uauaaaacgugugaaaacaa

SEQ ID NO: 2146028 - RNA, 22 nt, Human herpesvirus 7
gaaaaugaugguugcaauacaa

SEQ ID NO: 2146029 - RNA, 16 nt, Human herpesvirus 7
cauauuaacaagcaca

SEQ ID NO: 2146030 - RNA, 15 nt, Human herpesvirus 7
agacaaaaccaaacu

SEQ ID NO: 2146031 - RNA, 21 nt, Human herpesvirus 7
guugcuucuucgagucaguua

SEQ ID NO: 2146032 - RNA, 19 nt, Human herpesvirus 7
auuugguguacuacauauu

SEQ ID NO: 2146033 - RNA, 18 nt, Human herpesvirus 7
agaaauuaugaaaagcuu

SEQ ID NO: 2146034 - RNA, 20 nt, Human herpesvirus 7
cuucuuugugagaaauggaa

SEQ ID NO: 2146035 - RNA, 23 nt, Human herpesvirus 7
ggaaacuauucgaaaauaucuuc

SEQ ID NO: 2146036 - RNA, 22 nt, Human herpesvirus 7
auaaagagucuauugacauaau

SEQ ID NO: 2146037 - RNA, 23 nt, Human herpesvirus 7
caguuuguuguaugugaaaagaa

SEQ ID NO: 2146038 - RNA, 17 nt, Human herpesvirus 7
ucuucugaaucugcaaa

SEQ ID NO: 2146039 - RNA, 19 nt, Human herpesvirus 7
gcauuccuuggaaaaauga

SEQ ID NO: 2146040 - RNA, 17 nt, Human herpesvirus 7
uuacaugaucuuguaau

SEQ ID NO: 2146041 - RNA, 19 nt, Human herpesvirus 7
aauaccaugaaaaauauga

SEQ ID NO: 2146042 - RNA, 18 nt, Human herpesvirus 7
gaaacgucccugugacag

SEQ ID NO: 2146043 - RNA, 14 nt, Human herpesvirus 7
ggaaugcaucugaa

SEQ ID NO: 2146044 - RNA, 17 nt, Human herpesvirus 7
caugaguacuguuucua

SEQ ID NO: 2146045 - RNA, 18 nt, Human herpesvirus 7
ccauuccguuuuaaauag

SEQ ID NO: 2146046 - RNA, 23 nt, Human herpesvirus 7
uuaacacguagaaaaaaacaaug

SEQ ID NO: 2146047 - RNA, 19 nt, Human herpesvirus 7
acgcuuaauagaaauuauu

SEQ ID NO: 2146048 - RNA, 17 nt, Human herpesvirus 7
uguccagccaaaaucua

SEQ ID NO: 2146049 - RNA, 14 nt, Human herpesvirus 7
cucucuuucuggag

SEQ ID NO: 2146050 - RNA, 20 nt, Human herpesvirus 7
acaugucuuuuaguuuucau

SEQ ID NO: 2146051 - RNA, 20 nt, Human herpesvirus 7
acgugagggggacaauuauu

SEQ ID NO: 2146052 - RNA, 14 nt, Human herpesvirus 7
uagucugcguuacu

SEQ ID NO: 2146053 - RNA, 14 nt, Human herpesvirus 7
auuuuaacacuguu

SEQ ID NO: 2146054 - RNA, 22 nt, Human herpesvirus 7
agcauauaucuuugauuacucg

SEQ ID NO: 2146055 - RNA, 13 nt, Human herpesvirus 7
guuacauuauuau

SEQ ID NO: 2146056 - RNA, 16 nt, Human herpesvirus 7
aagauuuaacaugugu

SEQ ID NO: 2146057 - RNA, 19 nt, Human herpesvirus 7
cuguugauaaauuuaaaga

SEQ ID NO: 2146058 - RNA, 22 nt, Human herpesvirus 7
gcuaacgauccaguacuugcau

SEQ ID NO: 2146059 - RNA, 18 nt, Human herpesvirus 7
augugugugguaaggcag

SEQ ID NO: 2146060 - RNA, 15 nt, Human herpesvirus 7
aucaaggucuuucau

SEQ ID NO: 2146061 - RNA, 16 nt, Human herpesvirus 7
agcuucaaaaauguuu

SEQ ID NO: 2146062 - RNA, 12 nt, Human herpesvirus 7
uucaaguuucuu

SEQ ID NO: 2146063 - RNA, 16 nt, Human herpesvirus 7
cucuagaacaaacugu

SEQ ID NO: 2146064 - RNA, 13 nt, Human herpesvirus 7
augguuugaaaac

SEQ ID NO: 2146065 - RNA, 17 nt, Human herpesvirus 7
ugggcguaacugugacg

SEQ ID NO: 2146066 - RNA, 16 nt, Human herpesvirus 7
ucuaaauaugaugaaa

SEQ ID NO: 2146067 - RNA, 21 nt, Human herpesvirus 7
acuacauuuaaaaaaucugaa

SEQ ID NO: 2146068 - RNA, 15 nt, Human herpesvirus 7
uaauuacuucuuuga

SEQ ID NO: 2146069 - RNA, 19 nt, Human herpesvirus 7
ugaauuaagguggaaaucu

SEQ ID NO: 2146070 - RNA, 19 nt, Human herpesvirus 7
acacaagguacauuuugca

SEQ ID NO: 2146071 - RNA, 22 nt, Human herpesvirus 7
auuuaggacuuuacacggucuu

SEQ ID NO: 2146072 - RNA, 14 nt, Human herpesvirus 7
aaggaagacacgga

SEQ ID NO: 2146073 - RNA, 21 nt, Human herpesvirus 7
cugagacggacuuauguccag

SEQ ID NO: 2146074 - RNA, 19 nt, Human herpesvirus 7
uuuacaaacauguuccauu

SEQ ID NO: 2146075 - RNA, 21 nt, Human herpesvirus 7
gaaugccaucuauaaacauuc

SEQ ID NO: 2146076 - RNA, 17 nt, Human herpesvirus 7
uugacaaugucaauaau

SEQ ID NO: 2146077 - RNA, 21 nt, Human herpesvirus 7
cuuuaacuggaauuauacacu

SEQ ID NO: 2146078 - RNA, 20 nt, Human herpesvirus 7
gaagagcuuuuuaaguaaau

SEQ ID NO: 2146079 - RNA, 20 nt, Human herpesvirus 7
aguuuuggguuuaugaugca

SEQ ID NO: 2146080 - RNA, 20 nt, Human herpesvirus 7
uaauuuggaaauuguuugau

SEQ ID NO: 2146081 - RNA, 13 nt, Human herpesvirus 7
auuuuauuuuccc

SEQ ID NO: 2146082 - RNA, 16 nt, Human herpesvirus 7
auggacggcauuuaac

SEQ ID NO: 2146083 - RNA, 16 nt, Human herpesvirus 7
cucaauuaaaacaucu

SEQ ID NO: 2146084 - RNA, 13 nt, Human herpesvirus 7
guuuaugaacaag

SEQ ID NO: 2146085 - RNA, 12 nt, Human herpesvirus 7
aaugaugaugua

SEQ ID NO: 2146086 - RNA, 21 nt, Human herpesvirus 7
uuuucaugguauuuguuagaa

SEQ ID NO: 2146087 - RNA, 21 nt, Human herpesvirus 7
aaugaauucuuugcaaucauu

SEQ ID NO: 2146088 - RNA, 19 nt, Human herpesvirus 7
uggaguuagcgaggcauuu

SEQ ID NO: 2146089 - RNA, 20 nt, Human herpesvirus 7
aaaaaucaguguaacucugc

SEQ ID NO: 2146090 - RNA, 16 nt, Human herpesvirus 7
uggaaaaacagaaugu

SEQ ID NO: 2146091 - RNA, 22 nt, Human herpesvirus 7
cucaauaguuuuacaaagaaca

SEQ ID NO: 2146092 - RNA, 14 nt, Human herpesvirus 7
gaaucuauuaaaga

SEQ ID NO: 2146093 - RNA, 14 nt, Human herpesvirus 7
gcuugaugaaucaa

SEQ ID NO: 2146094 - RNA, 20 nt, Human herpesvirus 7
aaagauuuaaaguaagaaug

SEQ ID NO: 2146095 - RNA, 14 nt, Human herpesvirus 7
cugucuauuucaau

SEQ ID NO: 2146096 - RNA, 17 nt, Human herpesvirus 7
uagaaacgucccuguga

SEQ ID NO: 2146097 - RNA, 16 nt, Human herpesvirus 7
uuuuuaaaaaugauuu

SEQ ID NO: 2146098 - RNA, 13 nt, Human herpesvirus 7
aaauaaacaauau

SEQ ID NO: 2146099 - RNA, 20 nt, Human herpesvirus 7
auaucuguuuuuuuucucgu

SEQ ID NO: 2146100 - RNA, 22 nt, Human herpesvirus 7
uagauuuggaugacauuuugga

SEQ ID NO: 2146101 - RNA, 22 nt, Human herpesvirus 7
aaguucuccuuguuguguuuua

SEQ ID NO: 2146102 - RNA, 16 nt, Human herpesvirus 7
gucuaagucaauuaaa

SEQ ID NO: 2146103 - RNA, 23 nt, Human herpesvirus 7
gaaaauggagcauuauuggauaa

SEQ ID NO: 2146104 - RNA, 18 nt, Human herpesvirus 7
ugaauuauguauaucuuu

SEQ ID NO: 2146105 - RNA, 16 nt, Human herpesvirus 7
acuaagcauauugaag

SEQ ID NO: 2146106 - RNA, 17 nt, Human herpesvirus 7
acugagacgagcaucua

SEQ ID NO: 2146107 - RNA, 16 nt, Human herpesvirus 7
cuugauuuucuuacac

SEQ ID NO: 2146108 - RNA, 23 nt, Human herpesvirus 7
uccuuugauagggauucuuugaa

SEQ ID NO: 2146109 - RNA, 18 nt, Human herpesvirus 7
caauagcauaugcuggau

SEQ ID NO: 2146110 - RNA, 17 nt, Human herpesvirus 7
uagaagaaugcaagccu

SEQ ID NO: 2146111 - RNA, 15 nt, Human herpesvirus 7
cuacaaaaguucugu

SEQ ID NO: 2146112 - RNA, 23 nt, Human herpesvirus 7
uaauuucucaaaucuuuaagaau

SEQ ID NO: 2146113 - RNA, 15 nt, Human herpesvirus 7
auaaucaucuuucuu

SEQ ID NO: 2146114 - RNA, 17 nt, Human herpesvirus 7
aacaaaaugacaaaaag

SEQ ID NO: 2146115 - RNA, 13 nt, Human herpesvirus 7
uucuccaugcaua

SEQ ID NO: 2146116 - RNA, 20 nt, Human herpesvirus 7
aucuuuacuuucauagcuua

SEQ ID NO: 2146117 - RNA, 9 nt, Human herpesvirus 7
augaagaua

SEQ ID NO: 2146118 - RNA, 21 nt, Human herpesvirus 7
auuguaugggaaaaauaagaa

SEQ ID NO: 2146119 - RNA, 15 nt, Human herpesvirus 7
agugucugcccuuuu

SEQ ID NO: 2146120 - RNA, 13 nt, Human herpesvirus 7
auaucuaugaugc

SEQ ID NO: 2146121 - RNA, 17 nt, Human herpesvirus 7
ccaaaaucuauauuuga

SEQ ID NO: 2146122 - RNA, 17 nt, Human herpesvirus 7
uguguacuaaagccaau

SEQ ID NO: 2146123 - RNA, 15 nt, Human herpesvirus 7
uuugcuucuucuaau

SEQ ID NO: 2146124 - RNA, 20 nt, Human herpesvirus 7
aaaaugauaugacauggcca

SEQ ID NO: 2146125 - RNA, 16 nt, Human herpesvirus 7
aacugugcaugaaauc

SEQ ID NO: 2146126 - RNA, 13 nt, Human herpesvirus 7
uaauuaaaguugc

SEQ ID NO: 2146127 - RNA, 16 nt, Human herpesvirus 7
cagaccuaacaaaaaa

SEQ ID NO: 2146128 - RNA, 12 nt, Human herpesvirus 7
cugguauguuuu

SEQ ID NO: 2146129 - RNA, 18 nt, Human herpesvirus 7
uucugcuaauucuggaaa

SEQ ID NO: 2146130 - RNA, 11 nt, Human herpesvirus 7
auauuaaauga

SEQ ID NO: 2146131 - RNA, 14 nt, Human herpesvirus 7
gcauuccuuggaaa

SEQ ID NO: 2146132 - RNA, 18 nt, Human herpesvirus 7
agaauacuacucagaaga

SEQ ID NO: 2146133 - RNA, 17 nt, Human herpesvirus 7
gauuguuuaauuaacca

SEQ ID NO: 2146134 - RNA, 18 nt, Human herpesvirus 7
cuagcucaguccauuagu

SEQ ID NO: 2146135 - RNA, 23 nt, Human herpesvirus 7
cgagaauaaaucaaccaacauuc

SEQ ID NO: 2146136 - RNA, 17 nt, Human herpesvirus 7
cuuugacaaaaauguua

SEQ ID NO: 2146137 - RNA, 23 nt, Human herpesvirus 7
caagucugaaggcugcuuuuuca

SEQ ID NO: 2146138 - RNA, 17 nt, Human herpesvirus 7
ucaaaacagaacuuuug

SEQ ID NO: 2146139 - RNA, 18 nt, Human herpesvirus 7
aaaaaugaggauaauaaa

SEQ ID NO: 2146140 - RNA, 19 nt, Human herpesvirus 7
acagaaauugaugaagaca

SEQ ID NO: 2146141 - RNA, 18 nt, Human herpesvirus 7
auuucaauaaucaaugca

SEQ ID NO: 2146142 - RNA, 15 nt, Human herpesvirus 7
cuaaugguuggauuu

SEQ ID NO: 2146143 - RNA, 16 nt, Human herpesvirus 7
acugcaaauuguaaau

SEQ ID NO: 2146144 - RNA, 12 nt, Human herpesvirus 7
guuugaauaucu

SEQ ID NO: 2146145 - RNA, 16 nt, Human herpesvirus 7
uuccaucacaaaacuc

SEQ ID NO: 2146146 - RNA, 17 nt, Human herpesvirus 7
agucaacacauaucuag

SEQ ID NO: 2146147 - RNA, 13 nt, Human herpesvirus 7
gaaaaauuuguua

SEQ ID NO: 2146148 - RNA, 19 nt, Human herpesvirus 7
aaaaguucuuugaaauagu

SEQ ID NO: 2146149 - RNA, 20 nt, Human herpesvirus 7
acaauggugugucugugguu

SEQ ID NO: 2146150 - RNA, 14 nt, Human herpesvirus 7
cuauuguucuuuca

SEQ ID NO: 2146151 - RNA, 18 nt, Human herpesvirus 7
acccuggagagacauaga

SEQ ID NO: 2146152 - RNA, 12 nt, Human herpesvirus 7
auaucuaugaug

SEQ ID NO: 2146153 - RNA, 16 nt, Human herpesvirus 7
auuccgauuuaaguga

SEQ ID NO: 2146154 - RNA, 12 nt, Human herpesvirus 7
uuuaaaaguuug

SEQ ID NO: 2146155 - RNA, 19 nt, Human herpesvirus 7
uguaucaauauucgaauuu

SEQ ID NO: 2146156 - RNA, 14 nt, Human herpesvirus 7
ucuggaucugccuc

SEQ ID NO: 2146157 - RNA, 14 nt, Human herpesvirus 7
uccuucuaccucuu

SEQ ID NO: 2146158 - RNA, 22 nt, Human herpesvirus 7
cagcuagauugacuaugaauuu

SEQ ID NO: 2146159 - RNA, 15 nt, Human herpesvirus 7
acuguauaaucuuaa

SEQ ID NO: 2146160 - RNA, 13 nt, Human herpesvirus 7
aauauuuaugccu

SEQ ID NO: 2146161 - RNA, 22 nt, Human herpesvirus 7
cuaucacaaccuggauguaaug

SEQ ID NO: 2146162 - RNA, 16 nt, Human herpesvirus 7
aaaucuuuauugguaa

SEQ ID NO: 2146163 - RNA, 19 nt, Human herpesvirus 7
ggcuuaagcagcagacaag

SEQ ID NO: 2146164 - RNA, 20 nt, Human herpesvirus 7
auagugaaucauauuuuagu

SEQ ID NO: 2146165 - RNA, 19 nt, Human herpesvirus 7
ugcuuuuagaaaaucaaaa

SEQ ID NO: 2146166 - RNA, 17 nt, Human herpesvirus 7
ucagaaauguuacuuaa

SEQ ID NO: 2146167 - RNA, 14 nt, Human herpesvirus 7
aucaaaaaauaauu

SEQ ID NO: 2146168 - RNA, 18 nt, Human herpesvirus 7
ggaaaugagauuucugaa

SEQ ID NO: 2146169 - RNA, 18 nt, Human herpesvirus 7
ucuggaaucgaauacagu

SEQ ID NO: 2146170 - RNA, 23 nt, Human herpesvirus 7
auaaugucauucguguuaguaga

SEQ ID NO: 2146171 - RNA, 22 nt, Human herpesvirus 7
aaguaaaagagaaaaaauagug

SEQ ID NO: 2146172 - RNA, 15 nt, Human herpesvirus 7
cuguagauauuuuga

SEQ ID NO: 2146173 - RNA, 18 nt, Human herpesvirus 7
cagcuaucucuacaaaca

SEQ ID NO: 2146174 - RNA, 20 nt, Human herpesvirus 7
uucacaucuagaguaucuuu

SEQ ID NO: 2146175 - RNA, 19 nt, Human herpesvirus 7
gacaaggaaccguuugcag

SEQ ID NO: 2146176 - RNA, 14 nt, Human herpesvirus 7
ugauuuucuuacac

SEQ ID NO: 2146177 - RNA, 22 nt, Human herpesvirus 7
gccagaucguucauugauuaua

SEQ ID NO: 2146178 - RNA, 16 nt, Human herpesvirus 7
caucguaaaaaaugua

SEQ ID NO: 2146179 - RNA, 18 nt, Human herpesvirus 7
uuaucauuucaaauguag

SEQ ID NO: 2146180 - RNA, 14 nt, Human herpesvirus 7
agcacuacuagaaa

SEQ ID NO: 2146181 - RNA, 17 nt, Human herpesvirus 7
auaugcaaaacaaaaua

SEQ ID NO: 2146182 - RNA, 19 nt, Human herpesvirus 7
uugguuuuacaaauuaaag

SEQ ID NO: 2146183 - RNA, 21 nt, Human herpesvirus 7
cuuucuguuuaaguauguuua

SEQ ID NO: 2146184 - RNA, 18 nt, Human herpesvirus 7
acaccccaugcaagaaaa

SEQ ID NO: 2146185 - RNA, 18 nt, Human herpesvirus 7
auaaaaccauuuauugau

SEQ ID NO: 2146186 - RNA, 19 nt, Human herpesvirus 7
caugacuucagaaaaacca

SEQ ID NO: 2146187 - RNA, 14 nt, Human herpesvirus 7
cuucgcugcuguga

SEQ ID NO: 2146188 - RNA, 22 nt, Human herpesvirus 7
aaacauuucaaaaucagaaaug

SEQ ID NO: 2146189 - RNA, 18 nt, Human herpesvirus 7
caauagguuccacacagg

SEQ ID NO: 2146190 - RNA, 19 nt, Human herpesvirus 7
acuucuuugacaaaaaugu

SEQ ID NO: 2146191 - RNA, 20 nt, Human herpesvirus 7
uucggcugaguaaaacucaa

SEQ ID NO: 2146192 - RNA, 23 nt, Human herpesvirus 7
uuauguccgcuuacaagaugcga

SEQ ID NO: 2146193 - RNA, 22 nt, Human herpesvirus 7
agaauuuggauagauacauuau

SEQ ID NO: 2146194 - RNA, 18 nt, Human herpesvirus 7
ugucuucggccuugcuga

SEQ ID NO: 2146195 - RNA, 15 nt, Human herpesvirus 7
aaaacaucagaccua

SEQ ID NO: 2146196 - RNA, 15 nt, Human herpesvirus 7
gcaugcuugcuuugc

SEQ ID NO: 2146197 - RNA, 18 nt, Human herpesvirus 7
cauaugcuggaucuucug

SEQ ID NO: 2146198 - RNA, 22 nt, Human herpesvirus 7
ucaauaguuuuacaaagaacau

SEQ ID NO: 2146199 - RNA, 23 nt, Human herpesvirus 7
cgcagucuaaaaguaaagggaaa

SEQ ID NO: 2146200 - RNA, 23 nt, Human herpesvirus 7
uacuggaccacguuuuugcagag

SEQ ID NO: 2146201 - RNA, 20 nt, Human herpesvirus 7
guagaauguguuucagcuuu

SEQ ID NO: 2146202 - RNA, 17 nt, Human herpesvirus 7
gaugcauccaaagaaaa

SEQ ID NO: 2146203 - RNA, 19 nt, Human herpesvirus 7
gcaacaaacaaauaauuca

SEQ ID NO: 2146204 - RNA, 23 nt, Human herpesvirus 7
acauuuauuauuuuuaaaaauga

SEQ ID NO: 2146205 - RNA, 17 nt, Human herpesvirus 7
gcaauuuucauaaagau

SEQ ID NO: 2146206 - RNA, 15 nt, Human herpesvirus 7
guuugcucugaaaaa

SEQ ID NO: 2146207 - RNA, 19 nt, Human herpesvirus 7
cuuagaucgaacuguuaca

SEQ ID NO: 2146208 - RNA, 22 nt, Human herpesvirus 7
cucaauuuuucgcugaagaaca

SEQ ID NO: 2146209 - RNA, 14 nt, Human herpesvirus 7
caauuauagaaaca

SEQ ID NO: 2146210 - RNA, 21 nt, Human herpesvirus 7
augaacaaguuucaaaaagug

SEQ ID NO: 2146211 - RNA, 15 nt, Human herpesvirus 7
acagcaacugugcau

SEQ ID NO: 2146212 - RNA, 13 nt, Human herpesvirus 7
uaaagcuuucaau

SEQ ID NO: 2146213 - RNA, 14 nt, Human herpesvirus 7
cacuaaaagagaac

SEQ ID NO: 2146214 - RNA, 14 nt, Human herpesvirus 7
agauauuuugacaa

SEQ ID NO: 2146215 - RNA, 20 nt, Human herpesvirus 7
caaauguuuuaauuuggaaa

SEQ ID NO: 2146216 - RNA, 13 nt, Human herpesvirus 7
uguucuguuuauu

SEQ ID NO: 2146217 - RNA, 19 nt, Human herpesvirus 7
augccaucuauaaacauuc

SEQ ID NO: 2146218 - RNA, 20 nt, Human herpesvirus 7
cuuuucuuaaacaugauuua

SEQ ID NO: 2146219 - RNA, 18 nt, Human herpesvirus 7
guugggaugacaacggua

SEQ ID NO: 2146220 - RNA, 16 nt, Human herpesvirus 7
aauuuacccugaaaag

SEQ ID NO: 2146221 - RNA, 18 nt, Human herpesvirus 7
aucuggagaacaauuaga

SEQ ID NO: 2146222 - RNA, 20 nt, Human herpesvirus 7
aaucuuugacuguaucucca

SEQ ID NO: 2146223 - RNA, 17 nt, Human herpesvirus 7
caaaaaacguaaaacug

SEQ ID NO: 2146224 - RNA, 13 nt, Human herpesvirus 7
acucauugggagu

SEQ ID NO: 2146225 - RNA, 15 nt, Human herpesvirus 7
aagacauuauuugcu

SEQ ID NO: 2146226 - RNA, 16 nt, Human herpesvirus 7
agucucaauaguuuua

SEQ ID NO: 2146227 - RNA, 18 nt, Human herpesvirus 7
acuguaauauaauuauuu

SEQ ID NO: 2146228 - RNA, 13 nt, Human herpesvirus 7
ccaccguugggaa

SEQ ID NO: 2146229 - RNA, 18 nt, Human herpesvirus 7
cgaacugauauuaaauca

SEQ ID NO: 2146230 - RNA, 20 nt, Human herpesvirus 7
cuugugaaaauaacaggaaa

SEQ ID NO: 2146231 - RNA, 22 nt, Human herpesvirus 7
ccaggaacagauucuccagaaa

SEQ ID NO: 2146232 - RNA, 21 nt, Human herpesvirus 7
uccaaucauaauuuucaugaa

SEQ ID NO: 2146233 - RNA, 20 nt, Human herpesvirus 7
agacuauaaaaagugcucug

SEQ ID NO: 2146234 - RNA, 16 nt, Human herpesvirus 7
uuugaacuuguuuuga

SEQ ID NO: 2146235 - RNA, 22 nt, Human herpesvirus 7
uacgaaugccaucuauaaacau

SEQ ID NO: 2146236 - RNA, 19 nt, Human herpesvirus 7
caccccaaaaucaaaaaac

SEQ ID NO: 2146237 - RNA, 20 nt, Human herpesvirus 7
auguaugaaaaaaacauuau

SEQ ID NO: 2146238 - RNA, 14 nt, Human herpesvirus 7
guagaaaauguuuu

SEQ ID NO: 2146239 - RNA, 17 nt, Human herpesvirus 7
ccauuuccucuggaaaa

SEQ ID NO: 2146240 - RNA, 16 nt, Human herpesvirus 7
uaucgcgaaacagcgu

SEQ ID NO: 2146241 - RNA, 14 nt, Human herpesvirus 7
aaagaccuguacug

SEQ ID NO: 2146242 - RNA, 14 nt, Human herpesvirus 7
uaaaucauguuuaa

SEQ ID NO: 2146243 - RNA, 20 nt, Human herpesvirus 7
uuaacaugaguacuguuucu

SEQ ID NO: 2146244 - RNA, 20 nt, Human herpesvirus 7
cuucuuugacaaaaauguua

SEQ ID NO: 2146245 - RNA, 15 nt, Human herpesvirus 7
gugucucuagaaaau

SEQ ID NO: 2146246 - RNA, 15 nt, Human herpesvirus 7
ugugaaaauaaacag

SEQ ID NO: 2146247 - RNA, 15 nt, Human herpesvirus 7
uggaaaucaaaauuc

SEQ ID NO: 2146248 - RNA, 20 nt, Human herpesvirus 7
augaauugaaauuucuaaau

SEQ ID NO: 2146249 - RNA, 13 nt, Human herpesvirus 7
uaugaaaacagcu

SEQ ID NO: 2146250 - RNA, 13 nt, Human herpesvirus 7
ugcuucggaauuu

SEQ ID NO: 2146251 - RNA, 17 nt, Human herpesvirus 7
guaauauaauuauuuua

SEQ ID NO: 2146252 - RNA, 15 nt, Human herpesvirus 7
auuaguauuguaaua

SEQ ID NO: 2146253 - RNA, 13 nt, Human herpesvirus 7
cuuuguuugagac

SEQ ID NO: 2146254 - RNA, 22 nt, Human herpesvirus 7
agacuacauaaagguaaaaauu

SEQ ID NO: 2146255 - RNA, 16 nt, Human herpesvirus 7
cguugaguugcugcug

SEQ ID NO: 2146256 - RNA, 21 nt, Human herpesvirus 7
uuuucauuuuuuucuuauaaa

SEQ ID NO: 2146257 - RNA, 14 nt, Human herpesvirus 7
uacuuucauagcuu

SEQ ID NO: 2146258 - RNA, 16 nt, Human herpesvirus 7
uauuaauuuggugaag

SEQ ID NO: 2146259 - RNA, 15 nt, Human herpesvirus 7
gaaaaaauaaauucu

SEQ ID NO: 2146260 - RNA, 18 nt, Human herpesvirus 7
uaaucaaggacaugauug

SEQ ID NO: 2146261 - RNA, 15 nt, Human herpesvirus 7
augaaggaugcgugu

SEQ ID NO: 2146262 - RNA, 13 nt, Human herpesvirus 7
augcuuuaacugg

SEQ ID NO: 2146263 - RNA, 16 nt, Human herpesvirus 7
ggaagacaucgaagaa

SEQ ID NO: 2146264 - RNA, 22 nt, Human herpesvirus 7
caugauccugguuaaaaaaaug

SEQ ID NO: 2146265 - RNA, 15 nt, Human herpesvirus 7
aacugagaaaaauga

SEQ ID NO: 2146266 - RNA, 17 nt, Human herpesvirus 7
gcaguacuacuaaucau

SEQ ID NO: 2146267 - RNA, 22 nt, Human herpesvirus 7
uaaguucaucauguuuguugag

SEQ ID NO: 2146268 - RNA, 18 nt, Human herpesvirus 7
auuuaaugguuuuaaaau

SEQ ID NO: 2146269 - RNA, 16 nt, Human herpesvirus 7
aagcugcagcugaaag

SEQ ID NO: 2146270 - RNA, 14 nt, Human herpesvirus 7
uauguguacagauu

SEQ ID NO: 2146271 - RNA, 23 nt, Human herpesvirus 7
auuuuuuucuuauaaauaaaaug

SEQ ID NO: 2146272 - RNA, 18 nt, Human herpesvirus 7
aacaacuagcaaacagug

SEQ ID NO: 2146273 - RNA, 14 nt, Human herpesvirus 7
ucguuuguguagaa

SEQ ID NO: 2146274 - RNA, 20 nt, Human herpesvirus 7
aaggaagcuuuacagcagcc

SEQ ID NO: 2146275 - RNA, 23 nt, Human herpesvirus 7
uaaccaaaaugugggauguaucc

SEQ ID NO: 2146276 - RNA, 15 nt, Human herpesvirus 7
ugaacagaauuuuca

SEQ ID NO: 2146277 - RNA, 16 nt, Human herpesvirus 7
acauugaaaaugcauu

SEQ ID NO: 2146278 - RNA, 14 nt, Human herpesvirus 7
gacggaauuuguau

SEQ ID NO: 2146279 - RNA, 22 nt, Human herpesvirus 7
cucgaauuacguuauauauuua

SEQ ID NO: 2146280 - RNA, 15 nt, Human herpesvirus 7
accacaacugugaca

SEQ ID NO: 2146281 - RNA, 17 nt, Human herpesvirus 7
acaagacagaaaugaau

SEQ ID NO: 2146282 - RNA, 21 nt, Human herpesvirus 7
cacuaacuacagcuuuuggaa

SEQ ID NO: 2146283 - RNA, 19 nt, Human herpesvirus 7
uuuauguucaaauaugcau

SEQ ID NO: 2146284 - RNA, 13 nt, Human herpesvirus 7
caaucuauuucua

SEQ ID NO: 2146285 - RNA, 23 nt, Human herpesvirus 7
cuagauguuuuugauauuguacu

SEQ ID NO: 2146286 - RNA, 22 nt, Human herpesvirus 7
aauauuuugaaaauauauucca

SEQ ID NO: 2146287 - RNA, 22 nt, Human herpesvirus 7
auuuuggauuguguaauuauug

SEQ ID NO: 2146288 - RNA, 19 nt, Human herpesvirus 7
cuuacagugcucuuugucu

SEQ ID NO: 2146289 - RNA, 13 nt, Human herpesvirus 7
ucaaaaguauaac

SEQ ID NO: 2146290 - RNA, 16 nt, Human herpesvirus 7
aguauuuaagaacaga

SEQ ID NO: 2146291 - RNA, 19 nt, Human herpesvirus 7
uauccacucuccugaaaua

SEQ ID NO: 2146292 - RNA, 22 nt, Human herpesvirus 7
cugcaacuuugugccugaaaua

SEQ ID NO: 2146293 - RNA, 14 nt, Human herpesvirus 7
ugaauaaaaguaaa

SEQ ID NO: 2146294 - RNA, 20 nt, Human herpesvirus 7
uguuacagcuuucauuauuu

SEQ ID NO: 2146295 - RNA, 14 nt, Human herpesvirus 7
aaucaaaaacugaa

SEQ ID NO: 2146296 - RNA, 13 nt, Human herpesvirus 7
augggaauuacag

SEQ ID NO: 2146297 - RNA, 20 nt, Human herpesvirus 7
gaauuaauaaaacaaacuau

SEQ ID NO: 2146298 - RNA, 15 nt, Human herpesvirus 7
acauuaaacagcauu

SEQ ID NO: 2146299 - RNA, 18 nt, Human herpesvirus 7
aacaacagcagcugcuaa

SEQ ID NO: 2146300 - RNA, 16 nt, Human herpesvirus 7
ucugauucuuauucua

SEQ ID NO: 2146301 - RNA, 12 nt, Human herpesvirus 7
auaaaaaaagaa

SEQ ID NO: 2146302 - RNA, 18 nt, Human herpesvirus 7
cuuagcguucgacagcaa

SEQ ID NO: 2146303 - RNA, 23 nt, Human herpesvirus 7
cugagaagugggauuaaaaaucu

SEQ ID NO: 2146304 - RNA, 20 nt, Human herpesvirus 7
aguaaagauuuaacugauaa

SEQ ID NO: 2146305 - RNA, 23 nt, Human herpesvirus 7
auuuccugcaauaauaaacauug

SEQ ID NO: 2146306 - RNA, 19 nt, Human herpesvirus 7
acuaauccaugacagagaa

SEQ ID NO: 2146307 - RNA, 23 nt, Human herpesvirus 7
uugauuuuuaaguuguucucaau

SEQ ID NO: 2146308 - RNA, 15 nt, Human herpesvirus 7
ucuaccaauaaaagg

SEQ ID NO: 2146309 - RNA, 16 nt, Human herpesvirus 7
gaaaagaaaaagcaac

SEQ ID NO: 2146310 - RNA, 21 nt, Human herpesvirus 7
uuugaaauaaaggaucucucu

SEQ ID NO: 2146311 - RNA, 22 nt, Human herpesvirus 7
gcuaaaauuuugaaauaaagga

SEQ ID NO: 2146312 - RNA, 13 nt, Human herpesvirus 7
acuugaaaaauuu

SEQ ID NO: 2146313 - RNA, 12 nt, Human herpesvirus 7
uuguuuaagaca

SEQ ID NO: 2146314 - RNA, 12 nt, Human herpesvirus 7
acacuuauucca

SEQ ID NO: 2146315 - RNA, 19 nt, Human herpesvirus 7
auaaauguaacuuucaucu

SEQ ID NO: 2146316 - RNA, 21 nt, Human herpesvirus 7
acaaccauuuuuucccagaga

SEQ ID NO: 2146317 - RNA, 21 nt, Human herpesvirus 7
acguccauuuccucaauuuuu

SEQ ID NO: 2146318 - RNA, 13 nt, Human herpesvirus 7
aucuaugaaauaa

SEQ ID NO: 2146319 - RNA, 20 nt, Human herpesvirus 7
aaaacguggaaauuaaucaa

SEQ ID NO: 2146320 - RNA, 20 nt, Human herpesvirus 7
auuggauaauaucaguacaa

SEQ ID NO: 2146321 - RNA, 17 nt, Human herpesvirus 7
cugccucugccucuugg

SEQ ID NO: 2146322 - RNA, 13 nt, Human herpesvirus 7
auuuguguaaaua

SEQ ID NO: 2146323 - RNA, 19 nt, Human herpesvirus 7
caaauuguaaauucuccaa

SEQ ID NO: 2146324 - RNA, 17 nt, Human herpesvirus 7
caaugauuuuucugcuu

SEQ ID NO: 2146325 - RNA, 19 nt, Human herpesvirus 7
aaaauuuccuacaaaaguu

SEQ ID NO: 2146326 - RNA, 15 nt, Human herpesvirus 7
cuguagaaaauguuu

SEQ ID NO: 2146327 - RNA, 18 nt, Human herpesvirus 7
ugaaaaauaaauacuauu

SEQ ID NO: 2146328 - RNA, 18 nt, Human herpesvirus 7
uauuucagcuccaugucu

SEQ ID NO: 2146329 - RNA, 16 nt, Human herpesvirus 7
agaacagaaugauaau

SEQ ID NO: 2146330 - RNA, 17 nt, Human herpesvirus 7
auuauguccauaaaaca

SEQ ID NO: 2146331 - RNA, 20 nt, Human herpesvirus 7
uaauaaaaauuacucaugaa

SEQ ID NO: 2146332 - RNA, 13 nt, Human herpesvirus 7
ccacauuuaaaaa

SEQ ID NO: 2146333 - RNA, 14 nt, Human herpesvirus 7
acguuucaaaucaa

SEQ ID NO: 2146334 - RNA, 16 nt, Human herpesvirus 7
uauauaaguccuucaa

SEQ ID NO: 2146335 - RNA, 17 nt, Human herpesvirus 7
aagaauuuucugcuuua

SEQ ID NO: 2146336 - RNA, 15 nt, Human herpesvirus 7
aaguaaacaaaacag

SEQ ID NO: 2146337 - RNA, 16 nt, Human herpesvirus 7
aguucccauuuucaga

SEQ ID NO: 2146338 - RNA, 21 nt, Human herpesvirus 7
acuuaguucgaaugaauuuug

SEQ ID NO: 2146339 - RNA, 19 nt, Human herpesvirus 7
ucaauuuauccuaagcuuu

SEQ ID NO: 2146340 - RNA, 17 nt, Human herpesvirus 7
gugauguacugcucauc

SEQ ID NO: 2146341 - RNA, 17 nt, Human herpesvirus 7
auguaauguugcaaaug

SEQ ID NO: 2146342 - RNA, 13 nt, Human herpesvirus 7
ccuuguuugcugg

SEQ ID NO: 2146343 - RNA, 23 nt, Human herpesvirus 7
uucuggaucugccucugccucuu

SEQ ID NO: 2146344 - RNA, 15 nt, Human herpesvirus 7
cuuaacaauuauuuu

SEQ ID NO: 2146345 - RNA, 18 nt, Human herpesvirus 7
aucauagagaaaacauug

SEQ ID NO: 2146346 - RNA, 13 nt, Human herpesvirus 7
ucaguuaucaagu

SEQ ID NO: 2146347 - RNA, 19 nt, Human herpesvirus 7
cugaauugguaauguuacu

SEQ ID NO: 2146348 - RNA, 12 nt, Human herpesvirus 7
uauauuaaucuu

SEQ ID NO: 2146349 - RNA, 14 nt, Human herpesvirus 7
uccgaaaagacaac

SEQ ID NO: 2146350 - RNA, 19 nt, Human herpesvirus 7
gguaucacuuccuguccaa

SEQ ID NO: 2146351 - RNA, 15 nt, Human herpesvirus 7
aaaauacaacuucua

SEQ ID NO: 2146352 - RNA, 13 nt, Human herpesvirus 7
ucuaaauaaacaa

SEQ ID NO: 2146353 - RNA, 20 nt, Human herpesvirus 7
ucaccgcagauccaucuuug

SEQ ID NO: 2146354 - RNA, 17 nt, Human herpesvirus 7
ugaagcuaaaauuuuga

SEQ ID NO: 2146355 - RNA, 16 nt, Human herpesvirus 7
ucaacgacaaacuuug

SEQ ID NO: 2146356 - RNA, 13 nt, Human herpesvirus 7
cgucucuuugccu

SEQ ID NO: 2146357 - RNA, 17 nt, Human herpesvirus 7
ucucuuauuuugucugg

SEQ ID NO: 2146358 - RNA, 20 nt, Human herpesvirus 7
cugaguaaaacucaauguaa

SEQ ID NO: 2146359 - RNA, 19 nt, Human herpesvirus 7
uguuguagguaauuucuua

SEQ ID NO: 2146360 - RNA, 18 nt, Human herpesvirus 7
aaguauggaaaaauguua

SEQ ID NO: 2146361 - RNA, 23 nt, Human herpesvirus 7
auaaaaauuacucaugaagcugu

SEQ ID NO: 2146362 - RNA, 14 nt, Human herpesvirus 7
auaaauucugaaau

SEQ ID NO: 2146363 - RNA, 16 nt, Human herpesvirus 7
cuuugaaaaaaacacu

SEQ ID NO: 2146364 - RNA, 23 nt, Human herpesvirus 7
agaauauuuauguucaaauaugc

SEQ ID NO: 2146365 - RNA, 14 nt, Human herpesvirus 7
uuucuggcaauaaa

SEQ ID NO: 2146366 - RNA, 21 nt, Human herpesvirus 7
uccaucaaaagucuuguuuuu

SEQ ID NO: 2146367 - RNA, 19 nt, Human herpesvirus 7
aaauucgcaaaauuucauu

SEQ ID NO: 2146368 - RNA, 21 nt, Human herpesvirus 7
acaaucgauugcaguugaauu

SEQ ID NO: 2146369 - RNA, 18 nt, Human herpesvirus 7
aaauuacacucuguuacu

SEQ ID NO: 2146370 - RNA, 13 nt, Human herpesvirus 7
ugacccugucaca

SEQ ID NO: 2146371 - RNA, 17 nt, Human herpesvirus 7
uaauacucagaugugga

SEQ ID NO: 2146372 - RNA, 12 nt, Human herpesvirus 7
auuuuucauuua

SEQ ID NO: 2146373 - RNA, 16 nt, Human herpesvirus 7
ccaccauuucugaaac

SEQ ID NO: 2146374 - RNA, 20 nt, Human herpesvirus 7
ucuuagccagaucguucauu

SEQ ID NO: 2146375 - RNA, 15 nt, Human herpesvirus 7
gaagagguugcuucu

SEQ ID NO: 2146376 - RNA, 16 nt, Human herpesvirus 7
gacauuauuagacaga

SEQ ID NO: 2146377 - RNA, 21 nt, Human herpesvirus 7
agagaaaaaauuaugaguaaa

SEQ ID NO: 2146378 - RNA, 22 nt, Human herpesvirus 7
accuguauggaaccuacugaag

SEQ ID NO: 2146379 - RNA, 15 nt, Human herpesvirus 7
agucgagaaaacacg

SEQ ID NO: 2146380 - RNA, 15 nt, Human herpesvirus 7
uugaagaaauuguga

SEQ ID NO: 2146381 - RNA, 16 nt, Human herpesvirus 7
gggcuacgaaugggaa

SEQ ID NO: 2146382 - RNA, 14 nt, Human herpesvirus 7
aaauaucuucugaa

SEQ ID NO: 2146383 - RNA, 16 nt, Human herpesvirus 7
cagaguauuuaagaac

SEQ ID NO: 2146384 - RNA, 14 nt, Human herpesvirus 7
aacuuugcaacaaa

SEQ ID NO: 2146385 - RNA, 19 nt, Human herpesvirus 7
cauuuauuuucuuaacaau

SEQ ID NO: 2146386 - RNA, 23 nt, Human herpesvirus 7
agaauguuuauauauaaccgaua

SEQ ID NO: 2146387 - RNA, 13 nt, Human herpesvirus 7
caauguaaacgaa

SEQ ID NO: 2146388 - RNA, 15 nt, Human herpesvirus 7
gaaaauaacuuuaaa

SEQ ID NO: 2146389 - RNA, 13 nt, Human herpesvirus 7
aagcuugaaaacu

SEQ ID NO: 2146390 - RNA, 15 nt, Human herpesvirus 7
gugaaaauaaacagg

SEQ ID NO: 2146391 - RNA, 19 nt, Human herpesvirus 7
auccacgcgggguuaaaaa

SEQ ID NO: 2146392 - RNA, 23 nt, Human herpesvirus 7
uucaggucucuuucuaaaaagag

SEQ ID NO: 2146393 - RNA, 17 nt, Human herpesvirus 7
aauuucacacaaugccu

SEQ ID NO: 2146394 - RNA, 17 nt, Human herpesvirus 7
uacgguggcaauuaaau

SEQ ID NO: 2146395 - RNA, 23 nt, Human herpesvirus 7
acaaauuaugcguuaaugucucu

SEQ ID NO: 2146396 - RNA, 13 nt, Human herpesvirus 7
uauaauaaaucgu

SEQ ID NO: 2146397 - RNA, 13 nt, Human herpesvirus 7
agucuaaaaaugu

SEQ ID NO: 2146398 - RNA, 20 nt, Human herpesvirus 7
uacagauacgcgcagauuuu

SEQ ID NO: 2146399 - RNA, 15 nt, Human herpesvirus 7
ccuguacaaauuucu

SEQ ID NO: 2146400 - RNA, 22 nt, Human herpesvirus 7
caaggucuuucaugcauugcau

SEQ ID NO: 2146401 - RNA, 20 nt, Human herpesvirus 7
gaauaaucucaauuaaaaca

SEQ ID NO: 2146402 - RNA, 18 nt, Human herpesvirus 7
uguuauuuuucaugccuu

SEQ ID NO: 2146403 - RNA, 21 nt, Human herpesvirus 7
acacagggaagaaacagcuga

SEQ ID NO: 2146404 - RNA, 18 nt, Human herpesvirus 7
gcagcaucccuauugcau

SEQ ID NO: 2146405 - RNA, 14 nt, Human herpesvirus 7
acaaaagucgagaa

SEQ ID NO: 2146406 - RNA, 15 nt, Human herpesvirus 7
uucacacaaugccuu

SEQ ID NO: 2146407 - RNA, 16 nt, Human herpesvirus 7
uuucagaaaauaaaag

SEQ ID NO: 2146408 - RNA, 14 nt, Human herpesvirus 7
caauaaauuuugaa

SEQ ID NO: 2146409 - RNA, 15 nt, Human herpesvirus 7
auaauucacauuuau

SEQ ID NO: 2146410 - RNA, 16 nt, Human herpesvirus 7
aaaacacguccaagaa

SEQ ID NO: 2146411 - RNA, 19 nt, Human herpesvirus 7
aagauucuagcguuucguu

SEQ ID NO: 2146412 - RNA, 22 nt, Human herpesvirus 7
ugucuucggccuugcugaagau

SEQ ID NO: 2146413 - RNA, 16 nt, Human herpesvirus 7
aauccaugacagagaa

SEQ ID NO: 2146414 - RNA, 15 nt, Human herpesvirus 7
guguguuaaaugcga

SEQ ID NO: 2146415 - RNA, 19 nt, Human herpesvirus 7
uuuagagucugugugugca

SEQ ID NO: 2146416 - RNA, 14 nt, Human herpesvirus 7
uaucgcguuuucau

SEQ ID NO: 2146417 - RNA, 17 nt, Human herpesvirus 7
gaaauggguuugggaaa

SEQ ID NO: 2146418 - RNA, 13 nt, Human herpesvirus 7
uucgaucuguaaa

SEQ ID NO: 2146419 - RNA, 14 nt, Human herpesvirus 7
aauaaauguucuuc

SEQ ID NO: 2146420 - RNA, 22 nt, Human herpesvirus 7
auaugcuaagaaagaacauuuu

SEQ ID NO: 2146421 - RNA, 18 nt, Human herpesvirus 7
auguccaaucaaaaacug

SEQ ID NO: 2146422 - RNA, 22 nt, Human herpesvirus 7
uaugugaaaauaaacaggaacu

SEQ ID NO: 2146423 - RNA, 23 nt, Human herpesvirus 7
ucugguaaugucauaaaacuuuu

SEQ ID NO: 2146424 - RNA, 17 nt, Human herpesvirus 7
ucguucuauguaugaaa

SEQ ID NO: 2146425 - RNA, 15 nt, Human herpesvirus 7
ugauccugcuauuca

SEQ ID NO: 2146426 - RNA, 21 nt, Human herpesvirus 7
aacagcucuaucgucaucauc

SEQ ID NO: 2146427 - RNA, 18 nt, Human herpesvirus 7
aucauuagucauacuuua

SEQ ID NO: 2146428 - RNA, 16 nt, Human herpesvirus 7
cacauuaucuugacag

SEQ ID NO: 2146429 - RNA, 13 nt, Human herpesvirus 7
auucuaaaaauua

SEQ ID NO: 2146430 - RNA, 11 nt, Human herpesvirus 7
aguuaaaagau

SEQ ID NO: 2146431 - RNA, 15 nt, Human herpesvirus 7
uuaaaaugggaaugu

SEQ ID NO: 2146432 - RNA, 17 nt, Human herpesvirus 7
gcggaguuugaguuucu

SEQ ID NO: 2146433 - RNA, 14 nt, Human herpesvirus 7
ucaaagugugcccg

SEQ ID NO: 2146434 - RNA, 12 nt, Human herpesvirus 7
uuaaaugucaau

SEQ ID NO: 2146435 - RNA, 14 nt, Human herpesvirus 7
aaucuuuuuugaac

SEQ ID NO: 2146436 - RNA, 14 nt, Human herpesvirus 7
aaacagcauuuucu

SEQ ID NO: 2146437 - RNA, 13 nt, Human herpesvirus 7
aaauccaaaauca

SEQ ID NO: 2146438 - RNA, 22 nt, Human herpesvirus 7
cuucaauagcagagaauauguu

SEQ ID NO: 2146439 - RNA, 16 nt, Human herpesvirus 7
caacauucuugucaac

SEQ ID NO: 2146440 - RNA, 22 nt, Human herpesvirus 7
augucucuugaagaacaacaug

SEQ ID NO: 2146441 - RNA, 21 nt, Human herpesvirus 7
acuagaaaauaacuuuaaauu

SEQ ID NO: 2146442 - RNA, 22 nt, Human herpesvirus 7
auuucuuaaagaugucuuaauu

SEQ ID NO: 2146443 - RNA, 19 nt, Human herpesvirus 7
uugcagcccaauguugccu

SEQ ID NO: 2146444 - RNA, 17 nt, Human herpesvirus 7
uauuuugauaauuuaca

SEQ ID NO: 2146445 - RNA, 14 nt, Human herpesvirus 7
uaauugcagcuucg

SEQ ID NO: 2146446 - RNA, 22 nt, Human herpesvirus 7
gacaaagcauacuuuaaaacuu

SEQ ID NO: 2146447 - RNA, 20 nt, Human herpesvirus 7
agguuuguuuuuuggcauua

SEQ ID NO: 2146448 - RNA, 21 nt, Human herpesvirus 7
cuguugaaacauagcuagaaa

SEQ ID NO: 2146449 - RNA, 18 nt, Human herpesvirus 7
ccaaaaucuauauuugau

SEQ ID NO: 2146450 - RNA, 14 nt, Human herpesvirus 7
agagacaagaggac

SEQ ID NO: 2146451 - RNA, 17 nt, Human herpesvirus 7
agcuaauugagaaauuu

SEQ ID NO: 2146452 - RNA, 16 nt, Human herpesvirus 7
auaacucaaaagacag

SEQ ID NO: 2146453 - RNA, 19 nt, Human herpesvirus 7
uaaaaacuuuucuuucuua

SEQ ID NO: 2146454 - RNA, 15 nt, Human herpesvirus 7
acauagcuagaaauu

SEQ ID NO: 2146455 - RNA, 12 nt, Human herpesvirus 7
auaaauucugaa

SEQ ID NO: 2146456 - RNA, 21 nt, Human herpesvirus 7
gcuuagaauauuuauguucaa

SEQ ID NO: 2146457 - RNA, 23 nt, Human herpesvirus 7
acucggucuuuuuauuucuaaua

SEQ ID NO: 2146458 - RNA, 16 nt, Human herpesvirus 7
aauaaagauuacauuu

SEQ ID NO: 2146459 - RNA, 18 nt, Human herpesvirus 7
aaugugguaaauuugcuu

SEQ ID NO: 2146460 - RNA, 17 nt, Human herpesvirus 7
gccagagaaccacguga

SEQ ID NO: 2146461 - RNA, 14 nt, Human herpesvirus 7
uucuuuuucaagau

SEQ ID NO: 2146462 - RNA, 19 nt, Human herpesvirus 7
gaaaaucuaucaccaagaa

SEQ ID NO: 2146463 - RNA, 13 nt, Human herpesvirus 7
aaauguuuugauu

SEQ ID NO: 2146464 - RNA, 22 nt, Human herpesvirus 7
uaacugagaaaaaugacaaaac

SEQ ID NO: 2146465 - RNA, 11 nt, Human herpesvirus 7
acaaagaacau

SEQ ID NO: 2146466 - RNA, 14 nt, Human herpesvirus 7
agcauaaagcacca

SEQ ID NO: 2146467 - RNA, 17 nt, Human herpesvirus 7
gaugcauuuuuauugca

SEQ ID NO: 2146468 - RNA, 14 nt, Human herpesvirus 7
cuauaaauggaauu

SEQ ID NO: 2146469 - RNA, 19 nt, Human herpesvirus 7
aacaucgagauuccaaaga

SEQ ID NO: 2146470 - RNA, 20 nt, Human herpesvirus 7
gugaagacuacauaaaggua

SEQ ID NO: 2146471 - RNA, 12 nt, Human herpesvirus 7
acguccaaaaau

SEQ ID NO: 2146472 - RNA, 17 nt, Human herpesvirus 7
aggaauucugacuccuu

SEQ ID NO: 2146473 - RNA, 12 nt, Human herpesvirus 7
aaaaaaaaccac

SEQ ID NO: 2146474 - RNA, 19 nt, Human herpesvirus 7
uaauaaaggaaagacaaac

SEQ ID NO: 2146475 - RNA, 15 nt, Human herpesvirus 7
auauaacaaaaaacg

SEQ ID NO: 2146476 - RNA, 21 nt, Human herpesvirus 7
gguaagaaaaaucauuuuuaa

SEQ ID NO: 2146477 - RNA, 17 nt, Human herpesvirus 7
cuugccaaaagcuugaa

SEQ ID NO: 2146478 - RNA, 15 nt, Human herpesvirus 7
cauauauaagagaau

SEQ ID NO: 2146479 - RNA, 16 nt, Human herpesvirus 7
accaugauguuaaaga

SEQ ID NO: 2146480 - RNA, 13 nt, Human herpesvirus 7
guuguacucagag

SEQ ID NO: 2146481 - RNA, 17 nt, Human herpesvirus 7
uggaaccuacugaagag

SEQ ID NO: 2146482 - RNA, 19 nt, Human herpesvirus 7
aaagaaaaagcaacaaaug

SEQ ID NO: 2146483 - RNA, 20 nt, Human herpesvirus 7
augguaagcaaaaaaaggua

SEQ ID NO: 2146484 - RNA, 18 nt, Human herpesvirus 7
aauuuagcaccaacugaa

SEQ ID NO: 2146485 - RNA, 19 nt, Human herpesvirus 7
cagaaauaacaaaauugua

SEQ ID NO: 2146486 - RNA, 14 nt, Human herpesvirus 7
auuucucaaaucuu

SEQ ID NO: 2146487 - RNA, 15 nt, Human herpesvirus 7
gucaugcuguauguu

SEQ ID NO: 2146488 - RNA, 19 nt, Human herpesvirus 7
caaggggucgcauauugca

SEQ ID NO: 2146489 - RNA, 14 nt, Human herpesvirus 7
gugauuuuaaauaa

SEQ ID NO: 2146490 - RNA, 19 nt, Human herpesvirus 7
uaaugaaguuuaucuugga

SEQ ID NO: 2146491 - RNA, 22 nt, Human herpesvirus 7
uuauaauguaagaaauuuucuu

SEQ ID NO: 2146492 - RNA, 13 nt, Human herpesvirus 7
gccagaaauuaaa

SEQ ID NO: 2146493 - RNA, 14 nt, Human herpesvirus 7
aaaagagaaaaugu

SEQ ID NO: 2146494 - RNA, 16 nt, Human herpesvirus 7
cuagaaaaacacuagc

SEQ ID NO: 2146495 - RNA, 19 nt, Human herpesvirus 7
uugaaaguaaaaacuuuuc

SEQ ID NO: 2146496 - RNA, 20 nt, Human herpesvirus 7
auugugaguuucuacauguu

SEQ ID NO: 2146497 - RNA, 12 nt, Human herpesvirus 7
cuuugucaugau

SEQ ID NO: 2146498 - RNA, 15 nt, Human herpesvirus 7
acccagaagaaacuu

SEQ ID NO: 2146499 - RNA, 22 nt, Human herpesvirus 7
uugauucacauugucacugcaa

SEQ ID NO: 2146500 - RNA, 22 nt, Human herpesvirus 7
uuucuccacuaugccacaaaaa

SEQ ID NO: 2146501 - RNA, 17 nt, Human herpesvirus 7
uaaucauaguacaucuu

SEQ ID NO: 2146502 - RNA, 21 nt, Human herpesvirus 7
gaauaucuguggcuuuugcuu

SEQ ID NO: 2146503 - RNA, 14 nt, Human herpesvirus 7
uuccgguguggaaa

SEQ ID NO: 2146504 - RNA, 15 nt, Human herpesvirus 7
uuauguguacacuuu

SEQ ID NO: 2146505 - RNA, 15 nt, Human herpesvirus 7
aacuagcaaacagug

SEQ ID NO: 2146506 - RNA, 14 nt, Human herpesvirus 7
auugcagucaaaga

SEQ ID NO: 2146507 - RNA, 22 nt, Human herpesvirus 7
aaaguauaacauugcuucagaa

SEQ ID NO: 2146508 - RNA, 16 nt, Human herpesvirus 7
cuuuuauuacucgaaa

SEQ ID NO: 2146509 - RNA, 14 nt, Human herpesvirus 7
ggacagucaacaaa

SEQ ID NO: 2146510 - RNA, 12 nt, Human herpesvirus 7
uucuaaaaauuc

SEQ ID NO: 2146511 - RNA, 16 nt, Human herpesvirus 7
caaaggaaaaaugcug

SEQ ID NO: 2146512 - RNA, 13 nt, Human herpesvirus 7
uaaauuuaaaauu

SEQ ID NO: 2146513 - RNA, 18 nt, Human herpesvirus 7
agccacgaugacuuccaa

SEQ ID NO: 2146514 - RNA, 22 nt, Human herpesvirus 7
uguaugcaagaaaguccaaagu

SEQ ID NO: 2146515 - RNA, 13 nt, Human herpesvirus 7
uuugaauguaugu

SEQ ID NO: 2146516 - RNA, 15 nt, Human herpesvirus 7
cuauauuuuguuaag

SEQ ID NO: 2146517 - RNA, 22 nt, Human herpesvirus 7
uaacacuguuuucaguuaugau

SEQ ID NO: 2146518 - RNA, 21 nt, Human herpesvirus 7
aaccuggauguaaugaauaaa

SEQ ID NO: 2146519 - RNA, 20 nt, Human herpesvirus 7
caaaccaugauguuaaagaa

SEQ ID NO: 2146520 - RNA, 18 nt, Human herpesvirus 7
auaaaagggcagacacua

SEQ ID NO: 2146521 - RNA, 12 nt, Human herpesvirus 7
aauuaacagcuc

SEQ ID NO: 2146522 - RNA, 14 nt, Human herpesvirus 7
ugucuauuucaauu

SEQ ID NO: 2146523 - RNA, 23 nt, Human herpesvirus 7
agaauggcgguuguacuguaauu

SEQ ID NO: 2146524 - RNA, 23 nt, Human herpesvirus 7
aaaaggccguuuaugaacaaggu

SEQ ID NO: 2146525 - RNA, 18 nt, Human herpesvirus 7
cauccugcuaaggcgaaa

SEQ ID NO: 2146526 - RNA, 13 nt, Human herpesvirus 7
acuauaaauggaa

SEQ ID NO: 2146527 - RNA, 23 nt, Human herpesvirus 7
ugucacguguucaggcaacauua

SEQ ID NO: 2146528 - RNA, 21 nt, Human herpesvirus 7
auuugacuuuuucuguagaca

SEQ ID NO: 2146529 - RNA, 19 nt, Human herpesvirus 7
aauauuuggcuuagaauau

SEQ ID NO: 2146530 - RNA, 23 nt, Human herpesvirus 7
agucuguagaugcaugcuaauau

SEQ ID NO: 2146531 - RNA, 15 nt, Human herpesvirus 7
aagacacuuauuuga

SEQ ID NO: 2146532 - RNA, 20 nt, Human herpesvirus 7
uuuuguacauuuaauaaggu

SEQ ID NO: 2146533 - RNA, 18 nt, Human herpesvirus 7
aauuauguguauaagaau

SEQ ID NO: 2146534 - RNA, 22 nt, Human herpesvirus 7
uuccagagggguuugaacuugu

SEQ ID NO: 2146535 - RNA, 17 nt, Human herpesvirus 7
uauggauacaaggaaaa

SEQ ID NO: 2146536 - RNA, 24 nt, Human herpesvirus 7
uuguggaauccuaugacugagaaa

SEQ ID NO: 2146537 - RNA, 16 nt, Human herpesvirus 7
aauacaucuaggucuu

SEQ ID NO: 2146538 - RNA, 18 nt, Human herpesvirus 7
gguuuugaaauugacaug

SEQ ID NO: 2146539 - RNA, 19 nt, Human herpesvirus 7
acgucuuuuaagcuucgcu

SEQ ID NO: 2146540 - RNA, 20 nt, Human herpesvirus 7
cugaugauaaucgagaauaa

SEQ ID NO: 2146541 - RNA, 18 nt, Human herpesvirus 7
ugcaugcuaauauuucca

SEQ ID NO: 2146542 - RNA, 21 nt, Human herpesvirus 7
ccuacaaaaguucuguuuuga

SEQ ID NO: 2146543 - RNA, 17 nt, Human herpesvirus 7
augaaaaaaauuaugug

SEQ ID NO: 2146544 - RNA, 15 nt, Human herpesvirus 7
ucuacacaucuucaa

SEQ ID NO: 2146545 - RNA, 15 nt, Human herpesvirus 7
uuccaucucacuuau

SEQ ID NO: 2146546 - RNA, 20 nt, Human herpesvirus 7
cuggacacaaucagcauuua

SEQ ID NO: 2146547 - RNA, 16 nt, Human herpesvirus 7
aaaagcaacaaauguu

SEQ ID NO: 2146548 - RNA, 20 nt, Human herpesvirus 7
ucaaaaaaaaaacaauccac

SEQ ID NO: 2146549 - RNA, 20 nt, Human herpesvirus 7
gaucauagagaaaacauugu

SEQ ID NO: 2146550 - RNA, 15 nt, Human herpesvirus 7
augccagaaauuaaa

SEQ ID NO: 2146551 - RNA, 15 nt, Human herpesvirus 7
acgaaauaauuagaa

SEQ ID NO: 2146552 - RNA, 20 nt, Human herpesvirus 7
uauuacucgaaauuuaaaaa

SEQ ID NO: 2146553 - RNA, 23 nt, Human herpesvirus 7
cuaauauguaugaaauaauagau

SEQ ID NO: 2146554 - RNA, 16 nt, Human herpesvirus 7
uucuagcguuucguua

SEQ ID NO: 2146555 - RNA, 12 nt, Human herpesvirus 7
aucaaaaaauuc

SEQ ID NO: 2146556 - RNA, 17 nt, Human herpesvirus 7
aaaauaaauucugaaau

SEQ ID NO: 2146557 - RNA, 16 nt, Human herpesvirus 7
gauuucagaauuucca

SEQ ID NO: 2146558 - RNA, 19 nt, Human herpesvirus 7
aagagccaaauauggagac

SEQ ID NO: 2146559 - RNA, 14 nt, Human herpesvirus 7
aauaagcaaauaaa

SEQ ID NO: 2146560 - RNA, 20 nt, Human herpesvirus 7
auaauguuuccguguuuaug

SEQ ID NO: 2146561 - RNA, 12 nt, Human herpesvirus 7
cauaauuucagc

SEQ ID NO: 2146562 - RNA, 16 nt, Human herpesvirus 7
gcagauuguagagaau

SEQ ID NO: 2146563 - RNA, 17 nt, Human herpesvirus 7
uaagugauacugaaucu

SEQ ID NO: 2146564 - RNA, 23 nt, Human herpesvirus 7
cuuugagcccauauuuuuaaauu

SEQ ID NO: 2146565 - RNA, 14 nt, Human herpesvirus 7
auuuuuaaagagaa

SEQ ID NO: 2146566 - RNA, 17 nt, Human herpesvirus 7
gccuaggauaccaaaca

SEQ ID NO: 2146567 - RNA, 19 nt, Human herpesvirus 7
augccacaaaaaacuuuga

SEQ ID NO: 2146568 - RNA, 22 nt, Human herpesvirus 7
ugaaaaauuuuuuacugucuuu

SEQ ID NO: 2146569 - RNA, 14 nt, Human herpesvirus 7
auauuuaauuucuc

SEQ ID NO: 2146570 - RNA, 19 nt, Human herpesvirus 7
acgcucucaaucaaaaucu

SEQ ID NO: 2146571 - RNA, 17 nt, Human herpesvirus 7
gauuuagauuuaaaaca

SEQ ID NO: 2146572 - RNA, 19 nt, Human herpesvirus 7
guucaggucucuuucuaaa

SEQ ID NO: 2146573 - RNA, 17 nt, Human herpesvirus 7
acauauuaguuuaacuu

SEQ ID NO: 2146574 - RNA, 17 nt, Human herpesvirus 7
aacugauauaaaugcuu

SEQ ID NO: 2146575 - RNA, 13 nt, Human herpesvirus 7
acuuuuaaaauug

SEQ ID NO: 2146576 - RNA, 20 nt, Human herpesvirus 7
aaagcuuuggcagcuagccu

SEQ ID NO: 2146577 - RNA, 15 nt, Human herpesvirus 7
auucuuuguacuugu

SEQ ID NO: 2146578 - RNA, 14 nt, Human herpesvirus 7
agaguauacaaaag

SEQ ID NO: 2146579 - RNA, 16 nt, Human herpesvirus 7
uugaaccuuaacauac

SEQ ID NO: 2146580 - RNA, 19 nt, Human herpesvirus 7
ugguaauuaauaaacagcg

SEQ ID NO: 2146581 - RNA, 13 nt, Human herpesvirus 7
ugauaagauuucc

SEQ ID NO: 2146582 - RNA, 23 nt, Human herpesvirus 7
ccuuauauuaaaaaccacagagg

SEQ ID NO: 2146583 - RNA, 18 nt, Human herpesvirus 7
auaaauacgcguggaagu

SEQ ID NO: 2146584 - RNA, 20 nt, Human herpesvirus 7
acaucagaccuaacaaaaaa

SEQ ID NO: 2146585 - RNA, 13 nt, Human herpesvirus 7
uaagcuuuuucuu

SEQ ID NO: 2146586 - RNA, 18 nt, Human herpesvirus 7
ugcaauuuucacaaugga

SEQ ID NO: 2146587 - RNA, 17 nt, Human herpesvirus 7
uaaaaucuacuguaauc

SEQ ID NO: 2146588 - RNA, 17 nt, Human herpesvirus 7
guccaaagugaugaaag

SEQ ID NO: 2146589 - RNA, 15 nt, Human herpesvirus 7
agcaccgaaaauggu

SEQ ID NO: 2146590 - RNA, 17 nt, Human herpesvirus 7
auuccuucuaaauucuu

SEQ ID NO: 2146591 - RNA, 20 nt, Human herpesvirus 7
caaucacgugauuaagauuc

SEQ ID NO: 2146592 - RNA, 15 nt, Human herpesvirus 7
accagauuucuggca

SEQ ID NO: 2146593 - RNA, 19 nt, Human herpesvirus 7
aagacacuuauuugauuau

SEQ ID NO: 2146594 - RNA, 20 nt, Human herpesvirus 7
ugccaccgggacagauuuag

SEQ ID NO: 2146595 - RNA, 15 nt, Human herpesvirus 7
agaaauugaugaaga

SEQ ID NO: 2146596 - RNA, 13 nt, Human herpesvirus 7
uguuugaucaaaa

SEQ ID NO: 2146597 - RNA, 13 nt, Human herpesvirus 7
uaaaaaaaaguug

SEQ ID NO: 2146598 - RNA, 13 nt, Human herpesvirus 7
cauacuuuacagc

SEQ ID NO: 2146599 - RNA, 14 nt, Human herpesvirus 7
agaaaaacagacuu

SEQ ID NO: 2146600 - RNA, 22 nt, Human herpesvirus 7
uaacucauaauuaugaaauguu

SEQ ID NO: 2146601 - RNA, 21 nt, Human herpesvirus 7
acucuucguuugaagagggaa

SEQ ID NO: 2146602 - RNA, 20 nt, Human herpesvirus 7
acuuuuuguucaguuaauaa

SEQ ID NO: 2146603 - RNA, 17 nt, Human herpesvirus 7
agaaaaguugaaaaugu

SEQ ID NO: 2146604 - RNA, 23 nt, Human herpesvirus 7
gauuuuaguuccacgucaaucac

SEQ ID NO: 2146605 - RNA, 21 nt, Human herpesvirus 7
gacuuaucaaucuauuucuau

SEQ ID NO: 2146606 - RNA, 19 nt, Human herpesvirus 7
uauuaauacguccaaaaau

SEQ ID NO: 2146607 - RNA, 14 nt, Human herpesvirus 7
ccacuucuaaauaa

SEQ ID NO: 2146608 - RNA, 17 nt, Human herpesvirus 7
aaacgaagaaucauuua

SEQ ID NO: 2146609 - RNA, 24 nt, Human herpesvirus 7
uccugcaauaauaaacauuguguu

SEQ ID NO: 2146610 - RNA, 20 nt, Human herpesvirus 7
gugggacuugauaauguuuc

SEQ ID NO: 2146611 - RNA, 16 nt, Human herpesvirus 7
gaaucagacuaaauau

SEQ ID NO: 2146612 - RNA, 18 nt, Human herpesvirus 7
gacggcauuuaacucaug

SEQ ID NO: 2146613 - RNA, 18 nt, Human herpesvirus 7
gcagaaaugucuuuugau

SEQ ID NO: 2146614 - RNA, 16 nt, Human herpesvirus 7
acuucagaaaaaccau

SEQ ID NO: 2146615 - RNA, 12 nt, Human herpesvirus 7
ucugcuaauucu

SEQ ID NO: 2146616 - RNA, 17 nt, Human herpesvirus 7
uguuaaggagcuucauu

SEQ ID NO: 2146617 - RNA, 22 nt, Human herpesvirus 7
aucuuguaauuucucaaaucuu

SEQ ID NO: 2146618 - RNA, 19 nt, Human herpesvirus 7
gaaucauagcaggaagcac

SEQ ID NO: 2146619 - RNA, 22 nt, Human herpesvirus 7
uguacaauuugcauaauccucu

SEQ ID NO: 2146620 - RNA, 22 nt, Human herpesvirus 7
caaucaaacauguaaucaaaau

SEQ ID NO: 2146621 - RNA, 19 nt, Human herpesvirus 7
aaacacuugcuagcuguga

SEQ ID NO: 2146622 - RNA, 11 nt, Human herpesvirus 7
guagugucugc

SEQ ID NO: 2146623 - RNA, 17 nt, Human herpesvirus 7
ugcagaccguaaaacaa

SEQ ID NO: 2146624 - RNA, 14 nt, Human herpesvirus 7
uuagacuuuuuucu

SEQ ID NO: 2146625 - RNA, 14 nt, Human herpesvirus 7
acagagacaaccau

SEQ ID NO: 2146626 - RNA, 22 nt, Human herpesvirus 7
acuggauguauaaaucagaaua

SEQ ID NO: 2146627 - RNA, 16 nt, Human herpesvirus 7
cuuuauaagcaguuau

SEQ ID NO: 2146628 - RNA, 20 nt, Human herpesvirus 7
uuaaauuuuucgcugucuuu

SEQ ID NO: 2146629 - RNA, 15 nt, Human herpesvirus 7
augcuuuaacuggaa

SEQ ID NO: 2146630 - RNA, 16 nt, Human herpesvirus 7
acauaauccaaaccgg

SEQ ID NO: 2146631 - RNA, 16 nt, Human herpesvirus 7
guuuuaugacucagac

SEQ ID NO: 2146632 - RNA, 14 nt, Human herpesvirus 7
gaaaacuugauaaa

SEQ ID NO: 2146633 - RNA, 17 nt, Human herpesvirus 7
cauccaaaaagaaacuu

SEQ ID NO: 2146634 - RNA, 18 nt, Human herpesvirus 7
cuacaauuucuggcaaua

SEQ ID NO: 2146635 - RNA, 22 nt, Human herpesvirus 7
acugcuucucccauucaauaau

SEQ ID NO: 2146636 - RNA, 24 nt, Human herpesvirus 7
uguauaaaucagaauauuuccagc

SEQ ID NO: 2146637 - RNA, 13 nt, Human herpesvirus 7
aauaaacaaaauu

SEQ ID NO: 2146638 - RNA, 23 nt, Human herpesvirus 7
cuugauacaggccuguuucuuga

SEQ ID NO: 2146639 - RNA, 13 nt, Human herpesvirus 7
auacgaaaacggu

SEQ ID NO: 2146640 - RNA, 22 nt, Human herpesvirus 7
uuaauuauucggugucuucuug

SEQ ID NO: 2146641 - RNA, 12 nt, Human herpesvirus 7
cuuguauauacg

SEQ ID NO: 2146642 - RNA, 20 nt, Human herpesvirus 7
cuuuacgaaacaauuucaca

SEQ ID NO: 2146643 - RNA, 17 nt, Human herpesvirus 7
augugaaaauaaacagg

SEQ ID NO: 2146644 - RNA, 14 nt, Human herpesvirus 7
uucaagaaaucaga

SEQ ID NO: 2146645 - RNA, 16 nt, Human herpesvirus 7
aaaugguauuuugcgu

SEQ ID NO: 2146646 - RNA, 16 nt, Human herpesvirus 7
uacguucugaaacagu

SEQ ID NO: 2146647 - RNA, 16 nt, Human herpesvirus 7
ggaaaauuucauuuaa

SEQ ID NO: 2146648 - RNA, 20 nt, Human herpesvirus 7
aacaugauugguaaaaaauu

SEQ ID NO: 2146649 - RNA, 21 nt, Human herpesvirus 7
cuccacuaugccacaaaaaac

SEQ ID NO: 2146650 - RNA, 20 nt, Human herpesvirus 7
uaagagacauugaaaaugca

SEQ ID NO: 2146651 - RNA, 14 nt, Human herpesvirus 7
aaaacgauccuaaa

SEQ ID NO: 2146652 - RNA, 23 nt, Human herpesvirus 7
agaaucauagcaggaagcacaaa

SEQ ID NO: 2146653 - RNA, 14 nt, Human herpesvirus 7
aaauuuuuuacugu

SEQ ID NO: 2146654 - RNA, 23 nt, Human herpesvirus 7
ucuaccucuuacauuugauuuua

SEQ ID NO: 2146655 - RNA, 15 nt, Human herpesvirus 7
gcauauaugaaucaa

SEQ ID NO: 2146656 - RNA, 16 nt, Human herpesvirus 7
auccgcugaacgcaga

SEQ ID NO: 2146657 - RNA, 15 nt, Human herpesvirus 7
gcuugucucugucca

SEQ ID NO: 2146658 - RNA, 22 nt, Human herpesvirus 7
uauacauacuaaauuucuuaaa

SEQ ID NO: 2146659 - RNA, 23 nt, Human herpesvirus 7
ucacagauaaaaauuuauuuucu

SEQ ID NO: 2146660 - RNA, 16 nt, Human herpesvirus 7
acaucaauuuuaaugu

SEQ ID NO: 2146661 - RNA, 15 nt, Human herpesvirus 7
acuguauuuguugau

SEQ ID NO: 2146662 - RNA, 21 nt, Human herpesvirus 7
aaugaauaaaaucuauuuuau

SEQ ID NO: 2146663 - RNA, 23 nt, Human herpesvirus 7
ugcauuuuuauugcaguuuuuua

SEQ ID NO: 2146664 - RNA, 15 nt, Human herpesvirus 7
aaauuacuugcuaug

SEQ ID NO: 2146665 - RNA, 19 nt, Human herpesvirus 7
cauuccguuuuaaauagug

SEQ ID NO: 2146666 - RNA, 21 nt, Human herpesvirus 7
aacacguagaaaaaaacaaug

SEQ ID NO: 2146667 - RNA, 13 nt, Human herpesvirus 7
uuuuaaacuaagu

SEQ ID NO: 2146668 - RNA, 18 nt, Human herpesvirus 7
uuaaccagauauuaguuu

SEQ ID NO: 2146669 - RNA, 15 nt, Human herpesvirus 7
aauaaaauuuaaaau

SEQ ID NO: 2146670 - RNA, 16 nt, Human herpesvirus 7
aaggaaaauuucauuu

SEQ ID NO: 2146671 - RNA, 15 nt, Human herpesvirus 7
uuaaauagugaauca

SEQ ID NO: 2146672 - RNA, 13 nt, Human herpesvirus 7
gaaaauaacagga

SEQ ID NO: 2146673 - RNA, 18 nt, Human herpesvirus 7
ccguuuugaaaagucauu

SEQ ID NO: 2146674 - RNA, 19 nt, Human herpesvirus 7
ucuaauuuaugauacuugu

SEQ ID NO: 2146675 - RNA, 17 nt, Human herpesvirus 7
gaaaaaaauuaugugua

SEQ ID NO: 2146676 - RNA, 18 nt, Human herpesvirus 7
uaaggcuguaaaagaaaa

SEQ ID NO: 2146677 - RNA, 22 nt, Human herpesvirus 7
aucuuugaaaaucuugaauaaa

SEQ ID NO: 2146678 - RNA, 19 nt, Human herpesvirus 7
acuuuuuuuacuuaaauau

SEQ ID NO: 2146679 - RNA, 17 nt, Human herpesvirus 7
gugaaaacaguguugag

SEQ ID NO: 2146680 - RNA, 14 nt, Human herpesvirus 7
ugauauaaaugcuu

SEQ ID NO: 2146681 - RNA, 17 nt, Human herpesvirus 7
uguaacuguuuuucaaa

SEQ ID NO: 2146682 - RNA, 16 nt, Human herpesvirus 7
aacauacugauguaaa

SEQ ID NO: 2146683 - RNA, 18 nt, Human herpesvirus 7
cgaaauaauuagaaagcu

SEQ ID NO: 2146684 - RNA, 13 nt, Human herpesvirus 7
aauguaacuuuca

SEQ ID NO: 2146685 - RNA, 14 nt, Human herpesvirus 7
gaaugaacaaauaa

SEQ ID NO: 2146686 - RNA, 18 nt, Human herpesvirus 7
auuaauguaauuuaugau

SEQ ID NO: 2146687 - RNA, 21 nt, Human herpesvirus 7
uauauuacuacgguuuucaga

SEQ ID NO: 2146688 - RNA, 17 nt, Human herpesvirus 7
cuuuuuccaauagcacu

SEQ ID NO: 2146689 - RNA, 15 nt, Human herpesvirus 7
cgcugaaauuucaug

SEQ ID NO: 2146690 - RNA, 17 nt, Human herpesvirus 7
aaacggugauuguagau

SEQ ID NO: 2146691 - RNA, 17 nt, Human herpesvirus 7
ucuauuagauaaugaca

SEQ ID NO: 2146692 - RNA, 14 nt, Human herpesvirus 7
uuauuuugauugga

SEQ ID NO: 2146693 - RNA, 16 nt, Human herpesvirus 7
ugugagugaacauuug

SEQ ID NO: 2146694 - RNA, 22 nt, Human herpesvirus 7
auuuugaagagcguguuuugag

SEQ ID NO: 2146695 - RNA, 14 nt, Human herpesvirus 7
cuuauaacuucgua

SEQ ID NO: 2146696 - RNA, 14 nt, Human herpesvirus 7
agaaaaucucgaac

SEQ ID NO: 2146697 - RNA, 15 nt, Human herpesvirus 7
acuuuuuauaauaau

SEQ ID NO: 2146698 - RNA, 20 nt, Human herpesvirus 7
uuucuuagaucgaacuguua

SEQ ID NO: 2146699 - RNA, 17 nt, Human herpesvirus 7
gaaauuaaauacaaauu

SEQ ID NO: 2146700 - RNA, 20 nt, Human herpesvirus 7
auuuaccuuuaauugauauu

SEQ ID NO: 2146701 - RNA, 11 nt, Human herpesvirus 7
cuuucuuuacc

SEQ ID NO: 2146702 - RNA, 16 nt, Human herpesvirus 7
agaacauuaauaucaa

SEQ ID NO: 2146703 - RNA, 18 nt, Human herpesvirus 7
uuuaaagaaaagcuugua

SEQ ID NO: 2146704 - RNA, 19 nt, Human herpesvirus 7
cuccccaguaaauaaaaug

SEQ ID NO: 2146705 - RNA, 17 nt, Human herpesvirus 7
ggauacggcagcggaag

SEQ ID NO: 2146706 - RNA, 17 nt, Human herpesvirus 7
cuggauucaagaaauca

SEQ ID NO: 2146707 - RNA, 18 nt, Human herpesvirus 7
uuuaugaaaaacaaaaug

SEQ ID NO: 2146708 - RNA, 17 nt, Human herpesvirus 7
guacaagguguuccuua

SEQ ID NO: 2146709 - RNA, 16 nt, Human herpesvirus 7
aaccacaaaaaucaaa

SEQ ID NO: 2146710 - RNA, 23 nt, Human herpesvirus 7
gauuguauuugucucugugcauu

SEQ ID NO: 2146711 - RNA, 16 nt, Human herpesvirus 7
aacucaauaaaaaugu

SEQ ID NO: 2146712 - RNA, 19 nt, Human herpesvirus 7
uuaauacguccaaaaauug

SEQ ID NO: 2146713 - RNA, 14 nt, Human herpesvirus 7
gaaauuguuaaaaa

SEQ ID NO: 2146714 - RNA, 18 nt, Human herpesvirus 7
auacuaauagaaaaaugu

SEQ ID NO: 2146715 - RNA, 15 nt, Human herpesvirus 7
cgcguuuucaugcuc

SEQ ID NO: 2146716 - RNA, 14 nt, Human herpesvirus 7
ccgcguuggugugu

SEQ ID NO: 2146717 - RNA, 20 nt, Human herpesvirus 7
cagcuucagaugcuauggug

SEQ ID NO: 2146718 - RNA, 20 nt, Human herpesvirus 7
aucuugugaaguuugcugaa

SEQ ID NO: 2146719 - RNA, 17 nt, Human herpesvirus 7
acagaccuauguguuua

SEQ ID NO: 2146720 - RNA, 22 nt, Human herpesvirus 7
aaaauucaacgucuuacuugga

SEQ ID NO: 2146721 - RNA, 17 nt, Human herpesvirus 7
aaaaucaagucugaagg

SEQ ID NO: 2146722 - RNA, 20 nt, Human herpesvirus 7
acugugcaugaaaucuugaa

SEQ ID NO: 2146723 - RNA, 21 nt, Human herpesvirus 7
cauaggaaucgcaguguucau

SEQ ID NO: 2146724 - RNA, 9 nt, Human herpesvirus 7
uugccuuca

SEQ ID NO: 2146725 - RNA, 22 nt, Human herpesvirus 7
cuauccacucuccugaaauaaa

SEQ ID NO: 2146726 - RNA, 15 nt, Human herpesvirus 7
agacggaacuucuuu

SEQ ID NO: 2146727 - RNA, 16 nt, Human herpesvirus 7
uuacuugcuaugcuug

SEQ ID NO: 2146728 - RNA, 16 nt, Human herpesvirus 7
uaauaguggugaaauu

SEQ ID NO: 2146729 - RNA, 20 nt, Human herpesvirus 7
ugaaaccuucgcaacaauua

SEQ ID NO: 2146730 - RNA, 13 nt, Human herpesvirus 7
auuaauugcagcu

SEQ ID NO: 2146731 - RNA, 21 nt, Human herpesvirus 7
ucacuuagacucguaguaaga

SEQ ID NO: 2146732 - RNA, 19 nt, Human herpesvirus 7
aucuuuaucuuugucacuu

SEQ ID NO: 2146733 - RNA, 21 nt, Human herpesvirus 7
cggaauggacaaaaauaaagu

SEQ ID NO: 2146734 - RNA, 18 nt, Human herpesvirus 7
ugcuaaggcgaaaaacac

SEQ ID NO: 2146735 - RNA, 18 nt, Human herpesvirus 7
gaaaacugcaacuuugug

SEQ ID NO: 2146736 - RNA, 19 nt, Human herpesvirus 7
gaaaaguugaagaaaucuu

SEQ ID NO: 2146737 - RNA, 19 nt, Human herpesvirus 7
cuaaugguuggauuucaau

SEQ ID NO: 2146738 - RNA, 13 nt, Human herpesvirus 7
aagcacauguaca

SEQ ID NO: 2146739 - RNA, 18 nt, Human herpesvirus 7
caugauuauguuuucugc

SEQ ID NO: 2146740 - RNA, 17 nt, Human herpesvirus 7
uuauaauacuggcaugu

SEQ ID NO: 2146741 - RNA, 14 nt, Human herpesvirus 7
uucgccugaagaga

SEQ ID NO: 2146742 - RNA, 12 nt, Human herpesvirus 7
uugccagaaauc

SEQ ID NO: 2146743 - RNA, 18 nt, Human herpesvirus 7
aaaugggaauguuaacca

SEQ ID NO: 2146744 - RNA, 15 nt, Human herpesvirus 7
aacaguuuuuaaaau

SEQ ID NO: 2146745 - RNA, 14 nt, Human herpesvirus 7
auuuguucaaaaua

SEQ ID NO: 2146746 - RNA, 17 nt, Human herpesvirus 7
ucuaacacugcaagcug

SEQ ID NO: 2146747 - RNA, 16 nt, Human herpesvirus 7
caauugaguuuacugc

SEQ ID NO: 2146748 - RNA, 21 nt, Human herpesvirus 7
augacaacucaauaaaaaugu

SEQ ID NO: 2146749 - RNA, 16 nt, Human herpesvirus 7
ucuauuguucuuucaa

SEQ ID NO: 2146750 - RNA, 18 nt, Human herpesvirus 7
uuauauuugcuugcugaa

SEQ ID NO: 2146751 - RNA, 16 nt, Human herpesvirus 7
uuuauaaaauauggac

SEQ ID NO: 2146752 - RNA, 16 nt, Human herpesvirus 7
gucuacaauuucuggc

SEQ ID NO: 2146753 - RNA, 18 nt, Human herpesvirus 7
acuauuuacgauaauaau

SEQ ID NO: 2146754 - RNA, 22 nt, Human herpesvirus 7
ugauucuuauucuacacaucuu

SEQ ID NO: 2146755 - RNA, 21 nt, Human herpesvirus 7
accccaugcaagaaaaaaaug

SEQ ID NO: 2146756 - RNA, 19 nt, Human herpesvirus 7
cauacaugcaaucaacaaa

SEQ ID NO: 2146757 - RNA, 21 nt, Human herpesvirus 7
aaaucauuuuuaaaaauaaua

SEQ ID NO: 2146758 - RNA, 12 nt, Human herpesvirus 7
acuuuuaaauaa

SEQ ID NO: 2146759 - RNA, 22 nt, Human herpesvirus 7
auugcaguaaauuugagcuuug

SEQ ID NO: 2146760 - RNA, 14 nt, Human herpesvirus 7
uuuaaguaaauuuc

SEQ ID NO: 2146761 - RNA, 16 nt, Human herpesvirus 7
uaucuguggcuuuugc

SEQ ID NO: 2146762 - RNA, 18 nt, Human herpesvirus 7
gaaaagcaacuuuucuua

SEQ ID NO: 2146763 - RNA, 19 nt, Human herpesvirus 7
agauucuuaauuuguucaa

SEQ ID NO: 2146764 - RNA, 17 nt, Human herpesvirus 7
uaugaaauaauagaugu

SEQ ID NO: 2146765 - RNA, 14 nt, Human herpesvirus 7
uacaaaagacauaa

SEQ ID NO: 2146766 - RNA, 20 nt, Human herpesvirus 7
gaauagacacauuuauccau

SEQ ID NO: 2146767 - RNA, 22 nt, Human herpesvirus 7
aaggauuugcguaauggauuua

SEQ ID NO: 2146768 - RNA, 13 nt, Human herpesvirus 7
uaggauagcuuga

SEQ ID NO: 2146769 - RNA, 15 nt, Human herpesvirus 7
aauguuuuuuucaua

SEQ ID NO: 2146770 - RNA, 19 nt, Human herpesvirus 7
ucaauuuuucgcugaagaa

SEQ ID NO: 2146771 - RNA, 13 nt, Human herpesvirus 7
aauccaaguuuua

SEQ ID NO: 2146772 - RNA, 13 nt, Human herpesvirus 7
acucuccugaaau

SEQ ID NO: 2146773 - RNA, 21 nt, Human herpesvirus 7
ucuuaaaaguacaaauguuuu

SEQ ID NO: 2146774 - RNA, 20 nt, Human herpesvirus 7
aaauuauuagauuccauuua

SEQ ID NO: 2146775 - RNA, 22 nt, Human herpesvirus 7
ugaggaaaugucuuugucauga

SEQ ID NO: 2146776 - RNA, 22 nt, Human herpesvirus 7
aaauaauccauuccuguguucu

SEQ ID NO: 2146777 - RNA, 14 nt, Human herpesvirus 7
cuggaauauuugcu

SEQ ID NO: 2146778 - RNA, 15 nt, Human herpesvirus 7
cagaguuuaaaguaa

SEQ ID NO: 2146779 - RNA, 14 nt, Human herpesvirus 7
aauauuauaucuaa

SEQ ID NO: 2146780 - RNA, 12 nt, Human herpesvirus 7
gaaauuacagua

SEQ ID NO: 2146781 - RNA, 20 nt, Human herpesvirus 7
uaugguuucauuuggaagau

SEQ ID NO: 2146782 - RNA, 14 nt, Human herpesvirus 7
uuaauauuaguauu

SEQ ID NO: 2146783 - RNA, 20 nt, Human herpesvirus 7
auaugacuuguugaauuuuu

SEQ ID NO: 2146784 - RNA, 14 nt, Human herpesvirus 7
aacauugucaaaga

SEQ ID NO: 2146785 - RNA, 15 nt, Human herpesvirus 7
auuucagcuggaauu

SEQ ID NO: 2146786 - RNA, 15 nt, Human herpesvirus 7
caaguuaauuuugca

SEQ ID NO: 2146787 - RNA, 12 nt, Human herpesvirus 7
uucucaaaucuu

SEQ ID NO: 2146788 - RNA, 20 nt, Human herpesvirus 7
uauauuccaacucaaugaau

SEQ ID NO: 2146789 - RNA, 19 nt, Human herpesvirus 7
uuaaauuauuauuaguauu

SEQ ID NO: 2146790 - RNA, 23 nt, Human herpesvirus 7
cuucugggaacuagaaaaacacu

SEQ ID NO: 2146791 - RNA, 15 nt, Human herpesvirus 7
uuaucucauagcuua

SEQ ID NO: 2146792 - RNA, 19 nt, Human herpesvirus 7
ccugcaauaugcaugugua

SEQ ID NO: 2146793 - RNA, 15 nt, Human herpesvirus 7
auuuuccauucauuu

SEQ ID NO: 2146794 - RNA, 23 nt, Human herpesvirus 7
cagauuucauguuuuaugacuca

SEQ ID NO: 2146795 - RNA, 21 nt, Human herpesvirus 7
gguaauuuuaaaacugaagca

SEQ ID NO: 2146796 - RNA, 22 nt, Human herpesvirus 7
aauuuaugcuuuaacuggaauu

SEQ ID NO: 2146797 - RNA, 23 nt, Human herpesvirus 7
caucaaaagucuuguuuuuugga

SEQ ID NO: 2146798 - RNA, 20 nt, Human herpesvirus 7
uugcuauuuaaucuaugcaa

SEQ ID NO: 2146799 - RNA, 14 nt, Human herpesvirus 7
uuagcgaaucaucu

SEQ ID NO: 2146800 - RNA, 12 nt, Human herpesvirus 7
gcuguucaaaau

SEQ ID NO: 2146801 - RNA, 22 nt, Human herpesvirus 7
gcaugcaaaaaacaguggaaaa

SEQ ID NO: 2146802 - RNA, 22 nt, Human herpesvirus 7
uuuagaaguggcuucucuaguu

SEQ ID NO: 2146803 - RNA, 15 nt, Human herpesvirus 7
acauaaucauggaaa

SEQ ID NO: 2146804 - RNA, 15 nt, Human herpesvirus 7
uugaacagaauuuuc

SEQ ID NO: 2146805 - RNA, 20 nt, Human herpesvirus 7
auaaauuuuucgaucuguaa

SEQ ID NO: 2146806 - RNA, 20 nt, Human herpesvirus 7
ggagacgaugagcaugaaaa

SEQ ID NO: 2146807 - RNA, 20 nt, Human herpesvirus 7
ugaaaaaaucuugcaagcag

SEQ ID NO: 2146808 - RNA, 16 nt, Human herpesvirus 7
ggaaagcucauuucau

SEQ ID NO: 2146809 - RNA, 13 nt, Human herpesvirus 7
aaggaagguacau

SEQ ID NO: 2146810 - RNA, 20 nt, Human herpesvirus 7
aagaugucuaaaaguacagu

SEQ ID NO: 2146811 - RNA, 16 nt, Human herpesvirus 7
guugcuaguaugucag

SEQ ID NO: 2146812 - RNA, 17 nt, Human herpesvirus 7
uuuaaagaaaagcuugu

SEQ ID NO: 2146813 - RNA, 17 nt, Human herpesvirus 7
guaaaaaaucaagucug

SEQ ID NO: 2146814 - RNA, 22 nt, Human herpesvirus 7
aggcaucgcauauagcgcuuuu

SEQ ID NO: 2146815 - RNA, 22 nt, Human herpesvirus 7
auauacggaauggacaaaaaua

SEQ ID NO: 2146816 - RNA, 16 nt, Human herpesvirus 7
aaguuuuacagaaauu

SEQ ID NO: 2146817 - RNA, 12 nt, Human herpesvirus 7
uguuuacacauu

SEQ ID NO: 2146818 - RNA, 24 nt, Human herpesvirus 7
auuugcagcuucuaaaugugcuaa

SEQ ID NO: 2146819 - RNA, 16 nt, Human herpesvirus 7
uugaacauaaauauuc

SEQ ID NO: 2146820 - RNA, 18 nt, Human herpesvirus 7
aguauuuuuuaugaagag

SEQ ID NO: 2146821 - RNA, 15 nt, Human herpesvirus 7
acgucuacauuuaaa

SEQ ID NO: 2146822 - RNA, 22 nt, Human herpesvirus 7
cgcuucguaaauauaaucaaaa

SEQ ID NO: 2146823 - RNA, 20 nt, Human herpesvirus 7
aaaaucuuuaugugggauuu

SEQ ID NO: 2146824 - RNA, 16 nt, Human herpesvirus 7
agaccaaauucaucca

SEQ ID NO: 2146825 - RNA, 22 nt, Human herpesvirus 7
aacaugucuuuuaguuuucauu

SEQ ID NO: 2146826 - RNA, 15 nt, Human herpesvirus 7
auuccaacucaauga

SEQ ID NO: 2146827 - RNA, 15 nt, Human herpesvirus 7
aaaaguugaaaaugu

SEQ ID NO: 2146828 - RNA, 22 nt, Human herpesvirus 7
uuguagguaauuucuuauaauu

SEQ ID NO: 2146829 - RNA, 13 nt, Human herpesvirus 7
aaacuguuuguaa

SEQ ID NO: 2146830 - RNA, 17 nt, Human herpesvirus 7
uuacagaagaacauuua

SEQ ID NO: 2146831 - RNA, 13 nt, Human herpesvirus 7
gaugcucucuaau

SEQ ID NO: 2146832 - RNA, 19 nt, Human herpesvirus 7
uaaauauuuuuaaaaucua

SEQ ID NO: 2146833 - RNA, 17 nt, Human herpesvirus 7
cagcugugauauuuggu

SEQ ID NO: 2146834 - RNA, 22 nt, Human herpesvirus 7
agcaccaaaaaauaaaaacaag

SEQ ID NO: 2146835 - RNA, 22 nt, Human herpesvirus 7
augcuuccuaaaaaaaaaggaa

SEQ ID NO: 2146836 - RNA, 22 nt, Human herpesvirus 7
uacaaauuuuucggauaaaagg

SEQ ID NO: 2146837 - RNA, 17 nt, Human herpesvirus 7
agaaaguccaaagugau

SEQ ID NO: 2146838 - RNA, 17 nt, Human herpesvirus 7
caaacucaauaaagauu

SEQ ID NO: 2146839 - RNA, 23 nt, Human herpesvirus 7
uucugaaauaaacauuucaaaau

SEQ ID NO: 2146840 - RNA, 15 nt, Human herpesvirus 7
ucuggaugaaaacug

SEQ ID NO: 2146841 - RNA, 18 nt, Human herpesvirus 7
cuaaaaauccuaaauuuc

SEQ ID NO: 2146842 - RNA, 20 nt, Human herpesvirus 7
accgcagauccaucuuugaa

SEQ ID NO: 2146843 - RNA, 17 nt, Human herpesvirus 7
acccagaccgcauaacc

SEQ ID NO: 2146844 - RNA, 22 nt, Human herpesvirus 7
aaauguaucuuaaaauacuaau

SEQ ID NO: 2146845 - RNA, 19 nt, Human herpesvirus 7
cacccagucgucugcucaa

SEQ ID NO: 2146846 - RNA, 14 nt, Human herpesvirus 7
aguuccacgucaau

SEQ ID NO: 2146847 - RNA, 15 nt, Human herpesvirus 7
auaguugguuaauaa

SEQ ID NO: 2146848 - RNA, 21 nt, Human herpesvirus 7
ucuugcuugcgaucaucauug

SEQ ID NO: 2146849 - RNA, 20 nt, Human herpesvirus 7
cguucuauguaugaaaaaaa

SEQ ID NO: 2146850 - RNA, 15 nt, Human herpesvirus 7
gcagaaugcguaacu

SEQ ID NO: 2146851 - RNA, 18 nt, Human herpesvirus 7
auuuauauuugcuugcug

SEQ ID NO: 2146852 - RNA, 16 nt, Human herpesvirus 7
cagcagccuacuuuac

SEQ ID NO: 2146853 - RNA, 17 nt, Human herpesvirus 7
cugaauccgcauuugag

SEQ ID NO: 2146854 - RNA, 11 nt, Human herpesvirus 7
aaguugaacaa

SEQ ID NO: 2146855 - RNA, 11 nt, Human herpesvirus 7
cuguuuaagua

SEQ ID NO: 2146856 - RNA, 23 nt, Human herpesvirus 7
uucuucgucuaagucaauuaaag

SEQ ID NO: 2146857 - RNA, 13 nt, Human herpesvirus 7
agcaauugauuca

SEQ ID NO: 2146858 - RNA, 20 nt, Human herpesvirus 7
cgauccucagaauguacaca

SEQ ID NO: 2146859 - RNA, 22 nt, Human herpesvirus 7
uaacaacuagcaaacagugcug

SEQ ID NO: 2146860 - RNA, 14 nt, Human herpesvirus 7
agacagaaugccag

SEQ ID NO: 2146861 - RNA, 21 nt, Human herpesvirus 7
cugaaucaaaauccuggauuu

SEQ ID NO: 2146862 - RNA, 23 nt, Human herpesvirus 7
uuaauaaaaagcccaugaacacu

SEQ ID NO: 2146863 - RNA, 21 nt, Human herpesvirus 7
acucauacuaauagaaaaaug

SEQ ID NO: 2146864 - RNA, 20 nt, Human herpesvirus 7
caccaaaaaauaaaaacaag

SEQ ID NO: 2146865 - RNA, 13 nt, Human herpesvirus 7
ggagagauucaaa

SEQ ID NO: 2146866 - RNA, 17 nt, Human herpesvirus 7
gaugacuuccaaguuuu

SEQ ID NO: 2146867 - RNA, 13 nt, Human herpesvirus 7
aaaacuugccauc

SEQ ID NO: 2146868 - RNA, 20 nt, Human herpesvirus 7
accuuuuaaaaucaaaugua

SEQ ID NO: 2146869 - RNA, 14 nt, Human herpesvirus 7
acaauuugcauaau

SEQ ID NO: 2146870 - RNA, 17 nt, Human herpesvirus 7
auguacaauuugcauaa

SEQ ID NO: 2146871 - RNA, 17 nt, Human herpesvirus 7
uacagaaauugaugaag

SEQ ID NO: 2146872 - RNA, 16 nt, Human herpesvirus 7
auggacaaaaauaaag

SEQ ID NO: 2146873 - RNA, 15 nt, Human herpesvirus 7
cuuuuacagaagaac

SEQ ID NO: 2146874 - RNA, 22 nt, Human herpesvirus 7
ucaaaauucugcuugucucugu

SEQ ID NO: 2146875 - RNA, 18 nt, Human herpesvirus 7
ggcuagaaguuuagagac

SEQ ID NO: 2146876 - RNA, 23 nt, Human herpesvirus 7
caguuauuucuuauuggagaugu

SEQ ID NO: 2146877 - RNA, 16 nt, Human herpesvirus 7
cagcaauuuuaacgau

SEQ ID NO: 2146878 - RNA, 21 nt, Human herpesvirus 7
acguccaagaaauaugcuucc

SEQ ID NO: 2146879 - RNA, 21 nt, Human herpesvirus 7
gcuguucuugcuggcucaagc

SEQ ID NO: 2146880 - RNA, 19 nt, Human herpesvirus 7
uuuaaagaaaagcuuguau

SEQ ID NO: 2146881 - RNA, 23 nt, Human herpesvirus 7
auuauguauaucuuuuuauugaa

SEQ ID NO: 2146882 - RNA, 18 nt, Human herpesvirus 7
auuugaugaaauuguuaa

SEQ ID NO: 2146883 - RNA, 15 nt, Human herpesvirus 7
aguucguaaaaagaa

SEQ ID NO: 2146884 - RNA, 13 nt, Human herpesvirus 7
cauacaaugaauu

SEQ ID NO: 2146885 - RNA, 20 nt, Human herpesvirus 7
cauuagcauugaaaucauuu

SEQ ID NO: 2146886 - RNA, 16 nt, Human herpesvirus 7
cauuaaacagcauuuu

SEQ ID NO: 2146887 - RNA, 21 nt, Human herpesvirus 7
aauauacuuuagcgcugaaau

SEQ ID NO: 2146888 - RNA, 21 nt, Human herpesvirus 7
acuugaauagguaucuuuacu

SEQ ID NO: 2146889 - RNA, 19 nt, Human herpesvirus 7
uguaccacgaauaucguug

SEQ ID NO: 2146890 - RNA, 21 nt, Human herpesvirus 7
ucucuuggaguuugucucauu

SEQ ID NO: 2146891 - RNA, 20 nt, Human herpesvirus 7
uucuggcaacaguucaaaaa

SEQ ID NO: 2146892 - RNA, 20 nt, Human herpesvirus 7
ggaaacaaauuguggagaga

SEQ ID NO: 2146893 - RNA, 21 nt, Human herpesvirus 7
ucuggagaacaauuagaauuu

SEQ ID NO: 2146894 - RNA, 20 nt, Human herpesvirus 7
aagcagacauugaagauugu

SEQ ID NO: 2146895 - RNA, 17 nt, Human herpesvirus 7
cugccaccauuucugaa

SEQ ID NO: 2146896 - RNA, 17 nt, Human herpesvirus 7
aaauggguuugggaaac

SEQ ID NO: 2146897 - RNA, 15 nt, Human herpesvirus 7
gacaaacagaaaaac

SEQ ID NO: 2146898 - RNA, 16 nt, Human herpesvirus 7
ugcagucaaagauuuu

SEQ ID NO: 2146899 - RNA, 14 nt, Human herpesvirus 7
aaauguuuuugcua

SEQ ID NO: 2146900 - RNA, 17 nt, Human herpesvirus 7
gauuccaaagagccucc

SEQ ID NO: 2146901 - RNA, 15 nt, Human herpesvirus 7
uaaagacaugaauca

SEQ ID NO: 2146902 - RNA, 18 nt, Human herpesvirus 7
gaaacaagguuuaaaaca

SEQ ID NO: 2146903 - RNA, 13 nt, Human herpesvirus 7
aauuuuaaaacug

SEQ ID NO: 2146904 - RNA, 14 nt, Human herpesvirus 7
uucagcgugacaga

SEQ ID NO: 2146905 - RNA, 20 nt, Human herpesvirus 7
gaguuguuaaaauuaaaacu

SEQ ID NO: 2146906 - RNA, 20 nt, Human herpesvirus 7
cacaggauuugggaaaauau

SEQ ID NO: 2146907 - RNA, 17 nt, Human herpesvirus 7
caaugguauaaagugcu

SEQ ID NO: 2146908 - RNA, 18 nt, Human herpesvirus 7
cuguugagucgaaugcau

SEQ ID NO: 2146909 - RNA, 15 nt, Human herpesvirus 7
agguaagaaaaauuu

SEQ ID NO: 2146910 - RNA, 13 nt, Human herpesvirus 7
uaacaaauuggaa

SEQ ID NO: 2146911 - RNA, 17 nt, Human herpesvirus 7
uuagaaaaaaaacauua

SEQ ID NO: 2146912 - RNA, 20 nt, Human herpesvirus 7
uuccuaaaaaaaaaggaaaa

SEQ ID NO: 2146913 - RNA, 23 nt, Human herpesvirus 7
aguuuguuucaauaugcaugcaa

SEQ ID NO: 2146914 - RNA, 13 nt, Human herpesvirus 7
acaugaucuugua

SEQ ID NO: 2146915 - RNA, 21 nt, Human herpesvirus 7
agcacccggcuuaaugaagac

SEQ ID NO: 2146916 - RNA, 18 nt, Human herpesvirus 7
ugauugcgaccaaagauc

SEQ ID NO: 2146917 - RNA, 22 nt, Human herpesvirus 7
ugcaguguuuuuuucugguaaa

SEQ ID NO: 2146918 - RNA, 14 nt, Human herpesvirus 7
uuuucggauaaaag

SEQ ID NO: 2146919 - RNA, 15 nt, Human herpesvirus 7
aaucaauccaaauaa

SEQ ID NO: 2146920 - RNA, 17 nt, Human herpesvirus 7
agaugucuaaaaguaca

SEQ ID NO: 2146921 - RNA, 23 nt, Human herpesvirus 7
acauucuccaguggcaguacuac

SEQ ID NO: 2146922 - RNA, 13 nt, Human herpesvirus 7
uucaagaaaucag

SEQ ID NO: 2146923 - RNA, 14 nt, Human herpesvirus 7
ggaacguuggggau

SEQ ID NO: 2146924 - RNA, 20 nt, Human herpesvirus 7
cucaaguagccgaaaaagaa

SEQ ID NO: 2146925 - RNA, 16 nt, Human herpesvirus 7
uuuuuaugugguuaaa

SEQ ID NO: 2146926 - RNA, 19 nt, Human herpesvirus 7
uagucaggaucuccuggaa

SEQ ID NO: 2146927 - RNA, 21 nt, Human herpesvirus 7
auucuuuugcgggaaaaaacg

SEQ ID NO: 2146928 - RNA, 19 nt, Human herpesvirus 7
uuaaucauaucuugcuuag

SEQ ID NO: 2146929 - RNA, 13 nt, Human herpesvirus 7
uauuagaauuggg

SEQ ID NO: 2146930 - RNA, 12 nt, Human herpesvirus 7
cuuagaaucuuu

SEQ ID NO: 2146931 - RNA, 14 nt, Human herpesvirus 7
ugcuuuguugucau

SEQ ID NO: 2146932 - RNA, 22 nt, Human herpesvirus 7
ccaguucuaucucaaaacaaac

SEQ ID NO: 2146933 - RNA, 19 nt, Human herpesvirus 7
auuauauccaauaaugcau

SEQ ID NO: 2146934 - RNA, 22 nt, Human herpesvirus 7
ggcaacaguucaaaaaaagaag

SEQ ID NO: 2146935 - RNA, 22 nt, Human herpesvirus 7
uucagaaaauaaaaguaaaaac

SEQ ID NO: 2146936 - RNA, 23 nt, Human herpesvirus 7
agcuugcuuaaaacuuugaaaau

SEQ ID NO: 2146937 - RNA, 12 nt, Human herpesvirus 7
aauuuugaagag

SEQ ID NO: 2146938 - RNA, 17 nt, Human herpesvirus 7
uaggaaucagaccagca

SEQ ID NO: 2146939 - RNA, 13 nt, Human herpesvirus 7
agaaacuaauaaa

SEQ ID NO: 2146940 - RNA, 21 nt, Human herpesvirus 7
auuuauuuguguuuuguaaau

SEQ ID NO: 2146941 - RNA, 19 nt, Human herpesvirus 7
caagguucuaaaaauucug

SEQ ID NO: 2146942 - RNA, 15 nt, Human herpesvirus 7
gacaacgacuacagg

SEQ ID NO: 2146943 - RNA, 17 nt, Human herpesvirus 7
aaucuaauuaaucugca

SEQ ID NO: 2146944 - RNA, 17 nt, Human herpesvirus 7
gaacaucccuggacaga

SEQ ID NO: 2146945 - RNA, 17 nt, Human herpesvirus 7
cugugucaauaaacuua

SEQ ID NO: 2146946 - RNA, 13 nt, Human herpesvirus 7
cgaugauauuguc

SEQ ID NO: 2146947 - RNA, 22 nt, Human herpesvirus 7
acaaucgcggggaaaaaaugag

SEQ ID NO: 2146948 - RNA, 16 nt, Human herpesvirus 7
ucaauaaaugguuuua

SEQ ID NO: 2146949 - RNA, 16 nt, Human herpesvirus 7
cucagaacuguuuuaa

SEQ ID NO: 2146950 - RNA, 21 nt, Human herpesvirus 7
ugcuuuagaauuagagugcuu

SEQ ID NO: 2146951 - RNA, 17 nt, Human herpesvirus 7
cugagaaaaacagacuu

SEQ ID NO: 2146952 - RNA, 22 nt, Human herpesvirus 7
auuuuuagcucuaaacaaacaa

SEQ ID NO: 2146953 - RNA, 15 nt, Human herpesvirus 7
uugguaaucugcucg

SEQ ID NO: 2146954 - RNA, 14 nt, Human herpesvirus 7
uggucgagaauaca

SEQ ID NO: 2146955 - RNA, 20 nt, Human herpesvirus 7
ucuuuauuuaagcuucaaaa

SEQ ID NO: 2146956 - RNA, 11 nt, Human herpesvirus 7
ccuaacaaaaa

SEQ ID NO: 2146957 - RNA, 17 nt, Human herpesvirus 7
aaaagcuaaaaaacgug

SEQ ID NO: 2146958 - RNA, 23 nt, Human herpesvirus 7
agacacggaguuuuuacucugug

SEQ ID NO: 2146959 - RNA, 19 nt, Human herpesvirus 7
uaguaaucacauuaucuug

SEQ ID NO: 2146960 - RNA, 22 nt, Human herpesvirus 7
uguuuucaaauaucucuguuuu

SEQ ID NO: 2146961 - RNA, 20 nt, Human herpesvirus 7
aaagauuaaaaaaaaaagaa

SEQ ID NO: 2146962 - RNA, 12 nt, Human herpesvirus 7
aacucuucuuua

SEQ ID NO: 2146963 - RNA, 22 nt, Human herpesvirus 7
cugcuaauucuggaaaauguga

SEQ ID NO: 2146964 - RNA, 19 nt, Human herpesvirus 7
gauucacauugucacugca

SEQ ID NO: 2146965 - RNA, 19 nt, Human herpesvirus 7
uugcgcuguugguuaugca

SEQ ID NO: 2146966 - RNA, 19 nt, Human herpesvirus 7
caaaggaaaaaugcugcuc

SEQ ID NO: 2146967 - RNA, 20 nt, Human herpesvirus 7
guacauuuuaccaaauaugu

SEQ ID NO: 2146968 - RNA, 20 nt, Human herpesvirus 7
aauuauuuaaacagcguuca

SEQ ID NO: 2146969 - RNA, 20 nt, Human herpesvirus 7
auuucuauuagauaaugaca

SEQ ID NO: 2146970 - RNA, 13 nt, Human herpesvirus 7
aaaaugauaugac

SEQ ID NO: 2146971 - RNA, 19 nt, Human herpesvirus 7
uuuaacugauaauuucuac

SEQ ID NO: 2146972 - RNA, 14 nt, Human herpesvirus 7
ucauagguugcuau

SEQ ID NO: 2146973 - RNA, 20 nt, Human herpesvirus 7
auaguuugguuauccaaguu

SEQ ID NO: 2146974 - RNA, 15 nt, Human herpesvirus 7
caaugguaagcaaaa

SEQ ID NO: 2146975 - RNA, 13 nt, Human herpesvirus 7
caggcaaugcaag

SEQ ID NO: 2146976 - RNA, 19 nt, Human herpesvirus 7
aguuauaugaaauuucaaa

SEQ ID NO: 2146977 - RNA, 12 nt, Human herpesvirus 7
acagaaacaugu

SEQ ID NO: 2146978 - RNA, 18 nt, Human herpesvirus 7
acugauuuuuuuaauaau

SEQ ID NO: 2146979 - RNA, 17 nt, Human herpesvirus 7
accgguuaaaaugggaa

SEQ ID NO: 2146980 - RNA, 16 nt, Human herpesvirus 7
uugaauagguaucuuu

SEQ ID NO: 2146981 - RNA, 17 nt, Human herpesvirus 7
aaacaggcauuuaagaa

SEQ ID NO: 2146982 - RNA, 15 nt, Human herpesvirus 7
ucuauuaaauauuua

SEQ ID NO: 2146983 - RNA, 12 nt, Human herpesvirus 7
ugguaaaaagac

SEQ ID NO: 2146984 - RNA, 19 nt, Human herpesvirus 7
ucaauaugcaugcaauuuu

SEQ ID NO: 2146985 - RNA, 18 nt, Human herpesvirus 7
cuuugucaugacuggaca

SEQ ID NO: 2146986 - RNA, 22 nt, Human herpesvirus 7
aauuauuuccagaguaugaauu

SEQ ID NO: 2146987 - RNA, 22 nt, Human herpesvirus 7
uuuuauucagacaaguaaaagc

SEQ ID NO: 2146988 - RNA, 13 nt, Human herpesvirus 7
ucacauugucacu

SEQ ID NO: 2146989 - RNA, 15 nt, Human herpesvirus 7
ccagauuucuggcaa

SEQ ID NO: 2146990 - RNA, 17 nt, Human herpesvirus 7
ugcguuaaugucucugu

SEQ ID NO: 2146991 - RNA, 17 nt, Human herpesvirus 7
aguucuuugaaauagug

SEQ ID NO: 2146992 - RNA, 20 nt, Human herpesvirus 7
accgucauuuaauuggcaac

SEQ ID NO: 2146993 - RNA, 16 nt, Human herpesvirus 7
cuaagguuugaagagu

SEQ ID NO: 2146994 - RNA, 20 nt, Human herpesvirus 7
acagaucuugcuuuagaaca

SEQ ID NO: 2146995 - RNA, 18 nt, Human herpesvirus 7
aaaguaaaaacuuuucuu

SEQ ID NO: 2146996 - RNA, 17 nt, Human herpesvirus 7
ucaagaucgauuaaauc

SEQ ID NO: 2146997 - RNA, 16 nt, Human herpesvirus 7
aacuagaaaaacacua

SEQ ID NO: 2146998 - RNA, 19 nt, Human herpesvirus 7
uaacauauguugauucucu

SEQ ID NO: 2146999 - RNA, 21 nt, Human herpesvirus 7
caaaacgccuugggcacacca

SEQ ID NO: 2147000 - RNA, 18 nt, Human herpesvirus 7
aauauuuauuugcuuuua

SEQ ID NO: 2147001 - RNA, 23 nt, Human herpesvirus 7
uuacaaauuuuucggauaaaagg

SEQ ID NO: 2147002 - RNA, 14 nt, Human herpesvirus 7
cgaaaagacaacaa

SEQ ID NO: 2147003 - RNA, 13 nt, Human herpesvirus 7
cgagauuccaaag

SEQ ID NO: 2147004 - RNA, 19 nt, Human herpesvirus 7
uacaauaugacgacuuuga

SEQ ID NO: 2147005 - RNA, 16 nt, Human herpesvirus 7
augacaaacaaaaaua

SEQ ID NO: 2147006 - RNA, 18 nt, Human herpesvirus 7
agucaaucacaguugcuu

SEQ ID NO: 2147007 - RNA, 15 nt, Human herpesvirus 7
auucuaaauuaaaaa

SEQ ID NO: 2147008 - RNA, 14 nt, Human herpesvirus 7
aaugaccacaaccg

SEQ ID NO: 2147009 - RNA, 14 nt, Human herpesvirus 7
acuuaaauauuuua

SEQ ID NO: 2147010 - RNA, 16 nt, Human herpesvirus 7
gcauaucaugauuaua

SEQ ID NO: 2147011 - RNA, 14 nt, Human herpesvirus 7
uuacaaaaaguaga

SEQ ID NO: 2147012 - RNA, 13 nt, Human herpesvirus 7
gcuaucugauuua

SEQ ID NO: 2147013 - RNA, 14 nt, Human herpesvirus 7
ugcuuaaggacagg

SEQ ID NO: 2147014 - RNA, 14 nt, Human herpesvirus 7
cuacuguuaagaau

SEQ ID NO: 2147015 - RNA, 20 nt, Human herpesvirus 7
ggcaauagauuacgcacaaa

SEQ ID NO: 2147016 - RNA, 15 nt, Human herpesvirus 7
auuuaaaauuaauaa

SEQ ID NO: 2147017 - RNA, 22 nt, Human herpesvirus 7
aucuaccccgauccucagaaug

SEQ ID NO: 2147018 - RNA, 12 nt, Human herpesvirus 7
aggaaauugcuu

SEQ ID NO: 2147019 - RNA, 14 nt, Human herpesvirus 7
cuuucguuuucaaa

SEQ ID NO: 2147020 - RNA, 21 nt, Human herpesvirus 7
uaugaaaagcccaaacuguuu

SEQ ID NO: 2147021 - RNA, 16 nt, Human herpesvirus 7
uugucauacaaugaau

SEQ ID NO: 2147022 - RNA, 17 nt, Human herpesvirus 7
gcuuguuaaagaaaagc

SEQ ID NO: 2147023 - RNA, 23 nt, Human herpesvirus 7
uucuucaaagucuaagguuugaa

SEQ ID NO: 2147024 - RNA, 22 nt, Human herpesvirus 7
aauuguuuuucuuucuugcaua

SEQ ID NO: 2147025 - RNA, 16 nt, Human herpesvirus 7
uuucguaucugugacu

SEQ ID NO: 2147026 - RNA, 17 nt, Human herpesvirus 7
gucacaaaagcuuugau

SEQ ID NO: 2147027 - RNA, 18 nt, Human herpesvirus 7
gaucuaagucuacaucau

SEQ ID NO: 2147028 - RNA, 15 nt, Human herpesvirus 7
gucaaaaaaaauuaa

SEQ ID NO: 2147029 - RNA, 19 nt, Human herpesvirus 7
uuauccaaguuuuaacaau

SEQ ID NO: 2147030 - RNA, 13 nt, Human herpesvirus 7
aauucgaaaugaa

SEQ ID NO: 2147031 - RNA, 12 nt, Human herpesvirus 7
uucacagaaauc

SEQ ID NO: 2147032 - RNA, 16 nt, Human herpesvirus 7
ugcugauccgccgaca

SEQ ID NO: 2147033 - RNA, 15 nt, Human herpesvirus 7
uuaccgguacauuua

SEQ ID NO: 2147034 - RNA, 18 nt, Human herpesvirus 7
auaacccacuaacauuuu

SEQ ID NO: 2147035 - RNA, 14 nt, Human herpesvirus 7
ugccauuacugauc

SEQ ID NO: 2147036 - RNA, 13 nt, Human herpesvirus 7
auaaauaaaaugu

SEQ ID NO: 2147037 - RNA, 16 nt, Human herpesvirus 7
aaugucucuguuccca

SEQ ID NO: 2147038 - RNA, 16 nt, Human herpesvirus 7
uuggauuuucuguaau

SEQ ID NO: 2147039 - RNA, 18 nt, Human herpesvirus 7
aguaaaacucaauguaaa

SEQ ID NO: 2147040 - RNA, 22 nt, Human herpesvirus 7
auacaacugcagaaauuuuuaa

SEQ ID NO: 2147041 - RNA, 16 nt, Human herpesvirus 7
uauauagcaauauuua

SEQ ID NO: 2147042 - RNA, 13 nt, Human herpesvirus 7
aagacaucgaaga

SEQ ID NO: 2147043 - RNA, 16 nt, Human herpesvirus 7
auuguccuuucaacga

SEQ ID NO: 2147044 - RNA, 17 nt, Human herpesvirus 7
aguuuuacagaaauuga

SEQ ID NO: 2147045 - RNA, 17 nt, Human herpesvirus 7
uuccugcaauaauaaac

SEQ ID NO: 2147046 - RNA, 19 nt, Human herpesvirus 7
uuugaucaaaaucuguaga

SEQ ID NO: 2147047 - RNA, 20 nt, Human herpesvirus 7
cugcaacaaauuaaauacuu

SEQ ID NO: 2147048 - RNA, 23 nt, Human herpesvirus 7
uuaaguaaggaagguacaucuuu

SEQ ID NO: 2147049 - RNA, 14 nt, Human herpesvirus 7
uaaauaauaacaau

SEQ ID NO: 2147050 - RNA, 18 nt, Human herpesvirus 7
auuauuuugauuggaaau

SEQ ID NO: 2147051 - RNA, 19 nt, Human herpesvirus 7
ccacuaugccacaaaaaac

SEQ ID NO: 2147052 - RNA, 11 nt, Human herpesvirus 7
uugaaaaccau

SEQ ID NO: 2147053 - RNA, 21 nt, Human herpesvirus 7
ucagcacugggagcaaugcau

SEQ ID NO: 2147054 - RNA, 20 nt, Human herpesvirus 7
ccuacgcagcaauguauaua

SEQ ID NO: 2147055 - RNA, 17 nt, Human herpesvirus 7
gaacauuugaagauaag

SEQ ID NO: 2147056 - RNA, 16 nt, Human herpesvirus 7
uacucagaagacauau

SEQ ID NO: 2147057 - RNA, 15 nt, Human herpesvirus 7
uuaaaauauuagaac

SEQ ID NO: 2147058 - RNA, 13 nt, Human herpesvirus 7
agauaaugacaaa

SEQ ID NO: 2147059 - RNA, 23 nt, Human herpesvirus 7
uagaaaauaacuuuaaauuauua

SEQ ID NO: 2147060 - RNA, 11 nt, Human herpesvirus 7
aacaaugacuu

SEQ ID NO: 2147061 - RNA, 12 nt, Human herpesvirus 7
ugucaggaagca

SEQ ID NO: 2147062 - RNA, 19 nt, Human herpesvirus 7
ugugcaauuuggcucugau

SEQ ID NO: 2147063 - RNA, 18 nt, Human herpesvirus 7
ccacacucauauuuuuca

SEQ ID NO: 2147064 - RNA, 19 nt, Human herpesvirus 7
ugcuggaaaacauuucaga

SEQ ID NO: 2147065 - RNA, 23 nt, Human herpesvirus 7
auccaaguuuuaacaaucuaagg

SEQ ID NO: 2147066 - RNA, 18 nt, Human herpesvirus 7
cucagauucgacuucuaa

SEQ ID NO: 2147067 - RNA, 14 nt, Human herpesvirus 7
aaugucucuguucc

SEQ ID NO: 2147068 - RNA, 22 nt, Human herpesvirus 7
gucaucuuauauuccuuugaaa

SEQ ID NO: 2147069 - RNA, 21 nt, Human herpesvirus 7
guuuuaauugagauuauucaa

SEQ ID NO: 2147070 - RNA, 18 nt, Human herpesvirus 7
aauuguaguuuuugcaua

SEQ ID NO: 2147071 - RNA, 15 nt, Human herpesvirus 7
aaaauuuuagacgca

SEQ ID NO: 2147072 - RNA, 22 nt, Human herpesvirus 7
acgcaugcuugcuuugcauaga

SEQ ID NO: 2147073 - RNA, 21 nt, Human herpesvirus 7
auuguagagguccaauagaaa

SEQ ID NO: 2147074 - RNA, 11 nt, Human herpesvirus 7
uaaaacuguuu

SEQ ID NO: 2147075 - RNA, 13 nt, Human herpesvirus 7
augcuaaaguuaa

SEQ ID NO: 2147076 - RNA, 23 nt, Human herpesvirus 7
uaauugcagacuaauuacagcua

SEQ ID NO: 2147077 - RNA, 17 nt, Human herpesvirus 7
gucaaauuuauauuuua

SEQ ID NO: 2147078 - RNA, 22 nt, Human herpesvirus 7
cuggcucuuuacaaaauucaac

SEQ ID NO: 2147079 - RNA, 22 nt, Human herpesvirus 7
uggucagaacaucccuggacag

SEQ ID NO: 2147080 - RNA, 13 nt, Human herpesvirus 7
auuuuacaaaaag

SEQ ID NO: 2147081 - RNA, 16 nt, Human herpesvirus 7
aauaaauuaauuccuu

SEQ ID NO: 2147082 - RNA, 18 nt, Human herpesvirus 7
cauggggcauuaauucuu

SEQ ID NO: 2147083 - RNA, 14 nt, Human herpesvirus 7
aauuuggaaauugu

SEQ ID NO: 2147084 - RNA, 14 nt, Human herpesvirus 7
cgaaagccacuguu

SEQ ID NO: 2147085 - RNA, 18 nt, Human herpesvirus 7
aaaagccauaaaauguac

SEQ ID NO: 2147086 - RNA, 22 nt, Human herpesvirus 7
agcagcuuaagacaccccaaaa

SEQ ID NO: 2147087 - RNA, 24 nt, Human herpesvirus 7
aaaauuauaauaacaaacgauuug

SEQ ID NO: 2147088 - RNA, 19 nt, Human herpesvirus 7
uuggguagguuaagccuag

SEQ ID NO: 2147089 - RNA, 18 nt, Human herpesvirus 7
uaucucuguaaaacguuc

SEQ ID NO: 2147090 - RNA, 19 nt, Human herpesvirus 7
auuucaaaaucagaaaugu

SEQ ID NO: 2147091 - RNA, 13 nt, Human herpesvirus 7
cagaaaucccaaa

SEQ ID NO: 2147092 - RNA, 19 nt, Human herpesvirus 7
gauacguuaguugcagcug

SEQ ID NO: 2147093 - RNA, 23 nt, Human herpesvirus 7
aggacuuuacacggucuuaucua

SEQ ID NO: 2147094 - RNA, 13 nt, Human herpesvirus 7
aaacagcugaaaa

SEQ ID NO: 2147095 - RNA, 22 nt, Human herpesvirus 7
cuaacuauaauagccuuucacu

SEQ ID NO: 2147096 - RNA, 15 nt, Human herpesvirus 7
ugguuggauuucaau

SEQ ID NO: 2147097 - RNA, 19 nt, Human herpesvirus 7
aaugcaacaucuuaaaugu

SEQ ID NO: 2147098 - RNA, 20 nt, Human herpesvirus 7
ucuaaaguggagacaaucua

SEQ ID NO: 2147099 - RNA, 16 nt, Human herpesvirus 7
ggaggugcuguuucca

SEQ ID NO: 2147100 - RNA, 22 nt, Human herpesvirus 7
agcaagugucuuuuauuacucg

SEQ ID NO: 2147101 - RNA, 12 nt, Human herpesvirus 7
uuaaauuauuau

SEQ ID NO: 2147102 - RNA, 15 nt, Human herpesvirus 7
auuuauugaugucaa

SEQ ID NO: 2147103 - RNA, 19 nt, Human herpesvirus 7
guauugccuuucccagaag

SEQ ID NO: 2147104 - RNA, 15 nt, Human herpesvirus 7
agaaaguccaaagug

SEQ ID NO: 2147105 - RNA, 14 nt, Human herpesvirus 7
auugguaauuagug

SEQ ID NO: 2147106 - RNA, 16 nt, Human herpesvirus 7
ugguauugucuacaau

SEQ ID NO: 2147107 - RNA, 15 nt, Human herpesvirus 7
uguuccacgaucauu

SEQ ID NO: 2147108 - RNA, 15 nt, Human herpesvirus 7
uaugaguuugauugu

SEQ ID NO: 2147109 - RNA, 20 nt, Human herpesvirus 7
uguucuaucaagauaagcaa

SEQ ID NO: 2147110 - RNA, 22 nt, Human herpesvirus 7
aaucaaccaacauucuugucaa

SEQ ID NO: 2147111 - RNA, 14 nt, Human herpesvirus 7
augaaacuuccaau

SEQ ID NO: 2147112 - RNA, 13 nt, Human herpesvirus 7
agcuagaaauuga

SEQ ID NO: 2147113 - RNA, 20 nt, Human herpesvirus 7
ucagaaaaaccauuguauga

SEQ ID NO: 2147114 - RNA, 22 nt, Human herpesvirus 7
aaagaccuguacuguugcuaau

SEQ ID NO: 2147115 - RNA, 17 nt, Human herpesvirus 7
augcagaaaaauccaaa

SEQ ID NO: 2147116 - RNA, 22 nt, Human herpesvirus 7
cuuaucugucauggacggcauu

SEQ ID NO: 2147117 - RNA, 15 nt, Human herpesvirus 7
auuuauauuaaauga

SEQ ID NO: 2147118 - RNA, 18 nt, Human herpesvirus 7
gagauggauugagugcau

SEQ ID NO: 2147119 - RNA, 19 nt, Human herpesvirus 7
gcugaauuguacguucuga

SEQ ID NO: 2147120 - RNA, 18 nt, Human herpesvirus 7
gaaaugagauuucugaaa

SEQ ID NO: 2147121 - RNA, 21 nt, Human herpesvirus 7
ugugaacugauguuuggcaac

SEQ ID NO: 2147122 - RNA, 14 nt, Human herpesvirus 7
cuuuucaugcuuug

SEQ ID NO: 2147123 - RNA, 19 nt, Human herpesvirus 7
acuaucuccuaaaugaauu

SEQ ID NO: 2147124 - RNA, 17 nt, Human herpesvirus 7
uuucaaacaacauaucg

SEQ ID NO: 2147125 - RNA, 12 nt, Human herpesvirus 7
uauaauagccuu

SEQ ID NO: 2147126 - RNA, 16 nt, Human herpesvirus 7
cuggaacguccucugg

SEQ ID NO: 2147127 - RNA, 16 nt, Human herpesvirus 7
acgcagucuaaaagua

SEQ ID NO: 2147128 - RNA, 22 nt, Human herpesvirus 7
agcaauuuuaacgauuccaaac

SEQ ID NO: 2147129 - RNA, 21 nt, Human herpesvirus 7
cuugugaaaauaacaggaaac

SEQ ID NO: 2147130 - RNA, 20 nt, Human herpesvirus 7
uaaacacuugcuagcuguga

SEQ ID NO: 2147131 - RNA, 13 nt, Human herpesvirus 7
ugcuaugaaaauu

SEQ ID NO: 2147132 - RNA, 20 nt, Human herpesvirus 7
uguuuaaauuacaguaaauu

SEQ ID NO: 2147133 - RNA, 20 nt, Human herpesvirus 7
cugacauuggaacuuuaugc

SEQ ID NO: 2147134 - RNA, 21 nt, Human herpesvirus 7
acuuauuccagauaugacaaa

SEQ ID NO: 2147135 - RNA, 14 nt, Human herpesvirus 7
uaauguaauuuaug

SEQ ID NO: 2147136 - RNA, 14 nt, Human herpesvirus 7
aucuguagaaaaug

SEQ ID NO: 2147137 - RNA, 16 nt, Human herpesvirus 7
guuuacuuauguguua

SEQ ID NO: 2147138 - RNA, 20 nt, Human herpesvirus 7
uuagaugcauccaaagaaaa

SEQ ID NO: 2147139 - RNA, 17 nt, Human herpesvirus 7
aggcagcgcuugauaca

SEQ ID NO: 2147140 - RNA, 14 nt, Human herpesvirus 7
guacuguugcuaau

SEQ ID NO: 2147141 - RNA, 15 nt, Human herpesvirus 7
agaaacagcugaaaa

SEQ ID NO: 2147142 - RNA, 16 nt, Human herpesvirus 7
uuuguauacaacuuua

SEQ ID NO: 2147143 - RNA, 14 nt, Human herpesvirus 7
cuccaaucauaauu

SEQ ID NO: 2147144 - RNA, 15 nt, Human herpesvirus 7
auuuuacaaaaagaa

SEQ ID NO: 2147145 - RNA, 12 nt, Human herpesvirus 7
aaacuuugaaau

SEQ ID NO: 2147146 - RNA, 16 nt, Human herpesvirus 7
gaaugcucuuuugaaa

SEQ ID NO: 2147147 - RNA, 15 nt, Human herpesvirus 7
cuguuaaaaucuguu

SEQ ID NO: 2147148 - RNA, 19 nt, Human herpesvirus 7
cuugcuuguaggcagaaau

SEQ ID NO: 2147149 - RNA, 15 nt, Human herpesvirus 7
cagcuagauugacua

SEQ ID NO: 2147150 - RNA, 17 nt, Human herpesvirus 7
auuucugucuuugcaag

SEQ ID NO: 2147151 - RNA, 20 nt, Human herpesvirus 7
ugauucgcuaacuuugcuau

SEQ ID NO: 2147152 - RNA, 21 nt, Human herpesvirus 7
uaagcauacuuucgcaacaau

SEQ ID NO: 2147153 - RNA, 15 nt, Human herpesvirus 7
aucucucaacgacaa

SEQ ID NO: 2147154 - RNA, 15 nt, Human herpesvirus 7
auauaaaagaaacuu

SEQ ID NO: 2147155 - RNA, 13 nt, Human herpesvirus 7
auuuguaugucua

SEQ ID NO: 2147156 - RNA, 16 nt, Human herpesvirus 7
uuaccccaaacgccuu

SEQ ID NO: 2147157 - RNA, 12 nt, Human herpesvirus 7
accgauaaaagg

SEQ ID NO: 2147158 - RNA, 23 nt, Human herpesvirus 7
uaagugaacuguuacaguuaaag

SEQ ID NO: 2147159 - RNA, 17 nt, Human herpesvirus 7
ugagacucacuccuugc

SEQ ID NO: 2147160 - RNA, 15 nt, Human herpesvirus 7
aauguugcaaauguu

SEQ ID NO: 2147161 - RNA, 18 nt, Human herpesvirus 7
aguucuccgcacuaaaac

SEQ ID NO: 2147162 - RNA, 15 nt, Human herpesvirus 7
auuauguuuucugcu

SEQ ID NO: 2147163 - RNA, 21 nt, Human herpesvirus 7
auuauuuccagaguaugaauu

SEQ ID NO: 2147164 - RNA, 19 nt, Human herpesvirus 7
aauucucgcuucaaagaua

SEQ ID NO: 2147165 - RNA, 14 nt, Human herpesvirus 7
aaaaauaaacaaua

SEQ ID NO: 2147166 - RNA, 17 nt, Human herpesvirus 7
aauuuucuuagcuuuca

SEQ ID NO: 2147167 - RNA, 19 nt, Human herpesvirus 7
aagcgcugagaucuuccaa

SEQ ID NO: 2147168 - RNA, 15 nt, Human herpesvirus 7
guuuaaaggugguua

SEQ ID NO: 2147169 - RNA, 16 nt, Human herpesvirus 7
aagagacugucauaau

SEQ ID NO: 2147170 - RNA, 16 nt, Human herpesvirus 7
cugaauaauaugcuuu

SEQ ID NO: 2147171 - RNA, 12 nt, Human herpesvirus 7
aacauugugagu

SEQ ID NO: 2147172 - RNA, 22 nt, Human herpesvirus 7
uuugcagcuucuaaaugugcua

SEQ ID NO: 2147173 - RNA, 15 nt, Human herpesvirus 7
agugcuaugaaaauu

SEQ ID NO: 2147174 - RNA, 17 nt, Human herpesvirus 7
ugaugacaacaaagcau

SEQ ID NO: 2147175 - RNA, 14 nt, Human herpesvirus 7
cauuauuuguuaaa

SEQ ID NO: 2147176 - RNA, 19 nt, Human herpesvirus 7
agaaucagacuaaauaugg

SEQ ID NO: 2147177 - RNA, 15 nt, Human herpesvirus 7
aggcggacaaauaua

SEQ ID NO: 2147178 - RNA, 19 nt, Human herpesvirus 7
uucuagaaacuaaagaaaa

SEQ ID NO: 2147179 - RNA, 15 nt, Human herpesvirus 7
ugaacaaguuucaaa

SEQ ID NO: 2147180 - RNA, 13 nt, Human herpesvirus 7
auacaaaagacau

SEQ ID NO: 2147181 - RNA, 20 nt, Human herpesvirus 7
guuuugaaaagucauuauuu

SEQ ID NO: 2147182 - RNA, 16 nt, Human herpesvirus 7
agcauacuuucgcaac

SEQ ID NO: 2147183 - RNA, 16 nt, Human herpesvirus 7
cgguaacaugucuuca

SEQ ID NO: 2147184 - RNA, 20 nt, Human herpesvirus 7
agauuuaaaacaauuuccuu

SEQ ID NO: 2147185 - RNA, 16 nt, Human herpesvirus 7
aauaugcaugcaauuu

SEQ ID NO: 2147186 - RNA, 22 nt, Human herpesvirus 7
uggacggcauuuaacucaugcg

SEQ ID NO: 2147187 - RNA, 17 nt, Human herpesvirus 7
ugauuuuaaauuuacuu

SEQ ID NO: 2147188 - RNA, 21 nt, Human herpesvirus 7
uccuuucaacgaucucaaaau

SEQ ID NO: 2147189 - RNA, 22 nt, Human herpesvirus 7
aagcuugugaagacuacauaaa

SEQ ID NO: 2147190 - RNA, 22 nt, Human herpesvirus 7
acacuauuggacaaaagacugu

SEQ ID NO: 2147191 - RNA, 23 nt, Human herpesvirus 7
aacuguuacaguuaaagacggaa

SEQ ID NO: 2147192 - RNA, 13 nt, Human herpesvirus 7
uaacauauguuga

SEQ ID NO: 2147193 - RNA, 12 nt, Human herpesvirus 7
agcucaaaaagu

SEQ ID NO: 2147194 - RNA, 16 nt, Human herpesvirus 7
aguugacaaugucaau

SEQ ID NO: 2147195 - RNA, 15 nt, Human herpesvirus 7
ucaucaaaauuuuaa

SEQ ID NO: 2147196 - RNA, 14 nt, Human herpesvirus 7
auucucuacuuaau

SEQ ID NO: 2147197 - RNA, 17 nt, Human herpesvirus 7
acuccguuucauuuaaa

SEQ ID NO: 2147198 - RNA, 17 nt, Human herpesvirus 7
cauucuuuucaaugcaa

SEQ ID NO: 2147199 - RNA, 16 nt, Human herpesvirus 7
acucgaggcuuaaaau

SEQ ID NO: 2147200 - RNA, 23 nt, Human herpesvirus 7
cuaaccaucugcuggaaauuugu

SEQ ID NO: 2147201 - RNA, 15 nt, Human herpesvirus 7
ucguuuuuggcaaaa

SEQ ID NO: 2147202 - RNA, 18 nt, Human herpesvirus 7
accgacaauauaaaagaa

SEQ ID NO: 2147203 - RNA, 17 nt, Human herpesvirus 7
uauauccaauaaugcau

SEQ ID NO: 2147204 - RNA, 16 nt, Human herpesvirus 7
uugaagauaaguauaa

SEQ ID NO: 2147205 - RNA, 19 nt, Human herpesvirus 7
uaucuccgugacaaagcau

SEQ ID NO: 2147206 - RNA, 17 nt, Human herpesvirus 7
acuuuuaacuguuaaag

SEQ ID NO: 2147207 - RNA, 20 nt, Human herpesvirus 7
ucaaaaaauaauuccuucua

SEQ ID NO: 2147208 - RNA, 22 nt, Human herpesvirus 7
acagcuagauugacuaugaauu

SEQ ID NO: 2147209 - RNA, 22 nt, Human herpesvirus 7
agacuaaucacgagaaaaauau

SEQ ID NO: 2147210 - RNA, 14 nt, Human herpesvirus 7
acagcucaaaagua

SEQ ID NO: 2147211 - RNA, 16 nt, Human herpesvirus 7
ugguugauuugagcag

SEQ ID NO: 2147212 - RNA, 13 nt, Human herpesvirus 7
aauauaacaaaaa

SEQ ID NO: 2147213 - RNA, 17 nt, Human herpesvirus 7
auuagcgcgugaacaaa

SEQ ID NO: 2147214 - RNA, 18 nt, Human herpesvirus 7
auuguaaauauuauuaac

SEQ ID NO: 2147215 - RNA, 22 nt, Human herpesvirus 7
aauuguacguucugaaacaguc

SEQ ID NO: 2147216 - RNA, 16 nt, Human herpesvirus 7
aacugaauuaaggugg

SEQ ID NO: 2147217 - RNA, 15 nt, Human herpesvirus 7
auggagcagcuuaag

SEQ ID NO: 2147218 - RNA, 20 nt, Human herpesvirus 7
uacacaaauugauccugcua

SEQ ID NO: 2147219 - RNA, 19 nt, Human herpesvirus 7
gaaugauauaaaguuuaua

SEQ ID NO: 2147220 - RNA, 12 nt, Human herpesvirus 7
auaauagagcug

SEQ ID NO: 2147221 - RNA, 16 nt, Human herpesvirus 7
acuuacuguuuacaca

SEQ ID NO: 2147222 - RNA, 13 nt, Human herpesvirus 7
guuaaagauguuu

SEQ ID NO: 2147223 - RNA, 19 nt, Human herpesvirus 7
accaaugcugauuccuucu

SEQ ID NO: 2147224 - RNA, 18 nt, Human herpesvirus 7
acuuguuuguagcucuag

SEQ ID NO: 2147225 - RNA, 22 nt, Human herpesvirus 7
cauacuuuuuugguuauuggaa

SEQ ID NO: 2147226 - RNA, 17 nt, Human herpesvirus 7
gcauuauuggauaauau

SEQ ID NO: 2147227 - RNA, 11 nt, Human herpesvirus 7
ccuugggcaca

SEQ ID NO: 2147228 - RNA, 17 nt, Human herpesvirus 7
uuaaaauuaaaacuugg

SEQ ID NO: 2147229 - RNA, 23 nt, Human herpesvirus 7
uuuucaaguuucuucuggguuaa

SEQ ID NO: 2147230 - RNA, 20 nt, Human herpesvirus 7
aucuaauuaaucugcauaua

SEQ ID NO: 2147231 - RNA, 20 nt, Human herpesvirus 7
uuguuuccgaucuaaagaca

SEQ ID NO: 2147232 - RNA, 13 nt, Human herpesvirus 7
aauuuuuuacugu

SEQ ID NO: 2147233 - RNA, 15 nt, Human herpesvirus 7
cuuaaaaaaaggccu

SEQ ID NO: 2147234 - RNA, 22 nt, Human herpesvirus 7
auguggucuggucuucauauuu

SEQ ID NO: 2147235 - RNA, 23 nt, Human herpesvirus 7
cuagacauuuguuuuggauauaa

SEQ ID NO: 2147236 - RNA, 18 nt, Human herpesvirus 7
uacauaaguuaaaucagu

SEQ ID NO: 2147237 - RNA, 22 nt, Human herpesvirus 7
agauauugaugacguuaucuaa

SEQ ID NO: 2147238 - RNA, 14 nt, Human herpesvirus 7
ggcaaaagauuuaa

SEQ ID NO: 2147239 - RNA, 19 nt, Human herpesvirus 7
acuucugauaucuuaaaau

SEQ ID NO: 2147240 - RNA, 19 nt, Human herpesvirus 7
gccagaaauuaaauacaaa

SEQ ID NO: 2147241 - RNA, 18 nt, Human herpesvirus 7
agagaacuagaacagcug

SEQ ID NO: 2147242 - RNA, 21 nt, Human herpesvirus 7
gaagcgcugagaucuuccaau

SEQ ID NO: 2147243 - RNA, 15 nt, Human herpesvirus 7
aaaacucaauguaaa

SEQ ID NO: 2147244 - RNA, 15 nt, Human herpesvirus 7
aaacuguuuuuacuu

SEQ ID NO: 2147245 - RNA, 21 nt, Human herpesvirus 7
ugcacuuagcuaauugagaaa

SEQ ID NO: 2147246 - RNA, 21 nt, Human herpesvirus 7
ucguaacgaauaaaaaguuuu

SEQ ID NO: 2147247 - RNA, 22 nt, Human herpesvirus 7
cgaucuaaagacacuuauuuga

SEQ ID NO: 2147248 - RNA, 23 nt, Human herpesvirus 7
ucgauguuuuaucuaacacugca

SEQ ID NO: 2147249 - RNA, 17 nt, Human herpesvirus 7
uauacauguaacuguuu

SEQ ID NO: 2147250 - RNA, 21 nt, Human herpesvirus 7
uuucuaggcuucauuggcauu

SEQ ID NO: 2147251 - RNA, 11 nt, Human herpesvirus 7
cucauagcuua

SEQ ID NO: 2147252 - RNA, 22 nt, Human herpesvirus 7
uaugcuuccuaaaaaaaaagga

SEQ ID NO: 2147253 - RNA, 24 nt, Human herpesvirus 7
cuuuacagcugagacgauaugaau

SEQ ID NO: 2147254 - RNA, 22 nt, Human herpesvirus 7
cugcaaagaaaaaaaugcuuag

SEQ ID NO: 2147255 - RNA, 12 nt, Human herpesvirus 7
aucugagagaac

SEQ ID NO: 2147256 - RNA, 22 nt, Human herpesvirus 7
aaacugaauugguaauguuacu

SEQ ID NO: 2147257 - RNA, 14 nt, Human herpesvirus 7
ucagauugaaauuc

SEQ ID NO: 2147258 - RNA, 15 nt, Human herpesvirus 7
guacuguuucuagua

SEQ ID NO: 2147259 - RNA, 23 nt, Human herpesvirus 7
cuuuaauaaaaaacaaauaacug

SEQ ID NO: 2147260 - RNA, 15 nt, Human herpesvirus 7
ucacaucuagaguau

SEQ ID NO: 2147261 - RNA, 23 nt, Human herpesvirus 7
caugucucucgcaacuucugaua

SEQ ID NO: 2147262 - RNA, 19 nt, Human herpesvirus 7
uuggagagauagcauuugu

SEQ ID NO: 2147263 - RNA, 13 nt, Human herpesvirus 7
ugucugauucuua

SEQ ID NO: 2147264 - RNA, 14 nt, Human herpesvirus 7
accuauguguuuac

SEQ ID NO: 2147265 - RNA, 18 nt, Human herpesvirus 7
aaaaaggccuuguaaagu

SEQ ID NO: 2147266 - RNA, 21 nt, Human herpesvirus 7
caggugacgucuagacauuug

SEQ ID NO: 2147267 - RNA, 16 nt, Human herpesvirus 7
cagcuggaguuauuua

SEQ ID NO: 2147268 - RNA, 13 nt, Human herpesvirus 7
aucgaguucugac

SEQ ID NO: 2147269 - RNA, 21 nt, Human herpesvirus 7
augauugguaaaaaauuacuu

SEQ ID NO: 2147270 - RNA, 15 nt, Human herpesvirus 7
uaucuuaaaauacua

SEQ ID NO: 2147271 - RNA, 22 nt, Human herpesvirus 7
auaaaacgugugaaaacaauua

SEQ ID NO: 2147272 - RNA, 16 nt, Human herpesvirus 7
gucuaaggaauguggc

SEQ ID NO: 2147273 - RNA, 14 nt, Human herpesvirus 7
aaugagauuucuga

SEQ ID NO: 2147274 - RNA, 21 nt, Human herpesvirus 7
aagacagcucaaaaguauaac

SEQ ID NO: 2147275 - RNA, 22 nt, Human herpesvirus 7
uaccguuuaaugaaaaagccau

SEQ ID NO: 2147276 - RNA, 21 nt, Human herpesvirus 7
acugcaaauccaacagaauac

SEQ ID NO: 2147277 - RNA, 14 nt, Human herpesvirus 7
uauuauuaaagcuu

SEQ ID NO: 2147278 - RNA, 19 nt, Human herpesvirus 7
uaaauuaaaaagaaugcua

SEQ ID NO: 2147279 - RNA, 22 nt, Human herpesvirus 7
auacaaauuuaagagacauuga

SEQ ID NO: 2147280 - RNA, 18 nt, Human herpesvirus 7
aagggaucuuuuuucagu

SEQ ID NO: 2147281 - RNA, 20 nt, Human herpesvirus 7
uucagucuuacagugcucuu

SEQ ID NO: 2147282 - RNA, 14 nt, Human herpesvirus 7
uuuaaaacaauuuc

SEQ ID NO: 2147283 - RNA, 15 nt, Human herpesvirus 7
agcuauguuuaaaug

SEQ ID NO: 2147284 - RNA, 17 nt, Human herpesvirus 7
aaggucuuucaugcauu

SEQ ID NO: 2147285 - RNA, 17 nt, Human herpesvirus 7
cuagugaaacacauucu

SEQ ID NO: 2147286 - RNA, 14 nt, Human herpesvirus 7
gcauacaguuuauu

SEQ ID NO: 2147287 - RNA, 20 nt, Human herpesvirus 7
aaucuguaaaauuuaaauac

SEQ ID NO: 2147288 - RNA, 14 nt, Human herpesvirus 7
uccagcacuuuuuu

SEQ ID NO: 2147289 - RNA, 21 nt, Human herpesvirus 7
agguugcuucuucgagucagu

SEQ ID NO: 2147290 - RNA, 22 nt, Human herpesvirus 7
aacaaagugcauaaauaauaac

SEQ ID NO: 2147291 - RNA, 20 nt, Human herpesvirus 7
uauuggagaugucagcaaau

SEQ ID NO: 2147292 - RNA, 22 nt, Human herpesvirus 7
cacuaugccacaaaaaacuuug

SEQ ID NO: 2147293 - RNA, 14 nt, Human herpesvirus 7
uuuagaccuaucaa

SEQ ID NO: 2147294 - RNA, 17 nt, Human herpesvirus 7
cugcaaagaaaaaaaug

SEQ ID NO: 2147295 - RNA, 18 nt, Human herpesvirus 7
uguguaaaaaaaaguugu

SEQ ID NO: 2147296 - RNA, 17 nt, Human herpesvirus 7
uggagaccgcacaggcu

SEQ ID NO: 2147297 - RNA, 18 nt, Human herpesvirus 7
aaaacuccguuucauuua

SEQ ID NO: 2147298 - RNA, 16 nt, Human herpesvirus 7
accaucugcuggaaau

SEQ ID NO: 2147299 - RNA, 15 nt, Human herpesvirus 7
aaaacagaacuuuug

SEQ ID NO: 2147300 - RNA, 16 nt, Human herpesvirus 7
uugaucguguguuacu

SEQ ID NO: 2147301 - RNA, 16 nt, Human herpesvirus 7
aucaggaaucuuuuuu

SEQ ID NO: 2147302 - RNA, 17 nt, Human herpesvirus 7
cuggacauuucaagaag

SEQ ID NO: 2147303 - RNA, 15 nt, Human herpesvirus 7
gccuguuaaaaguga

SEQ ID NO: 2147304 - RNA, 14 nt, Human herpesvirus 7
caacuucaacauac

SEQ ID NO: 2147305 - RNA, 22 nt, Human herpesvirus 7
accaagagccggaaagcaaugu

SEQ ID NO: 2147306 - RNA, 20 nt, Human herpesvirus 7
auuugguauacacuauuuua

SEQ ID NO: 2147307 - RNA, 16 nt, Human herpesvirus 7
gaaacuuccaauaacc

SEQ ID NO: 2147308 - RNA, 21 nt, Human herpesvirus 7
auuuaugcgguaagaaaaauc

SEQ ID NO: 2147309 - RNA, 15 nt, Human herpesvirus 7
agaugauaaaaacuu

SEQ ID NO: 2147310 - RNA, 17 nt, Human herpesvirus 7
auuauaucuaaagugga

SEQ ID NO: 2147311 - RNA, 19 nt, Human herpesvirus 7
auuucacccuuuguuugag

SEQ ID NO: 2147312 - RNA, 15 nt, Human herpesvirus 7
cucaaaacaaacucu

SEQ ID NO: 2147313 - RNA, 19 nt, Human herpesvirus 7
acaucaauuuuaaugugcu

SEQ ID NO: 2147314 - RNA, 16 nt, Human herpesvirus 7
uucaguaucacuuaaa

SEQ ID NO: 2147315 - RNA, 15 nt, Human herpesvirus 7
aaguuagcgaaucau

SEQ ID NO: 2147316 - RNA, 17 nt, Human herpesvirus 7
auguuauacauaaagag

SEQ ID NO: 2147317 - RNA, 19 nt, Human herpesvirus 7
uauaugaaucaaauuucaa

SEQ ID NO: 2147318 - RNA, 17 nt, Human herpesvirus 7
uguccauuuuauucaaa

SEQ ID NO: 2147319 - RNA, 22 nt, Human herpesvirus 7
ucuuacgucuuuucuaccaaca

SEQ ID NO: 2147320 - RNA, 20 nt, Human herpesvirus 7
guaaauauuuuuaaaaucua

SEQ ID NO: 2147321 - RNA, 20 nt, Human herpesvirus 7
aauuuaagagacauugaaaa

SEQ ID NO: 2147322 - RNA, 15 nt, Human herpesvirus 7
gucuaaaaauguuuu

SEQ ID NO: 2147323 - RNA, 19 nt, Human herpesvirus 7
uguauuuguugaucuucaa

SEQ ID NO: 2147324 - RNA, 22 nt, Human herpesvirus 7
auuuagucggcacacguacaau

SEQ ID NO: 2147325 - RNA, 21 nt, Human herpesvirus 7
gaaaucuuucaucuucugaau

SEQ ID NO: 2147326 - RNA, 22 nt, Human herpesvirus 7
gaauucaucuuaaguaaggaag

SEQ ID NO: 2147327 - RNA, 16 nt, Human herpesvirus 7
uguaugaaaaaaacau

SEQ ID NO: 2147328 - RNA, 20 nt, Human herpesvirus 7
cagcacuuuuuugcguugcu

SEQ ID NO: 2147329 - RNA, 20 nt, Human herpesvirus 7
caagguuuaaaacauuuaca

SEQ ID NO: 2147330 - RNA, 13 nt, Human herpesvirus 7
uuuuauuucuaau

SEQ ID NO: 2147331 - RNA, 18 nt, Human herpesvirus 7
ggagaauucuguacccau

SEQ ID NO: 2147332 - RNA, 13 nt, Human herpesvirus 7
gccacugauuuuu

SEQ ID NO: 2147333 - RNA, 14 nt, Human herpesvirus 7
acagacagaaugcc

SEQ ID NO: 2147334 - RNA, 14 nt, Human herpesvirus 7
aaugcaucugaauu

SEQ ID NO: 2147335 - RNA, 12 nt, Human herpesvirus 7
aaaaaaacacag

SEQ ID NO: 2147336 - RNA, 21 nt, Human herpesvirus 7
acaacuaaaauugacagcacc

SEQ ID NO: 2147337 - RNA, 20 nt, Human herpesvirus 7
auaugcauguguaaagccaa

SEQ ID NO: 2147338 - RNA, 15 nt, Human herpesvirus 7
ucauuuguauauucu

SEQ ID NO: 2147339 - RNA, 16 nt, Human herpesvirus 7
auuucaauaaucaaug

SEQ ID NO: 2147340 - RNA, 16 nt, Human herpesvirus 7
caagauaagcaauaca

SEQ ID NO: 2147341 - RNA, 14 nt, Human herpesvirus 7
aagcugcagcugaa

SEQ ID NO: 2147342 - RNA, 17 nt, Human herpesvirus 7
uuguguggcaacaucuu

SEQ ID NO: 2147343 - RNA, 15 nt, Human herpesvirus 7
aaaauuucauaucua

SEQ ID NO: 2147344 - RNA, 15 nt, Human herpesvirus 7
aaaucuuuaagaaug

SEQ ID NO: 2147345 - RNA, 15 nt, Human herpesvirus 7
cauauagauaaugaa

SEQ ID NO: 2147346 - RNA, 17 nt, Human herpesvirus 7
caugcaagaaaaaaaug

SEQ ID NO: 2147347 - RNA, 16 nt, Human herpesvirus 7
gccaauaaaucuucau

SEQ ID NO: 2147348 - RNA, 23 nt, Human herpesvirus 7
cuuucacuacuacaugaauggau

SEQ ID NO: 2147349 - RNA, 11 nt, Human herpesvirus 7
gguaaauugua

SEQ ID NO: 2147350 - RNA, 13 nt, Human herpesvirus 7
acauauuaguuua

SEQ ID NO: 2147351 - RNA, 14 nt, Human herpesvirus 7
cauacgaaucaguu

SEQ ID NO: 2147352 - RNA, 22 nt, Human herpesvirus 7
uagauuacgcacaaauuucuug

SEQ ID NO: 2147353 - RNA, 16 nt, Human herpesvirus 7
gaaaucauucugaaua

SEQ ID NO: 2147354 - RNA, 20 nt, Human herpesvirus 7
uuccagauaugacaaauuuc

SEQ ID NO: 2147355 - RNA, 22 nt, Human herpesvirus 7
ucauuuaauuggcaacacaaau

SEQ ID NO: 2147356 - RNA, 21 nt, Human herpesvirus 7
ugucucuugaagaacaacaug

SEQ ID NO: 2147357 - RNA, 18 nt, Human herpesvirus 7
uuaaauccgugaaugcug

SEQ ID NO: 2147358 - RNA, 14 nt, Human herpesvirus 7
aaauuaucggaaau

SEQ ID NO: 2147359 - RNA, 15 nt, Human herpesvirus 7
aacugauaauuucuu

SEQ ID NO: 2147360 - RNA, 11 nt, Human herpesvirus 7
uuaauaaaagu

SEQ ID NO: 2147361 - RNA, 22 nt, Human herpesvirus 7
ucacaacauauagauaaugaag

SEQ ID NO: 2147362 - RNA, 14 nt, Human herpesvirus 7
ucaaaucaauguga

SEQ ID NO: 2147363 - RNA, 23 nt, Human herpesvirus 7
caaaaaagauuccugaugauaau

SEQ ID NO: 2147364 - RNA, 18 nt, Human herpesvirus 7
agaacuaggaaacacaau

SEQ ID NO: 2147365 - RNA, 19 nt, Human herpesvirus 7
aaaaugcccucagaacugu

SEQ ID NO: 2147366 - RNA, 20 nt, Human herpesvirus 7
ccgguuaaaaugggaauguu

SEQ ID NO: 2147367 - RNA, 13 nt, Human herpesvirus 7
cguaacugugacg

SEQ ID NO: 2147368 - RNA, 22 nt, Human herpesvirus 7
aaucaacagccaucuaauugca

SEQ ID NO: 2147369 - RNA, 19 nt, Human herpesvirus 7
cagacacaccauuguucaa

SEQ ID NO: 2147370 - RNA, 23 nt, Human herpesvirus 7
aaaacggucugagacggacuuau

SEQ ID NO: 2147371 - RNA, 14 nt, Human herpesvirus 7
agcaaaucugaaaa

SEQ ID NO: 2147372 - RNA, 12 nt, Human herpesvirus 7
aagcuuaaauaa

SEQ ID NO: 2147373 - RNA, 23 nt, Human herpesvirus 7
augcuuccuaaaaaaaaaggaaa

SEQ ID NO: 2147374 - RNA, 16 nt, Human herpesvirus 7
uaaauucaacaucuuu

SEQ ID NO: 2147375 - RNA, 15 nt, Human herpesvirus 7
cgagaaaacacgaca

SEQ ID NO: 2147376 - RNA, 19 nt, Human herpesvirus 7
guaauaauuuaaaauuaau

SEQ ID NO: 2147377 - RNA, 14 nt, Human herpesvirus 7
ggcucuuaauaauu

SEQ ID NO: 2147378 - RNA, 22 nt, Human herpesvirus 7
agcccauauuuuuaaauuuguc

SEQ ID NO: 2147379 - RNA, 18 nt, Human herpesvirus 7
uuaaaacauuuacaaaaa

SEQ ID NO: 2147380 - RNA, 17 nt, Human herpesvirus 7
cuauucggguaaugucu

SEQ ID NO: 2147381 - RNA, 13 nt, Human herpesvirus 7
auguauauaagca

SEQ ID NO: 2147382 - RNA, 17 nt, Human herpesvirus 7
aacccagaagaaacuug

SEQ ID NO: 2147383 - RNA, 15 nt, Human herpesvirus 7
agaucuugacucaga

SEQ ID NO: 2147384 - RNA, 13 nt, Human herpesvirus 7
aaauaccaugaaa

SEQ ID NO: 2147385 - RNA, 16 nt, Human herpesvirus 7
uuuaucauuucaaaug

SEQ ID NO: 2147386 - RNA, 15 nt, Human herpesvirus 7
uuuaaauuugucugu

SEQ ID NO: 2147387 - RNA, 18 nt, Human herpesvirus 7
ccguuggcgaucacaaaa

SEQ ID NO: 2147388 - RNA, 19 nt, Human herpesvirus 7
acaacaacuaaaacuacau

SEQ ID NO: 2147389 - RNA, 19 nt, Human herpesvirus 7
auguugacgggaaaaagga

SEQ ID NO: 2147390 - RNA, 19 nt, Human herpesvirus 7
aaugaccgcaugugaaaau

SEQ ID NO: 2147391 - RNA, 12 nt, Human herpesvirus 7
gaggacuugaaa

SEQ ID NO: 2147392 - RNA, 14 nt, Human herpesvirus 7
aauguaugaaaaug

SEQ ID NO: 2147393 - RNA, 13 nt, Human herpesvirus 7
cuuuuucuggaau

SEQ ID NO: 2147394 - RNA, 13 nt, Human herpesvirus 7
uuaaaaauauuca

SEQ ID NO: 2147395 - RNA, 15 nt, Human herpesvirus 7
ucuaauugcagacua

SEQ ID NO: 2147396 - RNA, 19 nt, Human herpesvirus 7
acauauaggaacaaaucua

SEQ ID NO: 2147397 - RNA, 12 nt, Human herpesvirus 7
cagagaugaaaa

SEQ ID NO: 2147398 - RNA, 14 nt, Human herpesvirus 7
aucgcuuucucaag

SEQ ID NO: 2147399 - RNA, 22 nt, Human herpesvirus 7
agucugaaagccgcugccuucg

SEQ ID NO: 2147400 - RNA, 14 nt, Human herpesvirus 7
uucuaaaucacuag

SEQ ID NO: 2147401 - RNA, 15 nt, Human herpesvirus 7
uguuuuuauuaauuu

SEQ ID NO: 2147402 - RNA, 16 nt, Human herpesvirus 7
gagaaaguaaaagcua

SEQ ID NO: 2147403 - RNA, 15 nt, Human herpesvirus 7
uaaauucaacaucuu

SEQ ID NO: 2147404 - RNA, 23 nt, Human herpesvirus 7
uacacuaugagauauuuaauggu

SEQ ID NO: 2147405 - RNA, 11 nt, Human herpesvirus 7
uucuuaauuug

SEQ ID NO: 2147406 - RNA, 16 nt, Human herpesvirus 7
acguuuauuuggauug

SEQ ID NO: 2147407 - RNA, 17 nt, Human herpesvirus 7
uaacaugccugcaauau

SEQ ID NO: 2147408 - RNA, 16 nt, Human herpesvirus 7
cagaaacaccccuugc

SEQ ID NO: 2147409 - RNA, 19 nt, Human herpesvirus 7
aaucuuuauuauuuacuga

SEQ ID NO: 2147410 - RNA, 14 nt, Human herpesvirus 7
auuacauccugcua

SEQ ID NO: 2147411 - RNA, 13 nt, Human herpesvirus 7
uacagaagaacau

SEQ ID NO: 2147412 - RNA, 15 nt, Human herpesvirus 7
agcaaugcaugaugc

SEQ ID NO: 2147413 - RNA, 17 nt, Human herpesvirus 7
aaucaagucugaaggcu

SEQ ID NO: 2147414 - RNA, 13 nt, Human herpesvirus 7
uacaauaaugcug

SEQ ID NO: 2147415 - RNA, 19 nt, Human herpesvirus 7
auuacauugcagucaaaga

SEQ ID NO: 2147416 - RNA, 11 nt, Human herpesvirus 7
aguacaugugu

SEQ ID NO: 2147417 - RNA, 22 nt, Human herpesvirus 7
aacuacauuuaaaaaaucugaa

SEQ ID NO: 2147418 - RNA, 21 nt, Human herpesvirus 7
aaacuugugaaaauaacagga

SEQ ID NO: 2147419 - RNA, 12 nt, Human herpesvirus 7
caauauauugaa

SEQ ID NO: 2147420 - RNA, 19 nt, Human herpesvirus 7
uggacaaaaauaaaguuua

SEQ ID NO: 2147421 - RNA, 15 nt, Human herpesvirus 7
uuugaucuacauaua

SEQ ID NO: 2147422 - RNA, 23 nt, Human herpesvirus 7
ugaauuaucgcaauuaauucagu

SEQ ID NO: 2147423 - RNA, 18 nt, Human herpesvirus 7
guuugcgagccugugauc

SEQ ID NO: 2147424 - RNA, 18 nt, Human herpesvirus 7
cuucauaucugacauuca

SEQ ID NO: 2147425 - RNA, 18 nt, Human herpesvirus 7
ugaauauaaguuuucuua

SEQ ID NO: 2147426 - RNA, 15 nt, Human herpesvirus 7
uuaaaaaccacagag

SEQ ID NO: 2147427 - RNA, 14 nt, Human herpesvirus 7
ugugacccugucac

SEQ ID NO: 2147428 - RNA, 16 nt, Human herpesvirus 7
cuuuuucuggaauguu

SEQ ID NO: 2147429 - RNA, 13 nt, Human herpesvirus 7
uuuaucuaacacu

SEQ ID NO: 2147430 - RNA, 14 nt, Human herpesvirus 7
aucguguuaagucg

SEQ ID NO: 2147431 - RNA, 18 nt, Human herpesvirus 7
aucaugaaaacaguggga

SEQ ID NO: 2147432 - RNA, 19 nt, Human herpesvirus 7
gcgaaagccacuguugaug

SEQ ID NO: 2147433 - RNA, 20 nt, Human herpesvirus 7
caaggaaaaucguguuaagu

SEQ ID NO: 2147434 - RNA, 16 nt, Human herpesvirus 7
aguguuuaaaauguua

SEQ ID NO: 2147435 - RNA, 14 nt, Human herpesvirus 7
ugacacgacacuga

SEQ ID NO: 2147436 - RNA, 13 nt, Human herpesvirus 7
ucagcauuuacca

SEQ ID NO: 2147437 - RNA, 18 nt, Human herpesvirus 7
guuuuuuauuuagcuaau

SEQ ID NO: 2147438 - RNA, 14 nt, Human herpesvirus 7
cauggcuuuucaca

SEQ ID NO: 2147439 - RNA, 18 nt, Human herpesvirus 7
gaacauuaauaucaauuu

SEQ ID NO: 2147440 - RNA, 19 nt, Human herpesvirus 7
uguguuuuaucuaccauca

SEQ ID NO: 2147441 - RNA, 14 nt, Human herpesvirus 7
aaacaaacaaugag

SEQ ID NO: 2147442 - RNA, 18 nt, Human herpesvirus 7
caguuguuggaaauaccg

SEQ ID NO: 2147443 - RNA, 20 nt, Human herpesvirus 7
acuccguuucauuuaaaagg

SEQ ID NO: 2147444 - RNA, 16 nt, Human herpesvirus 7
uugcuuaaaaacagua

SEQ ID NO: 2147445 - RNA, 18 nt, Human herpesvirus 7
aaggaucaaaagcugcag

SEQ ID NO: 2147446 - RNA, 18 nt, Human herpesvirus 7
auuauauucaaauaaggg

SEQ ID NO: 2147447 - RNA, 15 nt, Human herpesvirus 7
cuagaaguuuagaga

SEQ ID NO: 2147448 - RNA, 16 nt, Human herpesvirus 7
uaaaauagaaaauguc

SEQ ID NO: 2147449 - RNA, 16 nt, Human herpesvirus 7
acaguuuuuuaauaca

SEQ ID NO: 2147450 - RNA, 19 nt, Human herpesvirus 7
gcaugaauuaauaaaacaa

SEQ ID NO: 2147451 - RNA, 14 nt, Human herpesvirus 7
agccauaaaugcuu

SEQ ID NO: 2147452 - RNA, 16 nt, Human herpesvirus 7
auucuuuucaaugcaa

SEQ ID NO: 2147453 - RNA, 22 nt, Human herpesvirus 7
guuaacccagaagaaacuugaa

SEQ ID NO: 2147454 - RNA, 21 nt, Human herpesvirus 7
aaugguuuuaaaauagaaaau

SEQ ID NO: 2147455 - RNA, 14 nt, Human herpesvirus 7
uugcugucuuggag

SEQ ID NO: 2147456 - RNA, 23 nt, Human herpesvirus 7
aaauaaaaccauuuauugauguc

SEQ ID NO: 2147457 - RNA, 21 nt, Human herpesvirus 7
gaauagguaucuuuacuuuca

SEQ ID NO: 2147458 - RNA, 14 nt, Human herpesvirus 7
uaaaagguguuuuu

SEQ ID NO: 2147459 - RNA, 19 nt, Human herpesvirus 7
auuuuauugcgaaaaugau

SEQ ID NO: 2147460 - RNA, 21 nt, Human herpesvirus 7
auguuacuauaugaaaacagc

SEQ ID NO: 2147461 - RNA, 17 nt, Human herpesvirus 7
agaaaauguuuugauuu

SEQ ID NO: 2147462 - RNA, 13 nt, Human herpesvirus 7
gaaaguccaaagu

SEQ ID NO: 2147463 - RNA, 21 nt, Human herpesvirus 7
augucuaaaaguacaguguau

SEQ ID NO: 2147464 - RNA, 14 nt, Human herpesvirus 7
uugcauaucaugau

SEQ ID NO: 2147465 - RNA, 14 nt, Human herpesvirus 7
gauuauauucaaau

SEQ ID NO: 2147466 - RNA, 21 nt, Human herpesvirus 7
auaaucuuaauguuucugagu

SEQ ID NO: 2147467 - RNA, 15 nt, Human herpesvirus 7
ucacauugucacugc

SEQ ID NO: 2147468 - RNA, 18 nt, Human herpesvirus 7
uuguaaauucuccaauca

SEQ ID NO: 2147469 - RNA, 14 nt, Human herpesvirus 7
aaauuucaaacgua

SEQ ID NO: 2147470 - RNA, 15 nt, Human herpesvirus 7
uuaucucagaugcua

SEQ ID NO: 2147471 - RNA, 15 nt, Human herpesvirus 7
acguuucuagcaaaa

SEQ ID NO: 2147472 - RNA, 17 nt, Human herpesvirus 7
ggagaaagcuguuucca

SEQ ID NO: 2147473 - RNA, 19 nt, Human herpesvirus 7
uucacagacgcaucauucc

SEQ ID NO: 2147474 - RNA, 21 nt, Human herpesvirus 7
caauauuuaaaguagcugaau

SEQ ID NO: 2147475 - RNA, 22 nt, Human herpesvirus 7
aucugucaggucacaaaagcuu

SEQ ID NO: 2147476 - RNA, 18 nt, Human herpesvirus 7
acugcaaauccaacagaa

SEQ ID NO: 2147477 - RNA, 16 nt, Human herpesvirus 7
uaaggccaaagguaaa

SEQ ID NO: 2147478 - RNA, 19 nt, Human herpesvirus 7
acgcuuucugaauugcauc

SEQ ID NO: 2147479 - RNA, 19 nt, Human herpesvirus 7
auacauaaguuaaaucagu

SEQ ID NO: 2147480 - RNA, 15 nt, Human herpesvirus 7
agaaaacauuauauu

SEQ ID NO: 2147481 - RNA, 13 nt, Human herpesvirus 7
uugaaaagaaugg

SEQ ID NO: 2147482 - RNA, 22 nt, Human herpesvirus 7
guuucuagcaaaauaugcaaaa

SEQ ID NO: 2147483 - RNA, 17 nt, Human herpesvirus 7
aaacaagacagaaauga

SEQ ID NO: 2147484 - RNA, 19 nt, Human herpesvirus 7
gaacaaaagucgagaaaac

SEQ ID NO: 2147485 - RNA, 22 nt, Human herpesvirus 7
caaaucaaaaugagauuuuucc

SEQ ID NO: 2147486 - RNA, 20 nt, Human herpesvirus 7
augaguauaccuacgacuau

SEQ ID NO: 2147487 - RNA, 15 nt, Human herpesvirus 7
guucuaucucaaaac

SEQ ID NO: 2147488 - RNA, 22 nt, Human herpesvirus 7
caaaggaucgaucucugucaaa

SEQ ID NO: 2147489 - RNA, 16 nt, Human herpesvirus 7
uacagcauauaucuuu

SEQ ID NO: 2147490 - RNA, 20 nt, Human herpesvirus 7
gcagccagaacucaauuuuu

SEQ ID NO: 2147491 - RNA, 15 nt, Human herpesvirus 7
uaucuccauucuaaa

SEQ ID NO: 2147492 - RNA, 11 nt, Human herpesvirus 7
cgguuaaucuu

SEQ ID NO: 2147493 - RNA, 14 nt, Human herpesvirus 7
aaaacguaaaacug

SEQ ID NO: 2147494 - RNA, 21 nt, Human herpesvirus 7
ucaccaaagaguauacaaaag

SEQ ID NO: 2147495 - RNA, 22 nt, Human herpesvirus 7
gcgcaaaggaaaaaugcugcuc

SEQ ID NO: 2147496 - RNA, 12 nt, Human herpesvirus 7
agaaaagcaagu

SEQ ID NO: 2147497 - RNA, 14 nt, Human herpesvirus 7
cuucuugcauuucc

SEQ ID NO: 2147498 - RNA, 15 nt, Human herpesvirus 7
aagcauaugugagaa

SEQ ID NO: 2147499 - RNA, 14 nt, Human herpesvirus 7
uuauccaaguuuua

SEQ ID NO: 2147500 - RNA, 16 nt, Human herpesvirus 7
gaauccgcauuugagg

SEQ ID NO: 2147501 - RNA, 21 nt, Human herpesvirus 7
aauuugcagcuucuaaaugug

SEQ ID NO: 2147502 - RNA, 23 nt, Human herpesvirus 7
caaaugugguaaauuugcuugcu

SEQ ID NO: 2147503 - RNA, 14 nt, Human herpesvirus 7
auucuugucaacuu

SEQ ID NO: 2147504 - RNA, 15 nt, Human herpesvirus 7
auucguuaagcaccg

SEQ ID NO: 2147505 - RNA, 23 nt, Human herpesvirus 7
auugcugauccgccgacaagaaa

SEQ ID NO: 2147506 - RNA, 20 nt, Human herpesvirus 7
guuuugagaguuguggcaaa

SEQ ID NO: 2147507 - RNA, 22 nt, Human herpesvirus 7
auuucuaaauaugaugaaacuu

SEQ ID NO: 2147508 - RNA, 15 nt, Human herpesvirus 7
cuuaaaugucaauga

SEQ ID NO: 2147509 - RNA, 19 nt, Human herpesvirus 7
ugaauuuuaaguggaaucu

SEQ ID NO: 2147510 - RNA, 14 nt, Human herpesvirus 7
aaugcaugaugcac

SEQ ID NO: 2147511 - RNA, 18 nt, Human herpesvirus 7
guuaaaaagaauguauua

SEQ ID NO: 2147512 - RNA, 22 nt, Human herpesvirus 7
uguguuacaugaucuuguaauu

SEQ ID NO: 2147513 - RNA, 23 nt, Human herpesvirus 7
uucaaucaaauuauaccucagcu

SEQ ID NO: 2147514 - RNA, 18 nt, Human herpesvirus 7
gccacgaugacuuccaag

SEQ ID NO: 2147515 - RNA, 21 nt, Human herpesvirus 7
uaguaaaccuucgugugucuc

SEQ ID NO: 2147516 - RNA, 12 nt, Human herpesvirus 7
acugauguaaaa

SEQ ID NO: 2147517 - RNA, 14 nt, Human herpesvirus 7
uguuccauucaaua

SEQ ID NO: 2147518 - RNA, 16 nt, Human herpesvirus 7
auggauacaaggaaaa

SEQ ID NO: 2147519 - RNA, 16 nt, Human herpesvirus 7
uuccuucuaaauucuu

SEQ ID NO: 2147520 - RNA, 19 nt, Human herpesvirus 7
uuagacgacgucuucuucu

SEQ ID NO: 2147521 - RNA, 18 nt, Human herpesvirus 7
uguuccuuauauuaaaaa

SEQ ID NO: 2147522 - RNA, 16 nt, Human herpesvirus 7
uugcuuuagaacaauu

SEQ ID NO: 2147523 - RNA, 17 nt, Human herpesvirus 7
aauagcagagaauaugu

SEQ ID NO: 2147524 - RNA, 13 nt, Human herpesvirus 7
uucugaauaaaag

SEQ ID NO: 2147525 - RNA, 20 nt, Human herpesvirus 7
auaacaaaaaagguguugau

SEQ ID NO: 2147526 - RNA, 12 nt, Human herpesvirus 7
gccaauugaaga

SEQ ID NO: 2147527 - RNA, 16 nt, Human herpesvirus 7
caaggugacagagggc

SEQ ID NO: 2147528 - RNA, 14 nt, Human herpesvirus 7
ucuuucuauuggag

SEQ ID NO: 2147529 - RNA, 21 nt, Human herpesvirus 7
uucaagaaggaaaauuucauu

SEQ ID NO: 2147530 - RNA, 14 nt, Human herpesvirus 7
uccagacagcugua

SEQ ID NO: 2147531 - RNA, 22 nt, Human herpesvirus 7
uuguaggaaauuuucauagcac

SEQ ID NO: 2147532 - RNA, 17 nt, Human herpesvirus 7
aggggguucuaaaugua

SEQ ID NO: 2147533 - RNA, 16 nt, Human herpesvirus 7
ugauaaugaaacuguu

SEQ ID NO: 2147534 - RNA, 21 nt, Human herpesvirus 7
uaagaaauuuucuuuuggaag

SEQ ID NO: 2147535 - RNA, 16 nt, Human herpesvirus 7
uccauucgguuuucaa

SEQ ID NO: 2147536 - RNA, 23 nt, Human herpesvirus 7
cguuucucuguagauauuuugac

SEQ ID NO: 2147537 - RNA, 17 nt, Human herpesvirus 7
uguggagagauucaaac

SEQ ID NO: 2147538 - RNA, 13 nt, Human herpesvirus 7
gaaaagaacuuaa

SEQ ID NO: 2147539 - RNA, 15 nt, Human herpesvirus 7
cgacaauauaaaaga

SEQ ID NO: 2147540 - RNA, 19 nt, Human herpesvirus 7
gaaccaguuuuacuuuuga

SEQ ID NO: 2147541 - RNA, 19 nt, Human herpesvirus 7
ccaaaauguaaaccaaauu

SEQ ID NO: 2147542 - RNA, 19 nt, Human herpesvirus 7
auuuguuuaagacauuauu

SEQ ID NO: 2147543 - RNA, 23 nt, Human herpesvirus 7
aauuuuauuccgugcuguacuga

SEQ ID NO: 2147544 - RNA, 19 nt, Human herpesvirus 7
uaaaauugacagcaccaau

SEQ ID NO: 2147545 - RNA, 21 nt, Human herpesvirus 7
gaauuuuaacacuguuuucag

SEQ ID NO: 2147546 - RNA, 21 nt, Human herpesvirus 7
aauugugguacaacaaacauu

SEQ ID NO: 2147547 - RNA, 21 nt, Human herpesvirus 7
uuguaguuuuugcauauggac

SEQ ID NO: 2147548 - RNA, 19 nt, Human herpesvirus 7
uaaauucuaauauguauga

SEQ ID NO: 2147549 - RNA, 15 nt, Human herpesvirus 7
aauaucgauuuaaca

SEQ ID NO: 2147550 - RNA, 21 nt, Human herpesvirus 7
aaaacaauuaagaaucauuug

SEQ ID NO: 2147551 - RNA, 16 nt, Human herpesvirus 7
uggaaagcuugugaag

SEQ ID NO: 2147552 - RNA, 11 nt, Human herpesvirus 7
aucuaauuaau

SEQ ID NO: 2147553 - RNA, 15 nt, Human herpesvirus 7
agcuugguuuuacaa

SEQ ID NO: 2147554 - RNA, 13 nt, Human herpesvirus 7
uguauuaaagaag

SEQ ID NO: 2147555 - RNA, 14 nt, Human herpesvirus 7
cuguguauuucuua

SEQ ID NO: 2147556 - RNA, 15 nt, Human herpesvirus 7
uucaauuucugucuu

SEQ ID NO: 2147557 - RNA, 20 nt, Human herpesvirus 7
agaugacauuuuuaccucca

SEQ ID NO: 2147558 - RNA, 17 nt, Human herpesvirus 7
auguaauuuaaauaauu

SEQ ID NO: 2147559 - RNA, 18 nt, Human herpesvirus 7
gaggaaaaccgcacauac

SEQ ID NO: 2147560 - RNA, 19 nt, Human herpesvirus 7
auuggcaugcuuacaguga

SEQ ID NO: 2147561 - RNA, 19 nt, Human herpesvirus 7
uugaauuauguauaucuuu

SEQ ID NO: 2147562 - RNA, 13 nt, Human herpesvirus 7
uucaaucaaauua

SEQ ID NO: 2147563 - RNA, 12 nt, Human herpesvirus 7
auugaaaguaaa

SEQ ID NO: 2147564 - RNA, 18 nt, Human herpesvirus 7
agcaauacauucucaaaa

SEQ ID NO: 2147565 - RNA, 16 nt, Human herpesvirus 7
uccgaaucuguuggag

SEQ ID NO: 2147566 - RNA, 13 nt, Human herpesvirus 7
cuugaaaaaaucu

SEQ ID NO: 2147567 - RNA, 21 nt, Human herpesvirus 7
gcaauuuucacaauggaaaga

SEQ ID NO: 2147568 - RNA, 21 nt, Human herpesvirus 7
acaaagaacauguaguacaau

SEQ ID NO: 2147569 - RNA, 18 nt, Human herpesvirus 7
ucaaggucuuucaugcau

SEQ ID NO: 2147570 - RNA, 19 nt, Human herpesvirus 7
cuuacaacuagaaaauaac

SEQ ID NO: 2147571 - RNA, 20 nt, Human herpesvirus 7
aaaggaucucucuuucugga

SEQ ID NO: 2147572 - RNA, 22 nt, Human herpesvirus 7
acaaaaaaauaccucuggcuuc

SEQ ID NO: 2147573 - RNA, 19 nt, Human herpesvirus 7
aaaaucaaaaaacacgucc

SEQ ID NO: 2147574 - RNA, 14 nt, Human herpesvirus 7
gcuucagaugcuau

SEQ ID NO: 2147575 - RNA, 12 nt, Human herpesvirus 7
uuuacuuaaaua

SEQ ID NO: 2147576 - RNA, 14 nt, Human herpesvirus 7
aacaaacaaauaau

SEQ ID NO: 2147577 - RNA, 23 nt, Human herpesvirus 7
aucgauguuuuaucuaacacugc

SEQ ID NO: 2147578 - RNA, 20 nt, Human herpesvirus 7
cagauucuccgcuuuuggau

SEQ ID NO: 2147579 - RNA, 19 nt, Human herpesvirus 7
ucaugacuggacacaauca

SEQ ID NO: 2147580 - RNA, 18 nt, Human herpesvirus 7
ucucaauuaaaacaucuc

SEQ ID NO: 2147581 - RNA, 23 nt, Human herpesvirus 7
cuuuaauggaagaacaacaacua

SEQ ID NO: 2147582 - RNA, 12 nt, Human herpesvirus 7
gaaaagagaaaa

SEQ ID NO: 2147583 - RNA, 14 nt, Human herpesvirus 7
gaaagcuguuucca

SEQ ID NO: 2147584 - RNA, 15 nt, Human herpesvirus 7
uuaaaauacuaauca

SEQ ID NO: 2147585 - RNA, 22 nt, Human herpesvirus 7
gcaacuuuaauuaacacucaaa

SEQ ID NO: 2147586 - RNA, 14 nt, Human herpesvirus 7
gucuacaauuucug

SEQ ID NO: 2147587 - RNA, 20 nt, Human herpesvirus 7
cuugaaugagcugacagagg

SEQ ID NO: 2147588 - RNA, 20 nt, Human herpesvirus 7
cgauagcauuagagcauauu

SEQ ID NO: 2147589 - RNA, 14 nt, Human herpesvirus 7
gaacaaauaaugag

SEQ ID NO: 2147590 - RNA, 17 nt, Human herpesvirus 7
aaaucuguagaaaaugu

SEQ ID NO: 2147591 - RNA, 17 nt, Human herpesvirus 7
ucaacaaaaugacaaaa

SEQ ID NO: 2147592 - RNA, 14 nt, Human herpesvirus 7
aauucgcugaugaa

SEQ ID NO: 2147593 - RNA, 24 nt, Human herpesvirus 7
cuauuaaauauuuagagucgucuu

SEQ ID NO: 2147594 - RNA, 13 nt, Human herpesvirus 7
gaacccuggagag

SEQ ID NO: 2147595 - RNA, 22 nt, Human herpesvirus 7
aauaacauuuuguaugaaaagc

SEQ ID NO: 2147596 - RNA, 16 nt, Human herpesvirus 7
guaauuuaugauuuuu

SEQ ID NO: 2147597 - RNA, 17 nt, Human herpesvirus 7
ucaucucacuucagaag

SEQ ID NO: 2147598 - RNA, 17 nt, Human herpesvirus 7
ggacuugauaauguuuc

SEQ ID NO: 2147599 - RNA, 18 nt, Human herpesvirus 7
gaucaaaagcugcagcug

SEQ ID NO: 2147600 - RNA, 16 nt, Human herpesvirus 7
cagggagguuucuugc

SEQ ID NO: 2147601 - RNA, 16 nt, Human herpesvirus 7
cauugaaaaugcauug

SEQ ID NO: 2147602 - RNA, 13 nt, Human herpesvirus 7
ugcaucugaauuu

SEQ ID NO: 2147603 - RNA, 16 nt, Human herpesvirus 7
aaaaucaaaacauuuc

SEQ ID NO: 2147604 - RNA, 14 nt, Human herpesvirus 7
gcaaauaaauugug

SEQ ID NO: 2147605 - RNA, 21 nt, Human herpesvirus 7
gcauauugaagaucaacaaau

SEQ ID NO: 2147606 - RNA, 21 nt, Human herpesvirus 7
aaagacgcuugcuauuuucuu

SEQ ID NO: 2147607 - RNA, 21 nt, Human herpesvirus 7
ucacagcuagauugacuauga

SEQ ID NO: 2147608 - RNA, 16 nt, Human herpesvirus 7
cuucuugcauuuccga

SEQ ID NO: 2147609 - RNA, 16 nt, Human herpesvirus 7
uaaugauguaauguug

SEQ ID NO: 2147610 - RNA, 20 nt, Human herpesvirus 7
gaagaggaguauguugcaua

SEQ ID NO: 2147611 - RNA, 21 nt, Human herpesvirus 7
uauuuaagcuucaaaaauguu

SEQ ID NO: 2147612 - RNA, 13 nt, Human herpesvirus 7
uuaaacuuaucag

SEQ ID NO: 2147613 - RNA, 14 nt, Human herpesvirus 7
uuacagauugcuug

SEQ ID NO: 2147614 - RNA, 17 nt, Human herpesvirus 7
guaaaaaauuacuugcu

SEQ ID NO: 2147615 - RNA, 16 nt, Human herpesvirus 7
aaucuguagaaaaugu

SEQ ID NO: 2147616 - RNA, 18 nt, Human herpesvirus 7
aauguuagaaacaucugu

SEQ ID NO: 2147617 - RNA, 13 nt, Human herpesvirus 7
gaacuuuuaaaaa

SEQ ID NO: 2147618 - RNA, 14 nt, Human herpesvirus 7
aggucacaaaagcu

SEQ ID NO: 2147619 - RNA, 21 nt, Human herpesvirus 7
cugacuccuuuuuuucugcuc

SEQ ID NO: 2147620 - RNA, 16 nt, Human herpesvirus 7
agacaccccaaaauca

SEQ ID NO: 2147621 - RNA, 23 nt, Human herpesvirus 7
aaauugauccugcuauucauuuc

SEQ ID NO: 2147622 - RNA, 16 nt, Human herpesvirus 7
uggucagaacaucccu

SEQ ID NO: 2147623 - RNA, 15 nt, Human herpesvirus 7
ucgauauacauguaa

SEQ ID NO: 2147624 - RNA, 20 nt, Human herpesvirus 7
aaugccaucuauaaacauuc

SEQ ID NO: 2147625 - RNA, 23 nt, Human herpesvirus 7
aauuauguauaucuuuuuauuga

SEQ ID NO: 2147626 - RNA, 14 nt, Human herpesvirus 7
aacauuaaaacuac

SEQ ID NO: 2147627 - RNA, 18 nt, Human herpesvirus 7
auagaaauuauuguacau

SEQ ID NO: 2147628 - RNA, 22 nt, Human herpesvirus 7
agccugguuuuguucccugcuc

SEQ ID NO: 2147629 - RNA, 21 nt, Human herpesvirus 7
gaaauccgucaccgacaauau

SEQ ID NO: 2147630 - RNA, 21 nt, Human herpesvirus 7
uuaguacuuuuucuggaaugu

SEQ ID NO: 2147631 - RNA, 17 nt, Human herpesvirus 7
caaauuaaacaaucugg

SEQ ID NO: 2147632 - RNA, 20 nt, Human herpesvirus 7
uacaaaacaaagauugaagc

SEQ ID NO: 2147633 - RNA, 17 nt, Human herpesvirus 7
uuuggauaguucguaaa

SEQ ID NO: 2147634 - RNA, 19 nt, Human herpesvirus 7
aauuucuaaauaugaugaa

SEQ ID NO: 2147635 - RNA, 21 nt, Human herpesvirus 7
caugaugaauauaacaaaaaa

SEQ ID NO: 2147636 - RNA, 12 nt, Human herpesvirus 7
aauguuucugag

SEQ ID NO: 2147637 - RNA, 16 nt, Human herpesvirus 7
auucuaaaaauuauuu

SEQ ID NO: 2147638 - RNA, 14 nt, Human herpesvirus 7
aucauagagaaaac

SEQ ID NO: 2147639 - RNA, 14 nt, Human herpesvirus 7
cuguagacauuucu

SEQ ID NO: 2147640 - RNA, 14 nt, Human herpesvirus 7
agagaacuagaaca

SEQ ID NO: 2147641 - RNA, 15 nt, Human herpesvirus 7
gaaagaaaagaugua

SEQ ID NO: 2147642 - RNA, 24 nt, Human herpesvirus 7
auuuguacuucaaaguagccuuca

SEQ ID NO: 2147643 - RNA, 21 nt, Human herpesvirus 7
uguaugaaauaauagaugucu

SEQ ID NO: 2147644 - RNA, 16 nt, Human herpesvirus 7
cagaccguaaaacaau

SEQ ID NO: 2147645 - RNA, 15 nt, Human herpesvirus 7
cgggguauguauggc

SEQ ID NO: 2147646 - RNA, 15 nt, Human herpesvirus 7
uccaaagugaugaaa

SEQ ID NO: 2147647 - RNA, 18 nt, Human herpesvirus 7
aucauaauuacauugcag

SEQ ID NO: 2147648 - RNA, 13 nt, Human herpesvirus 7
ucauccaaaaaga

SEQ ID NO: 2147649 - RNA, 14 nt, Human herpesvirus 7
aaaagcugcagcug

SEQ ID NO: 2147650 - RNA, 16 nt, Human herpesvirus 7
cugcuaacucauaauu

SEQ ID NO: 2147651 - RNA, 22 nt, Human herpesvirus 7
gguaaacucacuucuaaaagcu

SEQ ID NO: 2147652 - RNA, 16 nt, Human herpesvirus 7
cacuaauccaugacag

SEQ ID NO: 2147653 - RNA, 15 nt, Human herpesvirus 7
uacuuuuacuccuca

SEQ ID NO: 2147654 - RNA, 11 nt, Human herpesvirus 7
ggaucucucuu

SEQ ID NO: 2147655 - RNA, 22 nt, Human herpesvirus 7
gcucagcuagaauguguagauu

SEQ ID NO: 2147656 - RNA, 24 nt, Human herpesvirus 7
uuguuuugcauauuuugcuagaaa

SEQ ID NO: 2147657 - RNA, 19 nt, Human herpesvirus 7
gccagauuucauguuuuau

SEQ ID NO: 2147658 - RNA, 13 nt, Human herpesvirus 7
uaaacauuucaaa

SEQ ID NO: 2147659 - RNA, 17 nt, Human herpesvirus 7
guuaagaauuccagauu

SEQ ID NO: 2147660 - RNA, 16 nt, Human herpesvirus 7
uaauaugugaaaauaa

SEQ ID NO: 2147661 - RNA, 18 nt, Human herpesvirus 7
aaaaaccugaaaaacaug

SEQ ID NO: 2147662 - RNA, 20 nt, Human herpesvirus 7
acugaaucugaagaagaguu

SEQ ID NO: 2147663 - RNA, 18 nt, Human herpesvirus 7
aauuuuucggauaaaagg

SEQ ID NO: 2147664 - RNA, 13 nt, Human herpesvirus 7
cgucaacuaaaau

SEQ ID NO: 2147665 - RNA, 19 nt, Human herpesvirus 7
cuuugucugcugguaauaa

SEQ ID NO: 2147666 - RNA, 22 nt, Human herpesvirus 7
ugcaucaaaacauaucagauuu

SEQ ID NO: 2147667 - RNA, 23 nt, Human herpesvirus 7
acauuuaaaaaaaaaaccacaaa

SEQ ID NO: 2147668 - RNA, 19 nt, Human herpesvirus 7
ucgcuuggguuugaucgag

SEQ ID NO: 2147669 - RNA, 19 nt, Human herpesvirus 7
ucaaaaguagaggccgaaa

SEQ ID NO: 2147670 - RNA, 15 nt, Human herpesvirus 7
aucccuggacagaga

SEQ ID NO: 2147671 - RNA, 22 nt, Human herpesvirus 7
aagaugauagccauaaaugcuu

SEQ ID NO: 2147672 - RNA, 19 nt, Human herpesvirus 7
aaauuaauaauauuaguau

SEQ ID NO: 2147673 - RNA, 15 nt, Human herpesvirus 7
gucaucacuuaugau

SEQ ID NO: 2147674 - RNA, 15 nt, Human herpesvirus 7
uggauacaaggaaaa

SEQ ID NO: 2147675 - RNA, 22 nt, Human herpesvirus 7
guuuauuugaacggaauaaaca

SEQ ID NO: 2147676 - RNA, 21 nt, Human herpesvirus 7
agcauugaaaucauuuugcug

SEQ ID NO: 2147677 - RNA, 13 nt, Human herpesvirus 7
gauucuccagaaa

SEQ ID NO: 2147678 - RNA, 19 nt, Human herpesvirus 7
aaaagaauugauugaauuu

SEQ ID NO: 2147679 - RNA, 21 nt, Human herpesvirus 7
augguuuuaaaauagaaaaug

SEQ ID NO: 2147680 - RNA, 20 nt, Human herpesvirus 7
caauauauugaaggugucua

SEQ ID NO: 2147681 - RNA, 19 nt, Human herpesvirus 7
aauaaaaagcccaugaaca

SEQ ID NO: 2147682 - RNA, 19 nt, Human herpesvirus 7
gugccccaaacuguauuug

SEQ ID NO: 2147683 - RNA, 23 nt, Human herpesvirus 7
auugaauggaacauguuuguaaa

SEQ ID NO: 2147684 - RNA, 14 nt, Human herpesvirus 7
aaacaauacaugaa

SEQ ID NO: 2147685 - RNA, 13 nt, Human herpesvirus 7
cauuuuuucugau

SEQ ID NO: 2147686 - RNA, 18 nt, Human herpesvirus 7
agauuaccugcauacuuu

SEQ ID NO: 2147687 - RNA, 19 nt, Human herpesvirus 7
gaaagcguuucacugggaa

SEQ ID NO: 2147688 - RNA, 19 nt, Human herpesvirus 7
aauauguagcaucucugug

SEQ ID NO: 2147689 - RNA, 23 nt, Human herpesvirus 7
auucucaaaaaugauaugacaug

SEQ ID NO: 2147690 - RNA, 20 nt, Human herpesvirus 7
aguaaagggcugucugaagu

SEQ ID NO: 2147691 - RNA, 14 nt, Human herpesvirus 7
ucaggaucuccugg

SEQ ID NO: 2147692 - RNA, 17 nt, Human herpesvirus 7
ucaacuugcagaggacc

SEQ ID NO: 2147693 - RNA, 19 nt, Human herpesvirus 7
cuuugauagggauucuuug

SEQ ID NO: 2147694 - RNA, 23 nt, Human herpesvirus 7
agcauggaucguagcaacagaga

SEQ ID NO: 2147695 - RNA, 16 nt, Human herpesvirus 7
aagcaacaaauguuua

SEQ ID NO: 2147696 - RNA, 19 nt, Human herpesvirus 7
uuugucuuacgucuuuucu

SEQ ID NO: 2147697 - RNA, 18 nt, Human herpesvirus 7
uccuguccagucuguaaa

SEQ ID NO: 2147698 - RNA, 15 nt, Human herpesvirus 7
ugguaaaaaaguuug

SEQ ID NO: 2147699 - RNA, 22 nt, Human herpesvirus 7
aaaaaccuuuuuuccauauucc

SEQ ID NO: 2147700 - RNA, 20 nt, Human herpesvirus 7
aagguuaagugaaugugcuu

SEQ ID NO: 2147701 - RNA, 16 nt, Human herpesvirus 7
cagauuuucuguuuca

SEQ ID NO: 2147702 - RNA, 14 nt, Human herpesvirus 7
cauguauugucuua

SEQ ID NO: 2147703 - RNA, 23 nt, Human herpesvirus 7
aucuuccacaaaaauuuaauagu

SEQ ID NO: 2147704 - RNA, 21 nt, Human herpesvirus 7
acaaacauuccaacagcuuca

SEQ ID NO: 2147705 - RNA, 18 nt, Human herpesvirus 7
ugaaaagcccaaacuguu

SEQ ID NO: 2147706 - RNA, 22 nt, Human herpesvirus 7
uuaaacaaucuggacauuucaa

SEQ ID NO: 2147707 - RNA, 12 nt, Human herpesvirus 7
cugccaauuuuu

SEQ ID NO: 2147708 - RNA, 22 nt, Human herpesvirus 7
guguccagauaauauagaugca

SEQ ID NO: 2147709 - RNA, 17 nt, Human herpesvirus 7
acagagucaaucuguga

SEQ ID NO: 2147710 - RNA, 18 nt, Human herpesvirus 7
gcuaugacuuugaaucaa

SEQ ID NO: 2147711 - RNA, 20 nt, Human herpesvirus 7
uguaaucaaaauuuuggauu

SEQ ID NO: 2147712 - RNA, 20 nt, Human herpesvirus 7
ugauacaggccuguuucuug

SEQ ID NO: 2147713 - RNA, 13 nt, Human herpesvirus 7
uucacagaaaucc

SEQ ID NO: 2147714 - RNA, 13 nt, Human herpesvirus 7
gauauuaguuuca

SEQ ID NO: 2147715 - RNA, 13 nt, Human herpesvirus 7
uaguuaauugugu

SEQ ID NO: 2147716 - RNA, 17 nt, Human herpesvirus 7
aaagucuaagguuugaa

SEQ ID NO: 2147717 - RNA, 16 nt, Human herpesvirus 7
uucgaucuguaaaaac

SEQ ID NO: 2147718 - RNA, 13 nt, Human herpesvirus 7
cauauuuugcuag

SEQ ID NO: 2147719 - RNA, 12 nt, Human herpesvirus 7
uaaaugauuuua

SEQ ID NO: 2147720 - RNA, 22 nt, Human herpesvirus 7
auggggcauuaauucuuucagu

SEQ ID NO: 2147721 - RNA, 22 nt, Human herpesvirus 7
ccacagauauucuaacaaauac

SEQ ID NO: 2147722 - RNA, 16 nt, Human herpesvirus 7
aaguuuuuugagauau

SEQ ID NO: 2147723 - RNA, 16 nt, Human herpesvirus 7
guaaaagaucuuuuaa

SEQ ID NO: 2147724 - RNA, 18 nt, Human herpesvirus 7
aucuagcuuguuaaagaa

SEQ ID NO: 2147725 - RNA, 17 nt, Human herpesvirus 7
aagagucuauugacaua

SEQ ID NO: 2147726 - RNA, 22 nt, Human herpesvirus 7
augauuuuucugcuuaaaugua

SEQ ID NO: 2147727 - RNA, 22 nt, Human herpesvirus 7
cgaguguaaucuagaacuguua

SEQ ID NO: 2147728 - RNA, 18 nt, Human herpesvirus 7
gcaaauccuauaaaagca

SEQ ID NO: 2147729 - RNA, 15 nt, Human herpesvirus 7
aagauuuaacaugug

SEQ ID NO: 2147730 - RNA, 12 nt, Human herpesvirus 7
aauaacaggaaa

SEQ ID NO: 2147731 - RNA, 22 nt, Human herpesvirus 7
gacucuuuuuuuuuauugccuu

SEQ ID NO: 2147732 - RNA, 13 nt, Human herpesvirus 7
uuaaugucucugu

SEQ ID NO: 2147733 - RNA, 15 nt, Human herpesvirus 7
uuacacucuguuacu

SEQ ID NO: 2147734 - RNA, 16 nt, Human herpesvirus 7
uacaauuucuggcaau

SEQ ID NO: 2147735 - RNA, 16 nt, Human herpesvirus 7
uuuaagagacauugaa

SEQ ID NO: 2147736 - RNA, 16 nt, Human herpesvirus 7
gcagaccguaaaacaa

SEQ ID NO: 2147737 - RNA, 11 nt, Human herpesvirus 7
gaucuuguaau

SEQ ID NO: 2147738 - RNA, 13 nt, Human herpesvirus 7
aucucauagcuua

SEQ ID NO: 2147739 - RNA, 12 nt, Human herpesvirus 7
uuaaaauauguu

SEQ ID NO: 2147740 - RNA, 13 nt, Human herpesvirus 7
gcugaaauuucau

SEQ ID NO: 2147741 - RNA, 17 nt, Human herpesvirus 7
uccauuaagccagauuu

SEQ ID NO: 2147742 - RNA, 23 nt, Human herpesvirus 7
aaauauguggcacauaaguugac

SEQ ID NO: 2147743 - RNA, 13 nt, Human herpesvirus 7
auucuagcguuuc

SEQ ID NO: 2147744 - RNA, 16 nt, Human herpesvirus 7
acuugcaaagacagaa

SEQ ID NO: 2147745 - RNA, 18 nt, Human herpesvirus 7
caaaagacauaacaaaaa

SEQ ID NO: 2147746 - RNA, 18 nt, Human herpesvirus 7
augauuuaauauagaaau

SEQ ID NO: 2147747 - RNA, 14 nt, Human herpesvirus 7
gugcugucuugcuu

SEQ ID NO: 2147748 - RNA, 14 nt, Human herpesvirus 7
aaaguacaaauguu

SEQ ID NO: 2147749 - RNA, 20 nt, Human herpesvirus 7
gugucuuacaacuagaaaau

SEQ ID NO: 2147750 - RNA, 14 nt, Human herpesvirus 7
auuuuauuucagcu

SEQ ID NO: 2147751 - RNA, 22 nt, Human herpesvirus 7
auuaucgcaauuaauucaguuu

SEQ ID NO: 2147752 - RNA, 16 nt, Human herpesvirus 7
augaagacagcucaaa

SEQ ID NO: 2147753 - RNA, 20 nt, Human herpesvirus 7
gaauaugaagaguucuuguu

SEQ ID NO: 2147754 - RNA, 22 nt, Human herpesvirus 7
ugcuggaucauagagaaaacau

SEQ ID NO: 2147755 - RNA, 14 nt, Human herpesvirus 7
aucuuuuuucagug

SEQ ID NO: 2147756 - RNA, 13 nt, Human herpesvirus 7
accguuugcagcc

SEQ ID NO: 2147757 - RNA, 14 nt, Human herpesvirus 7
aaaguaugcuuugu

SEQ ID NO: 2147758 - RNA, 23 nt, Human herpesvirus 7
agcauuugguaaaaaaaauggag

SEQ ID NO: 2147759 - RNA, 13 nt, Human herpesvirus 7
aacugaaaacaau

SEQ ID NO: 2147760 - RNA, 22 nt, Human herpesvirus 7
guaaugaauaaaaucuauuuua

SEQ ID NO: 2147761 - RNA, 17 nt, Human herpesvirus 7
agauacgcgcagauuuu

SEQ ID NO: 2147762 - RNA, 22 nt, Human herpesvirus 7
auuuaacaaagugcauaaauaa

SEQ ID NO: 2147763 - RNA, 14 nt, Human herpesvirus 7
ucaagcacaaucac

SEQ ID NO: 2147764 - RNA, 19 nt, Human herpesvirus 7
gcuuucguuuauaaacucu

SEQ ID NO: 2147765 - RNA, 15 nt, Human herpesvirus 7
ggaagaacaagcaaa

SEQ ID NO: 2147766 - RNA, 14 nt, Human herpesvirus 7
aacaguucaaaaaa

SEQ ID NO: 2147767 - RNA, 18 nt, Human herpesvirus 7
caggaaaaagcagacauu

SEQ ID NO: 2147768 - RNA, 20 nt, Human herpesvirus 7
acgguaacggauuuacauuu

SEQ ID NO: 2147769 - RNA, 16 nt, Human herpesvirus 7
auuauuuuuaaaaaug

SEQ ID NO: 2147770 - RNA, 15 nt, Human herpesvirus 7
cacuauuggacaaaa

SEQ ID NO: 2147771 - RNA, 19 nt, Human herpesvirus 7
uaauguuuuuuucauacau

SEQ ID NO: 2147772 - RNA, 17 nt, Human herpesvirus 7
augaaucaaauuucaaa

SEQ ID NO: 2147773 - RNA, 16 nt, Human herpesvirus 7
uugugaguuucuacau

SEQ ID NO: 2147774 - RNA, 21 nt, Human herpesvirus 7
aaguuuccauaaauaaaaaca

SEQ ID NO: 2147775 - RNA, 22 nt, Human herpesvirus 7
cauuucaaaaucagaaauguua

SEQ ID NO: 2147776 - RNA, 14 nt, Human herpesvirus 7
uccagagucucuaa

SEQ ID NO: 2147777 - RNA, 19 nt, Human herpesvirus 7
agaaaaguugaaaauguuu

SEQ ID NO: 2147778 - RNA, 20 nt, Human herpesvirus 7
aagacacguuucucuguaga

SEQ ID NO: 2147779 - RNA, 20 nt, Human herpesvirus 7
ucaacacaauuuucacaucu

SEQ ID NO: 2147780 - RNA, 20 nt, Human herpesvirus 7
uuacaacuuugccaaugcca

SEQ ID NO: 2147781 - RNA, 15 nt, Human herpesvirus 7
ugucucauugacaug

SEQ ID NO: 2147782 - RNA, 22 nt, Human herpesvirus 7
uccaaagaaaaaaggaugaaag

SEQ ID NO: 2147783 - RNA, 16 nt, Human herpesvirus 7
ucauaucugacauuca

SEQ ID NO: 2147784 - RNA, 17 nt, Human herpesvirus 7
uaauacaaaauaaagcc

SEQ ID NO: 2147785 - RNA, 17 nt, Human herpesvirus 7
cuaagagcuuuugcaaa

SEQ ID NO: 2147786 - RNA, 18 nt, Human herpesvirus 7
ugaaacauagcuagaaau

SEQ ID NO: 2147787 - RNA, 16 nt, Human herpesvirus 7
aguagccgaaaaagaa

SEQ ID NO: 2147788 - RNA, 19 nt, Human herpesvirus 7
agaaugggugucagcuucu

SEQ ID NO: 2147789 - RNA, 16 nt, Human herpesvirus 7
aaugaauuagcuaaau

SEQ ID NO: 2147790 - RNA, 16 nt, Human herpesvirus 7
acgucaggaaaaaaac

SEQ ID NO: 2147791 - RNA, 21 nt, Human herpesvirus 7
aauccgucaccgacaauauaa

SEQ ID NO: 2147792 - RNA, 19 nt, Human herpesvirus 7
uagaacaaguagaaaaugc

SEQ ID NO: 2147793 - RNA, 16 nt, Human herpesvirus 7
aagcaaaagccacaga

SEQ ID NO: 2147794 - RNA, 18 nt, Human herpesvirus 7
uuuauauauggcaauaaa

SEQ ID NO: 2147795 - RNA, 15 nt, Human herpesvirus 7
agaguauuuaagaac

SEQ ID NO: 2147796 - RNA, 19 nt, Human herpesvirus 7
auuaucgcguuuucaugcu

SEQ ID NO: 2147797 - RNA, 17 nt, Human herpesvirus 7
gguaaauccuucguaac

SEQ ID NO: 2147798 - RNA, 20 nt, Human herpesvirus 7
aagaauuuuguaagaaacau

SEQ ID NO: 2147799 - RNA, 20 nt, Human herpesvirus 7
agugucuguuguaacagauu

SEQ ID NO: 2147800 - RNA, 13 nt, Human herpesvirus 7
aaugaaguuuauc

SEQ ID NO: 2147801 - RNA, 16 nt, Human herpesvirus 7
caucgguagugucugg

SEQ ID NO: 2147802 - RNA, 12 nt, Human herpesvirus 7
guuguuaagaau

SEQ ID NO: 2147803 - RNA, 14 nt, Human herpesvirus 7
uguauguugaaguu

SEQ ID NO: 2147804 - RNA, 19 nt, Human herpesvirus 7
uaauuugaauuaauucuag

SEQ ID NO: 2147805 - RNA, 13 nt, Human herpesvirus 7
ucagcucuguaau

SEQ ID NO: 2147806 - RNA, 18 nt, Human herpesvirus 7
agagaucauaauuacauu

SEQ ID NO: 2147807 - RNA, 18 nt, Human herpesvirus 7
aauucgcugaugaaaaua

SEQ ID NO: 2147808 - RNA, 20 nt, Human herpesvirus 7
auaacaauuauagaaacauu

SEQ ID NO: 2147809 - RNA, 14 nt, Human herpesvirus 7
agccauaaaaugua

SEQ ID NO: 2147810 - RNA, 23 nt, Human herpesvirus 7
gauguuuggcaacaaacaaauaa

SEQ ID NO: 2147811 - RNA, 18 nt, Human herpesvirus 7
uuuccuacaaaaguucug

SEQ ID NO: 2147812 - RNA, 19 nt, Human herpesvirus 7
aagaauuuuguaagaaaca

SEQ ID NO: 2147813 - RNA, 14 nt, Human herpesvirus 7
caaaagccacagau

SEQ ID NO: 2147814 - RNA, 18 nt, Human herpesvirus 7
agcaacagagaacaccau

SEQ ID NO: 2147815 - RNA, 16 nt, Human herpesvirus 7
gcuucuauuauagaag

SEQ ID NO: 2147816 - RNA, 19 nt, Human herpesvirus 7
uuacacuuggaguuguguu

SEQ ID NO: 2147817 - RNA, 18 nt, Human herpesvirus 7
ugcuuguaggcagaaaug

SEQ ID NO: 2147818 - RNA, 20 nt, Human herpesvirus 7
guauuaaaggaaacauuucu

SEQ ID NO: 2147819 - RNA, 14 nt, Human herpesvirus 7
caccauuguucaac

SEQ ID NO: 2147820 - RNA, 18 nt, Human herpesvirus 7
acuaaaacuacauuuaaa

SEQ ID NO: 2147821 - RNA, 22 nt, Human herpesvirus 7
aauaguuguguuuuaaaagcua

SEQ ID NO: 2147822 - RNA, 22 nt, Human herpesvirus 7
cuucagguuguugucauugaaa

SEQ ID NO: 2147823 - RNA, 23 nt, Human herpesvirus 7
uauagaacaaguagaaaaugcug

SEQ ID NO: 2147824 - RNA, 23 nt, Human herpesvirus 7
ugcuuacagaucuugcuuuagaa

SEQ ID NO: 2147825 - RNA, 14 nt, Human herpesvirus 7
aaccgauacagauc

SEQ ID NO: 2147826 - RNA, 22 nt, Human herpesvirus 7
cagaaagaucaaugcacacauu

SEQ ID NO: 2147827 - RNA, 17 nt, Human herpesvirus 7
aaaggaaaaauuucuuc

SEQ ID NO: 2147828 - RNA, 21 nt, Human herpesvirus 7
uauucuacacaucuucaaugu

SEQ ID NO: 2147829 - RNA, 13 nt, Human herpesvirus 7
agaagaagauuuu

SEQ ID NO: 2147830 - RNA, 22 nt, Human herpesvirus 7
agcuucuaaaugugcuaaauaa

SEQ ID NO: 2147831 - RNA, 18 nt, Human herpesvirus 7
auuuuaaaacugaagcau

SEQ ID NO: 2147832 - RNA, 18 nt, Human herpesvirus 7
acagauucuccagaaauu

SEQ ID NO: 2147833 - RNA, 17 nt, Human herpesvirus 7
ugugcgaagguugucug

SEQ ID NO: 2147834 - RNA, 15 nt, Human herpesvirus 7
ucagaguuuaaagua

SEQ ID NO: 2147835 - RNA, 17 nt, Human herpesvirus 7
auuucuguaaaaacuug

SEQ ID NO: 2147836 - RNA, 23 nt, Human herpesvirus 7
caauauguagcaucucuguggcu

SEQ ID NO: 2147837 - RNA, 19 nt, Human herpesvirus 7
uugcugguggguuuugaaa

SEQ ID NO: 2147838 - RNA, 13 nt, Human herpesvirus 7
aaucgagaauaaa

SEQ ID NO: 2147839 - RNA, 12 nt, Human herpesvirus 7
acuuguuuugac

SEQ ID NO: 2147840 - RNA, 16 nt, Human herpesvirus 7
gaagaaugcaagccua

SEQ ID NO: 2147841 - RNA, 16 nt, Human herpesvirus 7
ccuucuaaauucuuua

SEQ ID NO: 2147842 - RNA, 17 nt, Human herpesvirus 7
cagggaagaaacagcug

SEQ ID NO: 2147843 - RNA, 17 nt, Human herpesvirus 7
aaauauuuuacauauua

SEQ ID NO: 2147844 - RNA, 13 nt, Human herpesvirus 7
caauuucacagac

SEQ ID NO: 2147845 - RNA, 14 nt, Human herpesvirus 7
gauuagaaucagac

SEQ ID NO: 2147846 - RNA, 23 nt, Human herpesvirus 7
cagucugaaagccgcugccuucg

SEQ ID NO: 2147847 - RNA, 23 nt, Human herpesvirus 7
ugaucuugucaaaaaaaauuaaa

SEQ ID NO: 2147848 - RNA, 23 nt, Human herpesvirus 7
uuuuaauaugugaaaauaaacag

SEQ ID NO: 2147849 - RNA, 14 nt, Human herpesvirus 7
agcacauguacaga

SEQ ID NO: 2147850 - RNA, 15 nt, Human herpesvirus 7
uaaugcgguuuugua

SEQ ID NO: 2147851 - RNA, 17 nt, Human herpesvirus 7
agauauucuaacaaaua

SEQ ID NO: 2147852 - RNA, 16 nt, Human herpesvirus 7
cagcaacugugcauga

SEQ ID NO: 2147853 - RNA, 17 nt, Human herpesvirus 7
auuucuggaugaaaacu

SEQ ID NO: 2147854 - RNA, 18 nt, Human herpesvirus 7
ucuuuuugaacagaauuu

SEQ ID NO: 2147855 - RNA, 16 nt, Human herpesvirus 7
cugcuggaaagcuugu

SEQ ID NO: 2147856 - RNA, 16 nt, Human herpesvirus 7
gagagaauaagcaaau

SEQ ID NO: 2147857 - RNA, 20 nt, Human herpesvirus 7
auauaugucauagugggaac

SEQ ID NO: 2147858 - RNA, 19 nt, Human herpesvirus 7
guugaaugaggacugcagu

SEQ ID NO: 2147859 - RNA, 22 nt, Human herpesvirus 7
caaaacugcaaauccaacagaa

SEQ ID NO: 2147860 - RNA, 21 nt, Human herpesvirus 7
aaaagauguuacccaaaaugu

SEQ ID NO: 2147861 - RNA, 15 nt, Human herpesvirus 7
uucaauuaaugcauu

SEQ ID NO: 2147862 - RNA, 20 nt, Human herpesvirus 7
agaauguugagcuaucugau

SEQ ID NO: 2147863 - RNA, 16 nt, Human herpesvirus 7
aaucuauauaaaauau

SEQ ID NO: 2147864 - RNA, 18 nt, Human herpesvirus 7
uauacuuauuauaucuua

SEQ ID NO: 2147865 - RNA, 23 nt, Human herpesvirus 7
caucgaagaaauucgaaacacuu

SEQ ID NO: 2147866 - RNA, 16 nt, Human herpesvirus 7
auuauuaaagcuuuca

SEQ ID NO: 2147867 - RNA, 20 nt, Human herpesvirus 7
agcgcaaaggaaaaaugcug

SEQ ID NO: 2147868 - RNA, 23 nt, Human herpesvirus 7
agagaugauguuuuuugucuuuu

SEQ ID NO: 2147869 - RNA, 23 nt, Human herpesvirus 7
gucggcacacguacaauauuaaa

SEQ ID NO: 2147870 - RNA, 13 nt, Human herpesvirus 7
uguuacccaaaau

SEQ ID NO: 2147871 - RNA, 17 nt, Human herpesvirus 7
cugggauagaaauguaa

SEQ ID NO: 2147872 - RNA, 14 nt, Human herpesvirus 7
uuaaauuauuauua

SEQ ID NO: 2147873 - RNA, 20 nt, Human herpesvirus 7
auuuugaucuugucaaaaaa

SEQ ID NO: 2147874 - RNA, 22 nt, Human herpesvirus 7
acagaauacuacucagaagaca

SEQ ID NO: 2147875 - RNA, 13 nt, Human herpesvirus 7
uugaaauaaagga

SEQ ID NO: 2147876 - RNA, 21 nt, Human herpesvirus 7
uaaagagaaaguaaaagcuau

SEQ ID NO: 2147877 - RNA, 15 nt, Human herpesvirus 7
caaauuuauauuuua

SEQ ID NO: 2147878 - RNA, 15 nt, Human herpesvirus 7
aaauuuaaauacuga

SEQ ID NO: 2147879 - RNA, 18 nt, Human herpesvirus 7
gguaaagaaccuaucaaa

SEQ ID NO: 2147880 - RNA, 14 nt, Human herpesvirus 7
cguaaguuguuaua

SEQ ID NO: 2147881 - RNA, 21 nt, Human herpesvirus 7
uuacacaaauugauccugcua

SEQ ID NO: 2147882 - RNA, 17 nt, Human herpesvirus 7
auaaucaagaaacaugu

SEQ ID NO: 2147883 - RNA, 20 nt, Human herpesvirus 7
gaaaagaaaaagcaacaaau

SEQ ID NO: 2147884 - RNA, 17 nt, Human herpesvirus 7
uaaaguuuauauuuucu

SEQ ID NO: 2147885 - RNA, 11 nt, Human herpesvirus 7
gugucuuacaa

SEQ ID NO: 2147886 - RNA, 12 nt, Human herpesvirus 7
aaaaauaauaaa

SEQ ID NO: 2147887 - RNA, 16 nt, Human herpesvirus 7
guacgagcgauuuaau

SEQ ID NO: 2147888 - RNA, 17 nt, Human herpesvirus 7
uagacguagugucauca

SEQ ID NO: 2147889 - RNA, 19 nt, Human herpesvirus 7
auuucaagaaggaaaauuu

SEQ ID NO: 2147890 - RNA, 17 nt, Human herpesvirus 7
aaagcuuacucuuucug

SEQ ID NO: 2147891 - RNA, 22 nt, Human herpesvirus 7
aauuuccgaccugagaugauaa

SEQ ID NO: 2147892 - RNA, 13 nt, Human herpesvirus 7
aauaauauaaaag

SEQ ID NO: 2147893 - RNA, 21 nt, Human herpesvirus 7
ggaguuugucucauugacaug

SEQ ID NO: 2147894 - RNA, 18 nt, Human herpesvirus 7
gauauauguguacagauu

SEQ ID NO: 2147895 - RNA, 19 nt, Human herpesvirus 7
gugauuguagauggcacca

SEQ ID NO: 2147896 - RNA, 22 nt, Human herpesvirus 7
cgaaucuuuauuauuuacugau

SEQ ID NO: 2147897 - RNA, 12 nt, Human herpesvirus 7
caaaucaaaguu

SEQ ID NO: 2147898 - RNA, 22 nt, Human herpesvirus 7
aaccacgcauaugcuaagaaag

SEQ ID NO: 2147899 - RNA, 19 nt, Human herpesvirus 7
uucaacacauaauguguau

SEQ ID NO: 2147900 - RNA, 16 nt, Human herpesvirus 7
cuuacacuauucucua

SEQ ID NO: 2147901 - RNA, 17 nt, Human herpesvirus 7
cuuauacuccacauuca

SEQ ID NO: 2147902 - RNA, 14 nt, Human herpesvirus 7
guaacuuucaucug

SEQ ID NO: 2147903 - RNA, 14 nt, Human herpesvirus 7
uacuuuuaaaauug

SEQ ID NO: 2147904 - RNA, 14 nt, Human herpesvirus 7
uaaaugcuuaaauu

SEQ ID NO: 2147905 - RNA, 20 nt, Human herpesvirus 7
agaucauaauuacauugcag

SEQ ID NO: 2147906 - RNA, 14 nt, Human herpesvirus 7
aguacaucuuucua

SEQ ID NO: 2147907 - RNA, 22 nt, Human herpesvirus 7
agagucugugugugcaguguuu

SEQ ID NO: 2147908 - RNA, 17 nt, Human herpesvirus 7
auuuccguuguuaaaaa

SEQ ID NO: 2147909 - RNA, 17 nt, Human herpesvirus 7
uaauuucucaaaucuuu

SEQ ID NO: 2147910 - RNA, 15 nt, Human herpesvirus 7
gauguuacccaaaau

SEQ ID NO: 2147911 - RNA, 19 nt, Human herpesvirus 7
cacgcucccauaaaacaag

SEQ ID NO: 2147912 - RNA, 20 nt, Human herpesvirus 7
ucugaguguguuaaaugcga

SEQ ID NO: 2147913 - RNA, 20 nt, Human herpesvirus 7
caauuauuuuaaauucuaau

SEQ ID NO: 2147914 - RNA, 17 nt, Human herpesvirus 7
aucaauuuuaaugugcu

SEQ ID NO: 2147915 - RNA, 15 nt, Human herpesvirus 7
ugcccucagaacugu

SEQ ID NO: 2147916 - RNA, 17 nt, Human herpesvirus 7
aucugauaaaaaaagaa

SEQ ID NO: 2147917 - RNA, 21 nt, Human herpesvirus 7
uaaaauguacauaacucuauc

SEQ ID NO: 2147918 - RNA, 13 nt, Human herpesvirus 7
aaaguacaaaugu

SEQ ID NO: 2147919 - RNA, 15 nt, Human herpesvirus 7
agaauauaaaaaauu

SEQ ID NO: 2147920 - RNA, 14 nt, Human herpesvirus 7
aggcagaaaugucu

SEQ ID NO: 2147921 - RNA, 15 nt, Human herpesvirus 7
agugucuaagguuuu

SEQ ID NO: 2147922 - RNA, 21 nt, Human herpesvirus 7
guggagcuauacguuuggagc

SEQ ID NO: 2147923 - RNA, 15 nt, Human herpesvirus 7
caaccacagacacac

SEQ ID NO: 2147924 - RNA, 20 nt, Human herpesvirus 7
aaacauuguguuuuuuguaa

SEQ ID NO: 2147925 - RNA, 15 nt, Human herpesvirus 7
aaauaucuucugaac

SEQ ID NO: 2147926 - RNA, 18 nt, Human herpesvirus 7
aaaaucucagcucuguaa

SEQ ID NO: 2147927 - RNA, 18 nt, Human herpesvirus 7
auaauaaaaaagauguua

SEQ ID NO: 2147928 - RNA, 12 nt, Human herpesvirus 7
uucugaaaaucu

SEQ ID NO: 2147929 - RNA, 18 nt, Human herpesvirus 7
aagcuauguauaaucaag

SEQ ID NO: 2147930 - RNA, 15 nt, Human herpesvirus 7
uauagaucuugacuc

SEQ ID NO: 2147931 - RNA, 13 nt, Human herpesvirus 7
aaaauguaucuua

SEQ ID NO: 2147932 - RNA, 17 nt, Human herpesvirus 7
cagaacauugucaaaga

SEQ ID NO: 2147933 - RNA, 18 nt, Human herpesvirus 7
gacaacaaagcaugaaaa

SEQ ID NO: 2147934 - RNA, 22 nt, Human herpesvirus 7
acaagaugcgaguccaaaaguu

SEQ ID NO: 2147935 - RNA, 21 nt, Human herpesvirus 7
cuguaaucauauaugcauuau

SEQ ID NO: 2147936 - RNA, 15 nt, Human herpesvirus 7
uuauacacugugaaa

SEQ ID NO: 2147937 - RNA, 18 nt, Human herpesvirus 7
uuguuuggucuauugaaa

SEQ ID NO: 2147938 - RNA, 14 nt, Human herpesvirus 7
cacagaaaucccaa

SEQ ID NO: 2147939 - RNA, 18 nt, Human herpesvirus 7
aaaauaaauucugaaaua

SEQ ID NO: 2147940 - RNA, 12 nt, Human herpesvirus 7
ucuuaaaauaug

SEQ ID NO: 2147941 - RNA, 13 nt, Human herpesvirus 7
agaacaaguagaa

SEQ ID NO: 2147942 - RNA, 23 nt, Human herpesvirus 7
aggaauuucgcgagcugugucca

SEQ ID NO: 2147943 - RNA, 15 nt, Human herpesvirus 7
gaaaacaucagaccu

SEQ ID NO: 2147944 - RNA, 22 nt, Human herpesvirus 7
gucauugucgugagauuugaaa

SEQ ID NO: 2147945 - RNA, 16 nt, Human herpesvirus 7
augccagaaauuaaau

SEQ ID NO: 2147946 - RNA, 20 nt, Human herpesvirus 7
caucgaauuuuacaaugcag

SEQ ID NO: 2147947 - RNA, 15 nt, Human herpesvirus 7
aucuuguaauuucuc

SEQ ID NO: 2147948 - RNA, 18 nt, Human herpesvirus 7
auuugaagauaaguauaa

SEQ ID NO: 2147949 - RNA, 18 nt, Human herpesvirus 7
uuguguggcaacaucuuc

SEQ ID NO: 2147950 - RNA, 18 nt, Human herpesvirus 7
cgggaggugcuguuucca

SEQ ID NO: 2147951 - RNA, 21 nt, Human herpesvirus 7
aaagacagagucaaucuguga

SEQ ID NO: 2147952 - RNA, 13 nt, Human herpesvirus 7
gcauaaagcacca

SEQ ID NO: 2147953 - RNA, 22 nt, Human herpesvirus 7
aagcuuuugcgagaaaauacua

SEQ ID NO: 2147954 - RNA, 14 nt, Human herpesvirus 7
gcuagaaucuuguu

SEQ ID NO: 2147955 - RNA, 17 nt, Human herpesvirus 7
ccaaaccggccaaugau

SEQ ID NO: 2147956 - RNA, 13 nt, Human herpesvirus 7
aaaacacaguaua

SEQ ID NO: 2147957 - RNA, 20 nt, Human herpesvirus 7
ucagaaaaaaucaaaacauu

SEQ ID NO: 2147958 - RNA, 13 nt, Human herpesvirus 7
cacaaauuucuug

SEQ ID NO: 2147959 - RNA, 16 nt, Human herpesvirus 7
uuacuuucauagcuua

SEQ ID NO: 2147960 - RNA, 13 nt, Human herpesvirus 7
aaacaacauaucg

SEQ ID NO: 2147961 - RNA, 15 nt, Human herpesvirus 7
augugcacauuccaa

SEQ ID NO: 2147962 - RNA, 18 nt, Human herpesvirus 7
cgagaaaauuuagcacca

SEQ ID NO: 2147963 - RNA, 19 nt, Human herpesvirus 7
agauguguuggaaacuauu

SEQ ID NO: 2147964 - RNA, 21 nt, Human herpesvirus 7
agugucuuuuauuacucgaaa

SEQ ID NO: 2147965 - RNA, 11 nt, Human herpesvirus 7
gaaauuucaug

SEQ ID NO: 2147966 - RNA, 21 nt, Human herpesvirus 7
uuugauacagauauuuuaauu

SEQ ID NO: 2147967 - RNA, 14 nt, Human herpesvirus 7
uuuuggaagguuua

SEQ ID NO: 2147968 - RNA, 22 nt, Human herpesvirus 7
guugaucgucuguugaaacaua

SEQ ID NO: 2147969 - RNA, 15 nt, Human herpesvirus 7
uucaauuguccauuu

SEQ ID NO: 2147970 - RNA, 14 nt, Human herpesvirus 7
uaaacaaacaauga

SEQ ID NO: 2147971 - RNA, 18 nt, Human herpesvirus 7
auucauuuguuuaagaca

SEQ ID NO: 2147972 - RNA, 18 nt, Human herpesvirus 7
accuuacaacaaagaaaa

SEQ ID NO: 2147973 - RNA, 17 nt, Human herpesvirus 7
uccaaagugaugaaagu

SEQ ID NO: 2147974 - RNA, 13 nt, Human herpesvirus 7
gaagaaaagaaaa

SEQ ID NO: 2147975 - RNA, 23 nt, Human herpesvirus 7
gugaacccauagaagaaugcaag

SEQ ID NO: 2147976 - RNA, 19 nt, Human herpesvirus 7
acaauacccaauacauaag

SEQ ID NO: 2147977 - RNA, 18 nt, Human herpesvirus 7
cuguuuuucaaaaacguu

SEQ ID NO: 2147978 - RNA, 19 nt, Human herpesvirus 7
gugcagagaugaaggaagc

SEQ ID NO: 2147979 - RNA, 21 nt, Human herpesvirus 7
gcaaagucucauucaugcaca

SEQ ID NO: 2147980 - RNA, 22 nt, Human herpesvirus 7
aaacuucugauuggucguugcu

SEQ ID NO: 2147981 - RNA, 17 nt, Human herpesvirus 7
aaccaauuaauauuaau

SEQ ID NO: 2147982 - RNA, 15 nt, Human herpesvirus 7
agcuuaaaaaauaca

SEQ ID NO: 2147983 - RNA, 14 nt, Human herpesvirus 7
acuauuugacuggg

SEQ ID NO: 2147984 - RNA, 15 nt, Human herpesvirus 7
ucccagaaauuucaa

SEQ ID NO: 2147985 - RNA, 18 nt, Human herpesvirus 7
cauaauucaaucugcaaa

SEQ ID NO: 2147986 - RNA, 12 nt, Human herpesvirus 7
auuuacuugauu

SEQ ID NO: 2147987 - RNA, 20 nt, Human herpesvirus 7
agacaucuuccacaaaaauu

SEQ ID NO: 2147988 - RNA, 12 nt, Human herpesvirus 7
uuauagaaguac

SEQ ID NO: 2147989 - RNA, 16 nt, Human herpesvirus 7
guuacccaaaauguaa

SEQ ID NO: 2147990 - RNA, 18 nt, Human herpesvirus 7
ugacaccguuuugaaaag

SEQ ID NO: 2147991 - RNA, 17 nt, Human herpesvirus 7
aucuuuuucaaauggau

SEQ ID NO: 2147992 - RNA, 21 nt, Human herpesvirus 7
aaugagauuuuucccaaaaua

SEQ ID NO: 2147993 - RNA, 21 nt, Human herpesvirus 7
ugaguguggugacagaaguaa

SEQ ID NO: 2147994 - RNA, 23 nt, Human herpesvirus 7
aucuaggucuuccacuguuguag

SEQ ID NO: 2147995 - RNA, 15 nt, Human herpesvirus 7
aaagucagaacauug

SEQ ID NO: 2147996 - RNA, 17 nt, Human herpesvirus 7
uccauuuccucaauuuu

SEQ ID NO: 2147997 - RNA, 15 nt, Human herpesvirus 7
auauaauaaaucguu

SEQ ID NO: 2147998 - RNA, 14 nt, Human herpesvirus 7
gacgacgucuucuu

SEQ ID NO: 2147999 - RNA, 22 nt, Human herpesvirus 7
gucagaacaucccuggacagag

SEQ ID NO: 2148000 - RNA, 20 nt, Human herpesvirus 7
caauuaauucaguuuacugu

SEQ ID NO: 2148001 - RNA, 20 nt, Human herpesvirus 7
ugccuuucccagaagaaugg

SEQ ID NO: 2148002 - RNA, 17 nt, Human herpesvirus 7
gaaaugucaagaacuuc

SEQ ID NO: 2148003 - RNA, 21 nt, Human herpesvirus 7
aaugugguaaauuugcuugcu

SEQ ID NO: 2148004 - RNA, 15 nt, Human herpesvirus 7
uaaauaaaaugguug

SEQ ID NO: 2148005 - RNA, 16 nt, Human herpesvirus 7
ccucagaacuguuuua

SEQ ID NO: 2148006 - RNA, 16 nt, Human herpesvirus 7
agugauugguagaaau

SEQ ID NO: 2148007 - RNA, 17 nt, Human herpesvirus 7
uuacuuacgugaguguu

SEQ ID NO: 2148008 - RNA, 15 nt, Human herpesvirus 7
caggcugcaucuuuu

SEQ ID NO: 2148009 - RNA, 15 nt, Human herpesvirus 7
acgcucucaaucaaa

SEQ ID NO: 2148010 - RNA, 14 nt, Human herpesvirus 7
aacuaggaaacaca

SEQ ID NO: 2148011 - RNA, 18 nt, Human herpesvirus 7
uagaacaaacuguaccca

SEQ ID NO: 2148012 - RNA, 16 nt, Human herpesvirus 7
uuaagguggaaaucuu

SEQ ID NO: 2148013 - RNA, 21 nt, Human herpesvirus 7
auuucguuuucuuuggguaca

SEQ ID NO: 2148014 - RNA, 21 nt, Human herpesvirus 7
uguguauuuuuuaaagaaaag

SEQ ID NO: 2148015 - RNA, 13 nt, Human herpesvirus 7
ugcggaagaacaa

SEQ ID NO: 2148016 - RNA, 18 nt, Human herpesvirus 7
uuuauuuucuuaacaauu

SEQ ID NO: 2148017 - RNA, 15 nt, Human herpesvirus 7
ugauuuuuuaaaugu

SEQ ID NO: 2148018 - RNA, 20 nt, Human herpesvirus 7
cuucaauucaccaauuucua

SEQ ID NO: 2148019 - RNA, 14 nt, Human herpesvirus 7
uaugcaagaaaguc

SEQ ID NO: 2148020 - RNA, 21 nt, Human herpesvirus 7
aaaaaagugauugcagauugu

SEQ ID NO: 2148021 - RNA, 20 nt, Human herpesvirus 7
auguuucaucaauguuuuca

SEQ ID NO: 2148022 - RNA, 13 nt, Human herpesvirus 7
aucgcucaacuua

SEQ ID NO: 2148023 - RNA, 17 nt, Human herpesvirus 7
gagauauuauuaaaaaa

SEQ ID NO: 2148024 - RNA, 13 nt, Human herpesvirus 7
ucauaccauaaau

SEQ ID NO: 2148025 - RNA, 15 nt, Human herpesvirus 7
gguaauagcuuuaaa

SEQ ID NO: 2148026 - RNA, 18 nt, Human herpesvirus 7
acauuuaugaaaaacaaa

SEQ ID NO: 2148027 - RNA, 16 nt, Human herpesvirus 7
ggaaccguuugcagcc

SEQ ID NO: 2148028 - RNA, 18 nt, Human herpesvirus 7
cugagacgauaugaauuu

SEQ ID NO: 2148029 - RNA, 20 nt, Human herpesvirus 7
aaucuuggcauugaaauucu

SEQ ID NO: 2148030 - RNA, 22 nt, Human herpesvirus 7
ucuuucaacugauauaaaugcu

SEQ ID NO: 2148031 - RNA, 21 nt, Human herpesvirus 7
uuaaugguaccuuagaaucac

SEQ ID NO: 2148032 - RNA, 14 nt, Human herpesvirus 7
cuucaaagauaccu

SEQ ID NO: 2148033 - RNA, 13 nt, Human herpesvirus 7
ugucauaaaauua

SEQ ID NO: 2148034 - RNA, 23 nt, Human herpesvirus 7
cuuuucaggcuaugacuuugaau

SEQ ID NO: 2148035 - RNA, 21 nt, Human herpesvirus 7
ucaaacaauugcccuuguguu

SEQ ID NO: 2148036 - RNA, 22 nt, Human herpesvirus 7
auacugauguaaaauuaauuca

SEQ ID NO: 2148037 - RNA, 15 nt, Human herpesvirus 7
cauuuaaaaaaucug

SEQ ID NO: 2148038 - RNA, 17 nt, Human herpesvirus 7
cuauguccaaaaauuua

SEQ ID NO: 2148039 - RNA, 17 nt, Human herpesvirus 7
agggauuucuucuucua

SEQ ID NO: 2148040 - RNA, 14 nt, Human herpesvirus 7
uguucuaucaagau

SEQ ID NO: 2148041 - RNA, 21 nt, Human herpesvirus 7
ccucagaacuguuuuaaugua

SEQ ID NO: 2148042 - RNA, 19 nt, Human herpesvirus 7
uuccaaaaucaaguguuuc

SEQ ID NO: 2148043 - RNA, 21 nt, Human herpesvirus 7
ugaucaaaaucuguagaaaau

SEQ ID NO: 2148044 - RNA, 21 nt, Human herpesvirus 7
acagcaaauucacgcucucaa

SEQ ID NO: 2148045 - RNA, 16 nt, Human herpesvirus 7
gggcuggagcuuuaaa

SEQ ID NO: 2148046 - RNA, 17 nt, Human herpesvirus 7
caaauucaaccacagac

SEQ ID NO: 2148047 - RNA, 14 nt, Human herpesvirus 7
acguagaaaaaaac

SEQ ID NO: 2148048 - RNA, 15 nt, Human herpesvirus 7
aucuuucauaacaaa

SEQ ID NO: 2148049 - RNA, 21 nt, Human herpesvirus 7
agcuugaaaacuuagugauga

SEQ ID NO: 2148050 - RNA, 14 nt, Human herpesvirus 7
aauaugcauggaga

SEQ ID NO: 2148051 - RNA, 13 nt, Human herpesvirus 7
cguaucugugacu

SEQ ID NO: 2148052 - RNA, 13 nt, Human herpesvirus 7
aaaaucagaaaug

SEQ ID NO: 2148053 - RNA, 19 nt, Human herpesvirus 7
aaauuauuaauauuaguau

SEQ ID NO: 2148054 - RNA, 20 nt, Human herpesvirus 7
uauuuuuuaaagaaaagcuu

SEQ ID NO: 2148055 - RNA, 13 nt, Human herpesvirus 7
ucacaauggaaag

SEQ ID NO: 2148056 - RNA, 15 nt, Human herpesvirus 7
caugauguuaaagaa

SEQ ID NO: 2148057 - RNA, 15 nt, Human herpesvirus 7
ccucugccucuuggc

SEQ ID NO: 2148058 - RNA, 19 nt, Human herpesvirus 7
aagaauuuucugcuuuaag

SEQ ID NO: 2148059 - RNA, 13 nt, Human herpesvirus 7
uauuaaaaaccac

SEQ ID NO: 2148060 - RNA, 17 nt, Human herpesvirus 7
gucagaacuuuuaaaaa

SEQ ID NO: 2148061 - RNA, 17 nt, Human herpesvirus 7
gauacauuuuugcaaua

SEQ ID NO: 2148062 - RNA, 17 nt, Human herpesvirus 7
caguaucacuuaaagca

SEQ ID NO: 2148063 - RNA, 17 nt, Human herpesvirus 7
aacucugucaucaaaau

SEQ ID NO: 2148064 - RNA, 14 nt, Human herpesvirus 7
aucauuaaaaugau

SEQ ID NO: 2148065 - RNA, 16 nt, Human herpesvirus 7
auuguuaccgguuaaa

SEQ ID NO: 2148066 - RNA, 19 nt, Human herpesvirus 7
aauaugaugaaacuuccaa

SEQ ID NO: 2148067 - RNA, 14 nt, Human herpesvirus 7
uggaacaugaaaac

SEQ ID NO: 2148068 - RNA, 22 nt, Human herpesvirus 7
caacauuuguguguaugugcag

SEQ ID NO: 2148069 - RNA, 18 nt, Human herpesvirus 7
cgguaacaugucuucaac

SEQ ID NO: 2148070 - RNA, 20 nt, Human herpesvirus 7
ugaaaaagccauaaaaugua

SEQ ID NO: 2148071 - RNA, 13 nt, Human herpesvirus 7
aaugcaugaugca

SEQ ID NO: 2148072 - RNA, 22 nt, Human herpesvirus 7
aguuuuuaaacuuaucagauuc

SEQ ID NO: 2148073 - RNA, 17 nt, Human herpesvirus 7
gacgcuugcuauuuucu

SEQ ID NO: 2148074 - RNA, 18 nt, Human herpesvirus 7
cacgaucgucaucuucuc

SEQ ID NO: 2148075 - RNA, 14 nt, Human herpesvirus 7
uaaauaaaaauuug

SEQ ID NO: 2148076 - RNA, 22 nt, Human herpesvirus 7
gugagaaauggaaaccuggaga

SEQ ID NO: 2148077 - RNA, 18 nt, Human herpesvirus 7
acuucuuugacaaaaaug

SEQ ID NO: 2148078 - RNA, 15 nt, Human herpesvirus 7
guaggauugaaagua

SEQ ID NO: 2148079 - RNA, 15 nt, Human herpesvirus 7
cuuucguuuucuaaa

SEQ ID NO: 2148080 - RNA, 22 nt, Human herpesvirus 7
gaagauuuguuccaaacucgag

SEQ ID NO: 2148081 - RNA, 14 nt, Human herpesvirus 7
aucaaaacauauca

SEQ ID NO: 2148082 - RNA, 13 nt, Human herpesvirus 7
uuguacuucugug

SEQ ID NO: 2148083 - RNA, 13 nt, Human herpesvirus 7
aauaagcaaauaa

SEQ ID NO: 2148084 - RNA, 16 nt, Human herpesvirus 7
aaauguguaacaauug

SEQ ID NO: 2148085 - RNA, 17 nt, Human herpesvirus 7
cacaauuguauuucagu

SEQ ID NO: 2148086 - RNA, 19 nt, Human herpesvirus 7
cauuccuauuaagcagcuu

SEQ ID NO: 2148087 - RNA, 23 nt, Human herpesvirus 7
uaauacauggggcauuaauucuu

SEQ ID NO: 2148088 - RNA, 20 nt, Human herpesvirus 7
agcuucaaaaauguuuacaa

SEQ ID NO: 2148089 - RNA, 20 nt, Human herpesvirus 7
caagucaucgguuuucugag

SEQ ID NO: 2148090 - RNA, 24 nt, Human herpesvirus 7
uuguuaggccaguucuaucucaaa

SEQ ID NO: 2148091 - RNA, 20 nt, Human herpesvirus 7
gcacugggagcaaugcauga

SEQ ID NO: 2148092 - RNA, 17 nt, Human herpesvirus 7
ccagaaauuaaauacaa

SEQ ID NO: 2148093 - RNA, 17 nt, Human herpesvirus 7
cuagcaccgaaaauggu

SEQ ID NO: 2148094 - RNA, 14 nt, Human herpesvirus 7
uuaagaaauaaaag

SEQ ID NO: 2148095 - RNA, 16 nt, Human herpesvirus 7
ugaacaaauaaugagu

SEQ ID NO: 2148096 - RNA, 20 nt, Human herpesvirus 7
uacacaggaauugcugucua

SEQ ID NO: 2148097 - RNA, 19 nt, Human herpesvirus 7
guuaauugugguacaacaa

SEQ ID NO: 2148098 - RNA, 15 nt, Human herpesvirus 7
acuacaugaauggau

SEQ ID NO: 2148099 - RNA, 15 nt, Human herpesvirus 7
cugaaaauaaaagag

SEQ ID NO: 2148100 - RNA, 19 nt, Human herpesvirus 7
auuaaacagcauuuucucu

SEQ ID NO: 2148101 - RNA, 21 nt, Human herpesvirus 7
uuaacaugccugcaauaugca

SEQ ID NO: 2148102 - RNA, 15 nt, Human herpesvirus 7
auauaucugauguag

SEQ ID NO: 2148103 - RNA, 20 nt, Human herpesvirus 7
gauccaucuguaacagaccu

SEQ ID NO: 2148104 - RNA, 16 nt, Human herpesvirus 7
cucccauucaauaaug

SEQ ID NO: 2148105 - RNA, 20 nt, Human herpesvirus 7
gacuuaucaaucuauuucua

SEQ ID NO: 2148106 - RNA, 17 nt, Human herpesvirus 7
uaaauuuaaaauuuaua

SEQ ID NO: 2148107 - RNA, 17 nt, Human herpesvirus 7
aguaucacuuaaagcag

SEQ ID NO: 2148108 - RNA, 23 nt, Human herpesvirus 7
auugcuucagaaauaacaaaauu

SEQ ID NO: 2148109 - RNA, 17 nt, Human herpesvirus 7
gauauaguuuguuucaa

SEQ ID NO: 2148110 - RNA, 14 nt, Human herpesvirus 7
gaauuaauaaaaca

SEQ ID NO: 2148111 - RNA, 16 nt, Human herpesvirus 7
aagguugaguugacaa

SEQ ID NO: 2148112 - RNA, 20 nt, Human herpesvirus 7
uaauucucgcuucaaagaua

SEQ ID NO: 2148113 - RNA, 16 nt, Human herpesvirus 7
augucugauucuuauu

SEQ ID NO: 2148114 - RNA, 11 nt, Human herpesvirus 7
auauaugaauc

SEQ ID NO: 2148115 - RNA, 12 nt, Human herpesvirus 7
aaaaucaaaugu

SEQ ID NO: 2148116 - RNA, 15 nt, Human herpesvirus 7
uuaaaaguucauaau

SEQ ID NO: 2148117 - RNA, 22 nt, Human herpesvirus 7
agaaaucccaaaaaaaauuagu

SEQ ID NO: 2148118 - RNA, 22 nt, Human herpesvirus 7
ugcuuguaggcagaaaugucuu

SEQ ID NO: 2148119 - RNA, 23 nt, Human herpesvirus 7
augacacgacacugaaugucaac

SEQ ID NO: 2148120 - RNA, 20 nt, Human herpesvirus 7
acaugauugguaaaaaauua

SEQ ID NO: 2148121 - RNA, 13 nt, Human herpesvirus 7
auuuaugcuuuaa

SEQ ID NO: 2148122 - RNA, 15 nt, Human herpesvirus 7
ucguuuucaaagugu

SEQ ID NO: 2148123 - RNA, 15 nt, Human herpesvirus 7
uuaauaauauuagua

SEQ ID NO: 2148124 - RNA, 21 nt, Human herpesvirus 7
uuaauuguuuuuuauuuagcu

SEQ ID NO: 2148125 - RNA, 21 nt, Human herpesvirus 7
uacuuaaggcggacaaauaua

SEQ ID NO: 2148126 - RNA, 16 nt, Human herpesvirus 7
aguccaauaguaaugu

SEQ ID NO: 2148127 - RNA, 13 nt, Human herpesvirus 7
cuguugccagaaa

SEQ ID NO: 2148128 - RNA, 14 nt, Human herpesvirus 7
aauuaugaguaaag

SEQ ID NO: 2148129 - RNA, 19 nt, Human herpesvirus 7
caaauagaguuuaauugua

SEQ ID NO: 2148130 - RNA, 13 nt, Human herpesvirus 7
ugaaugaacaaau

SEQ ID NO: 2148131 - RNA, 21 nt, Human herpesvirus 7
acaauuugaagaggagaauuc

SEQ ID NO: 2148132 - RNA, 17 nt, Human herpesvirus 7
agauggcacaauuguaa

SEQ ID NO: 2148133 - RNA, 19 nt, Human herpesvirus 7
ugcucauguugacgggaaa

SEQ ID NO: 2148134 - RNA, 16 nt, Human herpesvirus 7
aguauguccaaucaaa

SEQ ID NO: 2148135 - RNA, 23 nt, Human herpesvirus 7
ucuguacccaugggcacauuugu

SEQ ID NO: 2148136 - RNA, 23 nt, Human herpesvirus 7
agcugcauguguacuaaagccaa

SEQ ID NO: 2148137 - RNA, 14 nt, Human herpesvirus 7
aguugaaaauguuu

SEQ ID NO: 2148138 - RNA, 13 nt, Human herpesvirus 7
cgaacccuggaga

SEQ ID NO: 2148139 - RNA, 20 nt, Human herpesvirus 7
cuaauagaaaaauguacaau

SEQ ID NO: 2148140 - RNA, 19 nt, Human herpesvirus 7
gcaacuuugugccugaaau

SEQ ID NO: 2148141 - RNA, 16 nt, Human herpesvirus 7
cuacaccaauaguugu

SEQ ID NO: 2148142 - RNA, 23 nt, Human herpesvirus 7
gugaacuguuacaguuaaagacg

SEQ ID NO: 2148143 - RNA, 18 nt, Human herpesvirus 7
uucagaauagacaucuuc

SEQ ID NO: 2148144 - RNA, 19 nt, Human herpesvirus 7
cuuucuggaguucaguaaa

SEQ ID NO: 2148145 - RNA, 19 nt, Human herpesvirus 7
aauauuuaaaguagcugaa

SEQ ID NO: 2148146 - RNA, 16 nt, Human herpesvirus 7
acugaagcauggauuu

SEQ ID NO: 2148147 - RNA, 21 nt, Human herpesvirus 7
auuucagaaaauaaaaguaaa

SEQ ID NO: 2148148 - RNA, 20 nt, Human herpesvirus 7
caaagaacauguaguacaau

SEQ ID NO: 2148149 - RNA, 17 nt, Human herpesvirus 7
agcaauacauucucaaa

SEQ ID NO: 2148150 - RNA, 20 nt, Human herpesvirus 7
agggggacaauuauuuaaac

SEQ ID NO: 2148151 - RNA, 16 nt, Human herpesvirus 7
aucccugcugauacaa

SEQ ID NO: 2148152 - RNA, 17 nt, Human herpesvirus 7
ucaacuugaaugagcug

SEQ ID NO: 2148153 - RNA, 16 nt, Human herpesvirus 7
uugugaaguuugcuga

SEQ ID NO: 2148154 - RNA, 20 nt, Human herpesvirus 7
ucauccaaaaagaaacuuuc

SEQ ID NO: 2148155 - RNA, 17 nt, Human herpesvirus 7
uucauuggcauuauucu

SEQ ID NO: 2148156 - RNA, 21 nt, Human herpesvirus 7
uguguuggaaacuauucgaaa

SEQ ID NO: 2148157 - RNA, 18 nt, Human herpesvirus 7
gaacuucagauuuuaguu

SEQ ID NO: 2148158 - RNA, 18 nt, Human herpesvirus 7
gugaagacuacauaaagg

SEQ ID NO: 2148159 - RNA, 19 nt, Human herpesvirus 7
cauauuuuuaaauuugucu

SEQ ID NO: 2148160 - RNA, 13 nt, Human herpesvirus 7
gggaaacaucuuu

SEQ ID NO: 2148161 - RNA, 18 nt, Human herpesvirus 7
ugcaauuaaaauguacau

SEQ ID NO: 2148162 - RNA, 22 nt, Human herpesvirus 7
cacauuccaaaaucaaguguuu

SEQ ID NO: 2148163 - RNA, 19 nt, Human herpesvirus 7
acuuauuccagauaugaca

SEQ ID NO: 2148164 - RNA, 20 nt, Human herpesvirus 7
gcauggaucguagcaacaga

SEQ ID NO: 2148165 - RNA, 20 nt, Human herpesvirus 7
uaugccacaaaaaacuuuga

SEQ ID NO: 2148166 - RNA, 21 nt, Human herpesvirus 7
aaucuauauuugauugaucgu

SEQ ID NO: 2148167 - RNA, 18 nt, Human herpesvirus 7
uugaagaacaacaugaaa

SEQ ID NO: 2148168 - RNA, 23 nt, Human herpesvirus 7
cuaucuccuaaaugaauuuuaag

SEQ ID NO: 2148169 - RNA, 21 nt, Human herpesvirus 7
uaauuguuuuuuauuuagcua

SEQ ID NO: 2148170 - RNA, 23 nt, Human herpesvirus 7
aacagauuuuauuucagcuccau

SEQ ID NO: 2148171 - RNA, 19 nt, Human herpesvirus 7
ugauuuuuuaguauucuca

SEQ ID NO: 2148172 - RNA, 21 nt, Human herpesvirus 7
uuuagauuccagucuacauau

SEQ ID NO: 2148173 - RNA, 15 nt, Human herpesvirus 7
gccauaaaugcuuaa

SEQ ID NO: 2148174 - RNA, 12 nt, Human herpesvirus 7
aaaucuguaaaa

SEQ ID NO: 2148175 - RNA, 18 nt, Human herpesvirus 7
cuuugacuguaucuccaa

SEQ ID NO: 2148176 - RNA, 15 nt, Human herpesvirus 7
agaaaaaaacaauga

SEQ ID NO: 2148177 - RNA, 22 nt, Human herpesvirus 7
aaagaugauuggauuuucugua

SEQ ID NO: 2148178 - RNA, 20 nt, Human herpesvirus 7
acaaaacugcucauauuaac

SEQ ID NO: 2148179 - RNA, 24 nt, Human herpesvirus 7
cagcaauguauauaagcagacacc

SEQ ID NO: 2148180 - RNA, 15 nt, Human herpesvirus 7
aaaauguuuaaauua

SEQ ID NO: 2148181 - RNA, 18 nt, Human herpesvirus 7
gaagaaucaagacgcugu

SEQ ID NO: 2148182 - RNA, 14 nt, Human herpesvirus 7
cugcuugucucugu

SEQ ID NO: 2148183 - RNA, 21 nt, Human herpesvirus 7
caacuagagaagccacuucua

SEQ ID NO: 2148184 - RNA, 17 nt, Human herpesvirus 7
caauuuuaaugugcuua

SEQ ID NO: 2148185 - RNA, 17 nt, Human herpesvirus 7
uuggacuguuagacuuu

SEQ ID NO: 2148186 - RNA, 19 nt, Human herpesvirus 7
uagcauaugcuggaucuuc

SEQ ID NO: 2148187 - RNA, 19 nt, Human herpesvirus 7
aaauaaacauguugaaaga

SEQ ID NO: 2148188 - RNA, 20 nt, Human herpesvirus 7
uuaaaaguacaaauguuuua

SEQ ID NO: 2148189 - RNA, 22 nt, Human herpesvirus 7
guagauggcaccaauagaaaac

SEQ ID NO: 2148190 - RNA, 14 nt, Human herpesvirus 7
uaaaggaaacauuu

SEQ ID NO: 2148191 - RNA, 14 nt, Human herpesvirus 7
aucgaugagaaugu

SEQ ID NO: 2148192 - RNA, 18 nt, Human herpesvirus 7
uuaugcaaacucacuaau

SEQ ID NO: 2148193 - RNA, 19 nt, Human herpesvirus 7
cugagagaaccugaaagaa

SEQ ID NO: 2148194 - RNA, 18 nt, Human herpesvirus 7
ggauuucuucuucuaaau

SEQ ID NO: 2148195 - RNA, 17 nt, Human herpesvirus 7
ggagauaguucgcaaug

SEQ ID NO: 2148196 - RNA, 19 nt, Human herpesvirus 7
auuuaacauguguauauuu

SEQ ID NO: 2148197 - RNA, 11 nt, Human herpesvirus 7
cuaugauacaa

SEQ ID NO: 2148198 - RNA, 20 nt, Human herpesvirus 7
augauugguaaaaaauuacu

SEQ ID NO: 2148199 - RNA, 16 nt, Human herpesvirus 7
uuaugugguuaaagau

SEQ ID NO: 2148200 - RNA, 12 nt, Human herpesvirus 7
aauuuaaauacu

SEQ ID NO: 2148201 - RNA, 16 nt, Human herpesvirus 7
ucuuggguaauuuuaa

SEQ ID NO: 2148202 - RNA, 16 nt, Human herpesvirus 7
agaaugcucuuuugaa

SEQ ID NO: 2148203 - RNA, 20 nt, Human herpesvirus 7
ucuuauaaauaaaauguuuu

SEQ ID NO: 2148204 - RNA, 18 nt, Human herpesvirus 7
cuuucuauuguaugggaa

SEQ ID NO: 2148205 - RNA, 17 nt, Human herpesvirus 7
caaguguuucuuugaau

SEQ ID NO: 2148206 - RNA, 22 nt, Human herpesvirus 7
gaauggcgguuguacuguaauu

SEQ ID NO: 2148207 - RNA, 20 nt, Human herpesvirus 7
acagcauauaucuuugauua

SEQ ID NO: 2148208 - RNA, 15 nt, Human herpesvirus 7
cgacaaacagaaaaa

SEQ ID NO: 2148209 - RNA, 13 nt, Human herpesvirus 7
gcggcucucuguu

SEQ ID NO: 2148210 - RNA, 21 nt, Human herpesvirus 7
cuuagaauauuuauguucaaa

SEQ ID NO: 2148211 - RNA, 14 nt, Human herpesvirus 7
uaaaagcauaugug

SEQ ID NO: 2148212 - RNA, 17 nt, Human herpesvirus 7
aacuuugauuugagaaa

SEQ ID NO: 2148213 - RNA, 16 nt, Human herpesvirus 7
agcuuguuaaagaaaa

SEQ ID NO: 2148214 - RNA, 14 nt, Human herpesvirus 7
aacaguuaaugugu

SEQ ID NO: 2148215 - RNA, 16 nt, Human herpesvirus 7
gacgcuguaugcaaga

SEQ ID NO: 2148216 - RNA, 19 nt, Human herpesvirus 7
caaauguuuuaauuuggaa

SEQ ID NO: 2148217 - RNA, 17 nt, Human herpesvirus 7
gaauuccagauuuucug

SEQ ID NO: 2148218 - RNA, 22 nt, Human herpesvirus 7
uaaaguacccgcuuauuaguga

SEQ ID NO: 2148219 - RNA, 22 nt, Human herpesvirus 7
uuacugccaccauuucugaaac

SEQ ID NO: 2148220 - RNA, 21 nt, Human herpesvirus 7
aagauuuuaacauaccuaaag

SEQ ID NO: 2148221 - RNA, 22 nt, Human herpesvirus 7
agucgaaaugaaaagucuguga

SEQ ID NO: 2148222 - RNA, 19 nt, Human herpesvirus 7
cauuacuggauguauaaau

SEQ ID NO: 2148223 - RNA, 17 nt, Human herpesvirus 7
cuaguucccauuuucag

SEQ ID NO: 2148224 - RNA, 19 nt, Human herpesvirus 7
gauauuguacuucuguguu

SEQ ID NO: 2148225 - RNA, 24 nt, Human herpesvirus 7
caaaauucaacgucuuacuuggaa

SEQ ID NO: 2148226 - RNA, 13 nt, Human herpesvirus 7
ugaauuugaaacu

SEQ ID NO: 2148227 - RNA, 14 nt, Human herpesvirus 7
uaaauucugaaaua

SEQ ID NO: 2148228 - RNA, 14 nt, Human herpesvirus 7
cuauucuauuucaa

SEQ ID NO: 2148229 - RNA, 13 nt, Human herpesvirus 7
auuagugccugca

SEQ ID NO: 2148230 - RNA, 21 nt, Human herpesvirus 7
aacuguuaaaaucuguucccc

SEQ ID NO: 2148231 - RNA, 14 nt, Human herpesvirus 7
gauucuaaauuaaa

SEQ ID NO: 2148232 - RNA, 14 nt, Human herpesvirus 7
auugcuuuuagaaa

SEQ ID NO: 2148233 - RNA, 15 nt, Human herpesvirus 7
cacuguugaugauuu

SEQ ID NO: 2148234 - RNA, 15 nt, Human herpesvirus 7
augcugauuccuucu

SEQ ID NO: 2148235 - RNA, 21 nt, Human herpesvirus 7
ugagaaucauagcaggaagca

SEQ ID NO: 2148236 - RNA, 17 nt, Human herpesvirus 7
guuuucugagugcuaaa

SEQ ID NO: 2148237 - RNA, 18 nt, Human herpesvirus 7
uacuugauuuucuuacac

SEQ ID NO: 2148238 - RNA, 22 nt, Human herpesvirus 7
caaagaaaaaaggaugaaagug

SEQ ID NO: 2148239 - RNA, 21 nt, Human herpesvirus 7
uuuugcuacuauacucuugca

SEQ ID NO: 2148240 - RNA, 21 nt, Human herpesvirus 7
aagauuuguuccaaacucgag

SEQ ID NO: 2148241 - RNA, 18 nt, Human herpesvirus 7
cuauaucaucaucuuuuu

SEQ ID NO: 2148242 - RNA, 23 nt, Human herpesvirus 7
aauucuauuuuaaaaaccaugaa

SEQ ID NO: 2148243 - RNA, 19 nt, Human herpesvirus 7
acuacauuuaaaaaaucug

SEQ ID NO: 2148244 - RNA, 14 nt, Human herpesvirus 7
uuagaauuuuuucu

SEQ ID NO: 2148245 - RNA, 20 nt, Human herpesvirus 7
aauuguuugaucaaaaucug

SEQ ID NO: 2148246 - RNA, 20 nt, Human herpesvirus 7
agugaagcuugcuuaaaacu

SEQ ID NO: 2148247 - RNA, 17 nt, Human herpesvirus 7
cgaaaugaaaagucugu

SEQ ID NO: 2148248 - RNA, 20 nt, Human herpesvirus 7
aacucaauaaagauugauca

SEQ ID NO: 2148249 - RNA, 21 nt, Human herpesvirus 7
uuagaaucacaacauauagau

SEQ ID NO: 2148250 - RNA, 21 nt, Human herpesvirus 7
agaauguucgcaaauguacaa

SEQ ID NO: 2148251 - RNA, 15 nt, Human herpesvirus 7
gaugucaaccuuuua

SEQ ID NO: 2148252 - RNA, 12 nt, Human herpesvirus 7
aucaaaaaauuu

SEQ ID NO: 2148253 - RNA, 16 nt, Human herpesvirus 7
aaagcugcauguguac

SEQ ID NO: 2148254 - RNA, 22 nt, Human herpesvirus 7
uuguaacagauuuuauuucagc

SEQ ID NO: 2148255 - RNA, 15 nt, Human herpesvirus 7
ucauaaucaucuuuc

SEQ ID NO: 2148256 - RNA, 15 nt, Human herpesvirus 7
uagaaauuaugaaaa

SEQ ID NO: 2148257 - RNA, 12 nt, Human herpesvirus 7
aucuauaaacau

SEQ ID NO: 2148258 - RNA, 13 nt, Human herpesvirus 7
cagaucucgaacu

SEQ ID NO: 2148259 - RNA, 19 nt, Human herpesvirus 7
acucggaaccgagaauguu

SEQ ID NO: 2148260 - RNA, 17 nt, Human herpesvirus 7
gaaaaguugcuuuucau

SEQ ID NO: 2148261 - RNA, 15 nt, Human herpesvirus 7
ugauaugauuuccug

SEQ ID NO: 2148262 - RNA, 15 nt, Human herpesvirus 7
agcuucaaaaauguu

SEQ ID NO: 2148263 - RNA, 16 nt, Human herpesvirus 7
gaucuacauauacuuu

SEQ ID NO: 2148264 - RNA, 14 nt, Human herpesvirus 7
auacagauauuuua

SEQ ID NO: 2148265 - RNA, 16 nt, Human herpesvirus 7
caaauucaaccacaga

SEQ ID NO: 2148266 - RNA, 19 nt, Human herpesvirus 7
agauuuuccaacgaaauuu

SEQ ID NO: 2148267 - RNA, 13 nt, Human herpesvirus 7
cuuggcuguucaa

SEQ ID NO: 2148268 - RNA, 14 nt, Human herpesvirus 7
aagacagaaaugaa

SEQ ID NO: 2148269 - RNA, 18 nt, Human herpesvirus 7
ccuuauauuaaaaaccac

SEQ ID NO: 2148270 - RNA, 22 nt, Human herpesvirus 7
aacguuaccguuuaaugaaaaa

SEQ ID NO: 2148271 - RNA, 14 nt, Human herpesvirus 7
agagauuaagguga

SEQ ID NO: 2148272 - RNA, 14 nt, Human herpesvirus 7
ggucacguucuaaa

SEQ ID NO: 2148273 - RNA, 22 nt, Human herpesvirus 7
uucucccgcagagauuaccugc

SEQ ID NO: 2148274 - RNA, 20 nt, Human herpesvirus 7
uucaaaaaccgggcuuuuuu

SEQ ID NO: 2148275 - RNA, 13 nt, Human herpesvirus 7
auacacuauuuua

SEQ ID NO: 2148276 - RNA, 13 nt, Human herpesvirus 7
uuacaaagaacau

SEQ ID NO: 2148277 - RNA, 20 nt, Human herpesvirus 7
acuguuuuucaaaaacguua

SEQ ID NO: 2148278 - RNA, 18 nt, Human herpesvirus 7
ugucugauucuuauucua

SEQ ID NO: 2148279 - RNA, 22 nt, Human herpesvirus 7
gcaacaaacaaauaauucaaaa

SEQ ID NO: 2148280 - RNA, 20 nt, Human herpesvirus 7
aauaacaauuauagaaacau

SEQ ID NO: 2148281 - RNA, 22 nt, Human herpesvirus 7
uccaguacgucuugcuguuugu

SEQ ID NO: 2148282 - RNA, 18 nt, Human herpesvirus 7
ugaaaacuuagugaugac

SEQ ID NO: 2148283 - RNA, 19 nt, Human herpesvirus 7
aggaaacacaauuguauuu

SEQ ID NO: 2148284 - RNA, 21 nt, Human herpesvirus 7
gauuguagagaauauuuauca

SEQ ID NO: 2148285 - RNA, 16 nt, Human herpesvirus 7
aaaucaguuguuggaa

SEQ ID NO: 2148286 - RNA, 20 nt, Human herpesvirus 7
guucaaccuuuuucugaaaa

SEQ ID NO: 2148287 - RNA, 18 nt, Human herpesvirus 7
ccgcucuuuuauuuucag

SEQ ID NO: 2148288 - RNA, 23 nt, Human herpesvirus 7
cuagccuauaauucucacagcuu

SEQ ID NO: 2148289 - RNA, 13 nt, Human herpesvirus 7
aauaaaacaaacu

SEQ ID NO: 2148290 - RNA, 15 nt, Human herpesvirus 7
ugcucaucaaauaag

SEQ ID NO: 2148291 - RNA, 14 nt, Human herpesvirus 7
aacaaacauuccaa

SEQ ID NO: 2148292 - RNA, 11 nt, Human herpesvirus 7
uugcuguuuuu

SEQ ID NO: 2148293 - RNA, 17 nt, Human herpesvirus 7
gucuuugucaugaugaa

SEQ ID NO: 2148294 - RNA, 19 nt, Human herpesvirus 7
uuugaagagcguguuuuga

SEQ ID NO: 2148295 - RNA, 17 nt, Human herpesvirus 7
cuuccgcauuuuguauu

SEQ ID NO: 2148296 - RNA, 22 nt, Human herpesvirus 7
ucuauuauuucuacacaaacga

SEQ ID NO: 2148297 - RNA, 17 nt, Human herpesvirus 7
caguguuuaaaauguua

SEQ ID NO: 2148298 - RNA, 14 nt, Human herpesvirus 7
gcuaugacuuugaa

SEQ ID NO: 2148299 - RNA, 15 nt, Human herpesvirus 7
uucuuugcaaucauu

SEQ ID NO: 2148300 - RNA, 20 nt, Human herpesvirus 7
auuuaucaggugcucuaaau

SEQ ID NO: 2148301 - RNA, 18 nt, Human herpesvirus 7
caaauuccuccugaaaau

SEQ ID NO: 2148302 - RNA, 13 nt, Human herpesvirus 7
acgcauucaaugg

SEQ ID NO: 2148303 - RNA, 20 nt, Human herpesvirus 7
aaaccacaaaaaucaaagua

SEQ ID NO: 2148304 - RNA, 15 nt, Human herpesvirus 7
aauuaaauacaaauu

SEQ ID NO: 2148305 - RNA, 12 nt, Human herpesvirus 7
cucuaguuuaau

SEQ ID NO: 2148306 - RNA, 16 nt, Human herpesvirus 7
uuugcugagucucugg

SEQ ID NO: 2148307 - RNA, 22 nt, Human herpesvirus 7
cucugccagucucuaaacuucu

SEQ ID NO: 2148308 - RNA, 16 nt, Human herpesvirus 7
aaacucacaauguuuu

SEQ ID NO: 2148309 - RNA, 15 nt, Human herpesvirus 7
uuauucauacguaag

SEQ ID NO: 2148310 - RNA, 18 nt, Human herpesvirus 7
ucuguaaaaacuuguuug

SEQ ID NO: 2148311 - RNA, 17 nt, Human herpesvirus 7
aaaaucucgaacagucc

SEQ ID NO: 2148312 - RNA, 17 nt, Human herpesvirus 7
caauguuagaaacaucu

SEQ ID NO: 2148313 - RNA, 16 nt, Human herpesvirus 7
auucaaauaagggaua

SEQ ID NO: 2148314 - RNA, 14 nt, Human herpesvirus 7
uggauacggcagcg

SEQ ID NO: 2148315 - RNA, 14 nt, Human herpesvirus 7
acuauaugaaaaca

SEQ ID NO: 2148316 - RNA, 16 nt, Human herpesvirus 7
aggauucggaaguaaa

SEQ ID NO: 2148317 - RNA, 22 nt, Human herpesvirus 7
cuugaauuccgauuuaagugaa

SEQ ID NO: 2148318 - RNA, 19 nt, Human herpesvirus 7
gcuuuagaguaugaguuug

SEQ ID NO: 2148319 - RNA, 22 nt, Human herpesvirus 7
ucauguuuuaugacucagacga

SEQ ID NO: 2148320 - RNA, 15 nt, Human herpesvirus 7
ugcgcggauuaagag

SEQ ID NO: 2148321 - RNA, 15 nt, Human herpesvirus 7
acauuccuugagaaa

SEQ ID NO: 2148322 - RNA, 11 nt, Human herpesvirus 7
cuuugacaaag

SEQ ID NO: 2148323 - RNA, 14 nt, Human herpesvirus 7
guuccuaaauaauu

SEQ ID NO: 2148324 - RNA, 17 nt, Human herpesvirus 7
uuucauauuuagacuuu

SEQ ID NO: 2148325 - RNA, 22 nt, Human herpesvirus 7
guuuggcaacaaacaaauaauu

SEQ ID NO: 2148326 - RNA, 17 nt, Human herpesvirus 7
augccugcaauaugcau

SEQ ID NO: 2148327 - RNA, 9 nt, Human herpesvirus 7
aaauuuaaa

SEQ ID NO: 2148328 - RNA, 17 nt, Human herpesvirus 7
uuaccuuuguuaacaug

SEQ ID NO: 2148329 - RNA, 21 nt, Human herpesvirus 7
uuggagucguucuauguauga

SEQ ID NO: 2148330 - RNA, 19 nt, Human herpesvirus 7
acaucuuccacaaaaauuu

SEQ ID NO: 2148331 - RNA, 20 nt, Human herpesvirus 7
gcaugcguaaaaaaucaagu

SEQ ID NO: 2148332 - RNA, 20 nt, Human herpesvirus 7
cauuuuauucaaagcuucua

SEQ ID NO: 2148333 - RNA, 17 nt, Human herpesvirus 7
auuagagcauauuccau

SEQ ID NO: 2148334 - RNA, 15 nt, Human herpesvirus 7
uccuuucguuuucaa

SEQ ID NO: 2148335 - RNA, 14 nt, Human herpesvirus 7
ucacauuuaugaaa

SEQ ID NO: 2148336 - RNA, 19 nt, Human herpesvirus 7
cgaacaucgagauuccaaa

SEQ ID NO: 2148337 - RNA, 21 nt, Human herpesvirus 7
ucuuaugccagguuuuucaaa

SEQ ID NO: 2148338 - RNA, 20 nt, Human herpesvirus 7
uagaacagcugaaacucauc

SEQ ID NO: 2148339 - RNA, 17 nt, Human herpesvirus 7
augaugacaaaaaauuu

SEQ ID NO: 2148340 - RNA, 13 nt, Human herpesvirus 7
guuuuaaaguaug

SEQ ID NO: 2148341 - RNA, 19 nt, Human herpesvirus 7
cgauccucagaauguacac

SEQ ID NO: 2148342 - RNA, 19 nt, Human herpesvirus 7
uaauaauuuaaaauuauua

SEQ ID NO: 2148343 - RNA, 13 nt, Human herpesvirus 7
cagacagcuguau

SEQ ID NO: 2148344 - RNA, 17 nt, Human herpesvirus 7
ucugaaaaucuccuuga

SEQ ID NO: 2148345 - RNA, 18 nt, Human herpesvirus 7
auucuacauagaaaucuu

SEQ ID NO: 2148346 - RNA, 19 nt, Human herpesvirus 7
agucacaauuacacaaauu

SEQ ID NO: 2148347 - RNA, 16 nt, Human herpesvirus 7
ucggaaccgagaaugu

SEQ ID NO: 2148348 - RNA, 21 nt, Human herpesvirus 7
gaaaacaaucaauaagccucu

SEQ ID NO: 2148349 - RNA, 15 nt, Human herpesvirus 7
guaucuagagaaugu

SEQ ID NO: 2148350 - RNA, 23 nt, Human herpesvirus 7
uaagggauaucuuaaaaacaaug

SEQ ID NO: 2148351 - RNA, 22 nt, Human herpesvirus 7
caauauuuaaaguagcugaauu

SEQ ID NO: 2148352 - RNA, 19 nt, Human herpesvirus 7
auuucuuauaauuaugaug

SEQ ID NO: 2148353 - RNA, 18 nt, Human herpesvirus 7
caagaaggccacgcugua

SEQ ID NO: 2148354 - RNA, 18 nt, Human herpesvirus 7
agaaacucacaauguuuu

SEQ ID NO: 2148355 - RNA, 16 nt, Human herpesvirus 7
gcaauuuuagauuuua

SEQ ID NO: 2148356 - RNA, 21 nt, Human herpesvirus 7
gaaaauauauuccaacucaau

SEQ ID NO: 2148357 - RNA, 20 nt, Human herpesvirus 7
gcacaguauaaucuugugaa

SEQ ID NO: 2148358 - RNA, 15 nt, Human herpesvirus 7
aacugcaaauccaac

SEQ ID NO: 2148359 - RNA, 12 nt, Human herpesvirus 7
cguuacuucugu

SEQ ID NO: 2148360 - RNA, 12 nt, Human herpesvirus 7
guuaacauaugu

SEQ ID NO: 2148361 - RNA, 17 nt, Human herpesvirus 7
acaaucgauaaacuuug

SEQ ID NO: 2148362 - RNA, 22 nt, Human herpesvirus 7
auguacgaacuaagaaaaaaac

SEQ ID NO: 2148363 - RNA, 15 nt, Human herpesvirus 7
uauacaaaagacaua

SEQ ID NO: 2148364 - RNA, 20 nt, Human herpesvirus 7
ccaaaaguuguuaagaaucu

SEQ ID NO: 2148365 - RNA, 17 nt, Human herpesvirus 7
uuauaagaauuuggaua

SEQ ID NO: 2148366 - RNA, 19 nt, Human herpesvirus 7
cuagauugacuaugaauuu

SEQ ID NO: 2148367 - RNA, 21 nt, Human herpesvirus 7
uccauaaaacaugcaacauaa

SEQ ID NO: 2148368 - RNA, 20 nt, Human herpesvirus 7
ugauuguauuugucucugug

SEQ ID NO: 2148369 - RNA, 23 nt, Human herpesvirus 7
uaauuauucggugucuucuugca

SEQ ID NO: 2148370 - RNA, 19 nt, Human herpesvirus 7
uuaucaaguagaauaccag

SEQ ID NO: 2148371 - RNA, 23 nt, Human herpesvirus 7
ucuacacaaacgaguuucaaaau

SEQ ID NO: 2148372 - RNA, 22 nt, Human herpesvirus 7
cuacguguuuauacaaauuuua

SEQ ID NO: 2148373 - RNA, 21 nt, Human herpesvirus 7
cuuucuuuaccgauucuaaau

SEQ ID NO: 2148374 - RNA, 16 nt, Human herpesvirus 7
aaucaugaaaacagug

SEQ ID NO: 2148375 - RNA, 15 nt, Human herpesvirus 7
uacuacgguuuucag

SEQ ID NO: 2148376 - RNA, 14 nt, Human herpesvirus 7
guugaauucguuaa

SEQ ID NO: 2148377 - RNA, 15 nt, Human herpesvirus 7
aacaaguagugcuaa

SEQ ID NO: 2148378 - RNA, 22 nt, Human herpesvirus 7
uauuucgguuggaaaugaugau

SEQ ID NO: 2148379 - RNA, 18 nt, Human herpesvirus 7
aaagauuaaaaaaaaaag

SEQ ID NO: 2148380 - RNA, 20 nt, Human herpesvirus 7
gauagcauuagagcauauuc

SEQ ID NO: 2148381 - RNA, 15 nt, Human herpesvirus 7
gcucugaaaaaaucu

SEQ ID NO: 2148382 - RNA, 12 nt, Human herpesvirus 7
uccuauaaaagc

SEQ ID NO: 2148383 - RNA, 13 nt, Human herpesvirus 7
cuccuucuaccuc

SEQ ID NO: 2148384 - RNA, 17 nt, Human herpesvirus 7
agauuuaauaacaauuu

SEQ ID NO: 2148385 - RNA, 16 nt, Human herpesvirus 7
caaguagaaaaugcug

SEQ ID NO: 2148386 - RNA, 18 nt, Human herpesvirus 7
ucaggacaaucaaacaug

SEQ ID NO: 2148387 - RNA, 21 nt, Human herpesvirus 7
aaacaguagaacgagaaaacu

SEQ ID NO: 2148388 - RNA, 16 nt, Human herpesvirus 7
augauuuuuuaaaugu

SEQ ID NO: 2148389 - RNA, 14 nt, Human herpesvirus 7
ugugaacugauguu

SEQ ID NO: 2148390 - RNA, 12 nt, Human herpesvirus 7
uacauucucaaa

SEQ ID NO: 2148391 - RNA, 12 nt, Human herpesvirus 7
uuaauauuagua

SEQ ID NO: 2148392 - RNA, 14 nt, Human herpesvirus 7
ggaaccgagaaugu

SEQ ID NO: 2148393 - RNA, 22 nt, Human herpesvirus 7
cuaaccaucugcuggaaauuug

SEQ ID NO: 2148394 - RNA, 16 nt, Human herpesvirus 7
agaaguuuagagacug

SEQ ID NO: 2148395 - RNA, 16 nt, Human herpesvirus 7
auuccuuggaaaaaug

SEQ ID NO: 2148396 - RNA, 14 nt, Human herpesvirus 7
uucugaauaaaagu

SEQ ID NO: 2148397 - RNA, 23 nt, Human herpesvirus 7
aguggcuuaaguuuuuaaacuua

SEQ ID NO: 2148398 - RNA, 14 nt, Human herpesvirus 7
caaugcaaacuucu

SEQ ID NO: 2148399 - RNA, 18 nt, Human herpesvirus 7
uuauggauacaaggaaaa

SEQ ID NO: 2148400 - RNA, 20 nt, Human herpesvirus 7
acaguuuuuuaauacaaaau

SEQ ID NO: 2148401 - RNA, 16 nt, Human herpesvirus 7
gcuuacucuuucugac

SEQ ID NO: 2148402 - RNA, 22 nt, Human herpesvirus 7
ugcuuacgugaugccauaauuu

SEQ ID NO: 2148403 - RNA, 11 nt, Human herpesvirus 7
aaaaaauggag

SEQ ID NO: 2148404 - RNA, 12 nt, Human herpesvirus 7
gcuguuuggaaa

SEQ ID NO: 2148405 - RNA, 13 nt, Human herpesvirus 7
uaaacuugugaaa

SEQ ID NO: 2148406 - RNA, 20 nt, Human herpesvirus 7
aaaaauguuuacaaacaugu

SEQ ID NO: 2148407 - RNA, 21 nt, Human herpesvirus 7
uucgaauuuguucaauugcca

SEQ ID NO: 2148408 - RNA, 13 nt, Human herpesvirus 7
uacgucaucccug

SEQ ID NO: 2148409 - RNA, 21 nt, Human herpesvirus 7
uuacaagucaucgguuuucug

SEQ ID NO: 2148410 - RNA, 18 nt, Human herpesvirus 7
ucaaaaucagaaauguua

SEQ ID NO: 2148411 - RNA, 18 nt, Human herpesvirus 7
uuagcgaauuugugcugu

SEQ ID NO: 2148412 - RNA, 18 nt, Human herpesvirus 7
aucuguaaaauuuaaaua

SEQ ID NO: 2148413 - RNA, 16 nt, Human herpesvirus 7
agagaugaaaaaaauu

SEQ ID NO: 2148414 - RNA, 14 nt, Human herpesvirus 7
caugcaaaaaacag

SEQ ID NO: 2148415 - RNA, 15 nt, Human herpesvirus 7
auaaaaauuacucau

SEQ ID NO: 2148416 - RNA, 14 nt, Human herpesvirus 7
uaaagaacaucuug

SEQ ID NO: 2148417 - RNA, 22 nt, Human herpesvirus 7
uguauaaucuuaauguuucuga

SEQ ID NO: 2148418 - RNA, 13 nt, Human herpesvirus 7
uguauuugucucu

SEQ ID NO: 2148419 - RNA, 12 nt, Human herpesvirus 7
cauuuacaaaaa

SEQ ID NO: 2148420 - RNA, 14 nt, Human herpesvirus 7
agagaaaauguuua

SEQ ID NO: 2148421 - RNA, 15 nt, Human herpesvirus 7
gauguuaaagaacaa

SEQ ID NO: 2148422 - RNA, 15 nt, Human herpesvirus 7
uaacaugucuucaac

SEQ ID NO: 2148423 - RNA, 18 nt, Human herpesvirus 7
aauauggagcagcuuaag

SEQ ID NO: 2148424 - RNA, 17 nt, Human herpesvirus 7
cugaaaucaaaaaugug

SEQ ID NO: 2148425 - RNA, 17 nt, Human herpesvirus 7
aaagugacggaaguacu

SEQ ID NO: 2148426 - RNA, 17 nt, Human herpesvirus 7
uuuaaugcuuugucuua

SEQ ID NO: 2148427 - RNA, 15 nt, Human herpesvirus 7
gcaacacaaauuuag

SEQ ID NO: 2148428 - RNA, 23 nt, Human herpesvirus 7
aaagaaaaaaucuuuauguggga

SEQ ID NO: 2148429 - RNA, 15 nt, Human herpesvirus 7
guaaucauauaugca

SEQ ID NO: 2148430 - RNA, 14 nt, Human herpesvirus 7
cauugaaauucugu

SEQ ID NO: 2148431 - RNA, 14 nt, Human herpesvirus 7
ucuuagcaguaaac

SEQ ID NO: 2148432 - RNA, 21 nt, Human herpesvirus 7
cucaacgacaaacuuugcaac

SEQ ID NO: 2148433 - RNA, 22 nt, Human herpesvirus 7
aucuucugaaucugcaaagaaa

SEQ ID NO: 2148434 - RNA, 19 nt, Human herpesvirus 7
uuguaauuuggcuucuauu

SEQ ID NO: 2148435 - RNA, 12 nt, Human herpesvirus 7
cuggaauuguaa

SEQ ID NO: 2148436 - RNA, 17 nt, Human herpesvirus 7
accgugucuucugggaa

SEQ ID NO: 2148437 - RNA, 17 nt, Human herpesvirus 7
acucauacuaauagaaa

SEQ ID NO: 2148438 - RNA, 14 nt, Human herpesvirus 7
uucaaucuacugua

SEQ ID NO: 2148439 - RNA, 17 nt, Human herpesvirus 7
guaaguuguuauagcca

SEQ ID NO: 2148440 - RNA, 13 nt, Human herpesvirus 7
uuaauuccuuugg

SEQ ID NO: 2148441 - RNA, 22 nt, Human herpesvirus 7
agaaacuaaagaaaaaaaaagu

SEQ ID NO: 2148442 - RNA, 20 nt, Human herpesvirus 7
cacccuuuguuugagacaau

SEQ ID NO: 2148443 - RNA, 21 nt, Human herpesvirus 7
cuuaacuuuuggaaugauaua

SEQ ID NO: 2148444 - RNA, 13 nt, Human herpesvirus 7
gauuuuaaaggaa

SEQ ID NO: 2148445 - RNA, 16 nt, Human herpesvirus 7
ugaaagccgcugccuu

SEQ ID NO: 2148446 - RNA, 19 nt, Human herpesvirus 7
ccaugaaaaauaaauacua

SEQ ID NO: 2148447 - RNA, 15 nt, Human herpesvirus 7
gcucucagauuagcu

SEQ ID NO: 2148448 - RNA, 22 nt, Human herpesvirus 7
uguacagauuucauauuuagac

SEQ ID NO: 2148449 - RNA, 17 nt, Human herpesvirus 7
acaaccuggauguaaug

SEQ ID NO: 2148450 - RNA, 21 nt, Human herpesvirus 7
ugaaacucaucauugaagaaa

SEQ ID NO: 2148451 - RNA, 16 nt, Human herpesvirus 7
acucauaauagagcug

SEQ ID NO: 2148452 - RNA, 15 nt, Human herpesvirus 7
cucaaaucaaaguuu

SEQ ID NO: 2148453 - RNA, 20 nt, Human herpesvirus 7
gaugacaacaaagcaugaaa

SEQ ID NO: 2148454 - RNA, 16 nt, Human herpesvirus 7
cagacaccgucauuuc

SEQ ID NO: 2148455 - RNA, 17 nt, Human herpesvirus 7
caguauuuuuuaugaag

SEQ ID NO: 2148456 - RNA, 16 nt, Human herpesvirus 7
uagaugcauccaaaga

SEQ ID NO: 2148457 - RNA, 21 nt, Human herpesvirus 7
cguuuuaaggaauacaaacug

SEQ ID NO: 2148458 - RNA, 19 nt, Human herpesvirus 7
aaacaaucuggacauuuca

SEQ ID NO: 2148459 - RNA, 20 nt, Human herpesvirus 7
ccuaggauaccaaacaaaau

SEQ ID NO: 2148460 - RNA, 20 nt, Human herpesvirus 7
uuauguccgcuuacaagaug

SEQ ID NO: 2148461 - RNA, 13 nt, Human herpesvirus 7
uuuaauaugugaa

SEQ ID NO: 2148462 - RNA, 15 nt, Human herpesvirus 7
uucgcaaauguacaa

SEQ ID NO: 2148463 - RNA, 18 nt, Human herpesvirus 7
auaauaaaggaaagacaa

SEQ ID NO: 2148464 - RNA, 17 nt, Human herpesvirus 7
uguagaugcaugcuaau

SEQ ID NO: 2148465 - RNA, 17 nt, Human herpesvirus 7
gauguauaaaucagaau

SEQ ID NO: 2148466 - RNA, 13 nt, Human herpesvirus 7
aucggaaauuuug

SEQ ID NO: 2148467 - RNA, 17 nt, Human herpesvirus 7
caggaagcacaaaucaa

SEQ ID NO: 2148468 - RNA, 16 nt, Human herpesvirus 7
cuuuacuuucauagcu

SEQ ID NO: 2148469 - RNA, 13 nt, Human herpesvirus 7
gccgacaagaaac

SEQ ID NO: 2148470 - RNA, 15 nt, Human herpesvirus 7
auauacauguaacug

SEQ ID NO: 2148471 - RNA, 14 nt, Human herpesvirus 7
uuagugaaaacuug

SEQ ID NO: 2148472 - RNA, 22 nt, Human herpesvirus 7
aucuuuaugugggauuugaaug

SEQ ID NO: 2148473 - RNA, 16 nt, Human herpesvirus 7
gcuucaaaaauguuua

SEQ ID NO: 2148474 - RNA, 20 nt, Human herpesvirus 7
cuuauaaccgauauaguuug

SEQ ID NO: 2148475 - RNA, 18 nt, Human herpesvirus 7
uaacggauuuacauuuca

SEQ ID NO: 2148476 - RNA, 21 nt, Human herpesvirus 7
aucaccaaagaguauacaaaa

SEQ ID NO: 2148477 - RNA, 19 nt, Human herpesvirus 7
cuuucggagacguugcuca

SEQ ID NO: 2148478 - RNA, 17 nt, Human herpesvirus 7
agaucuugacucagauu

SEQ ID NO: 2148479 - RNA, 20 nt, Human herpesvirus 7
augcagaccguaaaacaauc

SEQ ID NO: 2148480 - RNA, 20 nt, Human herpesvirus 7
cuuaauaaaguuuaauucuc

SEQ ID NO: 2148481 - RNA, 13 nt, Human herpesvirus 7
uuguaacuuuuug

SEQ ID NO: 2148482 - RNA, 17 nt, Human herpesvirus 7
aauuaucuagacccuuu

SEQ ID NO: 2148483 - RNA, 15 nt, Human herpesvirus 7
ucaaaacauaucaga

SEQ ID NO: 2148484 - RNA, 23 nt, Human herpesvirus 7
caccgaagcagggaaaaagcaua

SEQ ID NO: 2148485 - RNA, 18 nt, Human herpesvirus 7
aagcuugcuuaaaacuuu

SEQ ID NO: 2148486 - RNA, 18 nt, Human herpesvirus 7
acauuuuaauaugugaaa

SEQ ID NO: 2148487 - RNA, 22 nt, Human herpesvirus 7
agaaaaguugcuuuucaugcuu

SEQ ID NO: 2148488 - RNA, 19 nt, Human herpesvirus 7
ccaaaaucaaguguuucuu

SEQ ID NO: 2148489 - RNA, 15 nt, Human herpesvirus 7
ucaacuugcagagga

SEQ ID NO: 2148490 - RNA, 14 nt, Human herpesvirus 7
uuaugaugcauuuu

SEQ ID NO: 2148491 - RNA, 15 nt, Human herpesvirus 7
uguuacaugaucuug

SEQ ID NO: 2148492 - RNA, 12 nt, Human herpesvirus 7
guuuuucaaaaa

SEQ ID NO: 2148493 - RNA, 19 nt, Human herpesvirus 7
uaguucugaaaucaaaaau

SEQ ID NO: 2148494 - RNA, 19 nt, Human herpesvirus 7
cugccagucucuaaacuuc

SEQ ID NO: 2148495 - RNA, 18 nt, Human herpesvirus 7
uuucagugaguggaagca

SEQ ID NO: 2148496 - RNA, 17 nt, Human herpesvirus 7
ucccaugccuauucaaa

SEQ ID NO: 2148497 - RNA, 15 nt, Human herpesvirus 7
uauugacagaaugau

SEQ ID NO: 2148498 - RNA, 22 nt, Human herpesvirus 7
acugauuuuuaaacuugugaaa

SEQ ID NO: 2148499 - RNA, 20 nt, Human herpesvirus 7
ucaauuugaauauugcuagu

SEQ ID NO: 2148500 - RNA, 14 nt, Human herpesvirus 7
cagaucuugcuuua

SEQ ID NO: 2148501 - RNA, 13 nt, Human herpesvirus 7
auuucuuugcgcu

SEQ ID NO: 2148502 - RNA, 18 nt, Human herpesvirus 7
acauauaaauagccauua

SEQ ID NO: 2148503 - RNA, 15 nt, Human herpesvirus 7
aaauauuuauuugcu

SEQ ID NO: 2148504 - RNA, 18 nt, Human herpesvirus 7
aggccguuuaugaacaag

SEQ ID NO: 2148505 - RNA, 13 nt, Human herpesvirus 7
ggcaaaaaacgua

SEQ ID NO: 2148506 - RNA, 16 nt, Human herpesvirus 7
uuuaagugaacuguua

SEQ ID NO: 2148507 - RNA, 14 nt, Human herpesvirus 7
acuaaguugaaauu

SEQ ID NO: 2148508 - RNA, 21 nt, Human herpesvirus 7
aauuccugcuugcacaaagau

SEQ ID NO: 2148509 - RNA, 22 nt, Human herpesvirus 7
augucugcauagacaguaaugc

SEQ ID NO: 2148510 - RNA, 21 nt, Human herpesvirus 7
auuuaguacuuuuucuggaau

SEQ ID NO: 2148511 - RNA, 17 nt, Human herpesvirus 7
uucuauucaguuucuuu

SEQ ID NO: 2148512 - RNA, 17 nt, Human herpesvirus 7
aaucgauaaacuuuguc

SEQ ID NO: 2148513 - RNA, 11 nt, Human herpesvirus 7
uccguaacugc

SEQ ID NO: 2148514 - RNA, 17 nt, Human herpesvirus 7
uuugaaaaaaacacuuu

SEQ ID NO: 2148515 - RNA, 20 nt, Human herpesvirus 7
cuuucacuacuacaugaaug

SEQ ID NO: 2148516 - RNA, 17 nt, Human herpesvirus 7
uuucacccuuuguuuga

SEQ ID NO: 2148517 - RNA, 20 nt, Human herpesvirus 7
aaacucacuucuaaaagcug

SEQ ID NO: 2148518 - RNA, 22 nt, Human herpesvirus 7
uguuugaacaaguagugcuaau

SEQ ID NO: 2148519 - RNA, 15 nt, Human herpesvirus 7
uaacuguuuuucaaa

SEQ ID NO: 2148520 - RNA, 20 nt, Human herpesvirus 7
uaucuuaucuggagaacaau

SEQ ID NO: 2148521 - RNA, 16 nt, Human herpesvirus 7
uaauaacaauuugaag

SEQ ID NO: 2148522 - RNA, 13 nt, Human herpesvirus 7
agguacuaucuau

SEQ ID NO: 2148523 - RNA, 18 nt, Human herpesvirus 7
aagugaacaugacuucag

SEQ ID NO: 2148524 - RNA, 21 nt, Human herpesvirus 7
accgaagcagggaaaaagcau

SEQ ID NO: 2148525 - RNA, 19 nt, Human herpesvirus 7
auccaucuuugaaaaucuu

SEQ ID NO: 2148526 - RNA, 18 nt, Human herpesvirus 7
agcacccggcuuaaugaa

SEQ ID NO: 2148527 - RNA, 23 nt, Human herpesvirus 7
guaaaugaucagagaugaucuua

SEQ ID NO: 2148528 - RNA, 18 nt, Human herpesvirus 7
aacacuguuuucaguuau

SEQ ID NO: 2148529 - RNA, 16 nt, Human herpesvirus 7
caauucaucaggacaa

SEQ ID NO: 2148530 - RNA, 22 nt, Human herpesvirus 7
accaaugauaauaagauguguu

SEQ ID NO: 2148531 - RNA, 13 nt, Human herpesvirus 7
uuugaaucuguaa

SEQ ID NO: 2148532 - RNA, 19 nt, Human herpesvirus 7
aauaucuuuuucaaaugga

SEQ ID NO: 2148533 - RNA, 21 nt, Human herpesvirus 7
aguaauguuauuuuucaugcc

SEQ ID NO: 2148534 - RNA, 14 nt, Human herpesvirus 7
ugucaucaaaauuu

SEQ ID NO: 2148535 - RNA, 18 nt, Human herpesvirus 7
uaacugagaaaaaugaca

SEQ ID NO: 2148536 - RNA, 14 nt, Human herpesvirus 7
ucuuauaacaaagu

SEQ ID NO: 2148537 - RNA, 19 nt, Human herpesvirus 7
caugaacacugcuucuccc

SEQ ID NO: 2148538 - RNA, 13 nt, Human herpesvirus 7
ugaagaacaacau

SEQ ID NO: 2148539 - RNA, 19 nt, Human herpesvirus 7
aaaugggcguaacugugac

SEQ ID NO: 2148540 - RNA, 21 nt, Human herpesvirus 7
guuggcaauuguaaaaauaaa

SEQ ID NO: 2148541 - RNA, 13 nt, Human herpesvirus 7
guggaaacggcug

SEQ ID NO: 2148542 - RNA, 14 nt, Human herpesvirus 7
aaugaaaaagccau

SEQ ID NO: 2148543 - RNA, 12 nt, Human herpesvirus 7
uaaugucucugu

SEQ ID NO: 2148544 - RNA, 22 nt, Human herpesvirus 7
uugcuauuauuaaagcuuucaa

SEQ ID NO: 2148545 - RNA, 23 nt, Human herpesvirus 7
uuugcaaucaugauccugguuaa

SEQ ID NO: 2148546 - RNA, 21 nt, Human herpesvirus 7
auaucuugcuuagaugcugaa

SEQ ID NO: 2148547 - RNA, 14 nt, Human herpesvirus 7
cacgaugacuucca

SEQ ID NO: 2148548 - RNA, 17 nt, Human herpesvirus 7
agccacagauauucuaa

SEQ ID NO: 2148549 - RNA, 12 nt, Human herpesvirus 7
aauuauuuccag

SEQ ID NO: 2148550 - RNA, 18 nt, Human herpesvirus 7
cugaauagacacauuuau

SEQ ID NO: 2148551 - RNA, 18 nt, Human herpesvirus 7
uucuaccggaaguuuuua

SEQ ID NO: 2148552 - RNA, 20 nt, Human herpesvirus 7
cuuaaguuuuuuauacuuuu

SEQ ID NO: 2148553 - RNA, 16 nt, Human herpesvirus 7
acaugggauuucugua

SEQ ID NO: 2148554 - RNA, 15 nt, Human herpesvirus 7
caaacgaguuucaaa

SEQ ID NO: 2148555 - RNA, 15 nt, Human herpesvirus 7
uuccuguuaauaucu

SEQ ID NO: 2148556 - RNA, 18 nt, Human herpesvirus 7
aucagucaagaacuguga

SEQ ID NO: 2148557 - RNA, 19 nt, Human herpesvirus 7
auuguaaaaauaaagacau

SEQ ID NO: 2148558 - RNA, 14 nt, Human herpesvirus 7
uuuguaaacauuuu

SEQ ID NO: 2148559 - RNA, 22 nt, Human herpesvirus 7
auguuucuggaucugccucugc

SEQ ID NO: 2148560 - RNA, 19 nt, Human herpesvirus 7
uuaaaggaaacauuucuaa

SEQ ID NO: 2148561 - RNA, 16 nt, Human herpesvirus 7
aauguuauuuggaauu

SEQ ID NO: 2148562 - RNA, 21 nt, Human herpesvirus 7
uaaucgauuaugauguuugua

SEQ ID NO: 2148563 - RNA, 18 nt, Human herpesvirus 7
guccagauccaucuguaa

SEQ ID NO: 2148564 - RNA, 22 nt, Human herpesvirus 7
caugggauuucuguaaaaacuu

SEQ ID NO: 2148565 - RNA, 16 nt, Human herpesvirus 7
acguuuccauuaaaaa

SEQ ID NO: 2148566 - RNA, 18 nt, Human herpesvirus 7
uucuacuugggaguguuu

SEQ ID NO: 2148567 - RNA, 11 nt, Human herpesvirus 7
aagugugcccg

SEQ ID NO: 2148568 - RNA, 17 nt, Human herpesvirus 7
uaaauaccaaaaaccug

SEQ ID NO: 2148569 - RNA, 19 nt, Human herpesvirus 7
augaugauuauuauaacuu

SEQ ID NO: 2148570 - RNA, 18 nt, Human herpesvirus 7
aagacgugagcaauacac

SEQ ID NO: 2148571 - RNA, 16 nt, Human herpesvirus 7
aaauuaaaaauauuca

SEQ ID NO: 2148572 - RNA, 13 nt, Human herpesvirus 7
aucaaaaacugaa

SEQ ID NO: 2148573 - RNA, 22 nt, Human herpesvirus 7
auuuugccguugaguugcugcu

SEQ ID NO: 2148574 - RNA, 17 nt, Human herpesvirus 7
gauaucuuaaaauaugu

SEQ ID NO: 2148575 - RNA, 13 nt, Human herpesvirus 7
cauuauuauuuga

SEQ ID NO: 2148576 - RNA, 22 nt, Human herpesvirus 7
cauuuccucuggaaaagggaga

SEQ ID NO: 2148577 - RNA, 20 nt, Human herpesvirus 7
guuauaugaaauuucaaaaa

SEQ ID NO: 2148578 - RNA, 14 nt, Human herpesvirus 7
caaagacuugcaaa

SEQ ID NO: 2148579 - RNA, 16 nt, Human herpesvirus 7
cuuugaaaucauucug

SEQ ID NO: 2148580 - RNA, 19 nt, Human herpesvirus 7
gacguuucuagcaaaauau

SEQ ID NO: 2148581 - RNA, 18 nt, Human herpesvirus 7
gaauuaagguggaaaucu

SEQ ID NO: 2148582 - RNA, 17 nt, Human herpesvirus 7
aacauugcuucagaaau

SEQ ID NO: 2148583 - RNA, 15 nt, Human herpesvirus 7
gcuuuagaauuagag

SEQ ID NO: 2148584 - RNA, 15 nt, Human herpesvirus 7
aauuauuuccagagu

SEQ ID NO: 2148585 - RNA, 19 nt, Human herpesvirus 7
aaucuguagaaaauguuuu

SEQ ID NO: 2148586 - RNA, 14 nt, Human herpesvirus 7
auuuaaaaaaggaa

SEQ ID NO: 2148587 - RNA, 21 nt, Human herpesvirus 7
cuguaaccauuuauuuacaga

SEQ ID NO: 2148588 - RNA, 19 nt, Human herpesvirus 7
caugcgauaucugacuggu

SEQ ID NO: 2148589 - RNA, 15 nt, Human herpesvirus 7
uaacaaaauuguaag

SEQ ID NO: 2148590 - RNA, 17 nt, Human herpesvirus 7
ugcuauuauuaaagcuu

SEQ ID NO: 2148591 - RNA, 22 nt, Human herpesvirus 7
aggaauugcugucuauuucaau

SEQ ID NO: 2148592 - RNA, 18 nt, Human herpesvirus 7
aaaaagugauugcagauu

SEQ ID NO: 2148593 - RNA, 18 nt, Human herpesvirus 7
ccaagagccggaaagcaa

SEQ ID NO: 2148594 - RNA, 23 nt, Human herpesvirus 7
uauuuagacuuuuuucuuuaaau

SEQ ID NO: 2148595 - RNA, 17 nt, Human herpesvirus 7
cuugugaaaauaacagg

SEQ ID NO: 2148596 - RNA, 21 nt, Human herpesvirus 7
cuucugauaucuuaaaauaug

SEQ ID NO: 2148597 - RNA, 23 nt, Human herpesvirus 7
agucucuaaacuucuagccugca

SEQ ID NO: 2148598 - RNA, 13 nt, Human herpesvirus 7
gcugcaucuuuuc

SEQ ID NO: 2148599 - RNA, 23 nt, Human herpesvirus 7
aaacagcgugucaaaaaaaaaac

SEQ ID NO: 2148600 - RNA, 19 nt, Human herpesvirus 7
cugaauuguacguucugaa

SEQ ID NO: 2148601 - RNA, 14 nt, Human herpesvirus 7
acuuacuguuuaca

SEQ ID NO: 2148602 - RNA, 19 nt, Human herpesvirus 7
caaaaaagguguugauaga

SEQ ID NO: 2148603 - RNA, 19 nt, Human herpesvirus 7
aacauacuuaaaaaaauga

SEQ ID NO: 2148604 - RNA, 14 nt, Human herpesvirus 7
ucauuguacauuuu

SEQ ID NO: 2148605 - RNA, 14 nt, Human herpesvirus 7
uaugguuugaaaac

SEQ ID NO: 2148606 - RNA, 16 nt, Human herpesvirus 7
uuggauuguguaauua

SEQ ID NO: 2148607 - RNA, 19 nt, Human herpesvirus 7
uuacaaggugacagagggc

SEQ ID NO: 2148608 - RNA, 24 nt, Human herpesvirus 7
uacgugaguguuguaacaacuagc

SEQ ID NO: 2148609 - RNA, 14 nt, Human herpesvirus 7
agauauuauuaaaa

SEQ ID NO: 2148610 - RNA, 13 nt, Human herpesvirus 7
cacuagcuuucug

SEQ ID NO: 2148611 - RNA, 19 nt, Human herpesvirus 7
auuuuuuuuagaaaugguu

SEQ ID NO: 2148612 - RNA, 15 nt, Human herpesvirus 7
ucugugacuuagaaa

SEQ ID NO: 2148613 - RNA, 17 nt, Human herpesvirus 7
agcagaucucgaacuuc

SEQ ID NO: 2148614 - RNA, 14 nt, Human herpesvirus 7
uaucaucaucuuuu

SEQ ID NO: 2148615 - RNA, 20 nt, Human herpesvirus 7
aacagauuuuauuucagcuc

SEQ ID NO: 2148616 - RNA, 21 nt, Human herpesvirus 7
ugcugucuuggaguauuacca

SEQ ID NO: 2148617 - RNA, 19 nt, Human herpesvirus 7
ggacacaaucagcauuuac

SEQ ID NO: 2148618 - RNA, 15 nt, Human herpesvirus 7
aacaaacuguaccca

SEQ ID NO: 2148619 - RNA, 12 nt, Human herpesvirus 7
uuaauaacagca

SEQ ID NO: 2148620 - RNA, 19 nt, Human herpesvirus 7
ugcuuaaaaacaguaauuu

SEQ ID NO: 2148621 - RNA, 22 nt, Human herpesvirus 7
aaaagcugcauguguacuaaag

SEQ ID NO: 2148622 - RNA, 14 nt, Human herpesvirus 7
aucgguuuucugag

SEQ ID NO: 2148623 - RNA, 22 nt, Human herpesvirus 7
aucaucuuaaaaguacaaaugu

SEQ ID NO: 2148624 - RNA, 16 nt, Human herpesvirus 7
cacguagaacaaacug

SEQ ID NO: 2148625 - RNA, 15 nt, Human herpesvirus 7
cuucugcuaacucau

SEQ ID NO: 2148626 - RNA, 16 nt, Human herpesvirus 7
uuuaccccaaacgccu

SEQ ID NO: 2148627 - RNA, 16 nt, Human herpesvirus 7
ucgugugucucuagaa

SEQ ID NO: 2148628 - RNA, 13 nt, Human herpesvirus 7
aaauaaacaggaa

SEQ ID NO: 2148629 - RNA, 22 nt, Human herpesvirus 7
auaacaauuugaagaggagaau

SEQ ID NO: 2148630 - RNA, 16 nt, Human herpesvirus 7
agguugucuguucuca

SEQ ID NO: 2148631 - RNA, 16 nt, Human herpesvirus 7
ugugaaguuugcugaa

SEQ ID NO: 2148632 - RNA, 23 nt, Human herpesvirus 7
uuuccaauagcacuacuagaaau

SEQ ID NO: 2148633 - RNA, 23 nt, Human herpesvirus 7
ucuucauaaaaaaaaagggagaa

SEQ ID NO: 2148634 - RNA, 14 nt, Human herpesvirus 7
ucuucuaauacauc

SEQ ID NO: 2148635 - RNA, 19 nt, Human herpesvirus 7
ucuccgugucacugucacu

SEQ ID NO: 2148636 - RNA, 15 nt, Human herpesvirus 7
cauuguacaauuaca

SEQ ID NO: 2148637 - RNA, 13 nt, Human herpesvirus 7
gcuuguuaaagaa

SEQ ID NO: 2148638 - RNA, 21 nt, Human herpesvirus 7
gcuaauugagaaauuuuacag

SEQ ID NO: 2148639 - RNA, 19 nt, Human herpesvirus 7
auuuugugacccugucaca

SEQ ID NO: 2148640 - RNA, 21 nt, Human herpesvirus 7
uuuaaauaaaccuuaaguuuu

SEQ ID NO: 2148641 - RNA, 21 nt, Human herpesvirus 7
cugacagucacguaaaagugu

SEQ ID NO: 2148642 - RNA, 19 nt, Human herpesvirus 7
aaaacuuugauuugagaaa

SEQ ID NO: 2148643 - RNA, 14 nt, Human herpesvirus 7
aacuugugaaaaua

SEQ ID NO: 2148644 - RNA, 17 nt, Human herpesvirus 7
caucuuuuugaacagaa

SEQ ID NO: 2148645 - RNA, 12 nt, Human herpesvirus 7
accaaaaugugg

SEQ ID NO: 2148646 - RNA, 20 nt, Human herpesvirus 7
auguuuuuccuaugauacaa

SEQ ID NO: 2148647 - RNA, 11 nt, Human herpesvirus 7
aggaugaaagu

SEQ ID NO: 2148648 - RNA, 11 nt, Human herpesvirus 7
uaaaaacagua

SEQ ID NO: 2148649 - RNA, 18 nt, Human herpesvirus 7
auuuccucuggaaaaggg

SEQ ID NO: 2148650 - RNA, 23 nt, Human herpesvirus 7
aaaggaucucucuuucuggaguu

SEQ ID NO: 2148651 - RNA, 23 nt, Human herpesvirus 7
aagagccucccaccauggcuuuu

SEQ ID NO: 2148652 - RNA, 23 nt, Human herpesvirus 7
uuuauugguaauuagugaaaacu

SEQ ID NO: 2148653 - RNA, 20 nt, Human herpesvirus 7
caacgucuuacuuggaaaca

SEQ ID NO: 2148654 - RNA, 13 nt, Human herpesvirus 7
augaaaaaaauua

SEQ ID NO: 2148655 - RNA, 14 nt, Human herpesvirus 7
uauguugcauauca

SEQ ID NO: 2148656 - RNA, 21 nt, Human herpesvirus 7
aucagaauauuuccagcauca

SEQ ID NO: 2148657 - RNA, 16 nt, Human herpesvirus 7
augcauauuugaacau

SEQ ID NO: 2148658 - RNA, 22 nt, Human herpesvirus 7
uucaucaggacaaucaaacaug

SEQ ID NO: 2148659 - RNA, 14 nt, Human herpesvirus 7
uuaaguagugucug

SEQ ID NO: 2148660 - RNA, 14 nt, Human herpesvirus 7
ugaaguuugcugaa

SEQ ID NO: 2148661 - RNA, 15 nt, Human herpesvirus 7
agucuacaucaucaa

SEQ ID NO: 2148662 - RNA, 14 nt, Human herpesvirus 7
auugauuauaugca

SEQ ID NO: 2148663 - RNA, 16 nt, Human herpesvirus 7
gaaauaaaagcuuucu

SEQ ID NO: 2148664 - RNA, 18 nt, Human herpesvirus 7
cgauaaaagguguuuuug

SEQ ID NO: 2148665 - RNA, 21 nt, Human herpesvirus 7
aaagcuuguauauacggaaug

SEQ ID NO: 2148666 - RNA, 21 nt, Human herpesvirus 7
gcgacauuauaaaagauggaa

SEQ ID NO: 2148667 - RNA, 18 nt, Human herpesvirus 7
ucuuuauuuaagcuucaa

SEQ ID NO: 2148668 - RNA, 16 nt, Human herpesvirus 7
auaugcuuccuaaaaa

SEQ ID NO: 2148669 - RNA, 13 nt, Human herpesvirus 7
uaauguuacuaua

SEQ ID NO: 2148670 - RNA, 17 nt, Human herpesvirus 7
acuuuuaaauuaaaaga

SEQ ID NO: 2148671 - RNA, 17 nt, Human herpesvirus 7
cuuucaugcauugcauu

SEQ ID NO: 2148672 - RNA, 18 nt, Human herpesvirus 7
uuccugugugcaaugaug

SEQ ID NO: 2148673 - RNA, 21 nt, Human herpesvirus 7
aaccaugaaaaauaaauacua

SEQ ID NO: 2148674 - RNA, 13 nt, Human herpesvirus 7
cggauaagaacaa

SEQ ID NO: 2148675 - RNA, 17 nt, Human herpesvirus 7
ggucucuuucuaaaaag

SEQ ID NO: 2148676 - RNA, 19 nt, Human herpesvirus 7
cugaaucaaaauccuggau

SEQ ID NO: 2148677 - RNA, 17 nt, Human herpesvirus 7
aagccauaaaauguaca

SEQ ID NO: 2148678 - RNA, 14 nt, Human herpesvirus 7
cuuguguugucaua

SEQ ID NO: 2148679 - RNA, 17 nt, Human herpesvirus 7
agaacauuuuucuugcu

SEQ ID NO: 2148680 - RNA, 14 nt, Human herpesvirus 7
cauuuguuuuggau

SEQ ID NO: 2148681 - RNA, 17 nt, Human herpesvirus 7
uuagacgacgucuucuu

SEQ ID NO: 2148682 - RNA, 19 nt, Human herpesvirus 7
aaacuaaagaaaaaaaaag

SEQ ID NO: 2148683 - RNA, 13 nt, Human herpesvirus 7
uguauguugaagu

SEQ ID NO: 2148684 - RNA, 14 nt, Human herpesvirus 7
ucuuccgcauuuug

SEQ ID NO: 2148685 - RNA, 14 nt, Human herpesvirus 7
aauucauuguauga

SEQ ID NO: 2148686 - RNA, 17 nt, Human herpesvirus 7
uguacuuuugaucaaaa

SEQ ID NO: 2148687 - RNA, 16 nt, Human herpesvirus 7
uaagaaagaacauuuu

SEQ ID NO: 2148688 - RNA, 18 nt, Human herpesvirus 7
uuguccauuuuauucaaa

SEQ ID NO: 2148689 - RNA, 23 nt, Human herpesvirus 7
cuuaaauaaagaguguuuucaaa

SEQ ID NO: 2148690 - RNA, 17 nt, Human herpesvirus 7
uuugagcuaaccuuuua

SEQ ID NO: 2148691 - RNA, 22 nt, Human herpesvirus 7
gcugaaacucaucauugaagaa

SEQ ID NO: 2148692 - RNA, 15 nt, Human herpesvirus 7
uggauuucagcauuu

SEQ ID NO: 2148693 - RNA, 16 nt, Human herpesvirus 7
aauuuuagauuuuacg

SEQ ID NO: 2148694 - RNA, 22 nt, Human herpesvirus 7
caacuaaaacuacauuuaaaaa

SEQ ID NO: 2148695 - RNA, 20 nt, Human herpesvirus 7
uuugauaagacugaagacaa

SEQ ID NO: 2148696 - RNA, 14 nt, Human herpesvirus 7
uugaucgucuguug

SEQ ID NO: 2148697 - RNA, 17 nt, Human herpesvirus 7
gacauaacaaaaaaggu

SEQ ID NO: 2148698 - RNA, 20 nt, Human herpesvirus 7
uuaacuauaucaucaucuuu

SEQ ID NO: 2148699 - RNA, 19 nt, Human herpesvirus 7
ucacugacgaaaacugcaa

SEQ ID NO: 2148700 - RNA, 20 nt, Human herpesvirus 7
aaauucaaggaauucugacu

SEQ ID NO: 2148701 - RNA, 23 nt, Human herpesvirus 7
ucaauaaaugguuuuauuucaca

SEQ ID NO: 2148702 - RNA, 12 nt, Human herpesvirus 7
agaaaaaaaugg

SEQ ID NO: 2148703 - RNA, 13 nt, Human herpesvirus 7
uaucaaaauucca

SEQ ID NO: 2148704 - RNA, 12 nt, Human herpesvirus 7
aaaaagaaugcu

SEQ ID NO: 2148705 - RNA, 22 nt, Human herpesvirus 7
acauugcuucagaaauaacaaa

SEQ ID NO: 2148706 - RNA, 13 nt, Human herpesvirus 7
auucgacacuauu

SEQ ID NO: 2148707 - RNA, 18 nt, Human herpesvirus 7
ugaguauaacucaaaaga

SEQ ID NO: 2148708 - RNA, 13 nt, Human herpesvirus 7
auauuuuacauau

SEQ ID NO: 2148709 - RNA, 14 nt, Human herpesvirus 7
augauggaaagcaa

SEQ ID NO: 2148710 - RNA, 22 nt, Human herpesvirus 7
uauuugucggugaauguagaag

SEQ ID NO: 2148711 - RNA, 22 nt, Human herpesvirus 7
ucuuuaucgccauuuucuugag

SEQ ID NO: 2148712 - RNA, 16 nt, Human herpesvirus 7
caucuugagaaauaug

SEQ ID NO: 2148713 - RNA, 15 nt, Human herpesvirus 7
uuagauuuaaaacaa

SEQ ID NO: 2148714 - RNA, 14 nt, Human herpesvirus 7
ugguugugcaauuu

SEQ ID NO: 2148715 - RNA, 22 nt, Human herpesvirus 7
uuaaaucaguuguuggaaauac

SEQ ID NO: 2148716 - RNA, 14 nt, Human herpesvirus 7
guuuuaaagcugau

SEQ ID NO: 2148717 - RNA, 15 nt, Human herpesvirus 7
guugcacuccuagaa

SEQ ID NO: 2148718 - RNA, 13 nt, Human herpesvirus 7
aucuaauugcaga

SEQ ID NO: 2148719 - RNA, 15 nt, Human herpesvirus 7
gaagaaugcaagccu

SEQ ID NO: 2148720 - RNA, 17 nt, Human herpesvirus 7
cauaauuaugaaauguu

SEQ ID NO: 2148721 - RNA, 19 nt, Human herpesvirus 7
uccuuauauuaaaaaccac

SEQ ID NO: 2148722 - RNA, 17 nt, Human herpesvirus 7
gccaacguugagaaaac

SEQ ID NO: 2148723 - RNA, 18 nt, Human herpesvirus 7
uauuagauuauacaaauc

SEQ ID NO: 2148724 - RNA, 21 nt, Human herpesvirus 7
gauuuugacauuaguucuggc

SEQ ID NO: 2148725 - RNA, 18 nt, Human herpesvirus 7
ugaggauuuugacaagcg

SEQ ID NO: 2148726 - RNA, 14 nt, Human herpesvirus 7
gaaccugaaucaaa

SEQ ID NO: 2148727 - RNA, 15 nt, Human herpesvirus 7
guugcagcugugaua

SEQ ID NO: 2148728 - RNA, 18 nt, Human herpesvirus 7
cgaaaaugguauuuugcg

SEQ ID NO: 2148729 - RNA, 20 nt, Human herpesvirus 7
agaaauggaaaccuggagaa

SEQ ID NO: 2148730 - RNA, 23 nt, Human herpesvirus 7
acucuucuuugugagaaauggaa

SEQ ID NO: 2148731 - RNA, 19 nt, Human herpesvirus 7
guaaaauucgcugaugaaa

SEQ ID NO: 2148732 - RNA, 18 nt, Human herpesvirus 7
cuauaaauggaauuuaac

SEQ ID NO: 2148733 - RNA, 17 nt, Human herpesvirus 7
acuccuugcauacuuuu

SEQ ID NO: 2148734 - RNA, 16 nt, Human herpesvirus 7
aaagcaacaaauguuu

SEQ ID NO: 2148735 - RNA, 16 nt, Human herpesvirus 7
gucauuauuuguuaaa

SEQ ID NO: 2148736 - RNA, 21 nt, Human herpesvirus 7
auacguuauuuuuauuguaaa

SEQ ID NO: 2148737 - RNA, 20 nt, Human herpesvirus 7
acuguuagaggauuaaaaca

SEQ ID NO: 2148738 - RNA, 16 nt, Human herpesvirus 7
uuaucugcauugauuu

SEQ ID NO: 2148739 - RNA, 22 nt, Human herpesvirus 7
caaaccuauccacucuccugaa

SEQ ID NO: 2148740 - RNA, 21 nt, Human herpesvirus 7
uuugggaugucuuaggaguuu

SEQ ID NO: 2148741 - RNA, 17 nt, Human herpesvirus 7
agacguugcucauuuug

SEQ ID NO: 2148742 - RNA, 12 nt, Human herpesvirus 7
cccccagaacuu

SEQ ID NO: 2148743 - RNA, 15 nt, Human herpesvirus 7
augguugugcaauuu

SEQ ID NO: 2148744 - RNA, 15 nt, Human herpesvirus 7
cuuaauuuguucaau

SEQ ID NO: 2148745 - RNA, 16 nt, Human herpesvirus 7
uaaauggcaaauccua

SEQ ID NO: 2148746 - RNA, 15 nt, Human herpesvirus 7
cuuuucuuucuuaau

SEQ ID NO: 2148747 - RNA, 17 nt, Human herpesvirus 7
auaagcucaaaaaguac

SEQ ID NO: 2148748 - RNA, 17 nt, Human herpesvirus 7
uaaaucagaauauuucc

SEQ ID NO: 2148749 - RNA, 21 nt, Human herpesvirus 7
gacuuaucaccauaugccaau

SEQ ID NO: 2148750 - RNA, 18 nt, Human herpesvirus 7
gaggauucggaaguaaac

SEQ ID NO: 2148751 - RNA, 16 nt, Human herpesvirus 7
aguugggcaaacaguu

SEQ ID NO: 2148752 - RNA, 22 nt, Human herpesvirus 7
uuaauugagauuauucaaaagc

SEQ ID NO: 2148753 - RNA, 14 nt, Human herpesvirus 7
aacaauauagagua

SEQ ID NO: 2148754 - RNA, 14 nt, Human herpesvirus 7
ugaaauaaacauuu

SEQ ID NO: 2148755 - RNA, 17 nt, Human herpesvirus 7
auguaugguuucauuug

SEQ ID NO: 2148756 - RNA, 21 nt, Human herpesvirus 7
acuggaauuauacacugugaa

SEQ ID NO: 2148757 - RNA, 20 nt, Human herpesvirus 7
uaagcaguuauaugaaauuu

SEQ ID NO: 2148758 - RNA, 19 nt, Human herpesvirus 7
agcauaugcuggaucuucu

SEQ ID NO: 2148759 - RNA, 21 nt, Human herpesvirus 7
uuaauacguccaaaaauugga

SEQ ID NO: 2148760 - RNA, 18 nt, Human herpesvirus 7
guuuucuuuguaaaaaug

SEQ ID NO: 2148761 - RNA, 14 nt, Human herpesvirus 7
auguuuacauguaa

SEQ ID NO: 2148762 - RNA, 14 nt, Human herpesvirus 7
acaauuguauuuca

SEQ ID NO: 2148763 - RNA, 16 nt, Human herpesvirus 7
cagcacaaaugucuua

SEQ ID NO: 2148764 - RNA, 19 nt, Human herpesvirus 7
gggcacaccaagauuuuaa

SEQ ID NO: 2148765 - RNA, 21 nt, Human herpesvirus 7
gcauuauauccaauaaugcau

SEQ ID NO: 2148766 - RNA, 15 nt, Human herpesvirus 7
cucuacuuaauggag

SEQ ID NO: 2148767 - RNA, 20 nt, Human herpesvirus 7
aauucuuuaauaaaaaacaa

SEQ ID NO: 2148768 - RNA, 20 nt, Human herpesvirus 7
aacauguuuucuuagaugca

SEQ ID NO: 2148769 - RNA, 12 nt, Human herpesvirus 7
uauguuaucauu

SEQ ID NO: 2148770 - RNA, 22 nt, Human herpesvirus 7
uuaaaauucucuauuguucuuu

SEQ ID NO: 2148771 - RNA, 22 nt, Human herpesvirus 7
accauguuuuaccgugucuucu

SEQ ID NO: 2148772 - RNA, 16 nt, Human herpesvirus 7
cacaauuacacaaauu

SEQ ID NO: 2148773 - RNA, 18 nt, Human herpesvirus 7
ucucaaucaaaaucuugu

SEQ ID NO: 2148774 - RNA, 22 nt, Human herpesvirus 7
uagaaaaucuaccaauaaaagg

SEQ ID NO: 2148775 - RNA, 17 nt, Human herpesvirus 7
gaaaaugcauugcuuuu

SEQ ID NO: 2148776 - RNA, 14 nt, Human herpesvirus 7
aucuagauaaagua

SEQ ID NO: 2148777 - RNA, 13 nt, Human herpesvirus 7
ucaauguuuucau

SEQ ID NO: 2148778 - RNA, 17 nt, Human herpesvirus 7
guccccuucgcugcugu

SEQ ID NO: 2148779 - RNA, 18 nt, Human herpesvirus 7
augccuugccaaaagcuu

SEQ ID NO: 2148780 - RNA, 20 nt, Human herpesvirus 7
aaccaugaaaaauaaauacu

SEQ ID NO: 2148781 - RNA, 16 nt, Human herpesvirus 7
augcauuggaaaaaug

SEQ ID NO: 2148782 - RNA, 23 nt, Human herpesvirus 7
auuuauuuguguuuuguaaauaa

SEQ ID NO: 2148783 - RNA, 20 nt, Human herpesvirus 7
agaagugaguuuuucaguga

SEQ ID NO: 2148784 - RNA, 22 nt, Human herpesvirus 7
uguaaccuuggcuguucaaaau

SEQ ID NO: 2148785 - RNA, 14 nt, Human herpesvirus 7
auacauuauaaaug

SEQ ID NO: 2148786 - RNA, 13 nt, Human herpesvirus 7
gccaauugaagaa

SEQ ID NO: 2148787 - RNA, 14 nt, Human herpesvirus 7
uugcuuaacuuuug

SEQ ID NO: 2148788 - RNA, 21 nt, Human herpesvirus 7
agauugaucacuuugcaucaa

SEQ ID NO: 2148789 - RNA, 16 nt, Human herpesvirus 7
ucuggaucugccucug

SEQ ID NO: 2148790 - RNA, 15 nt, Human herpesvirus 7
acggacuuaugucca

SEQ ID NO: 2148791 - RNA, 19 nt, Human herpesvirus 7
acaaacauuccaacagcuu

SEQ ID NO: 2148792 - RNA, 14 nt, Human herpesvirus 7
auuuuacaaugcag

SEQ ID NO: 2148793 - RNA, 19 nt, Human herpesvirus 7
cauuucauuccaaaauaca

SEQ ID NO: 2148794 - RNA, 15 nt, Human herpesvirus 7
auucuaauauguaug

SEQ ID NO: 2148795 - RNA, 21 nt, Human herpesvirus 7
caaaaguauaacauugcuuca

SEQ ID NO: 2148796 - RNA, 14 nt, Human herpesvirus 7
cacaauuacacaaa

SEQ ID NO: 2148797 - RNA, 15 nt, Human herpesvirus 7
aaauuaaaaagaaug

SEQ ID NO: 2148798 - RNA, 18 nt, Human herpesvirus 7
ucauaauuaugaaauguu

SEQ ID NO: 2148799 - RNA, 17 nt, Human herpesvirus 7
uagauguuuuugauauu

SEQ ID NO: 2148800 - RNA, 17 nt, Human herpesvirus 7
uugcuuaaaacuuugaa

SEQ ID NO: 2148801 - RNA, 19 nt, Human herpesvirus 7
aaaucuguagaaaauguuu

SEQ ID NO: 2148802 - RNA, 15 nt, Human herpesvirus 7
gaguuuaaaguaaaa

SEQ ID NO: 2148803 - RNA, 13 nt, Human herpesvirus 7
gauauuuugacaa

SEQ ID NO: 2148804 - RNA, 16 nt, Human herpesvirus 7
uuaaaguauuuauuuu

SEQ ID NO: 2148805 - RNA, 15 nt, Human herpesvirus 7
agucuaaaaauguuu

SEQ ID NO: 2148806 - RNA, 13 nt, Human herpesvirus 7
gguuauuggaaau

SEQ ID NO: 2148807 - RNA, 21 nt, Human herpesvirus 7
caaccuguacucgacucugaa

SEQ ID NO: 2148808 - RNA, 14 nt, Human herpesvirus 7
acguuuuugcagag

SEQ ID NO: 2148809 - RNA, 21 nt, Human herpesvirus 7
agauuuccauuucaaaagaaa

SEQ ID NO: 2148810 - RNA, 23 nt, Human herpesvirus 7
agggauacaaaugcaaauuaaaa

SEQ ID NO: 2148811 - RNA, 15 nt, Human herpesvirus 7
auuuaaaaaaggaaa

SEQ ID NO: 2148812 - RNA, 16 nt, Human herpesvirus 7
acuucugauaucuuaa

SEQ ID NO: 2148813 - RNA, 21 nt, Human herpesvirus 7
ccagagucucuaaaauuuucu

SEQ ID NO: 2148814 - RNA, 23 nt, Human herpesvirus 7
caccgaugaauuuuuuuugguaa

SEQ ID NO: 2148815 - RNA, 16 nt, Human herpesvirus 7
ugauaauaagaugugu

SEQ ID NO: 2148816 - RNA, 14 nt, Human herpesvirus 7
ucagucaacuuuuu

SEQ ID NO: 2148817 - RNA, 21 nt, Human herpesvirus 7
uuuucuccaugcauauuugaa

SEQ ID NO: 2148818 - RNA, 16 nt, Human herpesvirus 7
auuggcauuauucuuc

SEQ ID NO: 2148819 - RNA, 16 nt, Human herpesvirus 7
uauuucuaauagacaa

SEQ ID NO: 2148820 - RNA, 19 nt, Human herpesvirus 7
uaaaauuuauauuaaauga

SEQ ID NO: 2148821 - RNA, 23 nt, Human herpesvirus 7
guuacaucauguuaaaaaaucaa

SEQ ID NO: 2148822 - RNA, 15 nt, Human herpesvirus 7
aaauaauauuuuacc

SEQ ID NO: 2148823 - RNA, 19 nt, Human herpesvirus 7
acgcccacucuggaaaugu

SEQ ID NO: 2148824 - RNA, 18 nt, Human herpesvirus 7
caguuucugcauacucuu

SEQ ID NO: 2148825 - RNA, 21 nt, Human herpesvirus 7
cuuuucucuccccaguaaaua

SEQ ID NO: 2148826 - RNA, 13 nt, Human herpesvirus 7
aaccuaucaaaau

SEQ ID NO: 2148827 - RNA, 16 nt, Human herpesvirus 7
aaagcaaaagccacag

SEQ ID NO: 2148828 - RNA, 15 nt, Human herpesvirus 7
cuagaaaauaguugu

SEQ ID NO: 2148829 - RNA, 18 nt, Human herpesvirus 7
caaaucugauaaauuaca

SEQ ID NO: 2148830 - RNA, 12 nt, Human herpesvirus 7
auucgaugucag

SEQ ID NO: 2148831 - RNA, 16 nt, Human herpesvirus 7
uagauuuaaaacaauu

SEQ ID NO: 2148832 - RNA, 17 nt, Human herpesvirus 7
uuaucaaugccuguuuu

SEQ ID NO: 2148833 - RNA, 23 nt, Human herpesvirus 7
gcaucaaaacauaucagauuuua

SEQ ID NO: 2148834 - RNA, 14 nt, Human herpesvirus 7
aucuuaaaauacua

SEQ ID NO: 2148835 - RNA, 23 nt, Human herpesvirus 7
aguuacacugauuuuuuuaauaa

SEQ ID NO: 2148836 - RNA, 14 nt, Human herpesvirus 7
cuaaccaucugcug

SEQ ID NO: 2148837 - RNA, 17 nt, Human herpesvirus 7
aggacaugauuggccag

SEQ ID NO: 2148838 - RNA, 23 nt, Human herpesvirus 7
cugcagaaauuuuuaaagagaaa

SEQ ID NO: 2148839 - RNA, 19 nt, Human herpesvirus 7
acaaauuggaaauuacugg

SEQ ID NO: 2148840 - RNA, 21 nt, Human herpesvirus 7
uggaacugaaaacaaugcaga

SEQ ID NO: 2148841 - RNA, 11 nt, Human herpesvirus 7
ugaaauuguag

SEQ ID NO: 2148842 - RNA, 21 nt, Human herpesvirus 7
acggacaauaacauuuuguau

SEQ ID NO: 2148843 - RNA, 21 nt, Human herpesvirus 7
uucuagcaaaauaugcaaaac

SEQ ID NO: 2148844 - RNA, 13 nt, Human herpesvirus 7
aaagggggaaaga

SEQ ID NO: 2148845 - RNA, 19 nt, Human herpesvirus 7
auuuuaaugugcuuauuua

SEQ ID NO: 2148846 - RNA, 19 nt, Human herpesvirus 7
uguaaccuuggcuguucaa

SEQ ID NO: 2148847 - RNA, 15 nt, Human herpesvirus 7
cagauucgacuucua

SEQ ID NO: 2148848 - RNA, 11 nt, Human herpesvirus 7
auauggcaaua

SEQ ID NO: 2148849 - RNA, 16 nt, Human herpesvirus 7
acauuaguucuggccg

SEQ ID NO: 2148850 - RNA, 18 nt, Human herpesvirus 7
uugcugaaagaacuuuuc

SEQ ID NO: 2148851 - RNA, 13 nt, Human herpesvirus 7
uacaguaaauugc

SEQ ID NO: 2148852 - RNA, 19 nt, Human herpesvirus 7
ggaaacauugaaaaagcag

SEQ ID NO: 2148853 - RNA, 20 nt, Human herpesvirus 7
aaagugaucaaaauuaaugu

SEQ ID NO: 2148854 - RNA, 23 nt, Human herpesvirus 7
gcuuugaucuacauauacuuuua

SEQ ID NO: 2148855 - RNA, 23 nt, Human herpesvirus 7
cgaggaagcuuucguaaucauuc

SEQ ID NO: 2148856 - RNA, 16 nt, Human herpesvirus 7
auuauaaauguaacuu

SEQ ID NO: 2148857 - RNA, 19 nt, Human herpesvirus 7
uuuaaaaaugauuuuucuu

SEQ ID NO: 2148858 - RNA, 13 nt, Human herpesvirus 7
uguauaugccugu

SEQ ID NO: 2148859 - RNA, 23 nt, Human herpesvirus 7
uuccauauuccugcaaaacuugg

SEQ ID NO: 2148860 - RNA, 19 nt, Human herpesvirus 7
ugaauauugcuagucucaa

SEQ ID NO: 2148861 - RNA, 16 nt, Human herpesvirus 7
uucuguaaaaacuugu

SEQ ID NO: 2148862 - RNA, 11 nt, Human herpesvirus 7
aauuguuugau

SEQ ID NO: 2148863 - RNA, 21 nt, Human herpesvirus 7
aaagugaacaugacuucagaa

SEQ ID NO: 2148864 - RNA, 16 nt, Human herpesvirus 7
uaacuuuaaauuauua

SEQ ID NO: 2148865 - RNA, 18 nt, Human herpesvirus 7
ucaugcgauaucugacug

SEQ ID NO: 2148866 - RNA, 21 nt, Human herpesvirus 7
gauuaaaaacccuuuauucau

SEQ ID NO: 2148867 - RNA, 17 nt, Human herpesvirus 7
uaaucauggaaaaugga

SEQ ID NO: 2148868 - RNA, 16 nt, Human herpesvirus 7
ugguaccuuagaauca

SEQ ID NO: 2148869 - RNA, 18 nt, Human herpesvirus 7
augucuuguuaucuccac

SEQ ID NO: 2148870 - RNA, 18 nt, Human herpesvirus 7
uacagcauauaucuuuga

SEQ ID NO: 2148871 - RNA, 15 nt, Human herpesvirus 7
uaaucuuaauguuuc

SEQ ID NO: 2148872 - RNA, 16 nt, Human herpesvirus 7
uguacuuuuuauuguu

SEQ ID NO: 2148873 - RNA, 18 nt, Human herpesvirus 7
ugcuaaggcuaaacucgu

SEQ ID NO: 2148874 - RNA, 22 nt, Human herpesvirus 7
gugggauuugaaugaacaaaua

SEQ ID NO: 2148875 - RNA, 19 nt, Human herpesvirus 7
cuuagaugcugaaacauca

SEQ ID NO: 2148876 - RNA, 12 nt, Human herpesvirus 7
agugaugaaagu

SEQ ID NO: 2148877 - RNA, 13 nt, Human herpesvirus 7
cuuccuaaaaaaa

SEQ ID NO: 2148878 - RNA, 18 nt, Human herpesvirus 7
ugaaaccuucgcaacaau

SEQ ID NO: 2148879 - RNA, 15 nt, Human herpesvirus 7
cuugacucagauucg

SEQ ID NO: 2148880 - RNA, 20 nt, Human herpesvirus 7
aacuaagcauauugaagauc

SEQ ID NO: 2148881 - RNA, 17 nt, Human herpesvirus 7
uaccaaaaaccugaaaa

SEQ ID NO: 2148882 - RNA, 21 nt, Human herpesvirus 7
aaaugucuuugucaugaugaa

SEQ ID NO: 2148883 - RNA, 22 nt, Human herpesvirus 7
guaaacucacuucuaaaagcug

SEQ ID NO: 2148884 - RNA, 18 nt, Human herpesvirus 7
aaacuuagugaugaccac

SEQ ID NO: 2148885 - RNA, 22 nt, Human herpesvirus 7
uuuaccgauucuaaauuaaaaa

SEQ ID NO: 2148886 - RNA, 22 nt, Human herpesvirus 7
acagaucuugcuuuagaacaau

SEQ ID NO: 2148887 - RNA, 16 nt, Human herpesvirus 7
cuuucauaacaaagug

SEQ ID NO: 2148888 - RNA, 15 nt, Human herpesvirus 7
acuaauaaaaauuac

SEQ ID NO: 2148889 - RNA, 18 nt, Human herpesvirus 7
ugcaauaugcauguguaa

SEQ ID NO: 2148890 - RNA, 14 nt, Human herpesvirus 7
cugguugauuugag

SEQ ID NO: 2148891 - RNA, 15 nt, Human herpesvirus 7
aagauuaaaugggcu

SEQ ID NO: 2148892 - RNA, 19 nt, Human herpesvirus 7
cugcuggaaagcuugugaa

SEQ ID NO: 2148893 - RNA, 15 nt, Human herpesvirus 7
uagccauaaaugcuu

SEQ ID NO: 2148894 - RNA, 14 nt, Human herpesvirus 7
uauucuauuucaac

SEQ ID NO: 2148895 - RNA, 15 nt, Human herpesvirus 7
aguuuguuucaauau

SEQ ID NO: 2148896 - RNA, 17 nt, Human herpesvirus 7
aauuuuccauucauuuc

SEQ ID NO: 2148897 - RNA, 23 nt, Human herpesvirus 7
aauaaauuuuucgaucuguaaaa

SEQ ID NO: 2148898 - RNA, 13 nt, Human herpesvirus 7
aaaauugaaaaga

SEQ ID NO: 2148899 - RNA, 17 nt, Human herpesvirus 7
uguauugucuuacagca

SEQ ID NO: 2148900 - RNA, 23 nt, Human herpesvirus 7
aauuguuuuucuuucuugcauac

SEQ ID NO: 2148901 - RNA, 20 nt, Human herpesvirus 7
uaacaaaaaagguguugaua

SEQ ID NO: 2148902 - RNA, 14 nt, Human herpesvirus 7
aauuaaucaaacaa

SEQ ID NO: 2148903 - RNA, 12 nt, Human herpesvirus 7
auucuuucaguu

SEQ ID NO: 2148904 - RNA, 20 nt, Human herpesvirus 7
acggcucuaacauuaaaacu

SEQ ID NO: 2148905 - RNA, 13 nt, Human herpesvirus 7
caggauuugggaa

SEQ ID NO: 2148906 - RNA, 21 nt, Human herpesvirus 7
uuagucggcacacguacaaua

SEQ ID NO: 2148907 - RNA, 13 nt, Human herpesvirus 7
augugcuuuuuuc

SEQ ID NO: 2148908 - RNA, 13 nt, Human herpesvirus 7
aacauuuguugcu

SEQ ID NO: 2148909 - RNA, 22 nt, Human herpesvirus 7
aucuacauccuuaaauuuuaca

SEQ ID NO: 2148910 - RNA, 14 nt, Human herpesvirus 7
aggaucucucuuuc

SEQ ID NO: 2148911 - RNA, 21 nt, Human herpesvirus 7
uuaauaaaaaacaaauaacug

SEQ ID NO: 2148912 - RNA, 21 nt, Human herpesvirus 7
aaugcagccuacuuuuaaaau

SEQ ID NO: 2148913 - RNA, 20 nt, Human herpesvirus 7
uuacagccuguacaaauuuc

SEQ ID NO: 2148914 - RNA, 18 nt, Human herpesvirus 7
uucaauugguuguucaaa

SEQ ID NO: 2148915 - RNA, 15 nt, Human herpesvirus 7
uaacagguaaauugu

SEQ ID NO: 2148916 - RNA, 12 nt, Human herpesvirus 7
gcucuaaacaaa

SEQ ID NO: 2148917 - RNA, 20 nt, Human herpesvirus 7
acauuuacaaaaaaaagcuu

SEQ ID NO: 2148918 - RNA, 14 nt, Human herpesvirus 7
agcuuucuuucuca

SEQ ID NO: 2148919 - RNA, 20 nt, Human herpesvirus 7
auccaaaaagaaacuuucua

SEQ ID NO: 2148920 - RNA, 19 nt, Human herpesvirus 7
acuccauucgguuuucaaa

SEQ ID NO: 2148921 - RNA, 15 nt, Human herpesvirus 7
gugcuuccucuggau

SEQ ID NO: 2148922 - RNA, 22 nt, Human herpesvirus 7
aaauucgcugaugaaaauauga

SEQ ID NO: 2148923 - RNA, 17 nt, Human herpesvirus 7
aagaugcguagcuacag

SEQ ID NO: 2148924 - RNA, 20 nt, Human herpesvirus 7
ccguugaguugcugcugucu

SEQ ID NO: 2148925 - RNA, 11 nt, Human herpesvirus 7
gacauguuucu

SEQ ID NO: 2148926 - RNA, 19 nt, Human herpesvirus 7
ggaaaugucuuugucauga

SEQ ID NO: 2148927 - RNA, 17 nt, Human herpesvirus 7
accaaauauaugcuuua

SEQ ID NO: 2148928 - RNA, 18 nt, Human herpesvirus 7
ugaacaaguagugcuaau

SEQ ID NO: 2148929 - RNA, 17 nt, Human herpesvirus 7
gcauuauuguauaugau

SEQ ID NO: 2148930 - RNA, 14 nt, Human herpesvirus 7
agucucuaaacuuc

SEQ ID NO: 2148931 - RNA, 15 nt, Human herpesvirus 7
aaggaaaaauuucuu

SEQ ID NO: 2148932 - RNA, 16 nt, Human herpesvirus 7
cacugcaaauuguaaa

SEQ ID NO: 2148933 - RNA, 14 nt, Human herpesvirus 7
caaauccacucugg

SEQ ID NO: 2148934 - RNA, 21 nt, Human herpesvirus 7
aaaguauggaaaaauguuaug

SEQ ID NO: 2148935 - RNA, 13 nt, Human herpesvirus 7
aaauugaauagau

SEQ ID NO: 2148936 - RNA, 19 nt, Human herpesvirus 7
gaagacauauuagauuaua

SEQ ID NO: 2148937 - RNA, 22 nt, Human herpesvirus 7
acauucagaaaaaaucaaaaca

SEQ ID NO: 2148938 - RNA, 14 nt, Human herpesvirus 7
uucuuguuuggaaa

SEQ ID NO: 2148939 - RNA, 16 nt, Human herpesvirus 7
aauaucccagaauauc

SEQ ID NO: 2148940 - RNA, 17 nt, Human herpesvirus 7
aauguagacguaguguc

SEQ ID NO: 2148941 - RNA, 13 nt, Human herpesvirus 7
uacauuuugcaau

SEQ ID NO: 2148942 - RNA, 20 nt, Human herpesvirus 7
agaggacuugaaaaauuuuu

SEQ ID NO: 2148943 - RNA, 16 nt, Human herpesvirus 7
gaacuguugccagaaa

SEQ ID NO: 2148944 - RNA, 16 nt, Human herpesvirus 7
acagucauuugcaguu

SEQ ID NO: 2148945 - RNA, 23 nt, Human herpesvirus 7
gagaauguugagcuaucugauuu

SEQ ID NO: 2148946 - RNA, 16 nt, Human herpesvirus 7
acguccauugauuaaa

SEQ ID NO: 2148947 - RNA, 18 nt, Human herpesvirus 7
accuaaagugaacaugac

SEQ ID NO: 2148948 - RNA, 14 nt, Human herpesvirus 7
aaucaacaaaauga

SEQ ID NO: 2148949 - RNA, 22 nt, Human herpesvirus 7
uccaucuuaugauaaagaaaac

SEQ ID NO: 2148950 - RNA, 18 nt, Human herpesvirus 7
cagaauacuacucagaag

SEQ ID NO: 2148951 - RNA, 16 nt, Human herpesvirus 7
ugucuauuaaaugcgu

SEQ ID NO: 2148952 - RNA, 14 nt, Human herpesvirus 7
gauccguaacugca

SEQ ID NO: 2148953 - RNA, 13 nt, Human herpesvirus 7
agauucuuaauuu

SEQ ID NO: 2148954 - RNA, 20 nt, Human herpesvirus 7
acuggagagaauaagcaaau

SEQ ID NO: 2148955 - RNA, 14 nt, Human herpesvirus 7
guucguaacaaauu

SEQ ID NO: 2148956 - RNA, 22 nt, Human herpesvirus 7
augaaggaugcguguguucaaa

SEQ ID NO: 2148957 - RNA, 22 nt, Human herpesvirus 7
caucuuaaaaguacaaauguuu

SEQ ID NO: 2148958 - RNA, 14 nt, Human herpesvirus 7
ucauugugugucuu

SEQ ID NO: 2148959 - RNA, 19 nt, Human herpesvirus 7
aagaacuucagauuuuagu

SEQ ID NO: 2148960 - RNA, 12 nt, Human herpesvirus 7
auacuaauagaa

SEQ ID NO: 2148961 - RNA, 21 nt, Human herpesvirus 7
cugcaaccugauaaauacuca

SEQ ID NO: 2148962 - RNA, 15 nt, Human herpesvirus 7
cugaagcauggauuu

SEQ ID NO: 2148963 - RNA, 20 nt, Human herpesvirus 7
uuccgcgcgguauaaugcac

SEQ ID NO: 2148964 - RNA, 12 nt, Human herpesvirus 7
aaaauccuggau

SEQ ID NO: 2148965 - RNA, 15 nt, Human herpesvirus 7
gcuauucauuucacg

SEQ ID NO: 2148966 - RNA, 18 nt, Human herpesvirus 7
ugcagaaaaauccaaaau

SEQ ID NO: 2148967 - RNA, 21 nt, Human herpesvirus 7
uuuaauuuggaaauuguuuga

SEQ ID NO: 2148968 - RNA, 21 nt, Human herpesvirus 7
gguuaaaaaaaugaauaacua

SEQ ID NO: 2148969 - RNA, 18 nt, Human herpesvirus 7
ucgauuagguaauagcuu

SEQ ID NO: 2148970 - RNA, 20 nt, Human herpesvirus 7
uauugaauguggaauuaaau

SEQ ID NO: 2148971 - RNA, 14 nt, Human herpesvirus 7
aaaugcauugcuuu

SEQ ID NO: 2148972 - RNA, 22 nt, Human herpesvirus 7
aaagaaaaagcaacaaauguuu

SEQ ID NO: 2148973 - RNA, 13 nt, Human herpesvirus 7
caucccuggacag

SEQ ID NO: 2148974 - RNA, 12 nt, Human herpesvirus 7
aaaaguguucaa

SEQ ID NO: 2148975 - RNA, 18 nt, Human herpesvirus 7
gcugauuauucaugcaga

SEQ ID NO: 2148976 - RNA, 23 nt, Human herpesvirus 7
uaaauuuugaauguuuacaugua

SEQ ID NO: 2148977 - RNA, 19 nt, Human herpesvirus 7
gucagaacaucccuggaca

SEQ ID NO: 2148978 - RNA, 23 nt, Human herpesvirus 7
caccaaaaaauaaaaacaagcuu

SEQ ID NO: 2148979 - RNA, 23 nt, Human herpesvirus 7
aagucacaauuacacaaauugau

SEQ ID NO: 2148980 - RNA, 18 nt, Human herpesvirus 7
cuagaacuguuaaaaucu

SEQ ID NO: 2148981 - RNA, 14 nt, Human herpesvirus 7
augaauaucuguuu

SEQ ID NO: 2148982 - RNA, 19 nt, Human herpesvirus 7
uggguaauuuuaaaacuga

SEQ ID NO: 2148983 - RNA, 23 nt, Human herpesvirus 7
caaaaacguuaccguuuaaugaa

SEQ ID NO: 2148984 - RNA, 19 nt, Human herpesvirus 7
auauuaaaaaccacagagg

SEQ ID NO: 2148985 - RNA, 18 nt, Human herpesvirus 7
acggauuuacauuucauu

SEQ ID NO: 2148986 - RNA, 22 nt, Human herpesvirus 7
aaaacgugugaaaacaauuaag

SEQ ID NO: 2148987 - RNA, 15 nt, Human herpesvirus 7
ucagaauagacaucu

SEQ ID NO: 2148988 - RNA, 15 nt, Human herpesvirus 7
uauauggcaauaaau

SEQ ID NO: 2148989 - RNA, 23 nt, Human herpesvirus 7
caguaacuacaggcuuacacuau

SEQ ID NO: 2148990 - RNA, 13 nt, Human herpesvirus 7
uuccucuggaaaa

SEQ ID NO: 2148991 - RNA, 22 nt, Human herpesvirus 7
ugacucagauucgacuucuaaa

SEQ ID NO: 2148992 - RNA, 22 nt, Human herpesvirus 7
cuuauuuauauauggcaauaaa

SEQ ID NO: 2148993 - RNA, 17 nt, Human herpesvirus 7
acuucuaguucugaaau

SEQ ID NO: 2148994 - RNA, 13 nt, Human herpesvirus 7
cucuagaaaaucu

SEQ ID NO: 2148995 - RNA, 21 nt, Human herpesvirus 7
cagauaaaaauuuauuuucua

SEQ ID NO: 2148996 - RNA, 22 nt, Human herpesvirus 7
uggguuaacgaaacgcuagaau

SEQ ID NO: 2148997 - RNA, 16 nt, Human herpesvirus 7
cuuggaguuugucuca

SEQ ID NO: 2148998 - RNA, 20 nt, Human herpesvirus 7
uucagaaaauaaaaguaaaa

SEQ ID NO: 2148999 - RNA, 19 nt, Human herpesvirus 7
cccuggaacguccucugga

SEQ ID NO: 2149000 - RNA, 12 nt, Human herpesvirus 7
aaaauagccgau

SEQ ID NO: 2149001 - RNA, 19 nt, Human herpesvirus 7
caaaaccguuggaugcacu

SEQ ID NO: 2149002 - RNA, 21 nt, Human herpesvirus 7
uuaacacguagaaaaaaacaa

SEQ ID NO: 2149003 - RNA, 12 nt, Human herpesvirus 7
cuaaauuuccuu

SEQ ID NO: 2149004 - RNA, 15 nt, Human herpesvirus 7
cugauacgcuuucug

SEQ ID NO: 2149005 - RNA, 15 nt, Human herpesvirus 7
augcucgauauacau

SEQ ID NO: 2149006 - RNA, 23 nt, Human herpesvirus 7
uuuacuuuugagcgcugaaauaa

SEQ ID NO: 2149007 - RNA, 15 nt, Human herpesvirus 7
aauuauuagauucca

SEQ ID NO: 2149008 - RNA, 17 nt, Human herpesvirus 7
ggaaaaaggauuugaag

SEQ ID NO: 2149009 - RNA, 12 nt, Human herpesvirus 7
auagaguuuaau

SEQ ID NO: 2149010 - RNA, 14 nt, Human herpesvirus 7
auaaaauuuuucau

SEQ ID NO: 2149011 - RNA, 15 nt, Human herpesvirus 7
aaugucucuugaaga

SEQ ID NO: 2149012 - RNA, 15 nt, Human herpesvirus 7
caagaagaugacauu

SEQ ID NO: 2149013 - RNA, 20 nt, Human herpesvirus 7
gccugaagagauuaagguga

SEQ ID NO: 2149014 - RNA, 19 nt, Human herpesvirus 7
uugaauucguuaagcaccg

SEQ ID NO: 2149015 - RNA, 12 nt, Human herpesvirus 7
aucaaaauccug

SEQ ID NO: 2149016 - RNA, 19 nt, Human herpesvirus 7
uuuugauccgauuuaucaa

SEQ ID NO: 2149017 - RNA, 23 nt, Human herpesvirus 7
ugaaaauuuccuacaaaaguucu

SEQ ID NO: 2149018 - RNA, 19 nt, Human herpesvirus 7
aaugaauuuuaaguggaau

SEQ ID NO: 2149019 - RNA, 15 nt, Human herpesvirus 7
uuccauuucaaaaga

SEQ ID NO: 2149020 - RNA, 21 nt, Human herpesvirus 7
auguuuuagaccuaucaaauu

SEQ ID NO: 2149021 - RNA, 16 nt, Human herpesvirus 7
gaggucuacuggacca

SEQ ID NO: 2149022 - RNA, 17 nt, Human herpesvirus 7
uuauaaugauguaaugu

SEQ ID NO: 2149023 - RNA, 14 nt, Human herpesvirus 7
auuuuuuaaagaaa

SEQ ID NO: 2149024 - RNA, 23 nt, Human herpesvirus 7
acaaugguguuaacaaucuuaca

SEQ ID NO: 2149025 - RNA, 21 nt, Human herpesvirus 7
uuuuauaauacuggcaugucu

SEQ ID NO: 2149026 - RNA, 23 nt, Human herpesvirus 7
cuggaugaaaacugaauugguaa

SEQ ID NO: 2149027 - RNA, 17 nt, Human herpesvirus 7
ugaaauaagaugcuuaa

SEQ ID NO: 2149028 - RNA, 17 nt, Human herpesvirus 7
acuauguccaaaaauuu

SEQ ID NO: 2149029 - RNA, 16 nt, Human herpesvirus 7
gcaacuuugugccuga

SEQ ID NO: 2149030 - RNA, 18 nt, Human herpesvirus 7
ugcauacucuuguugacu

SEQ ID NO: 2149031 - RNA, 23 nt, Human herpesvirus 7
cggauagcggucaucucacuuca

SEQ ID NO: 2149032 - RNA, 13 nt, Human herpesvirus 7
cuacuaugggcug

SEQ ID NO: 2149033 - RNA, 16 nt, Human herpesvirus 7
gaaaauaacaggaaac

SEQ ID NO: 2149034 - RNA, 19 nt, Human herpesvirus 7
aacgauaugguuugaaaac

SEQ ID NO: 2149035 - RNA, 23 nt, Human herpesvirus 7
auuuacuaucgacaaacagaaaa

SEQ ID NO: 2149036 - RNA, 22 nt, Human herpesvirus 7
cauagacauuauuagacagaua

SEQ ID NO: 2149037 - RNA, 14 nt, Human herpesvirus 7
auaauuuaaaauua

SEQ ID NO: 2149038 - RNA, 18 nt, Human herpesvirus 7
aaaucacugcucaaauca

SEQ ID NO: 2149039 - RNA, 22 nt, Human herpesvirus 7
uaauauuuuaccgguacauuua

SEQ ID NO: 2149040 - RNA, 21 nt, Human herpesvirus 7
uuugaucuacauauacuuuua

SEQ ID NO: 2149041 - RNA, 20 nt, Human herpesvirus 7
uaaaauuaucggaaauuuug

SEQ ID NO: 2149042 - RNA, 16 nt, Human herpesvirus 7
uuuugaauguuuacau

SEQ ID NO: 2149043 - RNA, 16 nt, Human herpesvirus 7
acagguaaauuguaaa

SEQ ID NO: 2149044 - RNA, 17 nt, Human herpesvirus 7
caucuuaaaaguacaaa

SEQ ID NO: 2149045 - RNA, 20 nt, Human herpesvirus 7
acauuuauuauuuuuaaaaa

SEQ ID NO: 2149046 - RNA, 21 nt, Human herpesvirus 7
agacuaaauauggagcagcuu

SEQ ID NO: 2149047 - RNA, 22 nt, Human herpesvirus 7
aauuguaaguaaauuuacuuga

SEQ ID NO: 2149048 - RNA, 23 nt, Human herpesvirus 7
gucucagagaacuagaacagcug

SEQ ID NO: 2149049 - RNA, 20 nt, Human herpesvirus 7
acacaguugaauaaagauua

SEQ ID NO: 2149050 - RNA, 15 nt, Human herpesvirus 7
ccaaaaucaaaaaac

SEQ ID NO: 2149051 - RNA, 21 nt, Human herpesvirus 7
cugacauacgaaucaguucaa

SEQ ID NO: 2149052 - RNA, 14 nt, Human herpesvirus 7
ugagcgcugaaaua

SEQ ID NO: 2149053 - RNA, 18 nt, Human herpesvirus 7
agaaugugguaaaaaagu

SEQ ID NO: 2149054 - RNA, 20 nt, Human herpesvirus 7
acguucuuggucauuaaaaa

SEQ ID NO: 2149055 - RNA, 12 nt, Human herpesvirus 7
agaaacaagguu

SEQ ID NO: 2149056 - RNA, 20 nt, Human herpesvirus 7
caucuaauugcagacuaauu

SEQ ID NO: 2149057 - RNA, 22 nt, Human herpesvirus 7
uaaaucaguuguuggaaauacc

SEQ ID NO: 2149058 - RNA, 16 nt, Human herpesvirus 7
uuuggcaacucuuccu

SEQ ID NO: 2149059 - RNA, 15 nt, Human herpesvirus 7
cagagggcauuugua

SEQ ID NO: 2149060 - RNA, 23 nt, Human herpesvirus 7
uguuaaaacuuggauaaccaaac

SEQ ID NO: 2149061 - RNA, 22 nt, Human herpesvirus 7
auuugcagccagaacucaauuu

SEQ ID NO: 2149062 - RNA, 22 nt, Human herpesvirus 7
ugaacacuuuuacgugacuguc

SEQ ID NO: 2149063 - RNA, 21 nt, Human herpesvirus 7
cagacgaauuucuuugcgcug

SEQ ID NO: 2149064 - RNA, 13 nt, Human herpesvirus 7
aaaguugaaaaug

SEQ ID NO: 2149065 - RNA, 23 nt, Human herpesvirus 7
gcuugaugaaucaaaauuagacg

SEQ ID NO: 2149066 - RNA, 20 nt, Human herpesvirus 7
uuucuucgggguauguaugg

SEQ ID NO: 2149067 - RNA, 12 nt, Human herpesvirus 7
aauauuuagagu

SEQ ID NO: 2149068 - RNA, 17 nt, Human herpesvirus 7
uguccaaucaaaaacug

SEQ ID NO: 2149069 - RNA, 20 nt, Human herpesvirus 7
cgcauuuuguauuaaaggaa

SEQ ID NO: 2149070 - RNA, 23 nt, Human herpesvirus 7
agaauggcgaguuacauuucacu

SEQ ID NO: 2149071 - RNA, 11 nt, Human herpesvirus 7
acuuugaaauc

SEQ ID NO: 2149072 - RNA, 13 nt, Human herpesvirus 7
ugaauaaaaucua

SEQ ID NO: 2149073 - RNA, 13 nt, Human herpesvirus 7
uauguucaaauau

SEQ ID NO: 2149074 - RNA, 23 nt, Human herpesvirus 7
ggagugcgcggauuaagagaaaa

SEQ ID NO: 2149075 - RNA, 21 nt, Human herpesvirus 7
aggguauuguucacagcaauu

SEQ ID NO: 2149076 - RNA, 21 nt, Human herpesvirus 7
gaaagucagaacauugucaaa

SEQ ID NO: 2149077 - RNA, 15 nt, Human herpesvirus 7
caaaagcugcagcug

SEQ ID NO: 2149078 - RNA, 20 nt, Human herpesvirus 7
cauaauuuuaauaaacggug

SEQ ID NO: 2149079 - RNA, 22 nt, Human herpesvirus 7
gcacugauaaucaagaaacaug

SEQ ID NO: 2149080 - RNA, 21 nt, Human herpesvirus 7
uuuaaaaaaaaaaccacaaaa

SEQ ID NO: 2149081 - RNA, 12 nt, Human herpesvirus 7
ggcuucuucuaa

SEQ ID NO: 2149082 - RNA, 19 nt, Human herpesvirus 7
gaagcugacuuugucauga

SEQ ID NO: 2149083 - RNA, 15 nt, Human herpesvirus 7
cuuuuagaaaucuuu

SEQ ID NO: 2149084 - RNA, 21 nt, Human herpesvirus 7
guaaagauuuaacugauaauu

SEQ ID NO: 2149085 - RNA, 21 nt, Human herpesvirus 7
gcuaagaaagaacauuuuucu

SEQ ID NO: 2149086 - RNA, 21 nt, Human herpesvirus 7
cauuucaucauccgaaucugu

SEQ ID NO: 2149087 - RNA, 18 nt, Human herpesvirus 7
uaaauauuuuuaaaaucu

SEQ ID NO: 2149088 - RNA, 20 nt, Human herpesvirus 7
cuagcguuucguuaacccag

SEQ ID NO: 2149089 - RNA, 16 nt, Human herpesvirus 7
caggcugcaucuuuuc

SEQ ID NO: 2149090 - RNA, 19 nt, Human herpesvirus 7
ccccuggaacguccucugg

SEQ ID NO: 2149091 - RNA, 13 nt, Human herpesvirus 7
caagaacugugaa

SEQ ID NO: 2149092 - RNA, 16 nt, Human herpesvirus 7
augaacaaguuucaaa

SEQ ID NO: 2149093 - RNA, 20 nt, Human herpesvirus 7
ucuaucaaggucuuucaugc

SEQ ID NO: 2149094 - RNA, 12 nt, Human herpesvirus 7
cacuguuguagg

SEQ ID NO: 2149095 - RNA, 22 nt, Human herpesvirus 7
uguuugaucaaaaucuguagaa

SEQ ID NO: 2149096 - RNA, 22 nt, Human herpesvirus 7
aacauaaaaacuaaguuuugca

SEQ ID NO: 2149097 - RNA, 19 nt, Human herpesvirus 7
aacaccccuugcagaaacu

SEQ ID NO: 2149098 - RNA, 22 nt, Human herpesvirus 7
gagcuguguccacuacagauau

SEQ ID NO: 2149099 - RNA, 22 nt, Human herpesvirus 7
gcacuugcucugugaaacaaug

SEQ ID NO: 2149100 - RNA, 18 nt, Human herpesvirus 7
cuuauaacugugaaaaca

SEQ ID NO: 2149101 - RNA, 16 nt, Human herpesvirus 7
ucgacuuccucucgug

SEQ ID NO: 2149102 - RNA, 17 nt, Human herpesvirus 7
cuuugucacuuaaagaa

SEQ ID NO: 2149103 - RNA, 13 nt, Human herpesvirus 7
ucaaaaucagaaa

SEQ ID NO: 2149104 - RNA, 14 nt, Human herpesvirus 7
acuuuuaacuguua

SEQ ID NO: 2149105 - RNA, 16 nt, Human herpesvirus 7
uuuuaauaugugaaaa

SEQ ID NO: 2149106 - RNA, 11 nt, Human herpesvirus 7
aaauagcaaag

SEQ ID NO: 2149107 - RNA, 23 nt, Human herpesvirus 7
accacaaccgauaaaagguguuu

SEQ ID NO: 2149108 - RNA, 23 nt, Human herpesvirus 7
uuuacagaagaacauuuauuauu

SEQ ID NO: 2149109 - RNA, 15 nt, Human herpesvirus 7
ugauuuauauagcaa

SEQ ID NO: 2149110 - RNA, 19 nt, Human herpesvirus 7
agauguuuuugauauugua

SEQ ID NO: 2149111 - RNA, 17 nt, Human herpesvirus 7
uaugaauugaaauuucu

SEQ ID NO: 2149112 - RNA, 19 nt, Human herpesvirus 7
aaauuauuauuaguauugu

SEQ ID NO: 2149113 - RNA, 14 nt, Human herpesvirus 7
aaaugguugugcaa

SEQ ID NO: 2149114 - RNA, 14 nt, Human herpesvirus 7
gcaacauuaauaaa

SEQ ID NO: 2149115 - RNA, 17 nt, Human herpesvirus 7
aauccaaguuuuacaga

SEQ ID NO: 2149116 - RNA, 19 nt, Human herpesvirus 7
uaacgaauuuuuccaugug

SEQ ID NO: 2149117 - RNA, 20 nt, Human herpesvirus 7
aggaucaaaagcugcagcug

SEQ ID NO: 2149118 - RNA, 23 nt, Human herpesvirus 7
gaaguugaucgucuguugaaaca

SEQ ID NO: 2149119 - RNA, 12 nt, Human herpesvirus 7
uaggggaagaau

SEQ ID NO: 2149120 - RNA, 18 nt, Human herpesvirus 7
ugguugauuugagcagug

SEQ ID NO: 2149121 - RNA, 14 nt, Human herpesvirus 7
caguuguuggaaau

SEQ ID NO: 2149122 - RNA, 23 nt, Human herpesvirus 7
uuuauugaauggaacauguuugu

SEQ ID NO: 2149123 - RNA, 13 nt, Human herpesvirus 7
aaacaaacucugc

SEQ ID NO: 2149124 - RNA, 18 nt, Human herpesvirus 7
uaaauaucccuagaagau

SEQ ID NO: 2149125 - RNA, 14 nt, Human herpesvirus 7
aauaugugaaaaua

SEQ ID NO: 2149126 - RNA, 22 nt, Human herpesvirus 7
guucauauacuucuugccccca

SEQ ID NO: 2149127 - RNA, 17 nt, Human herpesvirus 7
uaguuaguguucuucua

SEQ ID NO: 2149128 - RNA, 20 nt, Human herpesvirus 7
ugaaauuguaguuuuugcau

SEQ ID NO: 2149129 - RNA, 20 nt, Human herpesvirus 7
cuaguugcaacucuucuuca

SEQ ID NO: 2149130 - RNA, 17 nt, Human herpesvirus 7
auaagcaaauaaauugu

SEQ ID NO: 2149131 - RNA, 15 nt, Human herpesvirus 7
caguguuuaaaaugu

SEQ ID NO: 2149132 - RNA, 16 nt, Human herpesvirus 7
cauauuuugcuagaaa

SEQ ID NO: 2149133 - RNA, 11 nt, Human herpesvirus 7
uuuugccuuca

SEQ ID NO: 2149134 - RNA, 13 nt, Human herpesvirus 7
uaaaguuuacuua

SEQ ID NO: 2149135 - RNA, 14 nt, Human herpesvirus 7
guugauucucucuc

SEQ ID NO: 2149136 - RNA, 23 nt, Human herpesvirus 7
aaauucuucagguuguugucauu

SEQ ID NO: 2149137 - RNA, 16 nt, Human herpesvirus 7
aaaguugaaaauguuu

SEQ ID NO: 2149138 - RNA, 18 nt, Human herpesvirus 7
cuuugaaucuauuaaaga

SEQ ID NO: 2149139 - RNA, 11 nt, Human herpesvirus 7
ucaugaaggau

SEQ ID NO: 2149140 - RNA, 14 nt, Human herpesvirus 7
aaauaaaguuuacu

SEQ ID NO: 2149141 - RNA, 13 nt, Human herpesvirus 7
aacauugcuucag

SEQ ID NO: 2149142 - RNA, 19 nt, Human herpesvirus 7
agguugaguugacaauauu

SEQ ID NO: 2149143 - RNA, 15 nt, Human herpesvirus 7
cacucuccugaaaua

SEQ ID NO: 2149144 - RNA, 23 nt, Human herpesvirus 7
cuaaccccgcucuuuuauuuuca

SEQ ID NO: 2149145 - RNA, 15 nt, Human herpesvirus 7
guuaaugucucuguu

SEQ ID NO: 2149146 - RNA, 15 nt, Human herpesvirus 7
cagaauuuccagaag

SEQ ID NO: 2149147 - RNA, 16 nt, Human herpesvirus 7
accgguuaaaauggga

SEQ ID NO: 2149148 - RNA, 14 nt, Human herpesvirus 7
cauuuccgagacag

SEQ ID NO: 2149149 - RNA, 17 nt, Human herpesvirus 7
ucuuaucuccauucuaa

SEQ ID NO: 2149150 - RNA, 13 nt, Human herpesvirus 7
aaugagccugaca

SEQ ID NO: 2149151 - RNA, 12 nt, Human herpesvirus 7
uuuuaacuuuuu

SEQ ID NO: 2149152 - RNA, 20 nt, Human herpesvirus 7
uaaaaacuaaguuuugcauu

SEQ ID NO: 2149153 - RNA, 15 nt, Human herpesvirus 7
uauaaaagaaacuuu

SEQ ID NO: 2149154 - RNA, 23 nt, Human herpesvirus 7
gugcaauuaaaauguacauaacu

SEQ ID NO: 2149155 - RNA, 15 nt, Human herpesvirus 7
aaccauuuauuuaca

SEQ ID NO: 2149156 - RNA, 16 nt, Human herpesvirus 7
auuccaaaauguaaac

SEQ ID NO: 2149157 - RNA, 16 nt, Human herpesvirus 7
aaaucauguuuaagaa

SEQ ID NO: 2149158 - RNA, 19 nt, Human herpesvirus 7
uagaacuugcgaauacuug

SEQ ID NO: 2149159 - RNA, 21 nt, Human herpesvirus 7
ugcaauaugcuagaagacugc

SEQ ID NO: 2149160 - RNA, 12 nt, Human herpesvirus 7
aaagacggaauu

SEQ ID NO: 2149161 - RNA, 21 nt, Human herpesvirus 7
uuucaaaauuuuauugucuaa

SEQ ID NO: 2149162 - RNA, 14 nt, Human herpesvirus 7
ucaaacauuauucg

SEQ ID NO: 2149163 - RNA, 17 nt, Human herpesvirus 7
cuggaugauguuauaca

SEQ ID NO: 2149164 - RNA, 12 nt, Human herpesvirus 7
gugugcaaugau

SEQ ID NO: 2149165 - RNA, 21 nt, Human herpesvirus 7
aauuuacuugauuuucuuaca

SEQ ID NO: 2149166 - RNA, 17 nt, Human herpesvirus 7
guugccagaaaucuggu

SEQ ID NO: 2149167 - RNA, 14 nt, Human herpesvirus 7
cugggauagaaaug

SEQ ID NO: 2149168 - RNA, 21 nt, Human herpesvirus 7
aaauuuagcaccaacugaauu

SEQ ID NO: 2149169 - RNA, 18 nt, Human herpesvirus 7
gguuuuaaaauagaaaau

SEQ ID NO: 2149170 - RNA, 18 nt, Human herpesvirus 7
aaucuggacauuucaaga

SEQ ID NO: 2149171 - RNA, 18 nt, Human herpesvirus 7
uagaaaaacacuagcuuu

SEQ ID NO: 2149172 - RNA, 22 nt, Human herpesvirus 7
aaaagaauggcgguuguacugu

SEQ ID NO: 2149173 - RNA, 21 nt, Human herpesvirus 7
uuccagauaugacaaauuuca

SEQ ID NO: 2149174 - RNA, 22 nt, Human herpesvirus 7
aacuggaauuauacacugugaa

SEQ ID NO: 2149175 - RNA, 20 nt, Human herpesvirus 7
uugguggauccguaacugca

SEQ ID NO: 2149176 - RNA, 19 nt, Human herpesvirus 7
aucuggaaucgaauacagu

SEQ ID NO: 2149177 - RNA, 21 nt, Human herpesvirus 7
aagaacauuaauaucaauuug

SEQ ID NO: 2149178 - RNA, 20 nt, Human herpesvirus 7
aaaagcuuacucuuucugac

SEQ ID NO: 2149179 - RNA, 18 nt, Human herpesvirus 7
ccuaaaaaaaaaggaaaa

SEQ ID NO: 2149180 - RNA, 19 nt, Human herpesvirus 7
acgccaaaucuaauuuaug

SEQ ID NO: 2149181 - RNA, 14 nt, Human herpesvirus 7
agcuucuaaaugug

SEQ ID NO: 2149182 - RNA, 16 nt, Human herpesvirus 7
uugaaauuguaguuuu

SEQ ID NO: 2149183 - RNA, 16 nt, Human herpesvirus 7
gcgccaaaaaaacaca

SEQ ID NO: 2149184 - RNA, 15 nt, Human herpesvirus 7
aagguugucuguucu

SEQ ID NO: 2149185 - RNA, 22 nt, Human herpesvirus 7
uaauaucaauuugaauauugcu

SEQ ID NO: 2149186 - RNA, 14 nt, Human herpesvirus 7
augcauccaaagaa

SEQ ID NO: 2149187 - RNA, 16 nt, Human herpesvirus 7
ucauagagaaaacauu

SEQ ID NO: 2149188 - RNA, 15 nt, Human herpesvirus 7
caauuaaaguauuua

SEQ ID NO: 2149189 - RNA, 15 nt, Human herpesvirus 7
acaacgacauugaaa

SEQ ID NO: 2149190 - RNA, 16 nt, Human herpesvirus 7
uucugacuccuuuuuu

SEQ ID NO: 2149191 - RNA, 22 nt, Human herpesvirus 7
acuaacauuuuaauaugugaaa

SEQ ID NO: 2149192 - RNA, 21 nt, Human herpesvirus 7
uuacucaugaagcuguacaac

SEQ ID NO: 2149193 - RNA, 18 nt, Human herpesvirus 7
auuuugucuuuagauaga

SEQ ID NO: 2149194 - RNA, 22 nt, Human herpesvirus 7
uuuuacuucgagaaaauuuagc

SEQ ID NO: 2149195 - RNA, 22 nt, Human herpesvirus 7
ugacauuguacaauuacaaaau

SEQ ID NO: 2149196 - RNA, 14 nt, Human herpesvirus 7
auaaaguuuuguaa

SEQ ID NO: 2149197 - RNA, 15 nt, Human herpesvirus 7
guaagaaaagcaagu

SEQ ID NO: 2149198 - RNA, 18 nt, Human herpesvirus 7
uaccgguuaaaaugggaa

SEQ ID NO: 2149199 - RNA, 14 nt, Human herpesvirus 7
guuuucuuuguaaa

SEQ ID NO: 2149200 - RNA, 17 nt, Human herpesvirus 7
auuuuuauuguaaagga

SEQ ID NO: 2149201 - RNA, 17 nt, Human herpesvirus 7
uaucucauagcuuaaaa

SEQ ID NO: 2149202 - RNA, 13 nt, Human herpesvirus 7
aaucaaauuucaa

SEQ ID NO: 2149203 - RNA, 13 nt, Human herpesvirus 7
auaacuuuaaauu

SEQ ID NO: 2149204 - RNA, 15 nt, Human herpesvirus 7
gauaaugaaacuguu

SEQ ID NO: 2149205 - RNA, 14 nt, Human herpesvirus 7
uucuaggcuucauu

SEQ ID NO: 2149206 - RNA, 18 nt, Human herpesvirus 7
uaaauaaaaaaaauugaa

SEQ ID NO: 2149207 - RNA, 15 nt, Human herpesvirus 7
aucaaauuauaccuc

SEQ ID NO: 2149208 - RNA, 16 nt, Human herpesvirus 7
aggccuuguaaaguaa

SEQ ID NO: 2149209 - RNA, 15 nt, Human herpesvirus 7
uuuaccgguacauuu

SEQ ID NO: 2149210 - RNA, 22 nt, Human herpesvirus 7
auaaacuuacucuucucgaaga

SEQ ID NO: 2149211 - RNA, 12 nt, Human herpesvirus 7
uaucugugacuu

SEQ ID NO: 2149212 - RNA, 19 nt, Human herpesvirus 7
uuuguagcucuagauguuu

SEQ ID NO: 2149213 - RNA, 18 nt, Human herpesvirus 7
caauaugcauguguaaag

SEQ ID NO: 2149214 - RNA, 16 nt, Human herpesvirus 7
uuucuguagacauuuc

SEQ ID NO: 2149215 - RNA, 17 nt, Human herpesvirus 7
uccuaagcuuuucaggc

SEQ ID NO: 2149216 - RNA, 16 nt, Human herpesvirus 7
acgucuucuucugagu

SEQ ID NO: 2149217 - RNA, 17 nt, Human herpesvirus 7
ugaaauaaaauuuuuca

SEQ ID NO: 2149218 - RNA, 14 nt, Human herpesvirus 7
uugauaaaauuugg

SEQ ID NO: 2149219 - RNA, 20 nt, Human herpesvirus 7
acaagcacacuaaaaaagag

SEQ ID NO: 2149220 - RNA, 17 nt, Human herpesvirus 7
cgaauuggaaaaaaaac

SEQ ID NO: 2149221 - RNA, 14 nt, Human herpesvirus 7
aguagaaaaugcug

SEQ ID NO: 2149222 - RNA, 15 nt, Human herpesvirus 7
gagcuuuugcaaagc

SEQ ID NO: 2149223 - RNA, 16 nt, Human herpesvirus 7
guuuucugagugcuaa

SEQ ID NO: 2149224 - RNA, 14 nt, Human herpesvirus 7
gcgcaguguuuaaa

SEQ ID NO: 2149225 - RNA, 16 nt, Human herpesvirus 7
ucuacuaaggugucuu

SEQ ID NO: 2149226 - RNA, 20 nt, Human herpesvirus 7
cauguuaaaaaaucaacuug

SEQ ID NO: 2149227 - RNA, 16 nt, Human herpesvirus 7
uuacauuacuggaugu

SEQ ID NO: 2149228 - RNA, 21 nt, Human herpesvirus 7
ucacaguugcuugugaaggag

SEQ ID NO: 2149229 - RNA, 19 nt, Human herpesvirus 7
uccuaacuauaauagccuu

SEQ ID NO: 2149230 - RNA, 18 nt, Human herpesvirus 7
ugugaaaauaaacaggaa

SEQ ID NO: 2149231 - RNA, 17 nt, Human herpesvirus 7
uuaauaauauuaguauu

SEQ ID NO: 2149232 - RNA, 16 nt, Human herpesvirus 7
uaucuuuacuuucaua

SEQ ID NO: 2149233 - RNA, 16 nt, Human herpesvirus 7
acauucaacaaagaca

SEQ ID NO: 2149234 - RNA, 16 nt, Human herpesvirus 7
cagauacccacggacg

SEQ ID NO: 2149235 - RNA, 18 nt, Human herpesvirus 7
aauauauuccaacucaau

SEQ ID NO: 2149236 - RNA, 18 nt, Human herpesvirus 7
uugaaauagugucuguug

SEQ ID NO: 2149237 - RNA, 23 nt, Human herpesvirus 7
guuaacaaucuuacaaaaaguag

SEQ ID NO: 2149238 - RNA, 19 nt, Human herpesvirus 7
cuuuuuucaguguguauuu

SEQ ID NO: 2149239 - RNA, 22 nt, Human herpesvirus 7
acaugagauaaacuuuuauuca

SEQ ID NO: 2149240 - RNA, 22 nt, Human herpesvirus 7
cugagagaauaaguucaucaug

SEQ ID NO: 2149241 - RNA, 14 nt, Human herpesvirus 7
ucucuaugauccag

SEQ ID NO: 2149242 - RNA, 16 nt, Human herpesvirus 7
guggcuuuugcuuucc

SEQ ID NO: 2149243 - RNA, 23 nt, Human herpesvirus 7
auauuuucuacaacuaaaauuga

SEQ ID NO: 2149244 - RNA, 13 nt, Human herpesvirus 7
acggaacuucuuu

SEQ ID NO: 2149245 - RNA, 13 nt, Human herpesvirus 7
ugaaaucaaaaau

SEQ ID NO: 2149246 - RNA, 17 nt, Human herpesvirus 7
ugucaggcucauuucaa

SEQ ID NO: 2149247 - RNA, 14 nt, Human herpesvirus 7
caauagaaaacaaa

SEQ ID NO: 2149248 - RNA, 16 nt, Human herpesvirus 7
aggucacaaaagcuuu

SEQ ID NO: 2149249 - RNA, 20 nt, Human herpesvirus 7
augcaagaaaguccaaagug

SEQ ID NO: 2149250 - RNA, 19 nt, Human herpesvirus 7
cugauaaauacucaugaag

SEQ ID NO: 2149251 - RNA, 20 nt, Human herpesvirus 7
uguauuuguugaucuucaau

SEQ ID NO: 2149252 - RNA, 17 nt, Human herpesvirus 7
ucaauagcagagaauau

SEQ ID NO: 2149253 - RNA, 17 nt, Human herpesvirus 7
uacaaugcugucucuga

SEQ ID NO: 2149254 - RNA, 15 nt, Human herpesvirus 7
gaauucauuugugaa

SEQ ID NO: 2149255 - RNA, 14 nt, Human herpesvirus 7
caugucacauaaug

SEQ ID NO: 2149256 - RNA, 14 nt, Human herpesvirus 7
uuauguauaucuuu

SEQ ID NO: 2149257 - RNA, 15 nt, Human herpesvirus 7
uaugaaaaaaacauu

SEQ ID NO: 2149258 - RNA, 16 nt, Human herpesvirus 7
aaacgguauguaaauu

SEQ ID NO: 2149259 - RNA, 21 nt, Human herpesvirus 7
gcauuugguaaaaaaaaugga

SEQ ID NO: 2149260 - RNA, 21 nt, Human herpesvirus 7
acacuuuaaccgcaaaagcca

SEQ ID NO: 2149261 - RNA, 23 nt, Human herpesvirus 7
aggaagaggaguauguugcauau

SEQ ID NO: 2149262 - RNA, 21 nt, Human herpesvirus 7
auuuggauugauuuucaaguu

SEQ ID NO: 2149263 - RNA, 22 nt, Human herpesvirus 7
acuguauuuguugaucuucaau

SEQ ID NO: 2149264 - RNA, 12 nt, Human herpesvirus 7
gccaaugaacaa

SEQ ID NO: 2149265 - RNA, 14 nt, Human herpesvirus 7
uuuagauuuaaaac

SEQ ID NO: 2149266 - RNA, 13 nt, Human herpesvirus 7
acaacuagcaaac

SEQ ID NO: 2149267 - RNA, 22 nt, Human herpesvirus 7
gaaaucugguugauuugagcag

SEQ ID NO: 2149268 - RNA, 20 nt, Human herpesvirus 7
uugucacugcaaauuguaaa

SEQ ID NO: 2149269 - RNA, 16 nt, Human herpesvirus 7
uuuaaagggggaaaga

SEQ ID NO: 2149270 - RNA, 19 nt, Human herpesvirus 7
aucaaaauccuggauuuca

SEQ ID NO: 2149271 - RNA, 18 nt, Human herpesvirus 7
uacuacgguuuucagaaa

SEQ ID NO: 2149272 - RNA, 13 nt, Human herpesvirus 7
uaugcuaagaaag

SEQ ID NO: 2149273 - RNA, 19 nt, Human herpesvirus 7
uuacagauuuuauuaaaag

SEQ ID NO: 2149274 - RNA, 21 nt, Human herpesvirus 7
gaaaauauauuaaucuugaaa

SEQ ID NO: 2149275 - RNA, 18 nt, Human herpesvirus 7
auacauucucaaaaauga

SEQ ID NO: 2149276 - RNA, 18 nt, Human herpesvirus 7
cauguguacuaaagccaa

SEQ ID NO: 2149277 - RNA, 16 nt, Human herpesvirus 7
uucuauucaguuucuu

SEQ ID NO: 2149278 - RNA, 20 nt, Human herpesvirus 7
aaauucuuuaauaaaaaaca

SEQ ID NO: 2149279 - RNA, 16 nt, Human herpesvirus 7
auuguaauaauuuaaa

SEQ ID NO: 2149280 - RNA, 23 nt, Human herpesvirus 7
uuccaucaucacgucaugcugua

SEQ ID NO: 2149281 - RNA, 19 nt, Human herpesvirus 7
ucaggacaaucaaacaugu

SEQ ID NO: 2149282 - RNA, 12 nt, Human herpesvirus 7
uuucuguugacu

SEQ ID NO: 2149283 - RNA, 15 nt, Human herpesvirus 7
uucuucuguaaaaga

SEQ ID NO: 2149284 - RNA, 18 nt, Human herpesvirus 7
acuuucuugaagaaauug

SEQ ID NO: 2149285 - RNA, 19 nt, Human herpesvirus 7
aagccacgaugacuuccaa

SEQ ID NO: 2149286 - RNA, 17 nt, Human herpesvirus 7
agauuaaauagcaaagu

SEQ ID NO: 2149287 - RNA, 14 nt, Human herpesvirus 7
uguuaaauaaagag

SEQ ID NO: 2149288 - RNA, 19 nt, Human herpesvirus 7
ggcucuaacauuaaaacua

SEQ ID NO: 2149289 - RNA, 15 nt, Human herpesvirus 7
aucuuugaaaaucuu

SEQ ID NO: 2149290 - RNA, 17 nt, Human herpesvirus 7
aguaaagggaaaaacuu

SEQ ID NO: 2149291 - RNA, 19 nt, Human herpesvirus 7
ucgaaagauuuaaaguuuu

SEQ ID NO: 2149292 - RNA, 20 nt, Human herpesvirus 7
uaaaauguacaauuccugaa

SEQ ID NO: 2149293 - RNA, 21 nt, Human herpesvirus 7
ugauaaauacucaugaaggau

SEQ ID NO: 2149294 - RNA, 13 nt, Human herpesvirus 7
cugaaaaaauaaa

SEQ ID NO: 2149295 - RNA, 15 nt, Human herpesvirus 7
gaguacaugugucgu

SEQ ID NO: 2149296 - RNA, 15 nt, Human herpesvirus 7
uacuuggaaacaaau

SEQ ID NO: 2149297 - RNA, 17 nt, Human herpesvirus 7
gaaauauaugaauaucu

SEQ ID NO: 2149298 - RNA, 22 nt, Human herpesvirus 7
ucuuuaauccguaucuagagaa

SEQ ID NO: 2149299 - RNA, 15 nt, Human herpesvirus 7
aaaauaucuucugaa

SEQ ID NO: 2149300 - RNA, 11 nt, Human herpesvirus 7
gagguggaaaa

SEQ ID NO: 2149301 - RNA, 15 nt, Human herpesvirus 7
uccauucauuuccuc

SEQ ID NO: 2149302 - RNA, 16 nt, Human herpesvirus 7
gucaucccaauaccgu

SEQ ID NO: 2149303 - RNA, 15 nt, Human herpesvirus 7
ccaucacaaaacucu

SEQ ID NO: 2149304 - RNA, 11 nt, Human herpesvirus 7
caaaaaaccau

SEQ ID NO: 2149305 - RNA, 15 nt, Human herpesvirus 7
aucugucuucuuauu

SEQ ID NO: 2149306 - RNA, 22 nt, Human herpesvirus 7
ugaauaaucucaauuaaaacau

SEQ ID NO: 2149307 - RNA, 12 nt, Human herpesvirus 7
augcaaaacaaa

SEQ ID NO: 2149308 - RNA, 19 nt, Human herpesvirus 7
cagaauauuuccagcauca

SEQ ID NO: 2149309 - RNA, 14 nt, Human herpesvirus 7
aagaacuuacauuu

SEQ ID NO: 2149310 - RNA, 23 nt, Human herpesvirus 7
gauauaaaguuuauauuuucuau

SEQ ID NO: 2149311 - RNA, 19 nt, Human herpesvirus 7
acgucaugcggaagaacaa

SEQ ID NO: 2149312 - RNA, 20 nt, Human herpesvirus 7
aaauuuuucgaucuguaaaa

SEQ ID NO: 2149313 - RNA, 21 nt, Human herpesvirus 7
acuacuaaucaugaaaacagu

SEQ ID NO: 2149314 - RNA, 21 nt, Human herpesvirus 7
agaucauaauuacauugcagu

SEQ ID NO: 2149315 - RNA, 21 nt, Human herpesvirus 7
acuauuuaaguauuuuacaac

SEQ ID NO: 2149316 - RNA, 18 nt, Human herpesvirus 7
acaagguuuaaaacauuu

SEQ ID NO: 2149317 - RNA, 16 nt, Human herpesvirus 7
aagauugaagcacaca

SEQ ID NO: 2149318 - RNA, 14 nt, Human herpesvirus 7
cgacauaauuuuaa

SEQ ID NO: 2149319 - RNA, 21 nt, Human herpesvirus 7
acauuucacucauuagaaaca

SEQ ID NO: 2149320 - RNA, 14 nt, Human herpesvirus 7
aaauuaauguaauu

SEQ ID NO: 2149321 - RNA, 19 nt, Human herpesvirus 7
auguuccuuauauuaaaaa

SEQ ID NO: 2149322 - RNA, 15 nt, Human herpesvirus 7
ugguaauaauagugg

SEQ ID NO: 2149323 - RNA, 17 nt, Human herpesvirus 7
ucgaacccuggagagac

SEQ ID NO: 2149324 - RNA, 19 nt, Human herpesvirus 7
ugacagauuuaagugcaca

SEQ ID NO: 2149325 - RNA, 17 nt, Human herpesvirus 7
cuaaaugugcuaaauaa

SEQ ID NO: 2149326 - RNA, 16 nt, Human herpesvirus 7
aggaucuccuggaaag

SEQ ID NO: 2149327 - RNA, 17 nt, Human herpesvirus 7
ugugaaaauaacaggaa

SEQ ID NO: 2149328 - RNA, 16 nt, Human herpesvirus 7
accaguaugaaaucaa

SEQ ID NO: 2149329 - RNA, 23 nt, Human herpesvirus 7
auaaaggaucucucuuucuggag

SEQ ID NO: 2149330 - RNA, 18 nt, Human herpesvirus 7
uacuuauguguuacauga

SEQ ID NO: 2149331 - RNA, 16 nt, Human herpesvirus 7
uaaacucacuucuaaa

SEQ ID NO: 2149332 - RNA, 20 nt, Human herpesvirus 7
auaacaaagugcgaaacgug

SEQ ID NO: 2149333 - RNA, 12 nt, Human herpesvirus 7
agcaaaauaugc

SEQ ID NO: 2149334 - RNA, 22 nt, Human herpesvirus 7
agcacauguacagacagaaugc

SEQ ID NO: 2149335 - RNA, 17 nt, Human herpesvirus 7
agaacuuuuguaggaaa

SEQ ID NO: 2149336 - RNA, 16 nt, Human herpesvirus 7
auucaauaaaaagaua

SEQ ID NO: 2149337 - RNA, 16 nt, Human herpesvirus 7
uucaaaggaaaaauuu

SEQ ID NO: 2149338 - RNA, 19 nt, Human herpesvirus 7
ugcaacauaaccaaugcug

SEQ ID NO: 2149339 - RNA, 16 nt, Human herpesvirus 7
acacuuauuccagaua

SEQ ID NO: 2149340 - RNA, 24 nt, Human herpesvirus 7
uuaagaaaaguugcuuuucaugcu

SEQ ID NO: 2149341 - RNA, 14 nt, Human herpesvirus 7
cgaaugacagacac

SEQ ID NO: 2149342 - RNA, 14 nt, Human herpesvirus 7
uguuuguaaacauu

SEQ ID NO: 2149343 - RNA, 14 nt, Human herpesvirus 7
caaagaaaaaacua

SEQ ID NO: 2149344 - RNA, 17 nt, Human herpesvirus 7
auacguuaguugcagcu

SEQ ID NO: 2149345 - RNA, 14 nt, Human herpesvirus 7
ccaagcuuaaauaa

SEQ ID NO: 2149346 - RNA, 14 nt, Human herpesvirus 7
uugaaagaccaaau

SEQ ID NO: 2149347 - RNA, 20 nt, Human herpesvirus 7
agaauuccaggguaaagaua

SEQ ID NO: 2149348 - RNA, 13 nt, Human herpesvirus 7
agagcauauacaa

SEQ ID NO: 2149349 - RNA, 22 nt, Human herpesvirus 7
aaucagcauuuaccauuucgaa

SEQ ID NO: 2149350 - RNA, 20 nt, Human herpesvirus 7
gaaaaucuccuugauaagau

SEQ ID NO: 2149351 - RNA, 14 nt, Human herpesvirus 7
acagagaacaccau

SEQ ID NO: 2149352 - RNA, 16 nt, Human herpesvirus 7
auuuucuuacacuaug

SEQ ID NO: 2149353 - RNA, 15 nt, Human herpesvirus 7
aaauuaaauacaaau

SEQ ID NO: 2149354 - RNA, 12 nt, Human herpesvirus 7
ugcaucgaauuu

SEQ ID NO: 2149355 - RNA, 15 nt, Human herpesvirus 7
ucuaaaaaacaaaaa

SEQ ID NO: 2149356 - RNA, 19 nt, Human herpesvirus 7
ggagacgaugagcaugaaa

SEQ ID NO: 2149357 - RNA, 15 nt, Human herpesvirus 7
uacacuuuuguccug

SEQ ID NO: 2149358 - RNA, 18 nt, Human herpesvirus 7
aaccacagacacaccauu

SEQ ID NO: 2149359 - RNA, 17 nt, Human herpesvirus 7
uuauaugaaauuucaaa

SEQ ID NO: 2149360 - RNA, 17 nt, Human herpesvirus 7
caauaaaucuguaaaau

SEQ ID NO: 2149361 - RNA, 22 nt, Human herpesvirus 7
uaaaacuuugauuugagaaauu

SEQ ID NO: 2149362 - RNA, 12 nt, Human herpesvirus 7
caacugugcaug

SEQ ID NO: 2149363 - RNA, 15 nt, Human herpesvirus 7
agcuuucuuuaccga

SEQ ID NO: 2149364 - RNA, 14 nt, Human herpesvirus 7
augugaaaaugaug

SEQ ID NO: 2149365 - RNA, 14 nt, Human herpesvirus 7
guaaagauaauguu

SEQ ID NO: 2149366 - RNA, 22 nt, Human herpesvirus 7
ccauguauugucuuacagcacu

SEQ ID NO: 2149367 - RNA, 21 nt, Human herpesvirus 7
cugcuggaaagcuugugaaga

SEQ ID NO: 2149368 - RNA, 19 nt, Human herpesvirus 7
gcucugucuccaaaucaaa

SEQ ID NO: 2149369 - RNA, 19 nt, Human herpesvirus 7
acuuauuauaucuuaauaa

SEQ ID NO: 2149370 - RNA, 23 nt, Human herpesvirus 7
uuacuauuugacuggguaggaaa

SEQ ID NO: 2149371 - RNA, 15 nt, Human herpesvirus 7
gcaaaagccacugau

SEQ ID NO: 2149372 - RNA, 13 nt, Human herpesvirus 7
agacauugaagau

SEQ ID NO: 2149373 - RNA, 15 nt, Human herpesvirus 7
uuuaaaaaaucugaa

SEQ ID NO: 2149374 - RNA, 17 nt, Human herpesvirus 7
aaugaguguaauugguu

SEQ ID NO: 2149375 - RNA, 17 nt, Human herpesvirus 7
uuuucaaguuucuucug

SEQ ID NO: 2149376 - RNA, 15 nt, Human herpesvirus 7
uaaguaaauuuacuu

SEQ ID NO: 2149377 - RNA, 19 nt, Human herpesvirus 7
cacagggacguuucuagca

SEQ ID NO: 2149378 - RNA, 13 nt, Human herpesvirus 7
gccaaugauuuuu

SEQ ID NO: 2149379 - RNA, 12 nt, Human herpesvirus 7
acaacucaauaa

SEQ ID NO: 2149380 - RNA, 10 nt, Human herpesvirus 7
gcaacuuuuc

SEQ ID NO: 2149381 - RNA, 23 nt, Human herpesvirus 7
aaaauuuccuacaaaaguucugu

SEQ ID NO: 2149382 - RNA, 22 nt, Human herpesvirus 7
agccucuaagagcuuuugcaaa

SEQ ID NO: 2149383 - RNA, 16 nt, Human herpesvirus 7
agucaagaacugugaa

SEQ ID NO: 2149384 - RNA, 13 nt, Human herpesvirus 7
aaaagaaaaucuc

SEQ ID NO: 2149385 - RNA, 17 nt, Human herpesvirus 7
aucucauagcuuaaaaa

SEQ ID NO: 2149386 - RNA, 14 nt, Human herpesvirus 7
cuuuauaugucaaa

SEQ ID NO: 2149387 - RNA, 16 nt, Human herpesvirus 7
uccauugauuaaaaac

SEQ ID NO: 2149388 - RNA, 23 nt, Human herpesvirus 7
acgucuuacuuggaaacaaauug

SEQ ID NO: 2149389 - RNA, 21 nt, Human herpesvirus 7
gaaacaucuuuauauguguuc

SEQ ID NO: 2149390 - RNA, 18 nt, Human herpesvirus 7
aaacuguuuguaaggcca

SEQ ID NO: 2149391 - RNA, 13 nt, Human herpesvirus 7
aauaauuuaaaau

SEQ ID NO: 2149392 - RNA, 23 nt, Human herpesvirus 7
uauaauaaaggaaagacaaacua

SEQ ID NO: 2149393 - RNA, 22 nt, Human herpesvirus 7
aaacaccccuugcagaaacugg

SEQ ID NO: 2149394 - RNA, 20 nt, Human herpesvirus 7
cuguuagaggauuaaaacaa

SEQ ID NO: 2149395 - RNA, 15 nt, Human herpesvirus 7
cuuacauuugauuuu

SEQ ID NO: 2149396 - RNA, 14 nt, Human herpesvirus 7
gcaugucucauaau

SEQ ID NO: 2149397 - RNA, 15 nt, Human herpesvirus 7
ugcauauuugaacau

SEQ ID NO: 2149398 - RNA, 22 nt, Human herpesvirus 7
aaauucuggcucuuuacaaaau

SEQ ID NO: 2149399 - RNA, 21 nt, Human herpesvirus 7
uucgagaaaauuuagcaccaa

SEQ ID NO: 2149400 - RNA, 13 nt, Human herpesvirus 7
uugggaaacaucu

SEQ ID NO: 2149401 - RNA, 16 nt, Human herpesvirus 7
uuaaagauguuucuuu

SEQ ID NO: 2149402 - RNA, 16 nt, Human herpesvirus 7
uaaguagguaagaaaa

SEQ ID NO: 2149403 - RNA, 14 nt, Human herpesvirus 7
acuaaaaaaaauua

SEQ ID NO: 2149404 - RNA, 21 nt, Human herpesvirus 7
uuuagcuaauucauuguauga

SEQ ID NO: 2149405 - RNA, 14 nt, Human herpesvirus 7
gcaacaaauguuua

SEQ ID NO: 2149406 - RNA, 16 nt, Human herpesvirus 7
cuugcuagcugugaua

SEQ ID NO: 2149407 - RNA, 17 nt, Human herpesvirus 7
auuucaaaggaagacau

SEQ ID NO: 2149408 - RNA, 17 nt, Human herpesvirus 7
uuaguuccacgucaauc

SEQ ID NO: 2149409 - RNA, 18 nt, Human herpesvirus 7
agcgcaaaggaaaaaugc

SEQ ID NO: 2149410 - RNA, 12 nt, Human herpesvirus 7
uuucauuuaauu

SEQ ID NO: 2149411 - RNA, 22 nt, Human herpesvirus 7
auauaaacacuugcuagcugug

SEQ ID NO: 2149412 - RNA, 16 nt, Human herpesvirus 7
uuuaagugauacugaa

SEQ ID NO: 2149413 - RNA, 17 nt, Human herpesvirus 7
cacugggagcaaugcau

SEQ ID NO: 2149414 - RNA, 23 nt, Human herpesvirus 7
auggcauuacuacaguggaugcu

SEQ ID NO: 2149415 - RNA, 22 nt, Human herpesvirus 7
uauuuugauuggaaaucaaaau

SEQ ID NO: 2149416 - RNA, 19 nt, Human herpesvirus 7
uuagaacaauuaucucaga

SEQ ID NO: 2149417 - RNA, 19 nt, Human herpesvirus 7
gucuaaccccgcucuuuua

SEQ ID NO: 2149418 - RNA, 15 nt, Human herpesvirus 7
agaaaaucuaccaau

SEQ ID NO: 2149419 - RNA, 14 nt, Human herpesvirus 7
cucuguaaaacguu

SEQ ID NO: 2149420 - RNA, 13 nt, Human herpesvirus 7
uucaacaucuuuc

SEQ ID NO: 2149421 - RNA, 13 nt, Human herpesvirus 7
gccauucuuuuca

SEQ ID NO: 2149422 - RNA, 15 nt, Human herpesvirus 7
aaugucagaguuuaa

SEQ ID NO: 2149423 - RNA, 14 nt, Human herpesvirus 7
agggauuucuucuu

SEQ ID NO: 2149424 - RNA, 21 nt, Human herpesvirus 7
aagcaacuuuucuuaaacaug

SEQ ID NO: 2149425 - RNA, 23 nt, Human herpesvirus 7
uuaacaacagccaaaugugguaa

SEQ ID NO: 2149426 - RNA, 23 nt, Human herpesvirus 7
ggaugcacugauaaucaagaaac

SEQ ID NO: 2149427 - RNA, 14 nt, Human herpesvirus 7
uaauaucaauuuga

SEQ ID NO: 2149428 - RNA, 23 nt, Human herpesvirus 7
ucagacaauuucacacaaugccu

SEQ ID NO: 2149429 - RNA, 20 nt, Human herpesvirus 7
ugcaacuuugugccugaaau

SEQ ID NO: 2149430 - RNA, 17 nt, Human herpesvirus 7
agaaucacauuuuugcu

SEQ ID NO: 2149431 - RNA, 15 nt, Human herpesvirus 7
gcacacuaaaaaaga

SEQ ID NO: 2149432 - RNA, 14 nt, Human herpesvirus 7
aagaauuuggauuu

SEQ ID NO: 2149433 - RNA, 23 nt, Human herpesvirus 7
acgaauauucuaggcuugcauuc

SEQ ID NO: 2149434 - RNA, 12 nt, Human herpesvirus 7
ggcgccaaaaaa

SEQ ID NO: 2149435 - RNA, 12 nt, Human herpesvirus 7
ugguugugcaau

SEQ ID NO: 2149436 - RNA, 21 nt, Human herpesvirus 7
uuuaaucaauggacguuuauu

SEQ ID NO: 2149437 - RNA, 20 nt, Human herpesvirus 7
agauuauucaaaagcuaaaa

SEQ ID NO: 2149438 - RNA, 19 nt, Human herpesvirus 7
aaauuaaguuuuucaugua

SEQ ID NO: 2149439 - RNA, 17 nt, Human herpesvirus 7
ucuuggaguuugucuca

SEQ ID NO: 2149440 - RNA, 12 nt, Human herpesvirus 7
auuuuguuuugc

SEQ ID NO: 2149441 - RNA, 13 nt, Human herpesvirus 7
ucugaauaaaagu

SEQ ID NO: 2149442 - RNA, 17 nt, Human herpesvirus 7
aacaaucuuacaaaaag

SEQ ID NO: 2149443 - RNA, 14 nt, Human herpesvirus 7
caaggggcauuuuu

SEQ ID NO: 2149444 - RNA, 20 nt, Human herpesvirus 7
uuuaagauacauuuuugcaa

SEQ ID NO: 2149445 - RNA, 16 nt, Human herpesvirus 7
cuugcuuugcauagau

SEQ ID NO: 2149446 - RNA, 17 nt, Human herpesvirus 7
gauauucuaacaaauac

SEQ ID NO: 2149447 - RNA, 12 nt, Human herpesvirus 7
auuaaguguuug

SEQ ID NO: 2149448 - RNA, 18 nt, Human herpesvirus 7
uacaaaaguucuguuuug

SEQ ID NO: 2149449 - RNA, 15 nt, Human herpesvirus 7
gauuuacauuucauu

SEQ ID NO: 2149450 - RNA, 21 nt, Human herpesvirus 7
uaugacgaagcuaaacuuuua

SEQ ID NO: 2149451 - RNA, 15 nt, Human herpesvirus 7
agagaugaucuuacu

SEQ ID NO: 2149452 - RNA, 12 nt, Human herpesvirus 7
guugaaauuaag

SEQ ID NO: 2149453 - RNA, 20 nt, Human herpesvirus 7
ugaaggugucuauuaaaugc

SEQ ID NO: 2149454 - RNA, 10 nt, Human herpesvirus 7
ggugaagauc

SEQ ID NO: 2149455 - RNA, 16 nt, Human herpesvirus 7
cagagaacuagaacag

SEQ ID NO: 2149456 - RNA, 15 nt, Human herpesvirus 7
agccagguauucaaa

SEQ ID NO: 2149457 - RNA, 15 nt, Human herpesvirus 7
gaaagacaaacuaug

SEQ ID NO: 2149458 - RNA, 22 nt, Human herpesvirus 7
gaacuguuuuaauguauuuuuc

SEQ ID NO: 2149459 - RNA, 22 nt, Human herpesvirus 7
uugugacccugucacacuuauu

SEQ ID NO: 2149460 - RNA, 20 nt, Human herpesvirus 7
cugauaaucaagaaacaugu

SEQ ID NO: 2149461 - RNA, 20 nt, Human herpesvirus 7
ugaaaaucuugaauaaauuu

SEQ ID NO: 2149462 - RNA, 13 nt, Human herpesvirus 7
ugauccuccuugc

SEQ ID NO: 2149463 - RNA, 20 nt, Human herpesvirus 7
gaaacucaucauugaagaaa

SEQ ID NO: 2149464 - RNA, 15 nt, Human herpesvirus 7
uugaaauucugugga

SEQ ID NO: 2149465 - RNA, 16 nt, Human herpesvirus 7
caagauagcagaauau

SEQ ID NO: 2149466 - RNA, 14 nt, Human herpesvirus 7
aaaugaugauguau

SEQ ID NO: 2149467 - RNA, 15 nt, Human herpesvirus 7
uaggggaagaaucaa

SEQ ID NO: 2149468 - RNA, 22 nt, Human herpesvirus 7
aaguuuuguaacuauaaaugga

SEQ ID NO: 2149469 - RNA, 22 nt, Human herpesvirus 7
cuuuugcgggaaaaaacgucua

SEQ ID NO: 2149470 - RNA, 21 nt, Human herpesvirus 7
uaggcaagaaggccacgcugu

SEQ ID NO: 2149471 - RNA, 18 nt, Human herpesvirus 7
aaauuuuggauuguguaa

SEQ ID NO: 2149472 - RNA, 14 nt, Human herpesvirus 7
ucagaacuguuuua

SEQ ID NO: 2149473 - RNA, 15 nt, Human herpesvirus 7
cugacauuguacaau

SEQ ID NO: 2149474 - RNA, 15 nt, Human herpesvirus 7
auuaaacgaacucuu

SEQ ID NO: 2149475 - RNA, 19 nt, Human herpesvirus 7
gucugaaggcugcuuuuuc

SEQ ID NO: 2149476 - RNA, 19 nt, Human herpesvirus 7
uuucaagaaggaaaauuuc

SEQ ID NO: 2149477 - RNA, 18 nt, Human herpesvirus 7
aaauguaauuuaaauaau

SEQ ID NO: 2149478 - RNA, 17 nt, Human herpesvirus 7
caauagaaaacauuaua

SEQ ID NO: 2149479 - RNA, 15 nt, Human herpesvirus 7
gaaauggcucuaguu

SEQ ID NO: 2149480 - RNA, 18 nt, Human herpesvirus 7
aucuaccgcgaugaaaac

SEQ ID NO: 2149481 - RNA, 14 nt, Human herpesvirus 7
aaauaugaauugau

SEQ ID NO: 2149482 - RNA, 16 nt, Human herpesvirus 7
aaaucaaaacauuuca

SEQ ID NO: 2149483 - RNA, 14 nt, Human herpesvirus 7
auauaaacaaaauu

SEQ ID NO: 2149484 - RNA, 14 nt, Human herpesvirus 7
aaaauacuaaucaa

SEQ ID NO: 2149485 - RNA, 21 nt, Human herpesvirus 7
caaauagaguuuaauuguacu

SEQ ID NO: 2149486 - RNA, 12 nt, Human herpesvirus 7
uucuuugucugc

SEQ ID NO: 2149487 - RNA, 18 nt, Human herpesvirus 7
uggaaagaagaagauuuu

SEQ ID NO: 2149488 - RNA, 13 nt, Human herpesvirus 7
gagauuccaaaga

SEQ ID NO: 2149489 - RNA, 14 nt, Human herpesvirus 7
caucaggaaucuuu

SEQ ID NO: 2149490 - RNA, 19 nt, Human herpesvirus 7
aagacaccccaaaaucaaa

SEQ ID NO: 2149491 - RNA, 15 nt, Human herpesvirus 7
gucuuacuuggaaac

SEQ ID NO: 2149492 - RNA, 17 nt, Human herpesvirus 7
aaaauguaaaauucgcu

SEQ ID NO: 2149493 - RNA, 16 nt, Human herpesvirus 7
auuauaacuuguaauu

SEQ ID NO: 2149494 - RNA, 16 nt, Human herpesvirus 7
caacgguauacauuaa

SEQ ID NO: 2149495 - RNA, 10 nt, Human herpesvirus 7
ugucauacaa

SEQ ID NO: 2149496 - RNA, 17 nt, Human herpesvirus 7
aagaacuuacauuucaa

SEQ ID NO: 2149497 - RNA, 21 nt, Human herpesvirus 7
ugccacguuuuuuucuucaau

SEQ ID NO: 2149498 - RNA, 12 nt, Human herpesvirus 7
gaacauaaaaaa

SEQ ID NO: 2149499 - RNA, 20 nt, Human herpesvirus 7
uuucucgcguuucuucaaag

SEQ ID NO: 2149500 - RNA, 18 nt, Human herpesvirus 7
agugaaugauuuugacau

SEQ ID NO: 2149501 - RNA, 22 nt, Human herpesvirus 7
auuuuacauauuaguuuaacuu

SEQ ID NO: 2149502 - RNA, 21 nt, Human herpesvirus 7
cauguuucaagaauggcugau

SEQ ID NO: 2149503 - RNA, 23 nt, Human herpesvirus 7
accauuucugaaaccuucgcaac

SEQ ID NO: 2149504 - RNA, 18 nt, Human herpesvirus 7
agauucuccagaaauuau

SEQ ID NO: 2149505 - RNA, 19 nt, Human herpesvirus 7
auaugcuggaucuucugcu

SEQ ID NO: 2149506 - RNA, 18 nt, Human herpesvirus 7
uggaaaaauaaacaauau

SEQ ID NO: 2149507 - RNA, 21 nt, Human herpesvirus 7
uuuauuauuuguuuguucugu

SEQ ID NO: 2149508 - RNA, 21 nt, Human herpesvirus 7
agaacaucuugagaaauauga

SEQ ID NO: 2149509 - RNA, 15 nt, Human herpesvirus 7
gugaaacaauguuua

SEQ ID NO: 2149510 - RNA, 12 nt, Human herpesvirus 7
aaauccuggauu

SEQ ID NO: 2149511 - RNA, 21 nt, Human herpesvirus 7
guucuaaaaaacaaaaaagug

SEQ ID NO: 2149512 - RNA, 15 nt, Human herpesvirus 7
ugucuaagguuuuua

SEQ ID NO: 2149513 - RNA, 22 nt, Human herpesvirus 7
uuuccaauagcacuacuagaaa

SEQ ID NO: 2149514 - RNA, 18 nt, Human herpesvirus 7
uucauuuauauuaauuug

SEQ ID NO: 2149515 - RNA, 15 nt, Human herpesvirus 7
gaauuguacguucug

SEQ ID NO: 2149516 - RNA, 18 nt, Human herpesvirus 7
ucuuaaaauauguucaga

SEQ ID NO: 2149517 - RNA, 21 nt, Human herpesvirus 7
uggauaaccaaacuauauuga

SEQ ID NO: 2149518 - RNA, 17 nt, Human herpesvirus 7
acuuacuguuuacacau

SEQ ID NO: 2149519 - RNA, 12 nt, Human herpesvirus 7
caauuuaucaau

SEQ ID NO: 2149520 - RNA, 18 nt, Human herpesvirus 7
cugcaaagaaaaaaaugc

SEQ ID NO: 2149521 - RNA, 17 nt, Human herpesvirus 7
cuucaacuucucuugga

SEQ ID NO: 2149522 - RNA, 13 nt, Human herpesvirus 7
ugcaugaaaucuu

SEQ ID NO: 2149523 - RNA, 18 nt, Human herpesvirus 7
uuaaguauuuuacaacaa

SEQ ID NO: 2149524 - RNA, 20 nt, Human herpesvirus 7
uauccacgcgggguuaaaaa

SEQ ID NO: 2149525 - RNA, 16 nt, Human herpesvirus 7
acuuauuauaucuuaa

SEQ ID NO: 2149526 - RNA, 13 nt, Human herpesvirus 7
gugcaucacgaaa

SEQ ID NO: 2149527 - RNA, 22 nt, Human herpesvirus 7
aauagguaucuuuacuuucaua

SEQ ID NO: 2149528 - RNA, 13 nt, Human herpesvirus 7
acuuguugaaaua

SEQ ID NO: 2149529 - RNA, 17 nt, Human herpesvirus 7
gcaaauccuauaaaagc

SEQ ID NO: 2149530 - RNA, 18 nt, Human herpesvirus 7
ucugccucugccucuugg

SEQ ID NO: 2149531 - RNA, 16 nt, Human herpesvirus 7
uguuuaagacauuauu

SEQ ID NO: 2149532 - RNA, 23 nt, Human herpesvirus 7
auaaauacgcguggaaguguuaa

SEQ ID NO: 2149533 - RNA, 21 nt, Human herpesvirus 7
acgucuugcuguuugucaucg

SEQ ID NO: 2149534 - RNA, 16 nt, Human herpesvirus 7
uguugccuucuaaaac

SEQ ID NO: 2149535 - RNA, 18 nt, Human herpesvirus 7
aauuaauguaauuuauga

SEQ ID NO: 2149536 - RNA, 20 nt, Human herpesvirus 7
acaggcugcaucuuuucagu

SEQ ID NO: 2149537 - RNA, 23 nt, Human herpesvirus 7
uuuacaaagaacauguaguacaa

SEQ ID NO: 2149538 - RNA, 22 nt, Human herpesvirus 7
auuagaaacaaucccagaaauu

SEQ ID NO: 2149539 - RNA, 22 nt, Human herpesvirus 7
auauauggcaauaaaucuguaa

SEQ ID NO: 2149540 - RNA, 18 nt, Human herpesvirus 7
augccagaaauuaaauac

SEQ ID NO: 2149541 - RNA, 16 nt, Human herpesvirus 7
uuuacuugaucuaauu

SEQ ID NO: 2149542 - RNA, 15 nt, Human herpesvirus 7
uaucaugauuauaua

SEQ ID NO: 2149543 - RNA, 23 nt, Human herpesvirus 7
uuaaugcuuugucuuacgucuuu

SEQ ID NO: 2149544 - RNA, 18 nt, Human herpesvirus 7
augaauuaauaaaacaaa

SEQ ID NO: 2149545 - RNA, 18 nt, Human herpesvirus 7
ucuauuaaauauuuagag

SEQ ID NO: 2149546 - RNA, 17 nt, Human herpesvirus 7
uuaucuggagaacaauu

SEQ ID NO: 2149547 - RNA, 19 nt, Human herpesvirus 7
aagaauuuggauagauaca

SEQ ID NO: 2149548 - RNA, 19 nt, Human herpesvirus 7
ucaaaaucuguagaaaaug

SEQ ID NO: 2149549 - RNA, 20 nt, Human herpesvirus 7
gaauucaacaccagucucug

SEQ ID NO: 2149550 - RNA, 14 nt, Human herpesvirus 7
augagauuucugaa

SEQ ID NO: 2149551 - RNA, 22 nt, Human herpesvirus 7
cugaaagcgcaaaggaaaaaug

SEQ ID NO: 2149552 - RNA, 14 nt, Human herpesvirus 7
uuguucaaacucaa

SEQ ID NO: 2149553 - RNA, 16 nt, Human herpesvirus 7
uuaauagucauuuuca

SEQ ID NO: 2149554 - RNA, 21 nt, Human herpesvirus 7
auucauuuccucccaaaaauu

SEQ ID NO: 2149555 - RNA, 20 nt, Human herpesvirus 7
cuuugaaucuauuaaagaca

SEQ ID NO: 2149556 - RNA, 18 nt, Human herpesvirus 7
caacuuugugccugaaau

SEQ ID NO: 2149557 - RNA, 19 nt, Human herpesvirus 7
uguacaauuacaaaaugua

SEQ ID NO: 2149558 - RNA, 13 nt, Human herpesvirus 7
auaaccaaugcug

SEQ ID NO: 2149559 - RNA, 13 nt, Human herpesvirus 7
uugcauacaguuu

SEQ ID NO: 2149560 - RNA, 17 nt, Human herpesvirus 7
uaaaccaaauauaugcu

SEQ ID NO: 2149561 - RNA, 13 nt, Human herpesvirus 7
guaacagauuuua

SEQ ID NO: 2149562 - RNA, 22 nt, Human herpesvirus 7
gauuucauguuuuaugacucag

SEQ ID NO: 2149563 - RNA, 20 nt, Human herpesvirus 7
aggaaaccaauuaauauuaa

SEQ ID NO: 2149564 - RNA, 15 nt, Human herpesvirus 7
gcagguaaguauaaa

SEQ ID NO: 2149565 - RNA, 14 nt, Human herpesvirus 7
aguacaaauguuuu

SEQ ID NO: 2149566 - RNA, 13 nt, Human herpesvirus 7
uuuauugccuugu

SEQ ID NO: 2149567 - RNA, 19 nt, Human herpesvirus 7
ugaaaaaaauuauguguau

SEQ ID NO: 2149568 - RNA, 15 nt, Human herpesvirus 7
aaagccgcugccuuc

SEQ ID NO: 2149569 - RNA, 12 nt, Human herpesvirus 7
auggaagaacaa

SEQ ID NO: 2149570 - RNA, 11 nt, Human herpesvirus 7
aggaauugcug

SEQ ID NO: 2149571 - RNA, 15 nt, Human herpesvirus 7
agaaauguuacuuaa

SEQ ID NO: 2149572 - RNA, 13 nt, Human herpesvirus 7
gcuuaaaaacagu

SEQ ID NO: 2149573 - RNA, 20 nt, Human herpesvirus 7
agugaacaugacuucagaaa

SEQ ID NO: 2149574 - RNA, 22 nt, Human herpesvirus 7
caaguagugcuaauauuccuuu

SEQ ID NO: 2149575 - RNA, 23 nt, Human herpesvirus 7
uucauccaaaaagaaacuuucua

SEQ ID NO: 2149576 - RNA, 23 nt, Human herpesvirus 7
aagcgagauuuauuuuuaaaaau

SEQ ID NO: 2149577 - RNA, 16 nt, Human herpesvirus 7
aggugacagagggcau

SEQ ID NO: 2149578 - RNA, 17 nt, Human herpesvirus 7
ggagaaggaaaauuaua

SEQ ID NO: 2149579 - RNA, 19 nt, Human herpesvirus 7
cguuggggauguucuauuc

SEQ ID NO: 2149580 - RNA, 16 nt, Human herpesvirus 7
agcacauguacagaca

SEQ ID NO: 2149581 - RNA, 17 nt, Human herpesvirus 7
gaaauaaauucaaggaa

SEQ ID NO: 2149582 - RNA, 12 nt, Human herpesvirus 7
caauacaugaau

SEQ ID NO: 2149583 - RNA, 19 nt, Human herpesvirus 7
aggggucgcauauugcaau

SEQ ID NO: 2149584 - RNA, 16 nt, Human herpesvirus 7
uuuaacgauuccaaac

SEQ ID NO: 2149585 - RNA, 16 nt, Human herpesvirus 7
cuaaaauugacagcac

SEQ ID NO: 2149586 - RNA, 21 nt, Human herpesvirus 7
ucuauuucaauuaaugcauug

SEQ ID NO: 2149587 - RNA, 20 nt, Human herpesvirus 7
auaaaggaaagacaaacuau

SEQ ID NO: 2149588 - RNA, 17 nt, Human herpesvirus 7
aauacugagagaauaag

SEQ ID NO: 2149589 - RNA, 21 nt, Human herpesvirus 7
aaauuauuauuaguauuguaa

SEQ ID NO: 2149590 - RNA, 17 nt, Human herpesvirus 7
uucuugauguaacaaag

SEQ ID NO: 2149591 - RNA, 21 nt, Human herpesvirus 7
gcauugcuuuuagaaaaucaa

SEQ ID NO: 2149592 - RNA, 22 nt, Human herpesvirus 7
uagauuuuuugaaaaagauuua

SEQ ID NO: 2149593 - RNA, 20 nt, Human herpesvirus 7
ggggucugacuucaauuuug

SEQ ID NO: 2149594 - RNA, 22 nt, Human herpesvirus 7
caaucaacaaaaugacaaaaag

SEQ ID NO: 2149595 - RNA, 13 nt, Human herpesvirus 7
gauuccaaagagc

SEQ ID NO: 2149596 - RNA, 17 nt, Human herpesvirus 7
uacauggacauaagaau

SEQ ID NO: 2149597 - RNA, 18 nt, Human herpesvirus 7
agauucggcugaguaaaa

SEQ ID NO: 2149598 - RNA, 23 nt, Human herpesvirus 7
gacguuaucuaauauuauaucua

SEQ ID NO: 2149599 - RNA, 13 nt, Human herpesvirus 7
ugguaaugucaua

SEQ ID NO: 2149600 - RNA, 14 nt, Human herpesvirus 7
uacaauuccugaaa

SEQ ID NO: 2149601 - RNA, 20 nt, Human herpesvirus 7
uuuacaguuuuuuaauacaa

SEQ ID NO: 2149602 - RNA, 20 nt, Human herpesvirus 7
agugcgcggauuaagagaaa

SEQ ID NO: 2149603 - RNA, 21 nt, Human herpesvirus 7
uagaacaaguagaaaaugcug

SEQ ID NO: 2149604 - RNA, 14 nt, Human herpesvirus 7
auugucuacaauuu

SEQ ID NO: 2149605 - RNA, 22 nt, Human herpesvirus 7
cagaguuuaaaguaaaauuaau

SEQ ID NO: 2149606 - RNA, 16 nt, Human herpesvirus 7
ucuguggagugagaaa

SEQ ID NO: 2149607 - RNA, 14 nt, Human herpesvirus 7
cggagguuugcuau

SEQ ID NO: 2149608 - RNA, 13 nt, Human herpesvirus 7
acauguuuguaaa

SEQ ID NO: 2149609 - RNA, 22 nt, Human herpesvirus 7
caauugcccuuguguugucaua

SEQ ID NO: 2149610 - RNA, 23 nt, Human herpesvirus 7
gucuguugaaacauagcuagaaa

SEQ ID NO: 2149611 - RNA, 18 nt, Human herpesvirus 7
auaacuucguaguguaga

SEQ ID NO: 2149612 - RNA, 23 nt, Human herpesvirus 7
ucguuuuuauuuuuuucugaaau

SEQ ID NO: 2149613 - RNA, 13 nt, Human herpesvirus 7
acaucuaugugcu

SEQ ID NO: 2149614 - RNA, 14 nt, Human herpesvirus 7
auacuuguugagcu

SEQ ID NO: 2149615 - RNA, 20 nt, Human herpesvirus 7
uuaauggaggauucggaagu

SEQ ID NO: 2149616 - RNA, 20 nt, Human herpesvirus 7
cuaugauugcaguaaauuug

SEQ ID NO: 2149617 - RNA, 12 nt, Human herpesvirus 7
gaaacaaauugu

SEQ ID NO: 2149618 - RNA, 13 nt, Human herpesvirus 7
uuacauugcaguc

SEQ ID NO: 2149619 - RNA, 17 nt, Human herpesvirus 7
acauauagauaaugaag

SEQ ID NO: 2149620 - RNA, 17 nt, Human herpesvirus 7
cugacuucaauuuugaa

SEQ ID NO: 2149621 - RNA, 15 nt, Human herpesvirus 7
gccgccaaacuaugu

SEQ ID NO: 2149622 - RNA, 16 nt, Human herpesvirus 7
ugaaucaaauuucaaa

SEQ ID NO: 2149623 - RNA, 21 nt, Human herpesvirus 7
gaacuguuacaacuuugccaa

SEQ ID NO: 2149624 - RNA, 19 nt, Human herpesvirus 7
gcauuuuguauuaaaggaa

SEQ ID NO: 2149625 - RNA, 23 nt, Human herpesvirus 7
ugucagaguuuaaaguaaaauua

SEQ ID NO: 2149626 - RNA, 15 nt, Human herpesvirus 7
uccacucuccugaaa

SEQ ID NO: 2149627 - RNA, 23 nt, Human herpesvirus 7
auaaagaguguuuucaaauaucu

SEQ ID NO: 2149628 - RNA, 18 nt, Human herpesvirus 7
cuuuacuuucauagcuua

SEQ ID NO: 2149629 - RNA, 21 nt, Human herpesvirus 7
aauugguuuucgguguguaaa

SEQ ID NO: 2149630 - RNA, 13 nt, Human herpesvirus 7
gauuauucaaaag

SEQ ID NO: 2149631 - RNA, 19 nt, Human herpesvirus 7
aaggaucauaguaaacacg

SEQ ID NO: 2149632 - RNA, 22 nt, Human herpesvirus 7
aucugcaaagaaaaaaaugcuu

SEQ ID NO: 2149633 - RNA, 15 nt, Human herpesvirus 7
guauacaacuuuaug

SEQ ID NO: 2149634 - RNA, 15 nt, Human herpesvirus 7
auugcuucagaaaua

SEQ ID NO: 2149635 - RNA, 15 nt, Human herpesvirus 7
ugcugucuauuucaa

SEQ ID NO: 2149636 - RNA, 13 nt, Human herpesvirus 7
caagaaacauguu

SEQ ID NO: 2149637 - RNA, 18 nt, Human herpesvirus 7
agauuauacaaauccaag

SEQ ID NO: 2149638 - RNA, 16 nt, Human herpesvirus 7
agcaauacacccaguc

SEQ ID NO: 2149639 - RNA, 22 nt, Human herpesvirus 7
aaucauaauucaaucugcaaaa

SEQ ID NO: 2149640 - RNA, 14 nt, Human herpesvirus 7
uagaaaccaaguuu

SEQ ID NO: 2149641 - RNA, 13 nt, Human herpesvirus 7
aaacaaacaauga

SEQ ID NO: 2149642 - RNA, 15 nt, Human herpesvirus 7
aaauugaaauauuua

SEQ ID NO: 2149643 - RNA, 17 nt, Human herpesvirus 7
acuuaaauauuuuacau

SEQ ID NO: 2149644 - RNA, 18 nt, Human herpesvirus 7
aaaucagaaauguuacuu

SEQ ID NO: 2149645 - RNA, 22 nt, Human herpesvirus 7
caaacguaaugcaaaauagauu

SEQ ID NO: 2149646 - RNA, 19 nt, Human herpesvirus 7
cucauggccagugaaugau

SEQ ID NO: 2149647 - RNA, 21 nt, Human herpesvirus 7
cagaacaucccuggacagaga

SEQ ID NO: 2149648 - RNA, 19 nt, Human herpesvirus 7
auuguacaauuacaaaaug

SEQ ID NO: 2149649 - RNA, 14 nt, Human herpesvirus 7
aaacauguaaucaa

SEQ ID NO: 2149650 - RNA, 18 nt, Human herpesvirus 7
aucaagccacgaugacuu

SEQ ID NO: 2149651 - RNA, 22 nt, Human herpesvirus 7
uguauaugcucuagaaaaucua

SEQ ID NO: 2149652 - RNA, 13 nt, Human herpesvirus 7
gaucauuugcaug

SEQ ID NO: 2149653 - RNA, 12 nt, Human herpesvirus 7
uaugacucagac

SEQ ID NO: 2149654 - RNA, 21 nt, Human herpesvirus 7
aaccuacuguuaagaauucca

SEQ ID NO: 2149655 - RNA, 18 nt, Human herpesvirus 7
cuucucuauaccgcuucu

SEQ ID NO: 2149656 - RNA, 20 nt, Human herpesvirus 7
acgcucucaaucaaaaucuu

SEQ ID NO: 2149657 - RNA, 21 nt, Human herpesvirus 7
aacauuccaacagcuucagau

SEQ ID NO: 2149658 - RNA, 19 nt, Human herpesvirus 7
uaccgauucuaaauuaaaa

SEQ ID NO: 2149659 - RNA, 18 nt, Human herpesvirus 7
uuuaacuuuuuuuuucuu

SEQ ID NO: 2149660 - RNA, 16 nt, Human herpesvirus 7
gccagguauucaaaca

SEQ ID NO: 2149661 - RNA, 19 nt, Human herpesvirus 7
gauuauguuuucugcuaau

SEQ ID NO: 2149662 - RNA, 19 nt, Human herpesvirus 7
acaagggcaauuguuugau

SEQ ID NO: 2149663 - RNA, 15 nt, Human herpesvirus 7
auacauuauaaaugu

SEQ ID NO: 2149664 - RNA, 13 nt, Human herpesvirus 7
aagcacaaaucaa

SEQ ID NO: 2149665 - RNA, 16 nt, Human herpesvirus 7
uauaugaugacaacaa

SEQ ID NO: 2149666 - RNA, 20 nt, Human herpesvirus 7
cuguuaagaauuccagauuu

SEQ ID NO: 2149667 - RNA, 12 nt, Human herpesvirus 7
aaaaaaaaaaca

SEQ ID NO: 2149668 - RNA, 12 nt, Human herpesvirus 7
gcugaagaacau

SEQ ID NO: 2149669 - RNA, 22 nt, Human herpesvirus 7
auauuuaaggcuguaaaagaaa

SEQ ID NO: 2149670 - RNA, 16 nt, Human herpesvirus 7
aguuucuuuuucauua

SEQ ID NO: 2149671 - RNA, 13 nt, Human herpesvirus 7
uuaaaaaaaugaa

SEQ ID NO: 2149672 - RNA, 16 nt, Human herpesvirus 7
ugacgaagcuaaacuu

SEQ ID NO: 2149673 - RNA, 19 nt, Human herpesvirus 7
cauugcagucaaagauuuu

SEQ ID NO: 2149674 - RNA, 14 nt, Human herpesvirus 7
uacauccuuaaauu

SEQ ID NO: 2149675 - RNA, 15 nt, Human herpesvirus 7
aaauuaauaauauua

SEQ ID NO: 2149676 - RNA, 20 nt, Human herpesvirus 7
uuaauucuaaaaauuauuua

SEQ ID NO: 2149677 - RNA, 21 nt, Human herpesvirus 7
ccugguuuuguucccugcucg

SEQ ID NO: 2149678 - RNA, 17 nt, Human herpesvirus 7
uugaacuuguuuugacu

SEQ ID NO: 2149679 - RNA, 15 nt, Human herpesvirus 7
aguucaaaaaaagaa

SEQ ID NO: 2149680 - RNA, 16 nt, Human herpesvirus 7
cacaagguacauuuug

SEQ ID NO: 2149681 - RNA, 14 nt, Human herpesvirus 7
aaaguccaaaguga

SEQ ID NO: 2149682 - RNA, 15 nt, Human herpesvirus 7
agagcuuuugcaaag

SEQ ID NO: 2149683 - RNA, 16 nt, Human herpesvirus 7
aucaaauuuaucucau

SEQ ID NO: 2149684 - RNA, 17 nt, Human herpesvirus 7
uguugaaguugaacaau

SEQ ID NO: 2149685 - RNA, 19 nt, Human herpesvirus 7
ucugaaauaaacauuucaa

SEQ ID NO: 2149686 - RNA, 20 nt, Human herpesvirus 7
caauaaaguuuuguaacuau

SEQ ID NO: 2149687 - RNA, 13 nt, Human herpesvirus 7
caugcaaaaaaca

SEQ ID NO: 2149688 - RNA, 21 nt, Human herpesvirus 7
cacguguucaggcaacauuaa

SEQ ID NO: 2149689 - RNA, 14 nt, Human herpesvirus 7
guuuucaugcucau

SEQ ID NO: 2149690 - RNA, 16 nt, Human herpesvirus 7
gcaucaaaacauauca

SEQ ID NO: 2149691 - RNA, 13 nt, Human herpesvirus 7
aacuaacaucuuu

SEQ ID NO: 2149692 - RNA, 23 nt, Human herpesvirus 7
aagcugcauguguacuaaagcca

SEQ ID NO: 2149693 - RNA, 18 nt, Human herpesvirus 7
cuagaguaucuuuucaaa

SEQ ID NO: 2149694 - RNA, 23 nt, Human herpesvirus 7
aauuuuucgcugucuuuaacuga

SEQ ID NO: 2149695 - RNA, 19 nt, Human herpesvirus 7
ucaaauuuaucucauagcu

SEQ ID NO: 2149696 - RNA, 15 nt, Human herpesvirus 7
uucaggcaacauuaa

SEQ ID NO: 2149697 - RNA, 16 nt, Human herpesvirus 7
cuacaugaauggaucu

SEQ ID NO: 2149698 - RNA, 18 nt, Human herpesvirus 7
uuagaugcugaaacauca

SEQ ID NO: 2149699 - RNA, 13 nt, Human herpesvirus 7
gcaagccuagaau

SEQ ID NO: 2149700 - RNA, 12 nt, Human herpesvirus 7
gcauccaaagaa

SEQ ID NO: 2149701 - RNA, 18 nt, Human herpesvirus 7
aacuuacauuucaaacaa

SEQ ID NO: 2149702 - RNA, 21 nt, Human herpesvirus 7
acauuucauuccaaaauacaa

SEQ ID NO: 2149703 - RNA, 15 nt, Human herpesvirus 7
gcauauaauaaagga

SEQ ID NO: 2149704 - RNA, 23 nt, Human herpesvirus 7
ugagaauguugagcuaucugauu

SEQ ID NO: 2149705 - RNA, 20 nt, Human herpesvirus 7
auggccaucgcuuucucaag

SEQ ID NO: 2149706 - RNA, 15 nt, Human herpesvirus 7
uaaugaaaaagccau

SEQ ID NO: 2149707 - RNA, 19 nt, Human herpesvirus 7
ccgcuguacaaugcugucu

SEQ ID NO: 2149708 - RNA, 14 nt, Human herpesvirus 7
agaaaaauauuuaa

SEQ ID NO: 2149709 - RNA, 15 nt, Human herpesvirus 7
ucaggaaucuuuuuu

SEQ ID NO: 2149710 - RNA, 20 nt, Human herpesvirus 7
uacauugcagucaaagauuu

SEQ ID NO: 2149711 - RNA, 13 nt, Human herpesvirus 7
cguuguuuguccu

SEQ ID NO: 2149712 - RNA, 18 nt, Human herpesvirus 7
gacauuauuagacagaua

SEQ ID NO: 2149713 - RNA, 15 nt, Human herpesvirus 7
uaagaugcuuaagga

SEQ ID NO: 2149714 - RNA, 19 nt, Human herpesvirus 7
gagcuugguuuuacaaauu

SEQ ID NO: 2149715 - RNA, 22 nt, Human herpesvirus 7
gaaaguaaaaacuuuucuuucu

SEQ ID NO: 2149716 - RNA, 22 nt, Human herpesvirus 7
augauuagcgcgugaacaaaua

SEQ ID NO: 2149717 - RNA, 11 nt, Human herpesvirus 7
gcgcugaaaua

SEQ ID NO: 2149718 - RNA, 16 nt, Human herpesvirus 7
uuacacugauuucuac

SEQ ID NO: 2149719 - RNA, 15 nt, Human herpesvirus 7
cugggaacuagaaaa

SEQ ID NO: 2149720 - RNA, 14 nt, Human herpesvirus 7
caauggaacagcaa

SEQ ID NO: 2149721 - RNA, 19 nt, Human herpesvirus 7
auuuggcuucuauuauaga

SEQ ID NO: 2149722 - RNA, 18 nt, Human herpesvirus 7
caugauguuaaagaacaa

SEQ ID NO: 2149723 - RNA, 19 nt, Human herpesvirus 7
uuuacaaagaacauguagu

SEQ ID NO: 2149724 - RNA, 17 nt, Human herpesvirus 7
cagccaucuaauugcag

SEQ ID NO: 2149725 - RNA, 16 nt, Human herpesvirus 7
caauuuuaaugugcuu

SEQ ID NO: 2149726 - RNA, 13 nt, Human herpesvirus 7
auaauuuaaaauu

SEQ ID NO: 2149727 - RNA, 16 nt, Human herpesvirus 7
uugaaauagugucugu

SEQ ID NO: 2149728 - RNA, 13 nt, Human herpesvirus 7
aacauauguugau

SEQ ID NO: 2149729 - RNA, 18 nt, Human herpesvirus 7
agauacauuuuugcaaua

SEQ ID NO: 2149730 - RNA, 14 nt, Human herpesvirus 7
ugauucaacacucg

SEQ ID NO: 2149731 - RNA, 17 nt, Human herpesvirus 7
agacauugaaaaugcau

SEQ ID NO: 2149732 - RNA, 21 nt, Human herpesvirus 7
uggugcucaaacguucuuggu

SEQ ID NO: 2149733 - RNA, 22 nt, Human herpesvirus 7
aauccguaucuagagaauguac

SEQ ID NO: 2149734 - RNA, 15 nt, Human herpesvirus 7
ucugcuugucucugu

SEQ ID NO: 2149735 - RNA, 13 nt, Human herpesvirus 7
aaaauaugcaaaa

SEQ ID NO: 2149736 - RNA, 17 nt, Human herpesvirus 7
augugugugguaaggca

SEQ ID NO: 2149737 - RNA, 16 nt, Human herpesvirus 7
acauauagauaaugaa

SEQ ID NO: 2149738 - RNA, 22 nt, Human herpesvirus 7
cuuagaaaaacgcuaaccaucu

SEQ ID NO: 2149739 - RNA, 16 nt, Human herpesvirus 7
uagucauccaauauca

SEQ ID NO: 2149740 - RNA, 21 nt, Human herpesvirus 7
uguuguagguaauuucuuaua

SEQ ID NO: 2149741 - RNA, 22 nt, Human herpesvirus 7
acacuuggaguuguguucuuua

SEQ ID NO: 2149742 - RNA, 19 nt, Human herpesvirus 7
gccgcugccuucgcucugu

SEQ ID NO: 2149743 - RNA, 19 nt, Human herpesvirus 7
uggcaaauccuauaaaagc

SEQ ID NO: 2149744 - RNA, 17 nt, Human herpesvirus 7
gggaaaaaggauuugaa

SEQ ID NO: 2149745 - RNA, 16 nt, Human herpesvirus 7
uuugggaaacaucuuu

SEQ ID NO: 2149746 - RNA, 20 nt, Human herpesvirus 7
uuugauuccaucucacuuau

SEQ ID NO: 2149747 - RNA, 12 nt, Human herpesvirus 7
caacaaauguuu

SEQ ID NO: 2149748 - RNA, 14 nt, Human herpesvirus 7
gaugacuuccaagu

SEQ ID NO: 2149749 - RNA, 24 nt, Human herpesvirus 7
cuuaaggcggacaaauauacgaau

SEQ ID NO: 2149750 - RNA, 20 nt, Human herpesvirus 7
cagaaguaacgcagacuaau

SEQ ID NO: 2149751 - RNA, 14 nt, Human herpesvirus 7
auuugcuucuucua

SEQ ID NO: 2149752 - RNA, 17 nt, Human herpesvirus 7
uugcugaacucugucau

SEQ ID NO: 2149753 - RNA, 15 nt, Human herpesvirus 7
ugucuggaacuuuua

SEQ ID NO: 2149754 - RNA, 17 nt, Human herpesvirus 7
aguggcuuaaguuuuua

SEQ ID NO: 2149755 - RNA, 22 nt, Human herpesvirus 7
uugguguguuacaucauguuaa

SEQ ID NO: 2149756 - RNA, 19 nt, Human herpesvirus 7
agaaucauuuguauauucu

SEQ ID NO: 2149757 - RNA, 17 nt, Human herpesvirus 7
auaugcaucaaaacaua

SEQ ID NO: 2149758 - RNA, 22 nt, Human herpesvirus 7
uaaacacuugcuagcugugaua

SEQ ID NO: 2149759 - RNA, 21 nt, Human herpesvirus 7
gcaguacuacuaaucaugaaa

SEQ ID NO: 2149760 - RNA, 13 nt, Human herpesvirus 7
aucauauaugcau

SEQ ID NO: 2149761 - RNA, 19 nt, Human herpesvirus 7
caagaaggaaaauuucauu

SEQ ID NO: 2149762 - RNA, 22 nt, Human herpesvirus 7
gaaaugcacuugcucugugaaa

SEQ ID NO: 2149763 - RNA, 17 nt, Human herpesvirus 7
uguugagucgaaugcau

SEQ ID NO: 2149764 - RNA, 15 nt, Human herpesvirus 7
acgugcuuagacuua

SEQ ID NO: 2149765 - RNA, 14 nt, Human herpesvirus 7
aaucagaaauguua

SEQ ID NO: 2149766 - RNA, 17 nt, Human herpesvirus 7
uugauaaaauuuggaga

SEQ ID NO: 2149767 - RNA, 19 nt, Human herpesvirus 7
aaaauguuuuuguuucuga

SEQ ID NO: 2149768 - RNA, 14 nt, Human herpesvirus 7
ugacaucaauaaau

SEQ ID NO: 2149769 - RNA, 17 nt, Human herpesvirus 7
agcuucaaaaauguuua

SEQ ID NO: 2149770 - RNA, 18 nt, Human herpesvirus 7
augugcuuauaucuuaua

SEQ ID NO: 2149771 - RNA, 16 nt, Human herpesvirus 7
uggauuuucuguaauc

SEQ ID NO: 2149772 - RNA, 17 nt, Human herpesvirus 7
aucuuuauugguaauua

SEQ ID NO: 2149773 - RNA, 17 nt, Human herpesvirus 7
aaaugagauuucugaaa

SEQ ID NO: 2149774 - RNA, 18 nt, Human herpesvirus 7
uuccuuggaaaaaugaug

SEQ ID NO: 2149775 - RNA, 24 nt, Human herpesvirus 7
aaacaauugcccuuguguugucau

SEQ ID NO: 2149776 - RNA, 15 nt, Human herpesvirus 7
uguaguuuuugcaua

SEQ ID NO: 2149777 - RNA, 13 nt, Human herpesvirus 7
cgggacagauuua

SEQ ID NO: 2149778 - RNA, 18 nt, Human herpesvirus 7
auugaaaaugcauugcuu

SEQ ID NO: 2149779 - RNA, 12 nt, Human herpesvirus 7
caaaauagcaca

SEQ ID NO: 2149780 - RNA, 15 nt, Human herpesvirus 7
ccuucccaacuaaaa

SEQ ID NO: 2149781 - RNA, 21 nt, Human herpesvirus 7
auucacauaccuguauggaac

SEQ ID NO: 2149782 - RNA, 22 nt, Human herpesvirus 7
acuggcaaucguccgaaaagac

SEQ ID NO: 2149783 - RNA, 20 nt, Human herpesvirus 7
aaauuccuccugaaaauuug

SEQ ID NO: 2149784 - RNA, 19 nt, Human herpesvirus 7
agucuauugacauaaucau

SEQ ID NO: 2149785 - RNA, 22 nt, Human herpesvirus 7
guguauuuuuuaaagaaaagcu

SEQ ID NO: 2149786 - RNA, 23 nt, Human herpesvirus 7
gcuuucuaaguacuucuggcuua

SEQ ID NO: 2149787 - RNA, 12 nt, Human herpesvirus 7
augugaaaagaa

SEQ ID NO: 2149788 - RNA, 17 nt, Human herpesvirus 7
uuuaaaaaagaauuugg

SEQ ID NO: 2149789 - RNA, 19 nt, Human herpesvirus 7
uaggauaccaaacaaaauu

SEQ ID NO: 2149790 - RNA, 20 nt, Human herpesvirus 7
auuucgcaggggguucuaaa

SEQ ID NO: 2149791 - RNA, 14 nt, Human herpesvirus 7
aauuaauaaaagua

SEQ ID NO: 2149792 - RNA, 14 nt, Human herpesvirus 7
gcaacaaacaaaua

SEQ ID NO: 2149793 - RNA, 18 nt, Human herpesvirus 7
gacgcuguaugcaagaaa

SEQ ID NO: 2149794 - RNA, 18 nt, Human herpesvirus 7
uaugauacuuguucaauu

SEQ ID NO: 2149795 - RNA, 18 nt, Human herpesvirus 7
agcuaaaauuuugaaaua

SEQ ID NO: 2149796 - RNA, 14 nt, Human herpesvirus 7
uacuaaucaugaaa

SEQ ID NO: 2149797 - RNA, 24 nt, Human herpesvirus 7
augaucuccguugaaagcguuuca

SEQ ID NO: 2149798 - RNA, 17 nt, Human herpesvirus 7
cgccuacgcagcaaugu

SEQ ID NO: 2149799 - RNA, 22 nt, Human herpesvirus 7
cugcauuccacuaaaagagaac

SEQ ID NO: 2149800 - RNA, 19 nt, Human herpesvirus 7
acuuaaggcggacaaauau

SEQ ID NO: 2149801 - RNA, 14 nt, Human herpesvirus 7
uucguaaacauuug

SEQ ID NO: 2149802 - RNA, 23 nt, Human herpesvirus 7
ucugcacuaucuccuaaaugaau

SEQ ID NO: 2149803 - RNA, 18 nt, Human herpesvirus 7
auguaaccugaauuaaaa

SEQ ID NO: 2149804 - RNA, 20 nt, Human herpesvirus 7
gcucaaaacuugccauccaa

SEQ ID NO: 2149805 - RNA, 14 nt, Human herpesvirus 7
auuaucaccacaau

SEQ ID NO: 2149806 - RNA, 20 nt, Human herpesvirus 7
cauuuaaaaaaaaaaccaca

SEQ ID NO: 2149807 - RNA, 19 nt, Human herpesvirus 7
aaugucuuugucaugauga

SEQ ID NO: 2149808 - RNA, 14 nt, Human herpesvirus 7
uuccgguauuuugu

SEQ ID NO: 2149809 - RNA, 20 nt, Human herpesvirus 7
caaaaucuguagaaaauguu

SEQ ID NO: 2149810 - RNA, 17 nt, Human herpesvirus 7
uggacauuucaagaagg

SEQ ID NO: 2149811 - RNA, 15 nt, Human herpesvirus 7
ucuuaauuuguucaa

SEQ ID NO: 2149812 - RNA, 17 nt, Human herpesvirus 7
aauaagauguguuggaa

SEQ ID NO: 2149813 - RNA, 12 nt, Human herpesvirus 7
auuacacaggaa

SEQ ID NO: 2149814 - RNA, 12 nt, Human herpesvirus 7
gacauugaagau

SEQ ID NO: 2149815 - RNA, 14 nt, Human herpesvirus 7
guugaaaauguuuu

SEQ ID NO: 2149816 - RNA, 18 nt, Human herpesvirus 7
gauuucauggacuucaga

SEQ ID NO: 2149817 - RNA, 17 nt, Human herpesvirus 7
ugaauuaauucuuucca

SEQ ID NO: 2149818 - RNA, 17 nt, Human herpesvirus 7
guuuauauauaaccgau

SEQ ID NO: 2149819 - RNA, 15 nt, Human herpesvirus 7
ugugacccugucaca

SEQ ID NO: 2149820 - RNA, 13 nt, Human herpesvirus 7
guagaaaugugcg

SEQ ID NO: 2149821 - RNA, 19 nt, Human herpesvirus 7
agaagccacuucuaaauaa

SEQ ID NO: 2149822 - RNA, 22 nt, Human herpesvirus 7
cugucagucaacuuuuuguuca

SEQ ID NO: 2149823 - RNA, 13 nt, Human herpesvirus 7
gcauuuguuacag

SEQ ID NO: 2149824 - RNA, 20 nt, Human herpesvirus 7
aauuuuguaagaaacaucua

SEQ ID NO: 2149825 - RNA, 16 nt, Human herpesvirus 7
auuuuaaauuuacuua

SEQ ID NO: 2149826 - RNA, 14 nt, Human herpesvirus 7
ugaacaaauaauga

SEQ ID NO: 2149827 - RNA, 22 nt, Human herpesvirus 7
auuucaaaagaaaaaaucuuua

SEQ ID NO: 2149828 - RNA, 12 nt, Human herpesvirus 7
aggcagaaaugu

SEQ ID NO: 2149829 - RNA, 20 nt, Human herpesvirus 7
aaaucacagcauuauuguau

SEQ ID NO: 2149830 - RNA, 13 nt, Human herpesvirus 7
aguggcuucucua

SEQ ID NO: 2149831 - RNA, 15 nt, Human herpesvirus 7
uugcagauuguagag

SEQ ID NO: 2149832 - RNA, 18 nt, Human herpesvirus 7
cuuagaugcugaaacauc

SEQ ID NO: 2149833 - RNA, 18 nt, Human herpesvirus 7
acacuauuggacaaaaga

SEQ ID NO: 2149834 - RNA, 17 nt, Human herpesvirus 7
uguagacguagugucau

SEQ ID NO: 2149835 - RNA, 13 nt, Human herpesvirus 7
auuucugucaucu

SEQ ID NO: 2149836 - RNA, 14 nt, Human herpesvirus 7
uaaaaucaaaugua

SEQ ID NO: 2149837 - RNA, 12 nt, Human herpesvirus 7
uagaugcaucca

SEQ ID NO: 2149838 - RNA, 21 nt, Human herpesvirus 7
agaccaggugacgucuagaca

SEQ ID NO: 2149839 - RNA, 18 nt, Human herpesvirus 7
auuucagaauuuccagaa

SEQ ID NO: 2149840 - RNA, 14 nt, Human herpesvirus 7
guugcugcugucuu

SEQ ID NO: 2149841 - RNA, 18 nt, Human herpesvirus 7
aaucucagcucuguaaua

SEQ ID NO: 2149842 - RNA, 15 nt, Human herpesvirus 7
guggaaauuaaucaa

SEQ ID NO: 2149843 - RNA, 16 nt, Human herpesvirus 7
caacaucuuaaauguc

SEQ ID NO: 2149844 - RNA, 19 nt, Human herpesvirus 7
caaugauaauaagaugugu

SEQ ID NO: 2149845 - RNA, 22 nt, Human herpesvirus 7
aagacauaacaaaaaagguguu

SEQ ID NO: 2149846 - RNA, 21 nt, Human herpesvirus 7
cuugcauacaguuuauuugaa

SEQ ID NO: 2149847 - RNA, 15 nt, Human herpesvirus 7
cauaaaauguacaau

SEQ ID NO: 2149848 - RNA, 19 nt, Human herpesvirus 7
gaacaauggugugucugug

SEQ ID NO: 2149849 - RNA, 17 nt, Human herpesvirus 7
acaaucuuacaaaaagu

SEQ ID NO: 2149850 - RNA, 15 nt, Human herpesvirus 7
auaauuaugaaaugu

SEQ ID NO: 2149851 - RNA, 21 nt, Human herpesvirus 7
ugcuauuauuaaagcuuucaa

SEQ ID NO: 2149852 - RNA, 18 nt, Human herpesvirus 7
agaaucagacuaaauaug

SEQ ID NO: 2149853 - RNA, 12 nt, Human herpesvirus 7
aauuaaauacuu

SEQ ID NO: 2149854 - RNA, 18 nt, Human herpesvirus 7
acuuaaauauuuuacaua

SEQ ID NO: 2149855 - RNA, 13 nt, Human herpesvirus 7
aguguguuaaaug

SEQ ID NO: 2149856 - RNA, 22 nt, Human herpesvirus 7
uguaucuucaagcucuugaaga

SEQ ID NO: 2149857 - RNA, 22 nt, Human herpesvirus 7
aaaucuauuuuauccguuaaug

SEQ ID NO: 2149858 - RNA, 16 nt, Human herpesvirus 7
gcccugaauuuuacac

SEQ ID NO: 2149859 - RNA, 20 nt, Human herpesvirus 7
cugacuuaauugauugcacu

SEQ ID NO: 2149860 - RNA, 11 nt, Human herpesvirus 7
aacuuugcuau

SEQ ID NO: 2149861 - RNA, 15 nt, Human herpesvirus 7
ucaugaaaacagugg

SEQ ID NO: 2149862 - RNA, 16 nt, Human herpesvirus 7
aauuuaaagauugcuu

SEQ ID NO: 2149863 - RNA, 16 nt, Human herpesvirus 7
auugcuugcacuguaa

SEQ ID NO: 2149864 - RNA, 21 nt, Human herpesvirus 7
aauuacaguacaaccgccauu

SEQ ID NO: 2149865 - RNA, 19 nt, Human herpesvirus 7
cauuaauaucaauuugaau

SEQ ID NO: 2149866 - RNA, 14 nt, Human herpesvirus 7
auuugcuugcugaa

SEQ ID NO: 2149867 - RNA, 19 nt, Human herpesvirus 7
aaggaaaaaugcugcucag

SEQ ID NO: 2149868 - RNA, 21 nt, Human herpesvirus 7
aauuauuaaucuuuuugccuu

SEQ ID NO: 2149869 - RNA, 22 nt, Human herpesvirus 7
acauugugaguuucuacauguu

SEQ ID NO: 2149870 - RNA, 18 nt, Human herpesvirus 7
cugggaaaaaaaaaucac

SEQ ID NO: 2149871 - RNA, 17 nt, Human herpesvirus 7
caaauaugcauggagaa

SEQ ID NO: 2149872 - RNA, 15 nt, Human herpesvirus 7
aaaggaugaaagugc

SEQ ID NO: 2149873 - RNA, 16 nt, Human herpesvirus 7
ggugauuguggggcau

SEQ ID NO: 2149874 - RNA, 13 nt, Human herpesvirus 7
uuauuauguguac

SEQ ID NO: 2149875 - RNA, 14 nt, Human herpesvirus 7
gauauuauuaaaaa

SEQ ID NO: 2149876 - RNA, 18 nt, Human herpesvirus 7
uuuucuuaaacaugauuu

SEQ ID NO: 2149877 - RNA, 16 nt, Human herpesvirus 7
cauggagcacaauuac

SEQ ID NO: 2149878 - RNA, 24 nt, Human herpesvirus 7
uggaguauuaccauuuauggaaau

SEQ ID NO: 2149879 - RNA, 14 nt, Human herpesvirus 7
uuacuuucauagcu

SEQ ID NO: 2149880 - RNA, 13 nt, Human herpesvirus 7
gcauauaugaauc

SEQ ID NO: 2149881 - RNA, 11 nt, Human herpesvirus 7
cgcugucuuua

SEQ ID NO: 2149882 - RNA, 18 nt, Human herpesvirus 7
aucgacaaacagaaaaac

SEQ ID NO: 2149883 - RNA, 20 nt, Human herpesvirus 7
gcuucauuuuaaaaaagaca

SEQ ID NO: 2149884 - RNA, 15 nt, Human herpesvirus 7
caaaauuauaacuuu

SEQ ID NO: 2149885 - RNA, 13 nt, Human herpesvirus 7
uggaaaaacagaa

SEQ ID NO: 2149886 - RNA, 18 nt, Human herpesvirus 7
aaaagacaccuuucuuaa

SEQ ID NO: 2149887 - RNA, 20 nt, Human herpesvirus 7
auaccucuggcuucagacgu

SEQ ID NO: 2149888 - RNA, 20 nt, Human herpesvirus 7
gcugauuccuucuaaauucu

SEQ ID NO: 2149889 - RNA, 15 nt, Human herpesvirus 7
cuauaguuuguauuu

SEQ ID NO: 2149890 - RNA, 14 nt, Human herpesvirus 7
acaucgaagaaauu

SEQ ID NO: 2149891 - RNA, 19 nt, Human herpesvirus 7
gacacuauuggacaaaaga

SEQ ID NO: 2149892 - RNA, 16 nt, Human herpesvirus 7
agauuugacaaaacaa

SEQ ID NO: 2149893 - RNA, 12 nt, Human herpesvirus 7
ugaaugugcuuu

SEQ ID NO: 2149894 - RNA, 19 nt, Human herpesvirus 7
aauucauuugugaaauuga

SEQ ID NO: 2149895 - RNA, 21 nt, Human herpesvirus 7
aguucauaaugacacgacacu

SEQ ID NO: 2149896 - RNA, 12 nt, Human herpesvirus 7
acauaaaaauuu

SEQ ID NO: 2149897 - RNA, 17 nt, Human herpesvirus 7
ucuuucuaguucccauu

SEQ ID NO: 2149898 - RNA, 23 nt, Human herpesvirus 7
caacgauaugguuugaaaaccau

SEQ ID NO: 2149899 - RNA, 15 nt, Human herpesvirus 7
auguugcaaauguuc

SEQ ID NO: 2149900 - RNA, 13 nt, Human herpesvirus 7
uugaauaaauuuu

SEQ ID NO: 2149901 - RNA, 18 nt, Human herpesvirus 7
ugaaauaaacauuucaaa

SEQ ID NO: 2149902 - RNA, 18 nt, Human herpesvirus 7
uuuaaaacuuauguacuc

SEQ ID NO: 2149903 - RNA, 21 nt, Human herpesvirus 7
aacugaauuaagguggaaauc

SEQ ID NO: 2149904 - RNA, 15 nt, Human herpesvirus 7
aguuguacucagaga

SEQ ID NO: 2149905 - RNA, 22 nt, Human herpesvirus 7
cuuaccgcauaaaucauguuua

SEQ ID NO: 2149906 - RNA, 14 nt, Human herpesvirus 7
uuuccaugucuugu

SEQ ID NO: 2149907 - RNA, 14 nt, Human herpesvirus 7
auugccgauuccua

SEQ ID NO: 2149908 - RNA, 15 nt, Human herpesvirus 7
cagucaagaacugug

SEQ ID NO: 2149909 - RNA, 20 nt, Human herpesvirus 7
ugugaagucuuuauaaagga

SEQ ID NO: 2149910 - RNA, 22 nt, Human herpesvirus 7
uuuggaaaacaacauacauauu

SEQ ID NO: 2149911 - RNA, 13 nt, Human herpesvirus 7
ucuuaaaugucaa

SEQ ID NO: 2149912 - RNA, 22 nt, Human herpesvirus 7
ccuuuuauugguagauuuucua

SEQ ID NO: 2149913 - RNA, 24 nt, Human herpesvirus 7
ugccgccauguauugucuuacagc

SEQ ID NO: 2149914 - RNA, 14 nt, Human herpesvirus 7
auuaaauacaaauu

SEQ ID NO: 2149915 - RNA, 15 nt, Human herpesvirus 7
aauccaacagaauac

SEQ ID NO: 2149916 - RNA, 17 nt, Human herpesvirus 7
auagcuuaaaaaauaca

SEQ ID NO: 2149917 - RNA, 12 nt, Human herpesvirus 7
uuaaaauuauua

SEQ ID NO: 2149918 - RNA, 13 nt, Human herpesvirus 7
gcaauaugcucac

SEQ ID NO: 2149919 - RNA, 19 nt, Human herpesvirus 7
auuauaucuuaauaaaguu

SEQ ID NO: 2149920 - RNA, 14 nt, Human herpesvirus 7
auuuauugcuuaac

SEQ ID NO: 2149921 - RNA, 15 nt, Human herpesvirus 7
aaggaucaaaagcug

SEQ ID NO: 2149922 - RNA, 13 nt, Human herpesvirus 7
ugauaauuucuau

SEQ ID NO: 2149923 - RNA, 11 nt, Human herpesvirus 7
aauaaauacua

SEQ ID NO: 2149924 - RNA, 14 nt, Human herpesvirus 7
aaaucuacuguaau

SEQ ID NO: 2149925 - RNA, 14 nt, Human herpesvirus 7
ggacauuuguugug

SEQ ID NO: 2149926 - RNA, 16 nt, Human herpesvirus 7
gauaugguuugaaaac

SEQ ID NO: 2149927 - RNA, 22 nt, Human herpesvirus 7
cuuaaugcccguuuucggaaau

SEQ ID NO: 2149928 - RNA, 21 nt, Human herpesvirus 7
aguuuuacaaagaacauguag

SEQ ID NO: 2149929 - RNA, 21 nt, Human herpesvirus 7
ccugaaaaaauaaauucugaa

SEQ ID NO: 2149930 - RNA, 21 nt, Human herpesvirus 7
agauaaaaauuuauuuucuaa

SEQ ID NO: 2149931 - RNA, 22 nt, Human herpesvirus 7
auggauucaaucuacuguacuu

SEQ ID NO: 2149932 - RNA, 19 nt, Human herpesvirus 7
aacgucaggaaaaaaacgu

SEQ ID NO: 2149933 - RNA, 16 nt, Human herpesvirus 7
acuuugccaaugccaa

SEQ ID NO: 2149934 - RNA, 14 nt, Human herpesvirus 7
gagcgcuuugcuua

SEQ ID NO: 2149935 - RNA, 20 nt, Human herpesvirus 7
guccuucaauagcagagaau

SEQ ID NO: 2149936 - RNA, 23 nt, Human herpesvirus 7
acuguuguagguaauuucuuaua

SEQ ID NO: 2149937 - RNA, 14 nt, Human herpesvirus 7
caagauccuuaucc

SEQ ID NO: 2149938 - RNA, 14 nt, Human herpesvirus 7
guaucuaugaaaua

SEQ ID NO: 2149939 - RNA, 21 nt, Human herpesvirus 7
gaaauuaaguuuuucauguau

SEQ ID NO: 2149940 - RNA, 16 nt, Human herpesvirus 7
aauaugcauguguaaa

SEQ ID NO: 2149941 - RNA, 22 nt, Human herpesvirus 7
cugaacgcagacacaauggaac

SEQ ID NO: 2149942 - RNA, 22 nt, Human herpesvirus 7
aaaggugguuacauauccaaug

SEQ ID NO: 2149943 - RNA, 18 nt, Human herpesvirus 7
aaauguacaauuugcaua

SEQ ID NO: 2149944 - RNA, 15 nt, Human herpesvirus 7
uauaacuuguaauuu

SEQ ID NO: 2149945 - RNA, 18 nt, Human herpesvirus 7
ucaauaaaugguuuuauu

SEQ ID NO: 2149946 - RNA, 13 nt, Human herpesvirus 7
auauaugcuuuau

SEQ ID NO: 2149947 - RNA, 20 nt, Human herpesvirus 7
gaauauuuauguucaaauau

SEQ ID NO: 2149948 - RNA, 15 nt, Human herpesvirus 7
gaguaaagauuuaac

SEQ ID NO: 2149949 - RNA, 18 nt, Human herpesvirus 7
aaacaugggauuucugua

SEQ ID NO: 2149950 - RNA, 19 nt, Human herpesvirus 7
uuucaaauagaguuuaauu

SEQ ID NO: 2149951 - RNA, 23 nt, Human herpesvirus 7
guaacaaaggaucgaucucuguc

SEQ ID NO: 2149952 - RNA, 20 nt, Human herpesvirus 7
auuagucauacuuuacagcu

SEQ ID NO: 2149953 - RNA, 21 nt, Human herpesvirus 7
uucuucuaauugcgcaguguu

SEQ ID NO: 2149954 - RNA, 13 nt, Human herpesvirus 7
uggcaccaauaga

SEQ ID NO: 2149955 - RNA, 14 nt, Human herpesvirus 7
ugccaaaagcuuga

SEQ ID NO: 2149956 - RNA, 13 nt, Human herpesvirus 7
ccucacagauuuu

SEQ ID NO: 2149957 - RNA, 13 nt, Human herpesvirus 7
aaaaacaaaaaag

SEQ ID NO: 2149958 - RNA, 18 nt, Human herpesvirus 7
uucuuugaaauagugucu

SEQ ID NO: 2149959 - RNA, 18 nt, Human herpesvirus 7
agcgcugagaucuuccaa

SEQ ID NO: 2149960 - RNA, 22 nt, Human herpesvirus 7
uccaaaaucagacaauuucaca

SEQ ID NO: 2149961 - RNA, 16 nt, Human herpesvirus 7
aacagccaaauguggu

SEQ ID NO: 2149962 - RNA, 18 nt, Human herpesvirus 7
acaaagauccucugagaa

SEQ ID NO: 2149963 - RNA, 19 nt, Human herpesvirus 7
aaucaaaaaauaauuccuu

SEQ ID NO: 2149964 - RNA, 19 nt, Human herpesvirus 7
auguuuuaccgugucuucu

SEQ ID NO: 2149965 - RNA, 21 nt, Human herpesvirus 7
uuuucuuagcuuucaugauuu

SEQ ID NO: 2149966 - RNA, 13 nt, Human herpesvirus 7
cuaaaguggagac

SEQ ID NO: 2149967 - RNA, 15 nt, Human herpesvirus 7
cguuuauaaacucua

SEQ ID NO: 2149968 - RNA, 19 nt, Human herpesvirus 7
ugcaacuggcauuccuugg

SEQ ID NO: 2149969 - RNA, 14 nt, Human herpesvirus 7
cugaaaauugcgua

SEQ ID NO: 2149970 - RNA, 13 nt, Human herpesvirus 7
auaaaauguacaa

SEQ ID NO: 2149971 - RNA, 20 nt, Human herpesvirus 7
agacuaaauauggagcagcu

SEQ ID NO: 2149972 - RNA, 19 nt, Human herpesvirus 7
cuaaagacacuuauuugau

SEQ ID NO: 2149973 - RNA, 14 nt, Human herpesvirus 7
gacgaugagcauga

SEQ ID NO: 2149974 - RNA, 17 nt, Human herpesvirus 7
ugcgaauacuuguugag

SEQ ID NO: 2149975 - RNA, 19 nt, Human herpesvirus 7
acguguuuuugaugugcaa

SEQ ID NO: 2149976 - RNA, 18 nt, Human herpesvirus 7
aacuaaguuuugcauuuu

SEQ ID NO: 2149977 - RNA, 12 nt, Human herpesvirus 7
uaagaaacaucu

SEQ ID NO: 2149978 - RNA, 14 nt, Human herpesvirus 7
acuacauuuaaaaa

SEQ ID NO: 2149979 - RNA, 14 nt, Human herpesvirus 7
aucgacaaacagaa

SEQ ID NO: 2149980 - RNA, 18 nt, Human herpesvirus 7
uucaacuucuaguucuga

SEQ ID NO: 2149981 - RNA, 12 nt, Human herpesvirus 7
ucuaaacaaaca

SEQ ID NO: 2149982 - RNA, 14 nt, Human herpesvirus 7
caaauuaaauacuu

SEQ ID NO: 2149983 - RNA, 24 nt, Human herpesvirus 7
cagauugaaauuccauacaaagaa

SEQ ID NO: 2149984 - RNA, 18 nt, Human herpesvirus 7
uguugaguacgaaagaau

SEQ ID NO: 2149985 - RNA, 20 nt, Human herpesvirus 7
gaaucaagacgcuguaugca

SEQ ID NO: 2149986 - RNA, 17 nt, Human herpesvirus 7
guuuagugauagaguac

SEQ ID NO: 2149987 - RNA, 15 nt, Human herpesvirus 7
aucaagaaacaaggu

SEQ ID NO: 2149988 - RNA, 17 nt, Human herpesvirus 7
agaaacaaucccagaaa

SEQ ID NO: 2149989 - RNA, 15 nt, Human herpesvirus 7
uagccuuucggacac

SEQ ID NO: 2149990 - RNA, 13 nt, Human herpesvirus 7
gaauuuccagaag

SEQ ID NO: 2149991 - RNA, 18 nt, Human herpesvirus 7
ugauuugagcagugauuu

SEQ ID NO: 2149992 - RNA, 18 nt, Human herpesvirus 7
uaaacguuuaguuaacau

SEQ ID NO: 2149993 - RNA, 12 nt, Human herpesvirus 7
ugcucaaaucaa

SEQ ID NO: 2149994 - RNA, 22 nt, Human herpesvirus 7
cuuuaucagucaagaacuguga

SEQ ID NO: 2149995 - RNA, 17 nt, Human herpesvirus 7
auacaggccuguuucuu

SEQ ID NO: 2149996 - RNA, 19 nt, Human herpesvirus 7
caaaaugacaaaaagguug

SEQ ID NO: 2149997 - RNA, 18 nt, Human herpesvirus 7
auuaaaauguacauaacu

SEQ ID NO: 2149998 - RNA, 17 nt, Human herpesvirus 7
uaaaaguacaaauguuu

SEQ ID NO: 2149999 - RNA, 22 nt, Human herpesvirus 7
gccacagauauucuaacaaaua

SEQ ID NO: 2150000 - RNA, 23 nt, Human herpesvirus 7
agaacaacaacuaaaacuacauu

SEQ ID NO: 2150001 - RNA, 19 nt, Human herpesvirus 7
auuuuaaaagguugacauc

SEQ ID NO: 2150002 - RNA, 14 nt, Human herpesvirus 7
gcacaaucacguga

SEQ ID NO: 2150003 - RNA, 12 nt, Human herpesvirus 7
ugugucuuacaa

SEQ ID NO: 2150004 - RNA, 14 nt, Human herpesvirus 7
cuagaaaauaguug

SEQ ID NO: 2150005 - RNA, 19 nt, Human herpesvirus 7
cugcaaauccaacagaaua

SEQ ID NO: 2150006 - RNA, 16 nt, Human herpesvirus 7
uugcaauuuuagauuu

SEQ ID NO: 2150007 - RNA, 21 nt, Human herpesvirus 7
caaaggaaaaaugcugcucag

SEQ ID NO: 2150008 - RNA, 22 nt, Human herpesvirus 7
cucuugcacaggauuugggaaa

SEQ ID NO: 2150009 - RNA, 23 nt, Human herpesvirus 7
ggauuugaaugaacaaauaauga

SEQ ID NO: 2150010 - RNA, 22 nt, Human herpesvirus 7
auucaaauaagggauaucuuaa

SEQ ID NO: 2150011 - RNA, 15 nt, Human herpesvirus 7
uuucauaucuaugau

SEQ ID NO: 2150012 - RNA, 17 nt, Human herpesvirus 7
gacaaauuaaacaaucu

SEQ ID NO: 2150013 - RNA, 17 nt, Human herpesvirus 7
acuucaacauacagcau

SEQ ID NO: 2150014 - RNA, 13 nt, Human herpesvirus 7
aacaaauugugga

SEQ ID NO: 2150015 - RNA, 17 nt, Human herpesvirus 7
uaauuccgggagaaagc

SEQ ID NO: 2150016 - RNA, 15 nt, Human herpesvirus 7
uaaugaauaaaaucu

SEQ ID NO: 2150017 - RNA, 17 nt, Human herpesvirus 7
aauaaguccgugugcaa

SEQ ID NO: 2150018 - RNA, 12 nt, Human herpesvirus 7
aagaaauuuucu

SEQ ID NO: 2150019 - RNA, 18 nt, Human herpesvirus 7
cuuuucaaugcaacuuua

SEQ ID NO: 2150020 - RNA, 15 nt, Human herpesvirus 7
auguuacccaaaaug

SEQ ID NO: 2150021 - RNA, 18 nt, Human herpesvirus 7
gagucucuaaaauuuucu

SEQ ID NO: 2150022 - RNA, 19 nt, Human herpesvirus 7
uuauuaauuuuuaauucuu

SEQ ID NO: 2150023 - RNA, 16 nt, Human herpesvirus 7
acacuagcuuucuguu

SEQ ID NO: 2150024 - RNA, 11 nt, Human herpesvirus 7
aaaaaggaaaa

SEQ ID NO: 2150025 - RNA, 16 nt, Human herpesvirus 7
augggauuucuguaaa

SEQ ID NO: 2150026 - RNA, 12 nt, Human herpesvirus 7
aaacaucuguuu

SEQ ID NO: 2150027 - RNA, 14 nt, Human herpesvirus 7
aacucuaucuccua

SEQ ID NO: 2150028 - RNA, 16 nt, Human herpesvirus 7
gacaccaguaugaaau

SEQ ID NO: 2150029 - RNA, 21 nt, Human herpesvirus 7
cgugagggggacaauuauuua

SEQ ID NO: 2150030 - RNA, 15 nt, Human herpesvirus 7
aucucucuuucugga

SEQ ID NO: 2150031 - RNA, 19 nt, Human herpesvirus 7
ucguaucugugacuuagaa

SEQ ID NO: 2150032 - RNA, 18 nt, Human herpesvirus 7
aaacauuagcauugaaau

SEQ ID NO: 2150033 - RNA, 14 nt, Human herpesvirus 7
ucucguaauuuaag

SEQ ID NO: 2150034 - RNA, 17 nt, Human herpesvirus 7
ccugucuugaccuggag

SEQ ID NO: 2150035 - RNA, 16 nt, Human herpesvirus 7
ucaucgguuuucugag

SEQ ID NO: 2150036 - RNA, 18 nt, Human herpesvirus 7
cguuucuagcaaaauaug

SEQ ID NO: 2150037 - RNA, 17 nt, Human herpesvirus 7
ugauuguggggcauuca

SEQ ID NO: 2150038 - RNA, 19 nt, Human herpesvirus 7
auaaucaaaaaauucuucu

SEQ ID NO: 2150039 - RNA, 12 nt, Human herpesvirus 7
cugcaaagaaaa

SEQ ID NO: 2150040 - RNA, 15 nt, Human herpesvirus 7
uuuguaugucuacaa

SEQ ID NO: 2150041 - RNA, 15 nt, Human herpesvirus 7
acgcgggguuaaaaa

SEQ ID NO: 2150042 - RNA, 15 nt, Human herpesvirus 7
uuuccucacagauuu

SEQ ID NO: 2150043 - RNA, 15 nt, Human herpesvirus 7
uucauuuuuuucuua

SEQ ID NO: 2150044 - RNA, 19 nt, Human herpesvirus 7
aauuauuagauuccauuua

SEQ ID NO: 2150045 - RNA, 20 nt, Human herpesvirus 7
guaauguaagaaaagcaagu

SEQ ID NO: 2150046 - RNA, 18 nt, Human herpesvirus 7
agaagacauauuagauua

SEQ ID NO: 2150047 - RNA, 22 nt, Human herpesvirus 7
aaggaaauuaguucuugugacg

SEQ ID NO: 2150048 - RNA, 15 nt, Human herpesvirus 7
auagacacauuuauc

SEQ ID NO: 2150049 - RNA, 16 nt, Human herpesvirus 7
acaagguuuaaaacau

SEQ ID NO: 2150050 - RNA, 15 nt, Human herpesvirus 7
gauaugaauuugaaa

SEQ ID NO: 2150051 - RNA, 21 nt, Human herpesvirus 7
uagugauagaguacauguguc

SEQ ID NO: 2150052 - RNA, 15 nt, Human herpesvirus 7
aaaauaaacauguug

SEQ ID NO: 2150053 - RNA, 21 nt, Human herpesvirus 7
ugcuggcucaagcacaaucac

SEQ ID NO: 2150054 - RNA, 18 nt, Human herpesvirus 7
aaauauaugcuuuauuua

SEQ ID NO: 2150055 - RNA, 23 nt, Human herpesvirus 7
auccagaacauuuauuuucuuaa

SEQ ID NO: 2150056 - RNA, 14 nt, Human herpesvirus 7
acagaaaucccaaa

SEQ ID NO: 2150057 - RNA, 19 nt, Human herpesvirus 7
augaagcuguacaacaguc

SEQ ID NO: 2150058 - RNA, 18 nt, Human herpesvirus 7
aucugauuuauauagcaa

SEQ ID NO: 2150059 - RNA, 22 nt, Human herpesvirus 7
cauuuuuacucaauauaaagaa

SEQ ID NO: 2150060 - RNA, 15 nt, Human herpesvirus 7
uaauuuuuuuuugag

SEQ ID NO: 2150061 - RNA, 19 nt, Human herpesvirus 7
acuugaauagguaucuuua

SEQ ID NO: 2150062 - RNA, 15 nt, Human herpesvirus 7
guacuguaauuucuc

SEQ ID NO: 2150063 - RNA, 22 nt, Human herpesvirus 7
uauaaaggaccaugggaaaaga

SEQ ID NO: 2150064 - RNA, 15 nt, Human herpesvirus 7
ucaauaaaaaguuug

SEQ ID NO: 2150065 - RNA, 23 nt, Human herpesvirus 7
uggcauugaaauucuguggagug

SEQ ID NO: 2150066 - RNA, 19 nt, Human herpesvirus 7
aucuuugucacuuaaagaa

SEQ ID NO: 2150067 - RNA, 21 nt, Human herpesvirus 7
acugcuucucccauucaauaa

SEQ ID NO: 2150068 - RNA, 14 nt, Human herpesvirus 7
ucuauuauuucuac

SEQ ID NO: 2150069 - RNA, 18 nt, Human herpesvirus 7
agcuccaagcuuaaauaa

SEQ ID NO: 2150070 - RNA, 15 nt, Human herpesvirus 7
uucagaaaaaccauu

SEQ ID NO: 2150071 - RNA, 15 nt, Human herpesvirus 7
ggcuaacagugggaa

SEQ ID NO: 2150072 - RNA, 16 nt, Human herpesvirus 7
auaauucaaucugcaa

SEQ ID NO: 2150073 - RNA, 12 nt, Human herpesvirus 7
uaagaaucuauu

SEQ ID NO: 2150074 - RNA, 23 nt, Human herpesvirus 7
gcauaaaaaaucuaauuaaucug

SEQ ID NO: 2150075 - RNA, 21 nt, Human herpesvirus 7
aaauaaaggaucucucuuucu

SEQ ID NO: 2150076 - RNA, 16 nt, Human herpesvirus 7
uucaucuucugaaucu

SEQ ID NO: 2150077 - RNA, 13 nt, Human herpesvirus 7
aguguuuaaaaug

SEQ ID NO: 2150078 - RNA, 20 nt, Human herpesvirus 7
gaugaauuaauucuuuccac

SEQ ID NO: 2150079 - RNA, 16 nt, Human herpesvirus 7
cguuugaauguauguc

SEQ ID NO: 2150080 - RNA, 17 nt, Human herpesvirus 7
caguauauaaugguuug

SEQ ID NO: 2150081 - RNA, 20 nt, Human herpesvirus 7
uucguuaacccagaagaaac

SEQ ID NO: 2150082 - RNA, 13 nt, Human herpesvirus 7
uaggcuucuucua

SEQ ID NO: 2150083 - RNA, 15 nt, Human herpesvirus 7
ugaacucugucauca

SEQ ID NO: 2150084 - RNA, 20 nt, Human herpesvirus 7
acaguuuggggcacaaaaua

SEQ ID NO: 2150085 - RNA, 23 nt, Human herpesvirus 7
ggagcuucauuuuaaaaaagaca

SEQ ID NO: 2150086 - RNA, 15 nt, Human herpesvirus 7
uaacaagcacacuaa

SEQ ID NO: 2150087 - RNA, 21 nt, Human herpesvirus 7
augaagauaucuuaucuggag

SEQ ID NO: 2150088 - RNA, 14 nt, Human herpesvirus 7
cuguaaaauuuaaa

SEQ ID NO: 2150089 - RNA, 22 nt, Human herpesvirus 7
agaaauuuuacagccuguacaa

SEQ ID NO: 2150090 - RNA, 12 nt, Human herpesvirus 7
caaaguagccuu

SEQ ID NO: 2150091 - RNA, 13 nt, Human herpesvirus 7
cuuuucagugaag

SEQ ID NO: 2150092 - RNA, 14 nt, Human herpesvirus 7
guaauagcuuuaaa

SEQ ID NO: 2150093 - RNA, 14 nt, Human herpesvirus 7
uguuuugcauauuu

SEQ ID NO: 2150094 - RNA, 16 nt, Human herpesvirus 7
aacuuuucuuaaacau

SEQ ID NO: 2150095 - RNA, 22 nt, Human herpesvirus 7
uuguuugcugguggguuuugaa

SEQ ID NO: 2150096 - RNA, 21 nt, Human herpesvirus 7
ugucuuaauugccgauuccua

SEQ ID NO: 2150097 - RNA, 20 nt, Human herpesvirus 7
agcuugguuuuacaaauuaa

SEQ ID NO: 2150098 - RNA, 22 nt, Human herpesvirus 7
cguuauuauguguacacuuuug

SEQ ID NO: 2150099 - RNA, 22 nt, Human herpesvirus 7
aaguuaaaagaucuuuuacaga

SEQ ID NO: 2150100 - RNA, 15 nt, Human herpesvirus 7
auccagcaaagacuu

SEQ ID NO: 2150101 - RNA, 14 nt, Human herpesvirus 7
accauuucugaaac

SEQ ID NO: 2150102 - RNA, 15 nt, Human herpesvirus 7
aaugauuucagaaaa

SEQ ID NO: 2150103 - RNA, 22 nt, Human herpesvirus 7
augauuuuuuaaaugugucuua

SEQ ID NO: 2150104 - RNA, 19 nt, Human herpesvirus 7
uggacagagacaaccaucg

SEQ ID NO: 2150105 - RNA, 14 nt, Human herpesvirus 7
uuaacgaaugacag

SEQ ID NO: 2150106 - RNA, 19 nt, Human herpesvirus 7
ugaacaauggugugucugu

SEQ ID NO: 2150107 - RNA, 19 nt, Human herpesvirus 7
uuggauugauuuucaaguu

SEQ ID NO: 2150108 - RNA, 17 nt, Human herpesvirus 7
aaaaagccauaaaaugu

SEQ ID NO: 2150109 - RNA, 15 nt, Human herpesvirus 7
aucacaaaacucuuc

SEQ ID NO: 2150110 - RNA, 14 nt, Human herpesvirus 7
uaaaaaugauuuuu

SEQ ID NO: 2150111 - RNA, 20 nt, Human herpesvirus 7
aucuuaaaaguacaaauguu

SEQ ID NO: 2150112 - RNA, 14 nt, Human herpesvirus 7
auuauaagaaucug

SEQ ID NO: 2150113 - RNA, 16 nt, Human herpesvirus 7
aucaaauuuugauucc

SEQ ID NO: 2150114 - RNA, 20 nt, Human herpesvirus 7
cuauuagauaaugacaaaca

SEQ ID NO: 2150115 - RNA, 23 nt, Human herpesvirus 7
auucuauaaaacgugugaaaaca

SEQ ID NO: 2150116 - RNA, 20 nt, Human herpesvirus 7
uaucuccuaaaugaauuuua

SEQ ID NO: 2150117 - RNA, 19 nt, Human herpesvirus 7
cuuuagauagaaauaguug

SEQ ID NO: 2150118 - RNA, 17 nt, Human herpesvirus 7
aaugcugcucagcuaga

SEQ ID NO: 2150119 - RNA, 23 nt, Human herpesvirus 7
uacaaauguuuuaauuuggaaau

SEQ ID NO: 2150120 - RNA, 20 nt, Human herpesvirus 7
gcuugcuuaaaacuuugaaa

SEQ ID NO: 2150121 - RNA, 20 nt, Human herpesvirus 7
caguucaagaaauaaugaag

SEQ ID NO: 2150122 - RNA, 21 nt, Human herpesvirus 7
uguaacaacuagcaaacagug

SEQ ID NO: 2150123 - RNA, 21 nt, Human herpesvirus 7
auguuaaaggaucaaaagcug

SEQ ID NO: 2150124 - RNA, 19 nt, Human herpesvirus 7
gaacuuuuaaauuaaaaga

SEQ ID NO: 2150125 - RNA, 14 nt, Human herpesvirus 7
uauggacuccugua

SEQ ID NO: 2150126 - RNA, 16 nt, Human herpesvirus 7
aggaccaauucuuuua

SEQ ID NO: 2150127 - RNA, 23 nt, Human herpesvirus 7
ugaagaagaguugcaacuagaga

SEQ ID NO: 2150128 - RNA, 23 nt, Human herpesvirus 7
cgauguauuacuacuaacaugga

SEQ ID NO: 2150129 - RNA, 16 nt, Human herpesvirus 7
caauagugaacaugug

SEQ ID NO: 2150130 - RNA, 15 nt, Human herpesvirus 7
gcaauuaauucaguu

SEQ ID NO: 2150131 - RNA, 17 nt, Human herpesvirus 7
gcagauuuggggucuga

SEQ ID NO: 2150132 - RNA, 14 nt, Human herpesvirus 7
ucguaucugugacu

SEQ ID NO: 2150133 - RNA, 16 nt, Human herpesvirus 7
uuaauagaaauuauug

SEQ ID NO: 2150134 - RNA, 12 nt, Human herpesvirus 7
uuuaugaacaag

SEQ ID NO: 2150135 - RNA, 23 nt, Human herpesvirus 7
cgcaaugguauaaagugcugucu

SEQ ID NO: 2150136 - RNA, 16 nt, Human herpesvirus 7
uucaauuucugucuuu

SEQ ID NO: 2150137 - RNA, 21 nt, Human herpesvirus 7
augucaggaaaaaauugaaaa

SEQ ID NO: 2150138 - RNA, 19 nt, Human herpesvirus 7
ugaaauuguaguuuuugca

SEQ ID NO: 2150139 - RNA, 16 nt, Human herpesvirus 7
agaaugcguaacuuug

SEQ ID NO: 2150140 - RNA, 21 nt, Human herpesvirus 7
gaugcauuuuuauugcaguuu

SEQ ID NO: 2150141 - RNA, 13 nt, Human herpesvirus 7
uuucuuucucauc

SEQ ID NO: 2150142 - RNA, 16 nt, Human herpesvirus 7
uuaaaauuaaaacuug

SEQ ID NO: 2150143 - RNA, 19 nt, Human herpesvirus 7
agcaugcguaaaaaaucaa

SEQ ID NO: 2150144 - RNA, 16 nt, Human herpesvirus 7
ugauuuuuuauuccca

SEQ ID NO: 2150145 - RNA, 12 nt, Human herpesvirus 7
uguugcuuuuuc

SEQ ID NO: 2150146 - RNA, 15 nt, Human herpesvirus 7
gugugucucuagaaa

SEQ ID NO: 2150147 - RNA, 17 nt, Human herpesvirus 7
uuuaaguaaauuucuca

SEQ ID NO: 2150148 - RNA, 13 nt, Human herpesvirus 7
gcauauugaagau

SEQ ID NO: 2150149 - RNA, 24 nt, Human herpesvirus 7
gaaaauuuauauuugcuugcugaa

SEQ ID NO: 2150150 - RNA, 15 nt, Human herpesvirus 7
acaaggacgaaucua

SEQ ID NO: 2150151 - RNA, 20 nt, Human herpesvirus 7
cgcuguugguuaugcacauc

SEQ ID NO: 2150152 - RNA, 19 nt, Human herpesvirus 7
cuuacuuuuaauucuucua

SEQ ID NO: 2150153 - RNA, 20 nt, Human herpesvirus 7
auccaaguuuuacagaaauu

SEQ ID NO: 2150154 - RNA, 19 nt, Human herpesvirus 7
cagaagcugacuuugucau

SEQ ID NO: 2150155 - RNA, 18 nt, Human herpesvirus 7
auuagauuccauuuaaau

SEQ ID NO: 2150156 - RNA, 20 nt, Human herpesvirus 7
aagauguuacccaaaaugua

SEQ ID NO: 2150157 - RNA, 14 nt, Human herpesvirus 7
guguuguaauaauu

SEQ ID NO: 2150158 - RNA, 21 nt, Human herpesvirus 7
cuagcaccgaaaaugguauuu

SEQ ID NO: 2150159 - RNA, 23 nt, Human herpesvirus 7
uugcauauuuugcuagaaacguc

SEQ ID NO: 2150160 - RNA, 17 nt, Human herpesvirus 7
uguuacaugaucuugua

SEQ ID NO: 2150161 - RNA, 17 nt, Human herpesvirus 7
ugugcagagaugaagga

SEQ ID NO: 2150162 - RNA, 15 nt, Human herpesvirus 7
ucaaugcaucuuuaa

SEQ ID NO: 2150163 - RNA, 21 nt, Human herpesvirus 7
auacuaauagaaaaauguaca

SEQ ID NO: 2150164 - RNA, 14 nt, Human herpesvirus 7
gagaauuuaaagcu

SEQ ID NO: 2150165 - RNA, 14 nt, Human herpesvirus 7
gaaaagcuuguaua

SEQ ID NO: 2150166 - RNA, 22 nt, Human herpesvirus 7
aaagucagaacauugucaaaga

SEQ ID NO: 2150167 - RNA, 15 nt, Human herpesvirus 7
cagcguucaaucaaa

SEQ ID NO: 2150168 - RNA, 14 nt, Human herpesvirus 7
uagagaaaacauug

SEQ ID NO: 2150169 - RNA, 22 nt, Human herpesvirus 7
cuaaagugaacaugacuucaga

SEQ ID NO: 2150170 - RNA, 21 nt, Human herpesvirus 7
cagucugaaagccgcugccuu

SEQ ID NO: 2150171 - RNA, 17 nt, Human herpesvirus 7
agauaauauagaugcag

SEQ ID NO: 2150172 - RNA, 15 nt, Human herpesvirus 7
caccacaauuuuaac

SEQ ID NO: 2150173 - RNA, 17 nt, Human herpesvirus 7
ucuucaacuucucuugg

SEQ ID NO: 2150174 - RNA, 23 nt, Human herpesvirus 7
uaaaggaucaaaagcugcagcug

SEQ ID NO: 2150175 - RNA, 15 nt, Human herpesvirus 7
accauugcugauccg

SEQ ID NO: 2150176 - RNA, 11 nt, Human herpesvirus 7
gcaacuucuga

SEQ ID NO: 2150177 - RNA, 19 nt, Human herpesvirus 7
uaaaaugguugugcaauuu

SEQ ID NO: 2150178 - RNA, 14 nt, Human herpesvirus 7
guuucuuucuuuua

SEQ ID NO: 2150179 - RNA, 16 nt, Human herpesvirus 7
cuagaguaucuuuuca

SEQ ID NO: 2150180 - RNA, 16 nt, Human herpesvirus 7
uucuuguuuggaaaac

SEQ ID NO: 2150181 - RNA, 14 nt, Human herpesvirus 7
auaauaagaugugu

SEQ ID NO: 2150182 - RNA, 23 nt, Human herpesvirus 7
auuaacauuaaccacaacuguga

SEQ ID NO: 2150183 - RNA, 17 nt, Human herpesvirus 7
ucuguagaaaauguuuu

SEQ ID NO: 2150184 - RNA, 14 nt, Human herpesvirus 7
ucacagacgcauca

SEQ ID NO: 2150185 - RNA, 14 nt, Human herpesvirus 7
cuuucgcaacaauc

SEQ ID NO: 2150186 - RNA, 22 nt, Human herpesvirus 7
cuuucuuugagcuaaccuuuua

SEQ ID NO: 2150187 - RNA, 17 nt, Human herpesvirus 7
ugaaaaaaacacuuugc

SEQ ID NO: 2150188 - RNA, 14 nt, Human herpesvirus 7
guaugaaaaaaaca

SEQ ID NO: 2150189 - RNA, 16 nt, Human herpesvirus 7
cugccucugccucuug

SEQ ID NO: 2150190 - RNA, 13 nt, Human herpesvirus 7
uaagaaaaauuug

SEQ ID NO: 2150191 - RNA, 23 nt, Human herpesvirus 7
auaaaacaaacuauguccaaaaa

SEQ ID NO: 2150192 - RNA, 14 nt, Human herpesvirus 7
acuuguaauuuuug

SEQ ID NO: 2150193 - RNA, 23 nt, Human herpesvirus 7
uuguaucuaugaaauaaaauuuu

SEQ ID NO: 2150194 - RNA, 14 nt, Human herpesvirus 7
cagauucuccagaa

SEQ ID NO: 2150195 - RNA, 12 nt, Human herpesvirus 7
acagacagaaug

SEQ ID NO: 2150196 - RNA, 13 nt, Human herpesvirus 7
agaugcaugcuaa

SEQ ID NO: 2150197 - RNA, 20 nt, Human herpesvirus 7
auucaaucaccaaagaguau

SEQ ID NO: 2150198 - RNA, 17 nt, Human herpesvirus 7
gcuguguccacuacaga

SEQ ID NO: 2150199 - RNA, 16 nt, Human herpesvirus 7
aggaaauugcuuucua

SEQ ID NO: 2150200 - RNA, 13 nt, Human herpesvirus 7
ccaaauauaugcu

SEQ ID NO: 2150201 - RNA, 21 nt, Human herpesvirus 7
augcaagaaaguccaaaguga

SEQ ID NO: 2150202 - RNA, 16 nt, Human herpesvirus 7
aaacauuauauuccca

SEQ ID NO: 2150203 - RNA, 16 nt, Human herpesvirus 7
aagcaauguaugucaa

SEQ ID NO: 2150204 - RNA, 15 nt, Human herpesvirus 7
accgucauuuaauug

SEQ ID NO: 2150205 - RNA, 16 nt, Human herpesvirus 7
ucaaauuauuuccaga

SEQ ID NO: 2150206 - RNA, 14 nt, Human herpesvirus 7
gaagauuugacaaa

SEQ ID NO: 2150207 - RNA, 21 nt, Human herpesvirus 7
gaaucauuuguauauucuagu

SEQ ID NO: 2150208 - RNA, 18 nt, Human herpesvirus 7
cugaaaacauugcuguuc

SEQ ID NO: 2150209 - RNA, 18 nt, Human herpesvirus 7
acaccgcaaacauuuuga

SEQ ID NO: 2150210 - RNA, 22 nt, Human herpesvirus 7
ucaaauauauauuaagaaauaa

SEQ ID NO: 2150211 - RNA, 16 nt, Human herpesvirus 7
aacuauucgaaaauau

SEQ ID NO: 2150212 - RNA, 20 nt, Human herpesvirus 7
guaagaaacaucuaugugcu

SEQ ID NO: 2150213 - RNA, 14 nt, Human herpesvirus 7
aguagugcuaauau

SEQ ID NO: 2150214 - RNA, 11 nt, Human herpesvirus 7
aaaaaacacuu

SEQ ID NO: 2150215 - RNA, 20 nt, Human herpesvirus 7
gaaaaaaaaaguuaaaagau

SEQ ID NO: 2150216 - RNA, 18 nt, Human herpesvirus 7
guuucuuuuucauuaacu

SEQ ID NO: 2150217 - RNA, 16 nt, Human herpesvirus 7
acaauuguauuucagu

SEQ ID NO: 2150218 - RNA, 12 nt, Human herpesvirus 7
cagucuguaaac

SEQ ID NO: 2150219 - RNA, 16 nt, Human herpesvirus 7
agauuuguuccaaacu

SEQ ID NO: 2150220 - RNA, 16 nt, Human herpesvirus 7
cauuuuguuuugcaau

SEQ ID NO: 2150221 - RNA, 14 nt, Human herpesvirus 7
acagauaaaaauuu

SEQ ID NO: 2150222 - RNA, 21 nt, Human herpesvirus 7
acgcagacuaaucacgagaaa

SEQ ID NO: 2150223 - RNA, 13 nt, Human herpesvirus 7
uuacacugauuuu

SEQ ID NO: 2150224 - RNA, 15 nt, Human herpesvirus 7
acuguuguagguaau

SEQ ID NO: 2150225 - RNA, 22 nt, Human herpesvirus 7
aauaauuuuuuuuugagugugc

SEQ ID NO: 2150226 - RNA, 15 nt, Human herpesvirus 7
gaaaaauguacaaua

SEQ ID NO: 2150227 - RNA, 21 nt, Human herpesvirus 7
aucuugagaaauaugaauuga

SEQ ID NO: 2150228 - RNA, 23 nt, Human herpesvirus 7
gaaucagacuaaauauggagcag

SEQ ID NO: 2150229 - RNA, 14 nt, Human herpesvirus 7
ucuaaaauuuucuu

SEQ ID NO: 2150230 - RNA, 19 nt, Human herpesvirus 7
uguauuaaguguuugcucu

SEQ ID NO: 2150231 - RNA, 23 nt, Human herpesvirus 7
ucuaaaaauguuuuuguuucuga

SEQ ID NO: 2150232 - RNA, 15 nt, Human herpesvirus 7
aaggugguuacauau

SEQ ID NO: 2150233 - RNA, 16 nt, Human herpesvirus 7
gcaugaaaucuugaau

SEQ ID NO: 2150234 - RNA, 19 nt, Human herpesvirus 7
caguuauuucuuauuggag

SEQ ID NO: 2150235 - RNA, 17 nt, Human herpesvirus 7
cuaggucuuccacuguu

SEQ ID NO: 2150236 - RNA, 14 nt, Human herpesvirus 7
auucaaucugcaaa

SEQ ID NO: 2150237 - RNA, 15 nt, Human herpesvirus 7
gauuccaaaccuauc

SEQ ID NO: 2150238 - RNA, 21 nt, Human herpesvirus 7
ucacugggaaguauguuucau

SEQ ID NO: 2150239 - RNA, 21 nt, Human herpesvirus 7
cuacaauuucuggcaauaaag

SEQ ID NO: 2150240 - RNA, 22 nt, Human herpesvirus 7
ugcaguuauuucuuauuggaga

SEQ ID NO: 2150241 - RNA, 20 nt, Human herpesvirus 7
uuucggacacaaauaucacu

SEQ ID NO: 2150242 - RNA, 20 nt, Human herpesvirus 7
uagauacauuauaaauguaa

SEQ ID NO: 2150243 - RNA, 19 nt, Human herpesvirus 7
auggaacugaaaacaaugc

SEQ ID NO: 2150244 - RNA, 13 nt, Human herpesvirus 7
uggaaaacaacau

SEQ ID NO: 2150245 - RNA, 13 nt, Human herpesvirus 7
augucuucaacuu

SEQ ID NO: 2150246 - RNA, 15 nt, Human herpesvirus 7
guuagaauaucugug

SEQ ID NO: 2150247 - RNA, 16 nt, Human herpesvirus 7
gauauuguacuucugu

SEQ ID NO: 2150248 - RNA, 18 nt, Human herpesvirus 7
auauuuaaggcuguaaaa

SEQ ID NO: 2150249 - RNA, 22 nt, Human herpesvirus 7
ccaaaaucaaguguuucuuuga

SEQ ID NO: 2150250 - RNA, 20 nt, Human herpesvirus 7
uugaagauaaguauaaacag

SEQ ID NO: 2150251 - RNA, 13 nt, Human herpesvirus 7
uagagagaaacua

SEQ ID NO: 2150252 - RNA, 17 nt, Human herpesvirus 7
acucgauuagguaauag

SEQ ID NO: 2150253 - RNA, 11 nt, Human herpesvirus 7
uguugaaauug

SEQ ID NO: 2150254 - RNA, 15 nt, Human herpesvirus 7
cagauucuccagaaa

SEQ ID NO: 2150255 - RNA, 22 nt, Human herpesvirus 7
guuaucuuaugucugauucuua

SEQ ID NO: 2150256 - RNA, 23 nt, Human herpesvirus 7
gcaacaaacaaauaauucaaaaa

SEQ ID NO: 2150257 - RNA, 19 nt, Human herpesvirus 7
cuucuagaaacuaaagaaa

SEQ ID NO: 2150258 - RNA, 18 nt, Human herpesvirus 7
gucaggaucuccuggaaa

SEQ ID NO: 2150259 - RNA, 16 nt, Human herpesvirus 7
auugaagauuguuuaa

SEQ ID NO: 2150260 - RNA, 21 nt, Human herpesvirus 7
agcuauuuuuaauaaaaugau

SEQ ID NO: 2150261 - RNA, 15 nt, Human herpesvirus 7
auuguaaauggcaaa

SEQ ID NO: 2150262 - RNA, 21 nt, Human herpesvirus 7
ucuguuaguugggcaaacagu

SEQ ID NO: 2150263 - RNA, 15 nt, Human herpesvirus 7
agcuagccuauaauu

SEQ ID NO: 2150264 - RNA, 12 nt, Human herpesvirus 7
uagagcugaaua

SEQ ID NO: 2150265 - RNA, 23 nt, Human herpesvirus 7
ucaaauuccuccugaaaauuugu

SEQ ID NO: 2150266 - RNA, 22 nt, Human herpesvirus 7
acauuuaaaaaaucugaauaga

SEQ ID NO: 2150267 - RNA, 18 nt, Human herpesvirus 7
auguaaucaaaauuuugg

SEQ ID NO: 2150268 - RNA, 23 nt, Human herpesvirus 7
ugcuuccuaaaaaaaaaggaaaa

SEQ ID NO: 2150269 - RNA, 23 nt, Human herpesvirus 7
aaaccuauccacucuccugaaau

SEQ ID NO: 2150270 - RNA, 17 nt, Human herpesvirus 7
cgcaaggaauaugaaga

SEQ ID NO: 2150271 - RNA, 16 nt, Human herpesvirus 7
aaucuauuucuauuca

SEQ ID NO: 2150272 - RNA, 23 nt, Human herpesvirus 7
cauauuaacaagcacacuaaaaa

SEQ ID NO: 2150273 - RNA, 19 nt, Human herpesvirus 7
cguuggucgagaauacaca

SEQ ID NO: 2150274 - RNA, 17 nt, Human herpesvirus 7
acuaagaaaaaaacaaa

SEQ ID NO: 2150275 - RNA, 13 nt, Human herpesvirus 7
uuuuuaugaagau

SEQ ID NO: 2150276 - RNA, 14 nt, Human herpesvirus 7
uguauacaacuuua

SEQ ID NO: 2150277 - RNA, 16 nt, Human herpesvirus 7
uuaaaguagcugaauu

SEQ ID NO: 2150278 - RNA, 24 nt, Human herpesvirus 7
aagcuaaacuuuuaacuguuaaag

SEQ ID NO: 2150279 - RNA, 17 nt, Human herpesvirus 7
cuccaugcauauuugaa

SEQ ID NO: 2150280 - RNA, 19 nt, Human herpesvirus 7
ccgaagagggacuuuuaua

SEQ ID NO: 2150281 - RNA, 14 nt, Human herpesvirus 7
cgcagacacaaugg

SEQ ID NO: 2150282 - RNA, 15 nt, Human herpesvirus 7
ucgaucuaagagauu

SEQ ID NO: 2150283 - RNA, 18 nt, Human herpesvirus 7
aagcacaaaucaaaacga

SEQ ID NO: 2150284 - RNA, 13 nt, Human herpesvirus 7
uugaucaaaaucu

SEQ ID NO: 2150285 - RNA, 22 nt, Human herpesvirus 7
uuaacgaaacgcuagaaucuug

SEQ ID NO: 2150286 - RNA, 14 nt, Human herpesvirus 7
uuucaaauagaguu

SEQ ID NO: 2150287 - RNA, 14 nt, Human herpesvirus 7
uuccauuucaaaag

SEQ ID NO: 2150288 - RNA, 16 nt, Human herpesvirus 7
aagcauauugaagauc

SEQ ID NO: 2150289 - RNA, 14 nt, Human herpesvirus 7
gugacuuagaaaaa

SEQ ID NO: 2150290 - RNA, 20 nt, Human herpesvirus 7
ccaggaacagauucuccaga

SEQ ID NO: 2150291 - RNA, 19 nt, Human herpesvirus 7
aaucaaccaacauucuugu

SEQ ID NO: 2150292 - RNA, 17 nt, Human herpesvirus 7
aauuuaagagacauuga

SEQ ID NO: 2150293 - RNA, 14 nt, Human herpesvirus 7
aaaguugggaugac

SEQ ID NO: 2150294 - RNA, 19 nt, Human herpesvirus 7
uauuuaaugguuuuaaaau

SEQ ID NO: 2150295 - RNA, 14 nt, Human herpesvirus 7
caaauuaaagcgag

SEQ ID NO: 2150296 - RNA, 20 nt, Human herpesvirus 7
cacuugaauagguaucuuua

SEQ ID NO: 2150297 - RNA, 14 nt, Human herpesvirus 7
acagucugaaagcc

SEQ ID NO: 2150298 - RNA, 19 nt, Human herpesvirus 7
aauuucaaacguaaugcaa

SEQ ID NO: 2150299 - RNA, 19 nt, Human herpesvirus 7
aacugagaaaaaugacaaa

SEQ ID NO: 2150300 - RNA, 16 nt, Human herpesvirus 7
aaguacacguagacug

SEQ ID NO: 2150301 - RNA, 19 nt, Human herpesvirus 7
aacacugcaagcugauuca

SEQ ID NO: 2150302 - RNA, 14 nt, Human herpesvirus 7
aaaucacuuagacu

SEQ ID NO: 2150303 - RNA, 22 nt, Human herpesvirus 7
aaaucguuuuuggcaaaauauc

SEQ ID NO: 2150304 - RNA, 22 nt, Human herpesvirus 7
cgcuguacaaugcugucucuga

SEQ ID NO: 2150305 - RNA, 16 nt, Human herpesvirus 7
augcuuuaacuggaau

SEQ ID NO: 2150306 - RNA, 15 nt, Human herpesvirus 7
caaaaaauucuucua

SEQ ID NO: 2150307 - RNA, 16 nt, Human herpesvirus 7
caaaucugauaaauua

SEQ ID NO: 2150308 - RNA, 21 nt, Human herpesvirus 7
caaauaaacguccauugauua

SEQ ID NO: 2150309 - RNA, 16 nt, Human herpesvirus 7
cauugcuucagaaaua

SEQ ID NO: 2150310 - RNA, 22 nt, Human herpesvirus 7
cauuucaagaaggaaaauuuca

SEQ ID NO: 2150311 - RNA, 13 nt, Human herpesvirus 7
ccauaaaugcuua

SEQ ID NO: 2150312 - RNA, 20 nt, Human herpesvirus 7
cagaaauuauacuagcagau

SEQ ID NO: 2150313 - RNA, 22 nt, Human herpesvirus 7
cacuguuguagguaauuucuua

SEQ ID NO: 2150314 - RNA, 22 nt, Human herpesvirus 7
cuaagguuuaggaaauugcuuu

SEQ ID NO: 2150315 - RNA, 19 nt, Human herpesvirus 7
agaagcuugcuagauucua

SEQ ID NO: 2150316 - RNA, 20 nt, Human herpesvirus 7
agaaucauuuguauauucua

SEQ ID NO: 2150317 - RNA, 15 nt, Human herpesvirus 7
caccgugagaaauuu

SEQ ID NO: 2150318 - RNA, 12 nt, Human herpesvirus 7
aagaauuuggau

SEQ ID NO: 2150319 - RNA, 13 nt, Human herpesvirus 7
aagaacugugaag

SEQ ID NO: 2150320 - RNA, 22 nt, Human herpesvirus 7
aacugugcaugaaaucuugaau

SEQ ID NO: 2150321 - RNA, 17 nt, Human herpesvirus 7
aacugagaaaaaugaca

SEQ ID NO: 2150322 - RNA, 17 nt, Human herpesvirus 7
aacuaaaacuacauuua

SEQ ID NO: 2150323 - RNA, 15 nt, Human herpesvirus 7
aacuagaaaauaacu

SEQ ID NO: 2150324 - RNA, 16 nt, Human herpesvirus 7
aacucuuccuguuaau

SEQ ID NO: 2150325 - RNA, 17 nt, Human herpesvirus 7
aucuaugugcucugaau

SEQ ID NO: 2150326 - RNA, 16 nt, Human herpesvirus 7
cagucccagauaauua

SEQ ID NO: 2150327 - RNA, 16 nt, Human herpesvirus 7
cgacauuauaaaagau

SEQ ID NO: 2150328 - RNA, 12 nt, Human herpesvirus 7
cggaucuucauu

SEQ ID NO: 2150329 - RNA, 13 nt, Human herpesvirus 7
guaauuauuggau

SEQ ID NO: 2150330 - RNA, 18 nt, Human herpesvirus 7
gcucauuucaucauccga

SEQ ID NO: 2150331 - RNA, 22 nt, Human herpesvirus 7
gcgaaaaacacuuuaaccgcaa

SEQ ID NO: 2150332 - RNA, 20 nt, Human herpesvirus 7
gccaaaucuaauuuaugaua

SEQ ID NO: 2150333 - RNA, 18 nt, Human herpesvirus 7
gcauuauuggauaauauc

SEQ ID NO: 2150334 - RNA, 20 nt, Human herpesvirus 7
gaccucgacauucuccagug

SEQ ID NO: 2150335 - RNA, 14 nt, Human herpesvirus 7
gcagacaccgucau

SEQ ID NO: 2150336 - RNA, 18 nt, Human herpesvirus 7
uuugacaaucuuggcauu

SEQ ID NO: 2150337 - RNA, 20 nt, Human herpesvirus 7
uuuccaucuaccgcgaugaa

SEQ ID NO: 2150338 - RNA, 17 nt, Human herpesvirus 7
gcaauaugcuagaagac

SEQ ID NO: 2150339 - RNA, 16 nt, Human herpesvirus 7
gcaaauuaaaaauauu

SEQ ID NO: 2150340 - RNA, 23 nt, Human herpesvirus 7
gauuauaugcaucaaaacauauc

SEQ ID NO: 2150341 - RNA, 18 nt, Human herpesvirus 7
cagauucuccagaaauua

SEQ ID NO: 2150342 - RNA, 15 nt, Human herpesvirus 7
cacguccaagaaaua

SEQ ID NO: 2150343 - RNA, 16 nt, Human herpesvirus 7
acuauucgaaaauauc

SEQ ID NO: 2150344 - RNA, 18 nt, Human herpesvirus 7
uucgcuaacuuugcuauu

SEQ ID NO: 2150345 - RNA, 22 nt, Human herpesvirus 7
ucuuuauaaaggaccaugggaa

SEQ ID NO: 2150346 - RNA, 15 nt, Human herpesvirus 7
ucuauuacacaggaa

SEQ ID NO: 2150347 - RNA, 15 nt, Human herpesvirus 7
uauccaguacgucuu

SEQ ID NO: 2150348 - RNA, 18 nt, Human herpesvirus 7
guaugguuucauuuggaa

SEQ ID NO: 2150349 - RNA, 22 nt, Human herpesvirus 7
gacuaaucacgagaaaaauauu

SEQ ID NO: 2150350 - RNA, 16 nt, Human herpesvirus 7
cggugaauguagaagu

SEQ ID NO: 2150351 - RNA, 23 nt, Human herpesvirus 7
gacauuucaagaaggaaaauuuc

SEQ ID NO: 2150352 - RNA, 23 nt, Human herpesvirus 7
aaaaagauuuaauaacaauuuga

SEQ ID NO: 2150353 - RNA, 20 nt, Human herpesvirus 7
ccauuguguuaaaaauauca

SEQ ID NO: 2150354 - RNA, 15 nt, Human herpesvirus 7
caaucccagaaauuu

SEQ ID NO: 2150355 - RNA, 18 nt, Human herpesvirus 7
caauuguuaguuaugacg

SEQ ID NO: 2150356 - RNA, 15 nt, Human herpesvirus 7
auauagaaauuguua

SEQ ID NO: 2150357 - RNA, 16 nt, Human herpesvirus 7
aaguguuucuuugaau

SEQ ID NO: 2150358 - RNA, 16 nt, Human herpesvirus 7
aauaucccagaauauc

SEQ ID NO: 2150359 - RNA, 14 nt, Human herpesvirus 7
aauaucucugugau

SEQ ID NO: 2150360 - RNA, 17 nt, Human herpesvirus 7
acacguagacugagacg

SEQ ID NO: 2150361 - RNA, 16 nt, Human herpesvirus 7
aaucaacaaaaugaca

SEQ ID NO: 2150362 - RNA, 16 nt, Human herpesvirus 7
aauauaaaaaauuuga

SEQ ID NO: 2150363 - RNA, 22 nt, Human herpesvirus 7
aauccaaguuuuacagaaauug

SEQ ID NO: 2150364 - RNA, 20 nt, Human herpesvirus 7
acacuauuggacaaaagacu

SEQ ID NO: 2150365 - RNA, 14 nt, Human herpesvirus 7
acauuuaaaaaauc

SEQ ID NO: 2150366 - RNA, 19 nt, Human herpesvirus 7
acauuucauuccaaaauac

SEQ ID NO: 2150367 - RNA, 16 nt, Human herpesvirus 7
acauucagaaaaaauc

SEQ ID NO: 2150368 - RNA, 13 nt, Human herpesvirus 7
acauaaaaauuuc

SEQ ID NO: 2150369 - RNA, 20 nt, Human herpesvirus 7
acauaaagguaaaaauuuga

SEQ ID NO: 2150370 - RNA, 17 nt, Human herpesvirus 7
acauacgugcuuagacu

SEQ ID NO: 2150371 - RNA, 12 nt, Human herpesvirus 7
acagcugagacg

SEQ ID NO: 2150372 - RNA, 15 nt, Human herpesvirus 7
cuauuuaaaauauua

SEQ ID NO: 2150373 - RNA, 18 nt, Human herpesvirus 7
ucaauuaaugcauuggaa

SEQ ID NO: 2150374 - RNA, 16 nt, Human herpesvirus 7
uaucuuuucaaaggaa

SEQ ID NO: 2150375 - RNA, 16 nt, Human herpesvirus 7
uauuuagagucgucuu

SEQ ID NO: 2150376 - RNA, 14 nt, Human herpesvirus 7
gucauaaaauuauc

SEQ ID NO: 2150377 - RNA, 20 nt, Human herpesvirus 7
gacaaucuauauaaaauauc

SEQ ID NO: 2150378 - RNA, 20 nt, Human herpesvirus 7
gaauuuuacaaugcagccua

SEQ ID NO: 2150379 - RNA, 17 nt, Human herpesvirus 7
gaauuaauaaaaguauc

SEQ ID NO: 2150380 - RNA, 16 nt, Human herpesvirus 7
gaaucauuuauuugau

SEQ ID NO: 2150381 - RNA, 18 nt, Human herpesvirus 7
gaaucuauuuaaaauauu

SEQ ID NO: 2150382 - RNA, 15 nt, Human herpesvirus 7
gaaagugaaaauauu

SEQ ID NO: 2150383 - RNA, 17 nt, Human herpesvirus 7
gaaauucgcaaaauuuc

SEQ ID NO: 2150384 - RNA, 16 nt, Human herpesvirus 7
gaaauuucaaaaauuc

SEQ ID NO: 2150385 - RNA, 13 nt, Human herpesvirus 7
gccaauaaaaauc

SEQ ID NO: 2150386 - RNA, 17 nt, Human herpesvirus 7
cauauuagaauugggau

SEQ ID NO: 2150387 - RNA, 15 nt, Human herpesvirus 7
cauagcuagaaauug

SEQ ID NO: 2150388 - RNA, 14 nt, Human herpesvirus 7
caucgaagaaauuc

SEQ ID NO: 2150389 - RNA, 12 nt, Human herpesvirus 7
auaacugugaaa

SEQ ID NO: 2150390 - RNA, 14 nt, Human herpesvirus 7
aauuaacagcucua

SEQ ID NO: 2150391 - RNA, 21 nt, Human herpesvirus 7
acaaauaauucaaaaacuauc

SEQ ID NO: 2150392 - RNA, 21 nt, Human herpesvirus 7
acaaauaccaugaaaaauaug

SEQ ID NO: 2150393 - RNA, 14 nt, Human herpesvirus 7
aauuccugcuugca

SEQ ID NO: 2150394 - RNA, 22 nt, Human herpesvirus 7
aauucuguggagugagaaauua

SEQ ID NO: 2150395 - RNA, 13 nt, Human herpesvirus 7
aauugagaaauuu

SEQ ID NO: 2150396 - RNA, 18 nt, Human herpesvirus 7
acccaugggcacauuugu

SEQ ID NO: 2150397 - RNA, 21 nt, Human herpesvirus 7
aguuuuacuuuugagcgcuga

SEQ ID NO: 2150398 - RNA, 21 nt, Human herpesvirus 7
aaccuguacucgacucugaau

SEQ ID NO: 2150399 - RNA, 18 nt, Human herpesvirus 7
aaccaguuuuacuuuuga

SEQ ID NO: 2150400 - RNA, 19 nt, Human herpesvirus 7
aacauuaauaucaauuuga

SEQ ID NO: 2150401 - RNA, 23 nt, Human herpesvirus 7
aacauuccucauggccagugaau

SEQ ID NO: 2150402 - RNA, 17 nt, Human herpesvirus 7
aacccacuaacauuuua

SEQ ID NO: 2150403 - RNA, 18 nt, Human herpesvirus 7
gagauuucugaaaaucuc

SEQ ID NO: 2150404 - RNA, 14 nt, Human herpesvirus 7
gauaaaauuuggag

SEQ ID NO: 2150405 - RNA, 16 nt, Human herpesvirus 7
gauaucuuaaaauaug

SEQ ID NO: 2150406 - RNA, 22 nt, Human herpesvirus 8 [Kaposi`s sarcoma-associated h
cagaagagcauuuuucccuccu

SEQ ID NO: 2150407 - RNA, 18 nt, Human herpesvirus 8 [Kaposi`s sarcoma-associated h
cccaauuaauuggagcuc

SEQ ID NO: 2150408 - RNA, 22 nt, Human herpesvirus 8 [Kaposi`s sarcoma-associated h
agacauucguaagaggacccag

SEQ ID NO: 2150409 - RNA, 14 nt, Human herpesvirus 8 [Kaposi`s sarcoma-associated h
ugugaaguuuacau

SEQ ID NO: 2150410 - RNA, 20 nt, Human herpesvirus 8 [Kaposi`s sarcoma-associated h
aggaucugugugugaagcag

SEQ ID NO: 2150411 - RNA, 16 nt, Human herpesvirus 8 [Kaposi`s sarcoma-associated h
caucccgccugcgguc

SEQ ID NO: 2150412 - RNA, 22 nt, Human herpesvirus 8 [Kaposi`s sarcoma-associated h
cggcccaccgcguguucgaggg

SEQ ID NO: 2150413 - RNA, 16 nt, Human herpesvirus 8 [Kaposi`s sarcoma-associated h
accgugggaacuguga

SEQ ID NO: 2150414 - RNA, 15 nt, Human herpesvirus 8 [Kaposi`s sarcoma-associated h
cgggagaaccaugcc

SEQ ID NO: 2150415 - RNA, 14 nt, Human herpesvirus 8 [Kaposi`s sarcoma-associated h
guggauuuuaugga

SEQ ID NO: 2150416 - RNA, 14 nt, Human herpesvirus 8 [Kaposi`s sarcoma-associated h
caugaugcagagag

SEQ ID NO: 2150417 - RNA, 17 nt, Human herpesvirus 8 [Kaposi`s sarcoma-associated h
ccaguauuaugccaggg

SEQ ID NO: 2150418 - RNA, 14 nt, Human herpesvirus 8 [Kaposi`s sarcoma-associated h
cuuugcagccaggu

SEQ ID NO: 2150419 - RNA, 12 nt, Human herpesvirus 8 [Kaposi`s sarcoma-associated h
cgccccucuugg

SEQ ID NO: 2150420 - RNA, 18 nt, Human herpesvirus 8 [Kaposi`s sarcoma-associated h
cagaguuuuaugggcuca

SEQ ID NO: 2150421 - RNA, 13 nt, Human herpesvirus 8 [Kaposi`s sarcoma-associated h
cggacggagccgg

SEQ ID NO: 2150422 - RNA, 19 nt, Human herpesvirus 8 [Kaposi`s sarcoma-associated h
cugcucuaaauagaacagg

SEQ ID NO: 2150423 - RNA, 15 nt, Human herpesvirus 8 [Kaposi`s sarcoma-associated h
gcaugguugcaacag

SEQ ID NO: 2150424 - RNA, 21 nt, Human herpesvirus 8 [Kaposi`s sarcoma-associated h
cgugccuucgaggccaggccc

SEQ ID NO: 2150425 - RNA, 14 nt, Human herpesvirus 8 [Kaposi`s sarcoma-associated h
gucuaccugccgga

SEQ ID NO: 2150426 - RNA, 17 nt, Human herpesvirus 8 [Kaposi`s sarcoma-associated h
ccagugccucagcaacu

SEQ ID NO: 2150427 - RNA, 18 nt, Human herpesvirus 8 [Kaposi`s sarcoma-associated h
cuagcguacaugugacug

SEQ ID NO: 2150428 - RNA, 15 nt, Human herpesvirus 8 [Kaposi`s sarcoma-associated h
ccacaaaacugccaa

SEQ ID NO: 2150429 - RNA, 11 nt, Human herpesvirus 8 [Kaposi`s sarcoma-associated h
cgauguccuga

SEQ ID NO: 2150430 - RNA, 15 nt, Human herpesvirus 8 [Kaposi`s sarcoma-associated h
cgucagcagcaagca

SEQ ID NO: 2150431 - RNA, 22 nt, Human herpesvirus 8 [Kaposi`s sarcoma-associated h
accucgggccuugggugcgaug

SEQ ID NO: 2150432 - RNA, 22 nt, Human herpesvirus 8 [Kaposi`s sarcoma-associated h
agccugcaguguggggauuaug

SEQ ID NO: 2150433 - RNA, 17 nt, Human herpesvirus 8 [Kaposi`s sarcoma-associated h
ugaaugugaucacggag

SEQ ID NO: 2150434 - RNA, 13 nt, Human herpesvirus 8 [Kaposi`s sarcoma-associated h
gacucucaagcag

SEQ ID NO: 2150435 - RNA, 21 nt, Human herpesvirus 8 [Kaposi`s sarcoma-associated h
gggugacaccuuucagacguc

SEQ ID NO: 2150436 - RNA, 13 nt, Human herpesvirus 8 [Kaposi`s sarcoma-associated h
aggagggcagcug

SEQ ID NO: 2150437 - RNA, 14 nt, Human herpesvirus 8 [Kaposi`s sarcoma-associated h
gauuuuccagggac

SEQ ID NO: 2150438 - RNA, 18 nt, Human herpesvirus 8 [Kaposi`s sarcoma-associated h
aucuuagucuuacuguca

SEQ ID NO: 2150439 - RNA, 19 nt, Human herpesvirus 8 [Kaposi`s sarcoma-associated h
gcaaggagcagccugcagg

SEQ ID NO: 2150440 - RNA, 20 nt, Human herpesvirus 8 [Kaposi`s sarcoma-associated h
cgccaacuguccccucggag

SEQ ID NO: 2150441 - RNA, 22 nt, Human herpesvirus 8 [Kaposi`s sarcoma-associated h
cacauacacuagacuggcucug

SEQ ID NO: 2150442 - RNA, 20 nt, Human herpesvirus 8 [Kaposi`s sarcoma-associated h
ugguggacggcuccguccug

SEQ ID NO: 2150443 - RNA, 15 nt, Human herpesvirus 8 [Kaposi`s sarcoma-associated h
caaaccccauggcag

SEQ ID NO: 2150444 - RNA, 21 nt, Human herpesvirus 8 [Kaposi`s sarcoma-associated h
cggguugggucgcugcaccug

SEQ ID NO: 2150445 - RNA, 22 nt, Human herpesvirus 8 [Kaposi`s sarcoma-associated h
uggcgcggaaacugggcacgga

SEQ ID NO: 2150446 - RNA, 18 nt, Human herpesvirus 8 [Kaposi`s sarcoma-associated h
uccugugauuucucugug

SEQ ID NO: 2150447 - RNA, 15 nt, Human herpesvirus 8 [Kaposi`s sarcoma-associated h
gcagcgccaguggau

SEQ ID NO: 2150448 - RNA, 13 nt, Human herpesvirus 8 [Kaposi`s sarcoma-associated h
gaauggugucaau

SEQ ID NO: 2150449 - RNA, 17 nt, Human herpesvirus 8 [Kaposi`s sarcoma-associated h
cugucagauuucucuau

SEQ ID NO: 2150450 - RNA, 17 nt, Human herpesvirus 8 [Kaposi`s sarcoma-associated h
cuugauaaucuccugga

SEQ ID NO: 2150451 - RNA, 18 nt, Human herpesvirus 8 [Kaposi`s sarcoma-associated h
uguacauggagggaaugg

SEQ ID NO: 2150452 - RNA, 21 nt, Human herpesvirus 8 [Kaposi`s sarcoma-associated h
aagucguguaagaacauugga

SEQ ID NO: 2150453 - RNA, 14 nt, Human herpesvirus 8 [Kaposi`s sarcoma-associated h
cggcgagcccgugu

SEQ ID NO: 2150454 - RNA, 19 nt, Human herpesvirus 8 [Kaposi`s sarcoma-associated h
acggaggauccuagguggg

SEQ ID NO: 2150455 - RNA, 21 nt, Human herpesvirus 8 [Kaposi`s sarcoma-associated h
uaaacagccuuggugcuaggc

SEQ ID NO: 2150456 - RNA, 21 nt, Human herpesvirus 8 [Kaposi`s sarcoma-associated h
ggcuugcacgccaacccucag

SEQ ID NO: 2150457 - RNA, 23 nt, Human herpesvirus 8 [Kaposi`s sarcoma-associated h
uggcaccugaggugcucuuccca

SEQ ID NO: 2150458 - RNA, 23 nt, Human herpesvirus 8 [Kaposi`s sarcoma-associated h
ucaaggucuuuaacgccugcacc

SEQ ID NO: 2150459 - RNA, 16 nt, Human herpesvirus 8 [Kaposi`s sarcoma-associated h
acagucgagccgccag

SEQ ID NO: 2150460 - RNA, 18 nt, Human herpesvirus 8 [Kaposi`s sarcoma-associated h
agcacgaagacaugguga

SEQ ID NO: 2150461 - RNA, 21 nt, Human herpesvirus 8 [Kaposi`s sarcoma-associated h
ugugggaaacguguccugcca

SEQ ID NO: 2150462 - RNA, 15 nt, Human herpesvirus 8 [Kaposi`s sarcoma-associated h
acacacacaaagaca

SEQ ID NO: 2150463 - RNA, 14 nt, Human herpesvirus 8 [Kaposi`s sarcoma-associated h
auuauugcaccauu

SEQ ID NO: 2150464 - RNA, 22 nt, Human herpesvirus 8 [Kaposi`s sarcoma-associated h
agcguagaugaaugucucaaac

SEQ ID NO: 2150465 - RNA, 20 nt, Human herpesvirus 8 [Kaposi`s sarcoma-associated h
caugcaggcaguccaagguc

SEQ ID NO: 2150466 - RNA, 12 nt, Human herpesvirus 8 [Kaposi`s sarcoma-associated h
auaaaacaggaa

SEQ ID NO: 2150467 - RNA, 17 nt, Human herpesvirus 8 [Kaposi`s sarcoma-associated h
cagaguccgccaucacc

SEQ ID NO: 2150468 - RNA, 21 nt, Human herpesvirus 8 [Kaposi`s sarcoma-associated h
cgccgaggacacgccaucgcc

SEQ ID NO: 2150469 - RNA, 17 nt, Human herpesvirus 8 [Kaposi`s sarcoma-associated h
gaaccagaaucaguggu

SEQ ID NO: 2150470 - RNA, 17 nt, Human herpesvirus 8 [Kaposi`s sarcoma-associated h
cagccggucgccagggu

SEQ ID NO: 2150471 - RNA, 14 nt, Human herpesvirus 8 [Kaposi`s sarcoma-associated h
uucauuuguguaua

SEQ ID NO: 2150472 - RNA, 20 nt, Human herpesvirus 8 [Kaposi`s sarcoma-associated h
guccaaagcuuacgaggaca

SEQ ID NO: 2150473 - RNA, 19 nt, Human herpesvirus 8 [Kaposi`s sarcoma-associated h
gcggaagauugguguccag

SEQ ID NO: 2150474 - RNA, 12 nt, Human herpesvirus 8 [Kaposi`s sarcoma-associated h
ggacagcuuuca

SEQ ID NO: 2150475 - RNA, 20 nt, Human herpesvirus 8 [Kaposi`s sarcoma-associated h
acucacugggggucucggga

SEQ ID NO: 2150476 - RNA, 11 nt, Human herpesvirus 8 [Kaposi`s sarcoma-associated h
gcguugugaag

SEQ ID NO: 2150477 - RNA, 16 nt, Human herpesvirus 8 [Kaposi`s sarcoma-associated h
aucaggagggucaaug

SEQ ID NO: 2150478 - RNA, 15 nt, Human herpesvirus 8 [Kaposi`s sarcoma-associated h
cauuuccacccaccu

SEQ ID NO: 2150479 - RNA, 19 nt, Human herpesvirus 8 [Kaposi`s sarcoma-associated h
gccauggcagcccagccuc

SEQ ID NO: 2150480 - RNA, 19 nt, Human herpesvirus 8 [Kaposi`s sarcoma-associated h
augucuguguuuuguaaac

SEQ ID NO: 2150481 - RNA, 19 nt, Human herpesvirus 8 [Kaposi`s sarcoma-associated h
augaccaacaggcuguccu

SEQ ID NO: 2150482 - RNA, 16 nt, Human herpesvirus 8 [Kaposi`s sarcoma-associated h
ggccaggcaccuguug

SEQ ID NO: 2150483 - RNA, 17 nt, Human herpesvirus 8 [Kaposi`s sarcoma-associated h
cguccaguucccccaca

SEQ ID NO: 2150484 - RNA, 18 nt, Human herpesvirus 8 [Kaposi`s sarcoma-associated h
gcaugugucugugcccug

SEQ ID NO: 2150485 - RNA, 22 nt, Human herpesvirus 8 [Kaposi`s sarcoma-associated h
cugcaaaauaaagucugagugg

SEQ ID NO: 2150486 - RNA, 22 nt, Human herpesvirus 8 [Kaposi`s sarcoma-associated h
augccuacaccguauuguuaug

SEQ ID NO: 2150487 - RNA, 13 nt, Human herpesvirus 8 [Kaposi`s sarcoma-associated h
uuuacuugcagca

SEQ ID NO: 2150488 - RNA, 14 nt, Human herpesvirus 8 [Kaposi`s sarcoma-associated h
gagcucugcugccu

SEQ ID NO: 2150489 - RNA, 21 nt, Human herpesvirus 8 [Kaposi`s sarcoma-associated h
gaaaacagucuguaaagaaag

SEQ ID NO: 2150490 - RNA, 13 nt, Human herpesvirus 8 [Kaposi`s sarcoma-associated h
caccuucuggcuu

SEQ ID NO: 2150491 - RNA, 16 nt, Human herpesvirus 8 [Kaposi`s sarcoma-associated h
cuagacuggcucugau

SEQ ID NO: 2150492 - RNA, 19 nt, Human herpesvirus 8 [Kaposi`s sarcoma-associated h
cucaagcaacaugcccuuu

SEQ ID NO: 2150493 - RNA, 18 nt, Human herpesvirus 8 [Kaposi`s sarcoma-associated h
gcugucccgugcccaggc

SEQ ID NO: 2150494 - RNA, 13 nt, Human herpesvirus 8 [Kaposi`s sarcoma-associated h
cucucacacccug

SEQ ID NO: 2150495 - RNA, 13 nt, Human herpesvirus 8 [Kaposi`s sarcoma-associated h
ucuguuacuggca

SEQ ID NO: 2150496 - RNA, 19 nt, Human herpesvirus 8 [Kaposi`s sarcoma-associated h
ccucccaacauguaaauug

SEQ ID NO: 2150497 - RNA, 23 nt, Human herpesvirus 8 [Kaposi`s sarcoma-associated h
aguugccugugggguuucuggga

SEQ ID NO: 2150498 - RNA, 20 nt, Human herpesvirus 8 [Kaposi`s sarcoma-associated h
caccaagguaggccagcugc

SEQ ID NO: 2150499 - RNA, 14 nt, Human herpesvirus 8 [Kaposi`s sarcoma-associated h
aacugcgucaugua

SEQ ID NO: 2150500 - RNA, 22 nt, Human herpesvirus 8 [Kaposi`s sarcoma-associated h
ucauccuaggugacugggagau

SEQ ID NO: 2150501 - RNA, 22 nt, Human herpesvirus 8 [Kaposi`s sarcoma-associated h
gcccacuauuaugccgaacagg

SEQ ID NO: 2150502 - RNA, 12 nt, Human herpesvirus 8 [Kaposi`s sarcoma-associated h
aauguuuugguc

SEQ ID NO: 2150503 - RNA, 21 nt, Human herpesvirus 8 [Kaposi`s sarcoma-associated h
ccgagaaacacugugaggcaa

SEQ ID NO: 2150504 - RNA, 12 nt, Human herpesvirus 8 [Kaposi`s sarcoma-associated h
gaggauggugcu

SEQ ID NO: 2150505 - RNA, 16 nt, Human herpesvirus 8 [Kaposi`s sarcoma-associated h
uccugucuaaaaucag

SEQ ID NO: 2150506 - RNA, 20 nt, Human herpesvirus 8 [Kaposi`s sarcoma-associated h
gccgcaaucaugccugugga

SEQ ID NO: 2150507 - RNA, 23 nt, Human herpesvirus 8 [Kaposi`s sarcoma-associated h
gagccgcgcuuuuuaacuucuga

SEQ ID NO: 2150508 - RNA, 20 nt, Human herpesvirus 8 [Kaposi`s sarcoma-associated h
caugucuguccggacauuuu

SEQ ID NO: 2150509 - RNA, 16 nt, Human herpesvirus 8 [Kaposi`s sarcoma-associated h
cguuuuuuuauuuggg

SEQ ID NO: 2150510 - RNA, 22 nt, Human herpesvirus 8 [Kaposi`s sarcoma-associated h
cgauguccugauuuuccaggga

SEQ ID NO: 2150511 - RNA, 20 nt, Human herpesvirus 8 [Kaposi`s sarcoma-associated h
gaauuguuauccggcagcaa

SEQ ID NO: 2150512 - RNA, 16 nt, Human herpesvirus 8 [Kaposi`s sarcoma-associated h
aucuaucucugguggu

SEQ ID NO: 2150513 - RNA, 19 nt, Human herpesvirus 8 [Kaposi`s sarcoma-associated h
caaccgucuccgccaggga

SEQ ID NO: 2150514 - RNA, 15 nt, Human herpesvirus 8 [Kaposi`s sarcoma-associated h
aagucucuuggacaa

SEQ ID NO: 2150515 - RNA, 14 nt, Human herpesvirus 8 [Kaposi`s sarcoma-associated h
cguaggcgaagaga

SEQ ID NO: 2150516 - RNA, 14 nt, Human herpesvirus 8 [Kaposi`s sarcoma-associated h
ucccacgugcacca

SEQ ID NO: 2150517 - RNA, 22 nt, Human herpesvirus 8 [Kaposi`s sarcoma-associated h
aacccgcccucgggacuucugg

SEQ ID NO: 2150518 - RNA, 11 nt, Human herpesvirus 8 [Kaposi`s sarcoma-associated h
accugcacucc

SEQ ID NO: 2150519 - RNA, 18 nt, Human herpesvirus 8 [Kaposi`s sarcoma-associated h
ccaccgcaacggcggugu

SEQ ID NO: 2150520 - RNA, 21 nt, Human herpesvirus 8 [Kaposi`s sarcoma-associated h
uuggacuagagcgacugcugg

SEQ ID NO: 2150521 - RNA, 17 nt, Human herpesvirus 8 [Kaposi`s sarcoma-associated h
cuauugcaacugaccau

SEQ ID NO: 2150522 - RNA, 21 nt, Human herpesvirus 8 [Kaposi`s sarcoma-associated h
acaggaagcggguuggacugg

SEQ ID NO: 2150523 - RNA, 20 nt, Human herpesvirus 8 [Kaposi`s sarcoma-associated h
ggacuuucuccgugagaugg

SEQ ID NO: 2150524 - RNA, 20 nt, Human herpesvirus 8 [Kaposi`s sarcoma-associated h
gaguccaaccuggcaagcag

SEQ ID NO: 2150525 - RNA, 15 nt, Human herpesvirus 8 [Kaposi`s sarcoma-associated h
gccuugggugcgaug

SEQ ID NO: 2150526 - RNA, 13 nt, Human herpesvirus 8 [Kaposi`s sarcoma-associated h
cgauuacaggaaa

SEQ ID NO: 2150527 - RNA, 13 nt, Human herpesvirus 8 [Kaposi`s sarcoma-associated h
cugguaccagaga

SEQ ID NO: 2150528 - RNA, 18 nt, Human herpesvirus 8 [Kaposi`s sarcoma-associated h
accgucgcacccggccgc

SEQ ID NO: 2150529 - RNA, 16 nt, Human herpesvirus 8 [Kaposi`s sarcoma-associated h
aaaaugggccaugaca

SEQ ID NO: 2150530 - RNA, 18 nt, Human herpesvirus 8 [Kaposi`s sarcoma-associated h
gacaccaccgucuggcug

SEQ ID NO: 2150531 - RNA, 20 nt, Human herpesvirus 8 [Kaposi`s sarcoma-associated h
uuguauaaccgugcuacuua

SEQ ID NO: 2150532 - RNA, 13 nt, Human herpesvirus 8 [Kaposi`s sarcoma-associated h
ggcggggcggcug

SEQ ID NO: 2150533 - RNA, 22 nt, Human herpesvirus 8 [Kaposi`s sarcoma-associated h
cucuaucagcugcagccaggaa

SEQ ID NO: 2150534 - RNA, 21 nt, Human herpesvirus 8 [Kaposi`s sarcoma-associated h
augucuuuccgugucuccuug

SEQ ID NO: 2150535 - RNA, 18 nt, Human herpesvirus 8 [Kaposi`s sarcoma-associated h
uccacccauccuccucag

SEQ ID NO: 2150536 - RNA, 16 nt, Human herpesvirus 8 [Kaposi`s sarcoma-associated h
ugaggccaauggauuc

SEQ ID NO: 2150537 - RNA, 17 nt, Human herpesvirus 8 [Kaposi`s sarcoma-associated h
agagcguagaugaaugu

SEQ ID NO: 2150538 - RNA, 17 nt, Human herpesvirus 8 [Kaposi`s sarcoma-associated h
ggcucaucggacaggac

SEQ ID NO: 2150539 - RNA, 19 nt, Human herpesvirus 8 [Kaposi`s sarcoma-associated h
acauaauccccggcagcac

SEQ ID NO: 2150540 - RNA, 19 nt, Human herpesvirus 8 [Kaposi`s sarcoma-associated h
cauggcuuacaacuauuuc

SEQ ID NO: 2150541 - RNA, 15 nt, Human herpesvirus 8 [Kaposi`s sarcoma-associated h
cagcuacgcacugag

SEQ ID NO: 2150542 - RNA, 21 nt, Human herpesvirus 8 [Kaposi`s sarcoma-associated h
ugcaugcaauacccuguuuca

SEQ ID NO: 2150543 - RNA, 17 nt, Human herpesvirus 8 [Kaposi`s sarcoma-associated h
uccacccuaauacauaa

SEQ ID NO: 2150544 - RNA, 17 nt, Human herpesvirus 8 [Kaposi`s sarcoma-associated h
gacagaguuguggaccu

SEQ ID NO: 2150545 - RNA, 20 nt, Human herpesvirus 8 [Kaposi`s sarcoma-associated h
ggacacuaaaagucuggccc

SEQ ID NO: 2150546 - RNA, 20 nt, Human herpesvirus 8 [Kaposi`s sarcoma-associated h
uaggaaacacggcccgccuc

SEQ ID NO: 2150547 - RNA, 11 nt, Human herpesvirus 8 [Kaposi`s sarcoma-associated h
uggcaugcugg

SEQ ID NO: 2150548 - RNA, 22 nt, Human herpesvirus 8 [Kaposi`s sarcoma-associated h
aggagaaaucccauuugauaua

SEQ ID NO: 2150549 - RNA, 16 nt, Human herpesvirus 8 [Kaposi`s sarcoma-associated h
caccucuacagagggc

SEQ ID NO: 2150550 - RNA, 16 nt, Human herpesvirus 8 [Kaposi`s sarcoma-associated h
ggaagucgguggggau

SEQ ID NO: 2150551 - RNA, 18 nt, Human herpesvirus 8 [Kaposi`s sarcoma-associated h
uggccggcacgcgguguc

SEQ ID NO: 2150552 - RNA, 14 nt, Human herpesvirus 8 [Kaposi`s sarcoma-associated h
aaagcugagccaca

SEQ ID NO: 2150553 - RNA, 17 nt, Human herpesvirus 8 [Kaposi`s sarcoma-associated h
guuaagcuuugcagcca

SEQ ID NO: 2150554 - RNA, 18 nt, Human herpesvirus 8 [Kaposi`s sarcoma-associated h
guguuuuuugccauggua

SEQ ID NO: 2150555 - RNA, 13 nt, Human herpesvirus 8 [Kaposi`s sarcoma-associated h
auaacagcaacau

SEQ ID NO: 2150556 - RNA, 14 nt, Human herpesvirus 8 [Kaposi`s sarcoma-associated h
agacacgcaaagua

SEQ ID NO: 2150557 - RNA, 20 nt, Human herpesvirus 8 [Kaposi`s sarcoma-associated h
gaacugucgagacaugucac

SEQ ID NO: 2150558 - RNA, 24 nt, Human herpesvirus 8 [Kaposi`s sarcoma-associated h
acuauagugcgcgguguggcagaa

SEQ ID NO: 2150559 - RNA, 19 nt, Human herpesvirus 8 [Kaposi`s sarcoma-associated h
cuaggaggaagagcacugu

SEQ ID NO: 2150560 - RNA, 22 nt, Human herpesvirus 8 [Kaposi`s sarcoma-associated h
ugcaacccucuacucuuccggg

SEQ ID NO: 2150561 - RNA, 17 nt, Human herpesvirus 8 [Kaposi`s sarcoma-associated h
auguguguaacuuuuuc

SEQ ID NO: 2150562 - RNA, 18 nt, Human herpesvirus 8 [Kaposi`s sarcoma-associated h
cugucaaccuccuccggg

SEQ ID NO: 2150563 - RNA, 21 nt, Human herpesvirus 8 [Kaposi`s sarcoma-associated h
uacuagugagcccggaggagg

SEQ ID NO: 2150564 - RNA, 19 nt, Human herpesvirus 8 [Kaposi`s sarcoma-associated h
cgcacccggccgcugcguc

SEQ ID NO: 2150565 - RNA, 16 nt, Human herpesvirus 8 [Kaposi`s sarcoma-associated h
gcacuccuguuagcac

SEQ ID NO: 2150566 - RNA, 17 nt, Human herpesvirus 8 [Kaposi`s sarcoma-associated h
aacuguuuacugcuguu

SEQ ID NO: 2150567 - RNA, 13 nt, Human herpesvirus 8 [Kaposi`s sarcoma-associated h
ugugugaagcagu

SEQ ID NO: 2150568 - RNA, 15 nt, Human herpesvirus 8 [Kaposi`s sarcoma-associated h
acagguaugaccggc

SEQ ID NO: 2150569 - RNA, 23 nt, Human herpesvirus 8 [Kaposi`s sarcoma-associated h
cuuuacagaucuagcggcgacua

SEQ ID NO: 2150570 - RNA, 18 nt, Human herpesvirus 8 [Kaposi`s sarcoma-associated h
cucuuggcguuuaccugc

SEQ ID NO: 2150571 - RNA, 21 nt, Human herpesvirus 8 [Kaposi`s sarcoma-associated h
cggcgucaccgacaccaucuc

SEQ ID NO: 2150572 - RNA, 14 nt, Human herpesvirus 8 [Kaposi`s sarcoma-associated h
uggcuguuacaaua

SEQ ID NO: 2150573 - RNA, 19 nt, Human herpesvirus 8 [Kaposi`s sarcoma-associated h
gagucgccgguagcugccu

SEQ ID NO: 2150574 - RNA, 22 nt, Human herpesvirus 8 [Kaposi`s sarcoma-associated h
cgggacaauugucggauuuuga

SEQ ID NO: 2150575 - RNA, 15 nt, Human herpesvirus 8 [Kaposi`s sarcoma-associated h
acacccuggaugggu

SEQ ID NO: 2150576 - RNA, 21 nt, Human herpesvirus 8 [Kaposi`s sarcoma-associated h
ggcgagauuggaggcacauaa

SEQ ID NO: 2150577 - RNA, 12 nt, Human herpesvirus 8 [Kaposi`s sarcoma-associated h
uggcgccaccuu

SEQ ID NO: 2150578 - RNA, 23 nt, Human herpesvirus 8 [Kaposi`s sarcoma-associated h
gauggguuaacaguggaugacca

SEQ ID NO: 2150579 - RNA, 16 nt, Human herpesvirus 8 [Kaposi`s sarcoma-associated h
ugaggccaagugcauu

SEQ ID NO: 2150580 - RNA, 16 nt, Human herpesvirus 8 [Kaposi`s sarcoma-associated h
ccgguagcugccuggu

SEQ ID NO: 2150581 - RNA, 14 nt, Human herpesvirus 8 [Kaposi`s sarcoma-associated h
uuguggcugccugg

SEQ ID NO: 2150582 - RNA, 15 nt, Human herpesvirus 8 [Kaposi`s sarcoma-associated h
auggcgucaucugau

SEQ ID NO: 2150583 - RNA, 20 nt, Human herpesvirus 8 [Kaposi`s sarcoma-associated h
auaaaauacgcgugugggaa

SEQ ID NO: 2150584 - RNA, 22 nt, Human herpesvirus 8 [Kaposi`s sarcoma-associated h
ccauuuuccaaggccugugccc

SEQ ID NO: 2150585 - RNA, 12 nt, Human herpesvirus 8 [Kaposi`s sarcoma-associated h
gacccagggugc

SEQ ID NO: 2150586 - RNA, 22 nt, Human herpesvirus 8 [Kaposi`s sarcoma-associated h
uggaggcacauaaggaacagau

SEQ ID NO: 2150587 - RNA, 15 nt, Human herpesvirus 8 [Kaposi`s sarcoma-associated h
gacauacaugagaga

SEQ ID NO: 2150588 - RNA, 20 nt, Human herpesvirus 8 [Kaposi`s sarcoma-associated h
cugguggaacaugcugccac

SEQ ID NO: 2150589 - RNA, 12 nt, Human herpesvirus 8 [Kaposi`s sarcoma-associated h
ggugggugugca

SEQ ID NO: 2150590 - RNA, 19 nt, Human herpesvirus 8 [Kaposi`s sarcoma-associated h
uggcgcggaaacugggcac

SEQ ID NO: 2150591 - RNA, 14 nt, Human herpesvirus 8 [Kaposi`s sarcoma-associated h
ugcagugugcagua

SEQ ID NO: 2150592 - RNA, 17 nt, Human herpesvirus 8 [Kaposi`s sarcoma-associated h
acuuugcccuaaaugug

SEQ ID NO: 2150593 - RNA, 19 nt, Human herpesvirus 8 [Kaposi`s sarcoma-associated h
cccguacaaggccauggcg

SEQ ID NO: 2150594 - RNA, 15 nt, Human herpesvirus 8 [Kaposi`s sarcoma-associated h
cuuugcagugucuau

SEQ ID NO: 2150595 - RNA, 12 nt, Human herpesvirus 8 [Kaposi`s sarcoma-associated h
uauuaaagggac

SEQ ID NO: 2150596 - RNA, 20 nt, Human herpesvirus 8 [Kaposi`s sarcoma-associated h
gagggcauacccguggcuca

SEQ ID NO: 2150597 - RNA, 15 nt, Human herpesvirus 8 [Kaposi`s sarcoma-associated h
ucccgagacccccag

SEQ ID NO: 2150598 - RNA, 13 nt, Human herpesvirus 8 [Kaposi`s sarcoma-associated h
aacaugugggcuu

SEQ ID NO: 2150599 - RNA, 15 nt, Human herpesvirus 8 [Kaposi`s sarcoma-associated h
auggaccucugucuu

SEQ ID NO: 2150600 - RNA, 21 nt, Human herpesvirus 8 [Kaposi`s sarcoma-associated h
ccacccuauuggucacaucuc

SEQ ID NO: 2150601 - RNA, 11 nt, Human herpesvirus 8 [Kaposi`s sarcoma-associated h
cugagccacaa

SEQ ID NO: 2150602 - RNA, 12 nt, Human herpesvirus 8 [Kaposi`s sarcoma-associated h
gaacaugcugga

SEQ ID NO: 2150603 - RNA, 21 nt, Human herpesvirus 8 [Kaposi`s sarcoma-associated h
gcgcuguacagugccugcagu

SEQ ID NO: 2150604 - RNA, 22 nt, Human herpesvirus 8 [Kaposi`s sarcoma-associated h
gauuuccuuucugagccucuca

SEQ ID NO: 2150605 - RNA, 13 nt, Human herpesvirus 8 [Kaposi`s sarcoma-associated h
caggcgccuauga

SEQ ID NO: 2150606 - RNA, 18 nt, Human herpesvirus 8 [Kaposi`s sarcoma-associated h
ccacauaauuggaugggg

SEQ ID NO: 2150607 - RNA, 21 nt, Human herpesvirus 8 [Kaposi`s sarcoma-associated h
uccgcggaaguaugucguggg

SEQ ID NO: 2150608 - RNA, 15 nt, Human herpesvirus 8 [Kaposi`s sarcoma-associated h
ugggggauccacuca

SEQ ID NO: 2150609 - RNA, 13 nt, Human herpesvirus 8 [Kaposi`s sarcoma-associated h
cuuauuaaaagca

SEQ ID NO: 2150610 - RNA, 15 nt, Human herpesvirus 8 [Kaposi`s sarcoma-associated h
cgaaugugccagcag

SEQ ID NO: 2150611 - RNA, 19 nt, Human herpesvirus 8 [Kaposi`s sarcoma-associated h
agcccgagaucaucuuuuc

SEQ ID NO: 2150612 - RNA, 20 nt, Human herpesvirus 8 [Kaposi`s sarcoma-associated h
gagggcuguucucgccugga

SEQ ID NO: 2150613 - RNA, 13 nt, Human herpesvirus 8 [Kaposi`s sarcoma-associated h
agcaaaacacaaa

SEQ ID NO: 2150614 - RNA, 10 nt, Human herpesvirus 8 [Kaposi`s sarcoma-associated h
ccgcaucucu

SEQ ID NO: 2150615 - RNA, 12 nt, Human herpesvirus 8 [Kaposi`s sarcoma-associated h
ccaugguaccau

SEQ ID NO: 2150616 - RNA, 18 nt, Human herpesvirus 8 [Kaposi`s sarcoma-associated h
gcaguaguaaacgacagc

SEQ ID NO: 2150617 - RNA, 20 nt, Human herpesvirus 8 [Kaposi`s sarcoma-associated h
gcggaccuguucuaccaggu

SEQ ID NO: 2150618 - RNA, 17 nt, Human herpesvirus 8 [Kaposi`s sarcoma-associated h
ccuaaguggauuuccuu

SEQ ID NO: 2150619 - RNA, 20 nt, Human herpesvirus 8 [Kaposi`s sarcoma-associated h
cgccgcggaaacucggucag

SEQ ID NO: 2150620 - RNA, 16 nt, Human herpesvirus 8 [Kaposi`s sarcoma-associated h
cuuacaacuauuuccu

SEQ ID NO: 2150621 - RNA, 19 nt, Human herpesvirus 8 [Kaposi`s sarcoma-associated h
cagucgagccgccaggaac

SEQ ID NO: 2150622 - RNA, 22 nt, Human herpesvirus 8 [Kaposi`s sarcoma-associated h
gguagcaaaugaaaagcuucug

SEQ ID NO: 2150623 - RNA, 20 nt, Human herpesvirus 8 [Kaposi`s sarcoma-associated h
cggauccggagggaaggaag

SEQ ID NO: 2150624 - RNA, 17 nt, Human herpesvirus 8 [Kaposi`s sarcoma-associated h
cggaaacugggcacgga

SEQ ID NO: 2150625 - RNA, 22 nt, Human herpesvirus 8 [Kaposi`s sarcoma-associated h
agccuaacccacgucacaucac

SEQ ID NO: 2150626 - RNA, 16 nt, Human herpesvirus 8 [Kaposi`s sarcoma-associated h
uuugggcaaaacacau

SEQ ID NO: 2150627 - RNA, 21 nt, Human herpesvirus 8 [Kaposi`s sarcoma-associated h
ggccauccgcgagccauucau

SEQ ID NO: 2150628 - RNA, 12 nt, Human herpesvirus 8 [Kaposi`s sarcoma-associated h
guccaggccucu

SEQ ID NO: 2150629 - RNA, 17 nt, Human herpesvirus 8 [Kaposi`s sarcoma-associated h
ugauaccguaguccccu

SEQ ID NO: 2150630 - RNA, 20 nt, Human herpesvirus 8 [Kaposi`s sarcoma-associated h
ccugaggugcucuucccaca

SEQ ID NO: 2150631 - RNA, 13 nt, Human herpesvirus 8 [Kaposi`s sarcoma-associated h
cagcaucccccaa

SEQ ID NO: 2150632 - RNA, 22 nt, Human herpesvirus 8 [Kaposi`s sarcoma-associated h
caagccagucguacgcggccac

SEQ ID NO: 2150633 - RNA, 19 nt, Human herpesvirus 8 [Kaposi`s sarcoma-associated h
acacuguggauuuuaugga

SEQ ID NO: 2150634 - RNA, 23 nt, Human herpesvirus 8 [Kaposi`s sarcoma-associated h
cauaauuggauggggcaugggca

SEQ ID NO: 2150635 - RNA, 22 nt, Human herpesvirus 8 [Kaposi`s sarcoma-associated h
uggauuuucacuauggggucag

SEQ ID NO: 2150636 - RNA, 16 nt, Human herpesvirus 8 [Kaposi`s sarcoma-associated h
aggauguguguaacuu

SEQ ID NO: 2150637 - RNA, 12 nt, Human herpesvirus 8 [Kaposi`s sarcoma-associated h
cccgccucugaa

SEQ ID NO: 2150638 - RNA, 13 nt, Human herpesvirus 8 [Kaposi`s sarcoma-associated h
acuuuauuacagg

SEQ ID NO: 2150639 - RNA, 21 nt, Human herpesvirus 8 [Kaposi`s sarcoma-associated h
acccugcucuggacaauggga

SEQ ID NO: 2150640 - RNA, 20 nt, Human herpesvirus 8 [Kaposi`s sarcoma-associated h
acuuaacgugucugaaugug

SEQ ID NO: 2150641 - RNA, 21 nt, Human herpesvirus 8 [Kaposi`s sarcoma-associated h
cuccacguagacggggagcug

SEQ ID NO: 2150642 - RNA, 14 nt, Human herpesvirus 8 [Kaposi`s sarcoma-associated h
uccuucgcacuucu

SEQ ID NO: 2150643 - RNA, 19 nt, Human herpesvirus 8 [Kaposi`s sarcoma-associated h
ccauggcagcccagccucu

SEQ ID NO: 2150644 - RNA, 18 nt, Human herpesvirus 8 [Kaposi`s sarcoma-associated h
uagcagucgccaguuuuu

SEQ ID NO: 2150645 - RNA, 16 nt, Human herpesvirus 8 [Kaposi`s sarcoma-associated h
auaauggauggcuaug

SEQ ID NO: 2150646 - RNA, 21 nt, Human herpesvirus 8 [Kaposi`s sarcoma-associated h
cccacacauuugucuuuauug

SEQ ID NO: 2150647 - RNA, 21 nt, Human herpesvirus 8 [Kaposi`s sarcoma-associated h
uggaugaccaacaggcugucc

SEQ ID NO: 2150648 - RNA, 17 nt, Human herpesvirus 8 [Kaposi`s sarcoma-associated h
aggugucugcgggacaa

SEQ ID NO: 2150649 - RNA, 20 nt, Human herpesvirus 8 [Kaposi`s sarcoma-associated h
gaucucccaauuacaggaga

SEQ ID NO: 2150650 - RNA, 14 nt, Human herpesvirus 8 [Kaposi`s sarcoma-associated h
aggcuggaccuccu

SEQ ID NO: 2150651 - RNA, 19 nt, Human herpesvirus 8 [Kaposi`s sarcoma-associated h
auguaccuggcguccagcu

SEQ ID NO: 2150652 - RNA, 14 nt, Human herpesvirus 8 [Kaposi`s sarcoma-associated h
gggccuggccucga

SEQ ID NO: 2150653 - RNA, 22 nt, Human herpesvirus 8 [Kaposi`s sarcoma-associated h
cuagcagaaaacugucuccaga

SEQ ID NO: 2150654 - RNA, 15 nt, Human herpesvirus 8 [Kaposi`s sarcoma-associated h
gccaggacucacugg

SEQ ID NO: 2150655 - RNA, 15 nt, Human herpesvirus 8 [Kaposi`s sarcoma-associated h
ucgggggaucuugua

SEQ ID NO: 2150656 - RNA, 19 nt, Human herpesvirus 8 [Kaposi`s sarcoma-associated h
cgacugggccaccaagauc

SEQ ID NO: 2150657 - RNA, 14 nt, Human herpesvirus 8 [Kaposi`s sarcoma-associated h
aucgccgccagcaa

SEQ ID NO: 2150658 - RNA, 18 nt, Human herpesvirus 8 [Kaposi`s sarcoma-associated h
gguugcauagggcuuuga

SEQ ID NO: 2150659 - RNA, 15 nt, Human herpesvirus 8 [Kaposi`s sarcoma-associated h
cagaaccgaugguuu

SEQ ID NO: 2150660 - RNA, 16 nt, Human herpesvirus 8 [Kaposi`s sarcoma-associated h
uauuaggguggauagg

SEQ ID NO: 2150661 - RNA, 21 nt, Human herpesvirus 8 [Kaposi`s sarcoma-associated h
acuaugggugaccacauaauu

SEQ ID NO: 2150662 - RNA, 22 nt, Human herpesvirus 8 [Kaposi`s sarcoma-associated h
ccaagaucuuccagucuccaga

SEQ ID NO: 2150663 - RNA, 18 nt, Human herpesvirus 8 [Kaposi`s sarcoma-associated h
uaacuguuuacugcuguu

SEQ ID NO: 2150664 - RNA, 20 nt, Human herpesvirus 8 [Kaposi`s sarcoma-associated h
ugugacaaucuggaugugua

SEQ ID NO: 2150665 - RNA, 21 nt, Human herpesvirus 8 [Kaposi`s sarcoma-associated h
cucuccggcgguggcggccau

SEQ ID NO: 2150666 - RNA, 13 nt, Human herpesvirus 8 [Kaposi`s sarcoma-associated h
ugcauauggacug

SEQ ID NO: 2150667 - RNA, 17 nt, Human herpesvirus 8 [Kaposi`s sarcoma-associated h
gccucgagggcggccag

SEQ ID NO: 2150668 - RNA, 14 nt, Human herpesvirus 8 [Kaposi`s sarcoma-associated h
uuaauaaauugcuu

SEQ ID NO: 2150669 - RNA, 21 nt, Human herpesvirus 8 [Kaposi`s sarcoma-associated h
gaaagcuucaucguggugccc

SEQ ID NO: 2150670 - RNA, 12 nt, Human herpesvirus 8 [Kaposi`s sarcoma-associated h
ggagggcagcug

SEQ ID NO: 2150671 - RNA, 18 nt, Human herpesvirus 8 [Kaposi`s sarcoma-associated h
cuugauaaucuccuggag

SEQ ID NO: 2150672 - RNA, 16 nt, Human herpesvirus 8 [Kaposi`s sarcoma-associated h
uacucguugcacacag

SEQ ID NO: 2150673 - RNA, 18 nt, Human herpesvirus 8 [Kaposi`s sarcoma-associated h
cugcaccucgccgcaaag

SEQ ID NO: 2150674 - RNA, 19 nt, Human herpesvirus 8 [Kaposi`s sarcoma-associated h
ugccaccguuuacaaaaua

SEQ ID NO: 2150675 - RNA, 17 nt, Human herpesvirus 8 [Kaposi`s sarcoma-associated h
agcauugucuuaaguac

SEQ ID NO: 2150676 - RNA, 14 nt, Human herpesvirus 8 [Kaposi`s sarcoma-associated h
uacgucccucuugg

SEQ ID NO: 2150677 - RNA, 17 nt, Human herpesvirus 8 [Kaposi`s sarcoma-associated h
agcccgauggcccuuca

SEQ ID NO: 2150678 - RNA, 20 nt, Human herpesvirus 8 [Kaposi`s sarcoma-associated h
ccugcccucaaauucucaca

SEQ ID NO: 2150679 - RNA, 17 nt, Human herpesvirus 8 [Kaposi`s sarcoma-associated h
cucgaaagcuucaucgu

SEQ ID NO: 2150680 - RNA, 18 nt, Human herpesvirus 8 [Kaposi`s sarcoma-associated h
cuuggcguuuaccugcac

SEQ ID NO: 2150681 - RNA, 22 nt, Human herpesvirus 8 [Kaposi`s sarcoma-associated h
accguuuggcccacguggugcu

SEQ ID NO: 2150682 - RNA, 22 nt, Human herpesvirus 8 [Kaposi`s sarcoma-associated h
cgucaagaccgagcguauucuc

SEQ ID NO: 2150683 - RNA, 21 nt, Human herpesvirus 8 [Kaposi`s sarcoma-associated h
ucuugauguuuaaauuuuugg

SEQ ID NO: 2150684 - RNA, 16 nt, Human herpesvirus 8 [Kaposi`s sarcoma-associated h
auuagaagaaaaggau

SEQ ID NO: 2150685 - RNA, 16 nt, Human herpesvirus 8 [Kaposi`s sarcoma-associated h
ugagugggacaucauu

SEQ ID NO: 2150686 - RNA, 15 nt, Human herpesvirus 8 [Kaposi`s sarcoma-associated h
acugaacccugggug

SEQ ID NO: 2150687 - RNA, 20 nt, Human herpesvirus 8 [Kaposi`s sarcoma-associated h
agcuguuacccugcucugga

SEQ ID NO: 2150688 - RNA, 12 nt, Human herpesvirus 8 [Kaposi`s sarcoma-associated h
auacuuggcaag

SEQ ID NO: 2150689 - RNA, 16 nt, Human herpesvirus 8 [Kaposi`s sarcoma-associated h
aagucucccugcgugg

SEQ ID NO: 2150690 - RNA, 13 nt, Human herpesvirus 8 [Kaposi`s sarcoma-associated h
caugccuguggau

SEQ ID NO: 2150691 - RNA, 15 nt, Human herpesvirus 8 [Kaposi`s sarcoma-associated h
gcggugcugcccagg

SEQ ID NO: 2150692 - RNA, 20 nt, Human herpesvirus 8 [Kaposi`s sarcoma-associated h
guacauuaaaaggacauugu

SEQ ID NO: 2150693 - RNA, 12 nt, Human herpesvirus 8 [Kaposi`s sarcoma-associated h
aggaguggcuga

SEQ ID NO: 2150694 - RNA, 17 nt, Human herpesvirus 8 [Kaposi`s sarcoma-associated h
cguaagaggacccaggg

SEQ ID NO: 2150695 - RNA, 16 nt, Human herpesvirus 8 [Kaposi`s sarcoma-associated h
cgcgaccucccacggg

SEQ ID NO: 2150696 - RNA, 15 nt, Human herpesvirus 8 [Kaposi`s sarcoma-associated h
gcaugccgucagggc

SEQ ID NO: 2150697 - RNA, 22 nt, Human herpesvirus 8 [Kaposi`s sarcoma-associated h
auuuauuuuuuacuacagguau

SEQ ID NO: 2150698 - RNA, 14 nt, Human herpesvirus 8 [Kaposi`s sarcoma-associated h
gcugcagccaggaa

SEQ ID NO: 2150699 - RNA, 11 nt, Human herpesvirus 8 [Kaposi`s sarcoma-associated h
cgccagacagc

SEQ ID NO: 2150700 - RNA, 21 nt, Human herpesvirus 8 [Kaposi`s sarcoma-associated h
caugugcuuuugcuuggcgcu

SEQ ID NO: 2150701 - RNA, 21 nt, Human herpesvirus 8 [Kaposi`s sarcoma-associated h
ccagguaggucaccgggucaa

SEQ ID NO: 2150702 - RNA, 16 nt, Human herpesvirus 8 [Kaposi`s sarcoma-associated h
cgaauaaaacaggaag

SEQ ID NO: 2150703 - RNA, 17 nt, Human herpesvirus 8 [Kaposi`s sarcoma-associated h
uuccuccguugucgacu

SEQ ID NO: 2150704 - RNA, 17 nt, Human herpesvirus 8 [Kaposi`s sarcoma-associated h
gccacgguggcccugcc

SEQ ID NO: 2150705 - RNA, 18 nt, Human herpesvirus 8 [Kaposi`s sarcoma-associated h
ugcccuccugggccaggc

SEQ ID NO: 2150706 - RNA, 14 nt, Human herpesvirus 8 [Kaposi`s sarcoma-associated h
aucagaacaguggu

SEQ ID NO: 2150707 - RNA, 12 nt, Human herpesvirus 8 [Kaposi`s sarcoma-associated h
cagugugcagua

SEQ ID NO: 2150708 - RNA, 20 nt, Human herpesvirus 8 [Kaposi`s sarcoma-associated h
aggaguggacuuucuccgug

SEQ ID NO: 2150709 - RNA, 19 nt, Human herpesvirus 8 [Kaposi`s sarcoma-associated h
cugggagauuggguuggga

SEQ ID NO: 2150710 - RNA, 15 nt, Human herpesvirus 8 [Kaposi`s sarcoma-associated h
cguggaugagagggu

SEQ ID NO: 2150711 - RNA, 21 nt, Human herpesvirus 8 [Kaposi`s sarcoma-associated h
acgauguacuugaacagggca

SEQ ID NO: 2150712 - RNA, 17 nt, Human herpesvirus 8 [Kaposi`s sarcoma-associated h
cccgugcguuugcagug

SEQ ID NO: 2150713 - RNA, 17 nt, Human herpesvirus 8 [Kaposi`s sarcoma-associated h
ccagauuuaagauuaag

SEQ ID NO: 2150714 - RNA, 15 nt, Human herpesvirus 8 [Kaposi`s sarcoma-associated h
ccagugggguugggg

SEQ ID NO: 2150715 - RNA, 20 nt, Human herpesvirus 8 [Kaposi`s sarcoma-associated h
cuaaacguguucauaccuca

SEQ ID NO: 2150716 - RNA, 22 nt, Human herpesvirus 8 [Kaposi`s sarcoma-associated h
auguuuauuuuuuuucaaacag

SEQ ID NO: 2150717 - RNA, 16 nt, Human herpesvirus 8 [Kaposi`s sarcoma-associated h
cgccagcgucgccucc

SEQ ID NO: 2150718 - RNA, 22 nt, Human herpesvirus 8 [Kaposi`s sarcoma-associated h
acgaaugcucaggucugucacu

SEQ ID NO: 2150719 - RNA, 23 nt, Human herpesvirus 8 [Kaposi`s sarcoma-associated h
uaacucacguagccuuucucuaa

SEQ ID NO: 2150720 - RNA, 19 nt, Human herpesvirus 8 [Kaposi`s sarcoma-associated h
ucccccacacccccaggau

SEQ ID NO: 2150721 - RNA, 22 nt, Human herpesvirus 8 [Kaposi`s sarcoma-associated h
uugcacucagaacauaaaacga

SEQ ID NO: 2150722 - RNA, 18 nt, Human herpesvirus 8 [Kaposi`s sarcoma-associated h
uaugcaugugucugugcc

SEQ ID NO: 2150723 - RNA, 16 nt, Human herpesvirus 8 [Kaposi`s sarcoma-associated h
cguggcgaucgucccc

SEQ ID NO: 2150724 - RNA, 22 nt, Human herpesvirus 8 [Kaposi`s sarcoma-associated h
ucacaaauuuuaacagccacga

SEQ ID NO: 2150725 - RNA, 14 nt, Human herpesvirus 8 [Kaposi`s sarcoma-associated h
gcuguccaccuuaa

SEQ ID NO: 2150726 - RNA, 22 nt, Human herpesvirus 8 [Kaposi`s sarcoma-associated h
uaaacauacguuuugaacaaug

SEQ ID NO: 2150727 - RNA, 20 nt, Human herpesvirus 8 [Kaposi`s sarcoma-associated h
ggcgacaggcgcguauggga

SEQ ID NO: 2150728 - RNA, 16 nt, Human herpesvirus 8 [Kaposi`s sarcoma-associated h
gguuccguucuccuuc

SEQ ID NO: 2150729 - RNA, 21 nt, Human herpesvirus 8 [Kaposi`s sarcoma-associated h
gguaaccagcuacgcacugag

SEQ ID NO: 2150730 - RNA, 12 nt, Human herpesvirus 8 [Kaposi`s sarcoma-associated h
cgccccuggugg

SEQ ID NO: 2150731 - RNA, 23 nt, Human herpesvirus 8 [Kaposi`s sarcoma-associated h
cugccgcucggagauugccaccg

SEQ ID NO: 2150732 - RNA, 19 nt, Human herpesvirus 8 [Kaposi`s sarcoma-associated h
caggcccucuucuguugcc

SEQ ID NO: 2150733 - RNA, 20 nt, Human herpesvirus 8 [Kaposi`s sarcoma-associated h
ccuauggcgcaagcacuuuu

SEQ ID NO: 2150734 - RNA, 19 nt, Human herpesvirus 8 [Kaposi`s sarcoma-associated h
cuggauggguuaacagugg

SEQ ID NO: 2150735 - RNA, 22 nt, Human herpesvirus 8 [Kaposi`s sarcoma-associated h
acuacagggaaguuucagagcc

SEQ ID NO: 2150736 - RNA, 17 nt, Human herpesvirus 8 [Kaposi`s sarcoma-associated h
cccucuacucuuccggg

SEQ ID NO: 2150737 - RNA, 18 nt, Human herpesvirus 8 [Kaposi`s sarcoma-associated h
uaacaugcaacccucuac

SEQ ID NO: 2150738 - RNA, 21 nt, Human herpesvirus 8 [Kaposi`s sarcoma-associated h
uguucuuaauugcccaucauu

SEQ ID NO: 2150739 - RNA, 18 nt, Human herpesvirus 8 [Kaposi`s sarcoma-associated h
gcagacgugcccagacac

SEQ ID NO: 2150740 - RNA, 23 nt, Human herpesvirus 8 [Kaposi`s sarcoma-associated h
ggucccacugcugcgauccagag

SEQ ID NO: 2150741 - RNA, 21 nt, Human herpesvirus 8 [Kaposi`s sarcoma-associated h
ccguguuuuucuggucgcugc

SEQ ID NO: 2150742 - RNA, 13 nt, Human herpesvirus 8 [Kaposi`s sarcoma-associated h
ggcagucaaaugg

SEQ ID NO: 2150743 - RNA, 17 nt, Human herpesvirus 8 [Kaposi`s sarcoma-associated h
ggcggcuguggcaccaa

SEQ ID NO: 2150744 - RNA, 17 nt, Human herpesvirus 8 [Kaposi`s sarcoma-associated h
cguggaguugccugugg

SEQ ID NO: 2150745 - RNA, 13 nt, Human herpesvirus 8 [Kaposi`s sarcoma-associated h
aagaggacccagg

SEQ ID NO: 2150746 - RNA, 13 nt, Human herpesvirus 8 [Kaposi`s sarcoma-associated h
gaccucccacggg

SEQ ID NO: 2150747 - RNA, 11 nt, Human herpesvirus 8 [Kaposi`s sarcoma-associated h
cgacaaaguga

SEQ ID NO: 2150748 - RNA, 16 nt, Human herpesvirus 8 [Kaposi`s sarcoma-associated h
acaaauguuuuaugca

SEQ ID NO: 2150749 - RNA, 12 nt, Human herpesvirus 8 [Kaposi`s sarcoma-associated h
gcgugcuucugu

SEQ ID NO: 2150750 - RNA, 17 nt, Human herpesvirus 8 [Kaposi`s sarcoma-associated h
gcaaccugcugcagcug

SEQ ID NO: 2150751 - RNA, 22 nt, Human herpesvirus 8 [Kaposi`s sarcoma-associated h
ucagcauauacagguguccaag

SEQ ID NO: 2150752 - RNA, 14 nt, Human herpesvirus 8 [Kaposi`s sarcoma-associated h
ccaggauccagacu

SEQ ID NO: 2150753 - RNA, 13 nt, Human herpesvirus 8 [Kaposi`s sarcoma-associated h
gcgacugcuggcu

SEQ ID NO: 2150754 - RNA, 18 nt, Human herpesvirus 8 [Kaposi`s sarcoma-associated h
guggauccgcaaugucag

SEQ ID NO: 2150755 - RNA, 16 nt, Human herpesvirus 8 [Kaposi`s sarcoma-associated h
uauagcagcugucccg

SEQ ID NO: 2150756 - RNA, 15 nt, Human herpesvirus 8 [Kaposi`s sarcoma-associated h
cagcaguagacgcag

SEQ ID NO: 2150757 - RNA, 23 nt, Human herpesvirus 8 [Kaposi`s sarcoma-associated h
ugugcuguccagcguggggacag

SEQ ID NO: 2150758 - RNA, 17 nt, Human herpesvirus 8 [Kaposi`s sarcoma-associated h
gauuugauacagggaca

SEQ ID NO: 2150759 - RNA, 13 nt, Human herpesvirus 8 [Kaposi`s sarcoma-associated h
ccccuucuucugg

SEQ ID NO: 2150760 - RNA, 19 nt, Human herpesvirus 8 [Kaposi`s sarcoma-associated h
gcuacugcuuguucaggag

SEQ ID NO: 2150761 - RNA, 23 nt, Human herpesvirus 8 [Kaposi`s sarcoma-associated h
gcacgugaaaucucgccuguccu

SEQ ID NO: 2150762 - RNA, 19 nt, Human herpesvirus 8 [Kaposi`s sarcoma-associated h
uccuggaugguuccccaga

SEQ ID NO: 2150763 - RNA, 13 nt, Human herpesvirus 8 [Kaposi`s sarcoma-associated h
uguguagguuguu

SEQ ID NO: 2150764 - RNA, 19 nt, Human herpesvirus 8 [Kaposi`s sarcoma-associated h
accaauaacgaagguaugu

SEQ ID NO: 2150765 - RNA, 22 nt, Human herpesvirus 8 [Kaposi`s sarcoma-associated h
aaagcagcgcccacugguguau

SEQ ID NO: 2150766 - RNA, 21 nt, Human herpesvirus 8 [Kaposi`s sarcoma-associated h
ccaccuacacccgguucagcc

SEQ ID NO: 2150767 - RNA, 19 nt, Human herpesvirus 8 [Kaposi`s sarcoma-associated h
cuaauauuaaccauagugu

SEQ ID NO: 2150768 - RNA, 22 nt, Human herpesvirus 8 [Kaposi`s sarcoma-associated h
ucgugcuuacccacccccuucu

SEQ ID NO: 2150769 - RNA, 18 nt, Human herpesvirus 8 [Kaposi`s sarcoma-associated h
uggcucacggacuuuauu

SEQ ID NO: 2150770 - RNA, 15 nt, Human herpesvirus 8 [Kaposi`s sarcoma-associated h
augggugugugccag

SEQ ID NO: 2150771 - RNA, 13 nt, Human herpesvirus 8 [Kaposi`s sarcoma-associated h
acuacagguauac

SEQ ID NO: 2150772 - RNA, 13 nt, Human herpesvirus 8 [Kaposi`s sarcoma-associated h
acacacacaaaga

SEQ ID NO: 2150773 - RNA, 20 nt, Human herpesvirus 8 [Kaposi`s sarcoma-associated h
ggaagggggcucccugggga

SEQ ID NO: 2150774 - RNA, 13 nt, Human herpesvirus 8 [Kaposi`s sarcoma-associated h
uugcgauugcuca

SEQ ID NO: 2150775 - RNA, 21 nt, Human herpesvirus 8 [Kaposi`s sarcoma-associated h
auuaugguuccguucuccuuc

SEQ ID NO: 2150776 - RNA, 18 nt, Human herpesvirus 8 [Kaposi`s sarcoma-associated h
caggucugucacuagaau

SEQ ID NO: 2150777 - RNA, 13 nt, Human herpesvirus 8 [Kaposi`s sarcoma-associated h
acugcccuccauc

SEQ ID NO: 2150778 - RNA, 15 nt, Human herpesvirus 8 [Kaposi`s sarcoma-associated h
gggaaggaagggcgg

SEQ ID NO: 2150779 - RNA, 15 nt, Human herpesvirus 8 [Kaposi`s sarcoma-associated h
uccacccaguuugag

SEQ ID NO: 2150780 - RNA, 12 nt, Human herpesvirus 8 [Kaposi`s sarcoma-associated h
cggacauuuugu

SEQ ID NO: 2150781 - RNA, 19 nt, Human herpesvirus 8 [Kaposi`s sarcoma-associated h
cuagaacuaaccacucaua

SEQ ID NO: 2150782 - RNA, 13 nt, Human herpesvirus 8 [Kaposi`s sarcoma-associated h
acaaaaacacaau

SEQ ID NO: 2150783 - RNA, 17 nt, Human herpesvirus 8 [Kaposi`s sarcoma-associated h
agggugcggugcugccc

SEQ ID NO: 2150784 - RNA, 16 nt, Human herpesvirus 8 [Kaposi`s sarcoma-associated h
uaggauucgugcagcc

SEQ ID NO: 2150785 - RNA, 14 nt, Human herpesvirus 8 [Kaposi`s sarcoma-associated h
ucagagucugaacc

SEQ ID NO: 2150786 - RNA, 19 nt, Human herpesvirus 8 [Kaposi`s sarcoma-associated h
cggggauggacgcggccuu

SEQ ID NO: 2150787 - RNA, 21 nt, Human herpesvirus 8 [Kaposi`s sarcoma-associated h
cagcccagccucuguacaugg

SEQ ID NO: 2150788 - RNA, 14 nt, Human herpesvirus 8 [Kaposi`s sarcoma-associated h
ucaccggggagcuu

SEQ ID NO: 2150789 - RNA, 22 nt, Human herpesvirus 8 [Kaposi`s sarcoma-associated h
cacucgaggggugacaccuuuc

SEQ ID NO: 2150790 - RNA, 21 nt, Human herpesvirus 8 [Kaposi`s sarcoma-associated h
ccauuuuuguggcugccugga

SEQ ID NO: 2150791 - RNA, 23 nt, Human herpesvirus 8 [Kaposi`s sarcoma-associated h
gaauuccacccauccuccucaga

SEQ ID NO: 2150792 - RNA, 20 nt, Human herpesvirus 8 [Kaposi`s sarcoma-associated h
gauuagccugcagugugggg

SEQ ID NO: 2150793 - RNA, 15 nt, Human herpesvirus 8 [Kaposi`s sarcoma-associated h
ggagcuguggggcag

SEQ ID NO: 2150794 - RNA, 16 nt, Human herpesvirus 8 [Kaposi`s sarcoma-associated h
gggggaugagccagaa

SEQ ID NO: 2150795 - RNA, 16 nt, Human herpesvirus 8 [Kaposi`s sarcoma-associated h
ccucgucuagcacaca

SEQ ID NO: 2150796 - RNA, 14 nt, Human herpesvirus 8 [Kaposi`s sarcoma-associated h
gugcuuugcuggag

SEQ ID NO: 2150797 - RNA, 20 nt, Human herpesvirus 8 [Kaposi`s sarcoma-associated h
uuguuaugggagggaguaua

SEQ ID NO: 2150798 - RNA, 15 nt, Human herpesvirus 8 [Kaposi`s sarcoma-associated h
gccaugaaagguggu

SEQ ID NO: 2150799 - RNA, 13 nt, Human herpesvirus 8 [Kaposi`s sarcoma-associated h
cagcaacugcguc

SEQ ID NO: 2150800 - RNA, 18 nt, Human herpesvirus 8 [Kaposi`s sarcoma-associated h
uucaaaacguauguuuau

SEQ ID NO: 2150801 - RNA, 17 nt, Human herpesvirus 8 [Kaposi`s sarcoma-associated h
acgcguuaagaagccac

SEQ ID NO: 2150802 - RNA, 18 nt, Human herpesvirus 8 [Kaposi`s sarcoma-associated h
aaguccggccaccgugga

SEQ ID NO: 2150803 - RNA, 16 nt, Human herpesvirus 8 [Kaposi`s sarcoma-associated h
cuacuaugucccaaag

SEQ ID NO: 2150804 - RNA, 20 nt, Human herpesvirus 8 [Kaposi`s sarcoma-associated h
gcauuuggacacaacaugca

SEQ ID NO: 2150805 - RNA, 17 nt, Human herpesvirus 8 [Kaposi`s sarcoma-associated h
cgcaccgcaagcagcaa

SEQ ID NO: 2150806 - RNA, 14 nt, Human herpesvirus 8 [Kaposi`s sarcoma-associated h
cuaaucaggguaga

SEQ ID NO: 2150807 - RNA, 21 nt, Human herpesvirus 8 [Kaposi`s sarcoma-associated h
uuaacgugucugaauguggaa

SEQ ID NO: 2150808 - RNA, 18 nt, Human herpesvirus 8 [Kaposi`s sarcoma-associated h
caucucgguacugcgcau

SEQ ID NO: 2150809 - RNA, 18 nt, Human herpesvirus 8 [Kaposi`s sarcoma-associated h
gccugcgucuacugcugc

SEQ ID NO: 2150810 - RNA, 20 nt, Human herpesvirus 8 [Kaposi`s sarcoma-associated h
gauuuacgguggugugccug

SEQ ID NO: 2150811 - RNA, 23 nt, Human herpesvirus 8 [Kaposi`s sarcoma-associated h
cgaugaagagagaaugcuuccaa

SEQ ID NO: 2150812 - RNA, 13 nt, Human herpesvirus 8 [Kaposi`s sarcoma-associated h
uaucaaagaaagg

SEQ ID NO: 2150813 - RNA, 20 nt, Human herpesvirus 8 [Kaposi`s sarcoma-associated h
gaccccgauaugcaccucca

SEQ ID NO: 2150814 - RNA, 23 nt, Human herpesvirus 8 [Kaposi`s sarcoma-associated h
gcaguagcccgccgcaaggagca

SEQ ID NO: 2150815 - RNA, 14 nt, Human herpesvirus 8 [Kaposi`s sarcoma-associated h
gcacgguauagaga

SEQ ID NO: 2150816 - RNA, 22 nt, Human herpesvirus 8 [Kaposi`s sarcoma-associated h
cagccaccguaacuucaccgug

SEQ ID NO: 2150817 - RNA, 12 nt, Human herpesvirus 8 [Kaposi`s sarcoma-associated h
cuggacacuaaa

SEQ ID NO: 2150818 - RNA, 14 nt, Human herpesvirus 8 [Kaposi`s sarcoma-associated h
gcuccucgagcgug

SEQ ID NO: 2150819 - RNA, 17 nt, Human herpesvirus 8 [Kaposi`s sarcoma-associated h
ccagccgcgcgaccucc

SEQ ID NO: 2150820 - RNA, 13 nt, Human herpesvirus 8 [Kaposi`s sarcoma-associated h
uggcgucaucuga

SEQ ID NO: 2150821 - RNA, 16 nt, Human herpesvirus 8 [Kaposi`s sarcoma-associated h
aguuucagagccuuca

SEQ ID NO: 2150822 - RNA, 21 nt, Human herpesvirus 8 [Kaposi`s sarcoma-associated h
cuccggacucgucuacccugc

SEQ ID NO: 2150823 - RNA, 13 nt, Human herpesvirus 8 [Kaposi`s sarcoma-associated h
gucgacagagcca

SEQ ID NO: 2150824 - RNA, 18 nt, Human herpesvirus 8 [Kaposi`s sarcoma-associated h
cacgcccgggggccagga

SEQ ID NO: 2150825 - RNA, 10 nt, Human herpesvirus 8 [Kaposi`s sarcoma-associated h
accaguaaag

SEQ ID NO: 2150826 - RNA, 14 nt, Human herpesvirus 8 [Kaposi`s sarcoma-associated h
caacauuaaacaca

SEQ ID NO: 2150827 - RNA, 14 nt, Human herpesvirus 8 [Kaposi`s sarcoma-associated h
accuagcgggcaca

SEQ ID NO: 2150828 - RNA, 22 nt, Human herpesvirus 8 [Kaposi`s sarcoma-associated h
ggccacgaauucgaggacacgc

SEQ ID NO: 2150829 - RNA, 15 nt, Human herpesvirus 8 [Kaposi`s sarcoma-associated h
agcgucaucugcgaa

SEQ ID NO: 2150830 - RNA, 16 nt, Human herpesvirus 8 [Kaposi`s sarcoma-associated h
cgccgcaaggagcagc

SEQ ID NO: 2150831 - RNA, 18 nt, Human herpesvirus 8 [Kaposi`s sarcoma-associated h
auucaugccuuucuguaa

SEQ ID NO: 2150832 - RNA, 18 nt, Human herpesvirus 8 [Kaposi`s sarcoma-associated h
agauccuccacagagccu

SEQ ID NO: 2150833 - RNA, 16 nt, Human herpesvirus 8 [Kaposi`s sarcoma-associated h
guuucgucgauuucac

SEQ ID NO: 2150834 - RNA, 16 nt, Human herpesvirus 8 [Kaposi`s sarcoma-associated h
cacauauggcgcagga

SEQ ID NO: 2150835 - RNA, 19 nt, Human herpesvirus 8 [Kaposi`s sarcoma-associated h
uccuacccuacuccccugu

SEQ ID NO: 2150836 - RNA, 17 nt, Human herpesvirus 8 [Kaposi`s sarcoma-associated h
caaaauucgcagggaga

SEQ ID NO: 2150837 - RNA, 13 nt, Human herpesvirus 8 [Kaposi`s sarcoma-associated h
agggaauggccuc

SEQ ID NO: 2150838 - RNA, 13 nt, Human herpesvirus 8 [Kaposi`s sarcoma-associated h
cccaugugggcuu

SEQ ID NO: 2150839 - RNA, 16 nt, Human herpesvirus 8 [Kaposi`s sarcoma-associated h
gucaaccagauuuaag

SEQ ID NO: 2150840 - RNA, 18 nt, Human herpesvirus 8 [Kaposi`s sarcoma-associated h
cuacucccccuccucaga

SEQ ID NO: 2150841 - RNA, 16 nt, Human herpesvirus 8 [Kaposi`s sarcoma-associated h
guagcuaugcccaccg

SEQ ID NO: 2150842 - RNA, 20 nt, Human herpesvirus 8 [Kaposi`s sarcoma-associated h
cugggguccgauugcuucau

SEQ ID NO: 2150843 - RNA, 23 nt, Human herpesvirus 8 [Kaposi`s sarcoma-associated h
caugcuggaucccagugccucag

SEQ ID NO: 2150844 - RNA, 20 nt, Human herpesvirus 8 [Kaposi`s sarcoma-associated h
acauuuucucgugugcccuu

SEQ ID NO: 2150845 - RNA, 15 nt, Human herpesvirus 8 [Kaposi`s sarcoma-associated h
cgugucuagacaaua

SEQ ID NO: 2150846 - RNA, 20 nt, Human herpesvirus 8 [Kaposi`s sarcoma-associated h
gaggugacccuuugugcucg

SEQ ID NO: 2150847 - RNA, 14 nt, Human herpesvirus 8 [Kaposi`s sarcoma-associated h
cgagacuuggcaga

SEQ ID NO: 2150848 - RNA, 19 nt, Human herpesvirus 8 [Kaposi`s sarcoma-associated h
auuucucuaucuaucucug

SEQ ID NO: 2150849 - RNA, 17 nt, Human herpesvirus 8 [Kaposi`s sarcoma-associated h
ggcugaugcucuggcca

SEQ ID NO: 2150850 - RNA, 13 nt, Human herpesvirus 8 [Kaposi`s sarcoma-associated h
uccaugcaggcag

SEQ ID NO: 2150851 - RNA, 22 nt, Human herpesvirus 8 [Kaposi`s sarcoma-associated h
aaaugaggggucugaucccaaa

SEQ ID NO: 2150852 - RNA, 18 nt, Human herpesvirus 8 [Kaposi`s sarcoma-associated h
aauauaacagcaacaugu

SEQ ID NO: 2150853 - RNA, 16 nt, Human herpesvirus 8 [Kaposi`s sarcoma-associated h
aaacuaaucaguguua

SEQ ID NO: 2150854 - RNA, 11 nt, Human herpesvirus 8 [Kaposi`s sarcoma-associated h
cacacuggccc

SEQ ID NO: 2150855 - RNA, 17 nt, Human herpesvirus 8 [Kaposi`s sarcoma-associated h
agcuuaaccacaugcau

SEQ ID NO: 2150856 - RNA, 15 nt, Human herpesvirus 8 [Kaposi`s sarcoma-associated h
gguaggccagcugcg

SEQ ID NO: 2150857 - RNA, 21 nt, Human herpesvirus 8 [Kaposi`s sarcoma-associated h
ucugggauagugucuggcugg

SEQ ID NO: 2150858 - RNA, 23 nt, Human herpesvirus 8 [Kaposi`s sarcoma-associated h
ugagguggcgcggaaacugggca

SEQ ID NO: 2150859 - RNA, 14 nt, Human herpesvirus 8 [Kaposi`s sarcoma-associated h
ucuuccuccauccc

SEQ ID NO: 2150860 - RNA, 18 nt, Human herpesvirus 8 [Kaposi`s sarcoma-associated h
ggaagcauccggacugag

SEQ ID NO: 2150861 - RNA, 13 nt, Human herpesvirus 8 [Kaposi`s sarcoma-associated h
auguguguaacuu

SEQ ID NO: 2150862 - RNA, 12 nt, Human herpesvirus 8 [Kaposi`s sarcoma-associated h
cguguccaggaa

SEQ ID NO: 2150863 - RNA, 19 nt, Human herpesvirus 8 [Kaposi`s sarcoma-associated h
ccgacugugccccuggaaa

SEQ ID NO: 2150864 - RNA, 21 nt, Human herpesvirus 8 [Kaposi`s sarcoma-associated h
ccucuaucagcugcagccagg

SEQ ID NO: 2150865 - RNA, 16 nt, Human herpesvirus 8 [Kaposi`s sarcoma-associated h
gcggucagaguggugg

SEQ ID NO: 2150866 - RNA, 20 nt, Human herpesvirus 8 [Kaposi`s sarcoma-associated h
caauaacgaagguauguuuu

SEQ ID NO: 2150867 - RNA, 22 nt, Human herpesvirus 8 [Kaposi`s sarcoma-associated h
ccuaauaaacuggccgcauuug

SEQ ID NO: 2150868 - RNA, 22 nt, Human herpesvirus 8 [Kaposi`s sarcoma-associated h
agcggcaccacaucugcugucu

SEQ ID NO: 2150869 - RNA, 12 nt, Human herpesvirus 8 [Kaposi`s sarcoma-associated h
acgcacugagcg

SEQ ID NO: 2150870 - RNA, 19 nt, Human herpesvirus 8 [Kaposi`s sarcoma-associated h
ucuuacuaagagaacagca

SEQ ID NO: 2150871 - RNA, 23 nt, Human herpesvirus 8 [Kaposi`s sarcoma-associated h
ugagccacaaacgccccucuugg

SEQ ID NO: 2150872 - RNA, 23 nt, Human herpesvirus 8 [Kaposi`s sarcoma-associated h
ucaccgugccuucgaggccaggc

SEQ ID NO: 2150873 - RNA, 17 nt, Human herpesvirus 8 [Kaposi`s sarcoma-associated h
uggcguggaggccagga

SEQ ID NO: 2150874 - RNA, 19 nt, Human herpesvirus 8 [Kaposi`s sarcoma-associated h
ggaugcacaguauagggau

SEQ ID NO: 2150875 - RNA, 15 nt, Human herpesvirus 8 [Kaposi`s sarcoma-associated h
augaauacccuggau

SEQ ID NO: 2150876 - RNA, 22 nt, Human herpesvirus 8 [Kaposi`s sarcoma-associated h
uuaccugcacuccaagccaguc

SEQ ID NO: 2150877 - RNA, 21 nt, Human herpesvirus 8 [Kaposi`s sarcoma-associated h
cggcacacuacucccccuccu

SEQ ID NO: 2150878 - RNA, 19 nt, Human herpesvirus 8 [Kaposi`s sarcoma-associated h
gccaauaaugcaaugcuuc

SEQ ID NO: 2150879 - RNA, 21 nt, Human herpesvirus 8 [Kaposi`s sarcoma-associated h
gcggccacgaauucgaggaca

SEQ ID NO: 2150880 - RNA, 17 nt, Human herpesvirus 8 [Kaposi`s sarcoma-associated h
cagggcaugaggcugga

SEQ ID NO: 2150881 - RNA, 19 nt, Human herpesvirus 8 [Kaposi`s sarcoma-associated h
augucacgucgcucuuuac

SEQ ID NO: 2150882 - RNA, 12 nt, Human herpesvirus 8 [Kaposi`s sarcoma-associated h
auaacagugcuc

SEQ ID NO: 2150883 - RNA, 19 nt, Human herpesvirus 8 [Kaposi`s sarcoma-associated h
gaucacgcccgugugcaug

SEQ ID NO: 2150884 - RNA, 17 nt, Human herpesvirus 8 [Kaposi`s sarcoma-associated h
gccauucgcaccaggac

SEQ ID NO: 2150885 - RNA, 14 nt, Human herpesvirus 8 [Kaposi`s sarcoma-associated h
ucccgugcccaggc

SEQ ID NO: 2150886 - RNA, 17 nt, Human herpesvirus 8 [Kaposi`s sarcoma-associated h
gacggacggcaccaagg

SEQ ID NO: 2150887 - RNA, 14 nt, Human herpesvirus 8 [Kaposi`s sarcoma-associated h
caucgccgccagca

SEQ ID NO: 2150888 - RNA, 21 nt, Human herpesvirus 8 [Kaposi`s sarcoma-associated h
ggaucucuaacgauacccaug

SEQ ID NO: 2150889 - RNA, 21 nt, Human herpesvirus 8 [Kaposi`s sarcoma-associated h
guaaugcugccccuagaccug

SEQ ID NO: 2150890 - RNA, 18 nt, Human herpesvirus 8 [Kaposi`s sarcoma-associated h
ccacccuaauacauaaca

SEQ ID NO: 2150891 - RNA, 23 nt, Human herpesvirus 8 [Kaposi`s sarcoma-associated h
cccucuuggcuguuacaauaaag

SEQ ID NO: 2150892 - RNA, 16 nt, Human herpesvirus 8 [Kaposi`s sarcoma-associated h
ugaaugcuuccgcgac

SEQ ID NO: 2150893 - RNA, 14 nt, Human herpesvirus 8 [Kaposi`s sarcoma-associated h
agaauacagugcua

SEQ ID NO: 2150894 - RNA, 21 nt, Human herpesvirus 8 [Kaposi`s sarcoma-associated h
cgaacagaagacccagaaaau

SEQ ID NO: 2150895 - RNA, 21 nt, Human herpesvirus 8 [Kaposi`s sarcoma-associated h
gaaguucauauucccaccucc

SEQ ID NO: 2150896 - RNA, 19 nt, Human herpesvirus 8 [Kaposi`s sarcoma-associated h
cgauauguccuucacuuug

SEQ ID NO: 2150897 - RNA, 16 nt, Human herpesvirus 8 [Kaposi`s sarcoma-associated h
cauggcaaaaaacacu

SEQ ID NO: 2150898 - RNA, 17 nt, Human herpesvirus 8 [Kaposi`s sarcoma-associated h
gauccaggagcgacugg

SEQ ID NO: 2150899 - RNA, 21 nt, Human herpesvirus 8 [Kaposi`s sarcoma-associated h
gaucucagaggcccauauuac

SEQ ID NO: 2150900 - RNA, 16 nt, Human herpesvirus 8 [Kaposi`s sarcoma-associated h
accacggcacaggacc

SEQ ID NO: 2150901 - RNA, 18 nt, Human herpesvirus 8 [Kaposi`s sarcoma-associated h
ccgagccacaaaguacau

SEQ ID NO: 2150902 - RNA, 14 nt, Human herpesvirus 8 [Kaposi`s sarcoma-associated h
acccugauuagcac

SEQ ID NO: 2150903 - RNA, 22 nt, Human herpesvirus 8 [Kaposi`s sarcoma-associated h
agcguucguguucaucgcugcc

SEQ ID NO: 2150904 - RNA, 20 nt, Human herpesvirus 8 [Kaposi`s sarcoma-associated h
gcucagcgaugccgacaagg

SEQ ID NO: 2150905 - RNA, 19 nt, Human herpesvirus 8 [Kaposi`s sarcoma-associated h
ugagagcuggagggcacag

SEQ ID NO: 2150906 - RNA, 18 nt, Human herpesvirus 8 [Kaposi`s sarcoma-associated h
aggcgcugaaaagggaac

SEQ ID NO: 2150907 - RNA, 14 nt, Human herpesvirus 8 [Kaposi`s sarcoma-associated h
cgagcuaggagugg

SEQ ID NO: 2150908 - RNA, 16 nt, Human herpesvirus 8 [Kaposi`s sarcoma-associated h
uugggaauggccgaac

SEQ ID NO: 2150909 - RNA, 22 nt, Human herpesvirus 8 [Kaposi`s sarcoma-associated h
agaguuccccgggaacggacaa

SEQ ID NO: 2150910 - RNA, 17 nt, Human herpesvirus 8 [Kaposi`s sarcoma-associated h
agagccagccuggacga

SEQ ID NO: 2150911 - RNA, 21 nt, Human herpesvirus 8 [Kaposi`s sarcoma-associated h
cugaugcucuggccacguugg

SEQ ID NO: 2150912 - RNA, 15 nt, Human herpesvirus 8 [Kaposi`s sarcoma-associated h
agccacaaaguacau

SEQ ID NO: 2150913 - RNA, 18 nt, Human herpesvirus 8 [Kaposi`s sarcoma-associated h
agucugaaccccgugugg

SEQ ID NO: 2150914 - RNA, 21 nt, Human herpesvirus 8 [Kaposi`s sarcoma-associated h
caacaauagggauacuguuua

SEQ ID NO: 2150915 - RNA, 21 nt, Human herpesvirus 8 [Kaposi`s sarcoma-associated h
gaugccaguagcaugcugaug

SEQ ID NO: 2150916 - RNA, 17 nt, Human herpesvirus 8 [Kaposi`s sarcoma-associated h
acgcaccgcaagcagca

SEQ ID NO: 2150917 - RNA, 20 nt, Human herpesvirus 8 [Kaposi`s sarcoma-associated h
gcucgagaacugucgagaca

SEQ ID NO: 2150918 - RNA, 17 nt, Human herpesvirus 8 [Kaposi`s sarcoma-associated h
caagcuacuggccuggc

SEQ ID NO: 2150919 - RNA, 21 nt, Human herpesvirus 8 [Kaposi`s sarcoma-associated h
uaacgagcgucgauggcccug

SEQ ID NO: 2150920 - RNA, 19 nt, Human herpesvirus 8 [Kaposi`s sarcoma-associated h
gccucugaagcaccacaua

SEQ ID NO: 2150921 - RNA, 15 nt, Human herpesvirus 8 [Kaposi`s sarcoma-associated h
acuguucuccacgua

SEQ ID NO: 2150922 - RNA, 19 nt, Human herpesvirus 8 [Kaposi`s sarcoma-associated h
gacgauguucaggaggaag

SEQ ID NO: 2150923 - RNA, 19 nt, Human herpesvirus 8 [Kaposi`s sarcoma-associated h
augcccaacuucaucacau

SEQ ID NO: 2150924 - RNA, 16 nt, Human herpesvirus 8 [Kaposi`s sarcoma-associated h
gggacgugcgggccaa

SEQ ID NO: 2150925 - RNA, 21 nt, Human herpesvirus 8 [Kaposi`s sarcoma-associated h
acaguugugaucucuggagac

SEQ ID NO: 2150926 - RNA, 14 nt, Human herpesvirus 8 [Kaposi`s sarcoma-associated h
cgcagaacaguacc

SEQ ID NO: 2150927 - RNA, 19 nt, Human herpesvirus 8 [Kaposi`s sarcoma-associated h
auucuacuuaaaauagcuc

SEQ ID NO: 2150928 - RNA, 21 nt, Human herpesvirus 8 [Kaposi`s sarcoma-associated h
ugugguuaagcuuugcagcca

SEQ ID NO: 2150929 - RNA, 13 nt, Human herpesvirus 8 [Kaposi`s sarcoma-associated h
ucuacgugcccuu

SEQ ID NO: 2150930 - RNA, 12 nt, Human herpesvirus 8 [Kaposi`s sarcoma-associated h
aauacagugcua

SEQ ID NO: 2150931 - RNA, 18 nt, Human herpesvirus 8 [Kaposi`s sarcoma-associated h
agacuggugcgcacaggc

SEQ ID NO: 2150932 - RNA, 24 nt, Human herpesvirus 8 [Kaposi`s sarcoma-associated h
ccccgggcguggugccggaugcag

SEQ ID NO: 2150933 - RNA, 14 nt, Human herpesvirus 8 [Kaposi`s sarcoma-associated h
gcggauaggcuggg

SEQ ID NO: 2150934 - RNA, 16 nt, Human herpesvirus 8 [Kaposi`s sarcoma-associated h
ucuaguggagagggcc

SEQ ID NO: 2150935 - RNA, 11 nt, Human herpesvirus 8 [Kaposi`s sarcoma-associated h
ccugugcauuc

SEQ ID NO: 2150936 - RNA, 14 nt, Human herpesvirus 8 [Kaposi`s sarcoma-associated h
uuaaaugaacauug

SEQ ID NO: 2150937 - RNA, 13 nt, Human herpesvirus 8 [Kaposi`s sarcoma-associated h
gccugguggagca

SEQ ID NO: 2150938 - RNA, 15 nt, Human herpesvirus 8 [Kaposi`s sarcoma-associated h
caaaugauauuuuga

SEQ ID NO: 2150939 - RNA, 13 nt, Human herpesvirus 8 [Kaposi`s sarcoma-associated h
uggcagcgcacca

SEQ ID NO: 2150940 - RNA, 19 nt, Human herpesvirus 8 [Kaposi`s sarcoma-associated h
cggaucaugcucucaccgc

SEQ ID NO: 2150941 - RNA, 13 nt, Human herpesvirus 8 [Kaposi`s sarcoma-associated h
uuaggggcacccu

SEQ ID NO: 2150942 - RNA, 17 nt, Human herpesvirus 8 [Kaposi`s sarcoma-associated h
augaggccaagugcauu

SEQ ID NO: 2150943 - RNA, 13 nt, Human herpesvirus 8 [Kaposi`s sarcoma-associated h
auuggagcucuua

SEQ ID NO: 2150944 - RNA, 21 nt, Human herpesvirus 8 [Kaposi`s sarcoma-associated h
cccuggauggguuaacagugg

SEQ ID NO: 2150945 - RNA, 23 nt, Human herpesvirus 8 [Kaposi`s sarcoma-associated h
gugauuggucuuauaacagugcu

SEQ ID NO: 2150946 - RNA, 15 nt, Human herpesvirus 8 [Kaposi`s sarcoma-associated h
acacggaaggcagug

SEQ ID NO: 2150947 - RNA, 18 nt, Human herpesvirus 8 [Kaposi`s sarcoma-associated h
ccaaaugcccagaaugaa

SEQ ID NO: 2150948 - RNA, 17 nt, Human herpesvirus 8 [Kaposi`s sarcoma-associated h
acggcguguuuugccug

SEQ ID NO: 2150949 - RNA, 19 nt, Human herpesvirus 8 [Kaposi`s sarcoma-associated h
gcgacggaaguuggccucc

SEQ ID NO: 2150950 - RNA, 17 nt, Human herpesvirus 8 [Kaposi`s sarcoma-associated h
aagaaauccgagcaccu

SEQ ID NO: 2150951 - RNA, 14 nt, Human herpesvirus 8 [Kaposi`s sarcoma-associated h
aagcuguacauaau

SEQ ID NO: 2150952 - RNA, 15 nt, Human herpesvirus 8 [Kaposi`s sarcoma-associated h
ccuccagcaaagcac

SEQ ID NO: 2150953 - RNA, 18 nt, Human herpesvirus 8 [Kaposi`s sarcoma-associated h
auguacuugaacagggca

SEQ ID NO: 2150954 - RNA, 12 nt, Human herpesvirus 8 [Kaposi`s sarcoma-associated h
aaagcugucacu

SEQ ID NO: 2150955 - RNA, 15 nt, Human herpesvirus 8 [Kaposi`s sarcoma-associated h
ggcguccgcucuccc

SEQ ID NO: 2150956 - RNA, 18 nt, Human herpesvirus 8 [Kaposi`s sarcoma-associated h
aucccccacaggacaagc

SEQ ID NO: 2150957 - RNA, 14 nt, Human herpesvirus 8 [Kaposi`s sarcoma-associated h
ucgccgcuccgcac

SEQ ID NO: 2150958 - RNA, 22 nt, Human herpesvirus 8 [Kaposi`s sarcoma-associated h
gcaucgucgcgccuggcgugau

SEQ ID NO: 2150959 - RNA, 17 nt, Human herpesvirus 8 [Kaposi`s sarcoma-associated h
acacuuccaccuccccu

SEQ ID NO: 2150960 - RNA, 20 nt, Human herpesvirus 8 [Kaposi`s sarcoma-associated h
acauugugucaaccagggca

SEQ ID NO: 2150961 - RNA, 16 nt, Human herpesvirus 8 [Kaposi`s sarcoma-associated h
uggaauauaaugugaa

SEQ ID NO: 2150962 - RNA, 12 nt, Human herpesvirus 8 [Kaposi`s sarcoma-associated h
gagagacugcag

SEQ ID NO: 2150963 - RNA, 16 nt, Human herpesvirus 8 [Kaposi`s sarcoma-associated h
aguuaaagcugucacu

SEQ ID NO: 2150964 - RNA, 14 nt, Human herpesvirus 8 [Kaposi`s sarcoma-associated h
gaggaagaugaaga

SEQ ID NO: 2150965 - RNA, 21 nt, Human herpesvirus 8 [Kaposi`s sarcoma-associated h
aagcauccggacugagauuuc

SEQ ID NO: 2150966 - RNA, 18 nt, Human herpesvirus 8 [Kaposi`s sarcoma-associated h
gccgucagggcccacggu

SEQ ID NO: 2150967 - RNA, 22 nt, Human herpesvirus 8 [Kaposi`s sarcoma-associated h
cauccacgcggauaggcugggg

SEQ ID NO: 2150968 - RNA, 21 nt, Human herpesvirus 8 [Kaposi`s sarcoma-associated h
gauucuuuuaaucuguuuauu

SEQ ID NO: 2150969 - RNA, 12 nt, Human herpesvirus 8 [Kaposi`s sarcoma-associated h
uuaugucaguuc

SEQ ID NO: 2150970 - RNA, 19 nt, Human herpesvirus 8 [Kaposi`s sarcoma-associated h
gggauggaggaagagggau

SEQ ID NO: 2150971 - RNA, 14 nt, Human herpesvirus 8 [Kaposi`s sarcoma-associated h
caauugacugugga

SEQ ID NO: 2150972 - RNA, 22 nt, Human herpesvirus 8 [Kaposi`s sarcoma-associated h
gcgaauucgcgugguccuggau

SEQ ID NO: 2150973 - RNA, 16 nt, Human herpesvirus 8 [Kaposi`s sarcoma-associated h
cagugaguccuggccc

SEQ ID NO: 2150974 - RNA, 19 nt, Human herpesvirus 8 [Kaposi`s sarcoma-associated h
uguccccugcaaugcaagg

SEQ ID NO: 2150975 - RNA, 17 nt, Human herpesvirus 8 [Kaposi`s sarcoma-associated h
cuaugacuaggaggaag

SEQ ID NO: 2150976 - RNA, 18 nt, Human herpesvirus 8 [Kaposi`s sarcoma-associated h
augacaccccucccucgc

SEQ ID NO: 2150977 - RNA, 18 nt, Human herpesvirus 8 [Kaposi`s sarcoma-associated h
cucccccuuuuuccuccc

SEQ ID NO: 2150978 - RNA, 13 nt, Human herpesvirus 8 [Kaposi`s sarcoma-associated h
cguuuccauauga

SEQ ID NO: 2150979 - RNA, 21 nt, Human herpesvirus 8 [Kaposi`s sarcoma-associated h
uggguguaagcuguacauaau

SEQ ID NO: 2150980 - RNA, 18 nt, Human herpesvirus 8 [Kaposi`s sarcoma-associated h
aggcggggaggagggggu

SEQ ID NO: 2150981 - RNA, 20 nt, Human herpesvirus 8 [Kaposi`s sarcoma-associated h
agaacugucgagacauguca

SEQ ID NO: 2150982 - RNA, 22 nt, Human herpesvirus 8 [Kaposi`s sarcoma-associated h
acgugcguggggguuggguggc

SEQ ID NO: 2150983 - RNA, 16 nt, Human herpesvirus 8 [Kaposi`s sarcoma-associated h
aaacaugcccuccugg

SEQ ID NO: 2150984 - RNA, 18 nt, Human herpesvirus 8 [Kaposi`s sarcoma-associated h
ucccgugcguuugcagug

SEQ ID NO: 2150985 - RNA, 15 nt, Human herpesvirus 8 [Kaposi`s sarcoma-associated h
augaguuccacacag

SEQ ID NO: 2150986 - RNA, 16 nt, Human herpesvirus 8 [Kaposi`s sarcoma-associated h
uugggauucacucagc

SEQ ID NO: 2150987 - RNA, 22 nt, Human herpesvirus 8 [Kaposi`s sarcoma-associated h
ggcagaaaauggcacacgguua

SEQ ID NO: 2150988 - RNA, 21 nt, Human herpesvirus 8 [Kaposi`s sarcoma-associated h
ugauuugauacagggacagau

SEQ ID NO: 2150989 - RNA, 12 nt, Human herpesvirus 8 [Kaposi`s sarcoma-associated h
gcaaaacacaaa

SEQ ID NO: 2150990 - RNA, 20 nt, Human herpesvirus 8 [Kaposi`s sarcoma-associated h
gccaccgucgccgcuccgca

SEQ ID NO: 2150991 - RNA, 15 nt, Human herpesvirus 8 [Kaposi`s sarcoma-associated h
cccagugccucagca

SEQ ID NO: 2150992 - RNA, 21 nt, Human herpesvirus 8 [Kaposi`s sarcoma-associated h
cuccagacucuucgcugauga

SEQ ID NO: 2150993 - RNA, 12 nt, Human herpesvirus 8 [Kaposi`s sarcoma-associated h
cuggcagggugg

SEQ ID NO: 2150994 - RNA, 18 nt, Human herpesvirus 8 [Kaposi`s sarcoma-associated h
agucgccgguagcugccu

SEQ ID NO: 2150995 - RNA, 12 nt, Human herpesvirus 8 [Kaposi`s sarcoma-associated h
gacgccacugcu

SEQ ID NO: 2150996 - RNA, 20 nt, Human herpesvirus 8 [Kaposi`s sarcoma-associated h
gacaccgucgccaaacaggc

SEQ ID NO: 2150997 - RNA, 14 nt, Human herpesvirus 8 [Kaposi`s sarcoma-associated h
caaagccguuccca

SEQ ID NO: 2150998 - RNA, 21 nt, Human herpesvirus 8 [Kaposi`s sarcoma-associated h
aaugagucaggcguggucucu

SEQ ID NO: 2150999 - RNA, 14 nt, Human herpesvirus 8 [Kaposi`s sarcoma-associated h
ccauccgcgagcca

SEQ ID NO: 2151000 - RNA, 20 nt, Human herpesvirus 8 [Kaposi`s sarcoma-associated h
ucguguucaucgcugcccca

SEQ ID NO: 2151001 - RNA, 18 nt, Human herpesvirus 8 [Kaposi`s sarcoma-associated h
ccguucccaugagccucc

SEQ ID NO: 2151002 - RNA, 21 nt, Human herpesvirus 8 [Kaposi`s sarcoma-associated h
aggggcagacccaaaaaggac

SEQ ID NO: 2151003 - RNA, 17 nt, Human herpesvirus 8 [Kaposi`s sarcoma-associated h
agcuuugcagccaggua

SEQ ID NO: 2151004 - RNA, 21 nt, Human herpesvirus 8 [Kaposi`s sarcoma-associated h
ccucagugugcuguccagcgu

SEQ ID NO: 2151005 - RNA, 19 nt, Human herpesvirus 8 [Kaposi`s sarcoma-associated h
ugcccugguugacacaaug

SEQ ID NO: 2151006 - RNA, 17 nt, Human herpesvirus 8 [Kaposi`s sarcoma-associated h
cugcgcauuuccugccc

SEQ ID NO: 2151007 - RNA, 22 nt, Human herpesvirus 8 [Kaposi`s sarcoma-associated h
cugcgcauuuccugcccugguu

SEQ ID NO: 2151008 - RNA, 12 nt, Human herpesvirus 8 [Kaposi`s sarcoma-associated h
ugcagccaggaa

SEQ ID NO: 2151009 - RNA, 20 nt, Human herpesvirus 8 [Kaposi`s sarcoma-associated h
guucgaccaccccugcaccu

SEQ ID NO: 2151010 - RNA, 16 nt, Human herpesvirus 8 [Kaposi`s sarcoma-associated h
caucauaaaguacuuu

SEQ ID NO: 2151011 - RNA, 21 nt, Human herpesvirus 8 [Kaposi`s sarcoma-associated h
cugcggcgcaaaaacagcugg

SEQ ID NO: 2151012 - RNA, 16 nt, Human herpesvirus 8 [Kaposi`s sarcoma-associated h
cauguaaauuggccac

SEQ ID NO: 2151013 - RNA, 18 nt, Human herpesvirus 8 [Kaposi`s sarcoma-associated h
gucaaccagauuuaagau

SEQ ID NO: 2151014 - RNA, 16 nt, Human herpesvirus 8 [Kaposi`s sarcoma-associated h
uuaagaagccacuugu

SEQ ID NO: 2151015 - RNA, 20 nt, Human herpesvirus 8 [Kaposi`s sarcoma-associated h
cauugccacccagcuacugg

SEQ ID NO: 2151016 - RNA, 19 nt, Human herpesvirus 8 [Kaposi`s sarcoma-associated h
uaugucuguguuuuguaaa

SEQ ID NO: 2151017 - RNA, 12 nt, Human herpesvirus 8 [Kaposi`s sarcoma-associated h
aagagggauggg

SEQ ID NO: 2151018 - RNA, 17 nt, Human herpesvirus 8 [Kaposi`s sarcoma-associated h
uagcuaugcccaccguc

SEQ ID NO: 2151019 - RNA, 17 nt, Human herpesvirus 8 [Kaposi`s sarcoma-associated h
cccacguggugcugccu

SEQ ID NO: 2151020 - RNA, 16 nt, Human herpesvirus 8 [Kaposi`s sarcoma-associated h
agguccccggaagagu

SEQ ID NO: 2151021 - RNA, 22 nt, Human herpesvirus 8 [Kaposi`s sarcoma-associated h
cuggagaaggguggguggggau

SEQ ID NO: 2151022 - RNA, 13 nt, Human herpesvirus 8 [Kaposi`s sarcoma-associated h
uccaggagcgacu

SEQ ID NO: 2151023 - RNA, 21 nt, Human herpesvirus 8 [Kaposi`s sarcoma-associated h
uuucagacguccaguuccccc

SEQ ID NO: 2151024 - RNA, 16 nt, Human herpesvirus 8 [Kaposi`s sarcoma-associated h
gcauaccacgugugug

SEQ ID NO: 2151025 - RNA, 22 nt, Human herpesvirus 8 [Kaposi`s sarcoma-associated h
aaggcuacgugaguuacaugga

SEQ ID NO: 2151026 - RNA, 11 nt, Human herpesvirus 8 [Kaposi`s sarcoma-associated h
ggcguguccag

SEQ ID NO: 2151027 - RNA, 21 nt, Human herpesvirus 8 [Kaposi`s sarcoma-associated h
caucaacaggagggcagcugu

SEQ ID NO: 2151028 - RNA, 16 nt, Human herpesvirus 8 [Kaposi`s sarcoma-associated h
ugugcggcgcagcagc

SEQ ID NO: 2151029 - RNA, 15 nt, Human herpesvirus 8 [Kaposi`s sarcoma-associated h
acgcguuaagaagcc

SEQ ID NO: 2151030 - RNA, 22 nt, Human herpesvirus 8 [Kaposi`s sarcoma-associated h
ccauccccggcguccucucaug

SEQ ID NO: 2151031 - RNA, 15 nt, Human herpesvirus 8 [Kaposi`s sarcoma-associated h
uuguggaccuccgcc

SEQ ID NO: 2151032 - RNA, 18 nt, Human herpesvirus 8 [Kaposi`s sarcoma-associated h
gcccucuucuguugccag

SEQ ID NO: 2151033 - RNA, 22 nt, Human herpesvirus 8 [Kaposi`s sarcoma-associated h
ccuggauggguuaacaguggau

SEQ ID NO: 2151034 - RNA, 16 nt, Human herpesvirus 8 [Kaposi`s sarcoma-associated h
uggggggaggaggaaa

SEQ ID NO: 2151035 - RNA, 19 nt, Human herpesvirus 8 [Kaposi`s sarcoma-associated h
cuguuugcuuaauaaauug

SEQ ID NO: 2151036 - RNA, 13 nt, Human herpesvirus 8 [Kaposi`s sarcoma-associated h
gagaacagcacau

SEQ ID NO: 2151037 - RNA, 16 nt, Human herpesvirus 8 [Kaposi`s sarcoma-associated h
gggccuucgcacccca

SEQ ID NO: 2151038 - RNA, 18 nt, Human herpesvirus 8 [Kaposi`s sarcoma-associated h
agcgggguuuccagggaa

SEQ ID NO: 2151039 - RNA, 13 nt, Human herpesvirus 8 [Kaposi`s sarcoma-associated h
gcaccuggacccc

SEQ ID NO: 2151040 - RNA, 15 nt, Human herpesvirus 8 [Kaposi`s sarcoma-associated h
aaagcugagccacaa

SEQ ID NO: 2151041 - RNA, 18 nt, Human herpesvirus 8 [Kaposi`s sarcoma-associated h
auaaucuaaauauucucu

SEQ ID NO: 2151042 - RNA, 19 nt, Human herpesvirus 8 [Kaposi`s sarcoma-associated h
ugcgaacuugcucuuuuca

SEQ ID NO: 2151043 - RNA, 19 nt, Human herpesvirus 8 [Kaposi`s sarcoma-associated h
caagcuugagcuuuucaaa

SEQ ID NO: 2151044 - RNA, 17 nt, Human herpesvirus 8 [Kaposi`s sarcoma-associated h
ccagcuccuauugcaac

SEQ ID NO: 2151045 - RNA, 23 nt, Human herpesvirus 8 [Kaposi`s sarcoma-associated h
ccggguuguuugugggacacggu

SEQ ID NO: 2151046 - RNA, 14 nt, Human herpesvirus 8 [Kaposi`s sarcoma-associated h
gcaccgcaagcagc

SEQ ID NO: 2151047 - RNA, 11 nt, Human herpesvirus 8 [Kaposi`s sarcoma-associated h
augcucucacc

SEQ ID NO: 2151048 - RNA, 20 nt, Human herpesvirus 8 [Kaposi`s sarcoma-associated h
aucgccguguugcgcgcugg

SEQ ID NO: 2151049 - RNA, 18 nt, Human herpesvirus 8 [Kaposi`s sarcoma-associated h
uaaagauuaacugucuac

SEQ ID NO: 2151050 - RNA, 12 nt, Human herpesvirus 8 [Kaposi`s sarcoma-associated h
aucuccuggaga

SEQ ID NO: 2151051 - RNA, 19 nt, Human herpesvirus 8 [Kaposi`s sarcoma-associated h
gagcaagacgccagacagc

SEQ ID NO: 2151052 - RNA, 21 nt, Human herpesvirus 8 [Kaposi`s sarcoma-associated h
aggggaguaggguaggaaggg

SEQ ID NO: 2151053 - RNA, 19 nt, Human herpesvirus 8 [Kaposi`s sarcoma-associated h
ccggacugagauuucccua

SEQ ID NO: 2151054 - RNA, 18 nt, Human herpesvirus 8 [Kaposi`s sarcoma-associated h
uggcccgucuguauacgu

SEQ ID NO: 2151055 - RNA, 13 nt, Human herpesvirus 8 [Kaposi`s sarcoma-associated h
gauucugacagac

SEQ ID NO: 2151056 - RNA, 11 nt, Human herpesvirus 8 [Kaposi`s sarcoma-associated h
acaauaaagcu

SEQ ID NO: 2151057 - RNA, 18 nt, Human herpesvirus 8 [Kaposi`s sarcoma-associated h
cgugaaugggggcagugc

SEQ ID NO: 2151058 - RNA, 23 nt, Human herpesvirus 8 [Kaposi`s sarcoma-associated h
agauuggguugggaggugacccu

SEQ ID NO: 2151059 - RNA, 22 nt, Human herpesvirus 8 [Kaposi`s sarcoma-associated h
aaacauuggcgggugugucuug

SEQ ID NO: 2151060 - RNA, 12 nt, Human herpesvirus 8 [Kaposi`s sarcoma-associated h
ucuauguuuccu

SEQ ID NO: 2151061 - RNA, 19 nt, Human herpesvirus 8 [Kaposi`s sarcoma-associated h
acgcccgggggccaggacu

SEQ ID NO: 2151062 - RNA, 22 nt, Human herpesvirus 8 [Kaposi`s sarcoma-associated h
uccaguagauuuaguacguggu

SEQ ID NO: 2151063 - RNA, 21 nt, Human herpesvirus 8 [Kaposi`s sarcoma-associated h
ggccaggcccugcauccggca

SEQ ID NO: 2151064 - RNA, 19 nt, Human herpesvirus 8 [Kaposi`s sarcoma-associated h
cggugaacguccccgcguc

SEQ ID NO: 2151065 - RNA, 13 nt, Human herpesvirus 8 [Kaposi`s sarcoma-associated h
cggaugacaggga

SEQ ID NO: 2151066 - RNA, 23 nt, Human herpesvirus 8 [Kaposi`s sarcoma-associated h
gagcguuucgugaaacgugccug

SEQ ID NO: 2151067 - RNA, 18 nt, Human herpesvirus 8 [Kaposi`s sarcoma-associated h
cuaucagcugcagccagg

SEQ ID NO: 2151068 - RNA, 18 nt, Human herpesvirus 8 [Kaposi`s sarcoma-associated h
agcucaucaaugggagaa

SEQ ID NO: 2151069 - RNA, 15 nt, Human herpesvirus 8 [Kaposi`s sarcoma-associated h
gucgcuggcgcaggc

SEQ ID NO: 2151070 - RNA, 15 nt, Human herpesvirus 8 [Kaposi`s sarcoma-associated h
uggccugugcccaaa

SEQ ID NO: 2151071 - RNA, 23 nt, Human herpesvirus 8 [Kaposi`s sarcoma-associated h
gccguguugcgcgcuggcucaga

SEQ ID NO: 2151072 - RNA, 20 nt, Human herpesvirus 8 [Kaposi`s sarcoma-associated h
aagcuucaucguggugcccu

SEQ ID NO: 2151073 - RNA, 23 nt, Human herpesvirus 8 [Kaposi`s sarcoma-associated h
gccacagucgagccgccaggaac

SEQ ID NO: 2151074 - RNA, 15 nt, Human herpesvirus 8 [Kaposi`s sarcoma-associated h
gguagauugacugga

SEQ ID NO: 2151075 - RNA, 15 nt, Human herpesvirus 8 [Kaposi`s sarcoma-associated h
ccaccacgccacaac

SEQ ID NO: 2151076 - RNA, 22 nt, Human herpesvirus 8 [Kaposi`s sarcoma-associated h
gaauaaaauacguacagaaaac

SEQ ID NO: 2151077 - RNA, 14 nt, Human herpesvirus 8 [Kaposi`s sarcoma-associated h
uccucaaacauggg

SEQ ID NO: 2151078 - RNA, 23 nt, Human herpesvirus 8 [Kaposi`s sarcoma-associated h
ccacggugucguguaugccaaua

SEQ ID NO: 2151079 - RNA, 20 nt, Human herpesvirus 8 [Kaposi`s sarcoma-associated h
cuagaauuggagcacuuuug

SEQ ID NO: 2151080 - RNA, 20 nt, Human herpesvirus 8 [Kaposi`s sarcoma-associated h
gagcauuuuucccuccugca

SEQ ID NO: 2151081 - RNA, 13 nt, Human herpesvirus 8 [Kaposi`s sarcoma-associated h
cuuguacaugugu

SEQ ID NO: 2151082 - RNA, 18 nt, Human herpesvirus 8 [Kaposi`s sarcoma-associated h
gggcacccuauccaucag

SEQ ID NO: 2151083 - RNA, 16 nt, Human herpesvirus 8 [Kaposi`s sarcoma-associated h
aacccucuacucuucc

SEQ ID NO: 2151084 - RNA, 23 nt, Human herpesvirus 8 [Kaposi`s sarcoma-associated h
uagugggguggcgcgccacaguc

SEQ ID NO: 2151085 - RNA, 23 nt, Human herpesvirus 8 [Kaposi`s sarcoma-associated h
gacgccauuugcgugcaaaaugu

SEQ ID NO: 2151086 - RNA, 13 nt, Human herpesvirus 8 [Kaposi`s sarcoma-associated h
ccacaaaguacau

SEQ ID NO: 2151087 - RNA, 16 nt, Human herpesvirus 8 [Kaposi`s sarcoma-associated h
acuuaacuguuuacug

SEQ ID NO: 2151088 - RNA, 12 nt, Human herpesvirus 8 [Kaposi`s sarcoma-associated h
auaauggauggc

SEQ ID NO: 2151089 - RNA, 22 nt, Human herpesvirus 8 [Kaposi`s sarcoma-associated h
gagcuguuacccugcucuggac

SEQ ID NO: 2151090 - RNA, 15 nt, Human herpesvirus 8 [Kaposi`s sarcoma-associated h
ggagucagagcagug

SEQ ID NO: 2151091 - RNA, 19 nt, Human herpesvirus 8 [Kaposi`s sarcoma-associated h
uaggccaauacugcccaag

SEQ ID NO: 2151092 - RNA, 11 nt, Human herpesvirus 8 [Kaposi`s sarcoma-associated h
uaggugucaag

SEQ ID NO: 2151093 - RNA, 13 nt, Human herpesvirus 8 [Kaposi`s sarcoma-associated h
ccacgguggcccu

SEQ ID NO: 2151094 - RNA, 20 nt, Human herpesvirus 8 [Kaposi`s sarcoma-associated h
uguaaaucgggccacuuugc

SEQ ID NO: 2151095 - RNA, 17 nt, Human herpesvirus 8 [Kaposi`s sarcoma-associated h
gaagccgagcucgggac

SEQ ID NO: 2151096 - RNA, 12 nt, Human herpesvirus 8 [Kaposi`s sarcoma-associated h
aagcacuggcug

SEQ ID NO: 2151097 - RNA, 14 nt, Human herpesvirus 8 [Kaposi`s sarcoma-associated h
cccgcccggggcgc

SEQ ID NO: 2151098 - RNA, 20 nt, Human herpesvirus 8 [Kaposi`s sarcoma-associated h
accucgaugggauauuuccu

SEQ ID NO: 2151099 - RNA, 16 nt, Human herpesvirus 8 [Kaposi`s sarcoma-associated h
ccucaacccacacugg

SEQ ID NO: 2151100 - RNA, 22 nt, Human herpesvirus 8 [Kaposi`s sarcoma-associated h
aagucagugccacaauuucauu

SEQ ID NO: 2151101 - RNA, 16 nt, Human herpesvirus 8 [Kaposi`s sarcoma-associated h
cuuucaucacuuccag

SEQ ID NO: 2151102 - RNA, 13 nt, Human herpesvirus 8 [Kaposi`s sarcoma-associated h
aagcgcugacgaa

SEQ ID NO: 2151103 - RNA, 20 nt, Human herpesvirus 8 [Kaposi`s sarcoma-associated h
aggggcagacccaaaaagga

SEQ ID NO: 2151104 - RNA, 17 nt, Human herpesvirus 8 [Kaposi`s sarcoma-associated h
ggaaguaugucguggga

SEQ ID NO: 2151105 - RNA, 15 nt, Human herpesvirus 8 [Kaposi`s sarcoma-associated h
gaaucaaugugguuc

SEQ ID NO: 2151106 - RNA, 20 nt, Human herpesvirus 8 [Kaposi`s sarcoma-associated h
ggacccagggugccuuggac

SEQ ID NO: 2151107 - RNA, 15 nt, Human herpesvirus 8 [Kaposi`s sarcoma-associated h
gcuuggcgaccucaa

SEQ ID NO: 2151108 - RNA, 16 nt, Human herpesvirus 8 [Kaposi`s sarcoma-associated h
caguuaaucuuuauug

SEQ ID NO: 2151109 - RNA, 13 nt, Human herpesvirus 8 [Kaposi`s sarcoma-associated h
ugagccagaauga

SEQ ID NO: 2151110 - RNA, 21 nt, Human herpesvirus 8 [Kaposi`s sarcoma-associated h
cucuaucagcugcagccagga

SEQ ID NO: 2151111 - RNA, 22 nt, Human herpesvirus 8 [Kaposi`s sarcoma-associated h
cgggagcuucggaaagcacugg

SEQ ID NO: 2151112 - RNA, 17 nt, Human herpesvirus 8 [Kaposi`s sarcoma-associated h
agccgcuugcugauaua

SEQ ID NO: 2151113 - RNA, 19 nt, Human herpesvirus 8 [Kaposi`s sarcoma-associated h
auuuauuuuuuacuacagg

SEQ ID NO: 2151114 - RNA, 14 nt, Human herpesvirus 8 [Kaposi`s sarcoma-associated h
uguaagcugcuggu

SEQ ID NO: 2151115 - RNA, 18 nt, Human herpesvirus 8 [Kaposi`s sarcoma-associated h
cccaauguuaauguucuc

SEQ ID NO: 2151116 - RNA, 21 nt, Human herpesvirus 8 [Kaposi`s sarcoma-associated h
ucgcaggccgaauaccucgug

SEQ ID NO: 2151117 - RNA, 12 nt, Human herpesvirus 8 [Kaposi`s sarcoma-associated h
agaacaugcugg

SEQ ID NO: 2151118 - RNA, 21 nt, Human herpesvirus 8 [Kaposi`s sarcoma-associated h
acguggcugaugcucuggcca

SEQ ID NO: 2151119 - RNA, 16 nt, Human herpesvirus 8 [Kaposi`s sarcoma-associated h
auuuuuuuccuaggcg

SEQ ID NO: 2151120 - RNA, 11 nt, Human herpesvirus 8 [Kaposi`s sarcoma-associated h
ugauagcugga

SEQ ID NO: 2151121 - RNA, 16 nt, Human herpesvirus 8 [Kaposi`s sarcoma-associated h
ugagcgcgcucugucg

SEQ ID NO: 2151122 - RNA, 12 nt, Human herpesvirus 8 [Kaposi`s sarcoma-associated h
ugagggugagug

SEQ ID NO: 2151123 - RNA, 20 nt, Human herpesvirus 8 [Kaposi`s sarcoma-associated h
agucacgcacuuggcccuga

SEQ ID NO: 2151124 - RNA, 17 nt, Human herpesvirus 8 [Kaposi`s sarcoma-associated h
ggacauggacaggggug

SEQ ID NO: 2151125 - RNA, 15 nt, Human herpesvirus 8 [Kaposi`s sarcoma-associated h
guaagaggacccagg

SEQ ID NO: 2151126 - RNA, 18 nt, Human herpesvirus 8 [Kaposi`s sarcoma-associated h
gcuguucucgccuggagc

SEQ ID NO: 2151127 - RNA, 18 nt, Human herpesvirus 8 [Kaposi`s sarcoma-associated h
cccguuguggcaccugag

SEQ ID NO: 2151128 - RNA, 22 nt, Human herpesvirus 8 [Kaposi`s sarcoma-associated h
uuaccaguauagugguuuacau

SEQ ID NO: 2151129 - RNA, 17 nt, Human herpesvirus 8 [Kaposi`s sarcoma-associated h
cgcagauaucgacgcgg

SEQ ID NO: 2151130 - RNA, 20 nt, Human herpesvirus 8 [Kaposi`s sarcoma-associated h
augcagcagcgugacacuac

SEQ ID NO: 2151131 - RNA, 18 nt, Human herpesvirus 8 [Kaposi`s sarcoma-associated h
gucagagaauacagugcu

SEQ ID NO: 2151132 - RNA, 17 nt, Human herpesvirus 8 [Kaposi`s sarcoma-associated h
auuuuuuacuacaggua

SEQ ID NO: 2151133 - RNA, 21 nt, Human herpesvirus 8 [Kaposi`s sarcoma-associated h
uagaucuggauacacuacuua

SEQ ID NO: 2151134 - RNA, 19 nt, Human herpesvirus 8 [Kaposi`s sarcoma-associated h
uaugucauuuuuacuuuua

SEQ ID NO: 2151135 - RNA, 12 nt, Human herpesvirus 8 [Kaposi`s sarcoma-associated h
uguaaaaaacuu

SEQ ID NO: 2151136 - RNA, 20 nt, Human herpesvirus 8 [Kaposi`s sarcoma-associated h
gccaccagguggcacccaac

SEQ ID NO: 2151137 - RNA, 13 nt, Human herpesvirus 8 [Kaposi`s sarcoma-associated h
aagucggcucugg

SEQ ID NO: 2151138 - RNA, 18 nt, Human herpesvirus 8 [Kaposi`s sarcoma-associated h
cuuaacgugucugaaugu

SEQ ID NO: 2151139 - RNA, 14 nt, Human herpesvirus 8 [Kaposi`s sarcoma-associated h
caguaaugcugccc

SEQ ID NO: 2151140 - RNA, 19 nt, Human herpesvirus 8 [Kaposi`s sarcoma-associated h
agcuuaccgcuacuguggg

SEQ ID NO: 2151141 - RNA, 19 nt, Human herpesvirus 8 [Kaposi`s sarcoma-associated h
cagucuaucgucuccagau

SEQ ID NO: 2151142 - RNA, 13 nt, Human herpesvirus 8 [Kaposi`s sarcoma-associated h
gcacuuuuggaaa

SEQ ID NO: 2151143 - RNA, 20 nt, Human herpesvirus 8 [Kaposi`s sarcoma-associated h
acuuugcccuaaaugugaca

SEQ ID NO: 2151144 - RNA, 20 nt, Human herpesvirus 8 [Kaposi`s sarcoma-associated h
ccagauccuccacagagccu

SEQ ID NO: 2151145 - RNA, 14 nt, Human herpesvirus 8 [Kaposi`s sarcoma-associated h
ccugcugcagcugg

SEQ ID NO: 2151146 - RNA, 24 nt, Human herpesvirus 8 [Kaposi`s sarcoma-associated h
auccacaggaagcgaaaagccugc

SEQ ID NO: 2151147 - RNA, 16 nt, Human herpesvirus 8 [Kaposi`s sarcoma-associated h
caaaauaccugucgcu

SEQ ID NO: 2151148 - RNA, 19 nt, Human herpesvirus 8 [Kaposi`s sarcoma-associated h
gaagaaaaggaugcacaac

SEQ ID NO: 2151149 - RNA, 14 nt, Human herpesvirus 8 [Kaposi`s sarcoma-associated h
gcaauaaagacaaa

SEQ ID NO: 2151150 - RNA, 15 nt, Human herpesvirus 8 [Kaposi`s sarcoma-associated h
caauagcgcugucau

SEQ ID NO: 2151151 - RNA, 20 nt, Human herpesvirus 8 [Kaposi`s sarcoma-associated h
guguacaaaaaaaacauagu

SEQ ID NO: 2151152 - RNA, 12 nt, Human herpesvirus 8 [Kaposi`s sarcoma-associated h
ggcuguggcacc

SEQ ID NO: 2151153 - RNA, 19 nt, Human herpesvirus 8 [Kaposi`s sarcoma-associated h
cugaaacgucgcccaaauc

SEQ ID NO: 2151154 - RNA, 17 nt, Human herpesvirus 8 [Kaposi`s sarcoma-associated h
uuaagcgccaagccauu

SEQ ID NO: 2151155 - RNA, 16 nt, Human herpesvirus 8 [Kaposi`s sarcoma-associated h
agugcucuuccuccua

SEQ ID NO: 2151156 - RNA, 16 nt, Human herpesvirus 8 [Kaposi`s sarcoma-associated h
cacucuacgcggcuag

SEQ ID NO: 2151157 - RNA, 19 nt, Human herpesvirus 8 [Kaposi`s sarcoma-associated h
caaucucucauagacuuuc

SEQ ID NO: 2151158 - RNA, 15 nt, Human herpesvirus 8 [Kaposi`s sarcoma-associated h
uaucagcugcagcca

SEQ ID NO: 2151159 - RNA, 20 nt, Human herpesvirus 8 [Kaposi`s sarcoma-associated h
gacaaacacuguggauuuua

SEQ ID NO: 2151160 - RNA, 18 nt, Human herpesvirus 8 [Kaposi`s sarcoma-associated h
gcauccuaucgcacagac

SEQ ID NO: 2151161 - RNA, 21 nt, Human herpesvirus 8 [Kaposi`s sarcoma-associated h
gcaccaagguaggccagcugc

SEQ ID NO: 2151162 - RNA, 14 nt, Human herpesvirus 8 [Kaposi`s sarcoma-associated h
gcugaucucagagg

SEQ ID NO: 2151163 - RNA, 15 nt, Human herpesvirus 8 [Kaposi`s sarcoma-associated h
ccagugaguccuggc

SEQ ID NO: 2151164 - RNA, 22 nt, Human herpesvirus 8 [Kaposi`s sarcoma-associated h
cuuggguuggcgagaagcccag

SEQ ID NO: 2151165 - RNA, 18 nt, Human herpesvirus 8 [Kaposi`s sarcoma-associated h
cgaccccagccccuuggu

SEQ ID NO: 2151166 - RNA, 17 nt, Human herpesvirus 8 [Kaposi`s sarcoma-associated h
caagcaaccggagcguu

SEQ ID NO: 2151167 - RNA, 18 nt, Human herpesvirus 8 [Kaposi`s sarcoma-associated h
ucugugucacuccccgag

SEQ ID NO: 2151168 - RNA, 16 nt, Human herpesvirus 8 [Kaposi`s sarcoma-associated h
caccuagcgggcacaa

SEQ ID NO: 2151169 - RNA, 21 nt, Human herpesvirus 8 [Kaposi`s sarcoma-associated h
uccucgcgucggccaccgcgg

SEQ ID NO: 2151170 - RNA, 19 nt, Human herpesvirus 8 [Kaposi`s sarcoma-associated h
caugauuugauacagggac

SEQ ID NO: 2151171 - RNA, 14 nt, Human herpesvirus 8 [Kaposi`s sarcoma-associated h
acuucgcuaacugu

SEQ ID NO: 2151172 - RNA, 11 nt, Human herpesvirus 8 [Kaposi`s sarcoma-associated h
caucagcggca

SEQ ID NO: 2151173 - RNA, 17 nt, Human herpesvirus 8 [Kaposi`s sarcoma-associated h
gugccugggugcugucc

SEQ ID NO: 2151174 - RNA, 19 nt, Human herpesvirus 8 [Kaposi`s sarcoma-associated h
agggugcgaaggaccugau

SEQ ID NO: 2151175 - RNA, 16 nt, Human herpesvirus 8 [Kaposi`s sarcoma-associated h
gcaaccugcugcagcu

SEQ ID NO: 2151176 - RNA, 15 nt, Human herpesvirus 8 [Kaposi`s sarcoma-associated h
caccugaggugcucu

SEQ ID NO: 2151177 - RNA, 18 nt, Human herpesvirus 8 [Kaposi`s sarcoma-associated h
uggcuucuauaagcaccu

SEQ ID NO: 2151178 - RNA, 23 nt, Human herpesvirus 8 [Kaposi`s sarcoma-associated h
aaaccccccucgucgacagagcc

SEQ ID NO: 2151179 - RNA, 19 nt, Human herpesvirus 8 [Kaposi`s sarcoma-associated h
ggagccggcccugacagag

SEQ ID NO: 2151180 - RNA, 15 nt, Human herpesvirus 8 [Kaposi`s sarcoma-associated h
uaaaagguuuccugu

SEQ ID NO: 2151181 - RNA, 21 nt, Human herpesvirus 8 [Kaposi`s sarcoma-associated h
gcaguguuugcugcuguaguu

SEQ ID NO: 2151182 - RNA, 15 nt, Human herpesvirus 8 [Kaposi`s sarcoma-associated h
ugcgugaacccucac

SEQ ID NO: 2151183 - RNA, 14 nt, Human herpesvirus 8 [Kaposi`s sarcoma-associated h
auuaagggggaagg

SEQ ID NO: 2151184 - RNA, 13 nt, Human herpesvirus 8 [Kaposi`s sarcoma-associated h
cccuagaagccac

SEQ ID NO: 2151185 - RNA, 14 nt, Human herpesvirus 8 [Kaposi`s sarcoma-associated h
aaagccgagccaca

SEQ ID NO: 2151186 - RNA, 18 nt, Human herpesvirus 8 [Kaposi`s sarcoma-associated h
ugcaaccugcugcagcug

SEQ ID NO: 2151187 - RNA, 17 nt, Human herpesvirus 8 [Kaposi`s sarcoma-associated h
cuugguaacucccucaa

SEQ ID NO: 2151188 - RNA, 22 nt, Human herpesvirus 8 [Kaposi`s sarcoma-associated h
cuauaaacagccuuggugcuag

SEQ ID NO: 2151189 - RNA, 15 nt, Human herpesvirus 8 [Kaposi`s sarcoma-associated h
cuguuuccagugacc

SEQ ID NO: 2151190 - RNA, 19 nt, Human herpesvirus 8 [Kaposi`s sarcoma-associated h
ggccagagguuugaggcgc

SEQ ID NO: 2151191 - RNA, 21 nt, Human herpesvirus 8 [Kaposi`s sarcoma-associated h
ucgccaacggacgcgccacuc

SEQ ID NO: 2151192 - RNA, 21 nt, Human herpesvirus 8 [Kaposi`s sarcoma-associated h
cauauacagguguccaagacu

SEQ ID NO: 2151193 - RNA, 17 nt, Human herpesvirus 8 [Kaposi`s sarcoma-associated h
caguauuaugccaggga

SEQ ID NO: 2151194 - RNA, 15 nt, Human herpesvirus 8 [Kaposi`s sarcoma-associated h
caaauaaaccagaca

SEQ ID NO: 2151195 - RNA, 22 nt, Human herpesvirus 8 [Kaposi`s sarcoma-associated h
aguugaucgauuucuguauaca

SEQ ID NO: 2151196 - RNA, 12 nt, Human herpesvirus 8 [Kaposi`s sarcoma-associated h
gaugagccagaa

SEQ ID NO: 2151197 - RNA, 23 nt, Human herpesvirus 8 [Kaposi`s sarcoma-associated h
ugacaaucuggauguguaucuua

SEQ ID NO: 2151198 - RNA, 21 nt, Human herpesvirus 8 [Kaposi`s sarcoma-associated h
gacagggcuaugauugcuucu

SEQ ID NO: 2151199 - RNA, 18 nt, Human herpesvirus 8 [Kaposi`s sarcoma-associated h
cuucuugaccaaaaguug

SEQ ID NO: 2151200 - RNA, 14 nt, Human herpesvirus 8 [Kaposi`s sarcoma-associated h
aggguaacucugaa

SEQ ID NO: 2151201 - RNA, 16 nt, Human herpesvirus 8 [Kaposi`s sarcoma-associated h
aauaacccgcuccgcc

SEQ ID NO: 2151202 - RNA, 12 nt, Human herpesvirus 8 [Kaposi`s sarcoma-associated h
cugcaauguacu

SEQ ID NO: 2151203 - RNA, 14 nt, Human herpesvirus 8 [Kaposi`s sarcoma-associated h
ccuagaugcgcugg

SEQ ID NO: 2151204 - RNA, 18 nt, Human herpesvirus 8 [Kaposi`s sarcoma-associated h
gggcuuguacaugugucu

SEQ ID NO: 2151205 - RNA, 13 nt, Human herpesvirus 8 [Kaposi`s sarcoma-associated h
ucaggucugucac

SEQ ID NO: 2151206 - RNA, 18 nt, Human herpesvirus 8 [Kaposi`s sarcoma-associated h
caacccacacuggcccaa

SEQ ID NO: 2151207 - RNA, 13 nt, Human herpesvirus 8 [Kaposi`s sarcoma-associated h
cuacccugccacu

SEQ ID NO: 2151208 - RNA, 13 nt, Human herpesvirus 8 [Kaposi`s sarcoma-associated h
ggccgcauuuggc

SEQ ID NO: 2151209 - RNA, 21 nt, Human herpesvirus 8 [Kaposi`s sarcoma-associated h
cagagcacccugaaacuccag

SEQ ID NO: 2151210 - RNA, 13 nt, Human herpesvirus 8 [Kaposi`s sarcoma-associated h
agacaaacacugu

SEQ ID NO: 2151211 - RNA, 15 nt, Human herpesvirus 8 [Kaposi`s sarcoma-associated h
gacccuagucacucc

SEQ ID NO: 2151212 - RNA, 12 nt, Human herpesvirus 8 [Kaposi`s sarcoma-associated h
cgagcucgggac

SEQ ID NO: 2151213 - RNA, 23 nt, Human herpesvirus 8 [Kaposi`s sarcoma-associated h
acgcucaccauccccugguggcu

SEQ ID NO: 2151214 - RNA, 14 nt, Human herpesvirus 8 [Kaposi`s sarcoma-associated h
gcuuauaccggccu

SEQ ID NO: 2151215 - RNA, 15 nt, Human herpesvirus 8 [Kaposi`s sarcoma-associated h
ucucgguacugcgca

SEQ ID NO: 2151216 - RNA, 15 nt, Human herpesvirus 8 [Kaposi`s sarcoma-associated h
ugaacguccccgcgu

SEQ ID NO: 2151217 - RNA, 17 nt, Human herpesvirus 8 [Kaposi`s sarcoma-associated h
gcccgggggccaggacu

SEQ ID NO: 2151218 - RNA, 12 nt, Human herpesvirus 8 [Kaposi`s sarcoma-associated h
agauagccacau

SEQ ID NO: 2151219 - RNA, 21 nt, Human herpesvirus 8 [Kaposi`s sarcoma-associated h
uggcgcaggagucagagcagu

SEQ ID NO: 2151220 - RNA, 21 nt, Human herpesvirus 8 [Kaposi`s sarcoma-associated h
gaaacugcucucgcugcucag

SEQ ID NO: 2151221 - RNA, 23 nt, Human herpesvirus 8 [Kaposi`s sarcoma-associated h
cagagccuucacggcacacuacu

SEQ ID NO: 2151222 - RNA, 19 nt, Human herpesvirus 8 [Kaposi`s sarcoma-associated h
ucaucguggugcccugccc

SEQ ID NO: 2151223 - RNA, 12 nt, Human herpesvirus 8 [Kaposi`s sarcoma-associated h
cuaccugcaaac

SEQ ID NO: 2151224 - RNA, 18 nt, Human herpesvirus 8 [Kaposi`s sarcoma-associated h
gccauucgcaccaggacg

SEQ ID NO: 2151225 - RNA, 17 nt, Human herpesvirus 8 [Kaposi`s sarcoma-associated h
gccguguugcgcgcugg

SEQ ID NO: 2151226 - RNA, 14 nt, Human herpesvirus 8 [Kaposi`s sarcoma-associated h
gauccggagggaag

SEQ ID NO: 2151227 - RNA, 16 nt, Human herpesvirus 8 [Kaposi`s sarcoma-associated h
acuuauuaaaagcauu

SEQ ID NO: 2151228 - RNA, 23 nt, Human herpesvirus 8 [Kaposi`s sarcoma-associated h
gcuuuccugugauuucucugugc

SEQ ID NO: 2151229 - RNA, 19 nt, Human herpesvirus 8 [Kaposi`s sarcoma-associated h
cugggcgaagaagcgcacc

SEQ ID NO: 2151230 - RNA, 16 nt, Human herpesvirus 8 [Kaposi`s sarcoma-associated h
agggcuaugauugcuu

SEQ ID NO: 2151231 - RNA, 15 nt, Human herpesvirus 8 [Kaposi`s sarcoma-associated h
agccaugugcugguu

SEQ ID NO: 2151232 - RNA, 12 nt, Human herpesvirus 8 [Kaposi`s sarcoma-associated h
gcugcagccagg

SEQ ID NO: 2151233 - RNA, 15 nt, Human herpesvirus 8 [Kaposi`s sarcoma-associated h
agcagacgugcccag

SEQ ID NO: 2151234 - RNA, 20 nt, Human herpesvirus 8 [Kaposi`s sarcoma-associated h
cgucugugaagucucccugc

SEQ ID NO: 2151235 - RNA, 16 nt, Human herpesvirus 8 [Kaposi`s sarcoma-associated h
ccagcaauaaacccac

SEQ ID NO: 2151236 - RNA, 15 nt, Human herpesvirus 8 [Kaposi`s sarcoma-associated h
agauuucgcaccagc

SEQ ID NO: 2151237 - RNA, 15 nt, Human herpesvirus 8 [Kaposi`s sarcoma-associated h
acugggccaccaaga

SEQ ID NO: 2151238 - RNA, 15 nt, Human herpesvirus 8 [Kaposi`s sarcoma-associated h
ccugcugcagcugga

SEQ ID NO: 2151239 - RNA, 20 nt, Human herpesvirus 8 [Kaposi`s sarcoma-associated h
cgagaaagucgcccacggaa

SEQ ID NO: 2151240 - RNA, 21 nt, Human herpesvirus 8 [Kaposi`s sarcoma-associated h
gacgcccuggguguuaugcac

SEQ ID NO: 2151241 - RNA, 14 nt, Human herpesvirus 8 [Kaposi`s sarcoma-associated h
cggugaaacagaua

SEQ ID NO: 2151242 - RNA, 13 nt, Human herpesvirus 8 [Kaposi`s sarcoma-associated h
agcaugcugauga

SEQ ID NO: 2151243 - RNA, 22 nt, Human herpesvirus 8 [Kaposi`s sarcoma-associated h
cgcagaacaguacccacgaaau

SEQ ID NO: 2151244 - RNA, 21 nt, Human herpesvirus 8 [Kaposi`s sarcoma-associated h
caauuuauuaagcaaacagua

SEQ ID NO: 2151245 - RNA, 22 nt, Human herpesvirus 8 [Kaposi`s sarcoma-associated h
ggacgcggccuucgucaugcac

SEQ ID NO: 2151246 - RNA, 20 nt, Human herpesvirus 8 [Kaposi`s sarcoma-associated h
agggcucguucaaugcaugu

SEQ ID NO: 2151247 - RNA, 22 nt, Human herpesvirus 8 [Kaposi`s sarcoma-associated h
ccaugguuauuggccaggacaa

SEQ ID NO: 2151248 - RNA, 15 nt, Human herpesvirus 8 [Kaposi`s sarcoma-associated h
gguuccagugcgcuc

SEQ ID NO: 2151249 - RNA, 23 nt, Human herpesvirus 8 [Kaposi`s sarcoma-associated h
acucuguguccuccucugaguuu

SEQ ID NO: 2151250 - RNA, 14 nt, Human herpesvirus 8 [Kaposi`s sarcoma-associated h
ucccacccacacau

SEQ ID NO: 2151251 - RNA, 18 nt, Human herpesvirus 8 [Kaposi`s sarcoma-associated h
gcccucgggacuucugga

SEQ ID NO: 2151252 - RNA, 18 nt, Human herpesvirus 8 [Kaposi`s sarcoma-associated h
cggcaggcgugagaggca

SEQ ID NO: 2151253 - RNA, 13 nt, Human herpesvirus 8 [Kaposi`s sarcoma-associated h
gacaugugcuuuu

SEQ ID NO: 2151254 - RNA, 13 nt, Human herpesvirus 8 [Kaposi`s sarcoma-associated h
gagauagccacau

SEQ ID NO: 2151255 - RNA, 12 nt, Human herpesvirus 8 [Kaposi`s sarcoma-associated h
ccugggccaggc

SEQ ID NO: 2151256 - RNA, 18 nt, Human herpesvirus 8 [Kaposi`s sarcoma-associated h
ccacuuugcccuaaaugu

SEQ ID NO: 2151257 - RNA, 16 nt, Human herpesvirus 8 [Kaposi`s sarcoma-associated h
cgugcuacuuacagca

SEQ ID NO: 2151258 - RNA, 11 nt, Human herpesvirus 8 [Kaposi`s sarcoma-associated h
caucagagaug

SEQ ID NO: 2151259 - RNA, 14 nt, Human herpesvirus 8 [Kaposi`s sarcoma-associated h
caugccgucagggc

SEQ ID NO: 2151260 - RNA, 22 nt, Human herpesvirus 8 [Kaposi`s sarcoma-associated h
aaguggugaucuuaggccagga

SEQ ID NO: 2151261 - RNA, 13 nt, Human herpesvirus 8 [Kaposi`s sarcoma-associated h
gaagaugaagaug

SEQ ID NO: 2151262 - RNA, 17 nt, Human herpesvirus 8 [Kaposi`s sarcoma-associated h
caaaguauauuaguguu

SEQ ID NO: 2151263 - RNA, 14 nt, Human herpesvirus 8 [Kaposi`s sarcoma-associated h
cguacaaggccaug

SEQ ID NO: 2151264 - RNA, 22 nt, Human herpesvirus 8 [Kaposi`s sarcoma-associated h
gguugacuuuuuaaaggggacg

SEQ ID NO: 2151265 - RNA, 23 nt, Human herpesvirus 8 [Kaposi`s sarcoma-associated h
cugggcguccacauggcagcuga

SEQ ID NO: 2151266 - RNA, 17 nt, Human herpesvirus 8 [Kaposi`s sarcoma-associated h
uauaauggauggcuaug

SEQ ID NO: 2151267 - RNA, 13 nt, Human herpesvirus 8 [Kaposi`s sarcoma-associated h
cauuccucuccgc

SEQ ID NO: 2151268 - RNA, 22 nt, Human herpesvirus 8 [Kaposi`s sarcoma-associated h
aaucuguuuauuguuuuugaac

SEQ ID NO: 2151269 - RNA, 13 nt, Human herpesvirus 8 [Kaposi`s sarcoma-associated h
ggcaccauggcca

SEQ ID NO: 2151270 - RNA, 22 nt, Human herpesvirus 8 [Kaposi`s sarcoma-associated h
acccacgucacaucaccggacc

SEQ ID NO: 2151271 - RNA, 18 nt, Human herpesvirus 8 [Kaposi`s sarcoma-associated h
agcaugacuuccccgucu

SEQ ID NO: 2151272 - RNA, 14 nt, Human herpesvirus 8 [Kaposi`s sarcoma-associated h
ucuacccugccacu

SEQ ID NO: 2151273 - RNA, 14 nt, Human herpesvirus 8 [Kaposi`s sarcoma-associated h
cauuaaaaggacau

SEQ ID NO: 2151274 - RNA, 20 nt, Human herpesvirus 8 [Kaposi`s sarcoma-associated h
uacccuuccuacccuacucc

SEQ ID NO: 2151275 - RNA, 17 nt, Human herpesvirus 8 [Kaposi`s sarcoma-associated h
gcccggagacuaucagg

SEQ ID NO: 2151276 - RNA, 21 nt, Human herpesvirus 8 [Kaposi`s sarcoma-associated h
aaaacugucuccagaagagca

SEQ ID NO: 2151277 - RNA, 17 nt, Human herpesvirus 8 [Kaposi`s sarcoma-associated h
gcguaugggaacacaau

SEQ ID NO: 2151278 - RNA, 13 nt, Human herpesvirus 8 [Kaposi`s sarcoma-associated h
cuguaaaacacug

SEQ ID NO: 2151279 - RNA, 13 nt, Human herpesvirus 8 [Kaposi`s sarcoma-associated h
cucggagacaaga

SEQ ID NO: 2151280 - RNA, 18 nt, Human herpesvirus 8 [Kaposi`s sarcoma-associated h
ccauuugauauauggaaa

SEQ ID NO: 2151281 - RNA, 14 nt, Human herpesvirus 8 [Kaposi`s sarcoma-associated h
cagggccuggccuc

SEQ ID NO: 2151282 - RNA, 16 nt, Human herpesvirus 8 [Kaposi`s sarcoma-associated h
caccgaaccaggcaac

SEQ ID NO: 2151283 - RNA, 13 nt, Human herpesvirus 8 [Kaposi`s sarcoma-associated h
cgcuccgccacgc

SEQ ID NO: 2151284 - RNA, 20 nt, Human herpesvirus 8 [Kaposi`s sarcoma-associated h
ccauggcagcccagccucug

SEQ ID NO: 2151285 - RNA, 17 nt, Human herpesvirus 8 [Kaposi`s sarcoma-associated h
uccgcaaugucagguuc

SEQ ID NO: 2151286 - RNA, 18 nt, Human herpesvirus 8 [Kaposi`s sarcoma-associated h
agcacuccuguuagcaca

SEQ ID NO: 2151287 - RNA, 16 nt, Human herpesvirus 8 [Kaposi`s sarcoma-associated h
uucguaagaggaccca

SEQ ID NO: 2151288 - RNA, 14 nt, Human herpesvirus 8 [Kaposi`s sarcoma-associated h
cacaaaacugccaa

SEQ ID NO: 2151289 - RNA, 22 nt, Human herpesvirus 8 [Kaposi`s sarcoma-associated h
auacauugugagggaguguuuu

SEQ ID NO: 2151290 - RNA, 16 nt, Human herpesvirus 8 [Kaposi`s sarcoma-associated h
ccacggugcacugaag

SEQ ID NO: 2151291 - RNA, 13 nt, Human herpesvirus 8 [Kaposi`s sarcoma-associated h
cgcaagcacuuuu

SEQ ID NO: 2151292 - RNA, 21 nt, Human herpesvirus 8 [Kaposi`s sarcoma-associated h
accacucuuuaucaugugaac

SEQ ID NO: 2151293 - RNA, 13 nt, Human herpesvirus 8 [Kaposi`s sarcoma-associated h
guuccacggcgug

SEQ ID NO: 2151294 - RNA, 12 nt, Human herpesvirus 8 [Kaposi`s sarcoma-associated h
gaacggacaauu

SEQ ID NO: 2151295 - RNA, 15 nt, Human herpesvirus 8 [Kaposi`s sarcoma-associated h
ggucgguucacugcu

SEQ ID NO: 2151296 - RNA, 16 nt, Human herpesvirus 8 [Kaposi`s sarcoma-associated h
ccgcaggccagccacc

SEQ ID NO: 2151297 - RNA, 23 nt, Human herpesvirus 8 [Kaposi`s sarcoma-associated h
aauggccuccacccaccaagcua

SEQ ID NO: 2151298 - RNA, 15 nt, Human herpesvirus 8 [Kaposi`s sarcoma-associated h
guccgacaugugcuu

SEQ ID NO: 2151299 - RNA, 17 nt, Human herpesvirus 8 [Kaposi`s sarcoma-associated h
ggcgcggaaacugggca

SEQ ID NO: 2151300 - RNA, 18 nt, Human herpesvirus 8 [Kaposi`s sarcoma-associated h
aaacguguccugccaggg

SEQ ID NO: 2151301 - RNA, 18 nt, Human herpesvirus 8 [Kaposi`s sarcoma-associated h
gcagcaguagacgcaggc

SEQ ID NO: 2151302 - RNA, 17 nt, Human herpesvirus 8 [Kaposi`s sarcoma-associated h
uaacuuuauuacaggua

SEQ ID NO: 2151303 - RNA, 17 nt, Human herpesvirus 8 [Kaposi`s sarcoma-associated h
gcgugucucagggagca

SEQ ID NO: 2151304 - RNA, 15 nt, Human herpesvirus 8 [Kaposi`s sarcoma-associated h
acucgcuguccugga

SEQ ID NO: 2151305 - RNA, 15 nt, Human herpesvirus 8 [Kaposi`s sarcoma-associated h
uaagcuuugcagcca

SEQ ID NO: 2151306 - RNA, 12 nt, Human herpesvirus 8 [Kaposi`s sarcoma-associated h
uuuaauaaacac

SEQ ID NO: 2151307 - RNA, 10 nt, Human herpesvirus 8 [Kaposi`s sarcoma-associated h
caaggcccug

SEQ ID NO: 2151308 - RNA, 13 nt, Human herpesvirus 8 [Kaposi`s sarcoma-associated h
uacgcguguggga

SEQ ID NO: 2151309 - RNA, 16 nt, Human herpesvirus 8 [Kaposi`s sarcoma-associated h
ucggcagccucuaccc

SEQ ID NO: 2151310 - RNA, 20 nt, Human herpesvirus 8 [Kaposi`s sarcoma-associated h
uggcccaaacuagcagagac

SEQ ID NO: 2151311 - RNA, 23 nt, Human herpesvirus 8 [Kaposi`s sarcoma-associated h
ccggacucgucuacccugccacu

SEQ ID NO: 2151312 - RNA, 21 nt, Human herpesvirus 8 [Kaposi`s sarcoma-associated h
uagcagcugucccggauccag

SEQ ID NO: 2151313 - RNA, 17 nt, Human herpesvirus 8 [Kaposi`s sarcoma-associated h
aaguccgucaaccagau

SEQ ID NO: 2151314 - RNA, 18 nt, Human herpesvirus 8 [Kaposi`s sarcoma-associated h
caaucucuuacuucgcau

SEQ ID NO: 2151315 - RNA, 17 nt, Human herpesvirus 8 [Kaposi`s sarcoma-associated h
auacccuggaucaggga

SEQ ID NO: 2151316 - RNA, 11 nt, Human herpesvirus 8 [Kaposi`s sarcoma-associated h
ccugccagggg

SEQ ID NO: 2151317 - RNA, 16 nt, Human herpesvirus 8 [Kaposi`s sarcoma-associated h
gacucuguauuuggga

SEQ ID NO: 2151318 - RNA, 23 nt, Human herpesvirus 8 [Kaposi`s sarcoma-associated h
ugcccacuguuguggaaagcucc

SEQ ID NO: 2151319 - RNA, 20 nt, Human herpesvirus 8 [Kaposi`s sarcoma-associated h
aacauauguuaaacacgucg

SEQ ID NO: 2151320 - RNA, 21 nt, Human herpesvirus 8 [Kaposi`s sarcoma-associated h
guggcccgucuguauacguga

SEQ ID NO: 2151321 - RNA, 12 nt, Human herpesvirus 8 [Kaposi`s sarcoma-associated h
aauuggagcacu

SEQ ID NO: 2151322 - RNA, 21 nt, Human herpesvirus 8 [Kaposi`s sarcoma-associated h
cuuggcgcuuagccugccucu

SEQ ID NO: 2151323 - RNA, 14 nt, Human herpesvirus 8 [Kaposi`s sarcoma-associated h
uggcgcgccacagu

SEQ ID NO: 2151324 - RNA, 17 nt, Human herpesvirus 8 [Kaposi`s sarcoma-associated h
cucuacagguaggccac

SEQ ID NO: 2151325 - RNA, 12 nt, Human herpesvirus 8 [Kaposi`s sarcoma-associated h
cuucuguuugaa

SEQ ID NO: 2151326 - RNA, 22 nt, Human herpesvirus 8 [Kaposi`s sarcoma-associated h
ggcaucguggaacgcacaggua

SEQ ID NO: 2151327 - RNA, 16 nt, Human herpesvirus 8 [Kaposi`s sarcoma-associated h
gcucugcgugcuggag

SEQ ID NO: 2151328 - RNA, 16 nt, Human herpesvirus 8 [Kaposi`s sarcoma-associated h
gauuuuccagggacau

SEQ ID NO: 2151329 - RNA, 21 nt, Human herpesvirus 8 [Kaposi`s sarcoma-associated h
cagccgcgcgaccucccacgg

SEQ ID NO: 2151330 - RNA, 20 nt, Human herpesvirus 8 [Kaposi`s sarcoma-associated h
ccugucgaggaagaaauggg

SEQ ID NO: 2151331 - RNA, 12 nt, Human herpesvirus 8 [Kaposi`s sarcoma-associated h
cuggcuggcgcu

SEQ ID NO: 2151332 - RNA, 20 nt, Human herpesvirus 8 [Kaposi`s sarcoma-associated h
ccuacgcguuaagaagccac

SEQ ID NO: 2151333 - RNA, 16 nt, Human herpesvirus 8 [Kaposi`s sarcoma-associated h
uaagccucaacgggca

SEQ ID NO: 2151334 - RNA, 23 nt, Human herpesvirus 8 [Kaposi`s sarcoma-associated h
uggcacacgguuacuagcaccac

SEQ ID NO: 2151335 - RNA, 20 nt, Human herpesvirus 8 [Kaposi`s sarcoma-associated h
guacugcgcauuuccugccc

SEQ ID NO: 2151336 - RNA, 14 nt, Human herpesvirus 8 [Kaposi`s sarcoma-associated h
cuaugaucagggca

SEQ ID NO: 2151337 - RNA, 17 nt, Human herpesvirus 8 [Kaposi`s sarcoma-associated h
cucuuggcuguuacaau

SEQ ID NO: 2151338 - RNA, 14 nt, Human herpesvirus 8 [Kaposi`s sarcoma-associated h
cuacccugccacuc

SEQ ID NO: 2151339 - RNA, 16 nt, Human herpesvirus 8 [Kaposi`s sarcoma-associated h
ggaguccauggcagug

SEQ ID NO: 2151340 - RNA, 20 nt, Human herpesvirus 8 [Kaposi`s sarcoma-associated h
gcggagaggggguggugcga

SEQ ID NO: 2151341 - RNA, 15 nt, Human herpesvirus 8 [Kaposi`s sarcoma-associated h
aauguuuuggucucu

SEQ ID NO: 2151342 - RNA, 18 nt, Human herpesvirus 8 [Kaposi`s sarcoma-associated h
gccucugaagcaccacau

SEQ ID NO: 2151343 - RNA, 15 nt, Human herpesvirus 8 [Kaposi`s sarcoma-associated h
cuaaucuggcaugua

SEQ ID NO: 2151344 - RNA, 19 nt, Human herpesvirus 8 [Kaposi`s sarcoma-associated h
agcagggcggccacucuug

SEQ ID NO: 2151345 - RNA, 22 nt, Human herpesvirus 8 [Kaposi`s sarcoma-associated h
agauaaucuaaauauucucuau

SEQ ID NO: 2151346 - RNA, 14 nt, Human herpesvirus 8 [Kaposi`s sarcoma-associated h
auugacuguggaga
